United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 76

SEQ ID NO: 3465221 - RNA, 21 nt, Human
aauagugccgcaauaaacaua

SEQ ID NO: 3465222 - RNA, 22 nt, Human
aauagugcucgcuuucuaugua

SEQ ID NO: 3465223 - RNA, 21 nt, Human
aauagugguucuuggaaaaau

SEQ ID NO: 3465224 - RNA, 14 nt, Human
aauaguguccuaug

SEQ ID NO: 3465225 - RNA, 15 nt, Human
aauagugugaaauau

SEQ ID NO: 3465226 - RNA, 17 nt, Human
aauagugugaaauauau

SEQ ID NO: 3465227 - RNA, 13 nt, Human
aauaguguguucu

SEQ ID NO: 3465228 - RNA, 14 nt, Human
aauauuguuuuucu

SEQ ID NO: 3465229 - RNA, 14 nt, Human
aauauuuaaaaaug

SEQ ID NO: 3465230 - RNA, 15 nt, Human
aauauuuaaaaaugu

SEQ ID NO: 3465231 - RNA, 17 nt, Human
aauauuuaaaaaugucu

SEQ ID NO: 3465232 - RNA, 15 nt, Human
aauauuuaaacaugg

SEQ ID NO: 3465233 - RNA, 12 nt, Human
aauauuuaagac

SEQ ID NO: 3465234 - RNA, 22 nt, Human
aauauuuaaggagauguaagag

SEQ ID NO: 3465235 - RNA, 13 nt, Human
aauauuuaaucuu

SEQ ID NO: 3465236 - RNA, 17 nt, Human
aauauuuacaauguauu

SEQ ID NO: 3465237 - RNA, 19 nt, Human
aauauuuacaauguauuaa

SEQ ID NO: 3465238 - RNA, 14 nt, Human
aauauuuagcaaau

SEQ ID NO: 3465239 - RNA, 20 nt, Human
aauauuuagcaaauaauuuc

SEQ ID NO: 3465240 - RNA, 12 nt, Human
aauauuuagugu

SEQ ID NO: 3465241 - RNA, 13 nt, Human
aauauuuauaaaa

SEQ ID NO: 3465242 - RNA, 19 nt, Human
aauauuuauaaaacuucuc

SEQ ID NO: 3465243 - RNA, 22 nt, Human
aauauuuauaaagaauguuucu

SEQ ID NO: 3465244 - RNA, 12 nt, Human
aauauuuauaac

SEQ ID NO: 3465245 - RNA, 15 nt, Human
aauauuuauagguca

SEQ ID NO: 3465246 - RNA, 18 nt, Human
aauauuuauauuucacua

SEQ ID NO: 3465247 - RNA, 12 nt, Human
aauauuuaugga

SEQ ID NO: 3465248 - RNA, 11 nt, Human
aauauuuauua

SEQ ID NO: 3465249 - RNA, 12 nt, Human
aauauuuauuaa

SEQ ID NO: 3465250 - RNA, 12 nt, Human
aauauuuauuac

SEQ ID NO: 3465251 - RNA, 14 nt, Human
aauauuuauuaccu

SEQ ID NO: 3465252 - RNA, 17 nt, Human
aauauuuauuaccucug

SEQ ID NO: 3465253 - RNA, 18 nt, Human
aauauuuauuaccucuga

SEQ ID NO: 3465254 - RNA, 19 nt, Human
aauauuuauuauuuucacc

SEQ ID NO: 3465255 - RNA, 20 nt, Human
aauauuuauucauuauuugu

SEQ ID NO: 3465256 - RNA, 22 nt, Human
aauauuuauucauuauuuguca

SEQ ID NO: 3465257 - RNA, 13 nt, Human
aauauuuauugcu

SEQ ID NO: 3465258 - RNA, 16 nt, Human
aauauuuauugcuuua

SEQ ID NO: 3465259 - RNA, 14 nt, Human
aauauuuauuguau

SEQ ID NO: 3465260 - RNA, 19 nt, Human
aauauuuauuuuaauaaug

SEQ ID NO: 3465261 - RNA, 13 nt, Human
aauauuuccauau

SEQ ID NO: 3465262 - RNA, 21 nt, Human
aauauuuccuuaaacugugug

SEQ ID NO: 3465263 - RNA, 14 nt, Human
aauauuucuauuga

SEQ ID NO: 3465264 - RNA, 14 nt, Human
aauauuugaaucuu

SEQ ID NO: 3465265 - RNA, 16 nt, Human
aauauuugaaucuugu

SEQ ID NO: 3465266 - RNA, 14 nt, Human
aauauuugaaugua

SEQ ID NO: 3465267 - RNA, 23 nt, Human
aauauuugaauguaugcuucaua

SEQ ID NO: 3465268 - RNA, 16 nt, Human
aauauuugacuugcau

SEQ ID NO: 3465269 - RNA, 22 nt, Human
aauauuugacuugcaugaagag

SEQ ID NO: 3465270 - RNA, 12 nt, Human
aauauuugcuga

SEQ ID NO: 3465271 - RNA, 12 nt, Human
aauauuuggaau

SEQ ID NO: 3465272 - RNA, 12 nt, Human
aauauuuguaca

SEQ ID NO: 3465273 - RNA, 19 nt, Human
aauauuugucgauauuucc

SEQ ID NO: 3465274 - RNA, 20 nt, Human
aauauuugucgauauuucca

SEQ ID NO: 3465275 - RNA, 16 nt, Human
aauauuuuaaaaucag

SEQ ID NO: 3465276 - RNA, 13 nt, Human
aauauuuuaagua

SEQ ID NO: 3465277 - RNA, 17 nt, Human
aauauuuuaucuuuccu

SEQ ID NO: 3465278 - RNA, 20 nt, Human
aauauuuuauucaagguaaa

SEQ ID NO: 3465279 - RNA, 12 nt, Human
aauauuuucaac

SEQ ID NO: 3465280 - RNA, 14 nt, Human
aauauuuucaguaa

SEQ ID NO: 3465281 - RNA, 19 nt, Human
aauauuuucucuguacuuu

SEQ ID NO: 3465282 - RNA, 14 nt, Human
aauauuuucugugu

SEQ ID NO: 3465283 - RNA, 20 nt, Human
aauauuuucuguguguuccu

SEQ ID NO: 3465284 - RNA, 21 nt, Human
aauauuuucuuuaaugcuuuu

SEQ ID NO: 3465285 - RNA, 15 nt, Human
aauauuuugaaucaa

SEQ ID NO: 3465286 - RNA, 15 nt, Human
aauauuuugauaaua

SEQ ID NO: 3465287 - RNA, 20 nt, Human
aauauuuugauaauaaauug

SEQ ID NO: 3465288 - RNA, 18 nt, Human
aauauuuugauaauaaua

SEQ ID NO: 3465289 - RNA, 20 nt, Human
aauauuuugaucuucaacaa

SEQ ID NO: 3465290 - RNA, 12 nt, Human
aauauuuuguau

SEQ ID NO: 3465291 - RNA, 19 nt, Human
aauauuuuguauuauugcu

SEQ ID NO: 3465292 - RNA, 15 nt, Human
aauauuuuuaaaaga

SEQ ID NO: 3465293 - RNA, 14 nt, Human
aauauuuuuagaua

SEQ ID NO: 3465294 - RNA, 22 nt, Human
aauauuuuuauagauuugaccu

SEQ ID NO: 3465295 - RNA, 20 nt, Human
aauauuuuuauauuuccuuu

SEQ ID NO: 3465296 - RNA, 22 nt, Human
aauauuuuuauauuuccuuuau

SEQ ID NO: 3465297 - RNA, 13 nt, Human
aauauuuuucuua

SEQ ID NO: 3465298 - RNA, 17 nt, Human
aauauuuuuuauauaua

SEQ ID NO: 3465299 - RNA, 17 nt, Human
aaucaaaaauugaagag

SEQ ID NO: 3465300 - RNA, 14 nt, Human
aaucaaaacaagug

SEQ ID NO: 3465301 - RNA, 19 nt, Human
aaucaaaagggccaaagaa

SEQ ID NO: 3465302 - RNA, 20 nt, Human
aaucaaaagggccaaagaac

SEQ ID NO: 3465303 - RNA, 23 nt, Human
aaucaaaagggccaaagaaccaa

SEQ ID NO: 3465304 - RNA, 13 nt, Human
aaucaaaauaugu

SEQ ID NO: 3465305 - RNA, 12 nt, Human
aaucaaaaucuc

SEQ ID NO: 3465306 - RNA, 16 nt, Human
aaucaaagacauggaa

SEQ ID NO: 3465307 - RNA, 13 nt, Human
aaucaaauaauac

SEQ ID NO: 3465308 - RNA, 13 nt, Human
aaucaaauguaaa

SEQ ID NO: 3465309 - RNA, 12 nt, Human
aaucaacagaag

SEQ ID NO: 3465310 - RNA, 14 nt, Human
aaucaacagaagca

SEQ ID NO: 3465311 - RNA, 15 nt, Human
aaucaacagaagcau

SEQ ID NO: 3465312 - RNA, 16 nt, Human
aaucaacagaagcauu

SEQ ID NO: 3465313 - RNA, 21 nt, Human
aaucaacauggcuacuugcuu

SEQ ID NO: 3465314 - RNA, 16 nt, Human
aaucaacuaguauuug

SEQ ID NO: 3465315 - RNA, 14 nt, Human
aaucaacugaaagu

SEQ ID NO: 3465316 - RNA, 17 nt, Human
aaucaacuugcuuauca

SEQ ID NO: 3465317 - RNA, 18 nt, Human
aaucaacuugcuuaucaa

SEQ ID NO: 3465318 - RNA, 21 nt, Human
aaucaacuugcuuaucaacuu

SEQ ID NO: 3465319 - RNA, 17 nt, Human
aaucaagagcugcccuc

SEQ ID NO: 3465320 - RNA, 17 nt, Human
aaucaagauaaaggaca

SEQ ID NO: 3465321 - RNA, 18 nt, Human
aaucaagguuauaauuuu

SEQ ID NO: 3465322 - RNA, 21 nt, Human
aaucaagucuguuuacugcaa

SEQ ID NO: 3465323 - RNA, 23 nt, Human
aaucaaguuggcuucuaaucaaa

SEQ ID NO: 3465324 - RNA, 15 nt, Human
aaucaaguuguaacu

SEQ ID NO: 3465325 - RNA, 23 nt, Human
aaucaaguuuuaagugaaaguga

SEQ ID NO: 3465326 - RNA, 12 nt, Human
aaucaauaauau

SEQ ID NO: 3465327 - RNA, 22 nt, Human
aaucaauccagcgguucucaaa

SEQ ID NO: 3465328 - RNA, 20 nt, Human
aaucaaucuugcauguaacg

SEQ ID NO: 3465329 - RNA, 16 nt, Human
aaucaaugaauauuga

SEQ ID NO: 3465330 - RNA, 19 nt, Human
aaucaaugaauauugaagu

SEQ ID NO: 3465331 - RNA, 22 nt, Human
aaucaaugaauauugaaguuuc

SEQ ID NO: 3465332 - RNA, 22 nt, Human
aaucaaugcuauaacuauguug

SEQ ID NO: 3465333 - RNA, 17 nt, Human
aaucaaugucacuuaaa

SEQ ID NO: 3465334 - RNA, 23 nt, Human
aaucaauguucacgcaacuugaa

SEQ ID NO: 3465335 - RNA, 22 nt, Human
aaucaauuuaaacccauuuuag

SEQ ID NO: 3465336 - RNA, 15 nt, Human
aaucacaauuuuuaa

SEQ ID NO: 3465337 - RNA, 19 nt, Human
aaucacacugucuucugau

SEQ ID NO: 3465338 - RNA, 13 nt, Human
aaucacagaauca

SEQ ID NO: 3465339 - RNA, 11 nt, Human
aaucacauccu

SEQ ID NO: 3465340 - RNA, 16 nt, Human
aaucacauccuggccu

SEQ ID NO: 3465341 - RNA, 19 nt, Human
aaucacauucgaguguuuc

SEQ ID NO: 3465342 - RNA, 14 nt, Human
aaucaccauguaag

SEQ ID NO: 3465343 - RNA, 17 nt, Human
aaucacgaggucaggag

SEQ ID NO: 3465344 - RNA, 16 nt, Human
aaucacgcuuuccuga

SEQ ID NO: 3465345 - RNA, 14 nt, Human
aaucacgcuuuuug

SEQ ID NO: 3465346 - RNA, 17 nt, Human
aaucacgcuuuuugaaa

SEQ ID NO: 3465347 - RNA, 21 nt, Human
aaucacguaaagcuagaaaug

SEQ ID NO: 3465348 - RNA, 17 nt, Human
aaucacuaaaaaugauc

SEQ ID NO: 3465349 - RNA, 16 nt, Human
aaucacucagagcagu

SEQ ID NO: 3465350 - RNA, 20 nt, Human
aaucacucuaauuaauugua

SEQ ID NO: 3465351 - RNA, 18 nt, Human
aaucacucuguccuugga

SEQ ID NO: 3465352 - RNA, 21 nt, Human
aaucacuguguauauuugauu

SEQ ID NO: 3465353 - RNA, 16 nt, Human
aaucacuguuuuuaga

SEQ ID NO: 3465354 - RNA, 18 nt, Human
aaucacuuaacauuccua

SEQ ID NO: 3465355 - RNA, 14 nt, Human
aaucacuugaaccc

SEQ ID NO: 3465356 - RNA, 11 nt, Human
aaucagaacuc

SEQ ID NO: 3465357 - RNA, 23 nt, Human
aaucagaacucaaauggggccag

SEQ ID NO: 3465358 - RNA, 20 nt, Human
aaucagagaccuuccagaaa

SEQ ID NO: 3465359 - RNA, 16 nt, Human
aaucagauagauauuc

SEQ ID NO: 3465360 - RNA, 14 nt, Human
aaucagaucauuuc

SEQ ID NO: 3465361 - RNA, 15 nt, Human
aaucagauuuuccug

SEQ ID NO: 3465362 - RNA, 18 nt, Human
aaucagauuuuccugugg

SEQ ID NO: 3465363 - RNA, 20 nt, Human
aaucagcacagauaaaaagu

SEQ ID NO: 3465364 - RNA, 15 nt, Human
aaucagcacugaaaa

SEQ ID NO: 3465365 - RNA, 17 nt, Human
aaucagcacugaaaaua

SEQ ID NO: 3465366 - RNA, 12 nt, Human
aaucagcauucu

SEQ ID NO: 3465367 - RNA, 19 nt, Human
aaucagcauucucacuccu

SEQ ID NO: 3465368 - RNA, 15 nt, Human
aaucagccaaguuuu

SEQ ID NO: 3465369 - RNA, 14 nt, Human
aaucagccaauuau

SEQ ID NO: 3465370 - RNA, 12 nt, Human
aaucagccucuu

SEQ ID NO: 3465371 - RNA, 13 nt, Human
aaucagccugcuc

SEQ ID NO: 3465372 - RNA, 18 nt, Human
aaucagccugcuccagcu

SEQ ID NO: 3465373 - RNA, 19 nt, Human
aaucagccugcuccagcug

SEQ ID NO: 3465374 - RNA, 15 nt, Human
aaucagcuauuuugu

SEQ ID NO: 3465375 - RNA, 11 nt, Human
aaucagcugcu

SEQ ID NO: 3465376 - RNA, 19 nt, Human
aaucagggaggucauuuug

SEQ ID NO: 3465377 - RNA, 18 nt, Human
aaucagguuuucuuuuaa

SEQ ID NO: 3465378 - RNA, 15 nt, Human
aaucaguauaaacaa

SEQ ID NO: 3465379 - RNA, 17 nt, Human
aaucaguauaaacaaag

SEQ ID NO: 3465380 - RNA, 13 nt, Human
aaucaguccccuc

SEQ ID NO: 3465381 - RNA, 19 nt, Human
aaucagugggcaggauaaa

SEQ ID NO: 3465382 - RNA, 21 nt, Human
aaucaguguagccccaagaag

SEQ ID NO: 3465383 - RNA, 18 nt, Human
aaucagugugucuaaauu

SEQ ID NO: 3465384 - RNA, 22 nt, Human
aaucagugugucuaaauuugaa

SEQ ID NO: 3465385 - RNA, 19 nt, Human
aaucaguguuugauugccc

SEQ ID NO: 3465386 - RNA, 19 nt, Human
aaucaguucauuagaaaua

SEQ ID NO: 3465387 - RNA, 14 nt, Human
aaucaguuuuccuc

SEQ ID NO: 3465388 - RNA, 17 nt, Human
aaucauaaacugugugc

SEQ ID NO: 3465389 - RNA, 20 nt, Human
aaucauaagauauuuuucau

SEQ ID NO: 3465390 - RNA, 12 nt, Human
aaucauaaguau

SEQ ID NO: 3465391 - RNA, 15 nt, Human
aaucauaaguauuug

SEQ ID NO: 3465392 - RNA, 20 nt, Human
aaucauacuccuaugcuuua

SEQ ID NO: 3465393 - RNA, 20 nt, Human
aaucauagcugguucacacu

SEQ ID NO: 3465394 - RNA, 19 nt, Human
aaucauaguacucuuugua

SEQ ID NO: 3465395 - RNA, 22 nt, Human
aaucauaguacucuuuguagca

SEQ ID NO: 3465396 - RNA, 12 nt, Human
aaucauauaaau

SEQ ID NO: 3465397 - RNA, 17 nt, Human
aaucauauaaauagaau

SEQ ID NO: 3465398 - RNA, 21 nt, Human
aaucauauaauaaauguacau

SEQ ID NO: 3465399 - RNA, 15 nt, Human
aaucauaugauucug

SEQ ID NO: 3465400 - RNA, 17 nt, Human
aaucauaugugaucugu

SEQ ID NO: 3465401 - RNA, 16 nt, Human
aaucauauugaugaaa

SEQ ID NO: 3465402 - RNA, 15 nt, Human
aaucaucaagagaau

SEQ ID NO: 3465403 - RNA, 23 nt, Human
aaucaucaagagaauuuggggcu

SEQ ID NO: 3465404 - RNA, 12 nt, Human
aaucaucaagua

SEQ ID NO: 3465405 - RNA, 15 nt, Human
aaucaucaagucuuu

SEQ ID NO: 3465406 - RNA, 17 nt, Human
aaucaucgaaaauucau

SEQ ID NO: 3465407 - RNA, 14 nt, Human
aaucaucuaaguca

SEQ ID NO: 3465408 - RNA, 20 nt, Human
aaucaucuauuuugaugcag

SEQ ID NO: 3465409 - RNA, 15 nt, Human
aaucaucugugugaa

SEQ ID NO: 3465410 - RNA, 15 nt, Human
aaucaucuuugugaa

SEQ ID NO: 3465411 - RNA, 16 nt, Human
aaucaugaaauuacuu

SEQ ID NO: 3465412 - RNA, 22 nt, Human
aaucaugaauguguaacacagu

SEQ ID NO: 3465413 - RNA, 12 nt, Human
aaucaugaauua

SEQ ID NO: 3465414 - RNA, 17 nt, Human
aaucaugaauuaguuuu

SEQ ID NO: 3465415 - RNA, 23 nt, Human
aaucaugaauuaguuuuauaugc

SEQ ID NO: 3465416 - RNA, 13 nt, Human
aaucaugagccug

SEQ ID NO: 3465417 - RNA, 17 nt, Human
aaucaugccaguauuuu

SEQ ID NO: 3465418 - RNA, 18 nt, Human
aaucauggaaugguuaua

SEQ ID NO: 3465419 - RNA, 16 nt, Human
aaucauguacauuucu

SEQ ID NO: 3465420 - RNA, 13 nt, Human
aaucauguaguau

SEQ ID NO: 3465421 - RNA, 18 nt, Human
aaucauguaguaucaaau

SEQ ID NO: 3465422 - RNA, 23 nt, Human
aaucauguaguaucaaauauuag

SEQ ID NO: 3465423 - RNA, 22 nt, Human
aaucaugucagucugcuuagaa

SEQ ID NO: 3465424 - RNA, 17 nt, Human
aaucauguccauacacu

SEQ ID NO: 3465425 - RNA, 13 nt, Human
accagggccuuuu

SEQ ID NO: 3465426 - RNA, 23 nt, Human
accagggcgaacgacaauagcuu

SEQ ID NO: 3465427 - RNA, 17 nt, Human
accagggguuucucgca

SEQ ID NO: 3465428 - RNA, 21 nt, Human
accaggguugaccccagagga

SEQ ID NO: 3465429 - RNA, 15 nt, Human
accaggguuuaucuu

SEQ ID NO: 3465430 - RNA, 17 nt, Human
accaguaaaguguaaca

SEQ ID NO: 3465431 - RNA, 15 nt, Human
accaguauuguacaa

SEQ ID NO: 3465432 - RNA, 22 nt, Human
accaguauuguacaaaguauua

SEQ ID NO: 3465433 - RNA, 17 nt, Human
accaguccccccacccu

SEQ ID NO: 3465434 - RNA, 12 nt, Human
accagucccugu

SEQ ID NO: 3465435 - RNA, 13 nt, Human
accagucccuguc

SEQ ID NO: 3465436 - RNA, 23 nt, Human
accagucugaaguuucauuuaug

SEQ ID NO: 3465437 - RNA, 19 nt, Human
acccucggggauguguccu

SEQ ID NO: 3465438 - RNA, 15 nt, Human
acccucguggacacc

SEQ ID NO: 3465439 - RNA, 18 nt, Human
acccucguggacaccugc

SEQ ID NO: 3465440 - RNA, 20 nt, Human
acccucguggccuuccccag

SEQ ID NO: 3465441 - RNA, 14 nt, Human
acccucucaaacua

SEQ ID NO: 3465442 - RNA, 16 nt, Human
acccucucagcuccag

SEQ ID NO: 3465443 - RNA, 16 nt, Human
acccucuccaccccau

SEQ ID NO: 3465444 - RNA, 15 nt, Human
acccucucccaggac

SEQ ID NO: 3465445 - RNA, 21 nt, Human
acccucugaaugguccagggu

SEQ ID NO: 3465446 - RNA, 15 nt, Human
acccucugacccuag

SEQ ID NO: 3465447 - RNA, 13 nt, Human
acccucugccacc

SEQ ID NO: 3465448 - RNA, 19 nt, Human
acccucugccaccagagac

SEQ ID NO: 3465449 - RNA, 16 nt, Human
acccucugcugaagac

SEQ ID NO: 3465450 - RNA, 12 nt, Human
acccucugggaa

SEQ ID NO: 3465451 - RNA, 13 nt, Human
acccucugggaac

SEQ ID NO: 3465452 - RNA, 14 nt, Human
acccucuguuccuu

SEQ ID NO: 3465453 - RNA, 15 nt, Human
acccucuuccuguga

SEQ ID NO: 3465454 - RNA, 17 nt, Human
acccucuuccugugauc

SEQ ID NO: 3465455 - RNA, 20 nt, Human
acccucuuccugugauccac

SEQ ID NO: 3465456 - RNA, 22 nt, Human
acccucuugcccauccugacug

SEQ ID NO: 3465457 - RNA, 20 nt, Human
acccucuuugcugcagagaa

SEQ ID NO: 3465458 - RNA, 18 nt, Human
acccugaaggggccauga

SEQ ID NO: 3465459 - RNA, 12 nt, Human
acccugagccgg

SEQ ID NO: 3465460 - RNA, 17 nt, Human
acccugagcugaggcag

SEQ ID NO: 3465461 - RNA, 22 nt, Human
acccugagcugaggcagcagug

SEQ ID NO: 3465462 - RNA, 23 nt, Human
acccugagcugaggcagcagugu

SEQ ID NO: 3465463 - RNA, 19 nt, Human
acccugaggagucugaggu

SEQ ID NO: 3465464 - RNA, 22 nt, Human
acccugaggagucugagguccu

SEQ ID NO: 3465465 - RNA, 23 nt, Human
acccugaggagucugagguccug

SEQ ID NO: 3465466 - RNA, 11 nt, Human
acccugaggcc

SEQ ID NO: 3465467 - RNA, 14 nt, Human
acccugaggcccag

SEQ ID NO: 3465468 - RNA, 16 nt, Human
acccugaggcccagag

SEQ ID NO: 3465469 - RNA, 19 nt, Human
acccugaggcccagagggc

SEQ ID NO: 3465470 - RNA, 18 nt, Human
acccugaggccucuggaa

SEQ ID NO: 3465471 - RNA, 14 nt, Human
acccugaggucagg

SEQ ID NO: 3465472 - RNA, 19 nt, Human
acccugaguugcuuuucag

SEQ ID NO: 3465473 - RNA, 20 nt, Human
aaucuagaagaaaugaaauu

SEQ ID NO: 3465474 - RNA, 13 nt, Human
aaucuagaagagu

SEQ ID NO: 3465475 - RNA, 14 nt, Human
aaucuagaggaaaa

SEQ ID NO: 3465476 - RNA, 22 nt, Human
aaucuagauaucgacuuguuuu

SEQ ID NO: 3465477 - RNA, 15 nt, Human
aaucuaggaaaauua

SEQ ID NO: 3465478 - RNA, 23 nt, Human
aaucuaggcaugaagagcaaaaa

SEQ ID NO: 3465479 - RNA, 18 nt, Human
aaucuaguuuacagaaaa

SEQ ID NO: 3465480 - RNA, 16 nt, Human
aaucuauagaaagugu

SEQ ID NO: 3465481 - RNA, 17 nt, Human
aaucuauagaaaguguu

SEQ ID NO: 3465482 - RNA, 23 nt, Human
aaucuauagaaaguguucuguua

SEQ ID NO: 3465483 - RNA, 17 nt, Human
aaucuaugaaguauaua

SEQ ID NO: 3465484 - RNA, 19 nt, Human
aaucuaugaaguauauaau

SEQ ID NO: 3465485 - RNA, 16 nt, Human
aaucuauuauacugua

SEQ ID NO: 3465486 - RNA, 19 nt, Human
aaucuauucagacaagcaa

SEQ ID NO: 3465487 - RNA, 16 nt, Human
aaucuauucuguguug

SEQ ID NO: 3465488 - RNA, 21 nt, Human
aaucuauugggauuuucuaca

SEQ ID NO: 3465489 - RNA, 16 nt, Human
aaucuauuggguucau

SEQ ID NO: 3465490 - RNA, 20 nt, Human
aaucuauuuauuaauauuua

SEQ ID NO: 3465491 - RNA, 23 nt, Human
aaucuauuuauuggacaugucca

SEQ ID NO: 3465492 - RNA, 17 nt, Human
aaucuauuucacuuauu

SEQ ID NO: 3465493 - RNA, 12 nt, Human
aaucuauuucua

SEQ ID NO: 3465494 - RNA, 17 nt, Human
aaucuauuuuguaacuu

SEQ ID NO: 3465495 - RNA, 13 nt, Human
aaucuauuuuucc

SEQ ID NO: 3465496 - RNA, 12 nt, Human
aaucucaaaauu

SEQ ID NO: 3465497 - RNA, 14 nt, Human
aaucucaaaauuag

SEQ ID NO: 3465498 - RNA, 15 nt, Human
aaucucaaauaacua

SEQ ID NO: 3465499 - RNA, 22 nt, Human
aaucucaacaugucuccuacug

SEQ ID NO: 3465500 - RNA, 19 nt, Human
aaucucaaugaagccagcu

SEQ ID NO: 3465501 - RNA, 13 nt, Human
aaucucaccccau

SEQ ID NO: 3465502 - RNA, 15 nt, Human
aaucucagugcuuuc

SEQ ID NO: 3465503 - RNA, 17 nt, Human
aaucucaucucagugaa

SEQ ID NO: 3465504 - RNA, 13 nt, Human
aaucuccaaaaua

SEQ ID NO: 3465505 - RNA, 15 nt, Human
aaucuccaguauucu

SEQ ID NO: 3465506 - RNA, 16 nt, Human
aaucucccaugugcau

SEQ ID NO: 3465507 - RNA, 21 nt, Human
aaucuccuauuuuuuuaaaau

SEQ ID NO: 3465508 - RNA, 18 nt, Human
aaucuccucuuuuaucuu

SEQ ID NO: 3465509 - RNA, 16 nt, Human
aaucucguuucaaaaa

SEQ ID NO: 3465510 - RNA, 18 nt, Human
aaucucguuucaaaaaca

SEQ ID NO: 3465511 - RNA, 15 nt, Human
aaucucuacaaaccc

SEQ ID NO: 3465512 - RNA, 16 nt, Human
aaucucuccacuuuca

SEQ ID NO: 3465513 - RNA, 18 nt, Human
aaucucucccuccucagu

SEQ ID NO: 3465514 - RNA, 20 nt, Human
aaucucucgguuccacgucc

SEQ ID NO: 3465515 - RNA, 16 nt, Human
aaucucucugcagcug

SEQ ID NO: 3465516 - RNA, 17 nt, Human
aaucucucugcagcugc

SEQ ID NO: 3465517 - RNA, 18 nt, Human
aaucucucugcagcugcc

SEQ ID NO: 3465518 - RNA, 13 nt, Human
aaucucugggggc

SEQ ID NO: 3465519 - RNA, 13 nt, Human
aaucucuguaaag

SEQ ID NO: 3465520 - RNA, 21 nt, Human
aaucucuguuauguacuguac

SEQ ID NO: 3465521 - RNA, 15 nt, Human
aaucucuucauuauu

SEQ ID NO: 3465522 - RNA, 18 nt, Human
aaucucuucauuauucuc

SEQ ID NO: 3465523 - RNA, 16 nt, Human
aaucucuucuguguuu

SEQ ID NO: 3465524 - RNA, 17 nt, Human
aaucucuuuuuguuugc

SEQ ID NO: 3465525 - RNA, 18 nt, Human
aaucucuuuuuguuugcc

SEQ ID NO: 3465526 - RNA, 15 nt, Human
aaucugaagauuguu

SEQ ID NO: 3465527 - RNA, 14 nt, Human
aaucugaauguaau

SEQ ID NO: 3465528 - RNA, 16 nt, Human
aaucugaauguaauuu

SEQ ID NO: 3465529 - RNA, 12 nt, Human
aaucugacccag

SEQ ID NO: 3465530 - RNA, 13 nt, Human
aaucugacccagu

SEQ ID NO: 3465531 - RNA, 14 nt, Human
aaucugacccagug

SEQ ID NO: 3465532 - RNA, 18 nt, Human
aaucugagggaaauguuu

SEQ ID NO: 3465533 - RNA, 22 nt, Human
aaucugauggccuuaauuuccu

SEQ ID NO: 3465534 - RNA, 17 nt, Human
aaucugauggcuucucc

SEQ ID NO: 3465535 - RNA, 22 nt, Human
aaucugauuuguuuuccucuua

SEQ ID NO: 3465536 - RNA, 13 nt, Human
aaucugauuuuua

SEQ ID NO: 3465537 - RNA, 16 nt, Human
aaucugcaaagcaugu

SEQ ID NO: 3465538 - RNA, 21 nt, Human
aaucugcaaagcauguuuugc

SEQ ID NO: 3465539 - RNA, 15 nt, Human
aaucugcaauucaaa

SEQ ID NO: 3465540 - RNA, 19 nt, Human
aaucugcaauucaaaaguu

SEQ ID NO: 3465541 - RNA, 14 nt, Human
aaucugcagaagga

SEQ ID NO: 3465542 - RNA, 17 nt, Human
aaucugcauuauuggaa

SEQ ID NO: 3465543 - RNA, 20 nt, Human
aaucugcauuuagcacaaaa

SEQ ID NO: 3465544 - RNA, 19 nt, Human
aaucugcuaccaaaacagu

SEQ ID NO: 3465545 - RNA, 24 nt, Human
aaucuggaccccaucugugaauaa

SEQ ID NO: 3465546 - RNA, 15 nt, Human
aaucuggacuccucu

SEQ ID NO: 3465547 - RNA, 14 nt, Human
aaucuggagaccag

SEQ ID NO: 3465548 - RNA, 19 nt, Human
aaucuggagagcuagaacc

SEQ ID NO: 3465549 - RNA, 21 nt, Human
aaucuggaugccucauuaugu

SEQ ID NO: 3465550 - RNA, 17 nt, Human
aaucuggauucauauuu

SEQ ID NO: 3465551 - RNA, 19 nt, Human
aaucuggauucauauuuaa

SEQ ID NO: 3465552 - RNA, 19 nt, Human
aaucuggucuuguuagaaa

SEQ ID NO: 3465553 - RNA, 19 nt, Human
aaucauguccauacacuuu

SEQ ID NO: 3465554 - RNA, 15 nt, Human
aaucaugugaacccg

SEQ ID NO: 3465555 - RNA, 16 nt, Human
aaucaugugaacccgg

SEQ ID NO: 3465556 - RNA, 22 nt, Human
aaucauguuaugauaaaaaauu

SEQ ID NO: 3465557 - RNA, 23 nt, Human
aaucauguuaugauaaaaaauuu

SEQ ID NO: 3465558 - RNA, 15 nt, Human
aaucauuagguguga

SEQ ID NO: 3465559 - RNA, 17 nt, Human
aaucauuaggugugacu

SEQ ID NO: 3465560 - RNA, 23 nt, Human
aaucauuaggugugacugaauuu

SEQ ID NO: 3465561 - RNA, 14 nt, Human
aaucauucagaaau

SEQ ID NO: 3465562 - RNA, 15 nt, Human
aaucauucagaaaug

SEQ ID NO: 3465563 - RNA, 19 nt, Human
aaucauucagaaauguuga

SEQ ID NO: 3465564 - RNA, 16 nt, Human
aaucauugaaguauuu

SEQ ID NO: 3465565 - RNA, 20 nt, Human
aaucauugcugaaaauggua

SEQ ID NO: 3465566 - RNA, 12 nt, Human
aaucauuguaca

SEQ ID NO: 3465567 - RNA, 17 nt, Human
aaucauuguccagagcu

SEQ ID NO: 3465568 - RNA, 12 nt, Human
aaucauuguugc

SEQ ID NO: 3465569 - RNA, 22 nt, Human
aaucauuguuuugaauauuacu

SEQ ID NO: 3465570 - RNA, 12 nt, Human
aaucauuucuau

SEQ ID NO: 3465571 - RNA, 19 nt, Human
aaucauuucuauuucuccu

SEQ ID NO: 3465572 - RNA, 16 nt, Human
aaucauuucucacugu

SEQ ID NO: 3465573 - RNA, 21 nt, Human
aaucauuucuugggcccuccu

SEQ ID NO: 3465574 - RNA, 22 nt, Human
aaucauuucuugggcccuccug

SEQ ID NO: 3465575 - RNA, 14 nt, Human
aaucauuugcuuuu

SEQ ID NO: 3465576 - RNA, 22 nt, Human
aaucauuuggguuaauauggcu

SEQ ID NO: 3465577 - RNA, 17 nt, Human
aaucauuuguuuaaaaa

SEQ ID NO: 3465578 - RNA, 22 nt, Human
aaucauuuguuuacauuugaug

SEQ ID NO: 3465579 - RNA, 19 nt, Human
aaucauuuuaauuauuauu

SEQ ID NO: 3465580 - RNA, 19 nt, Human
aaucauuuuaggaaaggau

SEQ ID NO: 3465581 - RNA, 13 nt, Human
aaucauuuucauu

SEQ ID NO: 3465582 - RNA, 22 nt, Human
aaucauuuuuuauauauaugca

SEQ ID NO: 3465583 - RNA, 24 nt, Human
aaucauuuuuuauauauaugcaua

SEQ ID NO: 3465584 - RNA, 15 nt, Human
aauccaaaagaaaaa

SEQ ID NO: 3465585 - RNA, 21 nt, Human
aauccaaauauuguuaaggga

SEQ ID NO: 3465586 - RNA, 13 nt, Human
aauccaaauggcg

SEQ ID NO: 3465587 - RNA, 17 nt, Human
aauccaacccaugauga

SEQ ID NO: 3465588 - RNA, 18 nt, Human
aauccaagccuccacagc

SEQ ID NO: 3465589 - RNA, 23 nt, Human
aauccaagccuccacagcgaggg

SEQ ID NO: 3465590 - RNA, 13 nt, Human
aauccaagcuccc

SEQ ID NO: 3465591 - RNA, 17 nt, Human
aauccaagcucccugcc

SEQ ID NO: 3465592 - RNA, 22 nt, Human
aauccaagcucccugccccaaa

SEQ ID NO: 3465593 - RNA, 23 nt, Human
aauccaaguagauaggaagaaag

SEQ ID NO: 3465594 - RNA, 23 nt, Human
aauccaaucagagaccaggcccu

SEQ ID NO: 3465595 - RNA, 15 nt, Human
aauccacauuucuaa

SEQ ID NO: 3465596 - RNA, 12 nt, Human
aauccacccauc

SEQ ID NO: 3465597 - RNA, 19 nt, Human
aauccaccugccucggccu

SEQ ID NO: 3465598 - RNA, 19 nt, Human
aauccagacccggcugcgu

SEQ ID NO: 3465599 - RNA, 21 nt, Human
aauccagauggugggaugugg

SEQ ID NO: 3465600 - RNA, 13 nt, Human
aauccagccugcu

SEQ ID NO: 3465601 - RNA, 16 nt, Human
aauccagcgguucuca

SEQ ID NO: 3465602 - RNA, 23 nt, Human
aauccaggacccugccaggcaca

SEQ ID NO: 3465603 - RNA, 17 nt, Human
aauccaggcacagcuga

SEQ ID NO: 3465604 - RNA, 18 nt, Human
aauccaggcacagcugag

SEQ ID NO: 3465605 - RNA, 18 nt, Human
aauccaggcagauccagg

SEQ ID NO: 3465606 - RNA, 18 nt, Human
aauccaggguggugguga

SEQ ID NO: 3465607 - RNA, 20 nt, Human
aauccagguacgcacagaca

SEQ ID NO: 3465608 - RNA, 13 nt, Human
aauccauaucuua

SEQ ID NO: 3465609 - RNA, 22 nt, Human
aauccaucuaaauaccugcccu

SEQ ID NO: 3465610 - RNA, 12 nt, Human
aauccauguaag

SEQ ID NO: 3465611 - RNA, 17 nt, Human
aauccauguuaguuuuu

SEQ ID NO: 3465612 - RNA, 14 nt, Human
aauccauuuggaaa

SEQ ID NO: 3465613 - RNA, 17 nt, Human
aauccauuuggaaaucu

SEQ ID NO: 3465614 - RNA, 11 nt, Human
aaucccaaauu

SEQ ID NO: 3465615 - RNA, 18 nt, Human
aaucccaaauuugauuga

SEQ ID NO: 3465616 - RNA, 14 nt, Human
aaucccagcaauuu

SEQ ID NO: 3465617 - RNA, 15 nt, Human
aaucccagcacuuug

SEQ ID NO: 3465618 - RNA, 13 nt, Human
aaucccagcgcac

SEQ ID NO: 3465619 - RNA, 16 nt, Human
aaucccauuauucaaa

SEQ ID NO: 3465620 - RNA, 13 nt, Human
aaucccccaggag

SEQ ID NO: 3465621 - RNA, 15 nt, Human
aaucccccuugccac

SEQ ID NO: 3465622 - RNA, 11 nt, Human
aauccccuccu

SEQ ID NO: 3465623 - RNA, 12 nt, Human
aauccccuccuu

SEQ ID NO: 3465624 - RNA, 14 nt, Human
aauccccuucuccc

SEQ ID NO: 3465625 - RNA, 16 nt, Human
aauccccuucuccccu

SEQ ID NO: 3465626 - RNA, 16 nt, Human
aaucccgauucacccu

SEQ ID NO: 3465627 - RNA, 23 nt, Human
aaucccuagggcuggcagaaagg

SEQ ID NO: 3465628 - RNA, 19 nt, Human
aaucccugggcauugcuuu

SEQ ID NO: 3465629 - RNA, 21 nt, Human
aaucccugggcauugcuuucc

SEQ ID NO: 3465630 - RNA, 17 nt, Human
aaucccuguuuaauauu

SEQ ID NO: 3465631 - RNA, 23 nt, Human
aaucccuguuuaauauuuaaaca

SEQ ID NO: 3465632 - RNA, 12 nt, Human
aaucccuucaua

SEQ ID NO: 3465633 - RNA, 23 nt, Human
aaucccuuuauuacccccuccuu

SEQ ID NO: 3465634 - RNA, 14 nt, Human
aauccgcucucuuc

SEQ ID NO: 3465635 - RNA, 19 nt, Human
aauccgcucucuuccugcc

SEQ ID NO: 3465636 - RNA, 20 nt, Human
aauccgcucucuuccugccc

SEQ ID NO: 3465637 - RNA, 18 nt, Human
aauccguaguuauuuugc

SEQ ID NO: 3465638 - RNA, 14 nt, Human
aauccuaagacaca

SEQ ID NO: 3465639 - RNA, 17 nt, Human
aauccuaccuugcuuuu

SEQ ID NO: 3465640 - RNA, 16 nt, Human
aaugcuucagauauua

SEQ ID NO: 3465641 - RNA, 16 nt, Human
aaugcuucaucccuuu

SEQ ID NO: 3465642 - RNA, 13 nt, Human
aaugcuucauuca

SEQ ID NO: 3465643 - RNA, 20 nt, Human
aaugcuucauucaauauuga

SEQ ID NO: 3465644 - RNA, 21 nt, Human
aaugcuucauucaauauugac

SEQ ID NO: 3465645 - RNA, 23 nt, Human
aaugcuuccuagaaguuacugaa

SEQ ID NO: 3465646 - RNA, 18 nt, Human
aaugcuucuaaguaaaua

SEQ ID NO: 3465647 - RNA, 16 nt, Human
aaugcuugaaaaaugu

SEQ ID NO: 3465648 - RNA, 18 nt, Human
aaugcuugcugcugauuu

SEQ ID NO: 3465649 - RNA, 19 nt, Human
aaugcuuggaauaucugcu

SEQ ID NO: 3465650 - RNA, 20 nt, Human
aaugcuuguggauugagggu

SEQ ID NO: 3465651 - RNA, 22 nt, Human
aaugcuuuaaaaacuauuuaac

SEQ ID NO: 3465652 - RNA, 18 nt, Human
aaugcuuuauuuguaaau

SEQ ID NO: 3465653 - RNA, 21 nt, Human
aaugcuuuauuuguaaauuua

SEQ ID NO: 3465654 - RNA, 22 nt, Human
aaugcuuuauuuguaaauuuag

SEQ ID NO: 3465655 - RNA, 15 nt, Human
aaugcuuuccaaaac

SEQ ID NO: 3465656 - RNA, 17 nt, Human
aaugcuuucugaagcuu

SEQ ID NO: 3465657 - RNA, 18 nt, Human
aaugcuuugauauuucaa

SEQ ID NO: 3465658 - RNA, 19 nt, Human
aaugcuuugugugauugaa

SEQ ID NO: 3465659 - RNA, 20 nt, Human
aaugcuuuuuauuucugcau

SEQ ID NO: 3465660 - RNA, 14 nt, Human
aaugcuuuuugaau

SEQ ID NO: 3465661 - RNA, 17 nt, Human
aaugcuuuuugaauguu

SEQ ID NO: 3465662 - RNA, 17 nt, Human
aauggaaaacuuaguuu

SEQ ID NO: 3465663 - RNA, 22 nt, Human
aauggaaaacuuaguuugugaa

SEQ ID NO: 3465664 - RNA, 20 nt, Human
aauggaaaaugccaugaauu

SEQ ID NO: 3465665 - RNA, 18 nt, Human
aauggaaacagaggacca

SEQ ID NO: 3465666 - RNA, 17 nt, Human
aauggaaaccacaacuu

SEQ ID NO: 3465667 - RNA, 13 nt, Human
aauggaaacugaa

SEQ ID NO: 3465668 - RNA, 15 nt, Human
aauggaaaggagagg

SEQ ID NO: 3465669 - RNA, 19 nt, Human
aauggaaaguaacucauuu

SEQ ID NO: 3465670 - RNA, 22 nt, Human
aauggaaaucaucgaaaauuca

SEQ ID NO: 3465671 - RNA, 21 nt, Human
aauggaaaugggcagagcaga

SEQ ID NO: 3465672 - RNA, 14 nt, Human
aauggaagacacau

SEQ ID NO: 3465673 - RNA, 18 nt, Human
aauggaagacagcucuua

SEQ ID NO: 3465674 - RNA, 15 nt, Human
aauggaagagaaauc

SEQ ID NO: 3465675 - RNA, 18 nt, Human
aauggaagagaaaucuca

SEQ ID NO: 3465676 - RNA, 21 nt, Human
aauggaagauuugcccauuua

SEQ ID NO: 3465677 - RNA, 21 nt, Human
aauggaaugugauguucaugg

SEQ ID NO: 3465678 - RNA, 20 nt, Human
aauggacuaacuugucuuug

SEQ ID NO: 3465679 - RNA, 19 nt, Human
aauggacugguuugagauu

SEQ ID NO: 3465680 - RNA, 20 nt, Human
aauggacuguggugacuuug

SEQ ID NO: 3465681 - RNA, 23 nt, Human
aauggacuuugcacacuuuggcc

SEQ ID NO: 3465682 - RNA, 17 nt, Human
aauggacuuuggaagca

SEQ ID NO: 3465683 - RNA, 15 nt, Human
aaugcaucagguccu

SEQ ID NO: 3465684 - RNA, 16 nt, Human
aaugcaucuguccuca

SEQ ID NO: 3465685 - RNA, 13 nt, Human
aaugcaugaguaa

SEQ ID NO: 3465686 - RNA, 17 nt, Human
aaugcaugauuuuguaa

SEQ ID NO: 3465687 - RNA, 13 nt, Human
aaugcaugcuuuc

SEQ ID NO: 3465688 - RNA, 16 nt, Human
aaugcaugcuuuccau

SEQ ID NO: 3465689 - RNA, 18 nt, Human
aaugcauuaaaccugucu

SEQ ID NO: 3465690 - RNA, 23 nt, Human
aaugcauuauaggaucauuuguu

SEQ ID NO: 3465691 - RNA, 19 nt, Human
aaugcauucuucucuguug

SEQ ID NO: 3465692 - RNA, 21 nt, Human
aaugcauuguaucgauguuau

SEQ ID NO: 3465693 - RNA, 20 nt, Human
aaugcauuuuguuugguauu

SEQ ID NO: 3465694 - RNA, 21 nt, Human
aaugcauuuuguuugguauug

SEQ ID NO: 3465695 - RNA, 22 nt, Human
aaugccaaauuaaaaaagauaa

SEQ ID NO: 3465696 - RNA, 14 nt, Human
aaugccaagcacuu

SEQ ID NO: 3465697 - RNA, 18 nt, Human
aaugccacagcccuguca

SEQ ID NO: 3465698 - RNA, 22 nt, Human
aaugccacagcccugucagcau

SEQ ID NO: 3465699 - RNA, 22 nt, Human
aaugccagagacggaagccuuu

SEQ ID NO: 3465700 - RNA, 13 nt, Human
aaugccagugugc

SEQ ID NO: 3465701 - RNA, 15 nt, Human
aaugccaucaaauga

SEQ ID NO: 3465702 - RNA, 17 nt, Human
aaugccauccucaaaca

SEQ ID NO: 3465703 - RNA, 13 nt, Human
aaugccaugaauu

SEQ ID NO: 3465704 - RNA, 16 nt, Human
aaugccauuaucccug

SEQ ID NO: 3465705 - RNA, 19 nt, Human
aaugccauuuauuuauuga

SEQ ID NO: 3465706 - RNA, 18 nt, Human
aaugccauuuuaaggaaa

SEQ ID NO: 3465707 - RNA, 22 nt, Human
aaugccauuuuaaggaaaacua

SEQ ID NO: 3465708 - RNA, 12 nt, Human
aaugcccagaca

SEQ ID NO: 3465709 - RNA, 15 nt, Human
aaugcccagccccuu

SEQ ID NO: 3465710 - RNA, 22 nt, Human
aaugcccagccccuucugaccc

SEQ ID NO: 3465711 - RNA, 24 nt, Human
aaugcccagccccuucugacccau

SEQ ID NO: 3465712 - RNA, 17 nt, Human
aaugcccccagcuggcc

SEQ ID NO: 3465713 - RNA, 18 nt, Human
aaugccgcgaugggucag

SEQ ID NO: 3465714 - RNA, 23 nt, Human
aaugccgcgaugggucagguagg

SEQ ID NO: 3465715 - RNA, 15 nt, Human
aaugccuaagaagau

SEQ ID NO: 3465716 - RNA, 17 nt, Human
aaugccuauuguaauau

SEQ ID NO: 3465717 - RNA, 15 nt, Human
aaugccucaguguau

SEQ ID NO: 3465718 - RNA, 15 nt, Human
aaugccuccuguggg

SEQ ID NO: 3465719 - RNA, 19 nt, Human
aaugccugagugccuggcc

SEQ ID NO: 3465720 - RNA, 13 nt, Human
aaugccugcuuuu

SEQ ID NO: 3465721 - RNA, 20 nt, Human
aaugccugcuuuuuggaaag

SEQ ID NO: 3465722 - RNA, 17 nt, Human
aaugccuuaaaauggaa

SEQ ID NO: 3465723 - RNA, 16 nt, Human
aaugccuuacuuugua

SEQ ID NO: 3465724 - RNA, 18 nt, Human
aaugccuuacuuuguaug

SEQ ID NO: 3465725 - RNA, 12 nt, Human
aaugccuuuaaa

SEQ ID NO: 3465726 - RNA, 18 nt, Human
aaugccuuugagacaguu

SEQ ID NO: 3465727 - RNA, 23 nt, Human
aaugccuuuguaaccacaacuuu

SEQ ID NO: 3465728 - RNA, 20 nt, Human
aaugcgaaugguagucuaac

SEQ ID NO: 3465729 - RNA, 16 nt, Human
aaugcgauuuuauuac

SEQ ID NO: 3465730 - RNA, 15 nt, Human
aaugcgcaggcuggc

SEQ ID NO: 3465731 - RNA, 17 nt, Human
aaugcgcaggcuggccc

SEQ ID NO: 3465732 - RNA, 22 nt, Human
aaugcgcaggcuggcccugccc

SEQ ID NO: 3465733 - RNA, 16 nt, Human
aaugcggccuuuucau

SEQ ID NO: 3465734 - RNA, 18 nt, Human
aaugcgugcauaccacuu

SEQ ID NO: 3465735 - RNA, 21 nt, Human
aaugcgugcauaccacuuuug

SEQ ID NO: 3465736 - RNA, 23 nt, Human
aaugcgugcauaccacuuuuguu

SEQ ID NO: 3465737 - RNA, 20 nt, Human
aaugcuaacaguucacuugc

SEQ ID NO: 3465738 - RNA, 16 nt, Human
aaugcuacgugugauu

SEQ ID NO: 3465739 - RNA, 19 nt, Human
aaugcuacgugugauuuuu

SEQ ID NO: 3465740 - RNA, 13 nt, Human
aaugcuagguucu

SEQ ID NO: 3465741 - RNA, 15 nt, Human
aaugcuagguucuac

SEQ ID NO: 3465742 - RNA, 17 nt, Human
aaugcuagguucuaccu

SEQ ID NO: 3465743 - RNA, 15 nt, Human
aaugcuaugucauuu

SEQ ID NO: 3465744 - RNA, 18 nt, Human
aaugcuaugucauuucau

SEQ ID NO: 3465745 - RNA, 16 nt, Human
aaugcuauugaaaaug

SEQ ID NO: 3465746 - RNA, 19 nt, Human
aaugcuauuuuuguuuuua

SEQ ID NO: 3465747 - RNA, 12 nt, Human
aaugcucaucug

SEQ ID NO: 3465748 - RNA, 16 nt, Human
aaugcuccccacagcg

SEQ ID NO: 3465749 - RNA, 22 nt, Human
aaugcucccccauccuccccuu

SEQ ID NO: 3465750 - RNA, 14 nt, Human
aaugcucuccuuuc

SEQ ID NO: 3465751 - RNA, 19 nt, Human
aaugcucucucaaauuguc

SEQ ID NO: 3465752 - RNA, 20 nt, Human
aaugcucuggggucuuuuua

SEQ ID NO: 3465753 - RNA, 15 nt, Human
aaugcugacccaugg

SEQ ID NO: 3465754 - RNA, 17 nt, Human
aaugcugacccaugggc

SEQ ID NO: 3465755 - RNA, 22 nt, Human
aaugcugacccaugggcaggag

SEQ ID NO: 3465756 - RNA, 13 nt, Human
aaugcugauuuaa

SEQ ID NO: 3465757 - RNA, 17 nt, Human
aaugcugcaaacuuaau

SEQ ID NO: 3465758 - RNA, 11 nt, Human
aaugcugccag

SEQ ID NO: 3465759 - RNA, 23 nt, Human
aaugcugcccaugccaccgcuuc

SEQ ID NO: 3465760 - RNA, 12 nt, Human
aaugcugccugc

SEQ ID NO: 3465761 - RNA, 15 nt, Human
aaugcugccugccug

SEQ ID NO: 3465762 - RNA, 18 nt, Human
aaugcugccugccugucu

SEQ ID NO: 3465763 - RNA, 22 nt, Human
aaugcuggcuauagaugucuuu

SEQ ID NO: 3465764 - RNA, 23 nt, Human
aaugcuggcuggccuuguggucc

SEQ ID NO: 3465765 - RNA, 21 nt, Human
aaugcuggcuguuggcugggg

SEQ ID NO: 3465766 - RNA, 22 nt, Human
aaugcugguuuuccuaaaugca

SEQ ID NO: 3465767 - RNA, 18 nt, Human
aaugcugguuuuucaguu

SEQ ID NO: 3465768 - RNA, 12 nt, Human
aaugcuguacau

SEQ ID NO: 3465769 - RNA, 13 nt, Human
aaugcuguacauc

SEQ ID NO: 3465770 - RNA, 15 nt, Human
aaugcuguacaucua

SEQ ID NO: 3465771 - RNA, 17 nt, Human
aaugcuguacaucuauu

SEQ ID NO: 3465772 - RNA, 21 nt, Human
aaugcugugcccuaaagugua

SEQ ID NO: 3465773 - RNA, 12 nt, Human
aaugcuguguua

SEQ ID NO: 3465774 - RNA, 13 nt, Human
aaugcuguguuaa

SEQ ID NO: 3465775 - RNA, 19 nt, Human
aaugcuuaaagaauucaaa

SEQ ID NO: 3465776 - RNA, 21 nt, Human
aaugcuuaaagaauucaaauu

SEQ ID NO: 3465777 - RNA, 22 nt, Human
aaugcuuaaagaauucaaauuu

SEQ ID NO: 3465778 - RNA, 15 nt, Human
aaugcuuaauuucua

SEQ ID NO: 3465779 - RNA, 17 nt, Human
aaugcuuaauuucuaaa

SEQ ID NO: 3465780 - RNA, 18 nt, Human
aaugcuucacuguacgua

SEQ ID NO: 3465781 - RNA, 17 nt, Human
aauguaaggcuguguaa

SEQ ID NO: 3465782 - RNA, 18 nt, Human
aauguaaggcuguguaag

SEQ ID NO: 3465783 - RNA, 15 nt, Human
aauguaagugggccc

SEQ ID NO: 3465784 - RNA, 21 nt, Human
aauguaaugaucauaagucua

SEQ ID NO: 3465785 - RNA, 19 nt, Human
aauguaauuaaacuguuaa

SEQ ID NO: 3465786 - RNA, 13 nt, Human
aauguaauuuaaa

SEQ ID NO: 3465787 - RNA, 23 nt, Human
aauguaauuuguguaauaaagug

SEQ ID NO: 3465788 - RNA, 13 nt, Human
aauguacaaaaua

SEQ ID NO: 3465789 - RNA, 17 nt, Human
aauguacaaaauaaagu

SEQ ID NO: 3465790 - RNA, 21 nt, Human
aauguacauagugcuaacaug

SEQ ID NO: 3465791 - RNA, 20 nt, Human
aauguacauguauuaaauua

SEQ ID NO: 3465792 - RNA, 14 nt, Human
aauguacccaguau

SEQ ID NO: 3465793 - RNA, 18 nt, Human
aauguacgaugagaaauu

SEQ ID NO: 3465794 - RNA, 18 nt, Human
aauguacguccagccugc

SEQ ID NO: 3465795 - RNA, 17 nt, Human
aauguacugauuucagu

SEQ ID NO: 3465796 - RNA, 12 nt, Human
aauguacugcau

SEQ ID NO: 3465797 - RNA, 19 nt, Human
aauguagaauauucagaca

SEQ ID NO: 3465798 - RNA, 18 nt, Human
aauguagauaaguguucu

SEQ ID NO: 3465799 - RNA, 23 nt, Human
aauguagcgacugucaacagcgu

SEQ ID NO: 3465800 - RNA, 18 nt, Human
aauguagcguguuuacau

SEQ ID NO: 3465801 - RNA, 21 nt, Human
aauguagcguguuuacaugug

SEQ ID NO: 3465802 - RNA, 14 nt, Human
aauguagcugguuu

SEQ ID NO: 3465803 - RNA, 17 nt, Human
aauguagcugguuuccu

SEQ ID NO: 3465804 - RNA, 21 nt, Human
aauguagcugguuuccucauu

SEQ ID NO: 3465805 - RNA, 22 nt, Human
aauguagcuucagucauuaaau

SEQ ID NO: 3465806 - RNA, 22 nt, Human
aauguaggagacuguuuggaaa

SEQ ID NO: 3465807 - RNA, 20 nt, Human
aauguagguaugaauaaguu

SEQ ID NO: 3465808 - RNA, 18 nt, Human
aauguagguccucagaaa

SEQ ID NO: 3465809 - RNA, 18 nt, Human
aauguaguuugaggaaau

SEQ ID NO: 3465810 - RNA, 20 nt, Human
aauguaguuugaggaaauuu

SEQ ID NO: 3465811 - RNA, 21 nt, Human
aauguauaaacuuuagaguag

SEQ ID NO: 3465812 - RNA, 13 nt, Human
aauguauaaauau

SEQ ID NO: 3465813 - RNA, 17 nt, Human
aauguauaccuguaacu

SEQ ID NO: 3465814 - RNA, 16 nt, Human
aauguauaguauuuga

SEQ ID NO: 3465815 - RNA, 18 nt, Human
aauguauaguauuugaaa

SEQ ID NO: 3465816 - RNA, 19 nt, Human
aauguauaguauuugaaaa

SEQ ID NO: 3465817 - RNA, 22 nt, Human
aauguauaguauuugaaaacag

SEQ ID NO: 3465818 - RNA, 12 nt, Human
aauguauauaaa

SEQ ID NO: 3465819 - RNA, 12 nt, Human
aauuguauauuc

SEQ ID NO: 3465820 - RNA, 16 nt, Human
aauuguauauucacuu

SEQ ID NO: 3465821 - RNA, 17 nt, Human
aauuguaucagaggccu

SEQ ID NO: 3465822 - RNA, 22 nt, Human
aauuguauguuaaguuacuuca

SEQ ID NO: 3465823 - RNA, 14 nt, Human
aauuguauuuuugu

SEQ ID NO: 3465824 - RNA, 19 nt, Human
aauugucacuuuuuaugcu

SEQ ID NO: 3465825 - RNA, 11 nt, Human
aauugucccuu

SEQ ID NO: 3465826 - RNA, 23 nt, Human
aauugucgaaaagagucuuccaa

SEQ ID NO: 3465827 - RNA, 17 nt, Human
aauugucuauuuaucuu

SEQ ID NO: 3465828 - RNA, 12 nt, Human
aauugucugaaa

SEQ ID NO: 3465829 - RNA, 18 nt, Human
aauugucuuuaauuucug

SEQ ID NO: 3465830 - RNA, 19 nt, Human
aauugucuuuaauuucugu

SEQ ID NO: 3465831 - RNA, 20 nt, Human
aauugugaauugauaauaaa

SEQ ID NO: 3465832 - RNA, 21 nt, Human
aauugugaauugauaauaaac

SEQ ID NO: 3465833 - RNA, 14 nt, Human
aauugugauguguc

SEQ ID NO: 3465834 - RNA, 12 nt, Human
aauugugcugcc

SEQ ID NO: 3465835 - RNA, 13 nt, Human
aauugugcuucuc

SEQ ID NO: 3465836 - RNA, 11 nt, Human
aauuguggcua

SEQ ID NO: 3465837 - RNA, 19 nt, Human
aauuguggcuauccugauu

SEQ ID NO: 3465838 - RNA, 18 nt, Human
aauugugggcauaaacug

SEQ ID NO: 3465839 - RNA, 20 nt, Human
aauugugggcauaaacuguu

SEQ ID NO: 3465840 - RNA, 23 nt, Human
aauugugggcauaaacuguuuca

SEQ ID NO: 3465841 - RNA, 16 nt, Human
aauugugguuuauaua

SEQ ID NO: 3465842 - RNA, 17 nt, Human
aauugugguuuauauau

SEQ ID NO: 3465843 - RNA, 16 nt, Human
aauuguguagccuuuu

SEQ ID NO: 3465844 - RNA, 17 nt, Human
aauuguguagccuuuuu

SEQ ID NO: 3465845 - RNA, 23 nt, Human
aauugugugaaagguacuucaaa

SEQ ID NO: 3465846 - RNA, 22 nt, Human
aauugugugauauuucagaaau

SEQ ID NO: 3465847 - RNA, 13 nt, Human
aauugugugguca

SEQ ID NO: 3465848 - RNA, 21 nt, Human
aauuguguggucaguggcucu

SEQ ID NO: 3465849 - RNA, 21 nt, Human
aauuguguuuacauuuuaugg

SEQ ID NO: 3465850 - RNA, 22 nt, Human
aauuguguuuacauuuuauggu

SEQ ID NO: 3465851 - RNA, 21 nt, Human
aauuguguuuauaauuuuaaa

SEQ ID NO: 3465852 - RNA, 20 nt, Human
aauuguguuuuaauuguaaa

SEQ ID NO: 3465853 - RNA, 20 nt, Human
aauuguugaaauuuugcaaa

SEQ ID NO: 3465854 - RNA, 23 nt, Human
aauuguugaaauuuugcaaauau

SEQ ID NO: 3465855 - RNA, 13 nt, Human
aauuguugacagu

SEQ ID NO: 3465856 - RNA, 18 nt, Human
aauuguugacaguucuga

SEQ ID NO: 3465857 - RNA, 23 nt, Human
aauuguugcuaaucuucuuaugc

SEQ ID NO: 3465858 - RNA, 14 nt, Human
aauuguuguucugu

SEQ ID NO: 3465859 - RNA, 19 nt, Human
aauuguuguuucuuucuag

SEQ ID NO: 3465860 - RNA, 14 nt, Human
aauuguuguuugua

SEQ ID NO: 3465861 - RNA, 21 nt, Human
aauuguuguuuguauguauaa

SEQ ID NO: 3465862 - RNA, 23 nt, Human
aauuguuguuuguauguauaauu

SEQ ID NO: 3465863 - RNA, 21 nt, Human
aauuguuuggcuuccuccuga

SEQ ID NO: 3465864 - RNA, 22 nt, Human
aauuguuuggggaugagaaagg

SEQ ID NO: 3465865 - RNA, 19 nt, Human
aauuguuuuaucugaauuu

SEQ ID NO: 3465866 - RNA, 20 nt, Human
aauuguuuuuauuguuuucu

SEQ ID NO: 3465867 - RNA, 17 nt, Human
aauuguuuuuuaucuuu

SEQ ID NO: 3465868 - RNA, 18 nt, Human
aauuguuuuuuaucuuuu

SEQ ID NO: 3465869 - RNA, 17 nt, Human
aauuuaaaaaaauacag

SEQ ID NO: 3465870 - RNA, 13 nt, Human
aauuuaaaacaaa

SEQ ID NO: 3465871 - RNA, 15 nt, Human
aauuuaaaacaaaca

SEQ ID NO: 3465872 - RNA, 13 nt, Human
aauuuaaaauaua

SEQ ID NO: 3465873 - RNA, 18 nt, Human
aauuuaaacccauuuuag

SEQ ID NO: 3465874 - RNA, 13 nt, Human
aauuuaaagauau

SEQ ID NO: 3465875 - RNA, 11 nt, Human
aauuuaaagca

SEQ ID NO: 3465876 - RNA, 20 nt, Human
aauuuaaagcagguucuugu

SEQ ID NO: 3465877 - RNA, 20 nt, Human
aauuuaaauauaauucugua

SEQ ID NO: 3465878 - RNA, 16 nt, Human
aauuuaaaugaaagaa

SEQ ID NO: 3465879 - RNA, 18 nt, Human
aauuuaaaugauuuaaau

SEQ ID NO: 3465880 - RNA, 11 nt, Human
aauuuaaaugu

SEQ ID NO: 3465881 - RNA, 11 nt, Human
aauuuaaauuu

SEQ ID NO: 3465882 - RNA, 15 nt, Human
aauuuaaauuuaaag

SEQ ID NO: 3465883 - RNA, 23 nt, Human
aauuuaagagcaguccauuucua

SEQ ID NO: 3465884 - RNA, 21 nt, Human
aauuuaagcauuguuugcuua

SEQ ID NO: 3465885 - RNA, 15 nt, Human
aauuuaaguuuugac

SEQ ID NO: 3465886 - RNA, 21 nt, Human
aauuuaauuagggguugcuaa

SEQ ID NO: 3465887 - RNA, 18 nt, Human
aauuuacaaaaauauaaa

SEQ ID NO: 3465888 - RNA, 16 nt, Human
aauuuacaaagugugu

SEQ ID NO: 3465889 - RNA, 18 nt, Human
aauuuacaaaguguguau

SEQ ID NO: 3465890 - RNA, 19 nt, Human
aauuuacaaaguguguauu

SEQ ID NO: 3465891 - RNA, 21 nt, Human
aauuuacaaaguguguauuaa

SEQ ID NO: 3465892 - RNA, 19 nt, Human
aauuuacauacucugcuua

SEQ ID NO: 3465893 - RNA, 14 nt, Human
aauuuacauggcaa

SEQ ID NO: 3465894 - RNA, 19 nt, Human
aauuuacccucuugaauau

SEQ ID NO: 3465895 - RNA, 14 nt, Human
aauuuaccuaagau

SEQ ID NO: 3465896 - RNA, 15 nt, Human
aauuuaccugaaguc

SEQ ID NO: 3465897 - RNA, 17 nt, Human
aauuuacuacaauaugu

SEQ ID NO: 3465898 - RNA, 15 nt, Human
aauuuacuauauaua

SEQ ID NO: 3465899 - RNA, 13 nt, Human
aauuuacuuguuu

SEQ ID NO: 3465900 - RNA, 15 nt, Human
aauuuacuuuaaacu

SEQ ID NO: 3465901 - RNA, 15 nt, Human
aauuuacuuuacaca

SEQ ID NO: 3465902 - RNA, 17 nt, Human
aauuuagaaaaagaaca

SEQ ID NO: 3465903 - RNA, 15 nt, Human
aauuuagaaaacuuu

SEQ ID NO: 3465904 - RNA, 19 nt, Human
aauuuagaaacuaauugac

SEQ ID NO: 3465905 - RNA, 22 nt, Human
aauuuagaaacuaauugacuuu

SEQ ID NO: 3465906 - RNA, 14 nt, Human
aauuuagaaaucau

SEQ ID NO: 3465907 - RNA, 20 nt, Human
aauuuagaaaucauuuugca

SEQ ID NO: 3465908 - RNA, 15 nt, Human
aauuuagauuguaaa

SEQ ID NO: 3465909 - RNA, 14 nt, Human
aauuuagcauugua

SEQ ID NO: 3465910 - RNA, 18 nt, Human
aauuuagguuuuuauuag

SEQ ID NO: 3465911 - RNA, 14 nt, Human
aauuuaguaaaugu

SEQ ID NO: 3465912 - RNA, 23 nt, Human
aauuuagugaucuuagcauagcu

SEQ ID NO: 3465913 - RNA, 17 nt, Human
aauuuaguguauccaua

SEQ ID NO: 3465914 - RNA, 22 nt, Human
aauuuaguguuuuuuuauuucu

SEQ ID NO: 3465915 - RNA, 23 nt, Human
aauuuaguguuuuuuuauuucua

SEQ ID NO: 3465916 - RNA, 13 nt, Human
aauuuaguuguuu

SEQ ID NO: 3465917 - RNA, 12 nt, Human
aauuuaguuuca

SEQ ID NO: 3465918 - RNA, 22 nt, Human
aauuuaguuucauauaaaguau

SEQ ID NO: 3465919 - RNA, 16 nt, Human
aauuuaguuuuuguuc

SEQ ID NO: 3465920 - RNA, 17 nt, Human
aauuuaguuuuuguucu

SEQ ID NO: 3465921 - RNA, 15 nt, Human
aauuuauaaaauuag

SEQ ID NO: 3465922 - RNA, 16 nt, Human
aauuuauaaaauuaga

SEQ ID NO: 3465923 - RNA, 15 nt, Human
aauuuauaaaguacc

SEQ ID NO: 3465924 - RNA, 23 nt, Human
aauuuauaacguguucaauauuu

SEQ ID NO: 3465925 - RNA, 17 nt, Human
aauuuauacaauaucau

SEQ ID NO: 3465926 - RNA, 16 nt, Human
aauuuauacaggucau

SEQ ID NO: 3465927 - RNA, 18 nt, Human
aauuuauaccucaauuuu

SEQ ID NO: 3465928 - RNA, 15 nt, Human
aauuuaucaaagcau

SEQ ID NO: 3465929 - RNA, 22 nt, Human
aauuuaucaaagcauagauguu

SEQ ID NO: 3465930 - RNA, 22 nt, Human
aauuuaucagauugcuuuugug

SEQ ID NO: 3465931 - RNA, 17 nt, Human
aauuuaucaguaccuaa

SEQ ID NO: 3465932 - RNA, 19 nt, Human
aauuuauccugaaauuuca

SEQ ID NO: 3465933 - RNA, 15 nt, Human
aauuuaucuuugaua

SEQ ID NO: 3465934 - RNA, 21 nt, Human
aauuuaugaauugaauuaucu

SEQ ID NO: 3465935 - RNA, 16 nt, Human
aauuuaugaguuuuug

SEQ ID NO: 3465936 - RNA, 14 nt, Human
aauuuaugugaugg

SEQ ID NO: 3465937 - RNA, 15 nt, Human
aauuuauuaaaauga

SEQ ID NO: 3465938 - RNA, 20 nt, Human
aauuuauuagcccugcauuu

SEQ ID NO: 3465939 - RNA, 17 nt, Human
aauuuauuaguuaauau

SEQ ID NO: 3465940 - RNA, 13 nt, Human
aauuuauuauggc

SEQ ID NO: 3465941 - RNA, 17 nt, Human
aauuuauuauugaaauu

SEQ ID NO: 3465942 - RNA, 18 nt, Human
aauuuauuauugaaauug

SEQ ID NO: 3465943 - RNA, 21 nt, Human
aauuuauucaauuccucuggg

SEQ ID NO: 3465944 - RNA, 15 nt, Human
aauuuauugcacaaa

SEQ ID NO: 3465945 - RNA, 18 nt, Human
aauuuauugcacauuguu

SEQ ID NO: 3465946 - RNA, 19 nt, Human
aauuuauugcacauuguuc

SEQ ID NO: 3465947 - RNA, 19 nt, Human
aauuuauuggcuuuucuga

SEQ ID NO: 3465948 - RNA, 21 nt, Human
aauuuauuggcuuuucugauc

SEQ ID NO: 3465949 - RNA, 17 nt, Human
aauuuauuuauacuauu

SEQ ID NO: 3465950 - RNA, 17 nt, Human
aauuuauuuauuaagau

SEQ ID NO: 3465951 - RNA, 21 nt, Human
aauuuauuuccacuaaaaaua

SEQ ID NO: 3465952 - RNA, 19 nt, Human
aauuuauuuccuaguucug

SEQ ID NO: 3465953 - RNA, 13 nt, Human
aauuuauuuucuu

SEQ ID NO: 3465954 - RNA, 12 nt, Human
aauuuauuuugu

SEQ ID NO: 3465955 - RNA, 17 nt, Human
acauuguuugcugcuau

SEQ ID NO: 3465956 - RNA, 18 nt, Human
acauuguuugcugcuauu

SEQ ID NO: 3465957 - RNA, 15 nt, Human
acauuguuuuaaaaa

SEQ ID NO: 3465958 - RNA, 18 nt, Human
acauuguuuuaaaaagaa

SEQ ID NO: 3465959 - RNA, 21 nt, Human
acauuguuuugccaacauugc

SEQ ID NO: 3465960 - RNA, 14 nt, Human
acauuuaaaacuua

SEQ ID NO: 3465961 - RNA, 12 nt, Human
acauuuaaaauu

SEQ ID NO: 3465962 - RNA, 13 nt, Human
acauuuaaagcau

SEQ ID NO: 3465963 - RNA, 20 nt, Human
acauuuaaagcauugcuguu

SEQ ID NO: 3465964 - RNA, 22 nt, Human
acauuuaacuuguuuccaaugu

SEQ ID NO: 3465965 - RNA, 17 nt, Human
acauuuaauacagcagu

SEQ ID NO: 3465966 - RNA, 15 nt, Human
acauuuaauugagaa

SEQ ID NO: 3465967 - RNA, 19 nt, Human
acauuuaauuuagugaucu

SEQ ID NO: 3465968 - RNA, 21 nt, Human
acauuuacaaacugaagagua

SEQ ID NO: 3465969 - RNA, 16 nt, Human
acauuuacauguauua

SEQ ID NO: 3465970 - RNA, 14 nt, Human
acauuuaccagcaa

SEQ ID NO: 3465971 - RNA, 16 nt, Human
acauuuaccuuuuuga

SEQ ID NO: 3465972 - RNA, 13 nt, Human
acauuuagaaaag

SEQ ID NO: 3465973 - RNA, 22 nt, Human
acauuuagaaaagugaauugaa

SEQ ID NO: 3465974 - RNA, 16 nt, Human
acauuuagaagaaaga

SEQ ID NO: 3465975 - RNA, 23 nt, Human
acauuuagauccugguuucauaa

SEQ ID NO: 3465976 - RNA, 20 nt, Human
acauuuagcugugcucagaa

SEQ ID NO: 3465977 - RNA, 13 nt, Human
acauuuauaauug

SEQ ID NO: 3465978 - RNA, 14 nt, Human
acauuuauaauugc

SEQ ID NO: 3465979 - RNA, 23 nt, Human
acauuuaucaaucaguauaauuc

SEQ ID NO: 3465980 - RNA, 17 nt, Human
acauuuaugauuuaaua

SEQ ID NO: 3465981 - RNA, 16 nt, Human
acauuuauuuuaugag

SEQ ID NO: 3465982 - RNA, 16 nt, Human
acauuuauuuugacau

SEQ ID NO: 3465983 - RNA, 15 nt, Human
acauuuauuuuuaua

SEQ ID NO: 3465984 - RNA, 21 nt, Human
acauuucacaggcuaauggga

SEQ ID NO: 3465985 - RNA, 20 nt, Human
acauuucaccuacuuuguaa

SEQ ID NO: 3465986 - RNA, 16 nt, Human
acauuucacugucugu

SEQ ID NO: 3465987 - RNA, 16 nt, Human
acauuucauguauucc

SEQ ID NO: 3465988 - RNA, 12 nt, Human
acauuucccugu

SEQ ID NO: 3465989 - RNA, 13 nt, Human
acauuucuaaaau

SEQ ID NO: 3465990 - RNA, 22 nt, Human
acauuucuaacucugauguaaa

SEQ ID NO: 3465991 - RNA, 23 nt, Human
acauuucuaagucaaacacuugu

SEQ ID NO: 3465992 - RNA, 15 nt, Human
acauuucuauaaaua

SEQ ID NO: 3465993 - RNA, 12 nt, Human
acauuucucuga

SEQ ID NO: 3465994 - RNA, 15 nt, Human
acauuucuguaaaua

SEQ ID NO: 3465995 - RNA, 18 nt, Human
acauuucuguaaauacca

SEQ ID NO: 3465996 - RNA, 19 nt, Human
acauuucuucuagugauga

SEQ ID NO: 3465997 - RNA, 19 nt, Human
acauuucuuugugcuuugg

SEQ ID NO: 3465998 - RNA, 14 nt, Human
acauuucuuuucuu

SEQ ID NO: 3465999 - RNA, 14 nt, Human
acauuugaaaucua

SEQ ID NO: 3466000 - RNA, 17 nt, Human
acauuugccuugcagaa

SEQ ID NO: 3466001 - RNA, 20 nt, Human
acauuugccuugcagaacug

SEQ ID NO: 3466002 - RNA, 23 nt, Human
acauuugccuugcagaacugcca

SEQ ID NO: 3466003 - RNA, 14 nt, Human
acauuugccuugcu

SEQ ID NO: 3466004 - RNA, 19 nt, Human
acauuugcuuuuugugaua

SEQ ID NO: 3466005 - RNA, 20 nt, Human
acauuuggaacuaacacgug

SEQ ID NO: 3466006 - RNA, 12 nt, Human
acauuuggaaua

SEQ ID NO: 3466007 - RNA, 20 nt, Human
acauuuggaguguuccccuu

SEQ ID NO: 3466008 - RNA, 19 nt, Human
acauuuggauaaacaacau

SEQ ID NO: 3466009 - RNA, 17 nt, Human
acauuugggagacaugu

SEQ ID NO: 3466010 - RNA, 21 nt, Human
acauuugggaguuuuuaugag

SEQ ID NO: 3466011 - RNA, 14 nt, Human
acauuuggguaaau

SEQ ID NO: 3466012 - RNA, 13 nt, Human
aauuuuauuuugu

SEQ ID NO: 3466013 - RNA, 19 nt, Human
aauuuucaagcaucuccug

SEQ ID NO: 3466014 - RNA, 16 nt, Human
aauuuucacaugaaca

SEQ ID NO: 3466015 - RNA, 21 nt, Human
aauuuucacaugaacauacug

SEQ ID NO: 3466016 - RNA, 17 nt, Human
aauuuucagauuugcac

SEQ ID NO: 3466017 - RNA, 20 nt, Human
aauuuucagauuugcacaaa

SEQ ID NO: 3466018 - RNA, 20 nt, Human
aauuuucaguauaauuuaac

SEQ ID NO: 3466019 - RNA, 16 nt, Human
aauuuucauuuuacag

SEQ ID NO: 3466020 - RNA, 22 nt, Human
aauuuuccuguccucuuucagc

SEQ ID NO: 3466021 - RNA, 21 nt, Human
aauuuucuaaaagcuuucaug

SEQ ID NO: 3466022 - RNA, 11 nt, Human
aauuuucuaag

SEQ ID NO: 3466023 - RNA, 12 nt, Human
aauuuucuagac

SEQ ID NO: 3466024 - RNA, 15 nt, Human
aauuuucuagacuuu

SEQ ID NO: 3466025 - RNA, 18 nt, Human
aauuuucuagacuuucug

SEQ ID NO: 3466026 - RNA, 20 nt, Human
aauuuucuagacuuucuguu

SEQ ID NO: 3466027 - RNA, 17 nt, Human
aauuuucucaaaagcau

SEQ ID NO: 3466028 - RNA, 18 nt, Human
aauuuucucccaggaagc

SEQ ID NO: 3466029 - RNA, 22 nt, Human
aauuuucuggaauacaugaaau

SEQ ID NO: 3466030 - RNA, 14 nt, Human
aauuuucuucaguu

SEQ ID NO: 3466031 - RNA, 13 nt, Human
aauuuucuugaug

SEQ ID NO: 3466032 - RNA, 23 nt, Human
aauuuucuuuaaccagucugaag

SEQ ID NO: 3466033 - RNA, 14 nt, Human
aauuuugaagugcu

SEQ ID NO: 3466034 - RNA, 16 nt, Human
aauuuugacacuauau

SEQ ID NO: 3466035 - RNA, 20 nt, Human
aauuuugaguucuacauaag

SEQ ID NO: 3466036 - RNA, 20 nt, Human
aauuuugauauaaucuuuca

SEQ ID NO: 3466037 - RNA, 12 nt, Human
aauuuugauuca

SEQ ID NO: 3466038 - RNA, 15 nt, Human
aauuuugcaaauaua

SEQ ID NO: 3466039 - RNA, 19 nt, Human
aauuuugcaaauauaaaca

SEQ ID NO: 3466040 - RNA, 20 nt, Human
aauuuugcaaauauaaacau

SEQ ID NO: 3466041 - RNA, 16 nt, Human
aauuuugcuuuuaauu

SEQ ID NO: 3466042 - RNA, 22 nt, Human
aauuuuggccaaaguguuaauc

SEQ ID NO: 3466043 - RNA, 18 nt, Human
aauuuuggggauuuucaa

SEQ ID NO: 3466044 - RNA, 16 nt, Human
aauuuugguuguauuc

SEQ ID NO: 3466045 - RNA, 19 nt, Human
aauuuugguuguauucuuu

SEQ ID NO: 3466046 - RNA, 22 nt, Human
aauuuugguuguauucuuugau

SEQ ID NO: 3466047 - RNA, 23 nt, Human
aauuuugguuguauucuuugaug

SEQ ID NO: 3466048 - RNA, 12 nt, Human
aauuuuguaaga

SEQ ID NO: 3466049 - RNA, 13 nt, Human
aauuuuguaauga

SEQ ID NO: 3466050 - RNA, 16 nt, Human
aauuuuguaauuuucu

SEQ ID NO: 3466051 - RNA, 12 nt, Human
aauuuuguauuu

SEQ ID NO: 3466052 - RNA, 21 nt, Human
aauuuugucugccccaaguuu

SEQ ID NO: 3466053 - RNA, 23 nt, Human
aauuuugugaaacagacuuguau

SEQ ID NO: 3466054 - RNA, 16 nt, Human
aauuuugugcccccau

SEQ ID NO: 3466055 - RNA, 15 nt, Human
aauuuuguguaagaa

SEQ ID NO: 3466056 - RNA, 17 nt, Human
aauuuuguguaagaaau

SEQ ID NO: 3466057 - RNA, 18 nt, Human
aauuuuguguaagaaaua

SEQ ID NO: 3466058 - RNA, 19 nt, Human
aauuuuguucuaguuuuca

SEQ ID NO: 3466059 - RNA, 16 nt, Human
aauuuuguucucuggg

SEQ ID NO: 3466060 - RNA, 13 nt, Human
aauuuuguugcug

SEQ ID NO: 3466061 - RNA, 19 nt, Human
aauuuuguuuauaagaaau

SEQ ID NO: 3466062 - RNA, 19 nt, Human
aauuuuuaaaaauacacuu

SEQ ID NO: 3466063 - RNA, 13 nt, Human
aauuuuuaaacaa

SEQ ID NO: 3466064 - RNA, 20 nt, Human
aauuuuuaaauguaaaacau

SEQ ID NO: 3466065 - RNA, 13 nt, Human
aauuuuuaagcaa

SEQ ID NO: 3466066 - RNA, 22 nt, Human
aauuuuuaaucuuuaauuuuac

SEQ ID NO: 3466067 - RNA, 13 nt, Human
aauuuuuaauguu

SEQ ID NO: 3466068 - RNA, 16 nt, Human
aauuuuuacagaauug

SEQ ID NO: 3466069 - RNA, 22 nt, Human
aauuuuuaccauaguuuucuca

SEQ ID NO: 3466070 - RNA, 22 nt, Human
aauuuuuauauuuaauuauuaa

SEQ ID NO: 3466071 - RNA, 14 nt, Human
aauuuuuaugugug

SEQ ID NO: 3466072 - RNA, 17 nt, Human
aauuuuuauuaaauuau

SEQ ID NO: 3466073 - RNA, 17 nt, Human
aauuuuuauuaugcaua

SEQ ID NO: 3466074 - RNA, 16 nt, Human
aauuuuuauuauuugu

SEQ ID NO: 3466075 - RNA, 12 nt, Human
aauuuuuauugu

SEQ ID NO: 3466076 - RNA, 22 nt, Human
aauuuuuauuuuugcugagacu

SEQ ID NO: 3466077 - RNA, 23 nt, Human
aauuuuucagcucucuguauaaa

SEQ ID NO: 3466078 - RNA, 20 nt, Human
aauuuuucucaguuuguaua

SEQ ID NO: 3466079 - RNA, 20 nt, Human
aauuuuucucuaacucagaa

SEQ ID NO: 3466080 - RNA, 18 nt, Human
aauuuuucuguauagaca

SEQ ID NO: 3466081 - RNA, 11 nt, Human
aauuuuugcaa

SEQ ID NO: 3466082 - RNA, 12 nt, Human
aauuuuugcaau

SEQ ID NO: 3466083 - RNA, 14 nt, Human
aauuuuugcaauaa

SEQ ID NO: 3466084 - RNA, 17 nt, Human
aauuuuugcaauaaugc

SEQ ID NO: 3466085 - RNA, 19 nt, Human
aauuuuugcaauaaugcag

SEQ ID NO: 3466086 - RNA, 21 nt, Human
aauuuuugcaauaaugcagua

SEQ ID NO: 3466087 - RNA, 20 nt, Human
aauuuuugcuuuuagaaaag

SEQ ID NO: 3466088 - RNA, 22 nt, Human
aauuuuuggauugacaguaacu

SEQ ID NO: 3466089 - RNA, 23 nt, Human
aauuuuuggugggugaaaggaau

SEQ ID NO: 3466090 - RNA, 14 nt, Human
aauuuuugguugaa

SEQ ID NO: 3466091 - RNA, 14 nt, Human
aauuuuuguaaauc

SEQ ID NO: 3466092 - RNA, 14 nt, Human
aauuuuuguauuuu

SEQ ID NO: 3466093 - RNA, 17 nt, Human
aauuuuuuaaaagagac

SEQ ID NO: 3466094 - RNA, 18 nt, Human
aauuuuuuauucuuguga

SEQ ID NO: 3466095 - RNA, 23 nt, Human
aauuuuuuauucuugugaauaug

SEQ ID NO: 3466096 - RNA, 19 nt, Human
aauuuuuucucuaggaaau

SEQ ID NO: 3466097 - RNA, 22 nt, Human
aauuuuuucucuaggaaauauu

SEQ ID NO: 3466098 - RNA, 22 nt, Human
aauuuuuuguugacauuagucu

SEQ ID NO: 3466099 - RNA, 19 nt, Human
aauuuuuuuaauuuacaaa

SEQ ID NO: 3466100 - RNA, 18 nt, Human
aauuuuuuuagaaagcau

SEQ ID NO: 3466101 - RNA, 15 nt, Human
aauuuuuuucaauau

SEQ ID NO: 3466102 - RNA, 13 nt, Human
aauuuuuuucacc

SEQ ID NO: 3466103 - RNA, 21 nt, Human
aauuuuuuucaucuucucugg

SEQ ID NO: 3466104 - RNA, 20 nt, Human
aauuuuuuuccuuaccuuuu

SEQ ID NO: 3466105 - RNA, 16 nt, Human
aauuuuuuucugcaac

SEQ ID NO: 3466106 - RNA, 14 nt, Human
aauuuuuuuguaug

SEQ ID NO: 3466107 - RNA, 15 nt, Human
aauuuuuuuguauga

SEQ ID NO: 3466108 - RNA, 19 nt, Human
aauuuuuuuguaugaaaac

SEQ ID NO: 3466109 - RNA, 16 nt, Human
aauuuuuuugucuuua

SEQ ID NO: 3466110 - RNA, 14 nt, Human
aauuuuuuuuaaca

SEQ ID NO: 3466111 - RNA, 20 nt, Human
aauuuuuuuuauuaguauug

SEQ ID NO: 3466112 - RNA, 20 nt, Human
aauuuuuuuuucauagagau

SEQ ID NO: 3466113 - RNA, 23 nt, Human
acaaaaaaaaaaaaagaagaccg

SEQ ID NO: 3466114 - RNA, 21 nt, Human
acaaaaaaaaaguuuuauuuu

SEQ ID NO: 3466115 - RNA, 16 nt, Human
acaaaaaaaucugcag

SEQ ID NO: 3466116 - RNA, 19 nt, Human
acaaaaaaaucugcagaag

SEQ ID NO: 3466117 - RNA, 13 nt, Human
acaaaaacacagc

SEQ ID NO: 3466118 - RNA, 14 nt, Human
acaaaaacacagca

SEQ ID NO: 3466119 - RNA, 13 nt, Human
acaaaaacaggua

SEQ ID NO: 3466120 - RNA, 20 nt, Human
acaaaaacagguauauacuu

SEQ ID NO: 3466121 - RNA, 18 nt, Human
acaaaaaccaaauguuua

SEQ ID NO: 3466122 - RNA, 18 nt, Human
acaaaaagaaaagaaaau

SEQ ID NO: 3466123 - RNA, 16 nt, Human
acaaaaagacacuuga

SEQ ID NO: 3466124 - RNA, 16 nt, Human
acaaaaagaugucuca

SEQ ID NO: 3466125 - RNA, 16 nt, Human
acaaaaagcauaaaaa

SEQ ID NO: 3466126 - RNA, 15 nt, Human
acaaaaagcuucccc

SEQ ID NO: 3466127 - RNA, 22 nt, Human
acaaaaagguaaaacuuuuuau

SEQ ID NO: 3466128 - RNA, 18 nt, Human
acaaaaaguuuccauaug

SEQ ID NO: 3466129 - RNA, 12 nt, Human
acaaaaauacuc

SEQ ID NO: 3466130 - RNA, 20 nt, Human
acaaaaauacucuaauucua

SEQ ID NO: 3466131 - RNA, 13 nt, Human
acaaaaauauaaa

SEQ ID NO: 3466132 - RNA, 19 nt, Human
acaaaaaugaacugaaguu

SEQ ID NO: 3466133 - RNA, 14 nt, Human
acaaaaauuaaaau

SEQ ID NO: 3466134 - RNA, 14 nt, Human
acaaaaauuaggua

SEQ ID NO: 3466135 - RNA, 11 nt, Human
acaaaaauuau

SEQ ID NO: 3466136 - RNA, 17 nt, Human
acaaaaauucacaagcu

SEQ ID NO: 3466137 - RNA, 15 nt, Human
acaaaaauugacuca

SEQ ID NO: 3466138 - RNA, 14 nt, Human
acaaaacaaaacaa

SEQ ID NO: 3466139 - RNA, 15 nt, Human
acaaaacaaaacuau

SEQ ID NO: 3466140 - RNA, 19 nt, Human
acaaaacaaagcaauucuu

SEQ ID NO: 3466141 - RNA, 12 nt, Human
acaaaacaaauc

SEQ ID NO: 3466142 - RNA, 17 nt, Human
acaaaacaacccuagag

SEQ ID NO: 3466143 - RNA, 21 nt, Human
acaaaaccuaacuugcgcaga

SEQ ID NO: 3466144 - RNA, 17 nt, Human
acaaaacgcgcagaugu

SEQ ID NO: 3466145 - RNA, 15 nt, Human
acaaaacuacaugag

SEQ ID NO: 3466146 - RNA, 17 nt, Human
acaaaacuacaugagaa

SEQ ID NO: 3466147 - RNA, 17 nt, Human
acaaaacuauacuugaa

SEQ ID NO: 3466148 - RNA, 21 nt, Human
acaaaacuauacuugaacaaa

SEQ ID NO: 3466149 - RNA, 14 nt, Human
acaaaacugcauuu

SEQ ID NO: 3466150 - RNA, 16 nt, Human
acaaaacugcauuuca

SEQ ID NO: 3466151 - RNA, 12 nt, Human
acaaaacuucuu

SEQ ID NO: 3466152 - RNA, 20 nt, Human
acaaaacuucuugucagaca

SEQ ID NO: 3466153 - RNA, 20 nt, Human
acaaaagaagcccggcuccu

SEQ ID NO: 3466154 - RNA, 23 nt, Human
acaaaagcaagacuguugcucaa

SEQ ID NO: 3466155 - RNA, 11 nt, Human
acaaaagcaau

SEQ ID NO: 3466156 - RNA, 21 nt, Human
acaaaagcauucggagggagg

SEQ ID NO: 3466157 - RNA, 14 nt, Human
acaaaagggucaga

SEQ ID NO: 3466158 - RNA, 15 nt, Human
acaaaagucugucuu

SEQ ID NO: 3466159 - RNA, 12 nt, Human
acaaaauaaaca

SEQ ID NO: 3466160 - RNA, 12 nt, Human
acaaaauagaag

SEQ ID NO: 3466161 - RNA, 22 nt, Human
acaaaauauaaagcaucuaaac

SEQ ID NO: 3466162 - RNA, 13 nt, Human
acagaagcagcuc

SEQ ID NO: 3466163 - RNA, 14 nt, Human
acagaagcagcucu

SEQ ID NO: 3466164 - RNA, 15 nt, Human
acagaagcagcucuu

SEQ ID NO: 3466165 - RNA, 14 nt, Human
acagaagcauuugu

SEQ ID NO: 3466166 - RNA, 20 nt, Human
acagaagcauuuguauuuug

SEQ ID NO: 3466167 - RNA, 21 nt, Human
acagaagcauuuguauuuugu

SEQ ID NO: 3466168 - RNA, 23 nt, Human
acagaagcauuuguauuuugugu

SEQ ID NO: 3466169 - RNA, 21 nt, Human
acagaagccaggagcaaaugu

SEQ ID NO: 3466170 - RNA, 22 nt, Human
acagaagcucuuacucuuuccu

SEQ ID NO: 3466171 - RNA, 13 nt, Human
acagaagcuucca

SEQ ID NO: 3466172 - RNA, 16 nt, Human
acagaaggcuccugcc

SEQ ID NO: 3466173 - RNA, 18 nt, Human
acagaaggcuccugcccc

SEQ ID NO: 3466174 - RNA, 17 nt, Human
acagaaggggacugcca

SEQ ID NO: 3466175 - RNA, 16 nt, Human
acagaagucaugaagc

SEQ ID NO: 3466176 - RNA, 17 nt, Human
acagaaguuugcacuau

SEQ ID NO: 3466177 - RNA, 17 nt, Human
acagaauauguuucaaa

SEQ ID NO: 3466178 - RNA, 19 nt, Human
acagaauauguuucaaacu

SEQ ID NO: 3466179 - RNA, 12 nt, Human
acagaauauuuc

SEQ ID NO: 3466180 - RNA, 21 nt, Human
acagaauauuucuauugaauu

SEQ ID NO: 3466181 - RNA, 22 nt, Human
acagaauauuuuuauauuuccu

SEQ ID NO: 3466182 - RNA, 23 nt, Human
acagaauauuuuuauauuuccuu

SEQ ID NO: 3466183 - RNA, 22 nt, Human
acagaaucauaugauucugcuu

SEQ ID NO: 3466184 - RNA, 19 nt, Human
acagaaucuuguuuugaaa

SEQ ID NO: 3466185 - RNA, 16 nt, Human
acagaaugaaaaauga

SEQ ID NO: 3466186 - RNA, 20 nt, Human
acagaaugaaaaaugaaaga

SEQ ID NO: 3466187 - RNA, 22 nt, Human
acagaaugaaaaaugaaagaug

SEQ ID NO: 3466188 - RNA, 13 nt, Human
acagaauguaucu

SEQ ID NO: 3466189 - RNA, 14 nt, Human
acagaauguaucug

SEQ ID NO: 3466190 - RNA, 18 nt, Human
acagaauguaucugugaa

SEQ ID NO: 3466191 - RNA, 18 nt, Human
acagaaugugauaaggaa

SEQ ID NO: 3466192 - RNA, 18 nt, Human
acagaauugugucugcag

SEQ ID NO: 3466193 - RNA, 21 nt, Human
acagacaagguagcccuggcc

SEQ ID NO: 3466194 - RNA, 14 nt, Human
acagacacacgcac

SEQ ID NO: 3466195 - RNA, 18 nt, Human
acagacacaggcccggcu

SEQ ID NO: 3466196 - RNA, 20 nt, Human
acagacacgagccaccucac

SEQ ID NO: 3466197 - RNA, 13 nt, Human
acagacaggaccc

SEQ ID NO: 3466198 - RNA, 18 nt, Human
acagacaggaccccugca

SEQ ID NO: 3466199 - RNA, 13 nt, Human
acagacaggagaa

SEQ ID NO: 3466200 - RNA, 15 nt, Human
acagacaggagaaau

SEQ ID NO: 3466201 - RNA, 21 nt, Human
acagacaggagaaaugcaucc

SEQ ID NO: 3466202 - RNA, 17 nt, Human
acagacauucugccagg

SEQ ID NO: 3466203 - RNA, 16 nt, Human
acagacauuguuuugc

SEQ ID NO: 3466204 - RNA, 21 nt, Human
acagaccacaucuuuaucugu

SEQ ID NO: 3466205 - RNA, 17 nt, Human
acagacccugcccugug

SEQ ID NO: 3466206 - RNA, 18 nt, Human
acagacccugcccugugg

SEQ ID NO: 3466207 - RNA, 19 nt, Human
acagaccgaacuguuguau

SEQ ID NO: 3466208 - RNA, 16 nt, Human
acagaccuaaugcucc

SEQ ID NO: 3466209 - RNA, 14 nt, Human
acagaccuuugaac

SEQ ID NO: 3466210 - RNA, 20 nt, Human
acagacguaugcuuauuuua

SEQ ID NO: 3466211 - RNA, 20 nt, Human
acagacucacaaccugaacc

SEQ ID NO: 3466212 - RNA, 18 nt, Human
acagacucauccugaaca

SEQ ID NO: 3466213 - RNA, 17 nt, Human
acagacuccugaggaca

SEQ ID NO: 3466214 - RNA, 23 nt, Human
acagacuccugaggacagcuguc

SEQ ID NO: 3466215 - RNA, 19 nt, Human
acagacugaccuugaugag

SEQ ID NO: 3466216 - RNA, 23 nt, Human
acagacugcaagaggcuccuguc

SEQ ID NO: 3466217 - RNA, 23 nt, Human
acagacugcgauuugucccaggu

SEQ ID NO: 3466218 - RNA, 14 nt, Human
acagacuggaagca

SEQ ID NO: 3466219 - RNA, 18 nt, Human
acagacuggagacaaugc

SEQ ID NO: 3466220 - RNA, 20 nt, Human
acagacuggauguaccacca

SEQ ID NO: 3466221 - RNA, 15 nt, Human
acagacuguuaauua

SEQ ID NO: 3466222 - RNA, 16 nt, Human
acagacuucuccagac

SEQ ID NO: 3466223 - RNA, 13 nt, Human
acagacuucugaa

SEQ ID NO: 3466224 - RNA, 15 nt, Human
acagacuugagaacu

SEQ ID NO: 3466225 - RNA, 17 nt, Human
acagacuugagaacuug

SEQ ID NO: 3466226 - RNA, 18 nt, Human
acagacuugagaacuuga

SEQ ID NO: 3466227 - RNA, 20 nt, Human
acagacuuuagcuuucugag

SEQ ID NO: 3466228 - RNA, 15 nt, Human
acagagaaaccagcu

SEQ ID NO: 3466229 - RNA, 17 nt, Human
acagagaaaccagcuuc

SEQ ID NO: 3466230 - RNA, 19 nt, Human
acagagaaaccagcuuccu

SEQ ID NO: 3466231 - RNA, 23 nt, Human
acagagaaaccagcuuccuucag

SEQ ID NO: 3466232 - RNA, 17 nt, Human
acagagaaagagagaga

SEQ ID NO: 3466233 - RNA, 10 nt, Human
acagagaagc

SEQ ID NO: 3466234 - RNA, 14 nt, Human
acagagaagccagc

SEQ ID NO: 3466235 - RNA, 15 nt, Human
acagagaagccuuca

SEQ ID NO: 3466236 - RNA, 20 nt, Human
acagagaagccuucaagcuc

SEQ ID NO: 3466237 - RNA, 17 nt, Human
acagagaagcuggggag

SEQ ID NO: 3466238 - RNA, 21 nt, Human
acagagaaggaaugucuuugg

SEQ ID NO: 3466239 - RNA, 16 nt, Human
acagagaaggcagcag

SEQ ID NO: 3466240 - RNA, 15 nt, Human
acagagaaggcagga

SEQ ID NO: 3466241 - RNA, 18 nt, Human
acagagaagucacagggc

SEQ ID NO: 3466242 - RNA, 19 nt, Human
acagagaagucacagggca

SEQ ID NO: 3466243 - RNA, 18 nt, Human
acagagacaaguaauuuc

SEQ ID NO: 3466244 - RNA, 15 nt, Human
acagagacaggccca

SEQ ID NO: 3466245 - RNA, 21 nt, Human
acagagacaggcccaagagau

SEQ ID NO: 3466246 - RNA, 17 nt, Human
acagagacauuccuccg

SEQ ID NO: 3466247 - RNA, 13 nt, Human
acagagaccaaga

SEQ ID NO: 3466248 - RNA, 15 nt, Human
acagagaggacgugg

SEQ ID NO: 3466249 - RNA, 14 nt, Human
acagagaggagaaa

SEQ ID NO: 3466250 - RNA, 21 nt, Human
acagagagggggccaccuccc

SEQ ID NO: 3466251 - RNA, 22 nt, Human
acagagagucccacugccucag

SEQ ID NO: 3466252 - RNA, 13 nt, Human
acagagaugucuc

SEQ ID NO: 3466253 - RNA, 15 nt, Human
acagagaugucucuu

SEQ ID NO: 3466254 - RNA, 16 nt, Human
acagagauucugaacu

SEQ ID NO: 3466255 - RNA, 17 nt, Human
acagagauugaacucca

SEQ ID NO: 3466256 - RNA, 20 nt, Human
acagagauugaacuccaaga

SEQ ID NO: 3466257 - RNA, 20 nt, Human
acagagcaaccccuggaccc

SEQ ID NO: 3466258 - RNA, 22 nt, Human
acagagcaaccccuggacccca

SEQ ID NO: 3466259 - RNA, 22 nt, Human
acagagcacuagguucaauucc

SEQ ID NO: 3466260 - RNA, 14 nt, Human
acagagcaggacug

SEQ ID NO: 3466261 - RNA, 11 nt, Human
acagagccagg

SEQ ID NO: 3466262 - RNA, 17 nt, Human
acagagccaggagaagc

SEQ ID NO: 3466263 - RNA, 14 nt, Human
acagagcccacgcc

SEQ ID NO: 3466264 - RNA, 19 nt, Human
acagagcccacgcccccac

SEQ ID NO: 3466265 - RNA, 20 nt, Human
acagagcccacgcccccacu

SEQ ID NO: 3466266 - RNA, 12 nt, Human
acagagccugcc

SEQ ID NO: 3466267 - RNA, 21 nt, Human
acagagcgagagucugucuca

SEQ ID NO: 3466268 - RNA, 22 nt, Human
acagagcguggcugugcucuca

SEQ ID NO: 3466269 - RNA, 18 nt, Human
acagagcucuccagcucc

SEQ ID NO: 3466270 - RNA, 21 nt, Human
acagagcugguugggaagaca

SEQ ID NO: 3466271 - RNA, 22 nt, Human
acagagcugucacuuuugcucc

SEQ ID NO: 3466272 - RNA, 12 nt, Human
acagagcugugg

SEQ ID NO: 3466273 - RNA, 14 nt, Human
acagagcuucccug

SEQ ID NO: 3466274 - RNA, 19 nt, Human
acagaggaaacaauauuua

SEQ ID NO: 3466275 - RNA, 23 nt, Human
acagaggaaacaauauuuauaaa

SEQ ID NO: 3466276 - RNA, 16 nt, Human
acagaggacacagaga

SEQ ID NO: 3466277 - RNA, 12 nt, Human
acagaggaccag

SEQ ID NO: 3466278 - RNA, 15 nt, Human
acagaggaccagcac

SEQ ID NO: 3466279 - RNA, 17 nt, Human
acagaggagagucccag

SEQ ID NO: 3466280 - RNA, 15 nt, Human
acagaggcagcccca

SEQ ID NO: 3466281 - RNA, 23 nt, Human
acagaggcagccccauucugccu

SEQ ID NO: 3466282 - RNA, 17 nt, Human
acagaggccccagccuc

SEQ ID NO: 3466283 - RNA, 17 nt, Human
acagaggcuauuguccc

SEQ ID NO: 3466284 - RNA, 20 nt, Human
acagaggggacucugggcua

SEQ ID NO: 3466285 - RNA, 22 nt, Human
acagaggggguggccucccaac

SEQ ID NO: 3466286 - RNA, 19 nt, Human
acagagggucacaguguuu

SEQ ID NO: 3466287 - RNA, 13 nt, Human
acagaguaagaca

SEQ ID NO: 3466288 - RNA, 15 nt, Human
acagaguaaucuugu

SEQ ID NO: 3466289 - RNA, 18 nt, Human
acagagucaaggccugcu

SEQ ID NO: 3466290 - RNA, 12 nt, Human
acagagucucac

SEQ ID NO: 3466291 - RNA, 14 nt, Human
acagagucuuccuc

SEQ ID NO: 3466292 - RNA, 16 nt, Human
acagagugcuuuucug

SEQ ID NO: 3466293 - RNA, 22 nt, Human
acagaguggacuguucccugag

SEQ ID NO: 3466294 - RNA, 14 nt, Human
acagaguggccguc

SEQ ID NO: 3466295 - RNA, 13 nt, Human
acagaguguagcc

SEQ ID NO: 3466296 - RNA, 13 nt, Human
acagaguugauuu

SEQ ID NO: 3466297 - RNA, 15 nt, Human
acagaguuguuacau

SEQ ID NO: 3466298 - RNA, 20 nt, Human
acagaguuguuacauuuuua

SEQ ID NO: 3466299 - RNA, 22 nt, Human
acagaguuguuacauuuuuaag

SEQ ID NO: 3466300 - RNA, 20 nt, Human
acagaguuuucacucuuauu

SEQ ID NO: 3466301 - RNA, 13 nt, Human
acagauaaaaugu

SEQ ID NO: 3466302 - RNA, 14 nt, Human
acagauaaaugauu

SEQ ID NO: 3466303 - RNA, 22 nt, Human
acagauaacauuagguuguccu

SEQ ID NO: 3466304 - RNA, 14 nt, Human
acagauaacugaaa

SEQ ID NO: 3466305 - RNA, 18 nt, Human
acagauaacugaaaauua

SEQ ID NO: 3466306 - RNA, 22 nt, Human
acaugcacuuggcugcauaaau

SEQ ID NO: 3466307 - RNA, 11 nt, Human
acaugcaguuu

SEQ ID NO: 3466308 - RNA, 12 nt, Human
acaugcaguuug

SEQ ID NO: 3466309 - RNA, 22 nt, Human
acaugcaguuugaaauucugaa

SEQ ID NO: 3466310 - RNA, 17 nt, Human
acaugcauacacacaca

SEQ ID NO: 3466311 - RNA, 13 nt, Human
acaugcauauaau

SEQ ID NO: 3466312 - RNA, 16 nt, Human
acaugcauauaaugaa

SEQ ID NO: 3466313 - RNA, 23 nt, Human
acaugcauauaaugaauaaauca

SEQ ID NO: 3466314 - RNA, 16 nt, Human
acaugcauuacugcau

SEQ ID NO: 3466315 - RNA, 20 nt, Human
acaugcauuacugcaugcac

SEQ ID NO: 3466316 - RNA, 21 nt, Human
acaugcauuugaggucaagua

SEQ ID NO: 3466317 - RNA, 16 nt, Human
acaugccucucucagg

SEQ ID NO: 3466318 - RNA, 19 nt, Human
acaugccucucucaggcca

SEQ ID NO: 3466319 - RNA, 20 nt, Human
acaugccucucucaggccaa

SEQ ID NO: 3466320 - RNA, 22 nt, Human
acaugccugccccaaacaaaua

SEQ ID NO: 3466321 - RNA, 21 nt, Human
acaugcgggcugggcagcugu

SEQ ID NO: 3466322 - RNA, 22 nt, Human
acaugcgguagccagcacacag

SEQ ID NO: 3466323 - RNA, 23 nt, Human
acaugcgguagccagcacacagg

SEQ ID NO: 3466324 - RNA, 15 nt, Human
acaugcuacacacug

SEQ ID NO: 3466325 - RNA, 21 nt, Human
acaugcuacacacugcauguu

SEQ ID NO: 3466326 - RNA, 18 nt, Human
acaugcuaggaugcggaa

SEQ ID NO: 3466327 - RNA, 16 nt, Human
acaugcuccagauuag

SEQ ID NO: 3466328 - RNA, 21 nt, Human
acaugcugaacaucacagcuu

SEQ ID NO: 3466329 - RNA, 17 nt, Human
acaugcugaagccaaag

SEQ ID NO: 3466330 - RNA, 19 nt, Human
acaugcuggccagccuggg

SEQ ID NO: 3466331 - RNA, 15 nt, Human
acaugcuuauuccau

SEQ ID NO: 3466332 - RNA, 17 nt, Human
acaugcuuauuccauga

SEQ ID NO: 3466333 - RNA, 23 nt, Human
acaugcuucaugaaaauccuacc

SEQ ID NO: 3466334 - RNA, 20 nt, Human
acaugcuuguguuucuuagu

SEQ ID NO: 3466335 - RNA, 13 nt, Human
acaugcuuuguga

SEQ ID NO: 3466336 - RNA, 21 nt, Human
acauggaaacccauaggccca

SEQ ID NO: 3466337 - RNA, 14 nt, Human
acauggaagggaag

SEQ ID NO: 3466338 - RNA, 18 nt, Human
acauggaauaacauguaa

SEQ ID NO: 3466339 - RNA, 20 nt, Human
acauggaauauauuuuaaua

SEQ ID NO: 3466340 - RNA, 19 nt, Human
acauggaaugaggguuuga

SEQ ID NO: 3466341 - RNA, 19 nt, Human
acauggacccggagcuaac

SEQ ID NO: 3466342 - RNA, 15 nt, Human
acauggacucagaga

SEQ ID NO: 3466343 - RNA, 17 nt, Human
acauggacuuguauauu

SEQ ID NO: 3466344 - RNA, 23 nt, Human
acauggacuuguauauuuguaca

SEQ ID NO: 3466345 - RNA, 15 nt, Human
acauggagacuccug

SEQ ID NO: 3466346 - RNA, 15 nt, Human
acauggagguucuaa

SEQ ID NO: 3466347 - RNA, 19 nt, Human
acauggagguucuaaggcc

SEQ ID NO: 3466348 - RNA, 19 nt, Human
acauggauucaguuucuaa

SEQ ID NO: 3466349 - RNA, 22 nt, Human
acauggcucuggacucuaaaga

SEQ ID NO: 3466350 - RNA, 13 nt, Human
acauggcuuccuc

SEQ ID NO: 3466351 - RNA, 22 nt, Human
acaugggaaacuuccaagaccu

SEQ ID NO: 3466352 - RNA, 15 nt, Human
acaugggacauuugc

SEQ ID NO: 3466353 - RNA, 20 nt, Human
acaugggagccgggucugcc

SEQ ID NO: 3466354 - RNA, 11 nt, Human
acauggggagg

SEQ ID NO: 3466355 - RNA, 18 nt, Human
acauggggcugggcagcu

SEQ ID NO: 3466356 - RNA, 17 nt, Human
acaugggguuggcuggg

SEQ ID NO: 3466357 - RNA, 16 nt, Human
acauggguagcuucug

SEQ ID NO: 3466358 - RNA, 16 nt, Human
acaugggucgcccaug

SEQ ID NO: 3466359 - RNA, 23 nt, Human
acaugguacucuuguugaguucu

SEQ ID NO: 3466360 - RNA, 22 nt, Human
acaugguagccaguugaauuua

SEQ ID NO: 3466361 - RNA, 18 nt, Human
acauggugccccuagcuu

SEQ ID NO: 3466362 - RNA, 19 nt, Human
acauggugccccuagcuuu

SEQ ID NO: 3466363 - RNA, 18 nt, Human
acauggugccugagaggc

SEQ ID NO: 3466364 - RNA, 19 nt, Human
acauggugcuacgccugca

SEQ ID NO: 3466365 - RNA, 23 nt, Human
acaugguggggucuccucaggac

SEQ ID NO: 3466366 - RNA, 18 nt, Human
acaugguggguccauggg

SEQ ID NO: 3466367 - RNA, 19 nt, Human
acaugguggguccaugggc

SEQ ID NO: 3466368 - RNA, 23 nt, Human
acaugguuacaaucauugcugaa

SEQ ID NO: 3466369 - RNA, 19 nt, Human
acaugguuaccaugucuuu

SEQ ID NO: 3466370 - RNA, 20 nt, Human
acaugguugugaccugagga

SEQ ID NO: 3466371 - RNA, 14 nt, Human
acaugguuuaaaag

SEQ ID NO: 3466372 - RNA, 21 nt, Human
acaugguuuaaaagaaaaaau

SEQ ID NO: 3466373 - RNA, 15 nt, Human
acauguaauuaagua

SEQ ID NO: 3466374 - RNA, 11 nt, Human
acauguacaga

SEQ ID NO: 3466375 - RNA, 17 nt, Human
acauguaggaaguagga

SEQ ID NO: 3466376 - RNA, 18 nt, Human
acauguaucuaugcauuu

SEQ ID NO: 3466377 - RNA, 15 nt, Human
acauguauuauuuca

SEQ ID NO: 3466378 - RNA, 13 nt, Human
acauguauuuaug

SEQ ID NO: 3466379 - RNA, 15 nt, Human
acauguauuuaugua

SEQ ID NO: 3466380 - RNA, 16 nt, Human
acauguauuuguuugc

SEQ ID NO: 3466381 - RNA, 15 nt, Human
acaugucaaucuguc

SEQ ID NO: 3466382 - RNA, 23 nt, Human
acaugucaccguggaccuuccug

SEQ ID NO: 3466383 - RNA, 18 nt, Human
acaugucaguaccuucaa

SEQ ID NO: 3466384 - RNA, 19 nt, Human
acaugucaguaccuucaaa

SEQ ID NO: 3466385 - RNA, 21 nt, Human
acaugucaguaccuucaaacu

SEQ ID NO: 3466386 - RNA, 14 nt, Human
agaaugaguuucuu

SEQ ID NO: 3466387 - RNA, 15 nt, Human
agaaugaguuucuua

SEQ ID NO: 3466388 - RNA, 16 nt, Human
agaaugaucugauuga

SEQ ID NO: 3466389 - RNA, 13 nt, Human
agaaugaugcuca

SEQ ID NO: 3466390 - RNA, 21 nt, Human
agaaugaugguuuccaauuuc

SEQ ID NO: 3466391 - RNA, 16 nt, Human
agaaugauuuuuagau

SEQ ID NO: 3466392 - RNA, 20 nt, Human
agaaugcacaagaauggauc

SEQ ID NO: 3466393 - RNA, 16 nt, Human
agaaugcaugcuuucc

SEQ ID NO: 3466394 - RNA, 23 nt, Human
agaaugcaugcuuuccauauuuu

SEQ ID NO: 3466395 - RNA, 17 nt, Human
agaaugcugaaaccaag

SEQ ID NO: 3466396 - RNA, 14 nt, Human
agaaugcuguacau

SEQ ID NO: 3466397 - RNA, 20 nt, Human
agaaugcuuaaucagauaga

SEQ ID NO: 3466398 - RNA, 23 nt, Human
agaauggaaaccacaacuuuuaa

SEQ ID NO: 3466399 - RNA, 15 nt, Human
agaauggagaggaac

SEQ ID NO: 3466400 - RNA, 18 nt, Human
agaauggauaaaauaaug

SEQ ID NO: 3466401 - RNA, 16 nt, Human
agaauggcagaaaagu

SEQ ID NO: 3466402 - RNA, 18 nt, Human
agaauggcuuuggucucu

SEQ ID NO: 3466403 - RNA, 23 nt, Human
agaauggcuuuggucucuugcuu

SEQ ID NO: 3466404 - RNA, 16 nt, Human
agaaugggcaguuaca

SEQ ID NO: 3466405 - RNA, 19 nt, Human
agaaugggcaguuacaugc

SEQ ID NO: 3466406 - RNA, 21 nt, Human
agaaugguccgugcuaaggac

SEQ ID NO: 3466407 - RNA, 14 nt, Human
agaauggugauuuu

SEQ ID NO: 3466408 - RNA, 21 nt, Human
agaauggugauuuuaaaugug

SEQ ID NO: 3466409 - RNA, 23 nt, Human
agaauggugugggagagggauga

SEQ ID NO: 3466410 - RNA, 21 nt, Human
agaaugguugccuuaaagaaa

SEQ ID NO: 3466411 - RNA, 16 nt, Human
agaauguaaaagaacu

SEQ ID NO: 3466412 - RNA, 12 nt, Human
agaauguaaagc

SEQ ID NO: 3466413 - RNA, 14 nt, Human
agaauguaaauguc

SEQ ID NO: 3466414 - RNA, 19 nt, Human
agaauguaaaugucucacu

SEQ ID NO: 3466415 - RNA, 15 nt, Human
agaauguaagaacua

SEQ ID NO: 3466416 - RNA, 16 nt, Human
agaauguaagaacuac

SEQ ID NO: 3466417 - RNA, 21 nt, Human
agaauguaagguauaucauuc

SEQ ID NO: 3466418 - RNA, 14 nt, Human
agaauguaguuuga

SEQ ID NO: 3466419 - RNA, 18 nt, Human
agaauguaguuugaggaa

SEQ ID NO: 3466420 - RNA, 17 nt, Human
agaauguaucugugaag

SEQ ID NO: 3466421 - RNA, 17 nt, Human
agaaugucagaaaaaca

SEQ ID NO: 3466422 - RNA, 17 nt, Human
agaaugucaguaugugg

SEQ ID NO: 3466423 - RNA, 23 nt, Human
agaaugucauuuugguacuuugg

SEQ ID NO: 3466424 - RNA, 18 nt, Human
agaauguguuucaaacug

SEQ ID NO: 3466425 - RNA, 18 nt, Human
agaauguguuuucugaau

SEQ ID NO: 3466426 - RNA, 15 nt, Human
agaauguuagagcac

SEQ ID NO: 3466427 - RNA, 15 nt, Human
agaauguuagaguaa

SEQ ID NO: 3466428 - RNA, 19 nt, Human
agaauguugaauacuuaua

SEQ ID NO: 3466429 - RNA, 18 nt, Human
agaauguuguauucagug

SEQ ID NO: 3466430 - RNA, 15 nt, Human
agaauguuucauuug

SEQ ID NO: 3466431 - RNA, 18 nt, Human
agaauuaaacuuuuaauu

SEQ ID NO: 3466432 - RNA, 20 nt, Human
agaauuaaacuuuuaauuca

SEQ ID NO: 3466433 - RNA, 21 nt, Human
agaauuaaacuuuuaauucau

SEQ ID NO: 3466434 - RNA, 17 nt, Human
agaauuaacagagauug

SEQ ID NO: 3466435 - RNA, 20 nt, Human
agaauuagauuucuauagga

SEQ ID NO: 3466436 - RNA, 16 nt, Human
agaauuagcuuuuuca

SEQ ID NO: 3466437 - RNA, 22 nt, Human
agaauuagcuuuuucauccccu

SEQ ID NO: 3466438 - RNA, 14 nt, Human
agaauuaucuaauu

SEQ ID NO: 3466439 - RNA, 15 nt, Human
agaauuaucuaauuu

SEQ ID NO: 3466440 - RNA, 18 nt, Human
agaauuaucuaauuuaua

SEQ ID NO: 3466441 - RNA, 21 nt, Human
agaauuauuucacaaauaaua

SEQ ID NO: 3466442 - RNA, 23 nt, Human
agaauuauuuuuaaaaagaaauc

SEQ ID NO: 3466443 - RNA, 20 nt, Human
agaauucaaacuggggccuc

SEQ ID NO: 3466444 - RNA, 18 nt, Human
agaauucauucauacuua

SEQ ID NO: 3466445 - RNA, 15 nt, Human
agaauucccagcugu

SEQ ID NO: 3466446 - RNA, 19 nt, Human
agaauucccucucucugac

SEQ ID NO: 3466447 - RNA, 14 nt, Human
agaauucucuaguu

SEQ ID NO: 3466448 - RNA, 18 nt, Human
agaauucucuaguuugau

SEQ ID NO: 3466449 - RNA, 18 nt, Human
agaauucugauugauuug

SEQ ID NO: 3466450 - RNA, 23 nt, Human
agaauucugauugauuugauugg

SEQ ID NO: 3466451 - RNA, 13 nt, Human
agaauucugcuac

SEQ ID NO: 3466452 - RNA, 22 nt, Human
agaauucugcuaccucacuggg

SEQ ID NO: 3466453 - RNA, 17 nt, Human
agaauucuuacauguuu

SEQ ID NO: 3466454 - RNA, 19 nt, Human
agaauucuuacauguuuuc

SEQ ID NO: 3466455 - RNA, 13 nt, Human
agaauucuuucaa

SEQ ID NO: 3466456 - RNA, 14 nt, Human
agaauucuuucaag

SEQ ID NO: 3466457 - RNA, 18 nt, Human
agaauugaacccaggagg

SEQ ID NO: 3466458 - RNA, 22 nt, Human
agaauugaacccaggaggugga

SEQ ID NO: 3466459 - RNA, 14 nt, Human
agaauugaagguuu

SEQ ID NO: 3466460 - RNA, 20 nt, Human
agaauugaagguuuuugaua

SEQ ID NO: 3466461 - RNA, 21 nt, Human
agaauugaagguuuuugauag

SEQ ID NO: 3466462 - RNA, 17 nt, Human
agaauugaguguuuaaa

SEQ ID NO: 3466463 - RNA, 22 nt, Human
agaauugaucauuuucccccca

SEQ ID NO: 3466464 - RNA, 16 nt, Human
agaauugauugggcac

SEQ ID NO: 3466465 - RNA, 15 nt, Human
agaauugcaaucuau

SEQ ID NO: 3466466 - RNA, 22 nt, Human
agaauugcugauucuugaguuu

SEQ ID NO: 3466467 - RNA, 12 nt, Human
agaauuggaaaa

SEQ ID NO: 3466468 - RNA, 13 nt, Human
agaauuggcucaa

SEQ ID NO: 3466469 - RNA, 15 nt, Human
agaauuguaucauuu

SEQ ID NO: 3466470 - RNA, 11 nt, Human
agaauuguuau

SEQ ID NO: 3466471 - RNA, 15 nt, Human
agaauuguuuagauu

SEQ ID NO: 3466472 - RNA, 14 nt, Human
agaauuuagggaga

SEQ ID NO: 3466473 - RNA, 19 nt, Human
agaauuuagggagaaaugu

SEQ ID NO: 3466474 - RNA, 15 nt, Human
agaauuuagguuuuu

SEQ ID NO: 3466475 - RNA, 19 nt, Human
agaauuuaguauuaucaaa

SEQ ID NO: 3466476 - RNA, 18 nt, Human
agaauuucccaaagcagu

SEQ ID NO: 3466477 - RNA, 23 nt, Human
agaauuucccaaagcagugcaug

SEQ ID NO: 3466478 - RNA, 21 nt, Human
agaauuucuugguaagaagcc

SEQ ID NO: 3466479 - RNA, 22 nt, Human
agaauuugaagacuucaaaaua

SEQ ID NO: 3466480 - RNA, 18 nt, Human
agaauuugauaugugaac

SEQ ID NO: 3466481 - RNA, 17 nt, Human
agaauuugcauacuuac

SEQ ID NO: 3466482 - RNA, 16 nt, Human
agaauuuggaaauccu

SEQ ID NO: 3466483 - RNA, 22 nt, Human
agaauuuggaaauccuaguuuc

SEQ ID NO: 3466484 - RNA, 15 nt, Human
agaauuuguguugaa

SEQ ID NO: 3466485 - RNA, 18 nt, Human
agaauuuuaaaaaugaau

SEQ ID NO: 3466486 - RNA, 20 nt, Human
agaauuuuaaaaaugaaucc

SEQ ID NO: 3466487 - RNA, 18 nt, Human
agaauuuuaaauuauaac

SEQ ID NO: 3466488 - RNA, 16 nt, Human
agaauuuuaagccuuu

SEQ ID NO: 3466489 - RNA, 22 nt, Human
agaauuuuaggaacuucagaga

SEQ ID NO: 3466490 - RNA, 22 nt, Human
agaauuuuauacuuucccuacc

SEQ ID NO: 3466491 - RNA, 20 nt, Human
agaauuuucagaccccagcg

SEQ ID NO: 3466492 - RNA, 22 nt, Human
agaauuuuccugagacaaauuu

SEQ ID NO: 3466493 - RNA, 20 nt, Human
agaauuuuuuuuguuguuuc

SEQ ID NO: 3466494 - RNA, 16 nt, Human
agacaaaaacagccuc

SEQ ID NO: 3466495 - RNA, 18 nt, Human
agacaaaaagacaaacau

SEQ ID NO: 3466496 - RNA, 19 nt, Human
agacaaaaaguauauuaaa

SEQ ID NO: 3466497 - RNA, 23 nt, Human
agacaaaaaguauauuaaacaaa

SEQ ID NO: 3466498 - RNA, 17 nt, Human
agacaaaagucugucuu

SEQ ID NO: 3466499 - RNA, 22 nt, Human
agacaaaagucugucuuuccug

SEQ ID NO: 3466500 - RNA, 16 nt, Human
agacaaaauggauaca

SEQ ID NO: 3466501 - RNA, 16 nt, Human
agacaaaccagaagca

SEQ ID NO: 3466502 - RNA, 21 nt, Human
agacaaacuuugcaucucagu

SEQ ID NO: 3466503 - RNA, 13 nt, Human
agacaaauacuca

SEQ ID NO: 3466504 - RNA, 14 nt, Human
agacaaauacucau

SEQ ID NO: 3466505 - RNA, 12 nt, Human
agacaaauagua

SEQ ID NO: 3466506 - RNA, 15 nt, Human
agacaaauauuugga

SEQ ID NO: 3466507 - RNA, 17 nt, Human
agacaaaucaacagaag

SEQ ID NO: 3466508 - RNA, 14 nt, Human
agacaaauggagga

SEQ ID NO: 3466509 - RNA, 14 nt, Human
agacaacagaaguc

SEQ ID NO: 3466510 - RNA, 21 nt, Human
agacaacgugcucuuuguuuu

SEQ ID NO: 3466511 - RNA, 23 nt, Human
agacaacgugcucuuuguuuugu

SEQ ID NO: 3466512 - RNA, 15 nt, Human
agacaagaagcaaau

SEQ ID NO: 3466513 - RNA, 15 nt, Human
agacaagacuucagu

SEQ ID NO: 3466514 - RNA, 19 nt, Human
agacaagacuucaguaugu

SEQ ID NO: 3466515 - RNA, 16 nt, Human
agacaagauauuguac

SEQ ID NO: 3466516 - RNA, 18 nt, Human
agacaagauauuguacau

SEQ ID NO: 3466517 - RNA, 19 nt, Human
agacaagauauuguacaua

SEQ ID NO: 3466518 - RNA, 20 nt, Human
agacaagauuuuuuaauugu

SEQ ID NO: 3466519 - RNA, 22 nt, Human
agacaagauuuuuuaauuguuu

SEQ ID NO: 3466520 - RNA, 17 nt, Human
agacaagccagaacuug

SEQ ID NO: 3466521 - RNA, 17 nt, Human
agacaagccuggccuac

SEQ ID NO: 3466522 - RNA, 13 nt, Human
agacaaggaaaua

SEQ ID NO: 3466523 - RNA, 15 nt, Human
agacaaguaauuuca

SEQ ID NO: 3466524 - RNA, 22 nt, Human
agacaaguaauuucaguguaaa

SEQ ID NO: 3466525 - RNA, 23 nt, Human
agacaagugacuguaucugugua

SEQ ID NO: 3466526 - RNA, 18 nt, Human
agacaauagcauuagaaa

SEQ ID NO: 3466527 - RNA, 15 nt, Human
agacaaucauuguuu

SEQ ID NO: 3466528 - RNA, 15 nt, Human
agacaaucuucuguu

SEQ ID NO: 3466529 - RNA, 21 nt, Human
agacaaugacuuacuguacau

SEQ ID NO: 3466530 - RNA, 14 nt, Human
agacaauucuuuau

SEQ ID NO: 3466531 - RNA, 18 nt, Human
agacaauucuuuauacaa

SEQ ID NO: 3466532 - RNA, 16 nt, Human
agacaauugacaacag

SEQ ID NO: 3466533 - RNA, 14 nt, Human
agacaauuuauuau

SEQ ID NO: 3466534 - RNA, 15 nt, Human
agacaauuuauuaug

SEQ ID NO: 3466535 - RNA, 15 nt, Human
agacugcacccagga

SEQ ID NO: 3466536 - RNA, 18 nt, Human
agacugcacccaggaggg

SEQ ID NO: 3466537 - RNA, 18 nt, Human
agacugcagguuggaccc

SEQ ID NO: 3466538 - RNA, 12 nt, Human
agacugccagcu

SEQ ID NO: 3466539 - RNA, 20 nt, Human
agacugcuccugagccccca

SEQ ID NO: 3466540 - RNA, 21 nt, Human
agacugcuccugagcccccag

SEQ ID NO: 3466541 - RNA, 23 nt, Human
agacugcuccugagcccccagcu

SEQ ID NO: 3466542 - RNA, 20 nt, Human
agacugcugggacuggccag

SEQ ID NO: 3466543 - RNA, 19 nt, Human
agacugcuguggccaggag

SEQ ID NO: 3466544 - RNA, 20 nt, Human
agacugcuguggccaggagg

SEQ ID NO: 3466545 - RNA, 20 nt, Human
agacugcuguguuugagcuc

SEQ ID NO: 3466546 - RNA, 16 nt, Human
agacugcuucccaucc

SEQ ID NO: 3466547 - RNA, 17 nt, Human
agacugcuucccauccu

SEQ ID NO: 3466548 - RNA, 14 nt, Human
agacuggaaaaaau

SEQ ID NO: 3466549 - RNA, 17 nt, Human
agacuggaacuugaacu

SEQ ID NO: 3466550 - RNA, 20 nt, Human
agacuggaagcuaauuugca

SEQ ID NO: 3466551 - RNA, 11 nt, Human
agacuggacag

SEQ ID NO: 3466552 - RNA, 15 nt, Human
agacuggacagcuug

SEQ ID NO: 3466553 - RNA, 23 nt, Human
agacuggaggggacgcugguaga

SEQ ID NO: 3466554 - RNA, 15 nt, Human
agacuggauacugcc

SEQ ID NO: 3466555 - RNA, 20 nt, Human
agacuggauaguccgucucu

SEQ ID NO: 3466556 - RNA, 18 nt, Human
agacuggcacaguuuucu

SEQ ID NO: 3466557 - RNA, 20 nt, Human
agacuggcacaguuuucuga

SEQ ID NO: 3466558 - RNA, 11 nt, Human
agacuggccug

SEQ ID NO: 3466559 - RNA, 17 nt, Human
agacuggcgugaaccca

SEQ ID NO: 3466560 - RNA, 14 nt, Human
agacuggcuggcug

SEQ ID NO: 3466561 - RNA, 20 nt, Human
agacuggcuggcugcaguga

SEQ ID NO: 3466562 - RNA, 20 nt, Human
agacugggcugagggagccu

SEQ ID NO: 3466563 - RNA, 18 nt, Human
agacuggguaggaaagag

SEQ ID NO: 3466564 - RNA, 18 nt, Human
agacugguccugugugca

SEQ ID NO: 3466565 - RNA, 18 nt, Human
agacuggugagcagacug

SEQ ID NO: 3466566 - RNA, 22 nt, Human
agacugguuuauccacccacaa

SEQ ID NO: 3466567 - RNA, 14 nt, Human
agacugguuuucug

SEQ ID NO: 3466568 - RNA, 21 nt, Human
agacuguaacuuccaaauaaa

SEQ ID NO: 3466569 - RNA, 16 nt, Human
agacuguagaagaaag

SEQ ID NO: 3466570 - RNA, 20 nt, Human
agacuguaggaagaguagca

SEQ ID NO: 3466571 - RNA, 22 nt, Human
agacuguaggaagaguagcauu

SEQ ID NO: 3466572 - RNA, 14 nt, Human
agacugucucaaga

SEQ ID NO: 3466573 - RNA, 18 nt, Human
agacugugacaacugucu

SEQ ID NO: 3466574 - RNA, 14 nt, Human
agacuguggcugcu

SEQ ID NO: 3466575 - RNA, 11 nt, Human
agacuguguau

SEQ ID NO: 3466576 - RNA, 23 nt, Human
agacugugugugcccucugggcu

SEQ ID NO: 3466577 - RNA, 17 nt, Human
agacuguguuugguccu

SEQ ID NO: 3466578 - RNA, 23 nt, Human
agacuguguuugguccuguagga

SEQ ID NO: 3466579 - RNA, 23 nt, Human
agacuguugcucaaaucuauuca

SEQ ID NO: 3466580 - RNA, 11 nt, Human
agacuguuggg

SEQ ID NO: 3466581 - RNA, 19 nt, Human
agacuguugucccugcacu

SEQ ID NO: 3466582 - RNA, 21 nt, Human
agacuuaaagggcccaaugaa

SEQ ID NO: 3466583 - RNA, 15 nt, Human
agacuuacucuaaga

SEQ ID NO: 3466584 - RNA, 20 nt, Human
agacuuacuuuacucauuuu

SEQ ID NO: 3466585 - RNA, 17 nt, Human
agacuuagggcaccagg

SEQ ID NO: 3466586 - RNA, 17 nt, Human
agacuucaaaauauuga

SEQ ID NO: 3466587 - RNA, 20 nt, Human
agacuucaaaauauugagca

SEQ ID NO: 3466588 - RNA, 15 nt, Human
agacuucacacugca

SEQ ID NO: 3466589 - RNA, 21 nt, Human
agacuucaguauguugucaaa

SEQ ID NO: 3466590 - RNA, 15 nt, Human
agacuuccaaagaau

SEQ ID NO: 3466591 - RNA, 15 nt, Human
agacuuccagagccu

SEQ ID NO: 3466592 - RNA, 14 nt, Human
agacuucccagcua

SEQ ID NO: 3466593 - RNA, 16 nt, Human
agacuucccuaacacu

SEQ ID NO: 3466594 - RNA, 16 nt, Human
agacuuccuugagaca

SEQ ID NO: 3466595 - RNA, 16 nt, Human
agacuucucuuugccu

SEQ ID NO: 3466596 - RNA, 19 nt, Human
agacuucucuuugccucaa

SEQ ID NO: 3466597 - RNA, 20 nt, Human
agacuucucuuugccucaaa

SEQ ID NO: 3466598 - RNA, 18 nt, Human
agacuucugcuuuccaca

SEQ ID NO: 3466599 - RNA, 17 nt, Human
agacuugaaaagagaca

SEQ ID NO: 3466600 - RNA, 19 nt, Human
agacuugaaaagagacagg

SEQ ID NO: 3466601 - RNA, 21 nt, Human
agacuugaaaagagacaggca

SEQ ID NO: 3466602 - RNA, 17 nt, Human
agacuugaaagaaaggg

SEQ ID NO: 3466603 - RNA, 14 nt, Human
agacuugaaauacu

SEQ ID NO: 3466604 - RNA, 14 nt, Human
agacuugacagugg

SEQ ID NO: 3466605 - RNA, 20 nt, Human
agacuugcugaaucggaauc

SEQ ID NO: 3466606 - RNA, 21 nt, Human
agacuuggauucuuuccauuu

SEQ ID NO: 3466607 - RNA, 17 nt, Human
agacuuggcaacagaag

SEQ ID NO: 3466608 - RNA, 22 nt, Human
agacuugguguccuuucccucc

SEQ ID NO: 3466609 - RNA, 16 nt, Human
agacuuguauauucua

SEQ ID NO: 3466610 - RNA, 18 nt, Human
agacuuguaugaaagaug

SEQ ID NO: 3466611 - RNA, 16 nt, Human
agacuuguuggcguag

SEQ ID NO: 3466612 - RNA, 21 nt, Human
agacuuguuggcguaggcuac

SEQ ID NO: 3466613 - RNA, 14 nt, Human
agacuuuaaaagca

SEQ ID NO: 3466614 - RNA, 14 nt, Human
agacuuuaaagaau

SEQ ID NO: 3466615 - RNA, 19 nt, Human
agacuuuacaugacacagc

SEQ ID NO: 3466616 - RNA, 20 nt, Human
agacuuuacaugacacagcu

SEQ ID NO: 3466617 - RNA, 12 nt, Human
agacuuuagaaa

SEQ ID NO: 3466618 - RNA, 22 nt, Human
agacuuuaggcuuucagcuuac

SEQ ID NO: 3466619 - RNA, 21 nt, Human
agacuuucuuuaaauuauguu

SEQ ID NO: 3466620 - RNA, 22 nt, Human
agacuuugcuaaagacaugaag

SEQ ID NO: 3466621 - RNA, 12 nt, Human
agacuuuggaaa

SEQ ID NO: 3466622 - RNA, 14 nt, Human
agacuuuggaaaau

SEQ ID NO: 3466623 - RNA, 22 nt, Human
agacuuuggaaaaugcauugua

SEQ ID NO: 3466624 - RNA, 14 nt, Human
agacuuuggaaaga

SEQ ID NO: 3466625 - RNA, 17 nt, Human
agacuuuggaaagacuu

SEQ ID NO: 3466626 - RNA, 15 nt, Human
agacuuuggaaagag

SEQ ID NO: 3466627 - RNA, 19 nt, Human
agacuuuggaaagaguagg

SEQ ID NO: 3466628 - RNA, 18 nt, Human
agacuuuuaaucagacaa

SEQ ID NO: 3466629 - RNA, 15 nt, Human
agacuuuuccaaccc

SEQ ID NO: 3466630 - RNA, 19 nt, Human
agacuuuuccaauauguga

SEQ ID NO: 3466631 - RNA, 13 nt, Human
agacuuuucuuug

SEQ ID NO: 3466632 - RNA, 22 nt, Human
agacuuuuguacaucuggcuua

SEQ ID NO: 3466633 - RNA, 12 nt, Human
agacuuuuuggu

SEQ ID NO: 3466634 - RNA, 23 nt, Human
agacuuuuugguggauguaaaua

SEQ ID NO: 3466635 - RNA, 16 nt, Human
agagaaaaaaaaaaua

SEQ ID NO: 3466636 - RNA, 18 nt, Human
agagaaaaaaaaaauagu

SEQ ID NO: 3466637 - RNA, 13 nt, Human
agagaaaaacaaa

SEQ ID NO: 3466638 - RNA, 16 nt, Human
agagaaaacuaaagaa

SEQ ID NO: 3466639 - RNA, 18 nt, Human
agagaaaacuuauuugag

SEQ ID NO: 3466640 - RNA, 10 nt, Human
agagaaaaga

SEQ ID NO: 3466641 - RNA, 11 nt, Human
agagaaaagaa

SEQ ID NO: 3466642 - RNA, 12 nt, Human
agagaaaauaaa

SEQ ID NO: 3466643 - RNA, 17 nt, Human
agagaaaauaaaaaguu

SEQ ID NO: 3466644 - RNA, 18 nt, Human
agagaaaauaaaaaguua

SEQ ID NO: 3466645 - RNA, 16 nt, Human
agagaaaauauaugua

SEQ ID NO: 3466646 - RNA, 13 nt, Human
agagaaaauugaa

SEQ ID NO: 3466647 - RNA, 22 nt, Human
agagaaacacugaaaagaagga

SEQ ID NO: 3466648 - RNA, 12 nt, Human
agagaaaccagc

SEQ ID NO: 3466649 - RNA, 15 nt, Human
agagaaaccagcuuc

SEQ ID NO: 3466650 - RNA, 22 nt, Human
agagaaaccagcuuccuucaga

SEQ ID NO: 3466651 - RNA, 13 nt, Human
agagaaacuuuau

SEQ ID NO: 3466652 - RNA, 13 nt, Human
agagaaagccagg

SEQ ID NO: 3466653 - RNA, 22 nt, Human
agagaaagccaggcagguagcc

SEQ ID NO: 3466654 - RNA, 19 nt, Human
agagaaaggccugcacaca

SEQ ID NO: 3466655 - RNA, 18 nt, Human
agagaaaggggagcccac

SEQ ID NO: 3466656 - RNA, 19 nt, Human
agagaaaggggagcccacu

SEQ ID NO: 3466657 - RNA, 19 nt, Human
agagaaagugauuucuaga

SEQ ID NO: 3466658 - RNA, 14 nt, Human
agagaaauauuuua

SEQ ID NO: 3466659 - RNA, 12 nt, Human
agagaaaugaaa

SEQ ID NO: 3466660 - RNA, 14 nt, Human
agagaacccagccc

SEQ ID NO: 3466661 - RNA, 15 nt, Human
agagaaccgagcaaa

SEQ ID NO: 3466662 - RNA, 20 nt, Human
agagaaccucacgcaccucc

SEQ ID NO: 3466663 - RNA, 16 nt, Human
agagaacuaacacuau

SEQ ID NO: 3466664 - RNA, 14 nt, Human
agagaacuguggcc

SEQ ID NO: 3466665 - RNA, 13 nt, Human
agagaagaaagaa

SEQ ID NO: 3466666 - RNA, 16 nt, Human
agagaagaagaaaaaa

SEQ ID NO: 3466667 - RNA, 11 nt, Human
agagaagacaa

SEQ ID NO: 3466668 - RNA, 16 nt, Human
agagaagacaggcugg

SEQ ID NO: 3466669 - RNA, 16 nt, Human
agagaagacccuucuc

SEQ ID NO: 3466670 - RNA, 10 nt, Human
agagaagaga

SEQ ID NO: 3466671 - RNA, 21 nt, Human
agagaagagauugugguuuca

SEQ ID NO: 3466672 - RNA, 14 nt, Human
agagaagagcccca

SEQ ID NO: 3466673 - RNA, 15 nt, Human
agagaagagccccac

SEQ ID NO: 3466674 - RNA, 21 nt, Human
agagaagagccccacucucag

SEQ ID NO: 3466675 - RNA, 12 nt, Human
agagaagaggcu

SEQ ID NO: 3466676 - RNA, 13 nt, Human
agagaagcaauuu

SEQ ID NO: 3466677 - RNA, 13 nt, Human
agagaagccauca

SEQ ID NO: 3466678 - RNA, 22 nt, Human
agagaagccaucaccucagaug

SEQ ID NO: 3466679 - RNA, 13 nt, Human
agagaagccccuu

SEQ ID NO: 3466680 - RNA, 12 nt, Human
agagaagccuuc

SEQ ID NO: 3466681 - RNA, 17 nt, Human
agagaagccuucaagcu

SEQ ID NO: 3466682 - RNA, 23 nt, Human
agagaagccuucaagcucugagg

SEQ ID NO: 3466683 - RNA, 17 nt, Human
agagaagcggauuucca

SEQ ID NO: 3466684 - RNA, 20 nt, Human
agagaagcuaaaaccugagc

SEQ ID NO: 3466685 - RNA, 12 nt, Human
agagaagcugcu

SEQ ID NO: 3466686 - RNA, 13 nt, Human
agagaagcugcug

SEQ ID NO: 3466687 - RNA, 13 nt, Human
agagaaggaaugu

SEQ ID NO: 3466688 - RNA, 13 nt, Human
agagaaggagcag

SEQ ID NO: 3466689 - RNA, 12 nt, Human
agagaaggcagg

SEQ ID NO: 3466690 - RNA, 20 nt, Human
agagaaggcaggaaugugug

SEQ ID NO: 3466691 - RNA, 22 nt, Human
agagaaggggaagcacucgugu

SEQ ID NO: 3466692 - RNA, 18 nt, Human
agagaaggggugugcaug

SEQ ID NO: 3466693 - RNA, 18 nt, Human
agagaaguauacauaagu

SEQ ID NO: 3466694 - RNA, 15 nt, Human
agagaagucacaggg

SEQ ID NO: 3466695 - RNA, 18 nt, Human
agagaagugacgguuccu

SEQ ID NO: 3466696 - RNA, 22 nt, Human
agagaaguggacuggaggagcu

SEQ ID NO: 3466697 - RNA, 23 nt, Human
agagaauauaacaugaaaugaua

SEQ ID NO: 3466698 - RNA, 22 nt, Human
agagaauaugucugcuccuuuc

SEQ ID NO: 3466699 - RNA, 22 nt, Human
agagaauauuagcuuuacuguu

SEQ ID NO: 3466700 - RNA, 14 nt, Human
agagaaugagaaau

SEQ ID NO: 3466701 - RNA, 18 nt, Human
agagaaugaguccuugau

SEQ ID NO: 3466702 - RNA, 16 nt, Human
agagaaugaugcucaa

SEQ ID NO: 3466703 - RNA, 20 nt, Human
agagaaugcacagauauacu

SEQ ID NO: 3466704 - RNA, 21 nt, Human
agagaaugcccuucuccuuau

SEQ ID NO: 3466705 - RNA, 17 nt, Human
agagaauguagauauug

SEQ ID NO: 3466706 - RNA, 15 nt, Human
agagaauuaaacgaa

SEQ ID NO: 3466707 - RNA, 16 nt, Human
agagaauuagauuaua

SEQ ID NO: 3466708 - RNA, 15 nt, Human
agagaauuggcucaa

SEQ ID NO: 3466709 - RNA, 19 nt, Human
agagacaaacaccucccag

SEQ ID NO: 3466710 - RNA, 21 nt, Human
agagacaaacaccucccagga

SEQ ID NO: 3466711 - RNA, 18 nt, Human
agagacaaacuguaaaaa

SEQ ID NO: 3466712 - RNA, 15 nt, Human
agagacacaagccuu

SEQ ID NO: 3466713 - RNA, 16 nt, Human
agagacacacugaaga

SEQ ID NO: 3466714 - RNA, 20 nt, Human
agagacacacugaagaagca

SEQ ID NO: 3466715 - RNA, 16 nt, Human
agagacacuggugggg

SEQ ID NO: 3466716 - RNA, 20 nt, Human
agagacacuguugauaaaaa

SEQ ID NO: 3466717 - RNA, 14 nt, Human
agagacagaaagca

SEQ ID NO: 3466718 - RNA, 12 nt, Human
agagacagaaug

SEQ ID NO: 3466719 - RNA, 17 nt, Human
agagacagacuugagaa

SEQ ID NO: 3466720 - RNA, 18 nt, Human
agagacagauaccuccaa

SEQ ID NO: 3466721 - RNA, 15 nt, Human
agagacaggagggca

SEQ ID NO: 3466722 - RNA, 15 nt, Human
agagacaugcagaga

SEQ ID NO: 3466723 - RNA, 15 nt, Human
agagacauggcuuuc

SEQ ID NO: 3466724 - RNA, 14 nt, Human
agagacauuccucc

SEQ ID NO: 3466725 - RNA, 19 nt, Human
agagaccaggcaaagcaag

SEQ ID NO: 3466726 - RNA, 16 nt, Human
agagaccaggcccugg

SEQ ID NO: 3466727 - RNA, 13 nt, Human
agagaccaucccu

SEQ ID NO: 3466728 - RNA, 15 nt, Human
agagaccaucccuga

SEQ ID NO: 3466729 - RNA, 19 nt, Human
agagaccaucccugaaggc

SEQ ID NO: 3466730 - RNA, 22 nt, Human
agagaccaucccugaaggcccc

SEQ ID NO: 3466731 - RNA, 14 nt, Human
agagacccaaggag

SEQ ID NO: 3466732 - RNA, 23 nt, Human
agagacccucugccaccagagac

SEQ ID NO: 3466733 - RNA, 22 nt, Human
agagaccuguuuuaaaaaggaa

SEQ ID NO: 3466734 - RNA, 22 nt, Human
agagacuauggagccuggcaca

SEQ ID NO: 3466735 - RNA, 19 nt, Human
agagacucagggccccagc

SEQ ID NO: 3466736 - RNA, 17 nt, Human
agagacucccaugaagc

SEQ ID NO: 3466737 - RNA, 21 nt, Human
agagacucccaugaagccuuu

SEQ ID NO: 3466738 - RNA, 19 nt, Human
agagacuccugcaggcagc

SEQ ID NO: 3466739 - RNA, 15 nt, Human
agagacugcguucug

SEQ ID NO: 3466740 - RNA, 17 nt, Human
agagacugcguucugca

SEQ ID NO: 3466741 - RNA, 18 nt, Human
agagacugcguucugcaa

SEQ ID NO: 3466742 - RNA, 14 nt, Human
agagacuggagcau

SEQ ID NO: 3466743 - RNA, 22 nt, Human
agagacuguagauugcuucugu

SEQ ID NO: 3466744 - RNA, 20 nt, Human
agagacuugggacauugccu

SEQ ID NO: 3466745 - RNA, 19 nt, Human
agagacuuuuaaucagaca

SEQ ID NO: 3466746 - RNA, 14 nt, Human
agagagaaaaacaa

SEQ ID NO: 3466747 - RNA, 10 nt, Human
agaggagaga

SEQ ID NO: 3466748 - RNA, 15 nt, Human
agaggagagaggacc

SEQ ID NO: 3466749 - RNA, 13 nt, Human
agaggagagaggc

SEQ ID NO: 3466750 - RNA, 15 nt, Human
agaggagagaggcag

SEQ ID NO: 3466751 - RNA, 15 nt, Human
agaggagcccucauc

SEQ ID NO: 3466752 - RNA, 14 nt, Human
agaggagcccugcc

SEQ ID NO: 3466753 - RNA, 23 nt, Human
agaggagcccugccucuccgccc

SEQ ID NO: 3466754 - RNA, 11 nt, Human
agaggagccuu

SEQ ID NO: 3466755 - RNA, 21 nt, Human
agaggagcgggaccuguggcu

SEQ ID NO: 3466756 - RNA, 18 nt, Human
agaggaguucaaugaucu

SEQ ID NO: 3466757 - RNA, 19 nt, Human
agaggaguucaaugaucua

SEQ ID NO: 3466758 - RNA, 14 nt, Human
agaggaugagagcc

SEQ ID NO: 3466759 - RNA, 17 nt, Human
agaggaugagagcccag

SEQ ID NO: 3466760 - RNA, 14 nt, Human
agaggauggccagu

SEQ ID NO: 3466761 - RNA, 18 nt, Human
agaggauggccagugucu

SEQ ID NO: 3466762 - RNA, 19 nt, Human
agaggauggcccaggguga

SEQ ID NO: 3466763 - RNA, 22 nt, Human
agaggauuuugcgucagagaaa

SEQ ID NO: 3466764 - RNA, 18 nt, Human
agaggcaacugcauuggc

SEQ ID NO: 3466765 - RNA, 16 nt, Human
agaggcagaacccugg

SEQ ID NO: 3466766 - RNA, 13 nt, Human
agaggcagaagaa

SEQ ID NO: 3466767 - RNA, 17 nt, Human
agaggcagaagaacccu

SEQ ID NO: 3466768 - RNA, 20 nt, Human
agaggcagagaaagaagaga

SEQ ID NO: 3466769 - RNA, 13 nt, Human
agaggcagagagc

SEQ ID NO: 3466770 - RNA, 13 nt, Human
agaggcagagccu

SEQ ID NO: 3466771 - RNA, 14 nt, Human
agaggcagagugcc

SEQ ID NO: 3466772 - RNA, 19 nt, Human
agaggcagagugccccacc

SEQ ID NO: 3466773 - RNA, 21 nt, Human
agaggcagagugccccaccug

SEQ ID NO: 3466774 - RNA, 22 nt, Human
agaggcagagugccccaccugc

SEQ ID NO: 3466775 - RNA, 13 nt, Human
agaggcagggagg

SEQ ID NO: 3466776 - RNA, 21 nt, Human
agaggcagggucucacucugu

SEQ ID NO: 3466777 - RNA, 13 nt, Human
agaggcaguaccu

SEQ ID NO: 3466778 - RNA, 13 nt, Human
agaggcauuuccc

SEQ ID NO: 3466779 - RNA, 13 nt, Human
agaggccagaggc

SEQ ID NO: 3466780 - RNA, 16 nt, Human
agaggccagccccacc

SEQ ID NO: 3466781 - RNA, 19 nt, Human
agaggccaugauucgccca

SEQ ID NO: 3466782 - RNA, 23 nt, Human
agaggccauggcagaauaaucuu

SEQ ID NO: 3466783 - RNA, 21 nt, Human
agaggccauucuuucccaaca

SEQ ID NO: 3466784 - RNA, 19 nt, Human
agaggcccaggcugccguc

SEQ ID NO: 3466785 - RNA, 21 nt, Human
agaggccccaauaccccaugg

SEQ ID NO: 3466786 - RNA, 14 nt, Human
agaggccccagccu

SEQ ID NO: 3466787 - RNA, 20 nt, Human
agaggcccccagcccagggc

SEQ ID NO: 3466788 - RNA, 14 nt, Human
agaggcccucugga

SEQ ID NO: 3466789 - RNA, 21 nt, Human
agaggcccucuggaguggcca

SEQ ID NO: 3466790 - RNA, 15 nt, Human
agaggcccuggauca

SEQ ID NO: 3466791 - RNA, 17 nt, Human
agaggcccuggaucagc

SEQ ID NO: 3466792 - RNA, 20 nt, Human
agaggcccuggaucagcgug

SEQ ID NO: 3466793 - RNA, 18 nt, Human
agaggccgagagcuaugg

SEQ ID NO: 3466794 - RNA, 15 nt, Human
agaggccguggcugc

SEQ ID NO: 3466795 - RNA, 22 nt, Human
agaggccguggcugcuguggga

SEQ ID NO: 3466796 - RNA, 23 nt, Human
agaggccuccuguggccugccag

SEQ ID NO: 3466797 - RNA, 12 nt, Human
agaggccugccc

SEQ ID NO: 3466798 - RNA, 14 nt, Human
agaggccugggcug

SEQ ID NO: 3466799 - RNA, 21 nt, Human
agaggccuuuaaccauggugc

SEQ ID NO: 3466800 - RNA, 13 nt, Human
agaggcgggccag

SEQ ID NO: 3466801 - RNA, 20 nt, Human
agaggcgggccagccaggcg

SEQ ID NO: 3466802 - RNA, 16 nt, Human
agaggcgucuguauau

SEQ ID NO: 3466803 - RNA, 16 nt, Human
agaggcuaaaauguuu

SEQ ID NO: 3466804 - RNA, 18 nt, Human
agaggcucagauuguaau

SEQ ID NO: 3466805 - RNA, 22 nt, Human
agaggcucguugacuggcugug

SEQ ID NO: 3466806 - RNA, 13 nt, Human
agaggcugaaaga

SEQ ID NO: 3466807 - RNA, 13 nt, Human
agaggcugaggac

SEQ ID NO: 3466808 - RNA, 18 nt, Human
agaggcugccccucucac

SEQ ID NO: 3466809 - RNA, 20 nt, Human
agaggcugccccucucacca

SEQ ID NO: 3466810 - RNA, 15 nt, Human
agaggcugcccuccu

SEQ ID NO: 3466811 - RNA, 16 nt, Human
agaggcuggaggcagg

SEQ ID NO: 3466812 - RNA, 20 nt, Human
agaggcuggaggcagggccu

SEQ ID NO: 3466813 - RNA, 14 nt, Human
agaggcugguuuug

SEQ ID NO: 3466814 - RNA, 20 nt, Human
agaggcuuccuucauuuccu

SEQ ID NO: 3466815 - RNA, 16 nt, Human
agaggcuucuccgcca

SEQ ID NO: 3466816 - RNA, 21 nt, Human
agaggcuucuucagaucagug

SEQ ID NO: 3466817 - RNA, 19 nt, Human
agaggcuuguuuaccuuuc

SEQ ID NO: 3466818 - RNA, 19 nt, Human
agagggaacagggcggaga

SEQ ID NO: 3466819 - RNA, 17 nt, Human
agagggaagagugcauu

SEQ ID NO: 3466820 - RNA, 14 nt, Human
agagggaccaugug

SEQ ID NO: 3466821 - RNA, 21 nt, Human
agagggacgccugggggugcc

SEQ ID NO: 3466822 - RNA, 21 nt, Human
agagggacggccaagaaugua

SEQ ID NO: 3466823 - RNA, 22 nt, Human
agagggacuguucuuuuguccc

SEQ ID NO: 3466824 - RNA, 13 nt, Human
agagggagaagaa

SEQ ID NO: 3466825 - RNA, 19 nt, Human
agagggagaagggauggag

SEQ ID NO: 3466826 - RNA, 12 nt, Human
agagggagagag

SEQ ID NO: 3466827 - RNA, 24 nt, Human
agagggaggagaaugagccucggc

SEQ ID NO: 3466828 - RNA, 18 nt, Human
agagggaggggccuaggc

SEQ ID NO: 3466829 - RNA, 23 nt, Human
agagggauaagguaccuuucaca

SEQ ID NO: 3466830 - RNA, 12 nt, Human
agagggcacaga

SEQ ID NO: 3466831 - RNA, 17 nt, Human
agagggcccaggcaggc

SEQ ID NO: 3466832 - RNA, 13 nt, Human
agagggcccuggu

SEQ ID NO: 3466833 - RNA, 13 nt, Human
agagggccugcaa

SEQ ID NO: 3466834 - RNA, 16 nt, Human
agagggccugcaaggg

SEQ ID NO: 3466835 - RNA, 15 nt, Human
agagggccuguggga

SEQ ID NO: 3466836 - RNA, 20 nt, Human
agagggcucgaggggugggc

SEQ ID NO: 3466837 - RNA, 17 nt, Human
agagggcuuuaauuuuu

SEQ ID NO: 3466838 - RNA, 18 nt, Human
agaggggaaaagagauga

SEQ ID NO: 3466839 - RNA, 19 nt, Human
agaggggaaaagcugaaca

SEQ ID NO: 3466840 - RNA, 16 nt, Human
agaggggaagagacuu

SEQ ID NO: 3466841 - RNA, 20 nt, Human
agaggggaauaauagaagaa

SEQ ID NO: 3466842 - RNA, 20 nt, Human
agaggggacaaaacccaccu

SEQ ID NO: 3466843 - RNA, 15 nt, Human
agaggggacucuggg

SEQ ID NO: 3466844 - RNA, 15 nt, Human
agaggggaggccaag

SEQ ID NO: 3466845 - RNA, 15 nt, Human
agaggggcagaacag

SEQ ID NO: 3466846 - RNA, 16 nt, Human
agaggggcagaacagc

SEQ ID NO: 3466847 - RNA, 20 nt, Human
agaggggccugccaccugga

SEQ ID NO: 3466848 - RNA, 16 nt, Human
agagggggcugguggg

SEQ ID NO: 3466849 - RNA, 22 nt, Human
agaggggggaagaucaggucau

SEQ ID NO: 3466850 - RNA, 12 nt, Human
agagggggugga

SEQ ID NO: 3466851 - RNA, 19 nt, Human
agaggggguggccucccaa

SEQ ID NO: 3466852 - RNA, 23 nt, Human
agaggggguggccucccaacuca

SEQ ID NO: 3466853 - RNA, 18 nt, Human
agaggggugcagaggcug

SEQ ID NO: 3466854 - RNA, 16 nt, Human
agagggguggagacug

SEQ ID NO: 3466855 - RNA, 19 nt, Human
agagggguggagacugcuu

SEQ ID NO: 3466856 - RNA, 20 nt, Human
agagggucugaggaauccag

SEQ ID NO: 3466857 - RNA, 23 nt, Human
agagggugcugccccaugaagcc

SEQ ID NO: 3466858 - RNA, 23 nt, Human
agaggguuuuagguagaaaaaca

SEQ ID NO: 3466859 - RNA, 23 nt, Human
agagguaaaagugugagcaguga

SEQ ID NO: 3466860 - RNA, 16 nt, Human
agagguacacuuguga

SEQ ID NO: 3466861 - RNA, 18 nt, Human
agagguacacuugugaau

SEQ ID NO: 3466862 - RNA, 19 nt, Human
agagguacaggguuuuuac

SEQ ID NO: 3466863 - RNA, 14 nt, Human
agagguacccuggg

SEQ ID NO: 3466864 - RNA, 15 nt, Human
agagguacccugggu

SEQ ID NO: 3466865 - RNA, 18 nt, Human
agagguacuagaaugcuu

SEQ ID NO: 3466866 - RNA, 16 nt, Human
agagguagggcugcca

SEQ ID NO: 3466867 - RNA, 18 nt, Human
agaggucaagcccaggag

SEQ ID NO: 3466868 - RNA, 17 nt, Human
agagguccucuggagcc

SEQ ID NO: 3466869 - RNA, 14 nt, Human
agaggucugugcug

SEQ ID NO: 3466870 - RNA, 19 nt, Human
agaggucugugcugaggcc

SEQ ID NO: 3466871 - RNA, 16 nt, Human
agaggucuuuuuuaaa

SEQ ID NO: 3466872 - RNA, 15 nt, Human
agaggugaccccagg

SEQ ID NO: 3466873 - RNA, 16 nt, Human
agaggugaccccaggg

SEQ ID NO: 3466874 - RNA, 24 nt, Human
agaggugaccccagggcacaggag

SEQ ID NO: 3466875 - RNA, 12 nt, Human
agaggugccagc

SEQ ID NO: 3466876 - RNA, 20 nt, Human
agaggugccagcaacugaau

SEQ ID NO: 3466877 - RNA, 22 nt, Human
agaggugccagcaacugaauaa

SEQ ID NO: 3466878 - RNA, 13 nt, Human
agaggugcuucac

SEQ ID NO: 3466879 - RNA, 17 nt, Human
agaggugggagggcccu

SEQ ID NO: 3466880 - RNA, 24 nt, Human
agaggugggccagucuguggauca

SEQ ID NO: 3466881 - RNA, 16 nt, Human
agagguucaaagauau

SEQ ID NO: 3466882 - RNA, 17 nt, Human
agagguucauuucaaau

SEQ ID NO: 3466883 - RNA, 19 nt, Human
agagguucuaaaaucauga

SEQ ID NO: 3466884 - RNA, 15 nt, Human
agagguugcagugag

SEQ ID NO: 3466885 - RNA, 19 nt, Human
agagguuguagugagccca

SEQ ID NO: 3466886 - RNA, 17 nt, Human
agagguuugcaguccca

SEQ ID NO: 3466887 - RNA, 20 nt, Human
agagguuugcagucccaagc

SEQ ID NO: 3466888 - RNA, 12 nt, Human
agagguuuuaaa

SEQ ID NO: 3466889 - RNA, 22 nt, Human
agagguuuuucuuaaauaauaa

SEQ ID NO: 3466890 - RNA, 20 nt, Human
agaguaagaaauuucagguu

SEQ ID NO: 3466891 - RNA, 13 nt, Human
agaguaagacauu

SEQ ID NO: 3466892 - RNA, 16 nt, Human
agaguaagcugcuuuu

SEQ ID NO: 3466893 - RNA, 13 nt, Human
agaguacacugcc

SEQ ID NO: 3466894 - RNA, 15 nt, Human
agaguacacugccug

SEQ ID NO: 3466895 - RNA, 19 nt, Human
agaguacacugccugccuu

SEQ ID NO: 3466896 - RNA, 13 nt, Human
agaguagaaauaa

SEQ ID NO: 3466897 - RNA, 18 nt, Human
agaguagaauugcauuga

SEQ ID NO: 3466898 - RNA, 22 nt, Human
agaguagcaaguucuagagaag

SEQ ID NO: 3466899 - RNA, 14 nt, Human
agaguagcauuuca

SEQ ID NO: 3466900 - RNA, 17 nt, Human
agaguagccgagagccu

SEQ ID NO: 3466901 - RNA, 22 nt, Human
agaguagccgagagccugcucc

SEQ ID NO: 3466902 - RNA, 21 nt, Human
agaguaggcuauuccugagag

SEQ ID NO: 3466903 - RNA, 14 nt, Human
agaguaguuauaua

SEQ ID NO: 3466904 - RNA, 15 nt, Human
agagucaaggccugc

SEQ ID NO: 3466905 - RNA, 20 nt, Human
agagucacacgggggcagcu

SEQ ID NO: 3466906 - RNA, 14 nt, Human
agagucagccagga

SEQ ID NO: 3466907 - RNA, 17 nt, Human
agagucagcucucugcc

SEQ ID NO: 3466908 - RNA, 19 nt, Human
agagucagcucucugcccu

SEQ ID NO: 3466909 - RNA, 18 nt, Human
agagucauauuuugauua

SEQ ID NO: 3466910 - RNA, 18 nt, Human
agagucaucuccaucagc

SEQ ID NO: 3466911 - RNA, 19 nt, Human
agaguccaagguuuaaaga

SEQ ID NO: 3466912 - RNA, 14 nt, Human
agaguccaggcccc

SEQ ID NO: 3466913 - RNA, 13 nt, Human
agagucccacugc

SEQ ID NO: 3466914 - RNA, 18 nt, Human
agagucccacugccucag

SEQ ID NO: 3466915 - RNA, 22 nt, Human
agagucccacugccucagguuc

SEQ ID NO: 3466916 - RNA, 19 nt, Human
agagucccagguuggcucu

SEQ ID NO: 3466917 - RNA, 14 nt, Human
agaguccccccacu

SEQ ID NO: 3466918 - RNA, 18 nt, Human
agaguccccccacuccca

SEQ ID NO: 3466919 - RNA, 15 nt, Human
agagucgcugugcca

SEQ ID NO: 3466920 - RNA, 19 nt, Human
agagucgcugugccacagg

SEQ ID NO: 3466921 - RNA, 22 nt, Human
agauaccuuaaaauuugaaaca

SEQ ID NO: 3466922 - RNA, 16 nt, Human
agauacgacuuuauuu

SEQ ID NO: 3466923 - RNA, 20 nt, Human
agauacgacuuuauuuucug

SEQ ID NO: 3466924 - RNA, 18 nt, Human
agauacuaaggacguugu

SEQ ID NO: 3466925 - RNA, 21 nt, Human
agauacuacugaccagacaag

SEQ ID NO: 3466926 - RNA, 23 nt, Human
agauacuacugaccagacaagcu

SEQ ID NO: 3466927 - RNA, 15 nt, Human
agauacucucuucuu

SEQ ID NO: 3466928 - RNA, 18 nt, Human
agauacucucuucuucuc

SEQ ID NO: 3466929 - RNA, 12 nt, Human
agauacugaaau

SEQ ID NO: 3466930 - RNA, 14 nt, Human
agauacuggauugu

SEQ ID NO: 3466931 - RNA, 14 nt, Human
agauacugguggaa

SEQ ID NO: 3466932 - RNA, 11 nt, Human
agauacuguau

SEQ ID NO: 3466933 - RNA, 21 nt, Human
agauacuuggaccgaguagag

SEQ ID NO: 3466934 - RNA, 19 nt, Human
agauacuuugcauugucug

SEQ ID NO: 3466935 - RNA, 17 nt, Human
agauacuuugcuagccg

SEQ ID NO: 3466936 - RNA, 17 nt, Human
agcccacgcccccacug

SEQ ID NO: 3466937 - RNA, 18 nt, Human
agcccacgcccccacugg

SEQ ID NO: 3466938 - RNA, 15 nt, Human
agcccacguccuguc

SEQ ID NO: 3466939 - RNA, 17 nt, Human
agcccacguccugucag

SEQ ID NO: 3466940 - RNA, 22 nt, Human
agcccacguccugucagugccg

SEQ ID NO: 3466941 - RNA, 13 nt, Human
agcccacucugcu

SEQ ID NO: 3466942 - RNA, 15 nt, Human
agcccacucugcucg

SEQ ID NO: 3466943 - RNA, 19 nt, Human
agcccacugcccacccccu

SEQ ID NO: 3466944 - RNA, 17 nt, Human
agcccacuguccugggc

SEQ ID NO: 3466945 - RNA, 22 nt, Human
agcccacuguccugggccugca

SEQ ID NO: 3466946 - RNA, 23 nt, Human
agcccacuguccugggccugcag

SEQ ID NO: 3466947 - RNA, 13 nt, Human
agcccacuucugc

SEQ ID NO: 3466948 - RNA, 15 nt, Human
agcccacuucugcca

SEQ ID NO: 3466949 - RNA, 16 nt, Human
agcccagaagugcaga

SEQ ID NO: 3466950 - RNA, 11 nt, Human
agcccagagac

SEQ ID NO: 3466951 - RNA, 14 nt, Human
agcccagaggaggg

SEQ ID NO: 3466952 - RNA, 16 nt, Human
agcccagaggagggca

SEQ ID NO: 3466953 - RNA, 15 nt, Human
agcccagagggucug

SEQ ID NO: 3466954 - RNA, 17 nt, Human
agcccagagguaacaga

SEQ ID NO: 3466955 - RNA, 18 nt, Human
agcccagagguaacagaa

SEQ ID NO: 3466956 - RNA, 21 nt, Human
agcccagagguaacagaacag

SEQ ID NO: 3466957 - RNA, 18 nt, Human
agcccagauuccccugug

SEQ ID NO: 3466958 - RNA, 20 nt, Human
agcccagauugugccacugc

SEQ ID NO: 3466959 - RNA, 21 nt, Human
agcccagccauuaccauggag

SEQ ID NO: 3466960 - RNA, 11 nt, Human
agcccagccca

SEQ ID NO: 3466961 - RNA, 18 nt, Human
agcccagcccagcugcuc

SEQ ID NO: 3466962 - RNA, 19 nt, Human
agcccagccccuacugcug

SEQ ID NO: 3466963 - RNA, 20 nt, Human
agcccagccccuacugcugu

SEQ ID NO: 3466964 - RNA, 14 nt, Human
agcccagcgcucug

SEQ ID NO: 3466965 - RNA, 17 nt, Human
agcccagcgcucugccu

SEQ ID NO: 3466966 - RNA, 15 nt, Human
agcccagcuccaggg

SEQ ID NO: 3466967 - RNA, 14 nt, Human
agcccagcucugaa

SEQ ID NO: 3466968 - RNA, 12 nt, Human
agcccagcugcu

SEQ ID NO: 3466969 - RNA, 15 nt, Human
agcccagcugcucug

SEQ ID NO: 3466970 - RNA, 23 nt, Human
agcccagcugcucugcccagagc

SEQ ID NO: 3466971 - RNA, 16 nt, Human
agccaagcuuuaaauu

SEQ ID NO: 3466972 - RNA, 20 nt, Human
agccaagcuuuaaauuaugu

SEQ ID NO: 3466973 - RNA, 21 nt, Human
agccaaggagucacugagacc

SEQ ID NO: 3466974 - RNA, 22 nt, Human
agccaaggccaaaggaagcaca

SEQ ID NO: 3466975 - RNA, 23 nt, Human
agccaaggccaaaggaagcacau

SEQ ID NO: 3466976 - RNA, 22 nt, Human
agccaaggccgaagcucuggcu

SEQ ID NO: 3466977 - RNA, 17 nt, Human
agccaagggaaccugug

SEQ ID NO: 3466978 - RNA, 21 nt, Human
agccaagggaaccuguguccg

SEQ ID NO: 3466979 - RNA, 18 nt, Human
agccaagggauggacauc

SEQ ID NO: 3466980 - RNA, 22 nt, Human
agccaagggauggacaucuugu

SEQ ID NO: 3466981 - RNA, 16 nt, Human
agccaaggggcuucag

SEQ ID NO: 3466982 - RNA, 17 nt, Human
agccaaggguauccaag

SEQ ID NO: 3466983 - RNA, 22 nt, Human
agccaaggugggcugagcccug

SEQ ID NO: 3466984 - RNA, 13 nt, Human
agccaaguggggu

SEQ ID NO: 3466985 - RNA, 16 nt, Human
agccaaguggggugcu

SEQ ID NO: 3466986 - RNA, 20 nt, Human
agccaaguggggugcuggga

SEQ ID NO: 3466987 - RNA, 15 nt, Human
agccaaguuuuauaa

SEQ ID NO: 3466988 - RNA, 12 nt, Human
agccaauauaac

SEQ ID NO: 3466989 - RNA, 13 nt, Human
agccaauccccuc

SEQ ID NO: 3466990 - RNA, 16 nt, Human
agccaauccccuccuu

SEQ ID NO: 3466991 - RNA, 21 nt, Human
agccaauccccuccuugggca

SEQ ID NO: 3466992 - RNA, 22 nt, Human
agccaauccccuccuugggcac

SEQ ID NO: 3466993 - RNA, 16 nt, Human
agccaaugucuccucc

SEQ ID NO: 3466994 - RNA, 16 nt, Human
agccaauuauguuaaa

SEQ ID NO: 3466995 - RNA, 17 nt, Human
agccaauuauguuaaac

SEQ ID NO: 3466996 - RNA, 20 nt, Human
agccaauuauguuaaacuag

SEQ ID NO: 3466997 - RNA, 13 nt, Human
agccaauuuuucu

SEQ ID NO: 3466998 - RNA, 15 nt, Human
agccaauuuuucugc

SEQ ID NO: 3466999 - RNA, 16 nt, Human
agccaauuuuucugca

SEQ ID NO: 3467000 - RNA, 15 nt, Human
agccacacacacaga

SEQ ID NO: 3467001 - RNA, 16 nt, Human
agccacacacacagaa

SEQ ID NO: 3467002 - RNA, 19 nt, Human
agccacacacacagaaaau

SEQ ID NO: 3467003 - RNA, 20 nt, Human
agccacacacacagaaaaua

SEQ ID NO: 3467004 - RNA, 13 nt, Human
agccacaccagga

SEQ ID NO: 3467005 - RNA, 15 nt, Human
agccacacccaggca

SEQ ID NO: 3467006 - RNA, 17 nt, Human
agccacacuucucagga

SEQ ID NO: 3467007 - RNA, 19 nt, Human
agccacacuucucaggaca

SEQ ID NO: 3467008 - RNA, 16 nt, Human
agccacagcagcauuu

SEQ ID NO: 3467009 - RNA, 18 nt, Human
agccacagcagcauuuuu

SEQ ID NO: 3467010 - RNA, 21 nt, Human
agccacagcccaggccuccag

SEQ ID NO: 3467011 - RNA, 20 nt, Human
agccacagugagggagaucc

SEQ ID NO: 3467012 - RNA, 11 nt, Human
agccacauccc

SEQ ID NO: 3467013 - RNA, 15 nt, Human
agccacauuuggaau

SEQ ID NO: 3467014 - RNA, 20 nt, Human
agccacauuuggaauacuuu

SEQ ID NO: 3467015 - RNA, 19 nt, Human
agccaccaacauacuccca

SEQ ID NO: 3467016 - RNA, 16 nt, Human
agccaccaacucuugc

SEQ ID NO: 3467017 - RNA, 15 nt, Human
agccaccacgcccgg

SEQ ID NO: 3467018 - RNA, 17 nt, Human
agccaccacguccagcu

SEQ ID NO: 3467019 - RNA, 14 nt, Human
agccaccagaugug

SEQ ID NO: 3467020 - RNA, 14 nt, Human
agccacccucccag

SEQ ID NO: 3467021 - RNA, 17 nt, Human
agccacccucccagcuc

SEQ ID NO: 3467022 - RNA, 18 nt, Human
agccacccucccagcucu

SEQ ID NO: 3467023 - RNA, 19 nt, Human
agccacccucccagcucug

SEQ ID NO: 3467024 - RNA, 20 nt, Human
agccacccucccagcucuga

SEQ ID NO: 3467025 - RNA, 13 nt, Human
agccacccugagg

SEQ ID NO: 3467026 - RNA, 19 nt, Human
agccacccugaggagucug

SEQ ID NO: 3467027 - RNA, 21 nt, Human
agccacccugaggagucugag

SEQ ID NO: 3467028 - RNA, 12 nt, Human
agccaccucucc

SEQ ID NO: 3467029 - RNA, 14 nt, Human
agccaccucucccu

SEQ ID NO: 3467030 - RNA, 16 nt, Human
agccaccucucccuca

SEQ ID NO: 3467031 - RNA, 22 nt, Human
agccaccucucccucaacaagg

SEQ ID NO: 3467032 - RNA, 14 nt, Human
agccaccucucuuu

SEQ ID NO: 3467033 - RNA, 23 nt, Human
agccaccucugucauuuguugug

SEQ ID NO: 3467034 - RNA, 16 nt, Human
agccaccugaguuccu

SEQ ID NO: 3467035 - RNA, 17 nt, Human
agccacguuccuuacug

SEQ ID NO: 3467036 - RNA, 20 nt, Human
agccacguuccuuacugcag

SEQ ID NO: 3467037 - RNA, 14 nt, Human
agccacuaacuaga

SEQ ID NO: 3467038 - RNA, 15 nt, Human
agccacucaggaggc

SEQ ID NO: 3467039 - RNA, 19 nt, Human
agccacuccccuccacucu

SEQ ID NO: 3467040 - RNA, 22 nt, Human
agccacuccucugacucagggc

SEQ ID NO: 3467041 - RNA, 13 nt, Human
agccacugaagcu

SEQ ID NO: 3467042 - RNA, 16 nt, Human
agccacugaagcuggg

SEQ ID NO: 3467043 - RNA, 19 nt, Human
agccacugcaccgggccac

SEQ ID NO: 3467044 - RNA, 16 nt, Human
agccacugccucuccc

SEQ ID NO: 3467045 - RNA, 18 nt, Human
agccacugccucucccuc

SEQ ID NO: 3467046 - RNA, 20 nt, Human
agccacugccucucccucug

SEQ ID NO: 3467047 - RNA, 21 nt, Human
agccacugccucucccucugg

SEQ ID NO: 3467048 - RNA, 20 nt, Human
agccacuggcugcuaacaag

SEQ ID NO: 3467049 - RNA, 15 nt, Human
agccacuuaccuuca

SEQ ID NO: 3467050 - RNA, 17 nt, Human
agccacuuaccuucaau

SEQ ID NO: 3467051 - RNA, 14 nt, Human
agccacuuaggaca

SEQ ID NO: 3467052 - RNA, 22 nt, Human
agccacuucggccaggucacac

SEQ ID NO: 3467053 - RNA, 19 nt, Human
agccagaaauaaaguuggu

SEQ ID NO: 3467054 - RNA, 16 nt, Human
agccagaaccccgagc

SEQ ID NO: 3467055 - RNA, 22 nt, Human
agccagaacuugacccugagcu

SEQ ID NO: 3467056 - RNA, 12 nt, Human
agccagaagcug

SEQ ID NO: 3467057 - RNA, 21 nt, Human
agccagaaucagcacagauaa

SEQ ID NO: 3467058 - RNA, 16 nt, Human
agccagacacucugcu

SEQ ID NO: 3467059 - RNA, 15 nt, Human
agccagaccagauua

SEQ ID NO: 3467060 - RNA, 23 nt, Human
agccagacgccauuuaaaagucu

SEQ ID NO: 3467061 - RNA, 16 nt, Human
agccagagaagugaca

SEQ ID NO: 3467062 - RNA, 17 nt, Human
agccagagaagugacag

SEQ ID NO: 3467063 - RNA, 21 nt, Human
agccagagaagugacagggaa

SEQ ID NO: 3467064 - RNA, 13 nt, Human
agccagaggacug

SEQ ID NO: 3467065 - RNA, 15 nt, Human
agccagaggagagag

SEQ ID NO: 3467066 - RNA, 17 nt, Human
agccagaggagagagga

SEQ ID NO: 3467067 - RNA, 11 nt, Human
agccagaggcu

SEQ ID NO: 3467068 - RNA, 16 nt, Human
agccagauccucuugg

SEQ ID NO: 3467069 - RNA, 23 nt, Human
agacaugccacaaggacuuccug

SEQ ID NO: 3467070 - RNA, 16 nt, Human
agacauggcuugccac

SEQ ID NO: 3467071 - RNA, 18 nt, Human
agacauguaauuugugua

SEQ ID NO: 3467072 - RNA, 16 nt, Human
agacauguagguguuu

SEQ ID NO: 3467073 - RNA, 14 nt, Human
agacaugugacauu

SEQ ID NO: 3467074 - RNA, 16 nt, Human
agacaugugacauuua

SEQ ID NO: 3467075 - RNA, 17 nt, Human
agacaugugacauuuau

SEQ ID NO: 3467076 - RNA, 17 nt, Human
agacauguggugggaca

SEQ ID NO: 3467077 - RNA, 17 nt, Human
agacauguuguaaauua

SEQ ID NO: 3467078 - RNA, 14 nt, Human
agacauuaaauaau

SEQ ID NO: 3467079 - RNA, 20 nt, Human
agacauuaacucauuagacu

SEQ ID NO: 3467080 - RNA, 13 nt, Human
agacauugucagc

SEQ ID NO: 3467081 - RNA, 19 nt, Human
agacauuguuuugccaaca

SEQ ID NO: 3467082 - RNA, 23 nt, Human
agacauuguuuugccaacauugc

SEQ ID NO: 3467083 - RNA, 15 nt, Human
agacauuuauacucu

SEQ ID NO: 3467084 - RNA, 17 nt, Human
agacauuuauacucuuu

SEQ ID NO: 3467085 - RNA, 21 nt, Human
agacauuuauacucuuuuuuc

SEQ ID NO: 3467086 - RNA, 19 nt, Human
agaucugccuaaggacuuc

SEQ ID NO: 3467087 - RNA, 15 nt, Human
agaucuggaaccuca

SEQ ID NO: 3467088 - RNA, 17 nt, Human
agaucuggaaccucagc

SEQ ID NO: 3467089 - RNA, 20 nt, Human
agaucuggaaccucagccug

SEQ ID NO: 3467090 - RNA, 17 nt, Human
agaucuggacuuggcaa

SEQ ID NO: 3467091 - RNA, 20 nt, Human
agccucugaaguuggacagc

SEQ ID NO: 3467092 - RNA, 17 nt, Human
agccucugaccccuccu

SEQ ID NO: 3467093 - RNA, 21 nt, Human
agccucugaccccuccucacu

SEQ ID NO: 3467094 - RNA, 22 nt, Human
agccucugaccccuccucacug

SEQ ID NO: 3467095 - RNA, 12 nt, Human
agccucugcugc

SEQ ID NO: 3467096 - RNA, 15 nt, Human
agccucuggcuagag

SEQ ID NO: 3467097 - RNA, 13 nt, Human
agccucuggguca

SEQ ID NO: 3467098 - RNA, 16 nt, Human
agccucugucaggccu

SEQ ID NO: 3467099 - RNA, 14 nt, Human
agccucugugucac

SEQ ID NO: 3467100 - RNA, 19 nt, Human
agccucugugucacuggcu

SEQ ID NO: 3467101 - RNA, 20 nt, Human
agccucugugucacuggcug

SEQ ID NO: 3467102 - RNA, 20 nt, Human
cagccaccccaugcuggccu

SEQ ID NO: 3467103 - RNA, 11 nt, Human
cagccaccccg

SEQ ID NO: 3467104 - RNA, 20 nt, Human
cagccaccccgggcucucug

SEQ ID NO: 3467105 - RNA, 12 nt, Human
cagccacccuga

SEQ ID NO: 3467106 - RNA, 15 nt, Human
cagccacccugagga

SEQ ID NO: 3467107 - RNA, 16 nt, Human
cagccacccugaggag

SEQ ID NO: 3467108 - RNA, 14 nt, Human
cagccacccugagu

SEQ ID NO: 3467109 - RNA, 18 nt, Human
cagccacggccaggccag

SEQ ID NO: 3467110 - RNA, 21 nt, Human
cagccacggggacucagcccu

SEQ ID NO: 3467111 - RNA, 15 nt, Human
cagccacuaagaacc

SEQ ID NO: 3467112 - RNA, 16 nt, Human
cagccacuccccagcc

SEQ ID NO: 3467113 - RNA, 17 nt, Human
cagccacuccccagcca

SEQ ID NO: 3467114 - RNA, 14 nt, Human
cagccacucgggag

SEQ ID NO: 3467115 - RNA, 17 nt, Human
cagccagaacguggcuc

SEQ ID NO: 3467116 - RNA, 22 nt, Human
cagccagaacguggcucugcug

SEQ ID NO: 3467117 - RNA, 16 nt, Human
cagccagaacucugug

SEQ ID NO: 3467118 - RNA, 23 nt, Human
cagccagaccagauuaaacuuca

SEQ ID NO: 3467119 - RNA, 22 nt, Human
cagccagaccuauuccuccugg

SEQ ID NO: 3467120 - RNA, 13 nt, Human
cagccagaggcac

SEQ ID NO: 3467121 - RNA, 19 nt, Human
cagccagaggcaucugagg

SEQ ID NO: 3467122 - RNA, 17 nt, Human
cagccagcagcagccca

SEQ ID NO: 3467123 - RNA, 17 nt, Human
cagccagcagccagcuc

SEQ ID NO: 3467124 - RNA, 18 nt, Human
cagccagcagccagcucu

SEQ ID NO: 3467125 - RNA, 14 nt, Human
cagccagcaguuca

SEQ ID NO: 3467126 - RNA, 21 nt, Human
cagccagcaguucagagcugc

SEQ ID NO: 3467127 - RNA, 16 nt, Human
cagccagcaucugggc

SEQ ID NO: 3467128 - RNA, 16 nt, Human
cagccagccacucuac

SEQ ID NO: 3467129 - RNA, 12 nt, Human
cagccagcccag

SEQ ID NO: 3467130 - RNA, 13 nt, Human
cagccagcccagc

SEQ ID NO: 3467131 - RNA, 17 nt, Human
cagccagcccagcccag

SEQ ID NO: 3467132 - RNA, 19 nt, Human
cagccagcccagcccagcu

SEQ ID NO: 3467133 - RNA, 20 nt, Human
cagccagcccagcccagcug

SEQ ID NO: 3467134 - RNA, 12 nt, Human
cagccagcccug

SEQ ID NO: 3467135 - RNA, 16 nt, Human
cagccagcccugccug

SEQ ID NO: 3467136 - RNA, 14 nt, Human
cagccagccucgcc

SEQ ID NO: 3467137 - RNA, 19 nt, Human
cagccagccucgcccaucc

SEQ ID NO: 3467138 - RNA, 16 nt, Human
cagccagccuggcugg

SEQ ID NO: 3467139 - RNA, 19 nt, Human
cagccagcgucggucugug

SEQ ID NO: 3467140 - RNA, 15 nt, Human
cagccagcucucagc

SEQ ID NO: 3467141 - RNA, 18 nt, Human
cagccagcucucagccaa

SEQ ID NO: 3467142 - RNA, 21 nt, Human
cagccagcucucagccaacga

SEQ ID NO: 3467143 - RNA, 23 nt, Human
cagccaggagagcuuagggucuc

SEQ ID NO: 3467144 - RNA, 15 nt, Human
cagccaggagcuggg

SEQ ID NO: 3467145 - RNA, 16 nt, Human
cagccaggagcugggc

SEQ ID NO: 3467146 - RNA, 13 nt, Human
cagccaggccaca

SEQ ID NO: 3467147 - RNA, 12 nt, Human
cagccaggcccu

SEQ ID NO: 3467148 - RNA, 12 nt, Human
cagccaggcggg

SEQ ID NO: 3467149 - RNA, 14 nt, Human
cagccaggcgggcu

SEQ ID NO: 3467150 - RNA, 16 nt, Human
cagccaggcgggcuca

SEQ ID NO: 3467151 - RNA, 18 nt, Human
cagccaggcgggcucaag

SEQ ID NO: 3467152 - RNA, 20 nt, Human
cagccaggcgggcucaagga

SEQ ID NO: 3467153 - RNA, 15 nt, Human
cagccaggcucugug

SEQ ID NO: 3467154 - RNA, 17 nt, Human
cagccaggcucugugcu

SEQ ID NO: 3467155 - RNA, 13 nt, Human
cagccaggcugcc

SEQ ID NO: 3467156 - RNA, 16 nt, Human
cagccaggcugccaag

SEQ ID NO: 3467157 - RNA, 22 nt, Human
cagccaggcugccaaggccaga

SEQ ID NO: 3467158 - RNA, 15 nt, Human
cagccagggagagcc

SEQ ID NO: 3467159 - RNA, 17 nt, Human
cagccagggagagccca

SEQ ID NO: 3467160 - RNA, 23 nt, Human
cagccagggccugcgagggcagc

SEQ ID NO: 3467161 - RNA, 12 nt, Human
cagccagggcug

SEQ ID NO: 3467162 - RNA, 23 nt, Human
cagccagggcugcuagacggagg

SEQ ID NO: 3467163 - RNA, 15 nt, Human
cagccaggggagcag

SEQ ID NO: 3467164 - RNA, 17 nt, Human
cagccaggggagcagag

SEQ ID NO: 3467165 - RNA, 16 nt, Human
cagccagugaccugag

SEQ ID NO: 3467166 - RNA, 20 nt, Human
cagccagugaccugaggaag

SEQ ID NO: 3467167 - RNA, 22 nt, Human
cagccagugaccugaggaagcg

SEQ ID NO: 3467168 - RNA, 19 nt, Human
cagccagugcccugagcca

SEQ ID NO: 3467169 - RNA, 20 nt, Human
cagccauacuuaucucucug

SEQ ID NO: 3467170 - RNA, 13 nt, Human
cagccaucaaaau

SEQ ID NO: 3467171 - RNA, 21 nt, Human
cagccaucaagagacugaguc

SEQ ID NO: 3467172 - RNA, 19 nt, Human
cagccaucauaggaaggga

SEQ ID NO: 3467173 - RNA, 16 nt, Human
cagccaucugcccagg

SEQ ID NO: 3467174 - RNA, 17 nt, Human
cagccaugccagcuggc

SEQ ID NO: 3467175 - RNA, 13 nt, Human
cagccaugugcug

SEQ ID NO: 3467176 - RNA, 20 nt, Human
cagccauuggcuauuuaaaa

SEQ ID NO: 3467177 - RNA, 16 nt, Human
cagcccaaaccaccag

SEQ ID NO: 3467178 - RNA, 20 nt, Human
cagcccaaaccaccagaagc

SEQ ID NO: 3467179 - RNA, 21 nt, Human
cagcccaaaccaccagaagcc

SEQ ID NO: 3467180 - RNA, 23 nt, Human
cagcccaaaggggacaggccuca

SEQ ID NO: 3467181 - RNA, 17 nt, Human
cagcccaauccagguac

SEQ ID NO: 3467182 - RNA, 17 nt, Human
cagcccaaucccugauc

SEQ ID NO: 3467183 - RNA, 24 nt, Human
cagcccacauuggauucaucagca

SEQ ID NO: 3467184 - RNA, 16 nt, Human
cagcccacccccggca

SEQ ID NO: 3467185 - RNA, 20 nt, Human
cagcccacccccggcagcag

SEQ ID NO: 3467186 - RNA, 13 nt, Human
cagcccacccucc

SEQ ID NO: 3467187 - RNA, 16 nt, Human
cagcccacccuccugu

SEQ ID NO: 3467188 - RNA, 14 nt, Human
cagcccacccugcu

SEQ ID NO: 3467189 - RNA, 16 nt, Human
cagcccacccugcugc

SEQ ID NO: 3467190 - RNA, 18 nt, Human
cagcccacccugcugcug

SEQ ID NO: 3467191 - RNA, 16 nt, Human
cagcccaccuggcuuu

SEQ ID NO: 3467192 - RNA, 16 nt, Human
cagcccacguccuguc

SEQ ID NO: 3467193 - RNA, 19 nt, Human
cagcccacguccugucagu

SEQ ID NO: 3467194 - RNA, 14 nt, Human
cagcccacugagaa

SEQ ID NO: 3467195 - RNA, 20 nt, Human
cagcccacuggaucagaaag

SEQ ID NO: 3467196 - RNA, 23 nt, Human
cagcccagaagugcagaacugca

SEQ ID NO: 3467197 - RNA, 20 nt, Human
cagcccagaggccaacacug

SEQ ID NO: 3467198 - RNA, 12 nt, Human
cagcccagccag

SEQ ID NO: 3467199 - RNA, 13 nt, Human
cagcccagccagc

SEQ ID NO: 3467200 - RNA, 14 nt, Human
cagcccagccagcg

SEQ ID NO: 3467201 - RNA, 15 nt, Human
cagcccagcccagcu

SEQ ID NO: 3467202 - RNA, 18 nt, Human
cagcccagcccagcugcu

SEQ ID NO: 3467203 - RNA, 16 nt, Human
cagcccagccccacuc

SEQ ID NO: 3467204 - RNA, 20 nt, Human
cagcccagcccgcccacugg

SEQ ID NO: 3467205 - RNA, 16 nt, Human
cagcccagcugcucug

SEQ ID NO: 3467206 - RNA, 18 nt, Human
cagcccagcugcucugcc

SEQ ID NO: 3467207 - RNA, 20 nt, Human
cagcccagcugcucugccca

SEQ ID NO: 3467208 - RNA, 21 nt, Human
cagcccagcugcucugcccag

SEQ ID NO: 3467209 - RNA, 23 nt, Human
cagcccagcuuggcccuuuccuu

SEQ ID NO: 3467210 - RNA, 12 nt, Human
cagcccaggccu

SEQ ID NO: 3467211 - RNA, 19 nt, Human
cagcccagggcuccugcac

SEQ ID NO: 3467212 - RNA, 23 nt, Human
cagcccauccauaguaacugaca

SEQ ID NO: 3467213 - RNA, 21 nt, Human
cagcccauccauuaggccagc

SEQ ID NO: 3467214 - RNA, 22 nt, Human
cagcccauccauuaggccagca

SEQ ID NO: 3467215 - RNA, 16 nt, Human
cagcccaucucggagc

SEQ ID NO: 3467216 - RNA, 14 nt, Human
cagcccaucuugcc

SEQ ID NO: 3467217 - RNA, 18 nt, Human
cagcccaucuugccucca

SEQ ID NO: 3467218 - RNA, 16 nt, Human
cagcccaugcccaccu

SEQ ID NO: 3467219 - RNA, 17 nt, Human
cagcccaugcccaccug

SEQ ID NO: 3467220 - RNA, 24 nt, Human
cagcccaugcccaccugcccauca

SEQ ID NO: 3467221 - RNA, 13 nt, Human
cagcccauggaga

SEQ ID NO: 3467222 - RNA, 21 nt, Human
cagcccauggagauugaccug

SEQ ID NO: 3467223 - RNA, 16 nt, Human
cagcccauggcccugu

SEQ ID NO: 3467224 - RNA, 17 nt, Human
cagcccauggcccugug

SEQ ID NO: 3467225 - RNA, 21 nt, Human
cagcccauucucucuccuguc

SEQ ID NO: 3467226 - RNA, 23 nt, Human
cagcccauucucucuccugucca

SEQ ID NO: 3467227 - RNA, 13 nt, Human
cagcccauuucuc

SEQ ID NO: 3467228 - RNA, 14 nt, Human
cagccccacacagc

SEQ ID NO: 3467229 - RNA, 15 nt, Human
cagccccacacagcu

SEQ ID NO: 3467230 - RNA, 16 nt, Human
cagccccacacagcua

SEQ ID NO: 3467231 - RNA, 13 nt, Human
cagccccacacca

SEQ ID NO: 3467232 - RNA, 13 nt, Human
cagccccacagcc

SEQ ID NO: 3467233 - RNA, 12 nt, Human
cagccccaccca

SEQ ID NO: 3467234 - RNA, 13 nt, Human
cagccccacccag

SEQ ID NO: 3467235 - RNA, 22 nt, Human
cagccccacccaggagggaggg

SEQ ID NO: 3467236 - RNA, 17 nt, Human
cagccccacccuguuuu

SEQ ID NO: 3467237 - RNA, 16 nt, Human
cagccccacugccagc

SEQ ID NO: 3467238 - RNA, 20 nt, Human
cagccccacugccagcagca

SEQ ID NO: 3467239 - RNA, 22 nt, Human
cagccccacugccagcagcagc

SEQ ID NO: 3467240 - RNA, 15 nt, Human
cagccccagccaggg

SEQ ID NO: 3467241 - RNA, 21 nt, Human
cagccccagcccagcccagcu

SEQ ID NO: 3467242 - RNA, 13 nt, Human
cagccccagccug

SEQ ID NO: 3467243 - RNA, 14 nt, Human
cagccccagccugc

SEQ ID NO: 3467244 - RNA, 16 nt, Human
cagccccagugcccac

SEQ ID NO: 3467245 - RNA, 17 nt, Human
cagccccagugcccaca

SEQ ID NO: 3467246 - RNA, 11 nt, Human
cagccccaucc

SEQ ID NO: 3467247 - RNA, 19 nt, Human
cagcucaccucucccuugg

SEQ ID NO: 3467248 - RNA, 20 nt, Human
cagcucaccucucccuugga

SEQ ID NO: 3467249 - RNA, 17 nt, Human
cagcucacgcuucacag

SEQ ID NO: 3467250 - RNA, 14 nt, Human
cagcucacugcaac

SEQ ID NO: 3467251 - RNA, 21 nt, Human
cagcucacugcaaccuucgcc

SEQ ID NO: 3467252 - RNA, 13 nt, Human
cagcucagaacca

SEQ ID NO: 3467253 - RNA, 17 nt, Human
cagcucagaaccacagc

SEQ ID NO: 3467254 - RNA, 18 nt, Human
cagcucagaacccagggc

SEQ ID NO: 3467255 - RNA, 22 nt, Human
cagcucagaaguuucuucuuua

SEQ ID NO: 3467256 - RNA, 13 nt, Human
cagcucagagagg

SEQ ID NO: 3467257 - RNA, 12 nt, Human
cagcucagcacu

SEQ ID NO: 3467258 - RNA, 21 nt, Human
cagcucagcacugccugcucc

SEQ ID NO: 3467259 - RNA, 11 nt, Human
cagcucagcgc

SEQ ID NO: 3467260 - RNA, 17 nt, Human
cagcucagcgccagccu

SEQ ID NO: 3467261 - RNA, 13 nt, Human
cagcucagcuucc

SEQ ID NO: 3467262 - RNA, 19 nt, Human
cagcucaggacagaugcca

SEQ ID NO: 3467263 - RNA, 22 nt, Human
cagcucaggacagaugccacac

SEQ ID NO: 3467264 - RNA, 11 nt, Human
cagcucaggau

SEQ ID NO: 3467265 - RNA, 16 nt, Human
cagcucagucuucccu

SEQ ID NO: 3467266 - RNA, 23 nt, Human
cagcucaguucuagucucucugg

SEQ ID NO: 3467267 - RNA, 16 nt, Human
cagcucauaagagcca

SEQ ID NO: 3467268 - RNA, 21 nt, Human
cagcucauccaugccucagaa

SEQ ID NO: 3467269 - RNA, 13 nt, Human
cagcucauucauu

SEQ ID NO: 3467270 - RNA, 19 nt, Human
cagcucauucauuuuauau

SEQ ID NO: 3467271 - RNA, 16 nt, Human
cagcuccaagaauuuc

SEQ ID NO: 3467272 - RNA, 19 nt, Human
cagcuccaagaauuucuag

SEQ ID NO: 3467273 - RNA, 13 nt, Human
cagcuccacccug

SEQ ID NO: 3467274 - RNA, 19 nt, Human
cagcuccacucugacuggc

SEQ ID NO: 3467275 - RNA, 21 nt, Human
cagcuccagggaauccaagcc

SEQ ID NO: 3467276 - RNA, 22 nt, Human
cagcuccagggaauccaagccu

SEQ ID NO: 3467277 - RNA, 17 nt, Human
cagcucccacaagccuc

SEQ ID NO: 3467278 - RNA, 15 nt, Human
cagcucccaccccac

SEQ ID NO: 3467279 - RNA, 20 nt, Human
cagcucccaccccacccccu

SEQ ID NO: 3467280 - RNA, 21 nt, Human
cagcucccaccuccccuuggg

SEQ ID NO: 3467281 - RNA, 24 nt, Human
cagcucccaggaccacaggcucag

SEQ ID NO: 3467282 - RNA, 17 nt, Human
cagcucccauuucuacu

SEQ ID NO: 3467283 - RNA, 13 nt, Human
cagcuccccaaga

SEQ ID NO: 3467284 - RNA, 18 nt, Human
cagcucccccucccuccc

SEQ ID NO: 3467285 - RNA, 21 nt, Human
cagcucccccuguccccucag

SEQ ID NO: 3467286 - RNA, 21 nt, Human
cagcuccccucggagaagagc

SEQ ID NO: 3467287 - RNA, 15 nt, Human
cagcucccuaggaga

SEQ ID NO: 3467288 - RNA, 18 nt, Human
cagcucccuaggagacca

SEQ ID NO: 3467289 - RNA, 19 nt, Human
cagcucccuaggagaccaa

SEQ ID NO: 3467290 - RNA, 16 nt, Human
cagcucccuggcuucu

SEQ ID NO: 3467291 - RNA, 18 nt, Human
cagcucccugugccccca

SEQ ID NO: 3467292 - RNA, 22 nt, Human
cagcucccugugcccccagggu

SEQ ID NO: 3467293 - RNA, 12 nt, Human
cagcucccuucu

SEQ ID NO: 3467294 - RNA, 13 nt, Human
cagcucccuucug

SEQ ID NO: 3467295 - RNA, 15 nt, Human
cagcucccuucuguu

SEQ ID NO: 3467296 - RNA, 19 nt, Human
cagcuccuaacccuuauca

SEQ ID NO: 3467297 - RNA, 19 nt, Human
cagcuccucauccagggcu

SEQ ID NO: 3467298 - RNA, 12 nt, Human
cagcuccucugu

SEQ ID NO: 3467299 - RNA, 14 nt, Human
cagcuccuuccugg

SEQ ID NO: 3467300 - RNA, 16 nt, Human
cagcuccuucuguccu

SEQ ID NO: 3467301 - RNA, 18 nt, Human
cagcuccuugggaggaag

SEQ ID NO: 3467302 - RNA, 22 nt, Human
cagcuccuugggaggaagcaga

SEQ ID NO: 3467303 - RNA, 23 nt, Human
cagcuccuugggaggaagcagaa

SEQ ID NO: 3467304 - RNA, 13 nt, Human
cagcuccuuuucc

SEQ ID NO: 3467305 - RNA, 22 nt, Human
cagcucgcaccccccuguucua

SEQ ID NO: 3467306 - RNA, 22 nt, Human
cagcucgcuggauggcggaagc

SEQ ID NO: 3467307 - RNA, 16 nt, Human
cagcucuaauaaaaca

SEQ ID NO: 3467308 - RNA, 19 nt, Human
cagcucuacccugcauggc

SEQ ID NO: 3467309 - RNA, 15 nt, Human
cagcucuacuggucu

SEQ ID NO: 3467310 - RNA, 21 nt, Human
cagcucuagacaacccugcaa

SEQ ID NO: 3467311 - RNA, 13 nt, Human
cagcucucagcca

SEQ ID NO: 3467312 - RNA, 12 nt, Human
cagcucuccagu

SEQ ID NO: 3467313 - RNA, 14 nt, Human
cagcucucccucug

SEQ ID NO: 3467314 - RNA, 19 nt, Human
cagcucucccucuggcccu

SEQ ID NO: 3467315 - RNA, 17 nt, Human
cagcucucugcccugug

SEQ ID NO: 3467316 - RNA, 18 nt, Human
cagcucugaaaccagugu

SEQ ID NO: 3467317 - RNA, 16 nt, Human
cagcucugaaagagaa

SEQ ID NO: 3467318 - RNA, 21 nt, Human
cagcucugacauucugauucg

SEQ ID NO: 3467319 - RNA, 20 nt, Human
cagcucugcauacucauuag

SEQ ID NO: 3467320 - RNA, 20 nt, Human
cagcucugccgucucuggag

SEQ ID NO: 3467321 - RNA, 12 nt, Human
cagcucugcuug

SEQ ID NO: 3467322 - RNA, 13 nt, Human
cagcucugcuugc

SEQ ID NO: 3467323 - RNA, 17 nt, Human
cagcucuggacagcccc

SEQ ID NO: 3467324 - RNA, 21 nt, Human
cagcucuggacagccccaccc

SEQ ID NO: 3467325 - RNA, 11 nt, Human
cagcucuggag

SEQ ID NO: 3467326 - RNA, 17 nt, Human
cagcucuggcucacaga

SEQ ID NO: 3467327 - RNA, 12 nt, Human
cagcucuggcuu

SEQ ID NO: 3467328 - RNA, 14 nt, Human
cagcucugggagag

SEQ ID NO: 3467329 - RNA, 19 nt, Human
cagcucugggccauucucc

SEQ ID NO: 3467330 - RNA, 17 nt, Human
cagcucuguccugggag

SEQ ID NO: 3467331 - RNA, 23 nt, Human
cagcucuguccugggagugagcu

SEQ ID NO: 3467332 - RNA, 16 nt, Human
cagcucuguucuuccu

SEQ ID NO: 3467333 - RNA, 20 nt, Human
cagcucuguucuuccucagc

SEQ ID NO: 3467334 - RNA, 21 nt, Human
cagcucuguucuuccucagcc

SEQ ID NO: 3467335 - RNA, 13 nt, Human
cagcucuuccuag

SEQ ID NO: 3467336 - RNA, 19 nt, Human
cagcucuuccuagcuggag

SEQ ID NO: 3467337 - RNA, 13 nt, Human
cagcucuucucca

SEQ ID NO: 3467338 - RNA, 15 nt, Human
cagcucuucuccagg

SEQ ID NO: 3467339 - RNA, 19 nt, Human
cagcucuucuccaggcugu

SEQ ID NO: 3467340 - RNA, 18 nt, Human
cagcucuucuccccaggu

SEQ ID NO: 3467341 - RNA, 15 nt, Human
cagcucuugcccuuc

SEQ ID NO: 3467342 - RNA, 21 nt, Human
cagcucuugcuaaucaguguc

SEQ ID NO: 3467343 - RNA, 22 nt, Human
cagcucuugcuaaucagugucu

SEQ ID NO: 3467344 - RNA, 19 nt, Human
cagcucuuuccuccuucca

SEQ ID NO: 3467345 - RNA, 22 nt, Human
cagcucuuuccuccuuccaugg

SEQ ID NO: 3467346 - RNA, 18 nt, Human
cagcucuuuuugugaagu

SEQ ID NO: 3467347 - RNA, 16 nt, Human
cagcugaaauugaaaa

SEQ ID NO: 3467348 - RNA, 20 nt, Human
cagcugaaauugaaaaguua

SEQ ID NO: 3467349 - RNA, 15 nt, Human
cagcugaacagccaa

SEQ ID NO: 3467350 - RNA, 22 nt, Human
cagcugaacaguguuggcuuuc

SEQ ID NO: 3467351 - RNA, 23 nt, Human
cagcugaaguugcagauguuaga

SEQ ID NO: 3467352 - RNA, 14 nt, Human
cagcugacaguccu

SEQ ID NO: 3467353 - RNA, 13 nt, Human
cagcugaccucug

SEQ ID NO: 3467354 - RNA, 18 nt, Human
cagcugacuaaacuuuuu

SEQ ID NO: 3467355 - RNA, 17 nt, Human
cagcugagagaaaauaa

SEQ ID NO: 3467356 - RNA, 16 nt, Human
cagcugagcagggccg

SEQ ID NO: 3467357 - RNA, 20 nt, Human
cagcugagcagggccgggga

SEQ ID NO: 3467358 - RNA, 15 nt, Human
cagcugagccuucug

SEQ ID NO: 3467359 - RNA, 16 nt, Human
cagcugagccuucuga

SEQ ID NO: 3467360 - RNA, 17 nt, Human
cagcugagccuucugag

SEQ ID NO: 3467361 - RNA, 19 nt, Human
cagcugagggugagugggu

SEQ ID NO: 3467362 - RNA, 19 nt, Human
cagcugaggucucuugagg

SEQ ID NO: 3467363 - RNA, 14 nt, Human
cagcugaguuauga

SEQ ID NO: 3467364 - RNA, 12 nt, Human
cagcugaguugu

SEQ ID NO: 3467365 - RNA, 14 nt, Human
cagcugaugaguua

SEQ ID NO: 3467366 - RNA, 20 nt, Human
cagcugaugaguuacagccu

SEQ ID NO: 3467367 - RNA, 15 nt, Human
cagcugauuuuaaca

SEQ ID NO: 3467368 - RNA, 20 nt, Human
cagcugauuuuaacaauaac

SEQ ID NO: 3467369 - RNA, 11 nt, Human
cagcugcaaag

SEQ ID NO: 3467370 - RNA, 16 nt, Human
cagcugcaaaguguuu

SEQ ID NO: 3467371 - RNA, 20 nt, Human
cagcugcaccccuuccuggg

SEQ ID NO: 3467372 - RNA, 20 nt, Human
cagcugcaccugccagccug

SEQ ID NO: 3467373 - RNA, 21 nt, Human
cagcugcaccugccagccugg

SEQ ID NO: 3467374 - RNA, 15 nt, Human
cagcugcagagacag

SEQ ID NO: 3467375 - RNA, 16 nt, Human
cagcugcagagacaga

SEQ ID NO: 3467376 - RNA, 16 nt, Human
cagcugcagcugggcu

SEQ ID NO: 3467377 - RNA, 15 nt, Human
cagcugcaggaauca

SEQ ID NO: 3467378 - RNA, 16 nt, Human
cagcugcaucuacuca

SEQ ID NO: 3467379 - RNA, 16 nt, Human
cagcugcauuccgcag

SEQ ID NO: 3467380 - RNA, 16 nt, Human
cagcugccagagaagc

SEQ ID NO: 3467381 - RNA, 11 nt, Human
cagcugccagu

SEQ ID NO: 3467382 - RNA, 15 nt, Human
cagcugccccagcca

SEQ ID NO: 3467383 - RNA, 22 nt, Human
cagcugcccccagagccacagu

SEQ ID NO: 3467384 - RNA, 15 nt, Human
cagcugcccccgcuc

SEQ ID NO: 3467385 - RNA, 13 nt, Human
cagcugccccggg

SEQ ID NO: 3467386 - RNA, 16 nt, Human
cagcugccccucccug

SEQ ID NO: 3467387 - RNA, 19 nt, Human
cagcugccccucccugcca

SEQ ID NO: 3467388 - RNA, 18 nt, Human
cagcugcccuaugggccu

SEQ ID NO: 3467389 - RNA, 20 nt, Human
cagcugcccuaugggccugc

SEQ ID NO: 3467390 - RNA, 15 nt, Human
cagcugcccuuccgc

SEQ ID NO: 3467391 - RNA, 19 nt, Human
cagcugccgaccagagccc

SEQ ID NO: 3467392 - RNA, 13 nt, Human
cagucccacugug

SEQ ID NO: 3467393 - RNA, 14 nt, Human
cagucccacugugc

SEQ ID NO: 3467394 - RNA, 14 nt, Human
cagucccagagcag

SEQ ID NO: 3467395 - RNA, 14 nt, Human
cagucccagcagcc

SEQ ID NO: 3467396 - RNA, 15 nt, Human
cagucccagcagcca

SEQ ID NO: 3467397 - RNA, 15 nt, Human
caguccccaccccug

SEQ ID NO: 3467398 - RNA, 16 nt, Human
caguccccaccccugc

SEQ ID NO: 3467399 - RNA, 22 nt, Human
cagucccccuauccuuggcacc

SEQ ID NO: 3467400 - RNA, 13 nt, Human
caguccccuccca

SEQ ID NO: 3467401 - RNA, 14 nt, Human
caguccccucccau

SEQ ID NO: 3467402 - RNA, 19 nt, Human
caguccccucccaucuggg

SEQ ID NO: 3467403 - RNA, 13 nt, Human
caguccccuuccc

SEQ ID NO: 3467404 - RNA, 14 nt, Human
caguccccuucccg

SEQ ID NO: 3467405 - RNA, 22 nt, Human
caguccccuucccgugaccugg

SEQ ID NO: 3467406 - RNA, 19 nt, Human
caguccccuucccuccaag

SEQ ID NO: 3467407 - RNA, 15 nt, Human
cagucccuauguauu

SEQ ID NO: 3467408 - RNA, 14 nt, Human
cagucccugccaau

SEQ ID NO: 3467409 - RNA, 15 nt, Human
cagucccugccaaug

SEQ ID NO: 3467410 - RNA, 22 nt, Human
cagucccugggggaagcccugg

SEQ ID NO: 3467411 - RNA, 19 nt, Human
caguccguguggauccaau

SEQ ID NO: 3467412 - RNA, 20 nt, Human
caguccuacucaagcgggug

SEQ ID NO: 3467413 - RNA, 17 nt, Human
caguccuagcugcacag

SEQ ID NO: 3467414 - RNA, 15 nt, Human
caguccuaucugggc

SEQ ID NO: 3467415 - RNA, 16 nt, Human
caguccuaucugggcu

SEQ ID NO: 3467416 - RNA, 12 nt, Human
caguccucccau

SEQ ID NO: 3467417 - RNA, 13 nt, Human
caguccucccauc

SEQ ID NO: 3467418 - RNA, 16 nt, Human
caguccucccaucuca

SEQ ID NO: 3467419 - RNA, 12 nt, Human
caguccuccccu

SEQ ID NO: 3467420 - RNA, 15 nt, Human
caguccuccccucac

SEQ ID NO: 3467421 - RNA, 19 nt, Human
caguccuccccucacagcc

SEQ ID NO: 3467422 - RNA, 20 nt, Human
caguccucuccaccuagugg

SEQ ID NO: 3467423 - RNA, 22 nt, Human
caguccucuccaccuaguggcu

SEQ ID NO: 3467424 - RNA, 13 nt, Human
caguccucuuuca

SEQ ID NO: 3467425 - RNA, 22 nt, Human
caguccugaucagagccguggu

SEQ ID NO: 3467426 - RNA, 14 nt, Human
caguccugcccgcc

SEQ ID NO: 3467427 - RNA, 17 nt, Human
caguccugccucagccu

SEQ ID NO: 3467428 - RNA, 19 nt, Human
caguccugccucagccucc

SEQ ID NO: 3467429 - RNA, 13 nt, Human
caguccugccugg

SEQ ID NO: 3467430 - RNA, 16 nt, Human
caguccugccuggcca

SEQ ID NO: 3467431 - RNA, 18 nt, Human
caguccugccuggccagg

SEQ ID NO: 3467432 - RNA, 21 nt, Human
caguccugccuggccaggcag

SEQ ID NO: 3467433 - RNA, 13 nt, Human
caguccugcucca

SEQ ID NO: 3467434 - RNA, 15 nt, Human
caguccugcuccaga

SEQ ID NO: 3467435 - RNA, 16 nt, Human
caguccugcuccagaa

SEQ ID NO: 3467436 - RNA, 22 nt, Human
caguccugcucucuacccagcc

SEQ ID NO: 3467437 - RNA, 17 nt, Human
caguccuggaagccagc

SEQ ID NO: 3467438 - RNA, 22 nt, Human
caguccuggaagccagcuuucc

SEQ ID NO: 3467439 - RNA, 23 nt, Human
caguccuggagcaaucacagaug

SEQ ID NO: 3467440 - RNA, 15 nt, Human
caguccuuggccugc

SEQ ID NO: 3467441 - RNA, 15 nt, Human
cagucgauagagcug

SEQ ID NO: 3467442 - RNA, 16 nt, Human
cagucgauagagcugu

SEQ ID NO: 3467443 - RNA, 15 nt, Human
cagucgcgcugccug

SEQ ID NO: 3467444 - RNA, 16 nt, Human
cagucgcgcugccugu

SEQ ID NO: 3467445 - RNA, 20 nt, Human
cagucgcgcugccugugugg

SEQ ID NO: 3467446 - RNA, 17 nt, Human
cagucgggggcuggccu

SEQ ID NO: 3467447 - RNA, 15 nt, Human
cagucguuagaauau

SEQ ID NO: 3467448 - RNA, 16 nt, Human
cagucguucccagugu

SEQ ID NO: 3467449 - RNA, 22 nt, Human
cagucuaaagcugguuuaaugu

SEQ ID NO: 3467450 - RNA, 14 nt, Human
cagucuacccagag

SEQ ID NO: 3467451 - RNA, 15 nt, Human
cagucuacccagaga

SEQ ID NO: 3467452 - RNA, 13 nt, Human
cagucuaguuccu

SEQ ID NO: 3467453 - RNA, 15 nt, Human
cagucuaucauuguu

SEQ ID NO: 3467454 - RNA, 23 nt, Human
cagucuauccacagagaguccca

SEQ ID NO: 3467455 - RNA, 16 nt, Human
cagucuauuugagacu

SEQ ID NO: 3467456 - RNA, 10 nt, Human
cagucucaca

SEQ ID NO: 3467457 - RNA, 22 nt, Human
cagucucacaugauuccagcca

SEQ ID NO: 3467458 - RNA, 19 nt, Human
cagucucacugugggaagg

SEQ ID NO: 3467459 - RNA, 13 nt, Human
cagucucaggagc

SEQ ID NO: 3467460 - RNA, 17 nt, Human
cagucuccaccaggaac

SEQ ID NO: 3467461 - RNA, 19 nt, Human
cagucucccccacccuugu

SEQ ID NO: 3467462 - RNA, 14 nt, Human
cagucucccucccu

SEQ ID NO: 3467463 - RNA, 11 nt, Human
cagucucccuu

SEQ ID NO: 3467464 - RNA, 17 nt, Human
cagucucccuucuccca

SEQ ID NO: 3467465 - RNA, 22 nt, Human
cagucucccuucucccaugagg

SEQ ID NO: 3467466 - RNA, 18 nt, Human
cagucucccuuucccuuc

SEQ ID NO: 3467467 - RNA, 22 nt, Human
cagucucccuuucccuucuugg

SEQ ID NO: 3467468 - RNA, 17 nt, Human
cagucuccggccucucc

SEQ ID NO: 3467469 - RNA, 22 nt, Human
cagucuccggccucuccagccu

SEQ ID NO: 3467470 - RNA, 12 nt, Human
cagucuccucuu

SEQ ID NO: 3467471 - RNA, 20 nt, Human
cagucuccucuuuaaaacaa

SEQ ID NO: 3467472 - RNA, 17 nt, Human
cagucucuauaccaaua

SEQ ID NO: 3467473 - RNA, 19 nt, Human
cagucucuauaccaauaaa

SEQ ID NO: 3467474 - RNA, 22 nt, Human
cagucucuauaccaauaaagug

SEQ ID NO: 3467475 - RNA, 23 nt, Human
cagucucuauaccaauaaaguga

SEQ ID NO: 3467476 - RNA, 14 nt, Human
cagucucucuuaaa

SEQ ID NO: 3467477 - RNA, 22 nt, Human
cagucucucuuacccuucugug

SEQ ID NO: 3467478 - RNA, 14 nt, Human
cagucucucuucuc

SEQ ID NO: 3467479 - RNA, 12 nt, Human
cagucucugagc

SEQ ID NO: 3467480 - RNA, 14 nt, Human
cagucucugagcag

SEQ ID NO: 3467481 - RNA, 13 nt, Human
cagucucugccuu

SEQ ID NO: 3467482 - RNA, 14 nt, Human
cagucucugccuug

SEQ ID NO: 3467483 - RNA, 15 nt, Human
cagucucuuuaaucu

SEQ ID NO: 3467484 - RNA, 16 nt, Human
cagucugaaugcugcc

SEQ ID NO: 3467485 - RNA, 18 nt, Human
cagucugagagaggccau

SEQ ID NO: 3467486 - RNA, 21 nt, Human
cagucugauucccaagcucug

SEQ ID NO: 3467487 - RNA, 12 nt, Human
cagucugcugcc

SEQ ID NO: 3467488 - RNA, 16 nt, Human
cagucugcuuagaaau

SEQ ID NO: 3467489 - RNA, 17 nt, Human
cagucugcuuagaaaua

SEQ ID NO: 3467490 - RNA, 17 nt, Human
cagucuggaaugcagug

SEQ ID NO: 3467491 - RNA, 16 nt, Human
cagucuggaggggcau

SEQ ID NO: 3467492 - RNA, 21 nt, Human
cagucuggaggggcauggcca

SEQ ID NO: 3467493 - RNA, 24 nt, Human
cagucugucaugaacauguuccug

SEQ ID NO: 3467494 - RNA, 11 nt, Human
cagucugucuu

SEQ ID NO: 3467495 - RNA, 23 nt, Human
cagucugucuucuguauauaaau

SEQ ID NO: 3467496 - RNA, 15 nt, Human
cagucuguggaucag

SEQ ID NO: 3467497 - RNA, 22 nt, Human
cagucuuagaucauaguuuuau

SEQ ID NO: 3467498 - RNA, 19 nt, Human
cagucuuaugcuuccagaa

SEQ ID NO: 3467499 - RNA, 19 nt, Human
cagucuuccacaaagaaaa

SEQ ID NO: 3467500 - RNA, 16 nt, Human
cagucuuccaccugga

SEQ ID NO: 3467501 - RNA, 19 nt, Human
cagucuuccaccuggaagc

SEQ ID NO: 3467502 - RNA, 15 nt, Human
cagucuuccauuugc

SEQ ID NO: 3467503 - RNA, 23 nt, Human
cagucuucccuagggcugggugu

SEQ ID NO: 3467504 - RNA, 18 nt, Human
cagucuuccugacacuuu

SEQ ID NO: 3467505 - RNA, 15 nt, Human
cagucuugcagcagg

SEQ ID NO: 3467506 - RNA, 17 nt, Human
cagucuuuaaaggccca

SEQ ID NO: 3467507 - RNA, 20 nt, Human
cagucuuuaaaggcccagcc

SEQ ID NO: 3467508 - RNA, 20 nt, Human
cagucuuucaacucauugca

SEQ ID NO: 3467509 - RNA, 12 nt, Human
cagucuuuuguc

SEQ ID NO: 3467510 - RNA, 16 nt, Human
cagucuuuuucuguug

SEQ ID NO: 3467511 - RNA, 22 nt, Human
cagugaaaauaagccaugagaa

SEQ ID NO: 3467512 - RNA, 23 nt, Human
cagugaaaauaagccaugagaau

SEQ ID NO: 3467513 - RNA, 13 nt, Human
cagugaaagaaaa

SEQ ID NO: 3467514 - RNA, 15 nt, Human
cagugaagacagaag

SEQ ID NO: 3467515 - RNA, 16 nt, Human
cagugaagacagaagu

SEQ ID NO: 3467516 - RNA, 14 nt, Human
cagugaaguugcug

SEQ ID NO: 3467517 - RNA, 20 nt, Human
cagugaauuguguaggagag

SEQ ID NO: 3467518 - RNA, 18 nt, Human
cagugacacuucagagag

SEQ ID NO: 3467519 - RNA, 19 nt, Human
cagugacacuucagagagc

SEQ ID NO: 3467520 - RNA, 22 nt, Human
cagugacacuucagagagcugg

SEQ ID NO: 3467521 - RNA, 23 nt, Human
cagugacacuucagagagcuggu

SEQ ID NO: 3467522 - RNA, 15 nt, Human
cagugacagacaggc

SEQ ID NO: 3467523 - RNA, 18 nt, Human
cagugacagacaggcucu

SEQ ID NO: 3467524 - RNA, 22 nt, Human
cagugacgugcaccuguacuca

SEQ ID NO: 3467525 - RNA, 13 nt, Human
cagugacuccagg

SEQ ID NO: 3467526 - RNA, 14 nt, Human
cagugacuccagga

SEQ ID NO: 3467527 - RNA, 15 nt, Human
cagugacuccaggag

SEQ ID NO: 3467528 - RNA, 19 nt, Human
cagugacucgggcuccugu

SEQ ID NO: 3467529 - RNA, 23 nt, Human
cagugacucgggcuccugugccc

SEQ ID NO: 3467530 - RNA, 13 nt, Human
cagugacuucuga

SEQ ID NO: 3467531 - RNA, 15 nt, Human
cagugacuucugaga

SEQ ID NO: 3467532 - RNA, 20 nt, Human
cagugagaaaaagcuccugu

SEQ ID NO: 3467533 - RNA, 22 nt, Human
cagugagaaaaagcuccugucc

SEQ ID NO: 3467534 - RNA, 15 nt, Human
cagugagacagcucu

SEQ ID NO: 3467535 - RNA, 21 nt, Human
cagugagagaguggcuggggc

SEQ ID NO: 3467536 - RNA, 15 nt, Human
cagugagagcagaug

SEQ ID NO: 3467537 - RNA, 20 nt, Human
caguuuucuggcuggagccu

SEQ ID NO: 3467538 - RNA, 20 nt, Human
caguuuugacaucagccagc

SEQ ID NO: 3467539 - RNA, 18 nt, Human
caguuuugguugcuuuaa

SEQ ID NO: 3467540 - RNA, 16 nt, Human
caguuuuuuaugcuaa

SEQ ID NO: 3467541 - RNA, 20 nt, Human
caguuuuuuuuuucuugucu

SEQ ID NO: 3467542 - RNA, 23 nt, Human
caguuuuuuuuuucuugucuaua

SEQ ID NO: 3467543 - RNA, 21 nt, Human
cauaaaaacaacuuuauaccc

SEQ ID NO: 3467544 - RNA, 23 nt, Human
cauaaaaagcaaaacaaaaauua

SEQ ID NO: 3467545 - RNA, 20 nt, Human
cauaaaaaggacaucagcaa

SEQ ID NO: 3467546 - RNA, 22 nt, Human
cauaaaaaguuaaaaaaaauaa

SEQ ID NO: 3467547 - RNA, 12 nt, Human
cauaaaacaggu

SEQ ID NO: 3467548 - RNA, 16 nt, Human
cauaaaacauuaagaa

SEQ ID NO: 3467549 - RNA, 17 nt, Human
cauaaaacauuaagaaa

SEQ ID NO: 3467550 - RNA, 18 nt, Human
cauaaaacauuaagaaaa

SEQ ID NO: 3467551 - RNA, 14 nt, Human
cauaaaagaauuuu

SEQ ID NO: 3467552 - RNA, 22 nt, Human
cauaaaauguccaguaagauca

SEQ ID NO: 3467553 - RNA, 22 nt, Human
cauaaacaagaccacguuucua

SEQ ID NO: 3467554 - RNA, 11 nt, Human
cauaaacauca

SEQ ID NO: 3467555 - RNA, 22 nt, Human
cauaaacaucagguuaggcagu

SEQ ID NO: 3467556 - RNA, 15 nt, Human
cauaaacauucuuuu

SEQ ID NO: 3467557 - RNA, 21 nt, Human
cauaaacccaguugccaucug

SEQ ID NO: 3467558 - RNA, 17 nt, Human
cauaaacugacuuuauc

SEQ ID NO: 3467559 - RNA, 14 nt, Human
cauaaacugugugc

SEQ ID NO: 3467560 - RNA, 15 nt, Human
cauaaacugugugca

SEQ ID NO: 3467561 - RNA, 11 nt, Human
cauaaagaagc

SEQ ID NO: 3467562 - RNA, 22 nt, Human
cauaaagaauuugucacaggaa

SEQ ID NO: 3467563 - RNA, 22 nt, Human
cauaaagaggcguugcuuucac

SEQ ID NO: 3467564 - RNA, 19 nt, Human
cauaaaggaaaagacacau

SEQ ID NO: 3467565 - RNA, 18 nt, Human
cauaaaggauaaacuuuu

SEQ ID NO: 3467566 - RNA, 16 nt, Human
cauaaagguaaaacaa

SEQ ID NO: 3467567 - RNA, 15 nt, Human
cauaaaguaaauaca

SEQ ID NO: 3467568 - RNA, 11 nt, Human
cauaaagucag

SEQ ID NO: 3467569 - RNA, 14 nt, Human
cauaaagugagaaa

SEQ ID NO: 3467570 - RNA, 17 nt, Human
cauaaagugagaaaacu

SEQ ID NO: 3467571 - RNA, 18 nt, Human
cauaaaguuagaaucuau

SEQ ID NO: 3467572 - RNA, 12 nt, Human
cauaaauaugca

SEQ ID NO: 3467573 - RNA, 15 nt, Human
cauaaauaugcagug

SEQ ID NO: 3467574 - RNA, 13 nt, Human
cauaaaugaagca

SEQ ID NO: 3467575 - RNA, 14 nt, Human
cauaaaugaagcag

SEQ ID NO: 3467576 - RNA, 21 nt, Human
cauaaaugcagcccauuucuc

SEQ ID NO: 3467577 - RNA, 11 nt, Human
cauaaauuauu

SEQ ID NO: 3467578 - RNA, 12 nt, Human
cauaaauuauug

SEQ ID NO: 3467579 - RNA, 17 nt, Human
cauaaauuauuugauua

SEQ ID NO: 3467580 - RNA, 19 nt, Human
cauaaauuuaguauuuugu

SEQ ID NO: 3467581 - RNA, 12 nt, Human
cauaaauuuuuu

SEQ ID NO: 3467582 - RNA, 13 nt, Human
cauaacagaaugc

SEQ ID NO: 3467583 - RNA, 13 nt, Human
cauaacagugcag

SEQ ID NO: 3467584 - RNA, 16 nt, Human
cauaacagugcagggc

SEQ ID NO: 3467585 - RNA, 16 nt, Human
cauaacagugccauug

SEQ ID NO: 3467586 - RNA, 13 nt, Human
cauaaccccaccc

SEQ ID NO: 3467587 - RNA, 20 nt, Human
cauaaccccacccuugccca

SEQ ID NO: 3467588 - RNA, 18 nt, Human
cauaaccuuaccagauuu

SEQ ID NO: 3467589 - RNA, 15 nt, Human
cauaacguuuuuccu

SEQ ID NO: 3467590 - RNA, 20 nt, Human
cauaacguuuuuccuuuaaa

SEQ ID NO: 3467591 - RNA, 13 nt, Human
cauaacuaaauuu

SEQ ID NO: 3467592 - RNA, 11 nt, Human
cauaacugaaa

SEQ ID NO: 3467593 - RNA, 14 nt, Human
cauaacugaaaaug

SEQ ID NO: 3467594 - RNA, 14 nt, Human
cauaacugaacauc

SEQ ID NO: 3467595 - RNA, 13 nt, Human
cauaacugacaaa

SEQ ID NO: 3467596 - RNA, 16 nt, Human
cauaacugacaaauca

SEQ ID NO: 3467597 - RNA, 19 nt, Human
cauaacugacaaaucaagu

SEQ ID NO: 3467598 - RNA, 20 nt, Human
cauaacugacaaaucaaguu

SEQ ID NO: 3467599 - RNA, 22 nt, Human
cauaacugacaaaucaaguuuc

SEQ ID NO: 3467600 - RNA, 19 nt, Human
cauaacugacuuaguucuu

SEQ ID NO: 3467601 - RNA, 14 nt, Human
cauaacugccuuga

SEQ ID NO: 3467602 - RNA, 21 nt, Human
cauaacuuauugcugauuuua

SEQ ID NO: 3467603 - RNA, 22 nt, Human
cauaacuuauugcugauuuuaa

SEQ ID NO: 3467604 - RNA, 14 nt, Human
cauaacuuccugua

SEQ ID NO: 3467605 - RNA, 12 nt, Human
cauaagaaugaa

SEQ ID NO: 3467606 - RNA, 11 nt, Human
cauaagaccau

SEQ ID NO: 3467607 - RNA, 16 nt, Human
cauaagacccuaagcc

SEQ ID NO: 3467608 - RNA, 16 nt, Human
cauaagcuacugccau

SEQ ID NO: 3467609 - RNA, 16 nt, Human
cauaagcuauuuuucu

SEQ ID NO: 3467610 - RNA, 17 nt, Human
cauaagcuauuuuucua

SEQ ID NO: 3467611 - RNA, 18 nt, Human
cauaagcuauuuuucuaa

SEQ ID NO: 3467612 - RNA, 16 nt, Human
cauaagcucagaaucc

SEQ ID NO: 3467613 - RNA, 18 nt, Human
cauaagcuuaugcuuaaa

SEQ ID NO: 3467614 - RNA, 19 nt, Human
cauaagcuuccauuuuaau

SEQ ID NO: 3467615 - RNA, 22 nt, Human
cauaagguuucguuucuguaua

SEQ ID NO: 3467616 - RNA, 22 nt, Human
cauaaguaauucaagaaaacaa

SEQ ID NO: 3467617 - RNA, 16 nt, Human
cauaaguauacaguuc

SEQ ID NO: 3467618 - RNA, 12 nt, Human
cauaaguuucug

SEQ ID NO: 3467619 - RNA, 18 nt, Human
cauaauaaaaggcuuuga

SEQ ID NO: 3467620 - RNA, 20 nt, Human
cauaauacacuugcccugcu

SEQ ID NO: 3467621 - RNA, 21 nt, Human
cauaauacacuugcccugcuc

SEQ ID NO: 3467622 - RNA, 21 nt, Human
cauaaucuaguuuacagaaaa

SEQ ID NO: 3467623 - RNA, 22 nt, Human
cauaaucuaguuuacagaaaaa

SEQ ID NO: 3467624 - RNA, 19 nt, Human
cauaaucuggacuccucug

SEQ ID NO: 3467625 - RNA, 20 nt, Human
cauaaucuggacuccucugu

SEQ ID NO: 3467626 - RNA, 22 nt, Human
cauaaucuggacuccucugucc

SEQ ID NO: 3467627 - RNA, 15 nt, Human
cauaaucuucugccu

SEQ ID NO: 3467628 - RNA, 21 nt, Human
cauaaugcauucuucucuguu

SEQ ID NO: 3467629 - RNA, 14 nt, Human
cauaaugcgugcau

SEQ ID NO: 3467630 - RNA, 17 nt, Human
cauaaugcgugcauacc

SEQ ID NO: 3467631 - RNA, 21 nt, Human
cauaaugcgugcauaccacuu

SEQ ID NO: 3467632 - RNA, 23 nt, Human
cauaaugcgugcauaccacuuuu

SEQ ID NO: 3467633 - RNA, 21 nt, Human
cauaaugcuaauuuaaagaga

SEQ ID NO: 3467634 - RNA, 18 nt, Human
cauaaugcuuaauuucua

SEQ ID NO: 3467635 - RNA, 22 nt, Human
cauaaugggccacugaaaucug

SEQ ID NO: 3467636 - RNA, 20 nt, Human
cauaauguacugauuucagu

SEQ ID NO: 3467637 - RNA, 14 nt, Human
cauaauguauuguu

SEQ ID NO: 3467638 - RNA, 13 nt, Human
cauaaugugaagu

SEQ ID NO: 3467639 - RNA, 15 nt, Human
cauaauguucugcua

SEQ ID NO: 3467640 - RNA, 15 nt, Human
cauaauuaaaguguc

SEQ ID NO: 3467641 - RNA, 21 nt, Human
cauaauuauccaggaagggaa

SEQ ID NO: 3467642 - RNA, 18 nt, Human
cauaauucugaaguuaua

SEQ ID NO: 3467643 - RNA, 16 nt, Human
cauaauucuuguauau

SEQ ID NO: 3467644 - RNA, 18 nt, Human
cauaauucuuguauauua

SEQ ID NO: 3467645 - RNA, 20 nt, Human
cauaauuuauacaggucaua

SEQ ID NO: 3467646 - RNA, 21 nt, Human
cauacaaacaagcauauaaaa

SEQ ID NO: 3467647 - RNA, 18 nt, Human
cauacaaagcgugcacaa

SEQ ID NO: 3467648 - RNA, 15 nt, Human
cauacaacacaaaga

SEQ ID NO: 3467649 - RNA, 13 nt, Human
cauacaaggccca

SEQ ID NO: 3467650 - RNA, 19 nt, Human
cauacacacgcugccuucg

SEQ ID NO: 3467651 - RNA, 13 nt, Human
cauacaccagcau

SEQ ID NO: 3467652 - RNA, 13 nt, Human
cauacacgaaaga

SEQ ID NO: 3467653 - RNA, 15 nt, Human
cauacacuuccuucu

SEQ ID NO: 3467654 - RNA, 13 nt, Human
cauacagagaagu

SEQ ID NO: 3467655 - RNA, 22 nt, Human
cauacagagaagucacagggca

SEQ ID NO: 3467656 - RNA, 18 nt, Human
cauacagcauuacaaauu

SEQ ID NO: 3467657 - RNA, 21 nt, Human
cauacaggauuugaacucaga

SEQ ID NO: 3467658 - RNA, 19 nt, Human
cauacagggaugguguuca

SEQ ID NO: 3467659 - RNA, 18 nt, Human
cauacauaaaagaaauaa

SEQ ID NO: 3467660 - RNA, 19 nt, Human
cauacauauuuuuguagca

SEQ ID NO: 3467661 - RNA, 21 nt, Human
cauacauucuucaagauccca

SEQ ID NO: 3467662 - RNA, 15 nt, Human
cauacauuguacgaa

SEQ ID NO: 3467663 - RNA, 17 nt, Human
cauacauuuauaauguu

SEQ ID NO: 3467664 - RNA, 14 nt, Human
cauacauuuucuaa

SEQ ID NO: 3467665 - RNA, 17 nt, Human
cauacauuuuguaccaa

SEQ ID NO: 3467666 - RNA, 20 nt, Human
cauaccaacucaacuuuuuu

SEQ ID NO: 3467667 - RNA, 18 nt, Human
cauaccacuuuuguucuu

SEQ ID NO: 3467668 - RNA, 14 nt, Human
cauacccaccccca

SEQ ID NO: 3467669 - RNA, 17 nt, Human
cauacccacccccaccc

SEQ ID NO: 3467670 - RNA, 20 nt, Human
cauaccccuuacaaaugaaa

SEQ ID NO: 3467671 - RNA, 22 nt, Human
cauacccgccuagcugcuguca

SEQ ID NO: 3467672 - RNA, 13 nt, Human
cauacccuccccc

SEQ ID NO: 3467673 - RNA, 14 nt, Human
cauacccugaccug

SEQ ID NO: 3467674 - RNA, 16 nt, Human
cauacccugaccuggc

SEQ ID NO: 3467675 - RNA, 18 nt, Human
cauacccugaccuggccc

SEQ ID NO: 3467676 - RNA, 18 nt, Human
cauaccuaaguacuguaa

SEQ ID NO: 3467677 - RNA, 16 nt, Human
cauaccuuccuucccu

SEQ ID NO: 3467678 - RNA, 14 nt, Human
cauacgauuuaagg

SEQ ID NO: 3467679 - RNA, 19 nt, Human
cauacggucagguuuaaca

SEQ ID NO: 3467680 - RNA, 16 nt, Human
cauacguacacauuuu

SEQ ID NO: 3467681 - RNA, 20 nt, Human
cauacuaauuauacccccug

SEQ ID NO: 3467682 - RNA, 19 nt, Human
cauguuccaauaaacagga

SEQ ID NO: 3467683 - RNA, 16 nt, Human
cauguucccuucuccu

SEQ ID NO: 3467684 - RNA, 13 nt, Human
cauguuccuucaa

SEQ ID NO: 3467685 - RNA, 20 nt, Human
cauguugaccaugucuauga

SEQ ID NO: 3467686 - RNA, 19 nt, Human
cauguugagccaggccugg

SEQ ID NO: 3467687 - RNA, 23 nt, Human
cauguugcacacccacucagcuc

SEQ ID NO: 3467688 - RNA, 17 nt, Human
cauguugccaaaauggu

SEQ ID NO: 3467689 - RNA, 15 nt, Human
cauguugcugaggag

SEQ ID NO: 3467690 - RNA, 18 nt, Human
cauguuggccaggcuggu

SEQ ID NO: 3467691 - RNA, 20 nt, Human
cauguuggccaggcuggucu

SEQ ID NO: 3467692 - RNA, 21 nt, Human
cauguuggccaggcuggucua

SEQ ID NO: 3467693 - RNA, 21 nt, Human
cauguuggccaggcuggucuu

SEQ ID NO: 3467694 - RNA, 20 nt, Human
cauguugguauuuaucuauu

SEQ ID NO: 3467695 - RNA, 18 nt, Human
cauguuggucaggcuggu

SEQ ID NO: 3467696 - RNA, 20 nt, Human
cauguugguugcacuuugua

SEQ ID NO: 3467697 - RNA, 16 nt, Human
cauguuguaaugcugc

SEQ ID NO: 3467698 - RNA, 17 nt, Human
cauguuguaaugcugca

SEQ ID NO: 3467699 - RNA, 18 nt, Human
cauguugugccucccugg

SEQ ID NO: 3467700 - RNA, 13 nt, Human
cauguuuaagauu

SEQ ID NO: 3467701 - RNA, 19 nt, Human
cauguuuaagauuuaauuu

SEQ ID NO: 3467702 - RNA, 19 nt, Human
cauguuuagacuuuaacau

SEQ ID NO: 3467703 - RNA, 23 nt, Human
cauguuuauaaaucuuaugcucu

SEQ ID NO: 3467704 - RNA, 20 nt, Human
cauguuuaugaaaauaaaua

SEQ ID NO: 3467705 - RNA, 14 nt, Human
cauguuuauguaaa

SEQ ID NO: 3467706 - RNA, 18 nt, Human
cauguuuauuacaguaua

SEQ ID NO: 3467707 - RNA, 19 nt, Human
cauguuuauuacaguauaa

SEQ ID NO: 3467708 - RNA, 15 nt, Human
cauguuuauuuuucu

SEQ ID NO: 3467709 - RNA, 14 nt, Human
cauguuuccagcag

SEQ ID NO: 3467710 - RNA, 21 nt, Human
cauguuuccucuaguucuuug

SEQ ID NO: 3467711 - RNA, 21 nt, Human
cauguuucucuggccccaagg

SEQ ID NO: 3467712 - RNA, 10 nt, Human
cauguuucuu

SEQ ID NO: 3467713 - RNA, 22 nt, Human
cauguuucuuugaucaugaaua

SEQ ID NO: 3467714 - RNA, 21 nt, Human
cauguuucuuuguaaugaaaa

SEQ ID NO: 3467715 - RNA, 22 nt, Human
cauguuucuuuguaaugaaaac

SEQ ID NO: 3467716 - RNA, 16 nt, Human
cauguuugagcucaga

SEQ ID NO: 3467717 - RNA, 23 nt, Human
cauguuugauguaucugagcagg

SEQ ID NO: 3467718 - RNA, 22 nt, Human
cauguuugcaccuuucuaguug

SEQ ID NO: 3467719 - RNA, 16 nt, Human
cauguuugcugaacac

SEQ ID NO: 3467720 - RNA, 14 nt, Human
cauguuugcuucau

SEQ ID NO: 3467721 - RNA, 21 nt, Human
cauguuuggugcauagaacug

SEQ ID NO: 3467722 - RNA, 15 nt, Human
cauguuugugauuga

SEQ ID NO: 3467723 - RNA, 18 nt, Human
cauguuuuaaagcuugcu

SEQ ID NO: 3467724 - RNA, 12 nt, Human
cauguuuuaaca

SEQ ID NO: 3467725 - RNA, 16 nt, Human
cauguuuuaacaaaaa

SEQ ID NO: 3467726 - RNA, 13 nt, Human
cauguuuucaaau

SEQ ID NO: 3467727 - RNA, 16 nt, Human
cauguuuucaaaugga

SEQ ID NO: 3467728 - RNA, 22 nt, Human
cauguuuucaaauggaguugga

SEQ ID NO: 3467729 - RNA, 18 nt, Human
cauguuuuccagcuccuc

SEQ ID NO: 3467730 - RNA, 21 nt, Human
cauguuuucugaaaauauaac

SEQ ID NO: 3467731 - RNA, 13 nt, Human
cauguuuugauaa

SEQ ID NO: 3467732 - RNA, 18 nt, Human
cauguuuugauaaaguag

SEQ ID NO: 3467733 - RNA, 14 nt, Human
cauguuuuguauac

SEQ ID NO: 3467734 - RNA, 22 nt, Human
cauguuuuguauacaaauauau

SEQ ID NO: 3467735 - RNA, 21 nt, Human
cauguuuugugcauuuguaaa

SEQ ID NO: 3467736 - RNA, 15 nt, Human
cauguuuuguuuacg

SEQ ID NO: 3467737 - RNA, 13 nt, Human
cauuaaaaaauga

SEQ ID NO: 3467738 - RNA, 22 nt, Human
cauuaaaaaaugaaauauuuuu

SEQ ID NO: 3467739 - RNA, 15 nt, Human
cauuaaaaauggaac

SEQ ID NO: 3467740 - RNA, 15 nt, Human
cauuaaaacugcuuu

SEQ ID NO: 3467741 - RNA, 12 nt, Human
cauuaaaagaaa

SEQ ID NO: 3467742 - RNA, 13 nt, Human
cauuaaaagaaaa

SEQ ID NO: 3467743 - RNA, 14 nt, Human
cauuaaaccugucu

SEQ ID NO: 3467744 - RNA, 23 nt, Human
cauuaaaccugucuccacugugc

SEQ ID NO: 3467745 - RNA, 22 nt, Human
cauuaaacgauuuuuaaaaugu

SEQ ID NO: 3467746 - RNA, 22 nt, Human
cauuaaagcagucacuuuuccu

SEQ ID NO: 3467747 - RNA, 18 nt, Human
cauuaaagcauuuacuuu

SEQ ID NO: 3467748 - RNA, 15 nt, Human
cauuaaagucagaag

SEQ ID NO: 3467749 - RNA, 11 nt, Human
cauuaaauaaa

SEQ ID NO: 3467750 - RNA, 11 nt, Human
cauuaaaugaa

SEQ ID NO: 3467751 - RNA, 14 nt, Human
cauuaaauguuuga

SEQ ID NO: 3467752 - RNA, 22 nt, Human
cauuaaauuacuauagcaaagu

SEQ ID NO: 3467753 - RNA, 18 nt, Human
cauuaaauucacaaacuu

SEQ ID NO: 3467754 - RNA, 13 nt, Human
cauuaacaaauaa

SEQ ID NO: 3467755 - RNA, 16 nt, Human
cauuaacaguuuucca

SEQ ID NO: 3467756 - RNA, 18 nt, Human
cauuaaccgaugcuuuac

SEQ ID NO: 3467757 - RNA, 22 nt, Human
cauuaaccgaugcuuuaccaaa

SEQ ID NO: 3467758 - RNA, 15 nt, Human
cauuaacucauuaga

SEQ ID NO: 3467759 - RNA, 13 nt, Human
cauuaacugcuuc

SEQ ID NO: 3467760 - RNA, 15 nt, Human
cauuaacugcuuccu

SEQ ID NO: 3467761 - RNA, 15 nt, Human
cauuaagaaaaucau

SEQ ID NO: 3467762 - RNA, 22 nt, Human
cauuaagaauguugguuuacuu

SEQ ID NO: 3467763 - RNA, 13 nt, Human
cauuaagcaucac

SEQ ID NO: 3467764 - RNA, 16 nt, Human
cauuaagcccucuucc

SEQ ID NO: 3467765 - RNA, 20 nt, Human
cauuaagcccucuuccauca

SEQ ID NO: 3467766 - RNA, 18 nt, Human
cauuaaggggaagaauga

SEQ ID NO: 3467767 - RNA, 23 nt, Human
cauuaaggggaagaaugaaagcu

SEQ ID NO: 3467768 - RNA, 15 nt, Human
cauuaauacucuuua

SEQ ID NO: 3467769 - RNA, 18 nt, Human
cauuaauagcagccuuuc

SEQ ID NO: 3467770 - RNA, 20 nt, Human
cauuaauagcagccuuucuc

SEQ ID NO: 3467771 - RNA, 17 nt, Human
cauuaauauuugcugac

SEQ ID NO: 3467772 - RNA, 17 nt, Human
cauuaauccacauguuu

SEQ ID NO: 3467773 - RNA, 19 nt, Human
cauuaauccacauguuuca

SEQ ID NO: 3467774 - RNA, 21 nt, Human
cauuaauccacauguuucaga

SEQ ID NO: 3467775 - RNA, 17 nt, Human
cauuaaugccugcuuuu

SEQ ID NO: 3467776 - RNA, 23 nt, Human
cauuaauguuaauucagcacuga

SEQ ID NO: 3467777 - RNA, 13 nt, Human
cauuaauguugau

SEQ ID NO: 3467778 - RNA, 17 nt, Human
cauuaauguugauuucu

SEQ ID NO: 3467779 - RNA, 15 nt, Human
cauuaauguuucuau

SEQ ID NO: 3467780 - RNA, 19 nt, Human
cauuaauuauuauugcugu

SEQ ID NO: 3467781 - RNA, 20 nt, Human
cauuaauuauuauugcuguu

SEQ ID NO: 3467782 - RNA, 21 nt, Human
cauuaauucaggcauauuuua

SEQ ID NO: 3467783 - RNA, 12 nt, Human
cauuaauucuau

SEQ ID NO: 3467784 - RNA, 14 nt, Human
cauuaauuuaaaug

SEQ ID NO: 3467785 - RNA, 18 nt, Human
cauuaauuuaaaugauuu

SEQ ID NO: 3467786 - RNA, 17 nt, Human
cauuacaaguauuuuua

SEQ ID NO: 3467787 - RNA, 22 nt, Human
cauuacagagaggagaaacaca

SEQ ID NO: 3467788 - RNA, 24 nt, Human
cauuacagggaaugccugagugcc

SEQ ID NO: 3467789 - RNA, 21 nt, Human
cauuacagggcacaggccaug

SEQ ID NO: 3467790 - RNA, 11 nt, Human
cauuaccaaaa

SEQ ID NO: 3467791 - RNA, 20 nt, Human
cauuaccaaaauaauaaaaa

SEQ ID NO: 3467792 - RNA, 23 nt, Human
cauuaccaaaauaauaaaaauca

SEQ ID NO: 3467793 - RNA, 12 nt, Human
cauuaccacuca

SEQ ID NO: 3467794 - RNA, 13 nt, Human
cauuaccacucag

SEQ ID NO: 3467795 - RNA, 14 nt, Human
cauuaccacucagg

SEQ ID NO: 3467796 - RNA, 15 nt, Human
cauuaccacucaggc

SEQ ID NO: 3467797 - RNA, 19 nt, Human
cauuacccuucccugcacu

SEQ ID NO: 3467798 - RNA, 17 nt, Human
cauuaccgcguuguaaa

SEQ ID NO: 3467799 - RNA, 15 nt, Human
cauuaccucuuugga

SEQ ID NO: 3467800 - RNA, 17 nt, Human
cauuaccucuuuggaaa

SEQ ID NO: 3467801 - RNA, 20 nt, Human
cauuaccuuacuguggagga

SEQ ID NO: 3467802 - RNA, 22 nt, Human
cauuaccuuuuaccagcuuuua

SEQ ID NO: 3467803 - RNA, 17 nt, Human
cauuacgugagccaggu

SEQ ID NO: 3467804 - RNA, 23 nt, Human
cauuacucaauugauaaacauuu

SEQ ID NO: 3467805 - RNA, 16 nt, Human
cauuacucuuaaggaa

SEQ ID NO: 3467806 - RNA, 18 nt, Human
cauuacucuuguaagauu

SEQ ID NO: 3467807 - RNA, 19 nt, Human
cauuacucuuguaagauuu

SEQ ID NO: 3467808 - RNA, 20 nt, Human
cauuacucuuguaagauuuu

SEQ ID NO: 3467809 - RNA, 23 nt, Human
cauuacuguacaggguuaucugc

SEQ ID NO: 3467810 - RNA, 17 nt, Human
cauuacuuguugccuau

SEQ ID NO: 3467811 - RNA, 18 nt, Human
cauuacuuguugccuaua

SEQ ID NO: 3467812 - RNA, 23 nt, Human
cauuacuuuaccacccccacacc

SEQ ID NO: 3467813 - RNA, 12 nt, Human
cauuagaacuuc

SEQ ID NO: 3467814 - RNA, 18 nt, Human
cauuagaauuaccauuug

SEQ ID NO: 3467815 - RNA, 16 nt, Human
cauuagacuggaacuu

SEQ ID NO: 3467816 - RNA, 20 nt, Human
cauuagacuggaacuugaac

SEQ ID NO: 3467817 - RNA, 23 nt, Human
cauuagagcaggcguucagcuca

SEQ ID NO: 3467818 - RNA, 19 nt, Human
cauuagagcccauuucaau

SEQ ID NO: 3467819 - RNA, 17 nt, Human
cauuagagucaacuaca

SEQ ID NO: 3467820 - RNA, 22 nt, Human
cauuagcaaaaaaaguuguaug

SEQ ID NO: 3467821 - RNA, 16 nt, Human
cauuagcacagauuuu

SEQ ID NO: 3467822 - RNA, 18 nt, Human
cauuagccagauuugucu

SEQ ID NO: 3467823 - RNA, 9 nt, Human
cauuagccu

SEQ ID NO: 3467824 - RNA, 17 nt, Human
cauuagggaugccuccu

SEQ ID NO: 3467825 - RNA, 22 nt, Human
cauuaggugugacugaauuucu

SEQ ID NO: 3467826 - RNA, 18 nt, Human
cauuucauguccauaaaa

SEQ ID NO: 3467827 - RNA, 13 nt, Human
cauuucauuccau

SEQ ID NO: 3467828 - RNA, 16 nt, Human
cauuucauuguaugau

SEQ ID NO: 3467829 - RNA, 18 nt, Human
cauuucauuguaugaugu

SEQ ID NO: 3467830 - RNA, 18 nt, Human
cauuucauuugugccaga

SEQ ID NO: 3467831 - RNA, 21 nt, Human
cauuuccaaaugaaugaccuu

SEQ ID NO: 3467832 - RNA, 20 nt, Human
cauuuccaacaccacagaca

SEQ ID NO: 3467833 - RNA, 12 nt, Human
cauuuccaagca

SEQ ID NO: 3467834 - RNA, 16 nt, Human
cauuuccauguaugca

SEQ ID NO: 3467835 - RNA, 15 nt, Human
cauuuccauugcuua

SEQ ID NO: 3467836 - RNA, 14 nt, Human
cauuucccaucugc

SEQ ID NO: 3467837 - RNA, 14 nt, Human
cauuuccccagggc

SEQ ID NO: 3467838 - RNA, 15 nt, Human
cauuuccccagggca

SEQ ID NO: 3467839 - RNA, 17 nt, Human
cauuuccccagggcacg

SEQ ID NO: 3467840 - RNA, 21 nt, Human
cauuucccccaccccauuucu

SEQ ID NO: 3467841 - RNA, 23 nt, Human
cauuuccuaucaccuauuuccau

SEQ ID NO: 3467842 - RNA, 19 nt, Human
cauuuccuauguaacugca

SEQ ID NO: 3467843 - RNA, 11 nt, Human
cauuuccugcc

SEQ ID NO: 3467844 - RNA, 12 nt, Human
cauuuccugccc

SEQ ID NO: 3467845 - RNA, 13 nt, Human
cauuuccugcccu

SEQ ID NO: 3467846 - RNA, 21 nt, Human
cauuuccuggguggcuacucu

SEQ ID NO: 3467847 - RNA, 15 nt, Human
cauuucgguggcuag

SEQ ID NO: 3467848 - RNA, 21 nt, Human
cauuucgugagccccaucuuc

SEQ ID NO: 3467849 - RNA, 22 nt, Human
cauuucgugagccccaucuuca

SEQ ID NO: 3467850 - RNA, 18 nt, Human
cauuucuaaaggccucuu

SEQ ID NO: 3467851 - RNA, 23 nt, Human
cauuucuaauuauguagcucuuu

SEQ ID NO: 3467852 - RNA, 23 nt, Human
cauuucuacucuuaaguuucuca

SEQ ID NO: 3467853 - RNA, 23 nt, Human
cauuucuauagccaaaaauagcu

SEQ ID NO: 3467854 - RNA, 18 nt, Human
cauuucuauuuauuuacu

SEQ ID NO: 3467855 - RNA, 13 nt, Human
cauuucucacuga

SEQ ID NO: 3467856 - RNA, 12 nt, Human
cauuucucaucc

SEQ ID NO: 3467857 - RNA, 16 nt, Human
cauuucucauguugaa

SEQ ID NO: 3467858 - RNA, 13 nt, Human
cauuucuccagaa

SEQ ID NO: 3467859 - RNA, 15 nt, Human
cauuucuccagaacc

SEQ ID NO: 3467860 - RNA, 20 nt, Human
cauuucuccuuugauaaaau

SEQ ID NO: 3467861 - RNA, 14 nt, Human
cauuucugaagugg

SEQ ID NO: 3467862 - RNA, 16 nt, Human
cauuucugauauagaa

SEQ ID NO: 3467863 - RNA, 23 nt, Human
cauuucuuccacaagagcccagg

SEQ ID NO: 3467864 - RNA, 23 nt, Human
cauuucuucuacaacucauacac

SEQ ID NO: 3467865 - RNA, 12 nt, Human
cauuucuugggc

SEQ ID NO: 3467866 - RNA, 14 nt, Human
cauuucuugggccc

SEQ ID NO: 3467867 - RNA, 15 nt, Human
cauuucuugggcccu

SEQ ID NO: 3467868 - RNA, 18 nt, Human
cauuucuugggcccuccu

SEQ ID NO: 3467869 - RNA, 21 nt, Human
cauuucuuuucuuuuuacaua

SEQ ID NO: 3467870 - RNA, 18 nt, Human
cauuucuuuuuaaaaaaa

SEQ ID NO: 3467871 - RNA, 20 nt, Human
cauuugaaaauuuugauguu

SEQ ID NO: 3467872 - RNA, 19 nt, Human
cauuugaaguguaccugug

SEQ ID NO: 3467873 - RNA, 23 nt, Human
cauuugaaugcauuuuguuuggu

SEQ ID NO: 3467874 - RNA, 19 nt, Human
cauuugacccuugcuguga

SEQ ID NO: 3467875 - RNA, 15 nt, Human
cauuugagaaaugca

SEQ ID NO: 3467876 - RNA, 17 nt, Human
cauuugagaaaugcaua

SEQ ID NO: 3467877 - RNA, 22 nt, Human
cauuugagaaaugcauauugua

SEQ ID NO: 3467878 - RNA, 19 nt, Human
cauuugaggucuguucuuu

SEQ ID NO: 3467879 - RNA, 19 nt, Human
cauuugauaccccugggga

SEQ ID NO: 3467880 - RNA, 15 nt, Human
cauuugauucugugu

SEQ ID NO: 3467881 - RNA, 18 nt, Human
cauuugcaauaacagcug

SEQ ID NO: 3467882 - RNA, 17 nt, Human
cauuugcacccuccgcc

SEQ ID NO: 3467883 - RNA, 13 nt, Human
cauuugcauuugu

SEQ ID NO: 3467884 - RNA, 12 nt, Human
cauuugccuauu

SEQ ID NO: 3467885 - RNA, 17 nt, Human
cauuugccuauucccac

SEQ ID NO: 3467886 - RNA, 19 nt, Human
cauuugccuugcagaacug

SEQ ID NO: 3467887 - RNA, 14 nt, Human
cauuugccuugcug

SEQ ID NO: 3467888 - RNA, 21 nt, Human
cauuugcgaaugguuccauuc

SEQ ID NO: 3467889 - RNA, 21 nt, Human
cauuugcguuccaugaugcug

SEQ ID NO: 3467890 - RNA, 18 nt, Human
cauuugcuacuguuguaa

SEQ ID NO: 3467891 - RNA, 14 nt, Human
cauuugcucaugga

SEQ ID NO: 3467892 - RNA, 15 nt, Human
cauuugcucauggaa

SEQ ID NO: 3467893 - RNA, 13 nt, Human
cauuugcugaaua

SEQ ID NO: 3467894 - RNA, 20 nt, Human
cauuugcugaauagcuacua

SEQ ID NO: 3467895 - RNA, 17 nt, Human
cauuuggaaaucuuuaa

SEQ ID NO: 3467896 - RNA, 22 nt, Human
cauuuggaaaucuuuaaaaaaa

SEQ ID NO: 3467897 - RNA, 17 nt, Human
cauuuggaauacuuuuu

SEQ ID NO: 3467898 - RNA, 23 nt, Human
cauuuggaauuuuugcuugacuu

SEQ ID NO: 3467899 - RNA, 21 nt, Human
cauuuggagacacaacuauuu

SEQ ID NO: 3467900 - RNA, 22 nt, Human
cauuuggaggaaaaaaagcaug

SEQ ID NO: 3467901 - RNA, 21 nt, Human
cauuuggauccuguguggaga

SEQ ID NO: 3467902 - RNA, 15 nt, Human
cauuuggauuggaug

SEQ ID NO: 3467903 - RNA, 18 nt, Human
cauuuggcaucccugggc

SEQ ID NO: 3467904 - RNA, 18 nt, Human
cauuugggagacauguga

SEQ ID NO: 3467905 - RNA, 17 nt, Human
cauuugggguaauacuu

SEQ ID NO: 3467906 - RNA, 15 nt, Human
cauuuggguaaauca

SEQ ID NO: 3467907 - RNA, 14 nt, Human
cauuuggguccagg

SEQ ID NO: 3467908 - RNA, 16 nt, Human
cauuuggguccaggag

SEQ ID NO: 3467909 - RNA, 18 nt, Human
cauuuggguccaggagga

SEQ ID NO: 3467910 - RNA, 20 nt, Human
cauuuggguugguuccaagu

SEQ ID NO: 3467911 - RNA, 20 nt, Human
cauuuggucaagauuuugaa

SEQ ID NO: 3467912 - RNA, 12 nt, Human
cauuuggugguu

SEQ ID NO: 3467913 - RNA, 19 nt, Human
cauuugguucuaagaaacc

SEQ ID NO: 3467914 - RNA, 20 nt, Human
cauuugguuugauuuucccu

SEQ ID NO: 3467915 - RNA, 14 nt, Human
cauuuguaauaaag

SEQ ID NO: 3467916 - RNA, 19 nt, Human
cauuuguaauuaaauuaug

SEQ ID NO: 3467917 - RNA, 12 nt, Human
cauuuguaauuu

SEQ ID NO: 3467918 - RNA, 20 nt, Human
cauuuguacagaauuuugga

SEQ ID NO: 3467919 - RNA, 22 nt, Human
cauuuguacagaauuuuggaag

SEQ ID NO: 3467920 - RNA, 14 nt, Human
cauuuguauguugu

SEQ ID NO: 3467921 - RNA, 11 nt, Human
cauuuguauuu

SEQ ID NO: 3467922 - RNA, 20 nt, Human
cauuugucauuuucauuagc

SEQ ID NO: 3467923 - RNA, 16 nt, Human
cauuugucccaagugc

SEQ ID NO: 3467924 - RNA, 18 nt, Human
cauuugucccaagugcca

SEQ ID NO: 3467925 - RNA, 18 nt, Human
cauuugucucuacuuuuc

SEQ ID NO: 3467926 - RNA, 14 nt, Human
cauuugugaaauga

SEQ ID NO: 3467927 - RNA, 18 nt, Human
cauuugugauauauguau

SEQ ID NO: 3467928 - RNA, 23 nt, Human
cauuuguggcagucccuuauaau

SEQ ID NO: 3467929 - RNA, 22 nt, Human
cauuuguggguuuuuauuuccu

SEQ ID NO: 3467930 - RNA, 19 nt, Human
cauuugugugugugcaagu

SEQ ID NO: 3467931 - RNA, 16 nt, Human
cauuuguuaauaucac

SEQ ID NO: 3467932 - RNA, 22 nt, Human
cauuuguuaauaucacucauua

SEQ ID NO: 3467933 - RNA, 22 nt, Human
cauuuguucacugaaggugauu

SEQ ID NO: 3467934 - RNA, 18 nt, Human
cauuuguucauauuaaga

SEQ ID NO: 3467935 - RNA, 16 nt, Human
cauuuguuggaaugaa

SEQ ID NO: 3467936 - RNA, 18 nt, Human
cauuuguugugaugucuu

SEQ ID NO: 3467937 - RNA, 14 nt, Human
cauuuguuguuuga

SEQ ID NO: 3467938 - RNA, 20 nt, Human
cauuuguuuacauuugaugc

SEQ ID NO: 3467939 - RNA, 18 nt, Human
cauuuguuuauguaauuu

SEQ ID NO: 3467940 - RNA, 15 nt, Human
cauuuguuucuacuu

SEQ ID NO: 3467941 - RNA, 23 nt, Human
cauuuguuucuuucucugaggac

SEQ ID NO: 3467942 - RNA, 20 nt, Human
cauuuuaaaaaaaaaggcau

SEQ ID NO: 3467943 - RNA, 13 nt, Human
cauuuuaaacaaa

SEQ ID NO: 3467944 - RNA, 13 nt, Human
cauuuuaaauaaa

SEQ ID NO: 3467945 - RNA, 18 nt, Human
cauuuuaaauaaaagaaa

SEQ ID NO: 3467946 - RNA, 15 nt, Human
cauuuuaaauggaca

SEQ ID NO: 3467947 - RNA, 12 nt, Human
cauuuuaacaag

SEQ ID NO: 3467948 - RNA, 20 nt, Human
cauuuuaacaagaagaugaa

SEQ ID NO: 3467949 - RNA, 12 nt, Human
cauuuuaaugua

SEQ ID NO: 3467950 - RNA, 14 nt, Human
cauuuuaauguaaa

SEQ ID NO: 3467951 - RNA, 22 nt, Human
cauuuuaauuuauuaauugcuu

SEQ ID NO: 3467952 - RNA, 23 nt, Human
cauuuuaauuuauuaauugcuuu

SEQ ID NO: 3467953 - RNA, 20 nt, Human
cauuuuacagagaaagaaau

SEQ ID NO: 3467954 - RNA, 19 nt, Human
cauuuuacaguuacuuuuc

SEQ ID NO: 3467955 - RNA, 11 nt, Human
cauuuuauaaa

SEQ ID NO: 3467956 - RNA, 15 nt, Human
cauuuuauaaagugc

SEQ ID NO: 3467957 - RNA, 23 nt, Human
cauuuuauaaaucgcuuuugaua

SEQ ID NO: 3467958 - RNA, 17 nt, Human
cauuuuauagacacccu

SEQ ID NO: 3467959 - RNA, 12 nt, Human
cauuuuauggug

SEQ ID NO: 3467960 - RNA, 21 nt, Human
cauuuuauuaagcuuuuugga

SEQ ID NO: 3467961 - RNA, 21 nt, Human
cauuuuauuuuauuaugcaug

SEQ ID NO: 3467962 - RNA, 19 nt, Human
cauuuucagacugcuuuaa

SEQ ID NO: 3467963 - RNA, 19 nt, Human
cauuuucagauucaggcau

SEQ ID NO: 3467964 - RNA, 21 nt, Human
cauuuucagauucaggcauuu

SEQ ID NO: 3467965 - RNA, 14 nt, Human
cauuuucauuccua

SEQ ID NO: 3467966 - RNA, 14 nt, Human
cauuuuccucugcu

SEQ ID NO: 3467967 - RNA, 15 nt, Human
cauuuuccucugcuu

SEQ ID NO: 3467968 - RNA, 13 nt, Human
cauuuucuagaua

SEQ ID NO: 3467969 - RNA, 17 nt, Human
cauuuucuagauacaau

SEQ ID NO: 3467970 - RNA, 13 nt, Human
ccagaacccauuu

SEQ ID NO: 3467971 - RNA, 15 nt, Human
ccagaaccuguccuu

SEQ ID NO: 3467972 - RNA, 19 nt, Human
ccagaacucacuggggccu

SEQ ID NO: 3467973 - RNA, 17 nt, Human
ccagaacucugccugcc

SEQ ID NO: 3467974 - RNA, 20 nt, Human
ccagaacucugccugcccuu

SEQ ID NO: 3467975 - RNA, 14 nt, Human
ccagaacucuuccu

SEQ ID NO: 3467976 - RNA, 12 nt, Human
ccagaacuggac

SEQ ID NO: 3467977 - RNA, 17 nt, Human
ccagaacuuagccuuua

SEQ ID NO: 3467978 - RNA, 19 nt, Human
ccagaagaagagaagcugc

SEQ ID NO: 3467979 - RNA, 20 nt, Human
ccagaagaagagaagcugcu

SEQ ID NO: 3467980 - RNA, 18 nt, Human
ccagaagauccccucagg

SEQ ID NO: 3467981 - RNA, 24 nt, Human
ccagaagauccccucaggacugca

SEQ ID NO: 3467982 - RNA, 18 nt, Human
ccagaagaugaacagacu

SEQ ID NO: 3467983 - RNA, 13 nt, Human
ccagaagaugacu

SEQ ID NO: 3467984 - RNA, 16 nt, Human
ccagaagaugacugag

SEQ ID NO: 3467985 - RNA, 15 nt, Human
ccagaagcuccccca

SEQ ID NO: 3467986 - RNA, 16 nt, Human
ccagaagcucccccag

SEQ ID NO: 3467987 - RNA, 20 nt, Human
ccagaagcugagcaccaggg

SEQ ID NO: 3467988 - RNA, 16 nt, Human
ccagaagcuuccauag

SEQ ID NO: 3467989 - RNA, 18 nt, Human
ccagaaggagacaggcag

SEQ ID NO: 3467990 - RNA, 22 nt, Human
ccagaaggcauaucagucucug

SEQ ID NO: 3467991 - RNA, 15 nt, Human
ccagaaguagcuuug

SEQ ID NO: 3467992 - RNA, 20 nt, Human
ccagaagucaagcccagcca

SEQ ID NO: 3467993 - RNA, 23 nt, Human
ccagaaguuguggauuucaguuu

SEQ ID NO: 3467994 - RNA, 22 nt, Human
ccagaaguuugagaucagccug

SEQ ID NO: 3467995 - RNA, 23 nt, Human
ccagaaguuugagaucagccugg

SEQ ID NO: 3467996 - RNA, 22 nt, Human
ccagaauaaguuauugcaguuu

SEQ ID NO: 3467997 - RNA, 23 nt, Human
ccagaauaaguuauugcaguuua

SEQ ID NO: 3467998 - RNA, 15 nt, Human
ccagaauacugaugg

SEQ ID NO: 3467999 - RNA, 21 nt, Human
ccagaauacugauggaauuuu

SEQ ID NO: 3468000 - RNA, 23 nt, Human
ccagaauacugauggaauuuuuu

SEQ ID NO: 3468001 - RNA, 15 nt, Human
ccagaaucccagccg

SEQ ID NO: 3468002 - RNA, 21 nt, Human
ccagaaucccucuacauggac

SEQ ID NO: 3468003 - RNA, 16 nt, Human
ccagaaucuaaagcca

SEQ ID NO: 3468004 - RNA, 16 nt, Human
ccagaaugagacaucc

SEQ ID NO: 3468005 - RNA, 16 nt, Human
ccagaaugcuuuagga

SEQ ID NO: 3468006 - RNA, 23 nt, Human
ccagaaugucagauuccuuuccc

SEQ ID NO: 3468007 - RNA, 14 nt, Human
ccagaauuauuuuu

SEQ ID NO: 3468008 - RNA, 21 nt, Human
ccagaauucccagcugucugu

SEQ ID NO: 3468009 - RNA, 16 nt, Human
ccagaauuuaaaccua

SEQ ID NO: 3468010 - RNA, 12 nt, Human
ccagaauuuccc

SEQ ID NO: 3468011 - RNA, 13 nt, Human
ccagaauuuggaa

SEQ ID NO: 3468012 - RNA, 23 nt, Human
ccagaauuuggaaauccuaguuu

SEQ ID NO: 3468013 - RNA, 22 nt, Human
ccagacaaggaaauacccuucu

SEQ ID NO: 3468014 - RNA, 18 nt, Human
ccagacacagaagaggcu

SEQ ID NO: 3468015 - RNA, 15 nt, Human
ccagacacaggcccu

SEQ ID NO: 3468016 - RNA, 20 nt, Human
ccagacacauguccaagaag

SEQ ID NO: 3468017 - RNA, 13 nt, Human
ccagacacucugc

SEQ ID NO: 3468018 - RNA, 19 nt, Human
ccagacagacaucucugca

SEQ ID NO: 3468019 - RNA, 12 nt, Human
ccagacagaggg

SEQ ID NO: 3468020 - RNA, 15 nt, Human
ccagacagaggguca

SEQ ID NO: 3468021 - RNA, 12 nt, Human
ccagacagccug

SEQ ID NO: 3468022 - RNA, 16 nt, Human
ccagacagugugcugu

SEQ ID NO: 3468023 - RNA, 14 nt, Human
ccagacaucaacag

SEQ ID NO: 3468024 - RNA, 20 nt, Human
ccagacaugccacaaggacu

SEQ ID NO: 3468025 - RNA, 23 nt, Human
ccagacauguggugggacaggga

SEQ ID NO: 3468026 - RNA, 23 nt, Human
ccagaccaacguuacucagggcu

SEQ ID NO: 3468027 - RNA, 13 nt, Human
ccagaccagagcu

SEQ ID NO: 3468028 - RNA, 15 nt, Human
ccagaccagauuaaa

SEQ ID NO: 3468029 - RNA, 14 nt, Human
ccagaccauggaca

SEQ ID NO: 3468030 - RNA, 21 nt, Human
ccagaccauugucucagagca

SEQ ID NO: 3468031 - RNA, 16 nt, Human
ccagacccccaccccu

SEQ ID NO: 3468032 - RNA, 22 nt, Human
ccagacccccaccccuucccca

SEQ ID NO: 3468033 - RNA, 14 nt, Human
ccagacccccagca

SEQ ID NO: 3468034 - RNA, 18 nt, Human
ccagacccccuggagacu

SEQ ID NO: 3468035 - RNA, 18 nt, Human
ccagaccccucuggccag

SEQ ID NO: 3468036 - RNA, 19 nt, Human
ccagaccccucuggccagg

SEQ ID NO: 3468037 - RNA, 20 nt, Human
ccagaccccucuggccagga

SEQ ID NO: 3468038 - RNA, 21 nt, Human
ccagaccccucuggccaggau

SEQ ID NO: 3468039 - RNA, 14 nt, Human
ccagaccccuggcu

SEQ ID NO: 3468040 - RNA, 24 nt, Human
ccagaccccuggcuuuucacugcu

SEQ ID NO: 3468041 - RNA, 15 nt, Human
ccagacccggcugcg

SEQ ID NO: 3468042 - RNA, 17 nt, Human
ccagacccggcugcgug

SEQ ID NO: 3468043 - RNA, 15 nt, Human
ccagaccugagcucc

SEQ ID NO: 3468044 - RNA, 13 nt, Human
ccagaccugaggc

SEQ ID NO: 3468045 - RNA, 15 nt, Human
ccagaccugauccug

SEQ ID NO: 3468046 - RNA, 16 nt, Human
ccagaccugauccugg

SEQ ID NO: 3468047 - RNA, 17 nt, Human
ccagaccugauccugga

SEQ ID NO: 3468048 - RNA, 18 nt, Human
ccagaccugauccuggag

SEQ ID NO: 3468049 - RNA, 15 nt, Human
ccagaccuucuagga

SEQ ID NO: 3468050 - RNA, 23 nt, Human
ccagacgcacgugggucuucagg

SEQ ID NO: 3468051 - RNA, 16 nt, Human
ccagacggcacccacc

SEQ ID NO: 3468052 - RNA, 17 nt, Human
ccagacguaggggaggg

SEQ ID NO: 3468053 - RNA, 17 nt, Human
ccagacuacuauuuucu

SEQ ID NO: 3468054 - RNA, 22 nt, Human
ccagacuagauguaguauuuuu

SEQ ID NO: 3468055 - RNA, 21 nt, Human
ccagacucguucuucugggaa

SEQ ID NO: 3468056 - RNA, 13 nt, Human
ccagacugcaggu

SEQ ID NO: 3468057 - RNA, 22 nt, Human
ccagacugcuuccaauuuucug

SEQ ID NO: 3468058 - RNA, 18 nt, Human
ccagacuguggagaaaua

SEQ ID NO: 3468059 - RNA, 17 nt, Human
ccagacuguguauucau

SEQ ID NO: 3468060 - RNA, 23 nt, Human
ccagacuucccacggcuccucga

SEQ ID NO: 3468061 - RNA, 14 nt, Human
ccagacuuccuuga

SEQ ID NO: 3468062 - RNA, 15 nt, Human
ccagacuuccuugag

SEQ ID NO: 3468063 - RNA, 18 nt, Human
ccagacuugggaggaugu

SEQ ID NO: 3468064 - RNA, 18 nt, Human
ccagagaaaaagggaggg

SEQ ID NO: 3468065 - RNA, 19 nt, Human
ccagagaaaggggagccca

SEQ ID NO: 3468066 - RNA, 12 nt, Human
ccagagaagcua

SEQ ID NO: 3468067 - RNA, 15 nt, Human
ccagagaagugacag

SEQ ID NO: 3468068 - RNA, 16 nt, Human
ccagagaagugacagg

SEQ ID NO: 3468069 - RNA, 14 nt, Human
ccagagacaagacu

SEQ ID NO: 3468070 - RNA, 18 nt, Human
ccagagacacaagccuuc

SEQ ID NO: 3468071 - RNA, 12 nt, Human
ccagagacagga

SEQ ID NO: 3468072 - RNA, 17 nt, Human
ccagagacauacuugaa

SEQ ID NO: 3468073 - RNA, 18 nt, Human
ccagagacauacuugaag

SEQ ID NO: 3468074 - RNA, 23 nt, Human
ccagagacauacuugaagggcca

SEQ ID NO: 3468075 - RNA, 20 nt, Human
ccagagaccaggcugugucc

SEQ ID NO: 3468076 - RNA, 15 nt, Human
ccagagacucagagg

SEQ ID NO: 3468077 - RNA, 22 nt, Human
ccagagagaagagccccacucu

SEQ ID NO: 3468078 - RNA, 19 nt, Human
ccagagagagaagugcccc

SEQ ID NO: 3468079 - RNA, 21 nt, Human
ccagagagagaagugccccug

SEQ ID NO: 3468080 - RNA, 12 nt, Human
ccagagagcccg

SEQ ID NO: 3468081 - RNA, 15 nt, Human
ccagagagcccgagg

SEQ ID NO: 3468082 - RNA, 14 nt, Human
ccagagaguccucu

SEQ ID NO: 3468083 - RNA, 14 nt, Human
ccagagaguggcuc

SEQ ID NO: 3468084 - RNA, 16 nt, Human
ccagagaguggcuccu

SEQ ID NO: 3468085 - RNA, 14 nt, Human
ccagagaugccucc

SEQ ID NO: 3468086 - RNA, 15 nt, Human
ccagagcaaccucuc

SEQ ID NO: 3468087 - RNA, 22 nt, Human
ccagagcaacgaccagggccga

SEQ ID NO: 3468088 - RNA, 19 nt, Human
ccagagcacagaucuguuu

SEQ ID NO: 3468089 - RNA, 17 nt, Human
ccagagcaccugcuguc

SEQ ID NO: 3468090 - RNA, 20 nt, Human
ccagagcaccugcugucugg

SEQ ID NO: 3468091 - RNA, 22 nt, Human
ccagagcacuggguugcagggg

SEQ ID NO: 3468092 - RNA, 15 nt, Human
ccagagcagaugcag

SEQ ID NO: 3468093 - RNA, 16 nt, Human
ccagagcagaugcaga

SEQ ID NO: 3468094 - RNA, 20 nt, Human
ccagagcagaugcagagagc

SEQ ID NO: 3468095 - RNA, 12 nt, Human
ccagagcaggag

SEQ ID NO: 3468096 - RNA, 14 nt, Human
ccagagcagggugu

SEQ ID NO: 3468097 - RNA, 18 nt, Human
ccagagcauuccagucag

SEQ ID NO: 3468098 - RNA, 20 nt, Human
ccagagcauuuccaacacca

SEQ ID NO: 3468099 - RNA, 21 nt, Human
ccagagcauuuccaacaccac

SEQ ID NO: 3468100 - RNA, 14 nt, Human
ccagagccacaguu

SEQ ID NO: 3468101 - RNA, 11 nt, Human
ccagagccagg

SEQ ID NO: 3468102 - RNA, 12 nt, Human
ccagagccaggg

SEQ ID NO: 3468103 - RNA, 22 nt, Human
ccagagccaggggggugaggag

SEQ ID NO: 3468104 - RNA, 21 nt, Human
ccagagccauggacucuacac

SEQ ID NO: 3468105 - RNA, 15 nt, Human
ccagagcccacucca

SEQ ID NO: 3468106 - RNA, 11 nt, Human
ccagagcccag

SEQ ID NO: 3468107 - RNA, 12 nt, Human
ccagagcccagc

SEQ ID NO: 3468108 - RNA, 14 nt, Human
ccagagcccagcuc

SEQ ID NO: 3468109 - RNA, 17 nt, Human
ccagagcccagcuccaa

SEQ ID NO: 3468110 - RNA, 13 nt, Human
ccagagccccaca

SEQ ID NO: 3468111 - RNA, 21 nt, Human
ccagagccccuccuccagccc

SEQ ID NO: 3468112 - RNA, 23 nt, Human
ccagagccucaaaugagaaaaug

SEQ ID NO: 3468113 - RNA, 11 nt, Human
ccagagccugg

SEQ ID NO: 3468114 - RNA, 19 nt, Human
ccagagccuggcugcccau

SEQ ID NO: 3468115 - RNA, 22 nt, Human
ccagcacugaggaagaacgggg

SEQ ID NO: 3468116 - RNA, 22 nt, Human
ccagcacugcuugaggaaaaca

SEQ ID NO: 3468117 - RNA, 17 nt, Human
ccagcacuuccauggga

SEQ ID NO: 3468118 - RNA, 15 nt, Human
ccagcacuuggagag

SEQ ID NO: 3468119 - RNA, 11 nt, Human
ccagcacuuug

SEQ ID NO: 3468120 - RNA, 14 nt, Human
ccagcacuuuggga

SEQ ID NO: 3468121 - RNA, 19 nt, Human
ccagcacuuugggaggcca

SEQ ID NO: 3468122 - RNA, 23 nt, Human
ccagcacuuugggaggccaagga

SEQ ID NO: 3468123 - RNA, 16 nt, Human
ccagcagaaaugccuu

SEQ ID NO: 3468124 - RNA, 15 nt, Human
ccagcagaagacaaa

SEQ ID NO: 3468125 - RNA, 12 nt, Human
ccagcagacaga

SEQ ID NO: 3468126 - RNA, 16 nt, Human
ccagcagacagagcca

SEQ ID NO: 3468127 - RNA, 20 nt, Human
ccagcagacagagccaggag

SEQ ID NO: 3468128 - RNA, 21 nt, Human
ccagcagacagagccaggaga

SEQ ID NO: 3468129 - RNA, 12 nt, Human
ccagcagagcac

SEQ ID NO: 3468130 - RNA, 13 nt, Human
ccagcagagcacc

SEQ ID NO: 3468131 - RNA, 16 nt, Human
ccagcagaucccagcu

SEQ ID NO: 3468132 - RNA, 17 nt, Human
ccagcagaucccagcuc

SEQ ID NO: 3468133 - RNA, 16 nt, Human
ccagcagauuauucac

SEQ ID NO: 3468134 - RNA, 20 nt, Human
ccagcagcaccugcccuacc

SEQ ID NO: 3468135 - RNA, 23 nt, Human
ccagcagcagcccaagcuucccu

SEQ ID NO: 3468136 - RNA, 12 nt, Human
ccagcagccagc

SEQ ID NO: 3468137 - RNA, 13 nt, Human
ccagcagccagcc

SEQ ID NO: 3468138 - RNA, 16 nt, Human
ccagcagccagcucuc

SEQ ID NO: 3468139 - RNA, 12 nt, Human
ccagcagccugg

SEQ ID NO: 3468140 - RNA, 12 nt, Human
ccagcagcgccu

SEQ ID NO: 3468141 - RNA, 17 nt, Human
ccagcagcgccuuuccc

SEQ ID NO: 3468142 - RNA, 24 nt, Human
ccagcagcggaaccgcccaggauc

SEQ ID NO: 3468143 - RNA, 22 nt, Human
ccagcagcuuuagaaucccagc

SEQ ID NO: 3468144 - RNA, 19 nt, Human
ccagcaggcucucaggcca

SEQ ID NO: 3468145 - RNA, 21 nt, Human
ccagcagggucuuuucaucug

SEQ ID NO: 3468146 - RNA, 15 nt, Human
ccagcaggugcugac

SEQ ID NO: 3468147 - RNA, 17 nt, Human
ccagcagucacuucggc

SEQ ID NO: 3468148 - RNA, 22 nt, Human
ccagcagucucugccuugccuu

SEQ ID NO: 3468149 - RNA, 18 nt, Human
ccagcaguucagagcugc

SEQ ID NO: 3468150 - RNA, 21 nt, Human
ccagcaguucagagcugcccu

SEQ ID NO: 3468151 - RNA, 13 nt, Human
ccagcaguucugu

SEQ ID NO: 3468152 - RNA, 14 nt, Human
ccagcaguucuguu

SEQ ID NO: 3468153 - RNA, 15 nt, Human
ccagcaguuugggag

SEQ ID NO: 3468154 - RNA, 15 nt, Human
ccagcauaaauaucu

SEQ ID NO: 3468155 - RNA, 15 nt, Human
ccagcaucaccugcc

SEQ ID NO: 3468156 - RNA, 17 nt, Human
ccagcaucaccugccug

SEQ ID NO: 3468157 - RNA, 17 nt, Human
ccagcaucacuccccaa

SEQ ID NO: 3468158 - RNA, 13 nt, Human
ccagcaucugggc

SEQ ID NO: 3468159 - RNA, 17 nt, Human
ccagcaucugggccuug

SEQ ID NO: 3468160 - RNA, 21 nt, Human
ccagcaucugggccuuggccu

SEQ ID NO: 3468161 - RNA, 20 nt, Human
ccagcaugcaccacgggccc

SEQ ID NO: 3468162 - RNA, 15 nt, Human
ccagcauggguuagu

SEQ ID NO: 3468163 - RNA, 21 nt, Human
ccagcauuccagccccucugg

SEQ ID NO: 3468164 - RNA, 22 nt, Human
ccagcauuccagccccucuggu

SEQ ID NO: 3468165 - RNA, 14 nt, Human
ccagcauucccagg

SEQ ID NO: 3468166 - RNA, 19 nt, Human
ccagcauucccagguaggc

SEQ ID NO: 3468167 - RNA, 13 nt, Human
ccagcauuccuuu

SEQ ID NO: 3468168 - RNA, 18 nt, Human
ccagcauuuagcuggcca

SEQ ID NO: 3468169 - RNA, 20 nt, Human
ccagcauuuagcuggccaca

SEQ ID NO: 3468170 - RNA, 21 nt, Human
ccagcauuucccuuccuuccu

SEQ ID NO: 3468171 - RNA, 18 nt, Human
ccagccaaacacacagaa

SEQ ID NO: 3468172 - RNA, 19 nt, Human
ccagccaaacccugucuga

SEQ ID NO: 3468173 - RNA, 19 nt, Human
ccagccaaagccuccucca

SEQ ID NO: 3468174 - RNA, 21 nt, Human
ccagccaccccgggcucucug

SEQ ID NO: 3468175 - RNA, 21 nt, Human
ccagccacggacgcuggcucc

SEQ ID NO: 3468176 - RNA, 20 nt, Human
ccagccacucgggaggcuga

SEQ ID NO: 3468177 - RNA, 21 nt, Human
ccagccacucgggaggcugag

SEQ ID NO: 3468178 - RNA, 19 nt, Human
ccagccagaguuccugcgg

SEQ ID NO: 3468179 - RNA, 19 nt, Human
ccagccagauccucuuggu

SEQ ID NO: 3468180 - RNA, 13 nt, Human
ccagccagcagcc

SEQ ID NO: 3468181 - RNA, 15 nt, Human
ccagccagcagccag

SEQ ID NO: 3468182 - RNA, 22 nt, Human
ccagccagcaguucagagcugc

SEQ ID NO: 3468183 - RNA, 14 nt, Human
ccagccagccuggc

SEQ ID NO: 3468184 - RNA, 10 nt, Human
ccagccaggc

SEQ ID NO: 3468185 - RNA, 12 nt, Human
ccagccaggcgg

SEQ ID NO: 3468186 - RNA, 21 nt, Human
ccagccaggcgggcucaagga

SEQ ID NO: 3468187 - RNA, 17 nt, Human
ccagccaggcucugugc

SEQ ID NO: 3468188 - RNA, 18 nt, Human
ccagccaggcucugugcu

SEQ ID NO: 3468189 - RNA, 20 nt, Human
ccagccaggcucugugcuga

SEQ ID NO: 3468190 - RNA, 20 nt, Human
ccagccagugaccugaggaa

SEQ ID NO: 3468191 - RNA, 21 nt, Human
ccagccauacuuaucucucug

SEQ ID NO: 3468192 - RNA, 20 nt, Human
ccagccaucugcccaggggu

SEQ ID NO: 3468193 - RNA, 14 nt, Human
ccagccaugucugc

SEQ ID NO: 3468194 - RNA, 22 nt, Human
ccagcccaaaggggacaggccu

SEQ ID NO: 3468195 - RNA, 24 nt, Human
ccagcccaaaggggacaggccuca

SEQ ID NO: 3468196 - RNA, 12 nt, Human
ccagcccaaguc

SEQ ID NO: 3468197 - RNA, 17 nt, Human
ccagcccaccccauggc

SEQ ID NO: 3468198 - RNA, 14 nt, Human
ccagcccacccccg

SEQ ID NO: 3468199 - RNA, 19 nt, Human
ccagcccacccuccugucu

SEQ ID NO: 3468200 - RNA, 13 nt, Human
ccagcccacgcug

SEQ ID NO: 3468201 - RNA, 16 nt, Human
ccagcccacuucugcc

SEQ ID NO: 3468202 - RNA, 11 nt, Human
ccagcccagag

SEQ ID NO: 3468203 - RNA, 12 nt, Human
ccagcccagaga

SEQ ID NO: 3468204 - RNA, 14 nt, Human
ccagcccagauguu

SEQ ID NO: 3468205 - RNA, 21 nt, Human
ccagcccagauuccccugugu

SEQ ID NO: 3468206 - RNA, 23 nt, Human
ccagcccagauuccccuguguca

SEQ ID NO: 3468207 - RNA, 12 nt, Human
ccagcccagccc

SEQ ID NO: 3468208 - RNA, 16 nt, Human
ccagcccagcccagcu

SEQ ID NO: 3468209 - RNA, 18 nt, Human
ccagcccaggguuccccc

SEQ ID NO: 3468210 - RNA, 21 nt, Human
ccagcccaggguucccccagc

SEQ ID NO: 3468211 - RNA, 21 nt, Human
ccagcccauccauuaggccag

SEQ ID NO: 3468212 - RNA, 23 nt, Human
ccagcccauggagauugaccugg

SEQ ID NO: 3468213 - RNA, 18 nt, Human
ccagcccauuugggcaga

SEQ ID NO: 3468214 - RNA, 16 nt, Human
ccagccccacacagcu

SEQ ID NO: 3468215 - RNA, 21 nt, Human
ccagccccacacagcuacagc

SEQ ID NO: 3468216 - RNA, 14 nt, Human
ccagccccacagcc

SEQ ID NO: 3468217 - RNA, 19 nt, Human
ccagccccacagcccacgu

SEQ ID NO: 3468218 - RNA, 21 nt, Human
ccagccccacagcccacgucc

SEQ ID NO: 3468219 - RNA, 16 nt, Human
ccagccccacugccag

SEQ ID NO: 3468220 - RNA, 21 nt, Human
ccagccccacugccagcagca

SEQ ID NO: 3468221 - RNA, 16 nt, Human
ccagccccagccaggg

SEQ ID NO: 3468222 - RNA, 15 nt, Human
ccagccccagugccc

SEQ ID NO: 3468223 - RNA, 18 nt, Human
ccagccccauccucugua

SEQ ID NO: 3468224 - RNA, 18 nt, Human
ccagcccccacagugcug

SEQ ID NO: 3468225 - RNA, 22 nt, Human
ccagcccccuaagagagcaccu

SEQ ID NO: 3468226 - RNA, 18 nt, Human
ccagcccccuccuggugc

SEQ ID NO: 3468227 - RNA, 14 nt, Human
ccagcccccugacc

SEQ ID NO: 3468228 - RNA, 19 nt, Human
ccagcccccugaccacuca

SEQ ID NO: 3468229 - RNA, 20 nt, Human
ccagcccccuuugggcccag

SEQ ID NO: 3468230 - RNA, 21 nt, Human
ccagcccccuuugggcccagg

SEQ ID NO: 3468231 - RNA, 22 nt, Human
ccagcccccuuugggcccaggg

SEQ ID NO: 3468232 - RNA, 23 nt, Human
ccagcccccuuugggcccaggga

SEQ ID NO: 3468233 - RNA, 18 nt, Human
ccagccccgguggcuggg

SEQ ID NO: 3468234 - RNA, 15 nt, Human
ccagccccuacugcu

SEQ ID NO: 3468235 - RNA, 12 nt, Human
ccagccccuaga

SEQ ID NO: 3468236 - RNA, 15 nt, Human
ccagccccuagaaac

SEQ ID NO: 3468237 - RNA, 15 nt, Human
ccagccccuagccca

SEQ ID NO: 3468238 - RNA, 20 nt, Human
ccagccccucccaccacagc

SEQ ID NO: 3468239 - RNA, 21 nt, Human
ccagccccucccaccacagca

SEQ ID NO: 3468240 - RNA, 13 nt, Human
ccagccccucugg

SEQ ID NO: 3468241 - RNA, 15 nt, Human
ccagccccucugguc

SEQ ID NO: 3468242 - RNA, 22 nt, Human
ccagccccucuggucgcuccug

SEQ ID NO: 3468243 - RNA, 22 nt, Human
ccagccccugccccagcccaag

SEQ ID NO: 3468244 - RNA, 12 nt, Human
ccagccccugga

SEQ ID NO: 3468245 - RNA, 14 nt, Human
ccagccccuggaug

SEQ ID NO: 3468246 - RNA, 12 nt, Human
ccagccccugua

SEQ ID NO: 3468247 - RNA, 19 nt, Human
ccagccccuguauggcacu

SEQ ID NO: 3468248 - RNA, 17 nt, Human
ccagccccugucccacc

SEQ ID NO: 3468249 - RNA, 18 nt, Human
ccagccccuucugaccca

SEQ ID NO: 3468250 - RNA, 14 nt, Human
ccagccccuugaga

SEQ ID NO: 3468251 - RNA, 22 nt, Human
ccagcccggccgcuccaccagc

SEQ ID NO: 3468252 - RNA, 22 nt, Human
ccagcccggccugcucccagca

SEQ ID NO: 3468253 - RNA, 17 nt, Human
ccagcccggcugguuuu

SEQ ID NO: 3468254 - RNA, 13 nt, Human
ccagcccgggagc

SEQ ID NO: 3468255 - RNA, 17 nt, Human
ccagcccgggagccuag

SEQ ID NO: 3468256 - RNA, 21 nt, Human
ccagcccgggagccuaggacc

SEQ ID NO: 3468257 - RNA, 14 nt, Human
ccagcccucauccc

SEQ ID NO: 3468258 - RNA, 19 nt, Human
ccagcccucccuguccucc

SEQ ID NO: 3468259 - RNA, 14 nt, Human
ccagcugcacugau

SEQ ID NO: 3468260 - RNA, 16 nt, Human
ccagcugcaggaauca

SEQ ID NO: 3468261 - RNA, 23 nt, Human
ccagcugcaggaaucaaaaauug

SEQ ID NO: 3468262 - RNA, 22 nt, Human
ccagcugcccccagagccacag

SEQ ID NO: 3468263 - RNA, 16 nt, Human
ccagcugcccuuccgc

SEQ ID NO: 3468264 - RNA, 20 nt, Human
ccagcugcccuuccgcagug

SEQ ID NO: 3468265 - RNA, 19 nt, Human
ccagcugccgaccagagcc

SEQ ID NO: 3468266 - RNA, 10 nt, Human
ccagcugccu

SEQ ID NO: 3468267 - RNA, 19 nt, Human
ccagcugcgcuugcuuuuc

SEQ ID NO: 3468268 - RNA, 17 nt, Human
ccagcugcuccccuccc

SEQ ID NO: 3468269 - RNA, 22 nt, Human
ccagcugcuccgaggacccagg

SEQ ID NO: 3468270 - RNA, 15 nt, Human
ccagcugcucugccc

SEQ ID NO: 3468271 - RNA, 21 nt, Human
ccagcugcucugcccagagcu

SEQ ID NO: 3468272 - RNA, 22 nt, Human
ccagcugcugagauccuggacu

SEQ ID NO: 3468273 - RNA, 23 nt, Human
ccagcugcugagauccuggacug

SEQ ID NO: 3468274 - RNA, 14 nt, Human
ccagcugcugagcc

SEQ ID NO: 3468275 - RNA, 18 nt, Human
ccagcugcugagccgcag

SEQ ID NO: 3468276 - RNA, 14 nt, Human
ccagcugcugucuu

SEQ ID NO: 3468277 - RNA, 19 nt, Human
ccagcugcugucuucugga

SEQ ID NO: 3468278 - RNA, 13 nt, Human
ccagcugcuuggg

SEQ ID NO: 3468279 - RNA, 24 nt, Human
ccagcuggagaaauaugguacuca

SEQ ID NO: 3468280 - RNA, 18 nt, Human
ccagcuggaggcaggggc

SEQ ID NO: 3468281 - RNA, 13 nt, Human
ccagcuggcagca

SEQ ID NO: 3468282 - RNA, 14 nt, Human
ccagcuggcagcag

SEQ ID NO: 3468283 - RNA, 15 nt, Human
ccagcuggcagcaga

SEQ ID NO: 3468284 - RNA, 16 nt, Human
ccagcuggcagcagag

SEQ ID NO: 3468285 - RNA, 19 nt, Human
ccagcuggcccgugacaga

SEQ ID NO: 3468286 - RNA, 12 nt, Human
ccagcuggccgg

SEQ ID NO: 3468287 - RNA, 20 nt, Human
ccagcuggccgggagccuga

SEQ ID NO: 3468288 - RNA, 17 nt, Human
ccagcuggccuggacag

SEQ ID NO: 3468289 - RNA, 12 nt, Human
ccagcuggccuu

SEQ ID NO: 3468290 - RNA, 21 nt, Human
ccagcugggaggcaagagggg

SEQ ID NO: 3468291 - RNA, 22 nt, Human
ccagcugggaggcaagaggggu

SEQ ID NO: 3468292 - RNA, 23 nt, Human
ccagcugggaucugacugcacgu

SEQ ID NO: 3468293 - RNA, 19 nt, Human
ccagcugggccgggaccca

SEQ ID NO: 3468294 - RNA, 11 nt, Human
ccagcugggcu

SEQ ID NO: 3468295 - RNA, 20 nt, Human
ccagcuggggccaggcuggg

SEQ ID NO: 3468296 - RNA, 23 nt, Human
ccagcuggggccaggcugggucg

SEQ ID NO: 3468297 - RNA, 21 nt, Human
ccagcuggggcguggggaggg

SEQ ID NO: 3468298 - RNA, 17 nt, Human
ccagcugggucaggcag

SEQ ID NO: 3468299 - RNA, 18 nt, Human
ccagcuguccccccacuc

SEQ ID NO: 3468300 - RNA, 17 nt, Human
ccagcugugagccuugg

SEQ ID NO: 3468301 - RNA, 20 nt, Human
ccagcugugagccuuggcug

SEQ ID NO: 3468302 - RNA, 21 nt, Human
ccagcugugcucuggacaggc

SEQ ID NO: 3468303 - RNA, 22 nt, Human
ccagcugugcucuggacaggca

SEQ ID NO: 3468304 - RNA, 14 nt, Human
ccagcugugcuuau

SEQ ID NO: 3468305 - RNA, 21 nt, Human
ccagcugugcuuaugguacca

SEQ ID NO: 3468306 - RNA, 23 nt, Human
ccagcuguggguacagagagguc

SEQ ID NO: 3468307 - RNA, 14 nt, Human
ccagcugugguuuu

SEQ ID NO: 3468308 - RNA, 14 nt, Human
ccagcuguguccaa

SEQ ID NO: 3468309 - RNA, 16 nt, Human
ccagcuguucagcugg

SEQ ID NO: 3468310 - RNA, 16 nt, Human
ccagcuucacuucuga

SEQ ID NO: 3468311 - RNA, 14 nt, Human
ccagcuuccagcag

SEQ ID NO: 3468312 - RNA, 15 nt, Human
ccagcuuccuucaga

SEQ ID NO: 3468313 - RNA, 20 nt, Human
ccagcuuccuucagagagca

SEQ ID NO: 3468314 - RNA, 23 nt, Human
ccagcuuccuucagagagcagug

SEQ ID NO: 3468315 - RNA, 18 nt, Human
ccagcuucuccaggcucu

SEQ ID NO: 3468316 - RNA, 22 nt, Human
ccagcuucugguacucuccuag

SEQ ID NO: 3468317 - RNA, 23 nt, Human
ccagcuucugguacucuccuaga

SEQ ID NO: 3468318 - RNA, 20 nt, Human
ccagcuugaaaccuucacuu

SEQ ID NO: 3468319 - RNA, 15 nt, Human
ccagcuugccagaug

SEQ ID NO: 3468320 - RNA, 18 nt, Human
ccagcuugccagaugcug

SEQ ID NO: 3468321 - RNA, 23 nt, Human
ccagcuugggcccagcugggcuc

SEQ ID NO: 3468322 - RNA, 16 nt, Human
ccagcuuggggccacc

SEQ ID NO: 3468323 - RNA, 19 nt, Human
ccagcuuggggccaccaaa

SEQ ID NO: 3468324 - RNA, 17 nt, Human
ccagcuuguggagcccc

SEQ ID NO: 3468325 - RNA, 19 nt, Human
ccagcuuguggagccccac

SEQ ID NO: 3468326 - RNA, 23 nt, Human
ccagcuuguggagccccacacug

SEQ ID NO: 3468327 - RNA, 23 nt, Human
ccagcuuguuuacaugcuuauuc

SEQ ID NO: 3468328 - RNA, 12 nt, Human
ccagcuuuccug

SEQ ID NO: 3468329 - RNA, 15 nt, Human
ccagcuuugcccaac

SEQ ID NO: 3468330 - RNA, 18 nt, Human
ccagcuuugcccaacacc

SEQ ID NO: 3468331 - RNA, 18 nt, Human
ccagcuuuuaaccaucug

SEQ ID NO: 3468332 - RNA, 20 nt, Human
ccaggaaagcgccuccaacc

SEQ ID NO: 3468333 - RNA, 14 nt, Human
ccaggaaaggcucc

SEQ ID NO: 3468334 - RNA, 15 nt, Human
ccaggaaaggcucca

SEQ ID NO: 3468335 - RNA, 18 nt, Human
ccaggaaaggcuccagga

SEQ ID NO: 3468336 - RNA, 19 nt, Human
ccaggaaaggcuccaggag

SEQ ID NO: 3468337 - RNA, 20 nt, Human
ccaggaaaggcuccaggagc

SEQ ID NO: 3468338 - RNA, 21 nt, Human
ccaggaaaggcuccaggagca

SEQ ID NO: 3468339 - RNA, 16 nt, Human
ccaggaaaugugcaca

SEQ ID NO: 3468340 - RNA, 19 nt, Human
ccaggaacagcaaaugcaa

SEQ ID NO: 3468341 - RNA, 13 nt, Human
ccaggaagccagc

SEQ ID NO: 3468342 - RNA, 19 nt, Human
ccaggaagccagcaggcuc

SEQ ID NO: 3468343 - RNA, 20 nt, Human
ccaggaagccagcaggcucu

SEQ ID NO: 3468344 - RNA, 16 nt, Human
ccaggaagccguccug

SEQ ID NO: 3468345 - RNA, 22 nt, Human
ccaggaagccguccuggcgccu

SEQ ID NO: 3468346 - RNA, 15 nt, Human
ccaggaaggcggggc

SEQ ID NO: 3468347 - RNA, 20 nt, Human
ccaggaauguuaaagucagu

SEQ ID NO: 3468348 - RNA, 18 nt, Human
ccaggaauuucccaggac

SEQ ID NO: 3468349 - RNA, 19 nt, Human
ccaggaauuucccaggacc

SEQ ID NO: 3468350 - RNA, 21 nt, Human
ccaggaauuucccaggacccu

SEQ ID NO: 3468351 - RNA, 22 nt, Human
ccaggaauuucccaggacccug

SEQ ID NO: 3468352 - RNA, 22 nt, Human
ccaggaauuugggacccugcuu

SEQ ID NO: 3468353 - RNA, 23 nt, Human
ccaggaauuugggacccugcuuu

SEQ ID NO: 3468354 - RNA, 20 nt, Human
ccaggacaagcaugguccca

SEQ ID NO: 3468355 - RNA, 23 nt, Human
ccaggacaagcauggucccacau

SEQ ID NO: 3468356 - RNA, 18 nt, Human
ccaggacaccacacccag

SEQ ID NO: 3468357 - RNA, 20 nt, Human
ccaggacaccacacccagcc

SEQ ID NO: 3468358 - RNA, 23 nt, Human
ccaggacaccacacccagccuca

SEQ ID NO: 3468359 - RNA, 14 nt, Human
ccaggacaggacca

SEQ ID NO: 3468360 - RNA, 13 nt, Human
ccaggacaggauc

SEQ ID NO: 3468361 - RNA, 19 nt, Human
ccaggacaggauccaggcc

SEQ ID NO: 3468362 - RNA, 20 nt, Human
ccaggacaugcaauaaaauu

SEQ ID NO: 3468363 - RNA, 23 nt, Human
ccaggacaugcaauaaaauuuaa

SEQ ID NO: 3468364 - RNA, 17 nt, Human
ccaggaccacaggcuca

SEQ ID NO: 3468365 - RNA, 13 nt, Human
ccaggaccagcuc

SEQ ID NO: 3468366 - RNA, 15 nt, Human
ccaggaccagcucag

SEQ ID NO: 3468367 - RNA, 16 nt, Human
ccaggaccagcucagg

SEQ ID NO: 3468368 - RNA, 11 nt, Human
ccaggacccca

SEQ ID NO: 3468369 - RNA, 17 nt, Human
ccaggaccuggcugcca

SEQ ID NO: 3468370 - RNA, 14 nt, Human
ccaggacgccacuc

SEQ ID NO: 3468371 - RNA, 15 nt, Human
ccaggacgccacuca

SEQ ID NO: 3468372 - RNA, 15 nt, Human
ccaggacgcuucuga

SEQ ID NO: 3468373 - RNA, 16 nt, Human
ccaggacgcuucugaa

SEQ ID NO: 3468374 - RNA, 18 nt, Human
ccaggacgcuucugaaug

SEQ ID NO: 3468375 - RNA, 19 nt, Human
ccaggacgcuucugaaugc

SEQ ID NO: 3468376 - RNA, 23 nt, Human
ccaggacgcuucugaaugcugcu

SEQ ID NO: 3468377 - RNA, 23 nt, Human
ccaggacggggccggccaggugg

SEQ ID NO: 3468378 - RNA, 22 nt, Human
ccaggacuauagcccagguccu

SEQ ID NO: 3468379 - RNA, 15 nt, Human
ccaggacuccccagg

SEQ ID NO: 3468380 - RNA, 19 nt, Human
ccaggacuccccaggccag

SEQ ID NO: 3468381 - RNA, 21 nt, Human
ccaggacuccccaggccaggc

SEQ ID NO: 3468382 - RNA, 13 nt, Human
ccaggacucugac

SEQ ID NO: 3468383 - RNA, 14 nt, Human
ccaggacucugacc

SEQ ID NO: 3468384 - RNA, 12 nt, Human
ccaggacucugc

SEQ ID NO: 3468385 - RNA, 14 nt, Human
ccaggacucugcag

SEQ ID NO: 3468386 - RNA, 16 nt, Human
ccaggacucugcagcc

SEQ ID NO: 3468387 - RNA, 14 nt, Human
ccaggacugagccc

SEQ ID NO: 3468388 - RNA, 14 nt, Human
ccaggacuguuuca

SEQ ID NO: 3468389 - RNA, 12 nt, Human
ccaggagaacug

SEQ ID NO: 3468390 - RNA, 14 nt, Human
ccaggagaagcuca

SEQ ID NO: 3468391 - RNA, 21 nt, Human
ccaggagaagcucagcugcau

SEQ ID NO: 3468392 - RNA, 22 nt, Human
ccaggagaagcucagcugcauu

SEQ ID NO: 3468393 - RNA, 13 nt, Human
ccaggagacaggu

SEQ ID NO: 3468394 - RNA, 16 nt, Human
ccaggagagagaaagc

SEQ ID NO: 3468395 - RNA, 13 nt, Human
ccaggagagccag

SEQ ID NO: 3468396 - RNA, 16 nt, Human
ccaggagagccagccc

SEQ ID NO: 3468397 - RNA, 18 nt, Human
ccaggagagccagcccuc

SEQ ID NO: 3468398 - RNA, 16 nt, Human
ccaggagagcuuaggg

SEQ ID NO: 3468399 - RNA, 12 nt, Human
ccaggagcaaau

SEQ ID NO: 3468400 - RNA, 15 nt, Human
ccaggagcaaauguu

SEQ ID NO: 3468401 - RNA, 18 nt, Human
ccaggagcacggcucugu

SEQ ID NO: 3468402 - RNA, 19 nt, Human
ccaggagcacggcucuguc

SEQ ID NO: 3468403 - RNA, 11 nt, Human
ccaggcuggga

SEQ ID NO: 3468404 - RNA, 13 nt, Human
ccaggcugggaga

SEQ ID NO: 3468405 - RNA, 17 nt, Human
ccaggcugggagagccu

SEQ ID NO: 3468406 - RNA, 22 nt, Human
ccaggcugggagagccuuccag

SEQ ID NO: 3468407 - RNA, 22 nt, Human
ccaggcugggucgcccuggacu

SEQ ID NO: 3468408 - RNA, 24 nt, Human
ccaggcuguaucccaugagccuca

SEQ ID NO: 3468409 - RNA, 23 nt, Human
ccaggcuguguuuggcuuucagg

SEQ ID NO: 3468410 - RNA, 23 nt, Human
ccaggcuuagucacugagacagc

SEQ ID NO: 3468411 - RNA, 18 nt, Human
ccaggcuucacccugaau

SEQ ID NO: 3468412 - RNA, 23 nt, Human
ccaggcuucugcuggggccuggg

SEQ ID NO: 3468413 - RNA, 12 nt, Human
ccaggcuuucua

SEQ ID NO: 3468414 - RNA, 19 nt, Human
ccaggcuuuuuuaucaugu

SEQ ID NO: 3468415 - RNA, 16 nt, Human
ccagggaagcagcagc

SEQ ID NO: 3468416 - RNA, 18 nt, Human
ccagggaagcuggccgag

SEQ ID NO: 3468417 - RNA, 12 nt, Human
ccagggaagggg

SEQ ID NO: 3468418 - RNA, 17 nt, Human
ccagggaagugcucuga

SEQ ID NO: 3468419 - RNA, 17 nt, Human
ccagggaauccaagccu

SEQ ID NO: 3468420 - RNA, 21 nt, Human
ccagggaauccaagccuccac

SEQ ID NO: 3468421 - RNA, 16 nt, Human
ccagggacacacagcc

SEQ ID NO: 3468422 - RNA, 19 nt, Human
ccagggacacacagccuag

SEQ ID NO: 3468423 - RNA, 21 nt, Human
ccagggacagaggggguggcc

SEQ ID NO: 3468424 - RNA, 22 nt, Human
ccagggacagaggggguggccu

SEQ ID NO: 3468425 - RNA, 15 nt, Human
ccagggacucugccg

SEQ ID NO: 3468426 - RNA, 13 nt, Human
ccagggagaccga

SEQ ID NO: 3468427 - RNA, 18 nt, Human
ccagggagaccuggacac

SEQ ID NO: 3468428 - RNA, 23 nt, Human
ccagggagaccuggacacaggcc

SEQ ID NO: 3468429 - RNA, 19 nt, Human
ccagggagagcccaggagc

SEQ ID NO: 3468430 - RNA, 21 nt, Human
ccagggagagcccaggagcuc

SEQ ID NO: 3468431 - RNA, 23 nt, Human
ccagggagagcccaggagcuccc

SEQ ID NO: 3468432 - RNA, 17 nt, Human
ccagggagaggccauga

SEQ ID NO: 3468433 - RNA, 15 nt, Human
ccagggagauuuuga

SEQ ID NO: 3468434 - RNA, 22 nt, Human
ccagggagcaugagaggaggca

SEQ ID NO: 3468435 - RNA, 19 nt, Human
ccagggagcauuuuccucc

SEQ ID NO: 3468436 - RNA, 12 nt, Human
ccagggagccuu

SEQ ID NO: 3468437 - RNA, 14 nt, Human
ccagggagccuuug

SEQ ID NO: 3468438 - RNA, 22 nt, Human
ccagggagccuuugguucuggc

SEQ ID NO: 3468439 - RNA, 17 nt, Human
ccagggaggcugguccu

SEQ ID NO: 3468440 - RNA, 16 nt, Human
ccagggaguccccucc

SEQ ID NO: 3468441 - RNA, 18 nt, Human
ccagggauggggccacag

SEQ ID NO: 3468442 - RNA, 17 nt, Human
ccagggcaagcuccgca

SEQ ID NO: 3468443 - RNA, 22 nt, Human
ccagggcaaggguuaaggccug

SEQ ID NO: 3468444 - RNA, 23 nt, Human
ccagggcaaggguuaaggccuga

SEQ ID NO: 3468445 - RNA, 19 nt, Human
ccagggcaccaagcccaca

SEQ ID NO: 3468446 - RNA, 22 nt, Human
ccagggcacccuguggcccugg

SEQ ID NO: 3468447 - RNA, 13 nt, Human
ccagggcagccag

SEQ ID NO: 3468448 - RNA, 14 nt, Human
ccagggcagccagg

SEQ ID NO: 3468449 - RNA, 14 nt, Human
ccagggcagggcca

SEQ ID NO: 3468450 - RNA, 13 nt, Human
ccagggcaucucu

SEQ ID NO: 3468451 - RNA, 16 nt, Human
ccagggcaucugggag

SEQ ID NO: 3468452 - RNA, 18 nt, Human
ccagggccacgcuccagc

SEQ ID NO: 3468453 - RNA, 17 nt, Human
ccagggccacgugccag

SEQ ID NO: 3468454 - RNA, 19 nt, Human
ccagggccacucugccucu

SEQ ID NO: 3468455 - RNA, 20 nt, Human
ccagggccacucugccucug

SEQ ID NO: 3468456 - RNA, 14 nt, Human
ccagggccagccuc

SEQ ID NO: 3468457 - RNA, 23 nt, Human
ccagggcccagagcccagcucca

SEQ ID NO: 3468458 - RNA, 21 nt, Human
ccagggccccucacccugccu

SEQ ID NO: 3468459 - RNA, 13 nt, Human
ccagggcccucgg

SEQ ID NO: 3468460 - RNA, 18 nt, Human
ccagggcccugagcucgg

SEQ ID NO: 3468461 - RNA, 16 nt, Human
ccagggccgaggaggu

SEQ ID NO: 3468462 - RNA, 18 nt, Human
ccagggccugagccuggc

SEQ ID NO: 3468463 - RNA, 15 nt, Human
ccagggccugucuca

SEQ ID NO: 3468464 - RNA, 21 nt, Human
ccagggccuuuucuggcaccg

SEQ ID NO: 3468465 - RNA, 19 nt, Human
ccagggcuagugacuugug

SEQ ID NO: 3468466 - RNA, 21 nt, Human
ccagggcuauagcucaggacc

SEQ ID NO: 3468467 - RNA, 19 nt, Human
ccagggcuaugggagcagc

SEQ ID NO: 3468468 - RNA, 20 nt, Human
ccagggcuaugggagcagcu

SEQ ID NO: 3468469 - RNA, 11 nt, Human
ccagggcucag

SEQ ID NO: 3468470 - RNA, 21 nt, Human
ccagggcuccagccccucuug

SEQ ID NO: 3468471 - RNA, 16 nt, Human
ccagggcucugaccag

SEQ ID NO: 3468472 - RNA, 14 nt, Human
ccagggcucugccc

SEQ ID NO: 3468473 - RNA, 17 nt, Human
ccagggcugcccugaga

SEQ ID NO: 3468474 - RNA, 18 nt, Human
ccagggcugcccugagaa

SEQ ID NO: 3468475 - RNA, 21 nt, Human
ccagggcugcccugagaagcu

SEQ ID NO: 3468476 - RNA, 21 nt, Human
ccagggcuggaaugauuucag

SEQ ID NO: 3468477 - RNA, 13 nt, Human
ccagggcuggacu

SEQ ID NO: 3468478 - RNA, 22 nt, Human
ccagggcuggacugaggccuga

SEQ ID NO: 3468479 - RNA, 21 nt, Human
ccagggcuggggcagccucug

SEQ ID NO: 3468480 - RNA, 20 nt, Human
ccagggcuguaacugccagg

SEQ ID NO: 3468481 - RNA, 20 nt, Human
ccagggcuuaccuguacacu

SEQ ID NO: 3468482 - RNA, 21 nt, Human
ccagggcuuacggcccuggcc

SEQ ID NO: 3468483 - RNA, 20 nt, Human
ccaggggaaaaucagccugc

SEQ ID NO: 3468484 - RNA, 19 nt, Human
ccaggggaacacuggggac

SEQ ID NO: 3468485 - RNA, 15 nt, Human
ccaggggaaccugcc

SEQ ID NO: 3468486 - RNA, 24 nt, Human
ccaggggaaccugccaugccagga

SEQ ID NO: 3468487 - RNA, 13 nt, Human
ccaggggaccaca

SEQ ID NO: 3468488 - RNA, 18 nt, Human
ccaggggaugaguggagg

SEQ ID NO: 3468489 - RNA, 16 nt, Human
ccaggggaugggaggu

SEQ ID NO: 3468490 - RNA, 16 nt, Human
ccaggggcagccccag

SEQ ID NO: 3468491 - RNA, 16 nt, Human
ccaggggcaggcacag

SEQ ID NO: 3468492 - RNA, 17 nt, Human
ccaggggcaggcacagc

SEQ ID NO: 3468493 - RNA, 22 nt, Human
ccaggggcccaaggcggccccu

SEQ ID NO: 3468494 - RNA, 19 nt, Human
ccaggggccggccaguggc

SEQ ID NO: 3468495 - RNA, 15 nt, Human
ccaggggcucccucc

SEQ ID NO: 3468496 - RNA, 17 nt, Human
ccagggggacuagcccc

SEQ ID NO: 3468497 - RNA, 19 nt, Human
ccagggggacuagccccug

SEQ ID NO: 3468498 - RNA, 18 nt, Human
ccagggggaugccacucc

SEQ ID NO: 3468499 - RNA, 19 nt, Human
ccaggggggugaggagcug

SEQ ID NO: 3468500 - RNA, 15 nt, Human
ccaggggucucccug

SEQ ID NO: 3468501 - RNA, 16 nt, Human
ccaggggucucccugg

SEQ ID NO: 3468502 - RNA, 17 nt, Human
ccaggggucucccugga

SEQ ID NO: 3468503 - RNA, 17 nt, Human
ccaggggucucccuggc

SEQ ID NO: 3468504 - RNA, 19 nt, Human
ccaggggugauuucagaga

SEQ ID NO: 3468505 - RNA, 21 nt, Human
ccaggggugggacacccugug

SEQ ID NO: 3468506 - RNA, 19 nt, Human
ccaggguagcccgccugcc

SEQ ID NO: 3468507 - RNA, 21 nt, Human
ccaggguagcccgccugccag

SEQ ID NO: 3468508 - RNA, 23 nt, Human
ccaggguagcccgccugccaguc

SEQ ID NO: 3468509 - RNA, 17 nt, Human
ccagggucacugaaggc

SEQ ID NO: 3468510 - RNA, 17 nt, Human
ccagggucccucugugu

SEQ ID NO: 3468511 - RNA, 18 nt, Human
ccagggucccucugugua

SEQ ID NO: 3468512 - RNA, 15 nt, Human
ccagggucuccagaa

SEQ ID NO: 3468513 - RNA, 20 nt, Human
ccagggucugugugaaugug

SEQ ID NO: 3468514 - RNA, 23 nt, Human
ccagggugagagcugcucuggaa

SEQ ID NO: 3468515 - RNA, 20 nt, Human
ccaggguggacuuagaaagc

SEQ ID NO: 3468516 - RNA, 21 nt, Human
ccaggguggacuuagaaagca

SEQ ID NO: 3468517 - RNA, 16 nt, Human
ccaggguggcagcaac

SEQ ID NO: 3468518 - RNA, 17 nt, Human
ccaggguggcagcaaca

SEQ ID NO: 3468519 - RNA, 24 nt, Human
ccaggguggccacaccucuauccc

SEQ ID NO: 3468520 - RNA, 21 nt, Human
ccaggguguggcccugccauc

SEQ ID NO: 3468521 - RNA, 20 nt, Human
ccaggguucccccagcccug

SEQ ID NO: 3468522 - RNA, 21 nt, Human
ccaggguucccccagcccugu

SEQ ID NO: 3468523 - RNA, 16 nt, Human
ccaggguugaccccag

SEQ ID NO: 3468524 - RNA, 19 nt, Human
ccaggguuggcaccuuccc

SEQ ID NO: 3468525 - RNA, 13 nt, Human
ccaggguuuuaac

SEQ ID NO: 3468526 - RNA, 23 nt, Human
ccagguaaugagggacuggaacc

SEQ ID NO: 3468527 - RNA, 17 nt, Human
ccagguaccagcugcgc

SEQ ID NO: 3468528 - RNA, 16 nt, Human
ccagguacgcacagac

SEQ ID NO: 3468529 - RNA, 18 nt, Human
ccagguacgcacagacag

SEQ ID NO: 3468530 - RNA, 19 nt, Human
ccagguacgcacagacagg

SEQ ID NO: 3468531 - RNA, 14 nt, Human
ccagguagaacaca

SEQ ID NO: 3468532 - RNA, 13 nt, Human
ccagguagcuggg

SEQ ID NO: 3468533 - RNA, 17 nt, Human
ccagguaucuccaggau

SEQ ID NO: 3468534 - RNA, 15 nt, Human
ccagguauggcucug

SEQ ID NO: 3468535 - RNA, 13 nt, Human
ccaggucaacaga

SEQ ID NO: 3468536 - RNA, 20 nt, Human
ccaggucaacagaaugaaaa

SEQ ID NO: 3468537 - RNA, 18 nt, Human
ccagguccaaugagcuuu

SEQ ID NO: 3468538 - RNA, 15 nt, Human
ccagguccagcucug

SEQ ID NO: 3468539 - RNA, 16 nt, Human
ccagguccagcucugg

SEQ ID NO: 3468540 - RNA, 18 nt, Human
ccagguccagcucuggag

SEQ ID NO: 3468541 - RNA, 17 nt, Human
ccaggucccccugcagc

SEQ ID NO: 3468542 - RNA, 15 nt, Human
ccaggucccucucau

SEQ ID NO: 3468543 - RNA, 23 nt, Human
ccaggucccucucauuuagccug

SEQ ID NO: 3468544 - RNA, 13 nt, Human
ccagguccucuga

SEQ ID NO: 3468545 - RNA, 22 nt, Human
ccagguccucugauacccagag

SEQ ID NO: 3468546 - RNA, 14 nt, Human
cccaggaagcccag

SEQ ID NO: 3468547 - RNA, 15 nt, Human
cccaggaagcccagg

SEQ ID NO: 3468548 - RNA, 12 nt, Human
cccaggaagccg

SEQ ID NO: 3468549 - RNA, 23 nt, Human
cccaggaaucaguuuaaaagcac

SEQ ID NO: 3468550 - RNA, 19 nt, Human
cccaggaauggagccugca

SEQ ID NO: 3468551 - RNA, 23 nt, Human
cccaggaauuugggacccugcuu

SEQ ID NO: 3468552 - RNA, 21 nt, Human
cccaggacaccacacccagcc

SEQ ID NO: 3468553 - RNA, 17 nt, Human
cccaggacaggauccag

SEQ ID NO: 3468554 - RNA, 23 nt, Human
cccaggaccacaggcucaggcag

SEQ ID NO: 3468555 - RNA, 22 nt, Human
cccaggaccagaagcuccccca

SEQ ID NO: 3468556 - RNA, 16 nt, Human
cccaggaccagcucag

SEQ ID NO: 3468557 - RNA, 21 nt, Human
cccaggaccagcucaggacag

SEQ ID NO: 3468558 - RNA, 20 nt, Human
cccaggaccaucuucccgag

SEQ ID NO: 3468559 - RNA, 19 nt, Human
cccaggacccuggacccag

SEQ ID NO: 3468560 - RNA, 20 nt, Human
cccaggacccuggacccagc

SEQ ID NO: 3468561 - RNA, 18 nt, Human
cccaggaccuggcugcca

SEQ ID NO: 3468562 - RNA, 22 nt, Human
cccaggacgccacucauuucau

SEQ ID NO: 3468563 - RNA, 15 nt, Human
cccaggacgcuucug

SEQ ID NO: 3468564 - RNA, 19 nt, Human
cccaggacggggccggcca

SEQ ID NO: 3468565 - RNA, 19 nt, Human
cccaggacucugaccccag

SEQ ID NO: 3468566 - RNA, 23 nt, Human
cccaggacucugaccccagcauu

SEQ ID NO: 3468567 - RNA, 12 nt, Human
cccaggacuggg

SEQ ID NO: 3468568 - RNA, 14 nt, Human
cccaggagagagaa

SEQ ID NO: 3468569 - RNA, 18 nt, Human
cccaggagagccagcccu

SEQ ID NO: 3468570 - RNA, 12 nt, Human
cccaggagccca

SEQ ID NO: 3468571 - RNA, 13 nt, Human
cccaggagcccau

SEQ ID NO: 3468572 - RNA, 17 nt, Human
cccaggagccugcccag

SEQ ID NO: 3468573 - RNA, 17 nt, Human
cccaggaggcagggagg

SEQ ID NO: 3468574 - RNA, 14 nt, Human
cccaggaggccagc

SEQ ID NO: 3468575 - RNA, 15 nt, Human
cccaggaggccagcc

SEQ ID NO: 3468576 - RNA, 18 nt, Human
cccaggaggccagccuug

SEQ ID NO: 3468577 - RNA, 22 nt, Human
cccaggaggccagccuugacca

SEQ ID NO: 3468578 - RNA, 18 nt, Human
cccaggagggcauccaua

SEQ ID NO: 3468579 - RNA, 15 nt, Human
cccaggaguucugcu

SEQ ID NO: 3468580 - RNA, 21 nt, Human
cccaggaguucugcucauucu

SEQ ID NO: 3468581 - RNA, 22 nt, Human
cccaggaguuugaggcugcagc

SEQ ID NO: 3468582 - RNA, 18 nt, Human
cccaggaguuuggccaga

SEQ ID NO: 3468583 - RNA, 17 nt, Human
cccaggauacuggcaca

SEQ ID NO: 3468584 - RNA, 19 nt, Human
cccaggauacuggcacaga

SEQ ID NO: 3468585 - RNA, 16 nt, Human
cccaggcaaauaaaau

SEQ ID NO: 3468586 - RNA, 22 nt, Human
cccaggcaaauaaaauucccua

SEQ ID NO: 3468587 - RNA, 20 nt, Human
cccaggcaaaucaguuacua

SEQ ID NO: 3468588 - RNA, 18 nt, Human
cccaggcaaggcugugga

SEQ ID NO: 3468589 - RNA, 19 nt, Human
cccaggcaaggcuguggac

SEQ ID NO: 3468590 - RNA, 13 nt, Human
cccaggcacugca

SEQ ID NO: 3468591 - RNA, 17 nt, Human
cccaggcacugggcucc

SEQ ID NO: 3468592 - RNA, 17 nt, Human
cccaggcaggucuugaa

SEQ ID NO: 3468593 - RNA, 17 nt, Human
cccaggcauuccccagg

SEQ ID NO: 3468594 - RNA, 18 nt, Human
cccaggcauuccccagga

SEQ ID NO: 3468595 - RNA, 22 nt, Human
cccaggcauuccccaggaggcc

SEQ ID NO: 3468596 - RNA, 14 nt, Human
cccaggcauugcca

SEQ ID NO: 3468597 - RNA, 21 nt, Human
cccaggcauugccaagggcuu

SEQ ID NO: 3468598 - RNA, 14 nt, Human
cccaggccaggacu

SEQ ID NO: 3468599 - RNA, 15 nt, Human
cccaggccaggacuc

SEQ ID NO: 3468600 - RNA, 21 nt, Human
cccaggccaggacucugcagc

SEQ ID NO: 3468601 - RNA, 22 nt, Human
cccaggccaggacucugcagcc

SEQ ID NO: 3468602 - RNA, 21 nt, Human
cccaggccaucuuccaggugg

SEQ ID NO: 3468603 - RNA, 11 nt, Human
cccaggcccac

SEQ ID NO: 3468604 - RNA, 15 nt, Human
cccaggcccacucag

SEQ ID NO: 3468605 - RNA, 16 nt, Human
cccaggcccacucagg

SEQ ID NO: 3468606 - RNA, 22 nt, Human
cccaggcccacugugccucaga

SEQ ID NO: 3468607 - RNA, 13 nt, Human
cccaggccccagg

SEQ ID NO: 3468608 - RNA, 17 nt, Human
cccaggccccaggaagc

SEQ ID NO: 3468609 - RNA, 18 nt, Human
cccaggccccugccaccc

SEQ ID NO: 3468610 - RNA, 18 nt, Human
cccaggccccuggaggcu

SEQ ID NO: 3468611 - RNA, 17 nt, Human
cccaggccgcagcucuu

SEQ ID NO: 3468612 - RNA, 18 nt, Human
cccaggccgcagcucuug

SEQ ID NO: 3468613 - RNA, 21 nt, Human
cccaggccgcagcucuugccc

SEQ ID NO: 3468614 - RNA, 12 nt, Human
cccaggccggcc

SEQ ID NO: 3468615 - RNA, 21 nt, Human
cccaggccgggguggagcaug

SEQ ID NO: 3468616 - RNA, 16 nt, Human
cccaggccuccagcuc

SEQ ID NO: 3468617 - RNA, 13 nt, Human
cccaggccucugu

SEQ ID NO: 3468618 - RNA, 22 nt, Human
cccaggcgggagcgguggcccu

SEQ ID NO: 3468619 - RNA, 14 nt, Human
cccaggcuccgccc

SEQ ID NO: 3468620 - RNA, 18 nt, Human
cccaggcuccgcccuuag

SEQ ID NO: 3468621 - RNA, 21 nt, Human
cccaggcuccgcccuuagucc

SEQ ID NO: 3468622 - RNA, 15 nt, Human
cccaggcugagccuc

SEQ ID NO: 3468623 - RNA, 16 nt, Human
cccaggcugagccuca

SEQ ID NO: 3468624 - RNA, 17 nt, Human
cccaggcugagccucag

SEQ ID NO: 3468625 - RNA, 14 nt, Human
cccaggcugccguc

SEQ ID NO: 3468626 - RNA, 18 nt, Human
cccaggcugccugagcac

SEQ ID NO: 3468627 - RNA, 22 nt, Human
cccaggcuggacaugcugacug

SEQ ID NO: 3468628 - RNA, 20 nt, Human
cccaggcuggagugcaaugg

SEQ ID NO: 3468629 - RNA, 16 nt, Human
cccaggcuggccagcc

SEQ ID NO: 3468630 - RNA, 19 nt, Human
cccaggcuggccagcccca

SEQ ID NO: 3468631 - RNA, 21 nt, Human
cccaggcugggaacucaucug

SEQ ID NO: 3468632 - RNA, 19 nt, Human
cccaggcugggcaaggagg

SEQ ID NO: 3468633 - RNA, 16 nt, Human
cccaggcuggucucaa

SEQ ID NO: 3468634 - RNA, 23 nt, Human
cccaggcuggucuugaaguccug

SEQ ID NO: 3468635 - RNA, 15 nt, Human
cccaggcuuagucac

SEQ ID NO: 3468636 - RNA, 13 nt, Human
cccagggaagugc

SEQ ID NO: 3468637 - RNA, 17 nt, Human
cccagggacaccagcca

SEQ ID NO: 3468638 - RNA, 18 nt, Human
cccagggacaccugggag

SEQ ID NO: 3468639 - RNA, 19 nt, Human
cccagggacaccugggaga

SEQ ID NO: 3468640 - RNA, 20 nt, Human
cccagggagcggaaagcagc

SEQ ID NO: 3468641 - RNA, 21 nt, Human
cccagggauuuguccuugggg

SEQ ID NO: 3468642 - RNA, 18 nt, Human
cccagggcaagcuccgca

SEQ ID NO: 3468643 - RNA, 11 nt, Human
cccagggcaca

SEQ ID NO: 3468644 - RNA, 15 nt, Human
cccagggcacaggag

SEQ ID NO: 3468645 - RNA, 17 nt, Human
cccagggcacaggagcu

SEQ ID NO: 3468646 - RNA, 22 nt, Human
cccagggcacaggagcuaccug

SEQ ID NO: 3468647 - RNA, 12 nt, Human
cccagggcaccc

SEQ ID NO: 3468648 - RNA, 14 nt, Human
cccagggcacgugg

SEQ ID NO: 3468649 - RNA, 21 nt, Human
cccagggcaucuugcuggcua

SEQ ID NO: 3468650 - RNA, 23 nt, Human
cccagggccacucugccucugcc

SEQ ID NO: 3468651 - RNA, 17 nt, Human
cccagggccagggcccu

SEQ ID NO: 3468652 - RNA, 21 nt, Human
cccagggccagggcccugcag

SEQ ID NO: 3468653 - RNA, 19 nt, Human
cccagggcccagagcccag

SEQ ID NO: 3468654 - RNA, 16 nt, Human
cccagggccugcagga

SEQ ID NO: 3468655 - RNA, 17 nt, Human
cccagggcucagccugg

SEQ ID NO: 3468656 - RNA, 18 nt, Human
cccagggcucagccuggu

SEQ ID NO: 3468657 - RNA, 19 nt, Human
cccagggcucugccccagu

SEQ ID NO: 3468658 - RNA, 13 nt, Human
cccagggcucugu

SEQ ID NO: 3468659 - RNA, 16 nt, Human
cccagggcucuguaag

SEQ ID NO: 3468660 - RNA, 21 nt, Human
cccagggcuguaacugccagg

SEQ ID NO: 3468661 - RNA, 22 nt, Human
cccagggcuuacggcccuggcc

SEQ ID NO: 3468662 - RNA, 16 nt, Human
cccaggggacaaggga

SEQ ID NO: 3468663 - RNA, 22 nt, Human
cccaggggagagggucuggaga

SEQ ID NO: 3468664 - RNA, 14 nt, Human
cccaggggagcccu

SEQ ID NO: 3468665 - RNA, 15 nt, Human
cccaggggagcccuc

SEQ ID NO: 3468666 - RNA, 19 nt, Human
cccaggggagcccuccacg

SEQ ID NO: 3468667 - RNA, 17 nt, Human
cccaggggcccacaggg

SEQ ID NO: 3468668 - RNA, 17 nt, Human
cccaggggcucccuccg

SEQ ID NO: 3468669 - RNA, 16 nt, Human
cccaggggucucccug

SEQ ID NO: 3468670 - RNA, 19 nt, Human
cccaggggucucccuggcu

SEQ ID NO: 3468671 - RNA, 19 nt, Human
cccaggggugcccccuccu

SEQ ID NO: 3468672 - RNA, 22 nt, Human
cccaggggugcccccuccucuc

SEQ ID NO: 3468673 - RNA, 23 nt, Human
cccaggggugcccccuccucucc

SEQ ID NO: 3468674 - RNA, 15 nt, Human
cccaggguccuggga

SEQ ID NO: 3468675 - RNA, 15 nt, Human
cccagggucuucccu

SEQ ID NO: 3468676 - RNA, 19 nt, Human
cccaggguggagugcagug

SEQ ID NO: 3468677 - RNA, 20 nt, Human
cccaggguggagugcagugg

SEQ ID NO: 3468678 - RNA, 18 nt, Human
cccaggguucccccagcc

SEQ ID NO: 3468679 - RNA, 14 nt, Human
cccagguaagcagg

SEQ ID NO: 3468680 - RNA, 19 nt, Human
cccagguaccagcugcgcu

SEQ ID NO: 3468681 - RNA, 17 nt, Human
cccagguaggccaaggu

SEQ ID NO: 3468682 - RNA, 17 nt, Human
cccagguaggggccccu

SEQ ID NO: 3468683 - RNA, 14 nt, Human
cccagguccagcuc

SEQ ID NO: 3468684 - RNA, 21 nt, Human
cccaggugcagccagaggcac

SEQ ID NO: 3468685 - RNA, 13 nt, Human
cccaggugccagu

SEQ ID NO: 3468686 - RNA, 23 nt, Human
cccagguggaaggcagacagcag

SEQ ID NO: 3468687 - RNA, 16 nt, Human
cccagguggcugaccc

SEQ ID NO: 3468688 - RNA, 18 nt, Human
cccagguggcugacccag

SEQ ID NO: 3468689 - RNA, 23 nt, Human
cccagguggcugacccagucccu

SEQ ID NO: 3468690 - RNA, 19 nt, Human
cccaugauuucauguacug

SEQ ID NO: 3468691 - RNA, 21 nt, Human
cccaugccaaagcuagggugg

SEQ ID NO: 3468692 - RNA, 18 nt, Human
cccaugccacguuccaca

SEQ ID NO: 3468693 - RNA, 22 nt, Human
cccaugccacguuccacaguug

SEQ ID NO: 3468694 - RNA, 15 nt, Human
cccaugcccaccugc

SEQ ID NO: 3468695 - RNA, 20 nt, Human
cccaugccuguccagccugg

SEQ ID NO: 3468696 - RNA, 17 nt, Human
cccaugccuguggcugc

SEQ ID NO: 3468697 - RNA, 15 nt, Human
cccaugcugcccugu

SEQ ID NO: 3468698 - RNA, 16 nt, Human
cccaugcugcccugug

SEQ ID NO: 3468699 - RNA, 18 nt, Human
cccaugcugcccugugag

SEQ ID NO: 3468700 - RNA, 19 nt, Human
cccaugcuggagccugugu

SEQ ID NO: 3468701 - RNA, 20 nt, Human
cccaugcuggagccugugua

SEQ ID NO: 3468702 - RNA, 23 nt, Human
cccaugcuggccuugccacacuc

SEQ ID NO: 3468703 - RNA, 21 nt, Human
cccauggacacuccagugcca

SEQ ID NO: 3468704 - RNA, 22 nt, Human
cccauggacaggcuggcuccag

SEQ ID NO: 3468705 - RNA, 23 nt, Human
cccauggagauugaccuggaugg

SEQ ID NO: 3468706 - RNA, 13 nt, Human
cccauggagccag

SEQ ID NO: 3468707 - RNA, 15 nt, Human
cccauggcauuuuau

SEQ ID NO: 3468708 - RNA, 14 nt, Human
cccauggcccugug

SEQ ID NO: 3468709 - RNA, 22 nt, Human
cccauggcccugugcuaauccc

SEQ ID NO: 3468710 - RNA, 23 nt, Human
cccauggccggcuuucaggagcu

SEQ ID NO: 3468711 - RNA, 17 nt, Human
cccauggcuuaaugcuu

SEQ ID NO: 3468712 - RNA, 13 nt, Human
cccaugggaggga

SEQ ID NO: 3468713 - RNA, 16 nt, Human
cccaugggcacugcug

SEQ ID NO: 3468714 - RNA, 16 nt, Human
cccaugggcaggagac

SEQ ID NO: 3468715 - RNA, 16 nt, Human
cccaugggcucugaca

SEQ ID NO: 3468716 - RNA, 15 nt, Human
cccauguaaauacca

SEQ ID NO: 3468717 - RNA, 22 nt, Human
cccauguagcccccuggccucu

SEQ ID NO: 3468718 - RNA, 20 nt, Human
cccauguauggccaggaagu

SEQ ID NO: 3468719 - RNA, 19 nt, Human
cccaugucgcgcucagcau

SEQ ID NO: 3468720 - RNA, 17 nt, Human
cccaugucucgacucau

SEQ ID NO: 3468721 - RNA, 16 nt, Human
cccaugugagcugcug

SEQ ID NO: 3468722 - RNA, 18 nt, Human
cccaugugagcugcugcc

SEQ ID NO: 3468723 - RNA, 22 nt, Human
cccaugugagcugcugccauga

SEQ ID NO: 3468724 - RNA, 13 nt, Human
cccaugugccaag

SEQ ID NO: 3468725 - RNA, 21 nt, Human
cccauguguccugguucccgu

SEQ ID NO: 3468726 - RNA, 14 nt, Human
cccaugugugagug

SEQ ID NO: 3468727 - RNA, 21 nt, Human
cccauuaggacaaucaguccc

SEQ ID NO: 3468728 - RNA, 18 nt, Human
cccauuauucaaaguugc

SEQ ID NO: 3468729 - RNA, 18 nt, Human
cccauucagagacugucc

SEQ ID NO: 3468730 - RNA, 18 nt, Human
cccauucauuccauucug

SEQ ID NO: 3468731 - RNA, 21 nt, Human
cccauucauuccauucuggaa

SEQ ID NO: 3468732 - RNA, 18 nt, Human
cccauuccaaagcuuuau

SEQ ID NO: 3468733 - RNA, 15 nt, Human
cccauucccgcagug

SEQ ID NO: 3468734 - RNA, 18 nt, Human
cccauucccgcaguggga

SEQ ID NO: 3468735 - RNA, 12 nt, Human
cccauucccugg

SEQ ID NO: 3468736 - RNA, 13 nt, Human
cccauucccuggg

SEQ ID NO: 3468737 - RNA, 14 nt, Human
cccauuccucaccu

SEQ ID NO: 3468738 - RNA, 14 nt, Human
cccauuccugggaa

SEQ ID NO: 3468739 - RNA, 18 nt, Human
cccauuccuucccagagg

SEQ ID NO: 3468740 - RNA, 19 nt, Human
cccauucuacacagagcag

SEQ ID NO: 3468741 - RNA, 19 nt, Human
cccauucuacuugcucugg

SEQ ID NO: 3468742 - RNA, 20 nt, Human
cccauucuacuugcucugga

SEQ ID NO: 3468743 - RNA, 23 nt, Human
cccauucuacuugcucuggaccu

SEQ ID NO: 3468744 - RNA, 15 nt, Human
cccauucucaucugc

SEQ ID NO: 3468745 - RNA, 17 nt, Human
cccauucucucuccugu

SEQ ID NO: 3468746 - RNA, 12 nt, Human
cccauucuuccu

SEQ ID NO: 3468747 - RNA, 20 nt, Human
cccauucuuugcuugaacac

SEQ ID NO: 3468748 - RNA, 14 nt, Human
cccauucuuuugua

SEQ ID NO: 3468749 - RNA, 14 nt, Human
cccauugcccuggu

SEQ ID NO: 3468750 - RNA, 17 nt, Human
cccauugccuccuccuu

SEQ ID NO: 3468751 - RNA, 14 nt, Human
cccauugucccucu

SEQ ID NO: 3468752 - RNA, 18 nt, Human
cccauugucccucugccc

SEQ ID NO: 3468753 - RNA, 19 nt, Human
cccauuguggcuccuaucu

SEQ ID NO: 3468754 - RNA, 23 nt, Human
cccauuguggucacaggaaguag

SEQ ID NO: 3468755 - RNA, 20 nt, Human
cccauuuaaaaaaaaucccu

SEQ ID NO: 3468756 - RNA, 12 nt, Human
cccauuucagcu

SEQ ID NO: 3468757 - RNA, 15 nt, Human
cccauuucccaucug

SEQ ID NO: 3468758 - RNA, 17 nt, Human
cccauuucccaucugca

SEQ ID NO: 3468759 - RNA, 21 nt, Human
cccauuucgugagccccaucu

SEQ ID NO: 3468760 - RNA, 18 nt, Human
cccauuucuaaaggccuc

SEQ ID NO: 3468761 - RNA, 20 nt, Human
cccauuucuagaacaucccu

SEQ ID NO: 3468762 - RNA, 15 nt, Human
cccauuucuauuuau

SEQ ID NO: 3468763 - RNA, 17 nt, Human
cccauuucuauuuauuu

SEQ ID NO: 3468764 - RNA, 19 nt, Human
cccauuucuauuuauuuac

SEQ ID NO: 3468765 - RNA, 15 nt, Human
cccauuugcuccuuu

SEQ ID NO: 3468766 - RNA, 16 nt, Human
cccauuugugccagag

SEQ ID NO: 3468767 - RNA, 18 nt, Human
cccauuuuagucacuuuu

SEQ ID NO: 3468768 - RNA, 15 nt, Human
cccauuuuccucuga

SEQ ID NO: 3468769 - RNA, 14 nt, Human
cccauuuucugugg

SEQ ID NO: 3468770 - RNA, 17 nt, Human
cccauuuugagugacuc

SEQ ID NO: 3468771 - RNA, 22 nt, Human
cccauuuuggaaguuuucagga

SEQ ID NO: 3468772 - RNA, 20 nt, Human
ccccaaaaaccucacccgag

SEQ ID NO: 3468773 - RNA, 23 nt, Human
ccccaaaaccacagcccugucag

SEQ ID NO: 3468774 - RNA, 14 nt, Human
ccccaaaacccggg

SEQ ID NO: 3468775 - RNA, 21 nt, Human
ccccaaaacucuccucugcug

SEQ ID NO: 3468776 - RNA, 19 nt, Human
ccccaaaagcgugagcuua

SEQ ID NO: 3468777 - RNA, 19 nt, Human
ccccaaaccugcaagggcu

SEQ ID NO: 3468778 - RNA, 22 nt, Human
ccccaaagagccuggagaagcu

SEQ ID NO: 3468779 - RNA, 21 nt, Human
ccccaaagauagacagguccu

SEQ ID NO: 3468780 - RNA, 17 nt, Human
ccccaaagcagcccuuc

SEQ ID NO: 3468781 - RNA, 18 nt, Human
ccccaaagcagcccuucc

SEQ ID NO: 3468782 - RNA, 22 nt, Human
ccccaaaggcuuugcccugcug

SEQ ID NO: 3468783 - RNA, 11 nt, Human
ccccaaagugg

SEQ ID NO: 3468784 - RNA, 17 nt, Human
ccccaaauaagaaggga

SEQ ID NO: 3468785 - RNA, 15 nt, Human
ccccaaaucaauaca

SEQ ID NO: 3468786 - RNA, 22 nt, Human
ccccaacaaaccauccagugac

SEQ ID NO: 3468787 - RNA, 21 nt, Human
ccccaacacugugcccuggug

SEQ ID NO: 3468788 - RNA, 14 nt, Human
ccccaacagcugga

SEQ ID NO: 3468789 - RNA, 23 nt, Human
ccccaacagcuggacccugacca

SEQ ID NO: 3468790 - RNA, 12 nt, Human
ccccaacagugu

SEQ ID NO: 3468791 - RNA, 13 nt, Human
ccccaaccccuga

SEQ ID NO: 3468792 - RNA, 21 nt, Human
ccccaacccuucuucauguuc

SEQ ID NO: 3468793 - RNA, 13 nt, Human
ccccaaccucagg

SEQ ID NO: 3468794 - RNA, 13 nt, Human
ccccaaccugcuc

SEQ ID NO: 3468795 - RNA, 14 nt, Human
ccccaaccugcucu

SEQ ID NO: 3468796 - RNA, 19 nt, Human
ccccaaccugcucuccucu

SEQ ID NO: 3468797 - RNA, 20 nt, Human
ccccaaccugcucuccucuu

SEQ ID NO: 3468798 - RNA, 19 nt, Human
ccccaaccuuucccucacc

SEQ ID NO: 3468799 - RNA, 21 nt, Human
ccccaaccuuucccucacccc

SEQ ID NO: 3468800 - RNA, 15 nt, Human
ccccaacuccuggaa

SEQ ID NO: 3468801 - RNA, 14 nt, Human
ccccaacucugagc

SEQ ID NO: 3468802 - RNA, 16 nt, Human
ccccaacucugagccc

SEQ ID NO: 3468803 - RNA, 18 nt, Human
ccccaacucugagcccau

SEQ ID NO: 3468804 - RNA, 19 nt, Human
ccccaacucugagcccaug

SEQ ID NO: 3468805 - RNA, 16 nt, Human
ccccaagaaagccuca

SEQ ID NO: 3468806 - RNA, 14 nt, Human
ccccaagaaggcug

SEQ ID NO: 3468807 - RNA, 23 nt, Human
ccccaagaccucuauauuugcuc

SEQ ID NO: 3468808 - RNA, 13 nt, Human
ccccaaggcugcg

SEQ ID NO: 3468809 - RNA, 20 nt, Human
ccccaagggaggcugcugcu

SEQ ID NO: 3468810 - RNA, 13 nt, Human
ccccaagguucuc

SEQ ID NO: 3468811 - RNA, 16 nt, Human
ccccaauaccccaugg

SEQ ID NO: 3468812 - RNA, 16 nt, Human
ccccaauaucuugcuu

SEQ ID NO: 3468813 - RNA, 13 nt, Human
ccccaaucccagc

SEQ ID NO: 3468814 - RNA, 14 nt, Human
ccccaauuccuugu

SEQ ID NO: 3468815 - RNA, 14 nt, Human
ccccacacacacac

SEQ ID NO: 3468816 - RNA, 12 nt, Human
ccccacacagcu

SEQ ID NO: 3468817 - RNA, 15 nt, Human
ccccacacucacucc

SEQ ID NO: 3468818 - RNA, 18 nt, Human
ccccacacuggggugccg

SEQ ID NO: 3468819 - RNA, 19 nt, Human
ccccacagcccacguccug

SEQ ID NO: 3468820 - RNA, 22 nt, Human
ccccacagcccacguccuguca

SEQ ID NO: 3468821 - RNA, 23 nt, Human
ccccacaggagguggucugggac

SEQ ID NO: 3468822 - RNA, 18 nt, Human
ccccaccacacaucccag

SEQ ID NO: 3468823 - RNA, 19 nt, Human
ccccaccacacaucccagc

SEQ ID NO: 3468824 - RNA, 15 nt, Human
ccccaccagugccuc

SEQ ID NO: 3468825 - RNA, 16 nt, Human
ccccaccagugccucu

SEQ ID NO: 3468826 - RNA, 18 nt, Human
ccccaccagugccucucc

SEQ ID NO: 3468827 - RNA, 21 nt, Human
ccccacccaccaacccucagg

SEQ ID NO: 3468828 - RNA, 22 nt, Human
ccccacccaccaacccucaggg

SEQ ID NO: 3468829 - RNA, 13 nt, Human
ccccacccacuuc

SEQ ID NO: 3468830 - RNA, 15 nt, Human
ccccaccccagggca

SEQ ID NO: 3468831 - RNA, 17 nt, Human
ccccacccccuccccag

SEQ ID NO: 3468832 - RNA, 14 nt, Human
ccccaccccuccag

SEQ ID NO: 3468833 - RNA, 23 nt, Human
ccccaccccugcccccagccccg

SEQ ID NO: 3468834 - RNA, 17 nt, Human
ccccagguggaaggcag

SEQ ID NO: 3468835 - RNA, 13 nt, Human
ccccagguggcug

SEQ ID NO: 3468836 - RNA, 20 nt, Human
ccccagguggcugacccagu

SEQ ID NO: 3468837 - RNA, 23 nt, Human
ccccagguguguuggggccuugg

SEQ ID NO: 3468838 - RNA, 14 nt, Human
ccccaguaaaauug

SEQ ID NO: 3468839 - RNA, 18 nt, Human
ccccaguaucucuucagu

SEQ ID NO: 3468840 - RNA, 15 nt, Human
ccccagucagccucu

SEQ ID NO: 3468841 - RNA, 18 nt, Human
ccccaguccccaccccug

SEQ ID NO: 3468842 - RNA, 15 nt, Human
ccccagugcccacag

SEQ ID NO: 3468843 - RNA, 20 nt, Human
ccccagugcccacaggauca

SEQ ID NO: 3468844 - RNA, 21 nt, Human
ccccaguucgccuggagcccu

SEQ ID NO: 3468845 - RNA, 14 nt, Human
ccccaguucugcuc

SEQ ID NO: 3468846 - RNA, 18 nt, Human
ccccaguucugcuccucu

SEQ ID NO: 3468847 - RNA, 14 nt, Human
ccccauagccaccc

SEQ ID NO: 3468848 - RNA, 18 nt, Human
ccccaucacaaacuuaaa

SEQ ID NO: 3468849 - RNA, 19 nt, Human
ccccaucacugcgccacug

SEQ ID NO: 3468850 - RNA, 13 nt, Human
ccccaucauucau

SEQ ID NO: 3468851 - RNA, 12 nt, Human
ccccauccucca

SEQ ID NO: 3468852 - RNA, 15 nt, Human
ccccauccuccagca

SEQ ID NO: 3468853 - RNA, 15 nt, Human
ccccauccuccagcu

SEQ ID NO: 3468854 - RNA, 13 nt, Human
ccccauccucccc

SEQ ID NO: 3468855 - RNA, 17 nt, Human
ccccauccucuguacag

SEQ ID NO: 3468856 - RNA, 19 nt, Human
ccccauccucuguacagag

SEQ ID NO: 3468857 - RNA, 21 nt, Human
ccccauccucuguacagagcc

SEQ ID NO: 3468858 - RNA, 22 nt, Human
ccccauccucuguacagagccc

SEQ ID NO: 3468859 - RNA, 19 nt, Human
ccccaucguugcccccauu

SEQ ID NO: 3468860 - RNA, 22 nt, Human
ccccaucguugcccccauuucu

SEQ ID NO: 3468861 - RNA, 13 nt, Human
ccccaucucaggc

SEQ ID NO: 3468862 - RNA, 14 nt, Human
ccccaucucaggcc

SEQ ID NO: 3468863 - RNA, 23 nt, Human
ccccaucucaugccccuggcugg

SEQ ID NO: 3468864 - RNA, 14 nt, Human
ccccaucucccugc

SEQ ID NO: 3468865 - RNA, 19 nt, Human
ccccaucucccugccuggc

SEQ ID NO: 3468866 - RNA, 22 nt, Human
ccccaucucgcucccucccagg

SEQ ID NO: 3468867 - RNA, 14 nt, Human
ccccaucucuacua

SEQ ID NO: 3468868 - RNA, 16 nt, Human
ccccaucugcauuccc

SEQ ID NO: 3468869 - RNA, 13 nt, Human
ccccaucugccca

SEQ ID NO: 3468870 - RNA, 17 nt, Human
ccccaucugcccaggac

SEQ ID NO: 3468871 - RNA, 18 nt, Human
ccccaucugcccaggacg

SEQ ID NO: 3468872 - RNA, 14 nt, Human
ccccaucugcgggg

SEQ ID NO: 3468873 - RNA, 12 nt, Human
ccccaucuguga

SEQ ID NO: 3468874 - RNA, 14 nt, Human
ccccaucugugaau

SEQ ID NO: 3468875 - RNA, 13 nt, Human
ccccaucugugca

SEQ ID NO: 3468876 - RNA, 12 nt, Human
ccccaucuugcu

SEQ ID NO: 3468877 - RNA, 20 nt, Human
ccccaugaagccacagccca

SEQ ID NO: 3468878 - RNA, 13 nt, Human
ccccaugaccucc

SEQ ID NO: 3468879 - RNA, 15 nt, Human
ccccaugaccuccag

SEQ ID NO: 3468880 - RNA, 16 nt, Human
ccccaugaccuccagc

SEQ ID NO: 3468881 - RNA, 23 nt, Human
ccccaugcacugugaaggacccu

SEQ ID NO: 3468882 - RNA, 22 nt, Human
ccccaugccaaagcuagggugg

SEQ ID NO: 3468883 - RNA, 12 nt, Human
ccccaugccugu

SEQ ID NO: 3468884 - RNA, 13 nt, Human
ccccaugccuguc

SEQ ID NO: 3468885 - RNA, 17 nt, Human
ccccaugccuguccagc

SEQ ID NO: 3468886 - RNA, 20 nt, Human
ccccaugccuguccagccug

SEQ ID NO: 3468887 - RNA, 12 nt, Human
ccccaugcugga

SEQ ID NO: 3468888 - RNA, 17 nt, Human
ccccaugcuggagccug

SEQ ID NO: 3468889 - RNA, 14 nt, Human
ccccaugcuggccu

SEQ ID NO: 3468890 - RNA, 14 nt, Human
ccccaugcuguuga

SEQ ID NO: 3468891 - RNA, 23 nt, Human
ccccaugcuuaacauacccgccu

SEQ ID NO: 3468892 - RNA, 15 nt, Human
ccccaugcuuccuug

SEQ ID NO: 3468893 - RNA, 16 nt, Human
ccccauggcccugagc

SEQ ID NO: 3468894 - RNA, 24 nt, Human
ccccauggccggcuuucaggagcu

SEQ ID NO: 3468895 - RNA, 22 nt, Human
ccccauguuguaaugcugcacu

SEQ ID NO: 3468896 - RNA, 17 nt, Human
ccccauuagcuuucaau

SEQ ID NO: 3468897 - RNA, 16 nt, Human
ccccauucccgcagug

SEQ ID NO: 3468898 - RNA, 13 nt, Human
ccccauucucauc

SEQ ID NO: 3468899 - RNA, 16 nt, Human
ccccauucucaucugc

SEQ ID NO: 3468900 - RNA, 13 nt, Human
ccccauucugccu

SEQ ID NO: 3468901 - RNA, 16 nt, Human
ccccauuucccaucug

SEQ ID NO: 3468902 - RNA, 20 nt, Human
ccccauuucccaucugcacc

SEQ ID NO: 3468903 - RNA, 17 nt, Human
ccccauuucuauuuauu

SEQ ID NO: 3468904 - RNA, 20 nt, Human
ccccauuugcuuucuuuucu

SEQ ID NO: 3468905 - RNA, 19 nt, Human
cccccaaagauagacaggu

SEQ ID NO: 3468906 - RNA, 22 nt, Human
cccccaaauggaaaugggcaga

SEQ ID NO: 3468907 - RNA, 22 nt, Human
cccccaacacugugcccuggug

SEQ ID NO: 3468908 - RNA, 14 nt, Human
cccccaaccccagc

SEQ ID NO: 3468909 - RNA, 14 nt, Human
cccccaacccccca

SEQ ID NO: 3468910 - RNA, 15 nt, Human
cccccaaccuuuccc

SEQ ID NO: 3468911 - RNA, 21 nt, Human
cccccaacuugagauguauga

SEQ ID NO: 3468912 - RNA, 13 nt, Human
cccccaagccugc

SEQ ID NO: 3468913 - RNA, 14 nt, Human
cccccacacacaca

SEQ ID NO: 3468914 - RNA, 17 nt, Human
cccccacauccugugcc

SEQ ID NO: 3468915 - RNA, 13 nt, Human
cccccacccacuu

SEQ ID NO: 3468916 - RNA, 14 nt, Human
cccccacccccagc

SEQ ID NO: 3468917 - RNA, 15 nt, Human
cccccacccccagcu

SEQ ID NO: 3468918 - RNA, 17 nt, Human
cccccaccccuucccca

SEQ ID NO: 3468919 - RNA, 18 nt, Human
cccccaccgguccagcug

SEQ ID NO: 3468920 - RNA, 20 nt, Human
cccccaccgguccagcuggc

SEQ ID NO: 3468921 - RNA, 22 nt, Human
cccccaccucucccugacccug

SEQ ID NO: 3468922 - RNA, 22 nt, Human
cccccagaaaagaaagcuacag

SEQ ID NO: 3468923 - RNA, 12 nt, Human
cccccagauauc

SEQ ID NO: 3468924 - RNA, 16 nt, Human
cccccagcaacccucc

SEQ ID NO: 3468925 - RNA, 11 nt, Human
cccccagcacu

SEQ ID NO: 3468926 - RNA, 15 nt, Human
cccccagcacugagg

SEQ ID NO: 3468927 - RNA, 17 nt, Human
cccccagcacugaggaa

SEQ ID NO: 3468928 - RNA, 18 nt, Human
cccccagcacugaggaag

SEQ ID NO: 3468929 - RNA, 12 nt, Human
cccccagcacuu

SEQ ID NO: 3468930 - RNA, 21 nt, Human
cccccagccaugccagcuggc

SEQ ID NO: 3468931 - RNA, 23 nt, Human
cccccagccccgacuccagccag

SEQ ID NO: 3468932 - RNA, 15 nt, Human
cccccagccuaugag

SEQ ID NO: 3468933 - RNA, 23 nt, Human
cccccagccuaugagcauccuga

SEQ ID NO: 3468934 - RNA, 15 nt, Human
cccccagccucuggc

SEQ ID NO: 3468935 - RNA, 11 nt, Human
cccccagccug

SEQ ID NO: 3468936 - RNA, 12 nt, Human
cccccagccugg

SEQ ID NO: 3468937 - RNA, 18 nt, Human
cccccagcuaagaaccug

SEQ ID NO: 3468938 - RNA, 21 nt, Human
cccccagcuaagaaccuggaa

SEQ ID NO: 3468939 - RNA, 14 nt, Human
cccccagcucaggg

SEQ ID NO: 3468940 - RNA, 21 nt, Human
cccccagcucaggggcagcuc

SEQ ID NO: 3468941 - RNA, 15 nt, Human
cccccagcucccacc

SEQ ID NO: 3468942 - RNA, 11 nt, Human
cccccagcugu

SEQ ID NO: 3468943 - RNA, 14 nt, Human
cccccagcuguggg

SEQ ID NO: 3468944 - RNA, 18 nt, Human
cccccagcuuccagcagg

SEQ ID NO: 3468945 - RNA, 12 nt, Human
cccccaggacug

SEQ ID NO: 3468946 - RNA, 20 nt, Human
cccccaggggaaagaugagc

SEQ ID NO: 3468947 - RNA, 22 nt, Human
cccccaguccccaccccugccc

SEQ ID NO: 3468948 - RNA, 11 nt, Human
cccccagugug

SEQ ID NO: 3468949 - RNA, 23 nt, Human
cccccauccccauccuccagcuu

SEQ ID NO: 3468950 - RNA, 16 nt, Human
cccccaucucuucugg

SEQ ID NO: 3468951 - RNA, 14 nt, Human
cccccaugcacugu

SEQ ID NO: 3468952 - RNA, 13 nt, Human
ccccccacucugu

SEQ ID NO: 3468953 - RNA, 21 nt, Human
ccccccagauaucaucuaccu

SEQ ID NO: 3468954 - RNA, 13 nt, Human
ccccccagcacug

SEQ ID NO: 3468955 - RNA, 13 nt, Human
cccccccaugcag

SEQ ID NO: 3468956 - RNA, 11 nt, Human
ccccccccucc

SEQ ID NO: 3468957 - RNA, 21 nt, Human
cccccgcgcgcgucccccugc

SEQ ID NO: 3468958 - RNA, 21 nt, Human
cccccgcugucagccauuccu

SEQ ID NO: 3468959 - RNA, 14 nt, Human
cccccggcccccug

SEQ ID NO: 3468960 - RNA, 15 nt, Human
cccccggcccccugg

SEQ ID NO: 3468961 - RNA, 15 nt, Human
cccccgggaggggcc

SEQ ID NO: 3468962 - RNA, 23 nt, Human
cccccgggccgacggagccggga

SEQ ID NO: 3468963 - RNA, 16 nt, Human
cccccuauccuuggca

SEQ ID NO: 3468964 - RNA, 19 nt, Human
cccccucaggacccucgcu

SEQ ID NO: 3468965 - RNA, 22 nt, Human
cccccucaggacccucgcuggc

SEQ ID NO: 3468966 - RNA, 18 nt, Human
cccccuccaauccugccc

SEQ ID NO: 3468967 - RNA, 12 nt, Human
cccccucccacc

SEQ ID NO: 3468968 - RNA, 14 nt, Human
cccccucccagagg

SEQ ID NO: 3468969 - RNA, 12 nt, Human
cccccucccucc

SEQ ID NO: 3468970 - RNA, 14 nt, Human
cccccucccuggcc

SEQ ID NO: 3468971 - RNA, 12 nt, Human
cccccuccuucc

SEQ ID NO: 3468972 - RNA, 18 nt, Human
cccccuccuucccagcug

SEQ ID NO: 3468973 - RNA, 21 nt, Human
cccccuccuucccagcugccc

SEQ ID NO: 3468974 - RNA, 15 nt, Human
cccccuccuugcucu

SEQ ID NO: 3468975 - RNA, 13 nt, Human
cccccucgugcca

SEQ ID NO: 3468976 - RNA, 14 nt, Human
cccccucucccugc

SEQ ID NO: 3468977 - RNA, 17 nt, Human
cccccucucccugcaug

SEQ ID NO: 3468978 - RNA, 19 nt, Human
cccccucucccugcauggc

SEQ ID NO: 3468979 - RNA, 22 nt, Human
cccccugagauccccugagccc

SEQ ID NO: 3468980 - RNA, 18 nt, Human
cccccugcaaagcccagc

SEQ ID NO: 3468981 - RNA, 17 nt, Human
ccccucgugccagucgc

SEQ ID NO: 3468982 - RNA, 17 nt, Human
ccccucucaggagccau

SEQ ID NO: 3468983 - RNA, 13 nt, Human
ccccucucccuuc

SEQ ID NO: 3468984 - RNA, 12 nt, Human
ccccucucuggg

SEQ ID NO: 3468985 - RNA, 18 nt, Human
ccccucugaccugcacug

SEQ ID NO: 3468986 - RNA, 22 nt, Human
ccccucugcccagcuugggccc

SEQ ID NO: 3468987 - RNA, 14 nt, Human
ccccucugcuggcc

SEQ ID NO: 3468988 - RNA, 20 nt, Human
ccccucuggucgcuccugcc

SEQ ID NO: 3468989 - RNA, 14 nt, Human
ccccucuguccagg

SEQ ID NO: 3468990 - RNA, 22 nt, Human
ccccucuguccaggcacugaga

SEQ ID NO: 3468991 - RNA, 12 nt, Human
ccccucugucuu

SEQ ID NO: 3468992 - RNA, 14 nt, Human
ccccucuucccugg

SEQ ID NO: 3468993 - RNA, 12 nt, Human
ccccucuuccuc

SEQ ID NO: 3468994 - RNA, 13 nt, Human
ccccucuuccucu

SEQ ID NO: 3468995 - RNA, 13 nt, Human
ccccucuugcccc

SEQ ID NO: 3468996 - RNA, 15 nt, Human
ccccucuugccccaa

SEQ ID NO: 3468997 - RNA, 22 nt, Human
ccccucuugccccaacccccag

SEQ ID NO: 3468998 - RNA, 22 nt, Human
ccccucuuggagaagucucagc

SEQ ID NO: 3468999 - RNA, 13 nt, Human
ccccucuuucucu

SEQ ID NO: 3469000 - RNA, 16 nt, Human
ccccugacagggccag

SEQ ID NO: 3469001 - RNA, 16 nt, Human
ccccugaccacucaga

SEQ ID NO: 3469002 - RNA, 22 nt, Human
ccccugaccacucagagacaug

SEQ ID NO: 3469003 - RNA, 12 nt, Human
ccccugaccuca

SEQ ID NO: 3469004 - RNA, 18 nt, Human
ccccugaccucacuguga

SEQ ID NO: 3469005 - RNA, 17 nt, Human
ccccugagauccccuga

SEQ ID NO: 3469006 - RNA, 21 nt, Human
ccccugagcaaugucugugcu

SEQ ID NO: 3469007 - RNA, 14 nt, Human
ccccugagcccacu

SEQ ID NO: 3469008 - RNA, 15 nt, Human
ccccugagcccacug

SEQ ID NO: 3469009 - RNA, 12 nt, Human
ccccugauuaca

SEQ ID NO: 3469010 - RNA, 15 nt, Human
ccccugcaaagccca

SEQ ID NO: 3469011 - RNA, 17 nt, Human
ccccugcaaagcccagc

SEQ ID NO: 3469012 - RNA, 18 nt, Human
ccccugcaaagcccagcu

SEQ ID NO: 3469013 - RNA, 16 nt, Human
ccccugcacagcaggc

SEQ ID NO: 3469014 - RNA, 22 nt, Human
ccccugcacagcaggcugccag

SEQ ID NO: 3469015 - RNA, 22 nt, Human
ccccugcacuggaguccagucu

SEQ ID NO: 3469016 - RNA, 14 nt, Human
ccccugcagcacgg

SEQ ID NO: 3469017 - RNA, 16 nt, Human
ccccugcagcacggac

SEQ ID NO: 3469018 - RNA, 22 nt, Human
ccccugcagcacggacaauaaa

SEQ ID NO: 3469019 - RNA, 14 nt, Human
ccccugcagcccug

SEQ ID NO: 3469020 - RNA, 18 nt, Human
ccccugcaggaaggagcu

SEQ ID NO: 3469021 - RNA, 22 nt, Human
ccccugcauuggaacuggaggc

SEQ ID NO: 3469022 - RNA, 20 nt, Human
ccccugccaccaggccaccu

SEQ ID NO: 3469023 - RNA, 14 nt, Human
ccccugccacccug

SEQ ID NO: 3469024 - RNA, 16 nt, Human
ccccugccacccuggg

SEQ ID NO: 3469025 - RNA, 21 nt, Human
ccccugccaccucccugaccc

SEQ ID NO: 3469026 - RNA, 15 nt, Human
ccccugccagggcag

SEQ ID NO: 3469027 - RNA, 16 nt, Human
ccccugccccagccca

SEQ ID NO: 3469028 - RNA, 11 nt, Human
ccccugccccc

SEQ ID NO: 3469029 - RNA, 18 nt, Human
ccccugcccccaggacug

SEQ ID NO: 3469030 - RNA, 15 nt, Human
ccccugcccccugca

SEQ ID NO: 3469031 - RNA, 23 nt, Human
ccccugccccuucuacacucucc

SEQ ID NO: 3469032 - RNA, 14 nt, Human
ccccugcccucgug

SEQ ID NO: 3469033 - RNA, 13 nt, Human
ccccugcccugcu

SEQ ID NO: 3469034 - RNA, 14 nt, Human
ccccugcccugcug

SEQ ID NO: 3469035 - RNA, 15 nt, Human
ccccugcccugcugc

SEQ ID NO: 3469036 - RNA, 13 nt, Human
ccccugcccuggg

SEQ ID NO: 3469037 - RNA, 13 nt, Human
ccccugcccuggu

SEQ ID NO: 3469038 - RNA, 17 nt, Human
ccccugcccugguccag

SEQ ID NO: 3469039 - RNA, 12 nt, Human
ccccugcccugu

SEQ ID NO: 3469040 - RNA, 11 nt, Human
ccccugccucc

SEQ ID NO: 3469041 - RNA, 12 nt, Human
ccccugccucca

SEQ ID NO: 3469042 - RNA, 18 nt, Human
ccccugccuccacccucu

SEQ ID NO: 3469043 - RNA, 22 nt, Human
ccccugccuccacccucugagc

SEQ ID NO: 3469044 - RNA, 10 nt, Human
ccccugccug

SEQ ID NO: 3469045 - RNA, 19 nt, Human
ccccugccugcccugucag

SEQ ID NO: 3469046 - RNA, 15 nt, Human
ccccugccuuuggga

SEQ ID NO: 3469047 - RNA, 19 nt, Human
ccccugcugcaggggcucu

SEQ ID NO: 3469048 - RNA, 14 nt, Human
ccccugcugccucc

SEQ ID NO: 3469049 - RNA, 20 nt, Human
ccccugcugccuccccaacc

SEQ ID NO: 3469050 - RNA, 14 nt, Human
ccccugcugcuguc

SEQ ID NO: 3469051 - RNA, 15 nt, Human
ccccugcugguucag

SEQ ID NO: 3469052 - RNA, 14 nt, Human
ccccugcuuugggc

SEQ ID NO: 3469053 - RNA, 22 nt, Human
ccccugcuuugggcuugggccu

SEQ ID NO: 3469054 - RNA, 17 nt, Human
ccccuggaagagcccag

SEQ ID NO: 3469055 - RNA, 22 nt, Human
ccccuggaagagcccagucugu

SEQ ID NO: 3469056 - RNA, 19 nt, Human
ccccuggaagcagugccca

SEQ ID NO: 3469057 - RNA, 23 nt, Human
ccccuggaagcagugcccaggug

SEQ ID NO: 3469058 - RNA, 14 nt, Human
ccccuggaccccag

SEQ ID NO: 3469059 - RNA, 15 nt, Human
ccccuggacugggag

SEQ ID NO: 3469060 - RNA, 22 nt, Human
ccccuggcagagaugccucccu

SEQ ID NO: 3469061 - RNA, 13 nt, Human
ccccuggcccagc

SEQ ID NO: 3469062 - RNA, 16 nt, Human
ccccuggcccagcggc

SEQ ID NO: 3469063 - RNA, 17 nt, Human
ccccuggcccagcggcc

SEQ ID NO: 3469064 - RNA, 16 nt, Human
ccccuggccgcgcucc

SEQ ID NO: 3469065 - RNA, 12 nt, Human
ccccuggccucc

SEQ ID NO: 3469066 - RNA, 14 nt, Human
ccccuggccucugu

SEQ ID NO: 3469067 - RNA, 22 nt, Human
ccccuggcugggacguggcuca

SEQ ID NO: 3469068 - RNA, 13 nt, Human
ccccugggcucug

SEQ ID NO: 3469069 - RNA, 23 nt, Human
ccccugggcucugccccagcucu

SEQ ID NO: 3469070 - RNA, 23 nt, Human
ccccugggcuuggccugcuguga

SEQ ID NO: 3469071 - RNA, 15 nt, Human
ccccuggggacccac

SEQ ID NO: 3469072 - RNA, 11 nt, Human
ccccuggggcc

SEQ ID NO: 3469073 - RNA, 19 nt, Human
ccccuggggcuucuccuga

SEQ ID NO: 3469074 - RNA, 19 nt, Human
ccccugggggcucucaugu

SEQ ID NO: 3469075 - RNA, 13 nt, Human
ccccugggguggc

SEQ ID NO: 3469076 - RNA, 20 nt, Human
ccccugggucagucuggugg

SEQ ID NO: 3469077 - RNA, 21 nt, Human
ccccuggguggguggugggga

SEQ ID NO: 3469078 - RNA, 15 nt, Human
ccccuggucucuggu

SEQ ID NO: 3469079 - RNA, 23 nt, Human
ccccuggugguucacucuuggag

SEQ ID NO: 3469080 - RNA, 15 nt, Human
ccccugguucucauc

SEQ ID NO: 3469081 - RNA, 17 nt, Human
ccccuguccccucagcu

SEQ ID NO: 3469082 - RNA, 20 nt, Human
ccccuguccccucagcucca

SEQ ID NO: 3469083 - RNA, 13 nt, Human
ccccuguccucac

SEQ ID NO: 3469084 - RNA, 16 nt, Human
ccccuguccucacugc

SEQ ID NO: 3469085 - RNA, 11 nt, Human
ccccugugcuc

SEQ ID NO: 3469086 - RNA, 19 nt, Human
ccccuguggaugcugcugc

SEQ ID NO: 3469087 - RNA, 20 nt, Human
ccccuguggaugcugcugcc

SEQ ID NO: 3469088 - RNA, 11 nt, Human
ccccuguucua

SEQ ID NO: 3469089 - RNA, 19 nt, Human
ccccuguuucaaucacugu

SEQ ID NO: 3469090 - RNA, 17 nt, Human
ccccuuauccucccugu

SEQ ID NO: 3469091 - RNA, 17 nt, Human
ccccuucacuucugacc

SEQ ID NO: 3469092 - RNA, 14 nt, Human
ccccuuccacugag

SEQ ID NO: 3469093 - RNA, 16 nt, Human
ccccuuccaucccaga

SEQ ID NO: 3469094 - RNA, 13 nt, Human
ccccuuccaugga

SEQ ID NO: 3469095 - RNA, 17 nt, Human
ccccuuccauuucugcc

SEQ ID NO: 3469096 - RNA, 18 nt, Human
ccccuucccgugaccugg

SEQ ID NO: 3469097 - RNA, 18 nt, Human
ccccuucccugcaaacau

SEQ ID NO: 3469098 - RNA, 17 nt, Human
ccccuuccuacucccag

SEQ ID NO: 3469099 - RNA, 12 nt, Human
ccccuuccuguc

SEQ ID NO: 3469100 - RNA, 19 nt, Human
ccccuuccuguguccaugu

SEQ ID NO: 3469101 - RNA, 20 nt, Human
ccccuuccuugcucugcacc

SEQ ID NO: 3469102 - RNA, 14 nt, Human
ccccuucgcuccug

SEQ ID NO: 3469103 - RNA, 19 nt, Human
ccccuucuacacucuccug

SEQ ID NO: 3469104 - RNA, 22 nt, Human
ccccuucuacacucuccugggc

SEQ ID NO: 3469105 - RNA, 21 nt, Human
ccccuucuacauuucuuagac

SEQ ID NO: 3469106 - RNA, 16 nt, Human
ccccuucucagaaucu

SEQ ID NO: 3469107 - RNA, 12 nt, Human
ccccuucuccca

SEQ ID NO: 3469108 - RNA, 16 nt, Human
ccccuucucccacacu

SEQ ID NO: 3469109 - RNA, 16 nt, Human
ccccuucucucccugc

SEQ ID NO: 3469110 - RNA, 19 nt, Human
ccccuucucuccuccccaa

SEQ ID NO: 3469111 - RNA, 14 nt, Human
ccccuucucugcuc

SEQ ID NO: 3469112 - RNA, 13 nt, Human
ccccuucucugug

SEQ ID NO: 3469113 - RNA, 15 nt, Human
ccccuucucugugac

SEQ ID NO: 3469114 - RNA, 18 nt, Human
ccccuugacaacuggcag

SEQ ID NO: 3469115 - RNA, 21 nt, Human
ccccuugauuuaaacacacag

SEQ ID NO: 3469116 - RNA, 14 nt, Human
ccccuugccacccc

SEQ ID NO: 3469117 - RNA, 12 nt, Human
ccccuugccagc

SEQ ID NO: 3469118 - RNA, 14 nt, Human
ccccuugccagcug

SEQ ID NO: 3469119 - RNA, 21 nt, Human
ccccuugccagcugcugagcc

SEQ ID NO: 3469120 - RNA, 18 nt, Human
ccccuugcccuugcccug

SEQ ID NO: 3469121 - RNA, 19 nt, Human
ccccuugcccuugcccuga

SEQ ID NO: 3469122 - RNA, 11 nt, Human
ccccuugccug

SEQ ID NO: 3469123 - RNA, 22 nt, Human
ccccuugcucuccccugcccug

SEQ ID NO: 3469124 - RNA, 17 nt, Human
ccccuuggcagguccug

SEQ ID NO: 3469125 - RNA, 16 nt, Human
ccccuugggcccacac

SEQ ID NO: 3469126 - RNA, 15 nt, Human
ccccuugggcggcug

SEQ ID NO: 3469127 - RNA, 20 nt, Human
ccccuuguuugucccuucua

SEQ ID NO: 3469128 - RNA, 15 nt, Human
ccggaugugcuuuuc

SEQ ID NO: 3469129 - RNA, 16 nt, Human
ccggauuggcuugugu

SEQ ID NO: 3469130 - RNA, 22 nt, Human
ccggauuggcuuguguguuuca

SEQ ID NO: 3469131 - RNA, 21 nt, Human
ccggcaaccccaguucugcuc

SEQ ID NO: 3469132 - RNA, 23 nt, Human
ccggcaaccccaguucugcuccu

SEQ ID NO: 3469133 - RNA, 16 nt, Human
ccggcaauaaaagccc

SEQ ID NO: 3469134 - RNA, 17 nt, Human
ccggcaauaaaagccca

SEQ ID NO: 3469135 - RNA, 18 nt, Human
ccggcaauaaaagcccag

SEQ ID NO: 3469136 - RNA, 19 nt, Human
ccggcaauaaaagcccagg

SEQ ID NO: 3469137 - RNA, 19 nt, Human
ccggcacagggucugcucu

SEQ ID NO: 3469138 - RNA, 17 nt, Human
ccggcacccccugcagc

SEQ ID NO: 3469139 - RNA, 19 nt, Human
ccggcacccccugcagcuu

SEQ ID NO: 3469140 - RNA, 21 nt, Human
ccggcacccccugcagcuugu

SEQ ID NO: 3469141 - RNA, 17 nt, Human
ccggcagccccagccug

SEQ ID NO: 3469142 - RNA, 11 nt, Human
ccggcaggccc

SEQ ID NO: 3469143 - RNA, 14 nt, Human
ccggcaggcccugc

SEQ ID NO: 3469144 - RNA, 17 nt, Human
ccggcaggcccugcagu

SEQ ID NO: 3469145 - RNA, 11 nt, Human
ccggcagggcg

SEQ ID NO: 3469146 - RNA, 17 nt, Human
ccggcaguucugggugc

SEQ ID NO: 3469147 - RNA, 22 nt, Human
ccggcaguucugggugcucccu

SEQ ID NO: 3469148 - RNA, 13 nt, Human
ccggcauggacaa

SEQ ID NO: 3469149 - RNA, 22 nt, Human
ccggcauggacaauggaccgga

SEQ ID NO: 3469150 - RNA, 18 nt, Human
ccggcauguuuccagcag

SEQ ID NO: 3469151 - RNA, 18 nt, Human
ccggccaauggaaaccuc

SEQ ID NO: 3469152 - RNA, 20 nt, Human
ccggccacccaggaggcagg

SEQ ID NO: 3469153 - RNA, 14 nt, Human
ccggccagccagcc

SEQ ID NO: 3469154 - RNA, 17 nt, Human
ccggccagccagccacu

SEQ ID NO: 3469155 - RNA, 18 nt, Human
ccggccagccagccacuc

SEQ ID NO: 3469156 - RNA, 19 nt, Human
ccggccaggugccuccuga

SEQ ID NO: 3469157 - RNA, 14 nt, Human
ccggccaguggcgg

SEQ ID NO: 3469158 - RNA, 15 nt, Human
ccggccccagccaga

SEQ ID NO: 3469159 - RNA, 14 nt, Human
ccggcccccugccc

SEQ ID NO: 3469160 - RNA, 12 nt, Human
ccggcccugggg

SEQ ID NO: 3469161 - RNA, 14 nt, Human
ccggcccugugugc

SEQ ID NO: 3469162 - RNA, 16 nt, Human
ccggccucucuggccu

SEQ ID NO: 3469163 - RNA, 16 nt, Human
ccggccugccaggagg

SEQ ID NO: 3469164 - RNA, 16 nt, Human
ccggccugcucccagc

SEQ ID NO: 3469165 - RNA, 15 nt, Human
ccggcgagcccugug

SEQ ID NO: 3469166 - RNA, 16 nt, Human
ccggcgucagccucca

SEQ ID NO: 3469167 - RNA, 16 nt, Human
ccggcuaagcaggcgc

SEQ ID NO: 3469168 - RNA, 22 nt, Human
ccggcuaugggggcacugagga

SEQ ID NO: 3469169 - RNA, 13 nt, Human
ccggcuccaggcu

SEQ ID NO: 3469170 - RNA, 14 nt, Human
ccggcuccaggcuc

SEQ ID NO: 3469171 - RNA, 15 nt, Human
ccggcuccaggcucc

SEQ ID NO: 3469172 - RNA, 21 nt, Human
ccggcuccaggcuccuuuagc

SEQ ID NO: 3469173 - RNA, 18 nt, Human
ccggcucccuucuacagc

SEQ ID NO: 3469174 - RNA, 12 nt, Human
ccggcuggaaau

SEQ ID NO: 3469175 - RNA, 17 nt, Human
ccggcuuuguggcacug

SEQ ID NO: 3469176 - RNA, 22 nt, Human
ccgggaaagaagagccggagcc

SEQ ID NO: 3469177 - RNA, 17 nt, Human
ccgggaaccaagcagga

SEQ ID NO: 3469178 - RNA, 15 nt, Human
ccgggaagccacccu

SEQ ID NO: 3469179 - RNA, 20 nt, Human
ccgggacaccuaggcuaggg

SEQ ID NO: 3469180 - RNA, 13 nt, Human
ccgggacccccag

SEQ ID NO: 3469181 - RNA, 17 nt, Human
ccgggaccccgagccug

SEQ ID NO: 3469182 - RNA, 19 nt, Human
ccgggacguggcaccuccu

SEQ ID NO: 3469183 - RNA, 13 nt, Human
ccgggacucacug

SEQ ID NO: 3469184 - RNA, 23 nt, Human
ccgggacucacuggcagccccag

SEQ ID NO: 3469185 - RNA, 17 nt, Human
ccgggagccuaggacca

SEQ ID NO: 3469186 - RNA, 18 nt, Human
ccgggagccuaggaccac

SEQ ID NO: 3469187 - RNA, 23 nt, Human
ccgggagccugaucaccugcccu

SEQ ID NO: 3469188 - RNA, 15 nt, Human
ccgggagcucaggaa

SEQ ID NO: 3469189 - RNA, 22 nt, Human
ccgggaggggcccgcuugccuc

SEQ ID NO: 3469190 - RNA, 19 nt, Human
ccgggauauauauucucuc

SEQ ID NO: 3469191 - RNA, 17 nt, Human
ccgggcaaacuggccgc

SEQ ID NO: 3469192 - RNA, 17 nt, Human
ccgggcaaaugccaggg

SEQ ID NO: 3469193 - RNA, 21 nt, Human
ccgggcaaaugccagggcccg

SEQ ID NO: 3469194 - RNA, 15 nt, Human
ccgggcacucagaag

SEQ ID NO: 3469195 - RNA, 15 nt, Human
ccgggcagggugugg

SEQ ID NO: 3469196 - RNA, 22 nt, Human
ccgggcaugguggcgcaagccu

SEQ ID NO: 3469197 - RNA, 13 nt, Human
ccgggccagggcu

SEQ ID NO: 3469198 - RNA, 21 nt, Human
ccgggccccugggcuuggccu

SEQ ID NO: 3469199 - RNA, 23 nt, Human
ccgggccccugggcuuggccugc

SEQ ID NO: 3469200 - RNA, 14 nt, Human
ccgggcccucccuu

SEQ ID NO: 3469201 - RNA, 13 nt, Human
ccgggccuggggc

SEQ ID NO: 3469202 - RNA, 19 nt, Human
ccgggcgcggccagccccg

SEQ ID NO: 3469203 - RNA, 20 nt, Human
ccgggcuacccgugagcccu

SEQ ID NO: 3469204 - RNA, 15 nt, Human
ccgggcucugccucc

SEQ ID NO: 3469205 - RNA, 16 nt, Human
ccgggcugagggccug

SEQ ID NO: 3469206 - RNA, 15 nt, Human
ccgggcugccugggc

SEQ ID NO: 3469207 - RNA, 16 nt, Human
ccgggcugccugggcu

SEQ ID NO: 3469208 - RNA, 19 nt, Human
ccgggcugggagcucugca

SEQ ID NO: 3469209 - RNA, 17 nt, Human
ccggggcagcagcagcc

SEQ ID NO: 3469210 - RNA, 18 nt, Human
ccggggcagcagcagccc

SEQ ID NO: 3469211 - RNA, 14 nt, Human
ccggggcagccccc

SEQ ID NO: 3469212 - RNA, 18 nt, Human
ccggggcagcugccagag

SEQ ID NO: 3469213 - RNA, 19 nt, Human
ccggggcagcugccagaga

SEQ ID NO: 3469214 - RNA, 16 nt, Human
ccggggccagcaccac

SEQ ID NO: 3469215 - RNA, 12 nt, Human
ccggggcccagg

SEQ ID NO: 3469216 - RNA, 13 nt, Human
ccggggcccaggg

SEQ ID NO: 3469217 - RNA, 19 nt, Human
ccggggccugggcaggagg

SEQ ID NO: 3469218 - RNA, 22 nt, Human
ccgggggcagcucuggaggggg

SEQ ID NO: 3469219 - RNA, 21 nt, Human
ccgggggcagucugagagagg

SEQ ID NO: 3469220 - RNA, 22 nt, Human
ccggggugagggggggcucccu

SEQ ID NO: 3469221 - RNA, 21 nt, Human
ccgggguggccacagcgccag

SEQ ID NO: 3469222 - RNA, 20 nt, Human
ccggggugggguggcugcag

SEQ ID NO: 3469223 - RNA, 15 nt, Human
ccggguccgcggggc

SEQ ID NO: 3469224 - RNA, 17 nt, Human
ccggguucuagucuccu

SEQ ID NO: 3469225 - RNA, 22 nt, Human
ccgguaaacacgccugcaaacg

SEQ ID NO: 3469226 - RNA, 16 nt, Human
ccgguaacuguccugu

SEQ ID NO: 3469227 - RNA, 16 nt, Human
ccgguagggaggcagc

SEQ ID NO: 3469228 - RNA, 15 nt, Human
ccggucaggcacaca

SEQ ID NO: 3469229 - RNA, 14 nt, Human
ccgguccagcuggc

SEQ ID NO: 3469230 - RNA, 17 nt, Human
ccggucugcaagucaga

SEQ ID NO: 3469231 - RNA, 19 nt, Human
ccggucugcaagucagagg

SEQ ID NO: 3469232 - RNA, 20 nt, Human
ccgguggcggccccagcacc

SEQ ID NO: 3469233 - RNA, 17 nt, Human
ccggugugggggccccg

SEQ ID NO: 3469234 - RNA, 15 nt, Human
ccgguguucuaagau

SEQ ID NO: 3469235 - RNA, 15 nt, Human
ccgguugcuucuggg

SEQ ID NO: 3469236 - RNA, 17 nt, Human
ccgguugcuucugggaa

SEQ ID NO: 3469237 - RNA, 20 nt, Human
ccguaaaaacugaaguucug

SEQ ID NO: 3469238 - RNA, 14 nt, Human
ccguaauuuaacuu

SEQ ID NO: 3469239 - RNA, 14 nt, Human
ccguaccccacccu

SEQ ID NO: 3469240 - RNA, 20 nt, Human
ccguaccccacccucagcac

SEQ ID NO: 3469241 - RNA, 24 nt, Human
ccguagacgugcacgcacacuguc

SEQ ID NO: 3469242 - RNA, 22 nt, Human
ccguaucuccggcucccagccu

SEQ ID NO: 3469243 - RNA, 17 nt, Human
ccgucaccccuguuucu

SEQ ID NO: 3469244 - RNA, 14 nt, Human
ccgucagggcccaa

SEQ ID NO: 3469245 - RNA, 16 nt, Human
ccgucagggcccaagu

SEQ ID NO: 3469246 - RNA, 15 nt, Human
ccgucauguuccuca

SEQ ID NO: 3469247 - RNA, 22 nt, Human
ccguccagccgccauugccacc

SEQ ID NO: 3469248 - RNA, 18 nt, Human
ccguccaggagccugugc

SEQ ID NO: 3469249 - RNA, 11 nt, Human
ccguccccucc

SEQ ID NO: 3469250 - RNA, 14 nt, Human
ccguccccucccag

SEQ ID NO: 3469251 - RNA, 13 nt, Human
ccguccugccugu

SEQ ID NO: 3469252 - RNA, 22 nt, Human
ccgucuacagcucccccagcuc

SEQ ID NO: 3469253 - RNA, 14 nt, Human
ccgucuaccugagg

SEQ ID NO: 3469254 - RNA, 16 nt, Human
ccgucucaugaggggc

SEQ ID NO: 3469255 - RNA, 18 nt, Human
ccgucucugguuccuccc

SEQ ID NO: 3469256 - RNA, 17 nt, Human
ccgucuggcccaccagg

SEQ ID NO: 3469257 - RNA, 20 nt, Human
ccgucugggguucagccccu

SEQ ID NO: 3469258 - RNA, 15 nt, Human
ccgucuguccaucug

SEQ ID NO: 3469259 - RNA, 16 nt, Human
ccgucuguccaucugc

SEQ ID NO: 3469260 - RNA, 23 nt, Human
ccgucugugugugaccccuccug

SEQ ID NO: 3469261 - RNA, 14 nt, Human
ccgucuucagccua

SEQ ID NO: 3469262 - RNA, 13 nt, Human
ccgucuuccucca

SEQ ID NO: 3469263 - RNA, 16 nt, Human
ccgucuuuuccuguuu

SEQ ID NO: 3469264 - RNA, 22 nt, Human
ccgugacagacuccugaggaca

SEQ ID NO: 3469265 - RNA, 14 nt, Human
ccgugacgucuggg

SEQ ID NO: 3469266 - RNA, 19 nt, Human
ccgugagcaggaaggccug

SEQ ID NO: 3469267 - RNA, 20 nt, Human
ccgugagcaggaaggccugg

SEQ ID NO: 3469268 - RNA, 15 nt, Human
ccgugagcauguuug

SEQ ID NO: 3469269 - RNA, 21 nt, Human
ccgugagcgccugugcacaca

SEQ ID NO: 3469270 - RNA, 22 nt, Human
ccgugagcgccugugcacacac

SEQ ID NO: 3469271 - RNA, 12 nt, Human
ccgugaggccag

SEQ ID NO: 3469272 - RNA, 17 nt, Human
ccgugaguucucagggc

SEQ ID NO: 3469273 - RNA, 15 nt, Human
ccuacacaggacagg

SEQ ID NO: 3469274 - RNA, 17 nt, Human
ccuacacccuuggacuu

SEQ ID NO: 3469275 - RNA, 20 nt, Human
ccuacacccuuggacuugag

SEQ ID NO: 3469276 - RNA, 18 nt, Human
ccuacacucaccugcacu

SEQ ID NO: 3469277 - RNA, 14 nt, Human
ccuacagaaaaacc

SEQ ID NO: 3469278 - RNA, 19 nt, Human
ccuacagaaaaaccuuggg

SEQ ID NO: 3469279 - RNA, 20 nt, Human
ccuacagaacuucagaaaga

SEQ ID NO: 3469280 - RNA, 15 nt, Human
ccuacagaggucucu

SEQ ID NO: 3469281 - RNA, 16 nt, Human
ccuacagauagucaaa

SEQ ID NO: 3469282 - RNA, 14 nt, Human
ccuacagccccuuu

SEQ ID NO: 3469283 - RNA, 21 nt, Human
ccuacagcuuugaucccugac

SEQ ID NO: 3469284 - RNA, 21 nt, Human
ccuacaggcagucucucucuu

SEQ ID NO: 3469285 - RNA, 15 nt, Human
ccuacaguggcuguc

SEQ ID NO: 3469286 - RNA, 21 nt, Human
ccuacaguugaaaaacagcug

SEQ ID NO: 3469287 - RNA, 22 nt, Human
ccuacaguugaaaaacagcuga

SEQ ID NO: 3469288 - RNA, 22 nt, Human
ccuacaguuggaaauccaucca

SEQ ID NO: 3469289 - RNA, 17 nt, Human
ccuacaguuuuaacugu

SEQ ID NO: 3469290 - RNA, 21 nt, Human
ccuacaguuuuaacuguggau

SEQ ID NO: 3469291 - RNA, 14 nt, Human
ccuacauguuauuc

SEQ ID NO: 3469292 - RNA, 23 nt, Human
ccuaccaauagauuccccauugc

SEQ ID NO: 3469293 - RNA, 13 nt, Human
ccuaccaaugcau

SEQ ID NO: 3469294 - RNA, 14 nt, Human
ccuaccacaugcca

SEQ ID NO: 3469295 - RNA, 13 nt, Human
ccuaccaccccuu

SEQ ID NO: 3469296 - RNA, 13 nt, Human
ccuaccaccuccc

SEQ ID NO: 3469297 - RNA, 20 nt, Human
ccuaccagcgcccgcugggc

SEQ ID NO: 3469298 - RNA, 21 nt, Human
ccuaccagcgcccgcugggcu

SEQ ID NO: 3469299 - RNA, 16 nt, Human
ccuaccaucagggaca

SEQ ID NO: 3469300 - RNA, 15 nt, Human
ccuacccaaccacuc

SEQ ID NO: 3469301 - RNA, 18 nt, Human
ccuacccacaccucugcc

SEQ ID NO: 3469302 - RNA, 18 nt, Human
ccuacccacccuccuuuc

SEQ ID NO: 3469303 - RNA, 13 nt, Human
ccuaccccacacc

SEQ ID NO: 3469304 - RNA, 18 nt, Human
ccuaccccacaccaggcc

SEQ ID NO: 3469305 - RNA, 23 nt, Human
ccuaccccacaccaggccguccu

SEQ ID NO: 3469306 - RNA, 14 nt, Human
ccuaccccaccacg

SEQ ID NO: 3469307 - RNA, 22 nt, Human
ccuaccccauggugcuaggaag

SEQ ID NO: 3469308 - RNA, 17 nt, Human
ccuacccccuccucucu

SEQ ID NO: 3469309 - RNA, 17 nt, Human
ccuaccccucccagcug

SEQ ID NO: 3469310 - RNA, 21 nt, Human
ccuaccccucccagcugacag

SEQ ID NO: 3469311 - RNA, 15 nt, Human
ccuacccuaaccaag

SEQ ID NO: 3469312 - RNA, 13 nt, Human
ccuacccucuaga

SEQ ID NO: 3469313 - RNA, 18 nt, Human
ccuaccucaaccuguaaa

SEQ ID NO: 3469314 - RNA, 14 nt, Human
ccuaccucagccua

SEQ ID NO: 3469315 - RNA, 13 nt, Human
ccuaccucagguu

SEQ ID NO: 3469316 - RNA, 13 nt, Human
ccuaccugcccca

SEQ ID NO: 3469317 - RNA, 15 nt, Human
ccuaccugcccugga

SEQ ID NO: 3469318 - RNA, 13 nt, Human
ccuaccugcucuc

SEQ ID NO: 3469319 - RNA, 16 nt, Human
ccuaccugcucuccaa

SEQ ID NO: 3469320 - RNA, 12 nt, Human
ccuaccugguaa

SEQ ID NO: 3469321 - RNA, 16 nt, Human
ccuaccuucaaagcug

SEQ ID NO: 3469322 - RNA, 19 nt, Human
ccuaccuucauuucaggag

SEQ ID NO: 3469323 - RNA, 16 nt, Human
ccuacgcgccuugucu

SEQ ID NO: 3469324 - RNA, 20 nt, Human
ccuacuacaucgcccuccac

SEQ ID NO: 3469325 - RNA, 17 nt, Human
ccuacuagggaccuggg

SEQ ID NO: 3469326 - RNA, 23 nt, Human
ccuacucaagcggguggcucugg

SEQ ID NO: 3469327 - RNA, 15 nt, Human
ccuacucacacaggc

SEQ ID NO: 3469328 - RNA, 16 nt, Human
ccuacucacacaggca

SEQ ID NO: 3469329 - RNA, 22 nt, Human
ccuacucacacaggcauuuccu

SEQ ID NO: 3469330 - RNA, 17 nt, Human
ccuacucauugggguuc

SEQ ID NO: 3469331 - RNA, 13 nt, Human
ccuacucccugca

SEQ ID NO: 3469332 - RNA, 20 nt, Human
ccuacuccugucuucugcuu

SEQ ID NO: 3469333 - RNA, 19 nt, Human
ccuacucuucucucugcuc

SEQ ID NO: 3469334 - RNA, 20 nt, Human
ccuacugcccaggcacugca

SEQ ID NO: 3469335 - RNA, 11 nt, Human
ccuacugcugu

SEQ ID NO: 3469336 - RNA, 12 nt, Human
ccuacugcugug

SEQ ID NO: 3469337 - RNA, 19 nt, Human
ccuacuguucuaaagcucu

SEQ ID NO: 3469338 - RNA, 16 nt, Human
ccuacuuccccuuccu

SEQ ID NO: 3469339 - RNA, 14 nt, Human
ccuacuucuccagc

SEQ ID NO: 3469340 - RNA, 23 nt, Human
ccuacuucuuugcuuugcccagc

SEQ ID NO: 3469341 - RNA, 16 nt, Human
ccuacuucuuuugcuc

SEQ ID NO: 3469342 - RNA, 13 nt, Human
ccuacuuucuuca

SEQ ID NO: 3469343 - RNA, 21 nt, Human
ccuacuuugacuuuuugcauu

SEQ ID NO: 3469344 - RNA, 18 nt, Human
ccuagaaacaacacugua

SEQ ID NO: 3469345 - RNA, 19 nt, Human
ccuagaaacaacacuguag

SEQ ID NO: 3469346 - RNA, 18 nt, Human
ccuagaaacccaagcucc

SEQ ID NO: 3469347 - RNA, 23 nt, Human
ccuagaaacccaagcuccuccuc

SEQ ID NO: 3469348 - RNA, 22 nt, Human
ccuagaaacguuuggaacaauc

SEQ ID NO: 3469349 - RNA, 23 nt, Human
ccuagaaguuacugaaugcacca

SEQ ID NO: 3469350 - RNA, 19 nt, Human
ccuagaauguuucauuugc

SEQ ID NO: 3469351 - RNA, 16 nt, Human
ccuagacccuccuccu

SEQ ID NO: 3469352 - RNA, 23 nt, Human
ccuagacucggggugcuuccuug

SEQ ID NO: 3469353 - RNA, 19 nt, Human
ccuagacuguaaaccucuc

SEQ ID NO: 3469354 - RNA, 19 nt, Human
ccuagagaacgcagcccua

SEQ ID NO: 3469355 - RNA, 20 nt, Human
ccuagagaacgcagcccuag

SEQ ID NO: 3469356 - RNA, 17 nt, Human
ccuagagaagacaggcu

SEQ ID NO: 3469357 - RNA, 19 nt, Human
ccuagagaagacaggcugg

SEQ ID NO: 3469358 - RNA, 22 nt, Human
ccuagagaagacaggcuggaag

SEQ ID NO: 3469359 - RNA, 15 nt, Human
ccuagagcacacugu

SEQ ID NO: 3469360 - RNA, 12 nt, Human
ccuagagccaga

SEQ ID NO: 3469361 - RNA, 13 nt, Human
ccuagagccagac

SEQ ID NO: 3469362 - RNA, 13 nt, Human
ccuagagccugcc

SEQ ID NO: 3469363 - RNA, 13 nt, Human
ccuagagggaggg

SEQ ID NO: 3469364 - RNA, 21 nt, Human
ccuagagucccagguuggcuc

SEQ ID NO: 3469365 - RNA, 18 nt, Human
ccuagcaagcuggccucu

SEQ ID NO: 3469366 - RNA, 15 nt, Human
ccuagcacagauggc

SEQ ID NO: 3469367 - RNA, 18 nt, Human
ccuagcacucacaugcug

SEQ ID NO: 3469368 - RNA, 23 nt, Human
ccuagcagcaccguucugugcac

SEQ ID NO: 3469369 - RNA, 22 nt, Human
ccuagcagcccacccugcugcu

SEQ ID NO: 3469370 - RNA, 23 nt, Human
ccuagcagcccacccugcugcug

SEQ ID NO: 3469371 - RNA, 21 nt, Human
ccuagcauacguacacauuuu

SEQ ID NO: 3469372 - RNA, 12 nt, Human
ccuagccaccca

SEQ ID NO: 3469373 - RNA, 16 nt, Human
ccuagccacccaccac

SEQ ID NO: 3469374 - RNA, 12 nt, Human
ccuagccagcug

SEQ ID NO: 3469375 - RNA, 20 nt, Human
ccuagcccacccugcugccu

SEQ ID NO: 3469376 - RNA, 20 nt, Human
ccuagcccagcgcucugccu

SEQ ID NO: 3469377 - RNA, 15 nt, Human
ccuagcccaggagag

SEQ ID NO: 3469378 - RNA, 20 nt, Human
ccuagcccaggagagagaaa

SEQ ID NO: 3469379 - RNA, 22 nt, Human
ccuagccccuuagcccccaccc

SEQ ID NO: 3469380 - RNA, 13 nt, Human
ccuagcccucuca

SEQ ID NO: 3469381 - RNA, 14 nt, Human
ccuagccgaccuca

SEQ ID NO: 3469382 - RNA, 17 nt, Human
ccuagccgaccucagcc

SEQ ID NO: 3469383 - RNA, 18 nt, Human
ccuagccgaccucagccu

SEQ ID NO: 3469384 - RNA, 19 nt, Human
ccuagccgaccucagccuu

SEQ ID NO: 3469385 - RNA, 21 nt, Human
ccuagccgguuccugucccug

SEQ ID NO: 3469386 - RNA, 23 nt, Human
ccuagccucacgcuccuuucuga

SEQ ID NO: 3469387 - RNA, 18 nt, Human
ccuagccuuauccucuga

SEQ ID NO: 3469388 - RNA, 17 nt, Human
ccuagcgaucucuccug

SEQ ID NO: 3469389 - RNA, 17 nt, Human
ccuagcgggauggggcu

SEQ ID NO: 3469390 - RNA, 20 nt, Human
ccuagcuccuccccuuccuc

SEQ ID NO: 3469391 - RNA, 21 nt, Human
ccuagcugaauguuuuucuaa

SEQ ID NO: 3469392 - RNA, 22 nt, Human
ccuagcugcacagggcagcugg

SEQ ID NO: 3469393 - RNA, 15 nt, Human
ccuagcugcugucac

SEQ ID NO: 3469394 - RNA, 12 nt, Human
ccuagcuggaga

SEQ ID NO: 3469395 - RNA, 20 nt, Human
ccuagcuggagaggagcccu

SEQ ID NO: 3469396 - RNA, 21 nt, Human
ccuagcuggagaggagcccug

SEQ ID NO: 3469397 - RNA, 14 nt, Human
ccuagcuggcucug

SEQ ID NO: 3469398 - RNA, 17 nt, Human
ccuagcuggcucuguga

SEQ ID NO: 3469399 - RNA, 20 nt, Human
ccuagcuguccuuuuuccuc

SEQ ID NO: 3469400 - RNA, 18 nt, Human
ccuagcuuuagacccugg

SEQ ID NO: 3469401 - RNA, 20 nt, Human
ccuagcuuuauauauggaca

SEQ ID NO: 3469402 - RNA, 13 nt, Human
ccuaggaagccuc

SEQ ID NO: 3469403 - RNA, 17 nt, Human
ccuaggaccacucagcc

SEQ ID NO: 3469404 - RNA, 23 nt, Human
ccuaggaccacucagccccuagg

SEQ ID NO: 3469405 - RNA, 18 nt, Human
ccuaggacccgucuccag

SEQ ID NO: 3469406 - RNA, 20 nt, Human
ccuaggacccgucuccagcu

SEQ ID NO: 3469407 - RNA, 19 nt, Human
ccuaggagauaucugaggg

SEQ ID NO: 3469408 - RNA, 22 nt, Human
ccuaggagauaucugagggagg

SEQ ID NO: 3469409 - RNA, 20 nt, Human
ccuaggagugccccauucuu

SEQ ID NO: 3469410 - RNA, 23 nt, Human
ccuaggauaaaaagccagggcug

SEQ ID NO: 3469411 - RNA, 18 nt, Human
ccuaggauucacacccca

SEQ ID NO: 3469412 - RNA, 19 nt, Human
ccuaggauucacaccccac

SEQ ID NO: 3469413 - RNA, 11 nt, Human
ccuaggauucu

SEQ ID NO: 3469414 - RNA, 16 nt, Human
ccuaggcauucuggac

SEQ ID NO: 3469415 - RNA, 23 nt, Human
ccuaggcauuugcugaauacaga

SEQ ID NO: 3469416 - RNA, 15 nt, Human
ccuaggccacuccuc

SEQ ID NO: 3469417 - RNA, 21 nt, Human
ccucaacucaccuaauguuua

SEQ ID NO: 3469418 - RNA, 21 nt, Human
ccucaacucuccuccagaguc

SEQ ID NO: 3469419 - RNA, 15 nt, Human
ccucaacucugcuga

SEQ ID NO: 3469420 - RNA, 20 nt, Human
ccucaacucugcugaggguc

SEQ ID NO: 3469421 - RNA, 20 nt, Human
ccucaagcuaugugagcuca

SEQ ID NO: 3469422 - RNA, 21 nt, Human
ccucaaggacaaagucuccag

SEQ ID NO: 3469423 - RNA, 23 nt, Human
ccucaaggacaaagucuccagcc

SEQ ID NO: 3469424 - RNA, 13 nt, Human
ccucaaggacuug

SEQ ID NO: 3469425 - RNA, 23 nt, Human
ccucaaggacuugaaagcaucca

SEQ ID NO: 3469426 - RNA, 21 nt, Human
ccucaaggccucccacaguga

SEQ ID NO: 3469427 - RNA, 23 nt, Human
ccucaagguuuuagguucuaaag

SEQ ID NO: 3469428 - RNA, 13 nt, Human
ccucaagucuuuc

SEQ ID NO: 3469429 - RNA, 17 nt, Human
ccucaagugauccuccc

SEQ ID NO: 3469430 - RNA, 13 nt, Human
ccucaauccagcu

SEQ ID NO: 3469431 - RNA, 18 nt, Human
ccucaaucucaauccugc

SEQ ID NO: 3469432 - RNA, 14 nt, Human
ccucaaugugacca

SEQ ID NO: 3469433 - RNA, 13 nt, Human
ccucaauguuuga

SEQ ID NO: 3469434 - RNA, 23 nt, Human
ccucacacacaaugugucugaga

SEQ ID NO: 3469435 - RNA, 13 nt, Human
ccucacacacccu

SEQ ID NO: 3469436 - RNA, 13 nt, Human
ccucacacuggga

SEQ ID NO: 3469437 - RNA, 15 nt, Human
ccucacacugggacu

SEQ ID NO: 3469438 - RNA, 16 nt, Human
ccucacagccucugac

SEQ ID NO: 3469439 - RNA, 23 nt, Human
ccucacagccucugaccccuccu

SEQ ID NO: 3469440 - RNA, 17 nt, Human
ccucacagcuggccguc

SEQ ID NO: 3469441 - RNA, 17 nt, Human
ccucacaguauugcuca

SEQ ID NO: 3469442 - RNA, 22 nt, Human
ccucacaguauugcucacccag

SEQ ID NO: 3469443 - RNA, 16 nt, Human
ccucacagucccacug

SEQ ID NO: 3469444 - RNA, 22 nt, Human
ccucacaguccuuaccagcaga

SEQ ID NO: 3469445 - RNA, 24 nt, Human
ccucacaguccuuaccagcagagc

SEQ ID NO: 3469446 - RNA, 13 nt, Human
ccucacagugacc

SEQ ID NO: 3469447 - RNA, 18 nt, Human
ccucacagugacccuucc

SEQ ID NO: 3469448 - RNA, 21 nt, Human
ccucacauagcuacccaaaag

SEQ ID NO: 3469449 - RNA, 15 nt, Human
ccucacaucuuucac

SEQ ID NO: 3469450 - RNA, 13 nt, Human
ccucaccaggggc

SEQ ID NO: 3469451 - RNA, 16 nt, Human
ccucacccaccccugc

SEQ ID NO: 3469452 - RNA, 12 nt, Human
ccucaccccacu

SEQ ID NO: 3469453 - RNA, 22 nt, Human
ccucaccccacuuaucccucuc

SEQ ID NO: 3469454 - RNA, 19 nt, Human
ccucacccccagcuuugcu

SEQ ID NO: 3469455 - RNA, 21 nt, Human
ccucacccccucccaccccca

SEQ ID NO: 3469456 - RNA, 15 nt, Human
ccucacccccucggg

SEQ ID NO: 3469457 - RNA, 17 nt, Human
ccucaccccgaggcccu

SEQ ID NO: 3469458 - RNA, 18 nt, Human
ccucaccccgaggcccug

SEQ ID NO: 3469459 - RNA, 14 nt, Human
ccucaccccugccc

SEQ ID NO: 3469460 - RNA, 17 nt, Human
ccucaccccugcccugg

SEQ ID NO: 3469461 - RNA, 22 nt, Human
ccucaccccugguucucaucuu

SEQ ID NO: 3469462 - RNA, 21 nt, Human
ccucaccccuguccucacugc

SEQ ID NO: 3469463 - RNA, 15 nt, Human
ccucacccugagccc

SEQ ID NO: 3469464 - RNA, 21 nt, Human
ccucacccugagccccuuccu

SEQ ID NO: 3469465 - RNA, 15 nt, Human
ccucacccugccuua

SEQ ID NO: 3469466 - RNA, 13 nt, Human
ccucacccuugcg

SEQ ID NO: 3469467 - RNA, 14 nt, Human
ccucaccucaugcc

SEQ ID NO: 3469468 - RNA, 22 nt, Human
ccucaccucaugcccacccccu

SEQ ID NO: 3469469 - RNA, 23 nt, Human
ccucaccucaugcccacccccug

SEQ ID NO: 3469470 - RNA, 13 nt, Human
ccucaccuccucu

SEQ ID NO: 3469471 - RNA, 14 nt, Human
ccucaccuccucua

SEQ ID NO: 3469472 - RNA, 16 nt, Human
ccucaccucuacccaa

SEQ ID NO: 3469473 - RNA, 12 nt, Human
ccucaccucugg

SEQ ID NO: 3469474 - RNA, 22 nt, Human
ccucaccucuggacuggcuaga

SEQ ID NO: 3469475 - RNA, 22 nt, Human
ccucaccugggcaccuggggag

SEQ ID NO: 3469476 - RNA, 17 nt, Human
ccucaccuugcaacaca

SEQ ID NO: 3469477 - RNA, 18 nt, Human
ccucaccuugcaacacac

SEQ ID NO: 3469478 - RNA, 15 nt, Human
ccucaccuuggcacc

SEQ ID NO: 3469479 - RNA, 16 nt, Human
ccucaccuuggcacca

SEQ ID NO: 3469480 - RNA, 21 nt, Human
ccucacggugccuuuuuucac

SEQ ID NO: 3469481 - RNA, 16 nt, Human
ccucacgugcaaagcc

SEQ ID NO: 3469482 - RNA, 22 nt, Human
ccucacuaucccggcugcccuu

SEQ ID NO: 3469483 - RNA, 21 nt, Human
ccucacucccuucuaccugcc

SEQ ID NO: 3469484 - RNA, 15 nt, Human
ccucacucugccagg

SEQ ID NO: 3469485 - RNA, 18 nt, Human
ccucacucugccagggca

SEQ ID NO: 3469486 - RNA, 18 nt, Human
ccucacugaaaacaucug

SEQ ID NO: 3469487 - RNA, 14 nt, Human
ccucacugcccgca

SEQ ID NO: 3469488 - RNA, 15 nt, Human
ccucacugcccgcac

SEQ ID NO: 3469489 - RNA, 17 nt, Human
ccucacugcucccugaa

SEQ ID NO: 3469490 - RNA, 14 nt, Human
ccucacuggaugaa

SEQ ID NO: 3469491 - RNA, 12 nt, Human
ccucacuggcca

SEQ ID NO: 3469492 - RNA, 14 nt, Human
ccucacuugaaugu

SEQ ID NO: 3469493 - RNA, 18 nt, Human
ccucacuuuuaaugaaca

SEQ ID NO: 3469494 - RNA, 22 nt, Human
ccucacuuuuaaugaacaaaug

SEQ ID NO: 3469495 - RNA, 18 nt, Human
ccucagaaacacuggggc

SEQ ID NO: 3469496 - RNA, 20 nt, Human
ccucagaaacacuggggcug

SEQ ID NO: 3469497 - RNA, 16 nt, Human
ccucagaacccuuggc

SEQ ID NO: 3469498 - RNA, 20 nt, Human
ccucagacucuaagaaagaa

SEQ ID NO: 3469499 - RNA, 18 nt, Human
ccucagacugcacccagg

SEQ ID NO: 3469500 - RNA, 19 nt, Human
ccucagacuuaccaggaag

SEQ ID NO: 3469501 - RNA, 16 nt, Human
ccucagagacaucagc

SEQ ID NO: 3469502 - RNA, 20 nt, Human
ccucagagacaucagcccuu

SEQ ID NO: 3469503 - RNA, 16 nt, Human
ccucagagaccagggc

SEQ ID NO: 3469504 - RNA, 21 nt, Human
ccucagagaccagggcuccag

SEQ ID NO: 3469505 - RNA, 13 nt, Human
ccucagaguccag

SEQ ID NO: 3469506 - RNA, 16 nt, Human
ccucagaucuucugug

SEQ ID NO: 3469507 - RNA, 21 nt, Human
ccucagauuccuucccaugga

SEQ ID NO: 3469508 - RNA, 18 nt, Human
ccucagccacuugccugu

SEQ ID NO: 3469509 - RNA, 13 nt, Human
ccucagccagccu

SEQ ID NO: 3469510 - RNA, 14 nt, Human
ccucagccccucuu

SEQ ID NO: 3469511 - RNA, 18 nt, Human
ccucagccccucuugccc

SEQ ID NO: 3469512 - RNA, 16 nt, Human
ccucagcccugacccu

SEQ ID NO: 3469513 - RNA, 17 nt, Human
ccucagcccugacccug

SEQ ID NO: 3469514 - RNA, 21 nt, Human
ccucagcccugacccugugga

SEQ ID NO: 3469515 - RNA, 14 nt, Human
ccucagccuagacc

SEQ ID NO: 3469516 - RNA, 11 nt, Human
ccucagccucc

SEQ ID NO: 3469517 - RNA, 12 nt, Human
ccucagccuccc

SEQ ID NO: 3469518 - RNA, 22 nt, Human
ccucagccucccaaguagcugg

SEQ ID NO: 3469519 - RNA, 22 nt, Human
ccucagccucccgaauagcugg

SEQ ID NO: 3469520 - RNA, 13 nt, Human
ccucagccuccug

SEQ ID NO: 3469521 - RNA, 15 nt, Human
ccucagccuccugag

SEQ ID NO: 3469522 - RNA, 12 nt, Human
ccucagccugca

SEQ ID NO: 3469523 - RNA, 14 nt, Human
ccucagccugcaca

SEQ ID NO: 3469524 - RNA, 13 nt, Human
ccucagccuggcc

SEQ ID NO: 3469525 - RNA, 14 nt, Human
ccucagccuggcca

SEQ ID NO: 3469526 - RNA, 18 nt, Human
ccucagccuggccagaca

SEQ ID NO: 3469527 - RNA, 20 nt, Human
ccucagccuggccagacaca

SEQ ID NO: 3469528 - RNA, 20 nt, Human
ccucagccugggcgcugguc

SEQ ID NO: 3469529 - RNA, 21 nt, Human
ccucagccugggcgcuggucc

SEQ ID NO: 3469530 - RNA, 17 nt, Human
ccucagccuugccagag

SEQ ID NO: 3469531 - RNA, 18 nt, Human
ccucagccuugccagaga

SEQ ID NO: 3469532 - RNA, 22 nt, Human
ccucagccuugccagagaucca

SEQ ID NO: 3469533 - RNA, 13 nt, Human
ccucagcuaccca

SEQ ID NO: 3469534 - RNA, 20 nt, Human
ccucagcuacccacuauccu

SEQ ID NO: 3469535 - RNA, 11 nt, Human
ccucagcucca

SEQ ID NO: 3469536 - RNA, 13 nt, Human
ccucagcucggcu

SEQ ID NO: 3469537 - RNA, 13 nt, Human
ccucagcucuggg

SEQ ID NO: 3469538 - RNA, 15 nt, Human
ccucagcugccucac

SEQ ID NO: 3469539 - RNA, 19 nt, Human
ccucagcugccucacuucc

SEQ ID NO: 3469540 - RNA, 14 nt, Human
ccucagcugcuucu

SEQ ID NO: 3469541 - RNA, 18 nt, Human
ccucagcuuccccaguag

SEQ ID NO: 3469542 - RNA, 21 nt, Human
ccucagcuuccccaguagcug

SEQ ID NO: 3469543 - RNA, 19 nt, Human
ccucaggaaagaauagaaa

SEQ ID NO: 3469544 - RNA, 21 nt, Human
ccucaggaaagaauagaaaga

SEQ ID NO: 3469545 - RNA, 16 nt, Human
ccucaggacccucgcu

SEQ ID NO: 3469546 - RNA, 23 nt, Human
ccucaggacccucgcuggccccc

SEQ ID NO: 3469547 - RNA, 18 nt, Human
ccucaggacugcaacagg

SEQ ID NO: 3469548 - RNA, 14 nt, Human
ccucaggacuggga

SEQ ID NO: 3469549 - RNA, 15 nt, Human
ccucaggacugggag

SEQ ID NO: 3469550 - RNA, 16 nt, Human
ccucaggacugggagc

SEQ ID NO: 3469551 - RNA, 21 nt, Human
ccucaggagccgaagcccagg

SEQ ID NO: 3469552 - RNA, 19 nt, Human
ccucaggaggcaggaccuu

SEQ ID NO: 3469553 - RNA, 17 nt, Human
ccucaggcacuagccuu

SEQ ID NO: 3469554 - RNA, 12 nt, Human
ccucaggcaggu

SEQ ID NO: 3469555 - RNA, 21 nt, Human
ccucaggccaggugcaguggc

SEQ ID NO: 3469556 - RNA, 10 nt, Human
ccucaggccu

SEQ ID NO: 3469557 - RNA, 14 nt, Human
ccucaggccucugu

SEQ ID NO: 3469558 - RNA, 19 nt, Human
ccucaggccucugugccgc

SEQ ID NO: 3469559 - RNA, 16 nt, Human
ccucaggcuuccuugg

SEQ ID NO: 3469560 - RNA, 15 nt, Human
ccucagggacucagg

SEQ ID NO: 3469561 - RNA, 19 nt, Human
ccucagggagcagggaagg

SEQ ID NO: 3469562 - RNA, 18 nt, Human
ccucccacacccaaagcu

SEQ ID NO: 3469563 - RNA, 13 nt, Human
ccucccacaguga

SEQ ID NO: 3469564 - RNA, 13 nt, Human
ccucccaccccca

SEQ ID NO: 3469565 - RNA, 13 nt, Human
ccucccacccccu

SEQ ID NO: 3469566 - RNA, 13 nt, Human
ccucccaccucca

SEQ ID NO: 3469567 - RNA, 12 nt, Human
ccucccaccucu

SEQ ID NO: 3469568 - RNA, 13 nt, Human
ccucccaccuuug

SEQ ID NO: 3469569 - RNA, 19 nt, Human
ccucccagaaagcaaaccu

SEQ ID NO: 3469570 - RNA, 17 nt, Human
ccucccagaacacacuc

SEQ ID NO: 3469571 - RNA, 21 nt, Human
ccucccagagcaccugcuguc

SEQ ID NO: 3469572 - RNA, 16 nt, Human
ccucccagagguccag

SEQ ID NO: 3469573 - RNA, 19 nt, Human
ccucccagagguccagccc

SEQ ID NO: 3469574 - RNA, 20 nt, Human
ccucccagagguccagccca

SEQ ID NO: 3469575 - RNA, 12 nt, Human
ccucccagcccu

SEQ ID NO: 3469576 - RNA, 18 nt, Human
ccucccaggaagcccagg

SEQ ID NO: 3469577 - RNA, 20 nt, Human
ccucccaggcgccccuuccc

SEQ ID NO: 3469578 - RNA, 18 nt, Human
ccucccagggagcaaggg

SEQ ID NO: 3469579 - RNA, 21 nt, Human
ccucccagggagcaagggcag

SEQ ID NO: 3469580 - RNA, 12 nt, Human
ccucccaggguu

SEQ ID NO: 3469581 - RNA, 13 nt, Human
ccucccaggguuu

SEQ ID NO: 3469582 - RNA, 18 nt, Human
ccucccaggguuuuaacu

SEQ ID NO: 3469583 - RNA, 20 nt, Human
ccucccauagauacucucuu

SEQ ID NO: 3469584 - RNA, 13 nt, Human
ccucccaucuggg

SEQ ID NO: 3469585 - RNA, 16 nt, Human
ccuccccaacccugcc

SEQ ID NO: 3469586 - RNA, 21 nt, Human
ccuccccaacccugccccugc

SEQ ID NO: 3469587 - RNA, 22 nt, Human
ccuccccacggccgcuccaggg

SEQ ID NO: 3469588 - RNA, 12 nt, Human
ccuccccagcag

SEQ ID NO: 3469589 - RNA, 20 nt, Human
ccuccccagcagguggggag

SEQ ID NO: 3469590 - RNA, 16 nt, Human
ccuccccagccccuag

SEQ ID NO: 3469591 - RNA, 13 nt, Human
ccuccccagccug

SEQ ID NO: 3469592 - RNA, 16 nt, Human
ccuccccagccugcgc

SEQ ID NO: 3469593 - RNA, 12 nt, Human
ccuccccagggg

SEQ ID NO: 3469594 - RNA, 12 nt, Human
ccuccccaugca

SEQ ID NO: 3469595 - RNA, 21 nt, Human
ccuccccauuagagucagccu

SEQ ID NO: 3469596 - RNA, 14 nt, Human
ccuccccauuuccc

SEQ ID NO: 3469597 - RNA, 19 nt, Human
ccucccccaacccccaccc

SEQ ID NO: 3469598 - RNA, 22 nt, Human
ccucccccaacccccaccccac

SEQ ID NO: 3469599 - RNA, 15 nt, Human
ccucccccagagggg

SEQ ID NO: 3469600 - RNA, 23 nt, Human
ccucccccagccaugccagcugg

SEQ ID NO: 3469601 - RNA, 16 nt, Human
ccucccccccaugcac

SEQ ID NO: 3469602 - RNA, 19 nt, Human
ccucccccccaugcacugu

SEQ ID NO: 3469603 - RNA, 18 nt, Human
ccucccccguccuggagg

SEQ ID NO: 3469604 - RNA, 17 nt, Human
ccucccccucccccuuc

SEQ ID NO: 3469605 - RNA, 15 nt, Human
ccucccccuccuucc

SEQ ID NO: 3469606 - RNA, 21 nt, Human
ccucccccuccuucccagcug

SEQ ID NO: 3469607 - RNA, 12 nt, Human
ccucccccugag

SEQ ID NO: 3469608 - RNA, 17 nt, Human
ccucccccugccagugc

SEQ ID NO: 3469609 - RNA, 19 nt, Human
ccucccccugccagugccu

SEQ ID NO: 3469610 - RNA, 14 nt, Human
ccucccccugcccc

SEQ ID NO: 3469611 - RNA, 12 nt, Human
ccucccccuucu

SEQ ID NO: 3469612 - RNA, 23 nt, Human
ccuccccggcucgagcaguccug

SEQ ID NO: 3469613 - RNA, 17 nt, Human
ccuccccuauccaccca

SEQ ID NO: 3469614 - RNA, 13 nt, Human
ccuccccucaagg

SEQ ID NO: 3469615 - RNA, 18 nt, Human
ccuccccucacagccucu

SEQ ID NO: 3469616 - RNA, 12 nt, Human
ccuccccuccag

SEQ ID NO: 3469617 - RNA, 15 nt, Human
ccuccccuccccugc

SEQ ID NO: 3469618 - RNA, 21 nt, Human
ccuccccuccggacuggugcc

SEQ ID NO: 3469619 - RNA, 15 nt, Human
ccuccccuccuccug

SEQ ID NO: 3469620 - RNA, 14 nt, Human
ccuccccuccucug

SEQ ID NO: 3469621 - RNA, 18 nt, Human
ccuccccuccucugcuug

SEQ ID NO: 3469622 - RNA, 22 nt, Human
ccuccccugaggcucagggaaa

SEQ ID NO: 3469623 - RNA, 12 nt, Human
ccuccccugcca

SEQ ID NO: 3469624 - RNA, 13 nt, Human
ccuccccugccac

SEQ ID NO: 3469625 - RNA, 16 nt, Human
ccuccccugccagggc

SEQ ID NO: 3469626 - RNA, 13 nt, Human
ccuccccugcccu

SEQ ID NO: 3469627 - RNA, 16 nt, Human
ccuccccugcccuggu

SEQ ID NO: 3469628 - RNA, 13 nt, Human
ccuccccugccuu

SEQ ID NO: 3469629 - RNA, 14 nt, Human
ccuccccugccuug

SEQ ID NO: 3469630 - RNA, 15 nt, Human
ccuccccugccuugc

SEQ ID NO: 3469631 - RNA, 12 nt, Human
ccuccccugcug

SEQ ID NO: 3469632 - RNA, 14 nt, Human
ccuccccuugccag

SEQ ID NO: 3469633 - RNA, 13 nt, Human
ccuccccuugccu

SEQ ID NO: 3469634 - RNA, 16 nt, Human
ccuccccuugggcggc

SEQ ID NO: 3469635 - RNA, 21 nt, Human
ccucccgaauagcugggacua

SEQ ID NO: 3469636 - RNA, 19 nt, Human
ccucccgagcuccucuucc

SEQ ID NO: 3469637 - RNA, 21 nt, Human
ccucccgaguagcugggacua

SEQ ID NO: 3469638 - RNA, 11 nt, Human
ccucccgcccc

SEQ ID NO: 3469639 - RNA, 19 nt, Human
ccucccggcaugggaaagc

SEQ ID NO: 3469640 - RNA, 22 nt, Human
ccucccggcccugccugcuggu

SEQ ID NO: 3469641 - RNA, 16 nt, Human
ccucccgggcccuccc

SEQ ID NO: 3469642 - RNA, 21 nt, Human
ccucccgggcccucccuugga

SEQ ID NO: 3469643 - RNA, 16 nt, Human
ccucccggugcccaag

SEQ ID NO: 3469644 - RNA, 18 nt, Human
ccucccuaccucaaccug

SEQ ID NO: 3469645 - RNA, 21 nt, Human
ccucccucaaccucauccucu

SEQ ID NO: 3469646 - RNA, 12 nt, Human
ccucccucagcc

SEQ ID NO: 3469647 - RNA, 14 nt, Human
ccucccucagcccc

SEQ ID NO: 3469648 - RNA, 12 nt, Human
ccucccuccacc

SEQ ID NO: 3469649 - RNA, 16 nt, Human
ccucccuccaccccag

SEQ ID NO: 3469650 - RNA, 17 nt, Human
ccucccuccaccucccu

SEQ ID NO: 3469651 - RNA, 18 nt, Human
ccucccuccccugcccuc

SEQ ID NO: 3469652 - RNA, 14 nt, Human
ccucccucccggca

SEQ ID NO: 3469653 - RNA, 13 nt, Human
ccucccucccucu

SEQ ID NO: 3469654 - RNA, 15 nt, Human
ccucccucccucuuu

SEQ ID NO: 3469655 - RNA, 12 nt, Human
ccucccuccuuc

SEQ ID NO: 3469656 - RNA, 14 nt, Human
ccucccuccuuccu

SEQ ID NO: 3469657 - RNA, 22 nt, Human
ccucccucucucuucugcucca

SEQ ID NO: 3469658 - RNA, 14 nt, Human
ccucccucugaccu

SEQ ID NO: 3469659 - RNA, 14 nt, Human
ccucccucugaggc

SEQ ID NO: 3469660 - RNA, 15 nt, Human
ccucccucuuguuuu

SEQ ID NO: 3469661 - RNA, 20 nt, Human
ccucccugaaccaucccuga

SEQ ID NO: 3469662 - RNA, 17 nt, Human
ccucccugacccugcag

SEQ ID NO: 3469663 - RNA, 23 nt, Human
ccucccugagcuagaacccucug

SEQ ID NO: 3469664 - RNA, 22 nt, Human
ccucccugcaucugaccagcag

SEQ ID NO: 3469665 - RNA, 13 nt, Human
ccucccugccagu

SEQ ID NO: 3469666 - RNA, 18 nt, Human
ccucccugccccucccuu

SEQ ID NO: 3469667 - RNA, 22 nt, Human
ccucccugccccucccuucaac

SEQ ID NO: 3469668 - RNA, 15 nt, Human
ccucccugccuccag

SEQ ID NO: 3469669 - RNA, 20 nt, Human
ccucccuggagccuccacug

SEQ ID NO: 3469670 - RNA, 23 nt, Human
ccucccuggaguguggcugagga

SEQ ID NO: 3469671 - RNA, 12 nt, Human
ccucccuggaug

SEQ ID NO: 3469672 - RNA, 16 nt, Human
ccucccuggcucccau

SEQ ID NO: 3469673 - RNA, 18 nt, Human
ccucccuggcucccauga

SEQ ID NO: 3469674 - RNA, 12 nt, Human
ccucccuggcug

SEQ ID NO: 3469675 - RNA, 16 nt, Human
ccucccuggcugcccu

SEQ ID NO: 3469676 - RNA, 12 nt, Human
ccucccugucaa

SEQ ID NO: 3469677 - RNA, 23 nt, Human
ccucccugucaaagcugucacuu

SEQ ID NO: 3469678 - RNA, 15 nt, Human
ccucccuguccaccc

SEQ ID NO: 3469679 - RNA, 15 nt, Human
ccucccuguccuccu

SEQ ID NO: 3469680 - RNA, 16 nt, Human
ccucccuguccuccuc

SEQ ID NO: 3469681 - RNA, 19 nt, Human
ccucccuguuccccagaga

SEQ ID NO: 3469682 - RNA, 22 nt, Human
ccucccuguugacgaagucucu

SEQ ID NO: 3469683 - RNA, 14 nt, Human
ccucccuguuugaa

SEQ ID NO: 3469684 - RNA, 16 nt, Human
ccucccuuccuuuucc

SEQ ID NO: 3469685 - RNA, 22 nt, Human
ccucccuuccuuuucccugcuu

SEQ ID NO: 3469686 - RNA, 18 nt, Human
ccucccuucucccuggau

SEQ ID NO: 3469687 - RNA, 16 nt, Human
ccucccuucucuucac

SEQ ID NO: 3469688 - RNA, 13 nt, Human
ccucccuucugcu

SEQ ID NO: 3469689 - RNA, 23 nt, Human
ccucccuuggaaaccugcccugc

SEQ ID NO: 3469690 - RNA, 15 nt, Human
ccucccuuggcgugg

SEQ ID NO: 3469691 - RNA, 20 nt, Human
ccucccuuggggccuaugca

SEQ ID NO: 3469692 - RNA, 13 nt, Human
ccucccuuucucc

SEQ ID NO: 3469693 - RNA, 16 nt, Human
ccucccuuuuuccuug

SEQ ID NO: 3469694 - RNA, 22 nt, Human
ccuccgaccacuuccaggggaa

SEQ ID NO: 3469695 - RNA, 16 nt, Human
ccuccgagggacgcgg

SEQ ID NO: 3469696 - RNA, 19 nt, Human
ccuccgauccuuccuccca

SEQ ID NO: 3469697 - RNA, 16 nt, Human
ccuccgccaggcgaga

SEQ ID NO: 3469698 - RNA, 12 nt, Human
ccuccgcccugc

SEQ ID NO: 3469699 - RNA, 14 nt, Human
ccuccgcccugcca

SEQ ID NO: 3469700 - RNA, 14 nt, Human
ccuccgccuccagg

SEQ ID NO: 3469701 - RNA, 16 nt, Human
ccuccgccuccaggaa

SEQ ID NO: 3469702 - RNA, 13 nt, Human
ccuccgccucccg

SEQ ID NO: 3469703 - RNA, 16 nt, Human
ccuccgccucccgggu

SEQ ID NO: 3469704 - RNA, 14 nt, Human
ccuccgccucuugg

SEQ ID NO: 3469705 - RNA, 20 nt, Human
ccuccgcgugaucaaagcca

SEQ ID NO: 3469706 - RNA, 19 nt, Human
ccuccggccaggugccucc

SEQ ID NO: 3469707 - RNA, 20 nt, Human
ccuccggccaggugccuccu

SEQ ID NO: 3469708 - RNA, 16 nt, Human
ccuccggccuccccuc

SEQ ID NO: 3469709 - RNA, 14 nt, Human
ccuggggagccagg

SEQ ID NO: 3469710 - RNA, 19 nt, Human
ccuggggagugggacagag

SEQ ID NO: 3469711 - RNA, 22 nt, Human
ccuggggagugggacagagucu

SEQ ID NO: 3469712 - RNA, 14 nt, Human
ccuggggcacaguc

SEQ ID NO: 3469713 - RNA, 23 nt, Human
ccuggggcagucaccugcccaga

SEQ ID NO: 3469714 - RNA, 18 nt, Human
ccuggggcauccaugggg

SEQ ID NO: 3469715 - RNA, 13 nt, Human
ccuggggccaggc

SEQ ID NO: 3469716 - RNA, 15 nt, Human
ccuggggccaggccg

SEQ ID NO: 3469717 - RNA, 22 nt, Human
ccuggggccucggagccucauc

SEQ ID NO: 3469718 - RNA, 13 nt, Human
ccuggggccugac

SEQ ID NO: 3469719 - RNA, 14 nt, Human
ccuggggccugacu

SEQ ID NO: 3469720 - RNA, 17 nt, Human
ccuggggccugacugcu

SEQ ID NO: 3469721 - RNA, 16 nt, Human
ccuggggccugagaga

SEQ ID NO: 3469722 - RNA, 16 nt, Human
ccuggggccuggaccu

SEQ ID NO: 3469723 - RNA, 13 nt, Human
ccuggggccugua

SEQ ID NO: 3469724 - RNA, 14 nt, Human
ccuggggccuguac

SEQ ID NO: 3469725 - RNA, 20 nt, Human
ccuggggccuguacugccug

SEQ ID NO: 3469726 - RNA, 21 nt, Human
ccuggggccuguacugccugc

SEQ ID NO: 3469727 - RNA, 23 nt, Human
ccuggggccuguacugccugcuu

SEQ ID NO: 3469728 - RNA, 20 nt, Human
ccuggggcuaggcuggagcc

SEQ ID NO: 3469729 - RNA, 13 nt, Human
ccuggggcucccu

SEQ ID NO: 3469730 - RNA, 21 nt, Human
ccuggggcucuaacgccugag

SEQ ID NO: 3469731 - RNA, 15 nt, Human
ccuggggcucugugc

SEQ ID NO: 3469732 - RNA, 18 nt, Human
ccuggggcugaucucagg

SEQ ID NO: 3469733 - RNA, 15 nt, Human
ccuggggcugcuggc

SEQ ID NO: 3469734 - RNA, 15 nt, Human
ccuggggcuggccuc

SEQ ID NO: 3469735 - RNA, 19 nt, Human
ccuggggcuggccucccaa

SEQ ID NO: 3469736 - RNA, 15 nt, Human
ccuggggcuggcuuu

SEQ ID NO: 3469737 - RNA, 14 nt, Human
ccuggggcugggcc

SEQ ID NO: 3469738 - RNA, 15 nt, Human
ccuggggcugggccc

SEQ ID NO: 3469739 - RNA, 17 nt, Human
ccugggggaagcccugg

SEQ ID NO: 3469740 - RNA, 19 nt, Human
ccugggggaagcccuggau

SEQ ID NO: 3469741 - RNA, 16 nt, Human
ccugggggccugaccu

SEQ ID NO: 3469742 - RNA, 17 nt, Human
ccugggggccugaccuc

SEQ ID NO: 3469743 - RNA, 23 nt, Human
ccugggggccugaccucccccuc

SEQ ID NO: 3469744 - RNA, 15 nt, Human
ccugggggccuggcu

SEQ ID NO: 3469745 - RNA, 18 nt, Human
ccugggggcugggcagag

SEQ ID NO: 3469746 - RNA, 22 nt, Human
ccugggguauaaaacuuuccuc

SEQ ID NO: 3469747 - RNA, 14 nt, Human
ccuggggucuggag

SEQ ID NO: 3469748 - RNA, 15 nt, Human
ccuggggugacccgg

SEQ ID NO: 3469749 - RNA, 15 nt, Human
ccuggggugcccucc

SEQ ID NO: 3469750 - RNA, 16 nt, Human
ccuggggugcccucca

SEQ ID NO: 3469751 - RNA, 21 nt, Human
ccugggguggggauagggagc

SEQ ID NO: 3469752 - RNA, 20 nt, Human
ccuggggugugggaggcccg

SEQ ID NO: 3469753 - RNA, 22 nt, Human
ccuggguaaaugcagcgugaag

SEQ ID NO: 3469754 - RNA, 18 nt, Human
ccuggguagcgggggagg

SEQ ID NO: 3469755 - RNA, 15 nt, Human
ccugggucagucugg

SEQ ID NO: 3469756 - RNA, 21 nt, Human
ccugggucagucuggugggag

SEQ ID NO: 3469757 - RNA, 22 nt, Human
ccugggucagucuggugggagg

SEQ ID NO: 3469758 - RNA, 19 nt, Human
ccuggguccaaugcucagg

SEQ ID NO: 3469759 - RNA, 23 nt, Human
ccuggguccaggggaggccuucc

SEQ ID NO: 3469760 - RNA, 15 nt, Human
ccugggucccaggac

SEQ ID NO: 3469761 - RNA, 15 nt, Human
ccuggguccccagcc

SEQ ID NO: 3469762 - RNA, 14 nt, Human
ccugggucuguguc

SEQ ID NO: 3469763 - RNA, 21 nt, Human
ccugggucugugucucuuuuc

SEQ ID NO: 3469764 - RNA, 23 nt, Human
ccugggugcuggcugcccagacc

SEQ ID NO: 3469765 - RNA, 22 nt, Human
ccuggguggaucggccuccucu

SEQ ID NO: 3469766 - RNA, 17 nt, Human
ccuggguggcuacucug

SEQ ID NO: 3469767 - RNA, 19 nt, Human
ccuggguggcuacucugug

SEQ ID NO: 3469768 - RNA, 22 nt, Human
ccuggguggcuacucugugcca

SEQ ID NO: 3469769 - RNA, 23 nt, Human
ccuggguggcuacucugugccag

SEQ ID NO: 3469770 - RNA, 17 nt, Human
ccuggguggggcugcuc

SEQ ID NO: 3469771 - RNA, 19 nt, Human
ccuggguggguggugggga

SEQ ID NO: 3469772 - RNA, 21 nt, Human
ccugggugggugguggggagg

SEQ ID NO: 3469773 - RNA, 23 nt, Human
ccugggugggugguggggagggg

SEQ ID NO: 3469774 - RNA, 22 nt, Human
ccuggguuagacugccagcucu

SEQ ID NO: 3469775 - RNA, 19 nt, Human
ccuggguucagaaaugcug

SEQ ID NO: 3469776 - RNA, 20 nt, Human
ccuggguuccaauccuggcu

SEQ ID NO: 3469777 - RNA, 19 nt, Human
ccuggguuugguguauggu

SEQ ID NO: 3469778 - RNA, 22 nt, Human
ccuggguuuuguauucucugag

SEQ ID NO: 3469779 - RNA, 15 nt, Human
ccugguaagaaaaag

SEQ ID NO: 3469780 - RNA, 13 nt, Human
ccugguacccagc

SEQ ID NO: 3469781 - RNA, 20 nt, Human
ccugguacccagccaucugc

SEQ ID NO: 3469782 - RNA, 22 nt, Human
ccugguacccagccaucugccc

SEQ ID NO: 3469783 - RNA, 16 nt, Human
ccugguacucaagccc

SEQ ID NO: 3469784 - RNA, 20 nt, Human
ccugguacucccucucagga

SEQ ID NO: 3469785 - RNA, 20 nt, Human
ccugguagaccacugccaua

SEQ ID NO: 3469786 - RNA, 19 nt, Human
ccugguaggagugugugau

SEQ ID NO: 3469787 - RNA, 18 nt, Human
ccugguauauccaaaagc

SEQ ID NO: 3469788 - RNA, 17 nt, Human
ccuggucaggcccuggu

SEQ ID NO: 3469789 - RNA, 20 nt, Human
ccuggucagggugagcccau

SEQ ID NO: 3469790 - RNA, 22 nt, Human
ccugguccagggaagcuggccg

SEQ ID NO: 3469791 - RNA, 16 nt, Human
ccugguccaugcaggg

SEQ ID NO: 3469792 - RNA, 20 nt, Human
ccuggucccacgagggugcc

SEQ ID NO: 3469793 - RNA, 18 nt, Human
ccugguccccuccuuccc

SEQ ID NO: 3469794 - RNA, 14 nt, Human
ccuggucccuggga

SEQ ID NO: 3469795 - RNA, 16 nt, Human
ccuggucccugggagg

SEQ ID NO: 3469796 - RNA, 23 nt, Human
ccugguccugaggguccccaccu

SEQ ID NO: 3469797 - RNA, 18 nt, Human
ccugguccuuccaggccc

SEQ ID NO: 3469798 - RNA, 19 nt, Human
ccugguccuuccaggcccc

SEQ ID NO: 3469799 - RNA, 21 nt, Human
ccuggucgccuuccaccucug

SEQ ID NO: 3469800 - RNA, 18 nt, Human
ccuggucucacccuggag

SEQ ID NO: 3469801 - RNA, 21 nt, Human
ccuggucucacccuggaggca

SEQ ID NO: 3469802 - RNA, 16 nt, Human
ccuggucuuuccucug

SEQ ID NO: 3469803 - RNA, 13 nt, Human
ccuggucuuugag

SEQ ID NO: 3469804 - RNA, 21 nt, Human
ccuggugaggaagcuccaguc

SEQ ID NO: 3469805 - RNA, 23 nt, Human
ccuggugaggaagcuccaguccu

SEQ ID NO: 3469806 - RNA, 14 nt, Human
ccuggugaucacgu

SEQ ID NO: 3469807 - RNA, 20 nt, Human
ccuggugcacuggccccacc

SEQ ID NO: 3469808 - RNA, 12 nt, Human
ccuggugccacc

SEQ ID NO: 3469809 - RNA, 13 nt, Human
ccuggugccaccu

SEQ ID NO: 3469810 - RNA, 20 nt, Human
ccuggugcccuggaugccca

SEQ ID NO: 3469811 - RNA, 21 nt, Human
ccuggugcccuggaugcccag

SEQ ID NO: 3469812 - RNA, 19 nt, Human
ccuggugcucucugccacu

SEQ ID NO: 3469813 - RNA, 13 nt, Human
ccuggugcugcug

SEQ ID NO: 3469814 - RNA, 13 nt, Human
ccuggugcuggau

SEQ ID NO: 3469815 - RNA, 14 nt, Human
ccuggugcuucucc

SEQ ID NO: 3469816 - RNA, 17 nt, Human
ccugguggacaguccug

SEQ ID NO: 3469817 - RNA, 22 nt, Human
ccugguggagaaagcacugacc

SEQ ID NO: 3469818 - RNA, 13 nt, Human
ccugguggcagcu

SEQ ID NO: 3469819 - RNA, 19 nt, Human
ccugguggcagcucaccuc

SEQ ID NO: 3469820 - RNA, 17 nt, Human
ccugguggcagcugcgg

SEQ ID NO: 3469821 - RNA, 14 nt, Human
ccugguggcagugg

SEQ ID NO: 3469822 - RNA, 18 nt, Human
ccugguggcagugggagc

SEQ ID NO: 3469823 - RNA, 21 nt, Human
ccugguggcagugggagcugc

SEQ ID NO: 3469824 - RNA, 16 nt, Human
ccugguggcccucucc

SEQ ID NO: 3469825 - RNA, 18 nt, Human
ccugguggcccucucccc

SEQ ID NO: 3469826 - RNA, 21 nt, Human
ccugguggcccucuccccugc

SEQ ID NO: 3469827 - RNA, 14 nt, Human
ccuggugggccucc

SEQ ID NO: 3469828 - RNA, 14 nt, Human
ccugguggggcagc

SEQ ID NO: 3469829 - RNA, 16 nt, Human
ccugguggggcagcuc

SEQ ID NO: 3469830 - RNA, 22 nt, Human
ccugguggguccaggggccccu

SEQ ID NO: 3469831 - RNA, 19 nt, Human
ccuggugguauuuucaaua

SEQ ID NO: 3469832 - RNA, 22 nt, Human
ccuggugguucacucuuggagc

SEQ ID NO: 3469833 - RNA, 12 nt, Human
ccuggugucacc

SEQ ID NO: 3469834 - RNA, 21 nt, Human
ccuggugucaccccagagcca

SEQ ID NO: 3469835 - RNA, 20 nt, Human
ccuggugugaagguccugcu

SEQ ID NO: 3469836 - RNA, 22 nt, Human
ccugguguuucuagcacuggcc

SEQ ID NO: 3469837 - RNA, 23 nt, Human
ccugguucaagcgauucucuugc

SEQ ID NO: 3469838 - RNA, 14 nt, Human
ccugguucucaucu

SEQ ID NO: 3469839 - RNA, 14 nt, Human
ccugguuuccugcc

SEQ ID NO: 3469840 - RNA, 19 nt, Human
ccugguuuuuggauuaaau

SEQ ID NO: 3469841 - RNA, 22 nt, Human
ccugguuuuuggauuaaauuag

SEQ ID NO: 3469842 - RNA, 19 nt, Human
ccugguuuuuguagccuuc

SEQ ID NO: 3469843 - RNA, 13 nt, Human
ccuguaaaacuuu

SEQ ID NO: 3469844 - RNA, 20 nt, Human
ccuguaaaacuuuauuuuau

SEQ ID NO: 3469845 - RNA, 13 nt, Human
ccuguaaacacuc

SEQ ID NO: 3469846 - RNA, 21 nt, Human
ccuguaaccucuucagaggcc

SEQ ID NO: 3469847 - RNA, 16 nt, Human
ccuguaagccaaagaa

SEQ ID NO: 3469848 - RNA, 18 nt, Human
ccuguaagccaaagaaau

SEQ ID NO: 3469849 - RNA, 14 nt, Human
ccuguaagccugca

SEQ ID NO: 3469850 - RNA, 14 nt, Human
ccuguaauaaauau

SEQ ID NO: 3469851 - RNA, 22 nt, Human
ccuguaauaaauaugagugcca

SEQ ID NO: 3469852 - RNA, 14 nt, Human
ccuuaaguaagcaa

SEQ ID NO: 3469853 - RNA, 22 nt, Human
ccuuaaguaauguuaauucuua

SEQ ID NO: 3469854 - RNA, 12 nt, Human
ccuuaagucaga

SEQ ID NO: 3469855 - RNA, 22 nt, Human
ccuuaagugaggaaaucaaagu

SEQ ID NO: 3469856 - RNA, 22 nt, Human
ccuuaaugcuucauaugaggag

SEQ ID NO: 3469857 - RNA, 16 nt, Human
ccuuaauuacuuaaaa

SEQ ID NO: 3469858 - RNA, 13 nt, Human
ccuuaauuuccuu

SEQ ID NO: 3469859 - RNA, 23 nt, Human
ccuuacaaaugauugcuuuuaaa

SEQ ID NO: 3469860 - RNA, 15 nt, Human
ccuuacacuuacugu

SEQ ID NO: 3469861 - RNA, 15 nt, Human
ccuuacauuuccugg

SEQ ID NO: 3469862 - RNA, 19 nt, Human
ccuuacauuugugagauuc

SEQ ID NO: 3469863 - RNA, 20 nt, Human
ccuuaccacugcucugauga

SEQ ID NO: 3469864 - RNA, 20 nt, Human
ccuuaccccuggcuguuugg

SEQ ID NO: 3469865 - RNA, 14 nt, Human
ccuuacccuuagaa

SEQ ID NO: 3469866 - RNA, 14 nt, Human
ccuuaccuccugcc

SEQ ID NO: 3469867 - RNA, 19 nt, Human
ccuuaccugccaggaagcc

SEQ ID NO: 3469868 - RNA, 14 nt, Human
ccuuaccuuuuuau

SEQ ID NO: 3469869 - RNA, 21 nt, Human
ccuuacgaucaggcacagguc

SEQ ID NO: 3469870 - RNA, 16 nt, Human
ccuuacgcuuugucac

SEQ ID NO: 3469871 - RNA, 15 nt, Human
ccuuacuccuguggg

SEQ ID NO: 3469872 - RNA, 17 nt, Human
ccuuacuucuugcccug

SEQ ID NO: 3469873 - RNA, 23 nt, Human
ccuuacuuuacugccugaauaaa

SEQ ID NO: 3469874 - RNA, 18 nt, Human
ccuuacuuuuuauauaua

SEQ ID NO: 3469875 - RNA, 15 nt, Human
ccuuagaaaaugugu

SEQ ID NO: 3469876 - RNA, 22 nt, Human
ccuuagaaauguaaacugccau

SEQ ID NO: 3469877 - RNA, 14 nt, Human
ccuuagaaccuuuc

SEQ ID NO: 3469878 - RNA, 16 nt, Human
ccuuagaaccuuucuu

SEQ ID NO: 3469879 - RNA, 21 nt, Human
ccuuagacagaggcccucaag

SEQ ID NO: 3469880 - RNA, 22 nt, Human
ccuuagacagaggcccucaagu

SEQ ID NO: 3469881 - RNA, 15 nt, Human
ccuuagaccaccaag

SEQ ID NO: 3469882 - RNA, 18 nt, Human
ccuuagaccaccaagccu

SEQ ID NO: 3469883 - RNA, 16 nt, Human
ccuuagacucuuuucc

SEQ ID NO: 3469884 - RNA, 16 nt, Human
ccuuagagacaucaaa

SEQ ID NO: 3469885 - RNA, 16 nt, Human
ccuuagagccaggcac

SEQ ID NO: 3469886 - RNA, 14 nt, Human
ccuuagaucuggca

SEQ ID NO: 3469887 - RNA, 18 nt, Human
ccuuagauuagcucugga

SEQ ID NO: 3469888 - RNA, 21 nt, Human
ccuuagauuagcucuggacca

SEQ ID NO: 3469889 - RNA, 20 nt, Human
ccuuagauuuaguaguguaa

SEQ ID NO: 3469890 - RNA, 17 nt, Human
ccuuagcaacagccgag

SEQ ID NO: 3469891 - RNA, 20 nt, Human
ccuuagcagggaaacagcua

SEQ ID NO: 3469892 - RNA, 18 nt, Human
ccuuagccaguuguauau

SEQ ID NO: 3469893 - RNA, 21 nt, Human
ccuuagccuaaaauccacacc

SEQ ID NO: 3469894 - RNA, 14 nt, Human
ccuuagccucccug

SEQ ID NO: 3469895 - RNA, 15 nt, Human
ccuuagccuggaccu

SEQ ID NO: 3469896 - RNA, 17 nt, Human
ccuuagccuggaccucu

SEQ ID NO: 3469897 - RNA, 19 nt, Human
ccuuagcucccucccgcac

SEQ ID NO: 3469898 - RNA, 13 nt, Human
ccuuagcugccaa

SEQ ID NO: 3469899 - RNA, 22 nt, Human
ccuuagcuggcauuacagcugg

SEQ ID NO: 3469900 - RNA, 21 nt, Human
ccuuagcuuagaccucagccu

SEQ ID NO: 3469901 - RNA, 12 nt, Human
ccuuagcuucag

SEQ ID NO: 3469902 - RNA, 16 nt, Human
ccuuaggcagggaagu

SEQ ID NO: 3469903 - RNA, 14 nt, Human
ccuuaggccucuga

SEQ ID NO: 3469904 - RNA, 16 nt, Human
ccuuaggccucugaga

SEQ ID NO: 3469905 - RNA, 15 nt, Human
ccuuaggccuuccuc

SEQ ID NO: 3469906 - RNA, 18 nt, Human
ccuuagggaagcuggccu

SEQ ID NO: 3469907 - RNA, 20 nt, Human
ccuuagggaagcuggccuga

SEQ ID NO: 3469908 - RNA, 16 nt, Human
ccuuaggguuuucucu

SEQ ID NO: 3469909 - RNA, 20 nt, Human
ccuuaggugauccacucgcc

SEQ ID NO: 3469910 - RNA, 20 nt, Human
ccuuagugcaguuauuugcu

SEQ ID NO: 3469911 - RNA, 15 nt, Human
ccuuagugggccagg

SEQ ID NO: 3469912 - RNA, 12 nt, Human
ccuuaguguuuc

SEQ ID NO: 3469913 - RNA, 14 nt, Human
ccuuaguguuucug

SEQ ID NO: 3469914 - RNA, 19 nt, Human
ccuuaguguuucugugcau

SEQ ID NO: 3469915 - RNA, 20 nt, Human
ccuuaguguuucugugcaug

SEQ ID NO: 3469916 - RNA, 17 nt, Human
ccuuauagucuaagacu

SEQ ID NO: 3469917 - RNA, 14 nt, Human
ccuuauaguuacug

SEQ ID NO: 3469918 - RNA, 21 nt, Human
ccuuauaguuacuguguaauu

SEQ ID NO: 3469919 - RNA, 22 nt, Human
ccuuauaguuugggcuucagcc

SEQ ID NO: 3469920 - RNA, 18 nt, Human
ccuuaucaaaggacacca

SEQ ID NO: 3469921 - RNA, 14 nt, Human
ccuuaucaaguguc

SEQ ID NO: 3469922 - RNA, 20 nt, Human
ccuuauccucccuguaacuu

SEQ ID NO: 3469923 - RNA, 13 nt, Human
ccuuauccucuga

SEQ ID NO: 3469924 - RNA, 16 nt, Human
ccuuauccucugaucu

SEQ ID NO: 3469925 - RNA, 13 nt, Human
ccuuaucugugcg

SEQ ID NO: 3469926 - RNA, 20 nt, Human
ccuuaucugugcgugaaaca

SEQ ID NO: 3469927 - RNA, 17 nt, Human
ccuuaucugugcucagg

SEQ ID NO: 3469928 - RNA, 13 nt, Human
ccuuaucuugcac

SEQ ID NO: 3469929 - RNA, 12 nt, Human
ccuuauggaaca

SEQ ID NO: 3469930 - RNA, 14 nt, Human
ccuuauggaacacu

SEQ ID NO: 3469931 - RNA, 19 nt, Human
ccuuauggaacacucugag

SEQ ID NO: 3469932 - RNA, 19 nt, Human
ccuuauggaugauuuaagu

SEQ ID NO: 3469933 - RNA, 14 nt, Human
ccuuauucagggaa

SEQ ID NO: 3469934 - RNA, 19 nt, Human
ccuucaaagcaaaugucuu

SEQ ID NO: 3469935 - RNA, 14 nt, Human
ccuucaaccauucc

SEQ ID NO: 3469936 - RNA, 21 nt, Human
ccuucaacguuucuucacuuu

SEQ ID NO: 3469937 - RNA, 13 nt, Human
ccuucaagaccuu

SEQ ID NO: 3469938 - RNA, 13 nt, Human
ccuucaagcucug

SEQ ID NO: 3469939 - RNA, 14 nt, Human
ccuucaauaaagua

SEQ ID NO: 3469940 - RNA, 15 nt, Human
ccuucaauuccuggg

SEQ ID NO: 3469941 - RNA, 18 nt, Human
ccuucacaaagcccaagg

SEQ ID NO: 3469942 - RNA, 18 nt, Human
ccuucacaccauaacuag

SEQ ID NO: 3469943 - RNA, 17 nt, Human
ccuucaccccaguggcc

SEQ ID NO: 3469944 - RNA, 19 nt, Human
ccuucaccuuuguccccac

SEQ ID NO: 3469945 - RNA, 14 nt, Human
ccuucacuccggug

SEQ ID NO: 3469946 - RNA, 23 nt, Human
ccuucacuccggugugccugcag

SEQ ID NO: 3469947 - RNA, 20 nt, Human
ccuucacuucugaccacacu

SEQ ID NO: 3469948 - RNA, 15 nt, Human
ccuucagagagcagu

SEQ ID NO: 3469949 - RNA, 16 nt, Human
ccuucagauccuaccc

SEQ ID NO: 3469950 - RNA, 22 nt, Human
ccuucagauguucucucccagg

SEQ ID NO: 3469951 - RNA, 23 nt, Human
ccuucagauguucucucccaggg

SEQ ID NO: 3469952 - RNA, 20 nt, Human
ccuucagcacuuuagaauau

SEQ ID NO: 3469953 - RNA, 19 nt, Human
ccuucagcccccagccccu

SEQ ID NO: 3469954 - RNA, 18 nt, Human
ccuucagcucacgcuuca

SEQ ID NO: 3469955 - RNA, 12 nt, Human
ccuucaggguga

SEQ ID NO: 3469956 - RNA, 19 nt, Human
ccuucagggugaugccagg

SEQ ID NO: 3469957 - RNA, 17 nt, Human
ccuucaguacccucuca

SEQ ID NO: 3469958 - RNA, 20 nt, Human
ccuucaguacccucucagcu

SEQ ID NO: 3469959 - RNA, 20 nt, Human
ccuucagucuugaauuucua

SEQ ID NO: 3469960 - RNA, 14 nt, Human
ccuucagugcccac

SEQ ID NO: 3469961 - RNA, 13 nt, Human
ccuucagugccuu

SEQ ID NO: 3469962 - RNA, 15 nt, Human
ccuucagugccuuau

SEQ ID NO: 3469963 - RNA, 19 nt, Human
ccuucagugccuuauggaa

SEQ ID NO: 3469964 - RNA, 15 nt, Human
ccuucaucuccaggg

SEQ ID NO: 3469965 - RNA, 15 nt, Human
ccuucaucuuccugu

SEQ ID NO: 3469966 - RNA, 16 nt, Human
ccuucaucuuccugug

SEQ ID NO: 3469967 - RNA, 18 nt, Human
ccuucaucuuccuguguc

SEQ ID NO: 3469968 - RNA, 22 nt, Human
ccuucaucuuccuguguccuga

SEQ ID NO: 3469969 - RNA, 13 nt, Human
ccuucaucuuuua

SEQ ID NO: 3469970 - RNA, 17 nt, Human
ccuucaugacagccucc

SEQ ID NO: 3469971 - RNA, 21 nt, Human
ccuucaugcauggaaauuccc

SEQ ID NO: 3469972 - RNA, 16 nt, Human
ccuucauggccccagc

SEQ ID NO: 3469973 - RNA, 19 nt, Human
ccuucauuucaggagggau

SEQ ID NO: 3469974 - RNA, 19 nt, Human
ccuucauuucugauauaga

SEQ ID NO: 3469975 - RNA, 16 nt, Human
ccuuccaacaggagcu

SEQ ID NO: 3469976 - RNA, 19 nt, Human
ccuuccaacaggagcuggg

SEQ ID NO: 3469977 - RNA, 16 nt, Human
ccuuccaacugcugcc

SEQ ID NO: 3469978 - RNA, 15 nt, Human
ccuuccaagagccug

SEQ ID NO: 3469979 - RNA, 18 nt, Human
ccuuccaaugucuggaga

SEQ ID NO: 3469980 - RNA, 19 nt, Human
ccuuccaaugucuggagac

SEQ ID NO: 3469981 - RNA, 15 nt, Human
ccuuccacaccccca

SEQ ID NO: 3469982 - RNA, 18 nt, Human
ccuuccacacccccaccc

SEQ ID NO: 3469983 - RNA, 16 nt, Human
ccuuccaccucuggga

SEQ ID NO: 3469984 - RNA, 15 nt, Human
ccuuccaccugcucu

SEQ ID NO: 3469985 - RNA, 18 nt, Human
ccuuccaccugcucugcu

SEQ ID NO: 3469986 - RNA, 18 nt, Human
ccuuccacgcugucucca

SEQ ID NO: 3469987 - RNA, 16 nt, Human
ccuuccacggacucaa

SEQ ID NO: 3469988 - RNA, 15 nt, Human
ccuuccacugagggc

SEQ ID NO: 3469989 - RNA, 16 nt, Human
ccuuccacugccucug

SEQ ID NO: 3469990 - RNA, 18 nt, Human
ccuuccacugccucugcc

SEQ ID NO: 3469991 - RNA, 20 nt, Human
ccuuccacugccucugccuu

SEQ ID NO: 3469992 - RNA, 21 nt, Human
ccuuccacugccucugccuua

SEQ ID NO: 3469993 - RNA, 14 nt, Human
ccuuccagacauac

SEQ ID NO: 3469994 - RNA, 10 nt, Human
ccuuccagau

SEQ ID NO: 3469995 - RNA, 14 nt, Human
ccuuccagcccaga

SEQ ID NO: 3469996 - RNA, 15 nt, Human
ccuuccagcuccugu

SEQ ID NO: 3469997 - RNA, 21 nt, Human
aucgccagcugaugacucaag

SEQ ID NO: 3469998 - RNA, 18 nt, Human
aucgcccuggcaggcagg

SEQ ID NO: 3469999 - RNA, 15 nt, Human
aucgccuuccccacc

SEQ ID NO: 3470000 - RNA, 12 nt, Human
aucgccuuuccc

SEQ ID NO: 3470001 - RNA, 22 nt, Human
aucgcggcggagcuggccccgc

SEQ ID NO: 3470002 - RNA, 17 nt, Human
aucgcuccaccuugcag

SEQ ID NO: 3470003 - RNA, 21 nt, Human
aucgcuccaccuugcagcucu

SEQ ID NO: 3470004 - RNA, 16 nt, Human
aucgcugugaugcugg

SEQ ID NO: 3470005 - RNA, 18 nt, Human
aucggaagcagugccuuc

SEQ ID NO: 3470006 - RNA, 20 nt, Human
aucggagaacaugaaucaaa

SEQ ID NO: 3470007 - RNA, 13 nt, Human
aucggagacagug

SEQ ID NO: 3470008 - RNA, 18 nt, Human
aucggagucagccaggag

SEQ ID NO: 3470009 - RNA, 15 nt, Human
aucggcauuuguuuc

SEQ ID NO: 3470010 - RNA, 23 nt, Human
aucggcccacagcucccacccca

SEQ ID NO: 3470011 - RNA, 14 nt, Human
aucggccuccucuu

SEQ ID NO: 3470012 - RNA, 15 nt, Human
aucgggaacaguguu

SEQ ID NO: 3470013 - RNA, 16 nt, Human
aucgggaacaguguuu

SEQ ID NO: 3470014 - RNA, 21 nt, Human
aucggggagguuuucuccccc

SEQ ID NO: 3470015 - RNA, 18 nt, Human
aucggugaaacuaacaga

SEQ ID NO: 3470016 - RNA, 16 nt, Human
aucgguuaacaaauaa

SEQ ID NO: 3470017 - RNA, 12 nt, Human
aucguaaaauua

SEQ ID NO: 3470018 - RNA, 14 nt, Human
aucguaaaauuaag

SEQ ID NO: 3470019 - RNA, 15 nt, Human
aucguaaccagccag

SEQ ID NO: 3470020 - RNA, 16 nt, Human
aucguaaccagccaga

SEQ ID NO: 3470021 - RNA, 15 nt, Human
aucguauagcuguau

SEQ ID NO: 3470022 - RNA, 23 nt, Human
aucguauagcuguauugaaucau

SEQ ID NO: 3470023 - RNA, 14 nt, Human
aucgucacugcuua

SEQ ID NO: 3470024 - RNA, 12 nt, Human
aucguccaggga

SEQ ID NO: 3470025 - RNA, 12 nt, Human
aucgugaaaccc

SEQ ID NO: 3470026 - RNA, 20 nt, Human
aucgugaaacccugucucua

SEQ ID NO: 3470027 - RNA, 23 nt, Human
aucgugaagaagccuguaacacu

SEQ ID NO: 3470028 - RNA, 14 nt, Human
aucgugacaacacu

SEQ ID NO: 3470029 - RNA, 17 nt, Human
aucgugacgcugaauaa

SEQ ID NO: 3470030 - RNA, 18 nt, Human
aucgugacgcugaauaaa

SEQ ID NO: 3470031 - RNA, 18 nt, Human
aucgugccguuacucucc

SEQ ID NO: 3470032 - RNA, 15 nt, Human
aucgugcuaaauuuu

SEQ ID NO: 3470033 - RNA, 16 nt, Human
aucgugcuaaauuuuc

SEQ ID NO: 3470034 - RNA, 16 nt, Human
aucguuauguguguau

SEQ ID NO: 3470035 - RNA, 18 nt, Human
aucguuauguguguauau

SEQ ID NO: 3470036 - RNA, 14 nt, Human
aucguugcccccau

SEQ ID NO: 3470037 - RNA, 14 nt, Human
aucguuuuuguauu

SEQ ID NO: 3470038 - RNA, 20 nt, Human
aucuaaaaauaacuguaauu

SEQ ID NO: 3470039 - RNA, 19 nt, Human
aucuaaaaauagacuuaaa

SEQ ID NO: 3470040 - RNA, 14 nt, Human
aucuaaaaauauac

SEQ ID NO: 3470041 - RNA, 18 nt, Human
aucuaaaaauauacaugu

SEQ ID NO: 3470042 - RNA, 20 nt, Human
aucuaaaauauuauuuuauu

SEQ ID NO: 3470043 - RNA, 22 nt, Human
aucuaaacuggauucacagcuc

SEQ ID NO: 3470044 - RNA, 16 nt, Human
aucuaaacuuuaauau

SEQ ID NO: 3470045 - RNA, 21 nt, Human
aucuaaacuuuaauauguauu

SEQ ID NO: 3470046 - RNA, 22 nt, Human
aucuaaacuuuaauauguauuu

SEQ ID NO: 3470047 - RNA, 12 nt, Human
aucuaaaguuau

SEQ ID NO: 3470048 - RNA, 15 nt, Human
aucuaaaguuauauu

SEQ ID NO: 3470049 - RNA, 22 nt, Human
aucuaaauauugauuucugccu

SEQ ID NO: 3470050 - RNA, 22 nt, Human
aucuaaaucuauuuauuaauau

SEQ ID NO: 3470051 - RNA, 17 nt, Human
aucuaaauggaaccacu

SEQ ID NO: 3470052 - RNA, 15 nt, Human
aucuaaauguugaaa

SEQ ID NO: 3470053 - RNA, 21 nt, Human
aucuaaauugaauaaugguac

SEQ ID NO: 3470054 - RNA, 16 nt, Human
aucuaagaauaauaaa

SEQ ID NO: 3470055 - RNA, 17 nt, Human
aucuaagaauaauaaaa

SEQ ID NO: 3470056 - RNA, 21 nt, Human
aucuaagcagcauuucugaag

SEQ ID NO: 3470057 - RNA, 13 nt, Human
aucuaagccugaa

SEQ ID NO: 3470058 - RNA, 16 nt, Human
aucuaagccuuuccau

SEQ ID NO: 3470059 - RNA, 15 nt, Human
aucuaagcugcagcu

SEQ ID NO: 3470060 - RNA, 14 nt, Human
aucuaagugauaua

SEQ ID NO: 3470061 - RNA, 16 nt, Human
aucuaaguuaauuuaa

SEQ ID NO: 3470062 - RNA, 17 nt, Human
aucuaaguuaauuuaaa

SEQ ID NO: 3470063 - RNA, 17 nt, Human
aucuaauaccucugugu

SEQ ID NO: 3470064 - RNA, 22 nt, Human
aucuaauaccucugugugcucc

SEQ ID NO: 3470065 - RNA, 19 nt, Human
aucuaauauauaugaauaa

SEQ ID NO: 3470066 - RNA, 22 nt, Human
aucuaauauauaugaauaaagu

SEQ ID NO: 3470067 - RNA, 22 nt, Human
aucuaauaucccagaaaaagua

SEQ ID NO: 3470068 - RNA, 13 nt, Human
aucuaauucugau

SEQ ID NO: 3470069 - RNA, 17 nt, Human
aucuaauucuuuaauga

SEQ ID NO: 3470070 - RNA, 14 nt, Human
aucuacacacggug

SEQ ID NO: 3470071 - RNA, 18 nt, Human
aucuacacuccagugaga

SEQ ID NO: 3470072 - RNA, 19 nt, Human
aucuacacuccagugagac

SEQ ID NO: 3470073 - RNA, 22 nt, Human
aucuacagauagagaguuguug

SEQ ID NO: 3470074 - RNA, 20 nt, Human
aucuaccccagacuagaugu

SEQ ID NO: 3470075 - RNA, 17 nt, Human
aucuaccccuuacuuau

SEQ ID NO: 3470076 - RNA, 21 nt, Human
aucuaccuagauuuaauauaa

SEQ ID NO: 3470077 - RNA, 17 nt, Human
aucuaccuucuguaguu

SEQ ID NO: 3470078 - RNA, 21 nt, Human
aucuaccuucuguaguuuuau

SEQ ID NO: 3470079 - RNA, 15 nt, Human
aucuacucaaagcau

SEQ ID NO: 3470080 - RNA, 18 nt, Human
aucuacucccaaguaugg

SEQ ID NO: 3470081 - RNA, 14 nt, Human
aucuacugcauuua

SEQ ID NO: 3470082 - RNA, 13 nt, Human
aucuacuuccaaa

SEQ ID NO: 3470083 - RNA, 15 nt, Human
aucuacuuccaaacu

SEQ ID NO: 3470084 - RNA, 19 nt, Human
aucuacuuccaaacuaauu

SEQ ID NO: 3470085 - RNA, 23 nt, Human
aucuacuucuguaauugugugga

SEQ ID NO: 3470086 - RNA, 12 nt, Human
aucuagaagaaa

SEQ ID NO: 3470087 - RNA, 14 nt, Human
aucuagaagaaaug

SEQ ID NO: 3470088 - RNA, 15 nt, Human
aucuagaagaaauga

SEQ ID NO: 3470089 - RNA, 17 nt, Human
aucuagaagaaaugaaa

SEQ ID NO: 3470090 - RNA, 21 nt, Human
aucuagaagaaaugaaauuuu

SEQ ID NO: 3470091 - RNA, 20 nt, Human
aucuagaagagucuauuguc

SEQ ID NO: 3470092 - RNA, 19 nt, Human
aucuagacccaucuucuuu

SEQ ID NO: 3470093 - RNA, 21 nt, Human
aucuagacucaagguucccag

SEQ ID NO: 3470094 - RNA, 18 nt, Human
aucuagagcuugaugcca

SEQ ID NO: 3470095 - RNA, 17 nt, Human
aucuagaggcuuccuuc

SEQ ID NO: 3470096 - RNA, 23 nt, Human
aucuagaggcuuccuucauuucc

SEQ ID NO: 3470097 - RNA, 19 nt, Human
aucuagauacuguaucaug

SEQ ID NO: 3470098 - RNA, 17 nt, Human
aucuagauguaaauuuu

SEQ ID NO: 3470099 - RNA, 19 nt, Human
aucuagccagugaacauaa

SEQ ID NO: 3470100 - RNA, 16 nt, Human
aucuaggagaggagaa

SEQ ID NO: 3470101 - RNA, 11 nt, Human
aucuaggauuu

SEQ ID NO: 3470102 - RNA, 19 nt, Human
aucuaggggagccuugauu

SEQ ID NO: 3470103 - RNA, 20 nt, Human
aucuaggggagccuugauuc

SEQ ID NO: 3470104 - RNA, 20 nt, Human
aucuaggugaggauugauua

SEQ ID NO: 3470105 - RNA, 22 nt, Human
aucuagguggaguugaaagagu

SEQ ID NO: 3470106 - RNA, 12 nt, Human
aucuagguuuaa

SEQ ID NO: 3470107 - RNA, 13 nt, Human
aucuagguuuaac

SEQ ID NO: 3470108 - RNA, 17 nt, Human
aucuagguuuaacucag

SEQ ID NO: 3470109 - RNA, 14 nt, Human
aucuagguuuauga

SEQ ID NO: 3470110 - RNA, 18 nt, Human
aucuagguuuaugacagu

SEQ ID NO: 3470111 - RNA, 14 nt, Human
aucuaguaugaaau

SEQ ID NO: 3470112 - RNA, 17 nt, Human
aucuagugcagcugauu

SEQ ID NO: 3470113 - RNA, 18 nt, Human
aucuagugcagcugauuu

SEQ ID NO: 3470114 - RNA, 11 nt, Human
aucuaguguug

SEQ ID NO: 3470115 - RNA, 22 nt, Human
aucuaguuauuuacaggaacuu

SEQ ID NO: 3470116 - RNA, 20 nt, Human
aucuaguuccccuguuuauu

SEQ ID NO: 3470117 - RNA, 17 nt, Human
aucuaguuuacagaaaa

SEQ ID NO: 3470118 - RNA, 18 nt, Human
aucuaguuuacagaaaaa

SEQ ID NO: 3470119 - RNA, 20 nt, Human
aucuaguuuacagaaaaauc

SEQ ID NO: 3470120 - RNA, 20 nt, Human
aucuauaaaauagauauaaa

SEQ ID NO: 3470121 - RNA, 16 nt, Human
aucuauaaagaagaac

SEQ ID NO: 3470122 - RNA, 12 nt, Human
aucuauaaagcg

SEQ ID NO: 3470123 - RNA, 17 nt, Human
aucuauaacuacauauu

SEQ ID NO: 3470124 - RNA, 19 nt, Human
aucuauaacuacauauuga

SEQ ID NO: 3470125 - RNA, 11 nt, Human
aucuauaauau

SEQ ID NO: 3470126 - RNA, 13 nt, Human
aucuauaauuuac

SEQ ID NO: 3470127 - RNA, 23 nt, Human
aucuauaauuuaccuaagauuac

SEQ ID NO: 3470128 - RNA, 14 nt, Human
aucuauagaaagug

SEQ ID NO: 3470129 - RNA, 17 nt, Human
aucuauauaaaauaacu

SEQ ID NO: 3470130 - RNA, 20 nt, Human
aucuauauaguaccuuugcu

SEQ ID NO: 3470131 - RNA, 21 nt, Human
aucuauauaguaccuuugcuc

SEQ ID NO: 3470132 - RNA, 14 nt, Human
aucuauauauauaa

SEQ ID NO: 3470133 - RNA, 20 nt, Human
aucuauauauguauaaauau

SEQ ID NO: 3470134 - RNA, 17 nt, Human
aucuauauauguguaug

SEQ ID NO: 3470135 - RNA, 21 nt, Human
aucuauauguacuugucaaag

SEQ ID NO: 3470136 - RNA, 23 nt, Human
aucuauauguacuugucaaagaa

SEQ ID NO: 3470137 - RNA, 12 nt, Human
aucuauauuaga

SEQ ID NO: 3470138 - RNA, 13 nt, Human
aucuauauuuugg

SEQ ID NO: 3470139 - RNA, 15 nt, Human
aucuaucaauaguca

SEQ ID NO: 3470140 - RNA, 20 nt, Human
aucuaucaauagucaagaaa

SEQ ID NO: 3470141 - RNA, 14 nt, Human
aucuaucuauuuga

SEQ ID NO: 3470142 - RNA, 16 nt, Human
aucuaucuauuugagg

SEQ ID NO: 3470143 - RNA, 20 nt, Human
aucuaucugcuuaugcaguu

SEQ ID NO: 3470144 - RNA, 21 nt, Human
aucuaucuggugauuucuagc

SEQ ID NO: 3470145 - RNA, 18 nt, Human
aucuaucuuauauaguuu

SEQ ID NO: 3470146 - RNA, 13 nt, Human
aucuaugauauaa

SEQ ID NO: 3470147 - RNA, 17 nt, Human
aucuaugccaaagauca

SEQ ID NO: 3470148 - RNA, 15 nt, Human
aucuauuaaaaccac

SEQ ID NO: 3470149 - RNA, 18 nt, Human
aucuauuaauauauguau

SEQ ID NO: 3470150 - RNA, 16 nt, Human
aucuauuauacuguau

SEQ ID NO: 3470151 - RNA, 22 nt, Human
aucuauucagacaagcaacagg

SEQ ID NO: 3470152 - RNA, 19 nt, Human
aucuauuccugguagaaua

SEQ ID NO: 3470153 - RNA, 22 nt, Human
aucuauucugagaaaacaagca

SEQ ID NO: 3470154 - RNA, 15 nt, Human
aucuauugggauuuu

SEQ ID NO: 3470155 - RNA, 19 nt, Human
aucuauuguaagauaaaaa

SEQ ID NO: 3470156 - RNA, 13 nt, Human
aucuauuuaagua

SEQ ID NO: 3470157 - RNA, 13 nt, Human
aucuauuuauugg

SEQ ID NO: 3470158 - RNA, 19 nt, Human
aucuauuucauguuuuuga

SEQ ID NO: 3470159 - RNA, 15 nt, Human
aucuauuucuaugag

SEQ ID NO: 3470160 - RNA, 14 nt, Human
aucuauuucugaga

SEQ ID NO: 3470161 - RNA, 14 nt, Human
aucuauuuucuaug

SEQ ID NO: 3470162 - RNA, 15 nt, Human
aucuauuuucuaugu

SEQ ID NO: 3470163 - RNA, 17 nt, Human
aucuauuuugaugcagc

SEQ ID NO: 3470164 - RNA, 21 nt, Human
aucuauuuugaugcagcauuu

SEQ ID NO: 3470165 - RNA, 13 nt, Human
aucuauuuuugga

SEQ ID NO: 3470166 - RNA, 14 nt, Human
aucucaaaaaauaa

SEQ ID NO: 3470167 - RNA, 19 nt, Human
aucucaaaacugcacuguc

SEQ ID NO: 3470168 - RNA, 16 nt, Human
aucucaaauuucuaaa

SEQ ID NO: 3470169 - RNA, 17 nt, Human
aucucaaauuucuaaau

SEQ ID NO: 3470170 - RNA, 19 nt, Human
aucucaauaaagugcuuua

SEQ ID NO: 3470171 - RNA, 22 nt, Human
aucucaauaaagugcuuuaaaa

SEQ ID NO: 3470172 - RNA, 23 nt, Human
aucucaaugaaccauaaauucaa

SEQ ID NO: 3470173 - RNA, 16 nt, Human
aucucaauucuucccu

SEQ ID NO: 3470174 - RNA, 14 nt, Human
aucucaauuugagu

SEQ ID NO: 3470175 - RNA, 16 nt, Human
aucucacauauacaag

SEQ ID NO: 3470176 - RNA, 22 nt, Human
aucucaccccaucccacacccu

SEQ ID NO: 3470177 - RNA, 15 nt, Human
aucucaccuccugcu

SEQ ID NO: 3470178 - RNA, 17 nt, Human
aucucaccuccugcugg

SEQ ID NO: 3470179 - RNA, 20 nt, Human
aucucaccuccugcugggca

SEQ ID NO: 3470180 - RNA, 15 nt, Human
aucucagaaagugcc

SEQ ID NO: 3470181 - RNA, 19 nt, Human
aucucagaaagugccugac

SEQ ID NO: 3470182 - RNA, 20 nt, Human
aucucagaaagugccugaca

SEQ ID NO: 3470183 - RNA, 20 nt, Human
aucucagaauuccuuuucua

SEQ ID NO: 3470184 - RNA, 20 nt, Human
aucucagauguuaaaauaaa

SEQ ID NO: 3470185 - RNA, 16 nt, Human
aucucagcucaucuuc

SEQ ID NO: 3470186 - RNA, 19 nt, Human
aucucaggacacuuccgua

SEQ ID NO: 3470187 - RNA, 14 nt, Human
aucucaggccaccu

SEQ ID NO: 3470188 - RNA, 15 nt, Human
aucucaggccaccug

SEQ ID NO: 3470189 - RNA, 18 nt, Human
aucucaggccagagccaa

SEQ ID NO: 3470190 - RNA, 16 nt, Human
aucucagggaagccca

SEQ ID NO: 3470191 - RNA, 17 nt, Human
aucucagggaagcccag

SEQ ID NO: 3470192 - RNA, 20 nt, Human
aucucagggaagcccagcuc

SEQ ID NO: 3470193 - RNA, 17 nt, Human
aucucaggggcuguuug

SEQ ID NO: 3470194 - RNA, 21 nt, Human
aucucaggggcuguuugagga

SEQ ID NO: 3470195 - RNA, 16 nt, Human
aucucagucaugcaua

SEQ ID NO: 3470196 - RNA, 22 nt, Human
aucucagucaugcauaaauaug

SEQ ID NO: 3470197 - RNA, 19 nt, Human
aucucaguugauuuucugg

SEQ ID NO: 3470198 - RNA, 15 nt, Human
aucucauaauuuaua

SEQ ID NO: 3470199 - RNA, 18 nt, Human
aucucauaccucugacca

SEQ ID NO: 3470200 - RNA, 19 nt, Human
aucucaucucagugaagaa

SEQ ID NO: 3470201 - RNA, 20 nt, Human
aucucaucucagugaagaau

SEQ ID NO: 3470202 - RNA, 16 nt, Human
aucucauucaguauua

SEQ ID NO: 3470203 - RNA, 14 nt, Human
aucucauuggaccc

SEQ ID NO: 3470204 - RNA, 20 nt, Human
aucucauuguucaauuccca

SEQ ID NO: 3470205 - RNA, 13 nt, Human
aucucauuuaagg

SEQ ID NO: 3470206 - RNA, 18 nt, Human
aucucauuuaagggaaaa

SEQ ID NO: 3470207 - RNA, 23 nt, Human
aucucauuuaagggaaaaauaua

SEQ ID NO: 3470208 - RNA, 23 nt, Human
aucucauuuccaagcaaguauua

SEQ ID NO: 3470209 - RNA, 21 nt, Human
aucuccaaaauaaaacuuuuu

SEQ ID NO: 3470210 - RNA, 17 nt, Human
aucuccaagaaugcuga

SEQ ID NO: 3470211 - RNA, 18 nt, Human
aucuccaagaaugcugaa

SEQ ID NO: 3470212 - RNA, 20 nt, Human
aucuccaagaaugcugaaac

SEQ ID NO: 3470213 - RNA, 18 nt, Human
aucuccacaaccucuucc

SEQ ID NO: 3470214 - RNA, 17 nt, Human
aucuccaccagucauuu

SEQ ID NO: 3470215 - RNA, 21 nt, Human
aucuccacccccagcugcuug

SEQ ID NO: 3470216 - RNA, 15 nt, Human
aucuccaccugcucc

SEQ ID NO: 3470217 - RNA, 15 nt, Human
aucuccacuccagau

SEQ ID NO: 3470218 - RNA, 20 nt, Human
aucuccagggaguccccucc

SEQ ID NO: 3470219 - RNA, 14 nt, Human
aucuccauggcuuc

SEQ ID NO: 3470220 - RNA, 18 nt, Human
aucuccauggcuuccucc

SEQ ID NO: 3470221 - RNA, 22 nt, Human
aucuccauggcuuccuccuccc

SEQ ID NO: 3470222 - RNA, 22 nt, Human
aucuccauugugccuaagucca

SEQ ID NO: 3470223 - RNA, 20 nt, Human
aucucccaagcuaucuaaag

SEQ ID NO: 3470224 - RNA, 19 nt, Human
aucucccaccuagcagcac

SEQ ID NO: 3470225 - RNA, 16 nt, Human
aucuccccaucauugg

SEQ ID NO: 3470226 - RNA, 12 nt, Human
aucucccccagc

SEQ ID NO: 3470227 - RNA, 15 nt, Human
aucucccccagcccc

SEQ ID NO: 3470228 - RNA, 21 nt, Human
aucucccccagccccauccuc

SEQ ID NO: 3470229 - RNA, 14 nt, Human
aucuccccucagcu

SEQ ID NO: 3470230 - RNA, 15 nt, Human
aucuccccucagcuc

SEQ ID NO: 3470231 - RNA, 16 nt, Human
aucuccccucagcucg

SEQ ID NO: 3470232 - RNA, 18 nt, Human
aucucccugccuggcccc

SEQ ID NO: 3470233 - RNA, 10 nt, Human
aucucccugg

SEQ ID NO: 3470234 - RNA, 18 nt, Human
aucucccuucacaaguuu

SEQ ID NO: 3470235 - RNA, 14 nt, Human
aucuccggcuccca

SEQ ID NO: 3470236 - RNA, 18 nt, Human
aucuccuauaaucuguca

SEQ ID NO: 3470237 - RNA, 19 nt, Human
aucuccuauaaucugucaa

SEQ ID NO: 3470238 - RNA, 13 nt, Human
aucuccuauuuuu

SEQ ID NO: 3470239 - RNA, 22 nt, Human
aucuccuauuuuuuuaaaauca

SEQ ID NO: 3470240 - RNA, 13 nt, Human
aucuccucacuga

SEQ ID NO: 3470241 - RNA, 21 nt, Human
aucuccugaggaucagaaagu

SEQ ID NO: 3470242 - RNA, 14 nt, Human
aucuccugugcaug

SEQ ID NO: 3470243 - RNA, 15 nt, Human
aucuccugugcaugg

SEQ ID NO: 3470244 - RNA, 19 nt, Human
aucucguauagaagucuuc

SEQ ID NO: 3470245 - RNA, 14 nt, Human
aucucgugggagag

SEQ ID NO: 3470246 - RNA, 20 nt, Human
aucucuaacagcucaggauc

SEQ ID NO: 3470247 - RNA, 19 nt, Human
aucucuaccuucuccccag

SEQ ID NO: 3470248 - RNA, 18 nt, Human
aucucuagaauuuuaagu

SEQ ID NO: 3470249 - RNA, 13 nt, Human
aucucuauuuaau

SEQ ID NO: 3470250 - RNA, 15 nt, Human
aucucuauuuaauau

SEQ ID NO: 3470251 - RNA, 17 nt, Human
aucucuauuuaauauuu

SEQ ID NO: 3470252 - RNA, 17 nt, Human
aucucucaggagcacag

SEQ ID NO: 3470253 - RNA, 18 nt, Human
aucucucaggagcacagg

SEQ ID NO: 3470254 - RNA, 22 nt, Human
aucucucaggagcacaggcagc

SEQ ID NO: 3470255 - RNA, 16 nt, Human
aucucucauccuccag

SEQ ID NO: 3470256 - RNA, 15 nt, Human
aucucucccuccccu

SEQ ID NO: 3470257 - RNA, 23 nt, Human
aucucucccuccccugccauuuu

SEQ ID NO: 3470258 - RNA, 19 nt, Human
aucucucgguuccacgucc

SEQ ID NO: 3470259 - RNA, 17 nt, Human
aucucucucuguugugu

SEQ ID NO: 3470260 - RNA, 18 nt, Human
aucucucugcagcugccg

SEQ ID NO: 3470261 - RNA, 18 nt, Human
aucucucugugcugugga

SEQ ID NO: 3470262 - RNA, 23 nt, Human
aucucucugugcuguggaagcaa

SEQ ID NO: 3470263 - RNA, 11 nt, Human
aucucugaaag

SEQ ID NO: 3470264 - RNA, 20 nt, Human
aucucugcacccuggggccu

SEQ ID NO: 3470265 - RNA, 22 nt, Human
aucucugcaggaaauggcugug

SEQ ID NO: 3470266 - RNA, 16 nt, Human
aucucugcuuuggaaa

SEQ ID NO: 3470267 - RNA, 17 nt, Human
aucucuguaaagcuaaa

SEQ ID NO: 3470268 - RNA, 18 nt, Human
aucucuguacuuugcuug

SEQ ID NO: 3470269 - RNA, 19 nt, Human
aucucugucccauucccug

SEQ ID NO: 3470270 - RNA, 19 nt, Human
aucucugucuaccaucucc

SEQ ID NO: 3470271 - RNA, 13 nt, Human
aucucugugccuu

SEQ ID NO: 3470272 - RNA, 15 nt, Human
aucucugugccuucg

SEQ ID NO: 3470273 - RNA, 17 nt, Human
aucucugugugcacaaa

SEQ ID NO: 3470274 - RNA, 16 nt, Human
aucucuguuauguacu

SEQ ID NO: 3470275 - RNA, 15 nt, Human
aucucuuaaauuggg

SEQ ID NO: 3470276 - RNA, 22 nt, Human
aucucuuaagacagcauguguu

SEQ ID NO: 3470277 - RNA, 18 nt, Human
aucucuuagcauuuuaau

SEQ ID NO: 3470278 - RNA, 13 nt, Human
aucucuuagcucc

SEQ ID NO: 3470279 - RNA, 12 nt, Human
aucucuucaguc

SEQ ID NO: 3470280 - RNA, 11 nt, Human
aucucuuccug

SEQ ID NO: 3470281 - RNA, 13 nt, Human
aucucuucuuaau

SEQ ID NO: 3470282 - RNA, 14 nt, Human
aucucuucuuuuaa

SEQ ID NO: 3470283 - RNA, 15 nt, Human
aucucuuucuaaaga

SEQ ID NO: 3470284 - RNA, 15 nt, Human
aucucuuugaauuuu

SEQ ID NO: 3470285 - RNA, 13 nt, Human
aucugaaaacugg

SEQ ID NO: 3470286 - RNA, 22 nt, Human
aucugaaaauguauguguaagu

SEQ ID NO: 3470287 - RNA, 16 nt, Human
augaaacuuuuggaag

SEQ ID NO: 3470288 - RNA, 12 nt, Human
augaaagaaaau

SEQ ID NO: 3470289 - RNA, 13 nt, Human
augaaagacugua

SEQ ID NO: 3470290 - RNA, 13 nt, Human
augaaagauuaaa

SEQ ID NO: 3470291 - RNA, 19 nt, Human
augaaagauuaaacagaug

SEQ ID NO: 3470292 - RNA, 21 nt, Human
augaaagcaacaaagaaaucc

SEQ ID NO: 3470293 - RNA, 15 nt, Human
augaaagcagggacu

SEQ ID NO: 3470294 - RNA, 19 nt, Human
augaaagcauggcuaauag

SEQ ID NO: 3470295 - RNA, 22 nt, Human
augaaagcuccucgagggcagg

SEQ ID NO: 3470296 - RNA, 16 nt, Human
augaaaggcuuuuaaa

SEQ ID NO: 3470297 - RNA, 13 nt, Human
augaaaggugcca

SEQ ID NO: 3470298 - RNA, 22 nt, Human
augaaaggugccauggaagagg

SEQ ID NO: 3470299 - RNA, 22 nt, Human
augaaauaaagacccaggggga

SEQ ID NO: 3470300 - RNA, 19 nt, Human
augaaauaaaucauguuaa

SEQ ID NO: 3470301 - RNA, 22 nt, Human
augaaauaggagggaaaccuuu

SEQ ID NO: 3470302 - RNA, 15 nt, Human
augaaauauauguga

SEQ ID NO: 3470303 - RNA, 17 nt, Human
augaaauauaugugaaa

SEQ ID NO: 3470304 - RNA, 13 nt, Human
augaaauaucaga

SEQ ID NO: 3470305 - RNA, 19 nt, Human
augaaauaucagacuagug

SEQ ID NO: 3470306 - RNA, 15 nt, Human
augaaauaucuguau

SEQ ID NO: 3470307 - RNA, 14 nt, Human
augaaaugaacaca

SEQ ID NO: 3470308 - RNA, 14 nt, Human
augaaaugagguca

SEQ ID NO: 3470309 - RNA, 14 nt, Human
augaaaugcuaugu

SEQ ID NO: 3470310 - RNA, 21 nt, Human
augaaauggagucauuugagu

SEQ ID NO: 3470311 - RNA, 21 nt, Human
augaaaugugcacuuuauccu

SEQ ID NO: 3470312 - RNA, 22 nt, Human
augaaauugucuagcagagcag

SEQ ID NO: 3470313 - RNA, 18 nt, Human
augaaauuuuaccaaguu

SEQ ID NO: 3470314 - RNA, 22 nt, Human
augaaauuuucuagacuuucug

SEQ ID NO: 3470315 - RNA, 16 nt, Human
augaaauuuuuguaaa

SEQ ID NO: 3470316 - RNA, 19 nt, Human
augaacaaaauuauuugua

SEQ ID NO: 3470317 - RNA, 18 nt, Human
augaacaaauugaacucu

SEQ ID NO: 3470318 - RNA, 14 nt, Human
augaacaagagaag

SEQ ID NO: 3470319 - RNA, 16 nt, Human
augaacacaaauuaug

SEQ ID NO: 3470320 - RNA, 13 nt, Human
augaacacacugu

SEQ ID NO: 3470321 - RNA, 18 nt, Human
augaacacaucagcuagc

SEQ ID NO: 3470322 - RNA, 14 nt, Human
augaacacucccca

SEQ ID NO: 3470323 - RNA, 18 nt, Human
augaacacuuaaauuaug

SEQ ID NO: 3470324 - RNA, 16 nt, Human
augaacacuuaauaaa

SEQ ID NO: 3470325 - RNA, 16 nt, Human
augaacagaacauaga

SEQ ID NO: 3470326 - RNA, 12 nt, Human
augaacagacuu

SEQ ID NO: 3470327 - RNA, 14 nt, Human
augaacaucccuuu

SEQ ID NO: 3470328 - RNA, 15 nt, Human
augaacauguuccug

SEQ ID NO: 3470329 - RNA, 15 nt, Human
augaacauguuuuag

SEQ ID NO: 3470330 - RNA, 12 nt, Human
augaacauucca

SEQ ID NO: 3470331 - RNA, 23 nt, Human
augaaccacaucuugcucugcug

SEQ ID NO: 3470332 - RNA, 17 nt, Human
augaaccuggagggcua

SEQ ID NO: 3470333 - RNA, 21 nt, Human
augaaccuucuggccucccac

SEQ ID NO: 3470334 - RNA, 16 nt, Human
augaacucuuaaucaa

SEQ ID NO: 3470335 - RNA, 20 nt, Human
augaacucuuagaaaugaag

SEQ ID NO: 3470336 - RNA, 17 nt, Human
augaacugaaguuucac

SEQ ID NO: 3470337 - RNA, 19 nt, Human
augaacugaaguuucacau

SEQ ID NO: 3470338 - RNA, 20 nt, Human
augaacugaaguuucacaug

SEQ ID NO: 3470339 - RNA, 18 nt, Human
augaacugcauguauaaa

SEQ ID NO: 3470340 - RNA, 12 nt, Human
augaacuggagg

SEQ ID NO: 3470341 - RNA, 13 nt, Human
augaacuuaacau

SEQ ID NO: 3470342 - RNA, 20 nt, Human
augaacuuaacaugcugugu

SEQ ID NO: 3470343 - RNA, 13 nt, Human
augaacuucgcau

SEQ ID NO: 3470344 - RNA, 17 nt, Human
augaacuucgcaucaaa

SEQ ID NO: 3470345 - RNA, 16 nt, Human
augaacuugaggacac

SEQ ID NO: 3470346 - RNA, 21 nt, Human
augaacuugaggacacauguc

SEQ ID NO: 3470347 - RNA, 22 nt, Human
augaacuugaggacacaugucc

SEQ ID NO: 3470348 - RNA, 22 nt, Human
augaagaaaaaauacauuuuau

SEQ ID NO: 3470349 - RNA, 15 nt, Human
augaagaaaauacuu

SEQ ID NO: 3470350 - RNA, 19 nt, Human
augaagaaaauacuuaaau

SEQ ID NO: 3470351 - RNA, 14 nt, Human
augaagaaagugga

SEQ ID NO: 3470352 - RNA, 16 nt, Human
augaagaauuuaaaga

SEQ ID NO: 3470353 - RNA, 19 nt, Human
augaagaccuuuuucugca

SEQ ID NO: 3470354 - RNA, 21 nt, Human
augaagaccuuuuucugcacu

SEQ ID NO: 3470355 - RNA, 20 nt, Human
augaagagauuuuucaugau

SEQ ID NO: 3470356 - RNA, 18 nt, Human
augaagagcuagagaaau

SEQ ID NO: 3470357 - RNA, 16 nt, Human
augaagagcuguugau

SEQ ID NO: 3470358 - RNA, 18 nt, Human
augaagagcuugcuuuga

SEQ ID NO: 3470359 - RNA, 18 nt, Human
augaagauaccaucagca

SEQ ID NO: 3470360 - RNA, 15 nt, Human
augaagauacugaaa

SEQ ID NO: 3470361 - RNA, 22 nt, Human
augaagaucuaaauaaaaugcu

SEQ ID NO: 3470362 - RNA, 15 nt, Human
augaagaugaugcua

SEQ ID NO: 3470363 - RNA, 14 nt, Human
augaagcaaacaca

SEQ ID NO: 3470364 - RNA, 16 nt, Human
augaagcaaggaagau

SEQ ID NO: 3470365 - RNA, 23 nt, Human
augaagcauuuacuuuguguuca

SEQ ID NO: 3470366 - RNA, 23 nt, Human
augaagccacagcccaggccucc

SEQ ID NO: 3470367 - RNA, 17 nt, Human
augaagcccaagugaaa

SEQ ID NO: 3470368 - RNA, 19 nt, Human
augaagccgaccuuagauu

SEQ ID NO: 3470369 - RNA, 16 nt, Human
augaagccuuagccag

SEQ ID NO: 3470370 - RNA, 16 nt, Human
augaagccuuuugaaa

SEQ ID NO: 3470371 - RNA, 13 nt, Human
augaagcuugugu

SEQ ID NO: 3470372 - RNA, 23 nt, Human
augaagcuuuauacguguagcua

SEQ ID NO: 3470373 - RNA, 18 nt, Human
augaagcuuuuaugugaa

SEQ ID NO: 3470374 - RNA, 20 nt, Human
augaagcuuuuaugugaaac

SEQ ID NO: 3470375 - RNA, 16 nt, Human
augaaggcaaaaaaau

SEQ ID NO: 3470376 - RNA, 17 nt, Human
augaagggaaaggauau

SEQ ID NO: 3470377 - RNA, 19 nt, Human
augaagguuucugaaaauu

SEQ ID NO: 3470378 - RNA, 18 nt, Human
augaagguuuuuguaaag

SEQ ID NO: 3470379 - RNA, 13 nt, Human
augaaguaaagaa

SEQ ID NO: 3470380 - RNA, 21 nt, Human
augaaguaacuugucuuaaau

SEQ ID NO: 3470381 - RNA, 21 nt, Human
augaaguaauaugcacacauu

SEQ ID NO: 3470382 - RNA, 17 nt, Human
augaaguauauaauggu

SEQ ID NO: 3470383 - RNA, 23 nt, Human
augaagucuuaaggacaaagugc

SEQ ID NO: 3470384 - RNA, 16 nt, Human
augaagugcgugaaug

SEQ ID NO: 3470385 - RNA, 18 nt, Human
augaagugcgugaaugua

SEQ ID NO: 3470386 - RNA, 15 nt, Human
augaaguguuagaua

SEQ ID NO: 3470387 - RNA, 15 nt, Human
augaaguuuaaaaca

SEQ ID NO: 3470388 - RNA, 17 nt, Human
augaaguuuauacagua

SEQ ID NO: 3470389 - RNA, 18 nt, Human
augaaguuugaauguuaa

SEQ ID NO: 3470390 - RNA, 23 nt, Human
augaaguuuuuuuuauacaggau

SEQ ID NO: 3470391 - RNA, 13 nt, Human
augaauacaaauu

SEQ ID NO: 3470392 - RNA, 21 nt, Human
augaauacuuuauaaaggauu

SEQ ID NO: 3470393 - RNA, 20 nt, Human
augaauauauggcauuugca

SEQ ID NO: 3470394 - RNA, 22 nt, Human
augaauauauggcauuugcaga

SEQ ID NO: 3470395 - RNA, 21 nt, Human
augaauaucuauuaauauaug

SEQ ID NO: 3470396 - RNA, 17 nt, Human
augaauauugaaguuuc

SEQ ID NO: 3470397 - RNA, 12 nt, Human
augaauauuuau

SEQ ID NO: 3470398 - RNA, 18 nt, Human
augaauauuuauaacagc

SEQ ID NO: 3470399 - RNA, 15 nt, Human
augaauauuuugaua

SEQ ID NO: 3470400 - RNA, 20 nt, Human
augaauauuuugauaauaau

SEQ ID NO: 3470401 - RNA, 18 nt, Human
augaaucacuguuuuuag

SEQ ID NO: 3470402 - RNA, 21 nt, Human
augaaucccacccacauguga

SEQ ID NO: 3470403 - RNA, 20 nt, Human
augaaucgcuucucuuuuga

SEQ ID NO: 3470404 - RNA, 16 nt, Human
augaaucuaagcagca

SEQ ID NO: 3470405 - RNA, 15 nt, Human
augaaucugauuuuu

SEQ ID NO: 3470406 - RNA, 22 nt, Human
augaaucugauuuuuaugauga

SEQ ID NO: 3470407 - RNA, 18 nt, Human
augaaucugcacaucugu

SEQ ID NO: 3470408 - RNA, 14 nt, Human
augaaucugcucac

SEQ ID NO: 3470409 - RNA, 13 nt, Human
augaaugaauggc

SEQ ID NO: 3470410 - RNA, 19 nt, Human
augaaugaggucccaggca

SEQ ID NO: 3470411 - RNA, 20 nt, Human
augaaugaggucccaggcag

SEQ ID NO: 3470412 - RNA, 15 nt, Human
augaaugaggucugg

SEQ ID NO: 3470413 - RNA, 19 nt, Human
augaaugaggucugggcua

SEQ ID NO: 3470414 - RNA, 18 nt, Human
augaaugcccccagcugg

SEQ ID NO: 3470415 - RNA, 12 nt, Human
augaaugcuuaa

SEQ ID NO: 3470416 - RNA, 20 nt, Human
augaaugcuuaaagaauuca

SEQ ID NO: 3470417 - RNA, 23 nt, Human
augaauggacucaaacugccuug

SEQ ID NO: 3470418 - RNA, 23 nt, Human
augaauggcucacuauggugcca

SEQ ID NO: 3470419 - RNA, 12 nt, Human
augaauguaaau

SEQ ID NO: 3470420 - RNA, 13 nt, Human
augaauguaaauu

SEQ ID NO: 3470421 - RNA, 16 nt, Human
augaauguaaauuugu

SEQ ID NO: 3470422 - RNA, 15 nt, Human
augaauguaucagga

SEQ ID NO: 3470423 - RNA, 19 nt, Human
augaauguaugugcacugu

SEQ ID NO: 3470424 - RNA, 21 nt, Human
augaaugucacuucuggauau

SEQ ID NO: 3470425 - RNA, 22 nt, Human
augaaugucuuuuuucaaacuu

SEQ ID NO: 3470426 - RNA, 15 nt, Human
augaaugugaagccu

SEQ ID NO: 3470427 - RNA, 17 nt, Human
augaaugugaagccuuc

SEQ ID NO: 3470428 - RNA, 18 nt, Human
augaaugugaagccuucc

SEQ ID NO: 3470429 - RNA, 12 nt, Human
augaauguguaa

SEQ ID NO: 3470430 - RNA, 14 nt, Human
augaauuaaauaaa

SEQ ID NO: 3470431 - RNA, 15 nt, Human
augucaugcugccuu

SEQ ID NO: 3470432 - RNA, 16 nt, Human
augucaugcugccuua

SEQ ID NO: 3470433 - RNA, 13 nt, Human
augucauguguuc

SEQ ID NO: 3470434 - RNA, 17 nt, Human
augucauuaaaauaaau

SEQ ID NO: 3470435 - RNA, 20 nt, Human
augucauuaaaauaaauaaa

SEQ ID NO: 3470436 - RNA, 17 nt, Human
augucauuaauguguug

SEQ ID NO: 3470437 - RNA, 17 nt, Human
augucauuucagaaguu

SEQ ID NO: 3470438 - RNA, 14 nt, Human
augucauuucaugu

SEQ ID NO: 3470439 - RNA, 15 nt, Human
augucauuucauuuc

SEQ ID NO: 3470440 - RNA, 16 nt, Human
auguccaacccgucug

SEQ ID NO: 3470441 - RNA, 16 nt, Human
auguccaagaagccca

SEQ ID NO: 3470442 - RNA, 19 nt, Human
auguccaagaagcccagga

SEQ ID NO: 3470443 - RNA, 14 nt, Human
auguccacugugua

SEQ ID NO: 3470444 - RNA, 17 nt, Human
auguccacuguguauag

SEQ ID NO: 3470445 - RNA, 21 nt, Human
auguccagaagaauauucagg

SEQ ID NO: 3470446 - RNA, 20 nt, Human
auguccaguaagaucacugu

SEQ ID NO: 3470447 - RNA, 19 nt, Human
auguccauuuauaucauuu

SEQ ID NO: 3470448 - RNA, 20 nt, Human
augucccaacuuguaaaaau

SEQ ID NO: 3470449 - RNA, 17 nt, Human
augucccauuuucagac

SEQ ID NO: 3470450 - RNA, 14 nt, Human
auguccccucccag

SEQ ID NO: 3470451 - RNA, 19 nt, Human
augucccuagaaaacaaug

SEQ ID NO: 3470452 - RNA, 16 nt, Human
augucccugggccagg

SEQ ID NO: 3470453 - RNA, 14 nt, Human
augucccuucucau

SEQ ID NO: 3470454 - RNA, 19 nt, Human
augucccuugaugcacaga

SEQ ID NO: 3470455 - RNA, 21 nt, Human
augucccuugaugcacagaga

SEQ ID NO: 3470456 - RNA, 23 nt, Human
augucccuugaugcacagagaag

SEQ ID NO: 3470457 - RNA, 16 nt, Human
augucccuuucuuggc

SEQ ID NO: 3470458 - RNA, 13 nt, Human
auguccuaugugu

SEQ ID NO: 3470459 - RNA, 15 nt, Human
auguccuauguguga

SEQ ID NO: 3470460 - RNA, 15 nt, Human
auguccucaccacau

SEQ ID NO: 3470461 - RNA, 18 nt, Human
auguccuccagaagccuc

SEQ ID NO: 3470462 - RNA, 17 nt, Human
auguccuccuuguucua

SEQ ID NO: 3470463 - RNA, 13 nt, Human
auguccuguaaac

SEQ ID NO: 3470464 - RNA, 23 nt, Human
auguccuguaaacacucagcugu

SEQ ID NO: 3470465 - RNA, 23 nt, Human
auguccuugugaugugcacguaa

SEQ ID NO: 3470466 - RNA, 22 nt, Human
augucguaguuacucucaggca

SEQ ID NO: 3470467 - RNA, 19 nt, Human
augucgugaccaacuagac

SEQ ID NO: 3470468 - RNA, 20 nt, Human
augucgugaccaacuagaca

SEQ ID NO: 3470469 - RNA, 21 nt, Human
augucgugaccaacuagacau

SEQ ID NO: 3470470 - RNA, 22 nt, Human
augucgugaccaacuagacauu

SEQ ID NO: 3470471 - RNA, 11 nt, Human
augucuaaaga

SEQ ID NO: 3470472 - RNA, 19 nt, Human
augucuaaaugcugaaaaa

SEQ ID NO: 3470473 - RNA, 21 nt, Human
augucuaauguauuuuauugu

SEQ ID NO: 3470474 - RNA, 23 nt, Human
augucuagaccaggaccucccuc

SEQ ID NO: 3470475 - RNA, 10 nt, Human
augucuauaa

SEQ ID NO: 3470476 - RNA, 22 nt, Human
augucuauaaaccgaacugaug

SEQ ID NO: 3470477 - RNA, 22 nt, Human
augucuauaaucccagcacuuu

SEQ ID NO: 3470478 - RNA, 20 nt, Human
augucuaucaacuuuaauca

SEQ ID NO: 3470479 - RNA, 13 nt, Human
augucuauugucc

SEQ ID NO: 3470480 - RNA, 17 nt, Human
augucucaggucccugc

SEQ ID NO: 3470481 - RNA, 20 nt, Human
augucuccuaagcaccugua

SEQ ID NO: 3470482 - RNA, 13 nt, Human
augucuccucccc

SEQ ID NO: 3470483 - RNA, 16 nt, Human
augucucgcuagugau

SEQ ID NO: 3470484 - RNA, 14 nt, Human
augucucuaaagca

SEQ ID NO: 3470485 - RNA, 16 nt, Human
augucucucagaauuc

SEQ ID NO: 3470486 - RNA, 22 nt, Human
augucucucaugaccaaaugcu

SEQ ID NO: 3470487 - RNA, 23 nt, Human
augucucugugagacucgagaac

SEQ ID NO: 3470488 - RNA, 23 nt, Human
augucucuuuaaugucacaggca

SEQ ID NO: 3470489 - RNA, 19 nt, Human
augucugcagcccugagaa

SEQ ID NO: 3470490 - RNA, 22 nt, Human
augucuggagaauaauucuuug

SEQ ID NO: 3470491 - RNA, 13 nt, Human
augucugguucuc

SEQ ID NO: 3470492 - RNA, 23 nt, Human
augucugguucucaauuccaaca

SEQ ID NO: 3470493 - RNA, 19 nt, Human
augucuguagcuccucaac

SEQ ID NO: 3470494 - RNA, 12 nt, Human
augucugugcua

SEQ ID NO: 3470495 - RNA, 14 nt, Human
augucuguggauuu

SEQ ID NO: 3470496 - RNA, 21 nt, Human
augucuguggccuuguucucu

SEQ ID NO: 3470497 - RNA, 20 nt, Human
augucuguuaccaugucacu

SEQ ID NO: 3470498 - RNA, 17 nt, Human
augucuguuuaagaaaa

SEQ ID NO: 3470499 - RNA, 19 nt, Human
augucuguuuaagaaaagu

SEQ ID NO: 3470500 - RNA, 15 nt, Human
augucuguuugcuga

SEQ ID NO: 3470501 - RNA, 16 nt, Human
augucuuaaugaaguu

SEQ ID NO: 3470502 - RNA, 19 nt, Human
augucuuaaugaaguuuga

SEQ ID NO: 3470503 - RNA, 23 nt, Human
augucuuaaugaaguuugaaugu

SEQ ID NO: 3470504 - RNA, 17 nt, Human
augucuucauuucauug

SEQ ID NO: 3470505 - RNA, 19 nt, Human
augucuucauuucauugua

SEQ ID NO: 3470506 - RNA, 20 nt, Human
augucuucauuucauuguau

SEQ ID NO: 3470507 - RNA, 14 nt, Human
augucuucucacaa

SEQ ID NO: 3470508 - RNA, 14 nt, Human
augucuucugccug

SEQ ID NO: 3470509 - RNA, 17 nt, Human
augucuucugccuguua

SEQ ID NO: 3470510 - RNA, 15 nt, Human
augucuugagcucua

SEQ ID NO: 3470511 - RNA, 21 nt, Human
augucuugagcucuauuauga

SEQ ID NO: 3470512 - RNA, 23 nt, Human
augucuugaugcaugcacuguuc

SEQ ID NO: 3470513 - RNA, 22 nt, Human
augucuugcuguugacauauuu

SEQ ID NO: 3470514 - RNA, 16 nt, Human
augucuuggacacugu

SEQ ID NO: 3470515 - RNA, 17 nt, Human
augucuuguacaugugu

SEQ ID NO: 3470516 - RNA, 10 nt, Human
augucuugug

SEQ ID NO: 3470517 - RNA, 20 nt, Human
augucuuguuaauauucuuu

SEQ ID NO: 3470518 - RNA, 16 nt, Human
augucuuuaaugcaau

SEQ ID NO: 3470519 - RNA, 18 nt, Human
augucuuuccaaauuauu

SEQ ID NO: 3470520 - RNA, 21 nt, Human
augucuuuccaaauuauuucu

SEQ ID NO: 3470521 - RNA, 21 nt, Human
augucuuugguccucuugcca

SEQ ID NO: 3470522 - RNA, 21 nt, Human
augucuuuguaagucaguguu

SEQ ID NO: 3470523 - RNA, 21 nt, Human
augucuuuuauaguggaaaaa

SEQ ID NO: 3470524 - RNA, 17 nt, Human
augucuuuuauauuugu

SEQ ID NO: 3470525 - RNA, 17 nt, Human
augucuuuucccauuua

SEQ ID NO: 3470526 - RNA, 21 nt, Human
augucuuuucccauuuaucua

SEQ ID NO: 3470527 - RNA, 15 nt, Human
augucuuuugaauau

SEQ ID NO: 3470528 - RNA, 16 nt, Human
augucuuuugaauauu

SEQ ID NO: 3470529 - RNA, 22 nt, Human
augucuuuuuauuaaaauauuu

SEQ ID NO: 3470530 - RNA, 19 nt, Human
augucuuuuuuucuguuaa

SEQ ID NO: 3470531 - RNA, 13 nt, Human
augugaaaaaucu

SEQ ID NO: 3470532 - RNA, 14 nt, Human
augugaaaaaucug

SEQ ID NO: 3470533 - RNA, 19 nt, Human
augugaaaaaucugcuguu

SEQ ID NO: 3470534 - RNA, 15 nt, Human
augugaaacauguuu

SEQ ID NO: 3470535 - RNA, 14 nt, Human
augugaaaggauau

SEQ ID NO: 3470536 - RNA, 20 nt, Human
augugaaauuuacaucauuu

SEQ ID NO: 3470537 - RNA, 11 nt, Human
augugaacagu

SEQ ID NO: 3470538 - RNA, 21 nt, Human
augugaacaguuguguuugaa

SEQ ID NO: 3470539 - RNA, 13 nt, Human
augugaacccggg

SEQ ID NO: 3470540 - RNA, 16 nt, Human
augugaacuuguagcu

SEQ ID NO: 3470541 - RNA, 18 nt, Human
augugaacuuguagcugu

SEQ ID NO: 3470542 - RNA, 15 nt, Human
augugaacuuuauua

SEQ ID NO: 3470543 - RNA, 22 nt, Human
augugaagccaauucagacagg

SEQ ID NO: 3470544 - RNA, 14 nt, Human
augugaagccuucc

SEQ ID NO: 3470545 - RNA, 19 nt, Human
augugaaguguuaauacua

SEQ ID NO: 3470546 - RNA, 20 nt, Human
augugaaugaucucucugaa

SEQ ID NO: 3470547 - RNA, 16 nt, Human
augugaaugggaaaag

SEQ ID NO: 3470548 - RNA, 18 nt, Human
augugaauuauugacacu

SEQ ID NO: 3470549 - RNA, 19 nt, Human
augugaauuauugacacug

SEQ ID NO: 3470550 - RNA, 11 nt, Human
augugaauugu

SEQ ID NO: 3470551 - RNA, 12 nt, Human
augugaauuuuu

SEQ ID NO: 3470552 - RNA, 17 nt, Human
augugaauuuuuaagcu

SEQ ID NO: 3470553 - RNA, 21 nt, Human
augugacaauuuuguacaaau

SEQ ID NO: 3470554 - RNA, 16 nt, Human
augugacagguaaacu

SEQ ID NO: 3470555 - RNA, 18 nt, Human
augugacauuugucauuu

SEQ ID NO: 3470556 - RNA, 23 nt, Human
augugacauuugucauuuucauu

SEQ ID NO: 3470557 - RNA, 18 nt, Human
augugacucugaagcuga

SEQ ID NO: 3470558 - RNA, 12 nt, Human
augugacucuuu

SEQ ID NO: 3470559 - RNA, 13 nt, Human
augugacuuugaa

SEQ ID NO: 3470560 - RNA, 14 nt, Human
augugagaagccag

SEQ ID NO: 3470561 - RNA, 15 nt, Human
augugagagaaagug

SEQ ID NO: 3470562 - RNA, 21 nt, Human
augugaggaagaacuacagcu

SEQ ID NO: 3470563 - RNA, 23 nt, Human
augugagugccuuuugcagaaga

SEQ ID NO: 3470564 - RNA, 17 nt, Human
augugaguuuggucugg

SEQ ID NO: 3470565 - RNA, 23 nt, Human
augugaguuuggucuggacugac

SEQ ID NO: 3470566 - RNA, 17 nt, Human
augugauaaggaaauca

SEQ ID NO: 3470567 - RNA, 15 nt, Human
augugauacauuuuu

SEQ ID NO: 3470568 - RNA, 15 nt, Human
augugauauauaagu

SEQ ID NO: 3470569 - RNA, 14 nt, Human
augugauauucuaa

SEQ ID NO: 3470570 - RNA, 16 nt, Human
augugauauucuaaga

SEQ ID NO: 3470571 - RNA, 18 nt, Human
augugaucacgccuggcu

SEQ ID NO: 3470572 - RNA, 17 nt, Human
augugauccuuuuaugu

SEQ ID NO: 3470573 - RNA, 21 nt, Human
augugauccuuuuauguuauu

SEQ ID NO: 3470574 - RNA, 23 nt, Human
augugauccuuuuauguuauuua

SEQ ID NO: 3470575 - RNA, 21 nt, Human
auuagaucaaauaguugcaua

SEQ ID NO: 3470576 - RNA, 18 nt, Human
auuagauccauuaauuua

SEQ ID NO: 3470577 - RNA, 18 nt, Human
auuagaucuucaaacaga

SEQ ID NO: 3470578 - RNA, 19 nt, Human
auuagaucuucaaacagaa

SEQ ID NO: 3470579 - RNA, 13 nt, Human
auuagaugcaugu

SEQ ID NO: 3470580 - RNA, 21 nt, Human
auuagaugcauguugaccaug

SEQ ID NO: 3470581 - RNA, 13 nt, Human
auuagaugugauu

SEQ ID NO: 3470582 - RNA, 21 nt, Human
auuagaugugauuuaauagug

SEQ ID NO: 3470583 - RNA, 19 nt, Human
auuagauguucucuaucau

SEQ ID NO: 3470584 - RNA, 21 nt, Human
auuagauuauauugagacaaa

SEQ ID NO: 3470585 - RNA, 16 nt, Human
auuagauuuuauuuua

SEQ ID NO: 3470586 - RNA, 20 nt, Human
auuagauuuuauuuuacuau

SEQ ID NO: 3470587 - RNA, 21 nt, Human
auuagcaaggucauuucuuca

SEQ ID NO: 3470588 - RNA, 15 nt, Human
auuagcacagauuuu

SEQ ID NO: 3470589 - RNA, 18 nt, Human
auuagcacagauuuuaau

SEQ ID NO: 3470590 - RNA, 23 nt, Human
auuagcacagauuuuaauuguca

SEQ ID NO: 3470591 - RNA, 17 nt, Human
auuagcaguuugcuuug

SEQ ID NO: 3470592 - RNA, 19 nt, Human
auuagcauuugucaacaaa

SEQ ID NO: 3470593 - RNA, 13 nt, Human
auuagccaggauc

SEQ ID NO: 3470594 - RNA, 15 nt, Human
auuagccaggaucau

SEQ ID NO: 3470595 - RNA, 21 nt, Human
auuagccaggaucauggugua

SEQ ID NO: 3470596 - RNA, 23 nt, Human
auuagccaguaauccuguaggaa

SEQ ID NO: 3470597 - RNA, 17 nt, Human
auuagccagugaaaaac

SEQ ID NO: 3470598 - RNA, 13 nt, Human
auuagcucuggac

SEQ ID NO: 3470599 - RNA, 21 nt, Human
auuagcuuauguuaacugaca

SEQ ID NO: 3470600 - RNA, 22 nt, Human
auuagcuuauguuaacugacaa

SEQ ID NO: 3470601 - RNA, 15 nt, Human
auuagcuuuacuguu

SEQ ID NO: 3470602 - RNA, 14 nt, Human
auuagcuuuguguu

SEQ ID NO: 3470603 - RNA, 16 nt, Human
auuagcuuuuucaucc

SEQ ID NO: 3470604 - RNA, 20 nt, Human
auuaggaaguguaacagcug

SEQ ID NO: 3470605 - RNA, 21 nt, Human
auuaggaggcucaacaauaaa

SEQ ID NO: 3470606 - RNA, 21 nt, Human
auuaggcaaggcuaugugauu

SEQ ID NO: 3470607 - RNA, 18 nt, Human
auuaggccagcaacgcuu

SEQ ID NO: 3470608 - RNA, 17 nt, Human
auuagggagaaaauuca

SEQ ID NO: 3470609 - RNA, 18 nt, Human
auuagggagaaaauucaa

SEQ ID NO: 3470610 - RNA, 15 nt, Human
auuagggaugccucc

SEQ ID NO: 3470611 - RNA, 23 nt, Human
auuagggcaauuggaacaaagug

SEQ ID NO: 3470612 - RNA, 18 nt, Human
auuagggcccugugucug

SEQ ID NO: 3470613 - RNA, 16 nt, Human
auuaggguacauuuau

SEQ ID NO: 3470614 - RNA, 15 nt, Human
auuagguauaucucc

SEQ ID NO: 3470615 - RNA, 21 nt, Human
auuaggugugacugaauuucu

SEQ ID NO: 3470616 - RNA, 13 nt, Human
auuagguuaacua

SEQ ID NO: 3470617 - RNA, 19 nt, Human
auuagguuaacuauguaca

SEQ ID NO: 3470618 - RNA, 20 nt, Human
auuagguuaacuauguacaa

SEQ ID NO: 3470619 - RNA, 19 nt, Human
auuagguugaaacauaucu

SEQ ID NO: 3470620 - RNA, 14 nt, Human
auuagguugugaau

SEQ ID NO: 3470621 - RNA, 21 nt, Human
auuagguuuuguacaauugaa

SEQ ID NO: 3470622 - RNA, 14 nt, Human
auuaguaaaugucu

SEQ ID NO: 3470623 - RNA, 21 nt, Human
auuaguaaaugucuuuguaag

SEQ ID NO: 3470624 - RNA, 16 nt, Human
auuaguaacauguguu

SEQ ID NO: 3470625 - RNA, 17 nt, Human
auuaguaacauguguua

SEQ ID NO: 3470626 - RNA, 21 nt, Human
auuaguaacauucauguucua

SEQ ID NO: 3470627 - RNA, 19 nt, Human
auuaguacugcucuuguuu

SEQ ID NO: 3470628 - RNA, 17 nt, Human
auuaguacuggauuauu

SEQ ID NO: 3470629 - RNA, 13 nt, Human
auuaguacuuuau

SEQ ID NO: 3470630 - RNA, 15 nt, Human
auuaguacuuuauag

SEQ ID NO: 3470631 - RNA, 17 nt, Human
auuaguauuguuguccu

SEQ ID NO: 3470632 - RNA, 23 nt, Human
auuaguauuguuguccuuuucau

SEQ ID NO: 3470633 - RNA, 23 nt, Human
auuaguauuuauuuaauguuaug

SEQ ID NO: 3470634 - RNA, 15 nt, Human
auuagucauguuuau

SEQ ID NO: 3470635 - RNA, 23 nt, Human
auuagucauucaauaaauuguaa

SEQ ID NO: 3470636 - RNA, 13 nt, Human
auuagugauauuu

SEQ ID NO: 3470637 - RNA, 16 nt, Human
auuagugauauuucuc

SEQ ID NO: 3470638 - RNA, 21 nt, Human
auuagugccagaauuuuagga

SEQ ID NO: 3470639 - RNA, 13 nt, Human
auuagugcuaagu

SEQ ID NO: 3470640 - RNA, 22 nt, Human
auuaguguaugcuuugaaugua

SEQ ID NO: 3470641 - RNA, 16 nt, Human
auuaguguuauaugaa

SEQ ID NO: 3470642 - RNA, 17 nt, Human
auuaguguuauaugaac

SEQ ID NO: 3470643 - RNA, 20 nt, Human
auuaguuguguacucuggcc

SEQ ID NO: 3470644 - RNA, 15 nt, Human
auuaguuuagaacag

SEQ ID NO: 3470645 - RNA, 21 nt, Human
auuaguuuagaacagguuuuu

SEQ ID NO: 3470646 - RNA, 20 nt, Human
auuaguuuccuuuuuaauau

SEQ ID NO: 3470647 - RNA, 16 nt, Human
auuaguuuucuuguug

SEQ ID NO: 3470648 - RNA, 21 nt, Human
auuaguuuugaagauucuaug

SEQ ID NO: 3470649 - RNA, 18 nt, Human
auuaguuuugcauaauuu

SEQ ID NO: 3470650 - RNA, 14 nt, Human
auuauaaaaauauu

SEQ ID NO: 3470651 - RNA, 22 nt, Human
auuauaaaaauauuaagacaau

SEQ ID NO: 3470652 - RNA, 18 nt, Human
auuauaaaauuaaucaca

SEQ ID NO: 3470653 - RNA, 22 nt, Human
auuauaaacaagaaugaagguu

SEQ ID NO: 3470654 - RNA, 14 nt, Human
auuauaaacgcuua

SEQ ID NO: 3470655 - RNA, 13 nt, Human
auuauaaaguuuu

SEQ ID NO: 3470656 - RNA, 16 nt, Human
auuauaacucauuugu

SEQ ID NO: 3470657 - RNA, 15 nt, Human
auuauaacuuaaaau

SEQ ID NO: 3470658 - RNA, 14 nt, Human
auuauaaggacugc

SEQ ID NO: 3470659 - RNA, 17 nt, Human
auuauaaggacugcaug

SEQ ID NO: 3470660 - RNA, 18 nt, Human
auuauaagggcaaauugg

SEQ ID NO: 3470661 - RNA, 15 nt, Human
auuauaagucuuaca

SEQ ID NO: 3470662 - RNA, 22 nt, Human
auuauaauauacuauauuuaug

SEQ ID NO: 3470663 - RNA, 13 nt, Human
auuauaaugaauu

SEQ ID NO: 3470664 - RNA, 22 nt, Human
auuauaauguauucauauuugu

SEQ ID NO: 3470665 - RNA, 15 nt, Human
auuauaauuguauca

SEQ ID NO: 3470666 - RNA, 23 nt, Human
auuauaauuguaucagaggccua

SEQ ID NO: 3470667 - RNA, 13 nt, Human
auuauaauuguug

SEQ ID NO: 3470668 - RNA, 16 nt, Human
auuauaauuguugcau

SEQ ID NO: 3470669 - RNA, 23 nt, Human
auuauaauuuuuuucaauauuua

SEQ ID NO: 3470670 - RNA, 19 nt, Human
auuauacaaauuaaaaaga

SEQ ID NO: 3470671 - RNA, 22 nt, Human
auuauacagaccgaacuguugu

SEQ ID NO: 3470672 - RNA, 17 nt, Human
auuauacaugaaauuca

SEQ ID NO: 3470673 - RNA, 15 nt, Human
auuauaccuguugcu

SEQ ID NO: 3470674 - RNA, 17 nt, Human
auuauacuaacuuauuu

SEQ ID NO: 3470675 - RNA, 19 nt, Human
auuauacuaagaaaagaua

SEQ ID NO: 3470676 - RNA, 16 nt, Human
auuauacuuguaauua

SEQ ID NO: 3470677 - RNA, 17 nt, Human
auuauacuuguaauuau

SEQ ID NO: 3470678 - RNA, 19 nt, Human
auuauagagcagaaauucu

SEQ ID NO: 3470679 - RNA, 21 nt, Human
auuauagagcagaaauucugu

SEQ ID NO: 3470680 - RNA, 23 nt, Human
auuauagagcagaaauucuguuu

SEQ ID NO: 3470681 - RNA, 15 nt, Human
auuauagauucuaaa

SEQ ID NO: 3470682 - RNA, 16 nt, Human
auuauagauucuaaag

SEQ ID NO: 3470683 - RNA, 18 nt, Human
auuauagauucuaaagau

SEQ ID NO: 3470684 - RNA, 12 nt, Human
auuauagcucua

SEQ ID NO: 3470685 - RNA, 17 nt, Human
auuauagcucuaauguu

SEQ ID NO: 3470686 - RNA, 18 nt, Human
auuauagcucuaauguuu

SEQ ID NO: 3470687 - RNA, 19 nt, Human
auuauagcucuaauguuug

SEQ ID NO: 3470688 - RNA, 22 nt, Human
auuauagcucuaauguuugcau

SEQ ID NO: 3470689 - RNA, 19 nt, Human
auuauaggaauaucaauau

SEQ ID NO: 3470690 - RNA, 19 nt, Human
auuauaggagccuuaauuu

SEQ ID NO: 3470691 - RNA, 19 nt, Human
auuauagguaaucaaugaa

SEQ ID NO: 3470692 - RNA, 21 nt, Human
auuauagguaaucaaugaaua

SEQ ID NO: 3470693 - RNA, 16 nt, Human
auuauaguguagaaaa

SEQ ID NO: 3470694 - RNA, 15 nt, Human
auuauaguuucaagc

SEQ ID NO: 3470695 - RNA, 15 nt, Human
auuauauaacuguau

SEQ ID NO: 3470696 - RNA, 17 nt, Human
auuauauaaguauucua

SEQ ID NO: 3470697 - RNA, 20 nt, Human
auuauauaaguauucuaaau

SEQ ID NO: 3470698 - RNA, 20 nt, Human
auuauauacuuguuguuuaa

SEQ ID NO: 3470699 - RNA, 14 nt, Human
auuauauauauaau

SEQ ID NO: 3470700 - RNA, 13 nt, Human
auuauauauauau

SEQ ID NO: 3470701 - RNA, 19 nt, Human
auuauaucaauuuccucau

SEQ ID NO: 3470702 - RNA, 16 nt, Human
auuauaucuaauuauu

SEQ ID NO: 3470703 - RNA, 21 nt, Human
auuauaucugaggaauucugu

SEQ ID NO: 3470704 - RNA, 18 nt, Human
auuauaucuguggucuuc

SEQ ID NO: 3470705 - RNA, 16 nt, Human
auuauaugcuauuucu

SEQ ID NO: 3470706 - RNA, 17 nt, Human
auuauaugcuauuucua

SEQ ID NO: 3470707 - RNA, 18 nt, Human
auuauaugcuauuucuau

SEQ ID NO: 3470708 - RNA, 17 nt, Human
auuauauggaaauauau

SEQ ID NO: 3470709 - RNA, 18 nt, Human
auuauauguucagauuau

SEQ ID NO: 3470710 - RNA, 13 nt, Human
auuauauuaaaau

SEQ ID NO: 3470711 - RNA, 14 nt, Human
auuauauuaaaaua

SEQ ID NO: 3470712 - RNA, 17 nt, Human
auuauauugagacaaaa

SEQ ID NO: 3470713 - RNA, 18 nt, Human
auuauauuguuaaucaau

SEQ ID NO: 3470714 - RNA, 15 nt, Human
auuauauuuacaaau

SEQ ID NO: 3470715 - RNA, 16 nt, Human
auuauauuuacaaaug

SEQ ID NO: 3470716 - RNA, 15 nt, Human
auuauauuuauuacu

SEQ ID NO: 3470717 - RNA, 22 nt, Human
auuauauuucuauuuuauuaug

SEQ ID NO: 3470718 - RNA, 23 nt, Human
auuauauuucuauuuuauuauga

SEQ ID NO: 3470719 - RNA, 15 nt, Human
auuuauuuccucccu

SEQ ID NO: 3470720 - RNA, 13 nt, Human
auuuauuugaaug

SEQ ID NO: 3470721 - RNA, 15 nt, Human
auuuauuugcuucuu

SEQ ID NO: 3470722 - RNA, 14 nt, Human
auuuauuuuaauaa

SEQ ID NO: 3470723 - RNA, 19 nt, Human
auuuauuuuaauaauguuu

SEQ ID NO: 3470724 - RNA, 15 nt, Human
auuuauuuuauaaga

SEQ ID NO: 3470725 - RNA, 16 nt, Human
auuuauuuuauaagaa

SEQ ID NO: 3470726 - RNA, 20 nt, Human
auuuauuuuauaagaaaaac

SEQ ID NO: 3470727 - RNA, 20 nt, Human
auuuauuuuaugagaaaugu

SEQ ID NO: 3470728 - RNA, 13 nt, Human
auuuauuuuccuc

SEQ ID NO: 3470729 - RNA, 23 nt, Human
auuuauuuucuuuugaauuguuu

SEQ ID NO: 3470730 - RNA, 19 nt, Human
auuuauuuuguaauuauga

SEQ ID NO: 3470731 - RNA, 15 nt, Human
auuuauuuuguauga

SEQ ID NO: 3470732 - RNA, 16 nt, Human
auuuauuuuguaugaa

SEQ ID NO: 3470733 - RNA, 20 nt, Human
auuuauuuuguaugaaauau

SEQ ID NO: 3470734 - RNA, 18 nt, Human
auuuauuuuuaagaaaga

SEQ ID NO: 3470735 - RNA, 14 nt, Human
auuuauuuuuacaa

SEQ ID NO: 3470736 - RNA, 16 nt, Human
auuuauuuuucaguuc

SEQ ID NO: 3470737 - RNA, 23 nt, Human
auuuauuuuucaguuccaagaaa

SEQ ID NO: 3470738 - RNA, 17 nt, Human
auuuauuuuuucuuuuc

SEQ ID NO: 3470739 - RNA, 17 nt, Human
auuuauuuuuuuuaaag

SEQ ID NO: 3470740 - RNA, 15 nt, Human
auuucaaaaauauaa

SEQ ID NO: 3470741 - RNA, 14 nt, Human
auuucaaaaauuug

SEQ ID NO: 3470742 - RNA, 19 nt, Human
auuucaaaaauuuggaauu

SEQ ID NO: 3470743 - RNA, 13 nt, Human
auuucaaaagaca

SEQ ID NO: 3470744 - RNA, 14 nt, Human
auuucaaaaugcuu

SEQ ID NO: 3470745 - RNA, 12 nt, Human
auuucaagaagu

SEQ ID NO: 3470746 - RNA, 21 nt, Human
auuucaagacauuaaaucuau

SEQ ID NO: 3470747 - RNA, 20 nt, Human
auuucaagagauuuaauuaa

SEQ ID NO: 3470748 - RNA, 14 nt, Human
auuucaagcuuauu

SEQ ID NO: 3470749 - RNA, 13 nt, Human
auuucaagguucu

SEQ ID NO: 3470750 - RNA, 17 nt, Human
auuucaagguucuaacc

SEQ ID NO: 3470751 - RNA, 16 nt, Human
auuucaaguuccaagu

SEQ ID NO: 3470752 - RNA, 16 nt, Human
auuucaauguaauuaa

SEQ ID NO: 3470753 - RNA, 14 nt, Human
auuucaauguguau

SEQ ID NO: 3470754 - RNA, 14 nt, Human
auuucacaaauaau

SEQ ID NO: 3470755 - RNA, 20 nt, Human
auuucacaaauauuaaaaag

SEQ ID NO: 3470756 - RNA, 15 nt, Human
auuucacaacagauc

SEQ ID NO: 3470757 - RNA, 10 nt, Human
auuucacaag

SEQ ID NO: 3470758 - RNA, 15 nt, Human
auuucacaagcuauu

SEQ ID NO: 3470759 - RNA, 18 nt, Human
auuucacauuaauggucu

SEQ ID NO: 3470760 - RNA, 15 nt, Human
auuucacauuauucu

SEQ ID NO: 3470761 - RNA, 21 nt, Human
auuucaccacucaaaggccag

SEQ ID NO: 3470762 - RNA, 15 nt, Human
auuucaccccucccu

SEQ ID NO: 3470763 - RNA, 14 nt, Human
auuucaccuguaaa

SEQ ID NO: 3470764 - RNA, 20 nt, Human
auuucacgucgucuucugua

SEQ ID NO: 3470765 - RNA, 14 nt, Human
auuucacuauuuuu

SEQ ID NO: 3470766 - RNA, 14 nt, Human
auuucacuggagca

SEQ ID NO: 3470767 - RNA, 19 nt, Human
auuucacuguagcucuaaa

SEQ ID NO: 3470768 - RNA, 24 nt, Human
auuucacuguagcucuaaaaucug

SEQ ID NO: 3470769 - RNA, 14 nt, Human
auuucacugucugu

SEQ ID NO: 3470770 - RNA, 12 nt, Human
auuucacuuaau

SEQ ID NO: 3470771 - RNA, 17 nt, Human
auuucacuuaauaaugu

SEQ ID NO: 3470772 - RNA, 16 nt, Human
auuucacuuauuuaga

SEQ ID NO: 3470773 - RNA, 19 nt, Human
auuucagaaaaugaaaaau

SEQ ID NO: 3470774 - RNA, 21 nt, Human
auuucagaaagccuuucauuu

SEQ ID NO: 3470775 - RNA, 19 nt, Human
auuucagaaguuaguuugu

SEQ ID NO: 3470776 - RNA, 21 nt, Human
auuucagaaguuaguuuguau

SEQ ID NO: 3470777 - RNA, 13 nt, Human
auuucagaaguuu

SEQ ID NO: 3470778 - RNA, 19 nt, Human
auuucagaaguuuaaauau

SEQ ID NO: 3470779 - RNA, 23 nt, Human
auuucagacucccauuccugaag

SEQ ID NO: 3470780 - RNA, 14 nt, Human
auuucagaugcuuu

SEQ ID NO: 3470781 - RNA, 16 nt, Human
auuucagauuuugaua

SEQ ID NO: 3470782 - RNA, 18 nt, Human
auuucagauuuugauaac

SEQ ID NO: 3470783 - RNA, 19 nt, Human
auuucaggaggaauacuga

SEQ ID NO: 3470784 - RNA, 22 nt, Human
auuucaggauacucugucagau

SEQ ID NO: 3470785 - RNA, 14 nt, Human
auuucaggauucuc

SEQ ID NO: 3470786 - RNA, 19 nt, Human
auuucaggggucgucacca

SEQ ID NO: 3470787 - RNA, 14 nt, Human
auuucaguacuuca

SEQ ID NO: 3470788 - RNA, 19 nt, Human
auuucaguacuucagcaag

SEQ ID NO: 3470789 - RNA, 14 nt, Human
auuucagucuuuuc

SEQ ID NO: 3470790 - RNA, 19 nt, Human
auuucagucuuuuccuguu

SEQ ID NO: 3470791 - RNA, 17 nt, Human
auuucaguguaaagugu

SEQ ID NO: 3470792 - RNA, 21 nt, Human
auuucaguguuaccugugugc

SEQ ID NO: 3470793 - RNA, 18 nt, Human
auuucaguucuaggaaaa

SEQ ID NO: 3470794 - RNA, 19 nt, Human
auuucaguucuaggaaaau

SEQ ID NO: 3470795 - RNA, 23 nt, Human
auuucauacuguaacauucagga

SEQ ID NO: 3470796 - RNA, 18 nt, Human
auuucauaucuacagaua

SEQ ID NO: 3470797 - RNA, 15 nt, Human
auuucauauucuuuc

SEQ ID NO: 3470798 - RNA, 19 nt, Human
auuucaucagaacagcugu

SEQ ID NO: 3470799 - RNA, 20 nt, Human
auuucaucauauuauacaga

SEQ ID NO: 3470800 - RNA, 17 nt, Human
auuucaucauuguuucu

SEQ ID NO: 3470801 - RNA, 16 nt, Human
auuucaucuauuucug

SEQ ID NO: 3470802 - RNA, 20 nt, Human
auuucaucuauuucugagaa

SEQ ID NO: 3470803 - RNA, 14 nt, Human
auuucaucucauuu

SEQ ID NO: 3470804 - RNA, 21 nt, Human
auuucaucucauuuaagggaa

SEQ ID NO: 3470805 - RNA, 11 nt, Human
auuucaucugc

SEQ ID NO: 3470806 - RNA, 17 nt, Human
auuucaucugcucuccu

SEQ ID NO: 3470807 - RNA, 21 nt, Human
auuucaucugcucuccuuccu

SEQ ID NO: 3470808 - RNA, 14 nt, Human
auuucaugaaaauu

SEQ ID NO: 3470809 - RNA, 15 nt, Human
auuucaugauuucau

SEQ ID NO: 3470810 - RNA, 20 nt, Human
auuucauguacugcauuauu

SEQ ID NO: 3470811 - RNA, 21 nt, Human
auuucauguacugcauuauuu

SEQ ID NO: 3470812 - RNA, 13 nt, Human
auuucauguccau

SEQ ID NO: 3470813 - RNA, 11 nt, Human
auuucauucca

SEQ ID NO: 3470814 - RNA, 17 nt, Human
auuucauuccauugccu

SEQ ID NO: 3470815 - RNA, 17 nt, Human
auuucauugccugugua

SEQ ID NO: 3470816 - RNA, 14 nt, Human
auuucauugguuaa

SEQ ID NO: 3470817 - RNA, 14 nt, Human
auuucauuguauga

SEQ ID NO: 3470818 - RNA, 15 nt, Human
auuucauuguaugau

SEQ ID NO: 3470819 - RNA, 20 nt, Human
auuucauuguaugauguguu

SEQ ID NO: 3470820 - RNA, 23 nt, Human
auuucauuuuguaacaaaugaac

SEQ ID NO: 3470821 - RNA, 17 nt, Human
auuuccaaauaaaauga

SEQ ID NO: 3470822 - RNA, 13 nt, Human
auuuccaaaugaa

SEQ ID NO: 3470823 - RNA, 16 nt, Human
auuuccaagagcugag

SEQ ID NO: 3470824 - RNA, 14 nt, Human
auuuccaauguuuc

SEQ ID NO: 3470825 - RNA, 21 nt, Human
auuuccacuaaaaauauuguu

SEQ ID NO: 3470826 - RNA, 16 nt, Human
auuuccacucaggucu

SEQ ID NO: 3470827 - RNA, 17 nt, Human
auuuccagccagggcug

SEQ ID NO: 3470828 - RNA, 22 nt, Human
auuuccauauaaauauuagaaa

SEQ ID NO: 3470829 - RNA, 17 nt, Human
auuuccauauggauuuu

SEQ ID NO: 3470830 - RNA, 15 nt, Human
auuuccauguaugca

SEQ ID NO: 3470831 - RNA, 15 nt, Human
auuuccauuauuuau

SEQ ID NO: 3470832 - RNA, 17 nt, Human
auuuccauuccagaaua

SEQ ID NO: 3470833 - RNA, 18 nt, Human
auuuccauuuacuuaaga

SEQ ID NO: 3470834 - RNA, 24 nt, Human
auuuccauuuggggauauugucau

SEQ ID NO: 3470835 - RNA, 17 nt, Human
auuucccaauuaggaag

SEQ ID NO: 3470836 - RNA, 13 nt, Human
auuucccaucugc

SEQ ID NO: 3470837 - RNA, 22 nt, Human
auuucccauuugugccagagga

SEQ ID NO: 3470838 - RNA, 17 nt, Human
auuuccccaccccagcu

SEQ ID NO: 3470839 - RNA, 23 nt, Human
auuuccccagaccugagcucccc

SEQ ID NO: 3470840 - RNA, 20 nt, Human
auuucccccauuuuucccag

SEQ ID NO: 3470841 - RNA, 18 nt, Human
auuuccccccuccgccuc

SEQ ID NO: 3470842 - RNA, 19 nt, Human
auuucccccuuucuuccuc

SEQ ID NO: 3470843 - RNA, 15 nt, Human
auuuccccuccuucc

SEQ ID NO: 3470844 - RNA, 15 nt, Human
auuucccuacauuaa

SEQ ID NO: 3470845 - RNA, 14 nt, Human
auuucccucucuca

SEQ ID NO: 3470846 - RNA, 17 nt, Human
auuucccugaaggaacc

SEQ ID NO: 3470847 - RNA, 15 nt, Human
auuucccuucuucug

SEQ ID NO: 3470848 - RNA, 16 nt, Human
auuucccuuuagcugu

SEQ ID NO: 3470849 - RNA, 22 nt, Human
auuucccuuuagcuguguuauu

SEQ ID NO: 3470850 - RNA, 15 nt, Human
auuuccguuaaaaua

SEQ ID NO: 3470851 - RNA, 21 nt, Human
auuuccuaaauauauuuuaag

SEQ ID NO: 3470852 - RNA, 21 nt, Human
auuuccuaauacugucauccu

SEQ ID NO: 3470853 - RNA, 15 nt, Human
auuuccuaucauuuu

SEQ ID NO: 3470854 - RNA, 14 nt, Human
auuuccuaugaugu

SEQ ID NO: 3470855 - RNA, 16 nt, Human
auuuccuaugauguau

SEQ ID NO: 3470856 - RNA, 20 nt, Human
auuuccuauguaacugcauu

SEQ ID NO: 3470857 - RNA, 20 nt, Human
auuuccuccgucaccucaga

SEQ ID NO: 3470858 - RNA, 19 nt, Human
auuuccucgcagccucuca

SEQ ID NO: 3470859 - RNA, 22 nt, Human
auuuccucuauugauguacagu

SEQ ID NO: 3470860 - RNA, 16 nt, Human
auuuccucuugaacca

SEQ ID NO: 3470861 - RNA, 23 nt, Human
auuuccugggagcuuuuguagaa

SEQ ID NO: 3470862 - RNA, 21 nt, Human
auuuccuggugugaagguccu

SEQ ID NO: 3470863 - RNA, 14 nt, Human
auuuccuugaaugu

SEQ ID NO: 3470864 - RNA, 16 nt, Human
auuuuaguuucuguuc

SEQ ID NO: 3470865 - RNA, 21 nt, Human
auuuuaguuucuguucugugg

SEQ ID NO: 3470866 - RNA, 23 nt, Human
auuuuaguuucuguucuguggaa

SEQ ID NO: 3470867 - RNA, 14 nt, Human
auuuuaguuuuauu

SEQ ID NO: 3470868 - RNA, 20 nt, Human
auuuuaguuuuauuuucuaa

SEQ ID NO: 3470869 - RNA, 21 nt, Human
auuuuaguuuuauuuucuaaa

SEQ ID NO: 3470870 - RNA, 22 nt, Human
auuuuaguuuuauuuucuaaag

SEQ ID NO: 3470871 - RNA, 20 nt, Human
auuuuaguuuuucauuaaau

SEQ ID NO: 3470872 - RNA, 23 nt, Human
auuuuaguuuuucauuaaauaaa

SEQ ID NO: 3470873 - RNA, 17 nt, Human
auuuuauaaaauuaaag

SEQ ID NO: 3470874 - RNA, 19 nt, Human
auuuuauaaaauuaaagaa

SEQ ID NO: 3470875 - RNA, 21 nt, Human
auuuuauaaaauuaaagaaaa

SEQ ID NO: 3470876 - RNA, 16 nt, Human
auuuuauaaaucgcuu

SEQ ID NO: 3470877 - RNA, 13 nt, Human
auuuuauaagaaa

SEQ ID NO: 3470878 - RNA, 16 nt, Human
auuuuauaagaaaaac

SEQ ID NO: 3470879 - RNA, 17 nt, Human
auuuuauaagaaaaacu

SEQ ID NO: 3470880 - RNA, 20 nt, Human
auuuuauaaggacuuccuga

SEQ ID NO: 3470881 - RNA, 12 nt, Human
auuuuauaauuu

SEQ ID NO: 3470882 - RNA, 17 nt, Human
auuuuauagcuacuaau

SEQ ID NO: 3470883 - RNA, 16 nt, Human
auuuuauauaaaguau

SEQ ID NO: 3470884 - RNA, 21 nt, Human
auuuuauauaaaguauucuuu

SEQ ID NO: 3470885 - RNA, 14 nt, Human
auuuuauauaauaa

SEQ ID NO: 3470886 - RNA, 17 nt, Human
auuuuauauaauaaagu

SEQ ID NO: 3470887 - RNA, 21 nt, Human
auuuuauaucaauuuaaaaaa

SEQ ID NO: 3470888 - RNA, 16 nt, Human
auuuuauaugcuuacu

SEQ ID NO: 3470889 - RNA, 18 nt, Human
auuuuauaugcuuacuga

SEQ ID NO: 3470890 - RNA, 16 nt, Human
auuuuauaugucaaag

SEQ ID NO: 3470891 - RNA, 15 nt, Human
auuuuauauuacacu

SEQ ID NO: 3470892 - RNA, 18 nt, Human
auuuuauauuacacuaca

SEQ ID NO: 3470893 - RNA, 19 nt, Human
auuuuauauuagaaguguu

SEQ ID NO: 3470894 - RNA, 15 nt, Human
auuuuauauugaaaa

SEQ ID NO: 3470895 - RNA, 16 nt, Human
auuuuauauugaaaaa

SEQ ID NO: 3470896 - RNA, 22 nt, Human
auuuuaucugccucucuuguaa

SEQ ID NO: 3470897 - RNA, 13 nt, Human
auuuuaucuguga

SEQ ID NO: 3470898 - RNA, 15 nt, Human
auuuuaucugugaau

SEQ ID NO: 3470899 - RNA, 15 nt, Human
auuuuaucuuugauu

SEQ ID NO: 3470900 - RNA, 21 nt, Human
auuuuaugaaagguuuacauu

SEQ ID NO: 3470901 - RNA, 16 nt, Human
auuuuaugaaugucuu

SEQ ID NO: 3470902 - RNA, 15 nt, Human
auuuuaugagaaaug

SEQ ID NO: 3470903 - RNA, 16 nt, Human
auuuuaugagaaaugu

SEQ ID NO: 3470904 - RNA, 17 nt, Human
auuuuaugagaaaugua

SEQ ID NO: 3470905 - RNA, 12 nt, Human
auuuuaugcuuu

SEQ ID NO: 3470906 - RNA, 18 nt, Human
auuuuaugcuuuaaacau

SEQ ID NO: 3470907 - RNA, 19 nt, Human
auuuuauggcucacuauga

SEQ ID NO: 3470908 - RNA, 12 nt, Human
auuuuauguaug

SEQ ID NO: 3470909 - RNA, 12 nt, Human
auuuuauguuau

SEQ ID NO: 3470910 - RNA, 17 nt, Human
auuuuauguuauauaua

SEQ ID NO: 3470911 - RNA, 13 nt, Human
auuuuauguugac

SEQ ID NO: 3470912 - RNA, 19 nt, Human
auuuuauguugacauuugu

SEQ ID NO: 3470913 - RNA, 20 nt, Human
auuuuauguugacauuuguu

SEQ ID NO: 3470914 - RNA, 18 nt, Human
auuuuauguugcauagaa

SEQ ID NO: 3470915 - RNA, 12 nt, Human
auuuuauuacug

SEQ ID NO: 3470916 - RNA, 14 nt, Human
auuuuauuaugaag

SEQ ID NO: 3470917 - RNA, 23 nt, Human
auuuuauuaugaagaaggugaau

SEQ ID NO: 3470918 - RNA, 15 nt, Human
auuuuauuauguaaa

SEQ ID NO: 3470919 - RNA, 19 nt, Human
auuuuauuauguaaauccc

SEQ ID NO: 3470920 - RNA, 12 nt, Human
auuuuauucaag

SEQ ID NO: 3470921 - RNA, 12 nt, Human
auuuuauucuug

SEQ ID NO: 3470922 - RNA, 21 nt, Human
auuuuauuguaacagacauug

SEQ ID NO: 3470923 - RNA, 22 nt, Human
auuuuauuuagacaagagaugg

SEQ ID NO: 3470924 - RNA, 14 nt, Human
auuuuauuucaaug

SEQ ID NO: 3470925 - RNA, 16 nt, Human
auuuuauuucaaugua

SEQ ID NO: 3470926 - RNA, 17 nt, Human
auuuuauuucaauguaa

SEQ ID NO: 3470927 - RNA, 13 nt, Human
auuuuauuuccau

SEQ ID NO: 3470928 - RNA, 16 nt, Human
auuuuauuuccaucau

SEQ ID NO: 3470929 - RNA, 14 nt, Human
auuuuauuugacaa

SEQ ID NO: 3470930 - RNA, 19 nt, Human
auuuuauuuuaaaauuuca

SEQ ID NO: 3470931 - RNA, 22 nt, Human
auuuuauuuugaaauggaaauu

SEQ ID NO: 3470932 - RNA, 22 nt, Human
auuuuauuuugugcucauuuaa

SEQ ID NO: 3470933 - RNA, 15 nt, Human
auuuuauuuuuagaa

SEQ ID NO: 3470934 - RNA, 16 nt, Human
auuuucaaaaccaggu

SEQ ID NO: 3470935 - RNA, 17 nt, Human
auuuucaaagacuuaag

SEQ ID NO: 3470936 - RNA, 17 nt, Human
auuuucaaaguacauaa

SEQ ID NO: 3470937 - RNA, 18 nt, Human
auuuucaaauuguaucua

SEQ ID NO: 3470938 - RNA, 18 nt, Human
auuuucaacgcagcccug

SEQ ID NO: 3470939 - RNA, 17 nt, Human
auuuucaagaaacugag

SEQ ID NO: 3470940 - RNA, 22 nt, Human
auuuucaagaaacugaggaauu

SEQ ID NO: 3470941 - RNA, 16 nt, Human
auuuucaaguaauugu

SEQ ID NO: 3470942 - RNA, 15 nt, Human
auuuucaaguagcug

SEQ ID NO: 3470943 - RNA, 20 nt, Human
auuuucaauagccacuaacc

SEQ ID NO: 3470944 - RNA, 15 nt, Human
auuuucacaauguca

SEQ ID NO: 3470945 - RNA, 17 nt, Human
auuuucacaugaacaua

SEQ ID NO: 3470946 - RNA, 22 nt, Human
auuuucaccccacccuuccccu

SEQ ID NO: 3470947 - RNA, 16 nt, Human
auuuucacccucugua

SEQ ID NO: 3470948 - RNA, 18 nt, Human
auuuucacccucuguacc

SEQ ID NO: 3470949 - RNA, 22 nt, Human
auuuucacuuuuggcaaugacu

SEQ ID NO: 3470950 - RNA, 14 nt, Human
auuuucagaaucug

SEQ ID NO: 3470951 - RNA, 15 nt, Human
auuuucagaaucuga

SEQ ID NO: 3470952 - RNA, 14 nt, Human
auuuucagauuugc

SEQ ID NO: 3470953 - RNA, 18 nt, Human
auuuucagauuugcacaa

SEQ ID NO: 3470954 - RNA, 19 nt, Human
auuuucagauuugcacaaa

SEQ ID NO: 3470955 - RNA, 17 nt, Human
auuuucagcaaacucuu

SEQ ID NO: 3470956 - RNA, 18 nt, Human
auuuucagcaaacucuuu

SEQ ID NO: 3470957 - RNA, 18 nt, Human
auuuucagcaugaaaaug

SEQ ID NO: 3470958 - RNA, 12 nt, Human
auuuucagcauu

SEQ ID NO: 3470959 - RNA, 23 nt, Human
auuuucagcccauauuucaucgu

SEQ ID NO: 3470960 - RNA, 20 nt, Human
auuuucagguaguacuaaga

SEQ ID NO: 3470961 - RNA, 22 nt, Human
auuuucaguagggcuacaaaac

SEQ ID NO: 3470962 - RNA, 20 nt, Human
auuuucagucaaaacuuuaa

SEQ ID NO: 3470963 - RNA, 12 nt, Human
auuuucagugau

SEQ ID NO: 3470964 - RNA, 14 nt, Human
auuuucauaacuua

SEQ ID NO: 3470965 - RNA, 21 nt, Human
auuuucauaaguauuucaaau

SEQ ID NO: 3470966 - RNA, 22 nt, Human
auuuucauacagcauuacaaau

SEQ ID NO: 3470967 - RNA, 18 nt, Human
auuuucauguauaugugu

SEQ ID NO: 3470968 - RNA, 15 nt, Human
auuuucauuaaaagc

SEQ ID NO: 3470969 - RNA, 16 nt, Human
auuuucauuacaaugg

SEQ ID NO: 3470970 - RNA, 15 nt, Human
auuuucauuuucugc

SEQ ID NO: 3470971 - RNA, 14 nt, Human
auuuuccaaaugua

SEQ ID NO: 3470972 - RNA, 17 nt, Human
auuuuccaaauguaaua

SEQ ID NO: 3470973 - RNA, 15 nt, Human
auuuuccaggcuucu

SEQ ID NO: 3470974 - RNA, 15 nt, Human
auuuuccaucuaaaa

SEQ ID NO: 3470975 - RNA, 19 nt, Human
auuuuccaucuaaaaauau

SEQ ID NO: 3470976 - RNA, 20 nt, Human
auuuucccaauagcacuuuc

SEQ ID NO: 3470977 - RNA, 17 nt, Human
auuuucccacugcaccc

SEQ ID NO: 3470978 - RNA, 14 nt, Human
auuuuccccccacu

SEQ ID NO: 3470979 - RNA, 19 nt, Human
auuuucccccuuggcucuc

SEQ ID NO: 3470980 - RNA, 22 nt, Human
auuuucccucagaaaaugagua

SEQ ID NO: 3470981 - RNA, 13 nt, Human
auuuucccugcua

SEQ ID NO: 3470982 - RNA, 21 nt, Human
auuuuccuaauaaaguucugu

SEQ ID NO: 3470983 - RNA, 12 nt, Human
auuuuccucccc

SEQ ID NO: 3470984 - RNA, 14 nt, Human
auuuuccuccccag

SEQ ID NO: 3470985 - RNA, 15 nt, Human
auuuuccuccccagc

SEQ ID NO: 3470986 - RNA, 13 nt, Human
auuuuccuccuuu

SEQ ID NO: 3470987 - RNA, 19 nt, Human
auuuuccucugcuuugaaa

SEQ ID NO: 3470988 - RNA, 14 nt, Human
auuuuccucuugug

SEQ ID NO: 3470989 - RNA, 23 nt, Human
auuuuccuguccucuuucagcuc

SEQ ID NO: 3470990 - RNA, 12 nt, Human
auuuuccuugaa

SEQ ID NO: 3470991 - RNA, 14 nt, Human
auuuuccuugaagc

SEQ ID NO: 3470992 - RNA, 17 nt, Human
auuuuccuuuuuuauac

SEQ ID NO: 3470993 - RNA, 22 nt, Human
auuuuccuuuuuuauacacaua

SEQ ID NO: 3470994 - RNA, 16 nt, Human
auuuucguucauuacu

SEQ ID NO: 3470995 - RNA, 15 nt, Human
auuuucuaaagacuu

SEQ ID NO: 3470996 - RNA, 15 nt, Human
auuuucuaaaguacu

SEQ ID NO: 3470997 - RNA, 17 nt, Human
auuuucuaagaaacauu

SEQ ID NO: 3470998 - RNA, 18 nt, Human
auuuucuaagcaauuucu

SEQ ID NO: 3470999 - RNA, 19 nt, Human
auuuucuacaaauaauuuu

SEQ ID NO: 3471000 - RNA, 21 nt, Human
auuuucuaccuggucucuccu

SEQ ID NO: 3471001 - RNA, 19 nt, Human
auuuucuagacuuucuguu

SEQ ID NO: 3471002 - RNA, 18 nt, Human
auuuucuagauacaauaa

SEQ ID NO: 3471003 - RNA, 17 nt, Human
auuuucuauaacagaua

SEQ ID NO: 3471004 - RNA, 17 nt, Human
auuuucuauaauuuaaa

SEQ ID NO: 3471005 - RNA, 19 nt, Human
auuuucucaaaagcauuua

SEQ ID NO: 3471006 - RNA, 20 nt, Human
auuuucucaaaagcauuuau

SEQ ID NO: 3471007 - RNA, 22 nt, Human
auuuucucaaaagcauuuauca

SEQ ID NO: 3471008 - RNA, 23 nt, Human
auuuucucccaggaagcuuugau

SEQ ID NO: 3471009 - RNA, 15 nt, Human
caagcggguggcucu

SEQ ID NO: 3471010 - RNA, 15 nt, Human
caagcggugucucuc

SEQ ID NO: 3471011 - RNA, 16 nt, Human
caagcgugagccacug

SEQ ID NO: 3471012 - RNA, 17 nt, Human
caagcgugagccacugc

SEQ ID NO: 3471013 - RNA, 13 nt, Human
caagcuaaccuua

SEQ ID NO: 3471014 - RNA, 22 nt, Human
caagcuaaccuuauccugcauu

SEQ ID NO: 3471015 - RNA, 16 nt, Human
caagcuaagcacugcc

SEQ ID NO: 3471016 - RNA, 23 nt, Human
caagcuaauaaaauaucauucag

SEQ ID NO: 3471017 - RNA, 21 nt, Human
caagcuaauugggaguccagg

SEQ ID NO: 3471018 - RNA, 23 nt, Human
caagcuaauugggaguccaggca

SEQ ID NO: 3471019 - RNA, 16 nt, Human
caagcuagaaccugga

SEQ ID NO: 3471020 - RNA, 17 nt, Human
caagcuagaaccuggag

SEQ ID NO: 3471021 - RNA, 18 nt, Human
caagcuagaaccuggagg

SEQ ID NO: 3471022 - RNA, 16 nt, Human
caagcuauccuggcuc

SEQ ID NO: 3471023 - RNA, 16 nt, Human
caagcuaucuaaaguu

SEQ ID NO: 3471024 - RNA, 17 nt, Human
caagcuauuccuuuccc

SEQ ID NO: 3471025 - RNA, 21 nt, Human
caagcuauuccuuucccuucc

SEQ ID NO: 3471026 - RNA, 16 nt, Human
caagcucacaguuccu

SEQ ID NO: 3471027 - RNA, 20 nt, Human
caagcucacaguuccucgcc

SEQ ID NO: 3471028 - RNA, 14 nt, Human
caagcucacuugcu

SEQ ID NO: 3471029 - RNA, 21 nt, Human
caagcucagaggcgcacugug

SEQ ID NO: 3471030 - RNA, 19 nt, Human
caagcuccaagccccaucu

SEQ ID NO: 3471031 - RNA, 18 nt, Human
caagcuccaagcucccag

SEQ ID NO: 3471032 - RNA, 12 nt, Human
caagcucccagg

SEQ ID NO: 3471033 - RNA, 14 nt, Human
caagcucccaggca

SEQ ID NO: 3471034 - RNA, 16 nt, Human
caagcucccugcccca

SEQ ID NO: 3471035 - RNA, 12 nt, Human
caagcuccuccu

SEQ ID NO: 3471036 - RNA, 14 nt, Human
caagcuccuccucc

SEQ ID NO: 3471037 - RNA, 19 nt, Human
caagcuccuccucggaacc

SEQ ID NO: 3471038 - RNA, 22 nt, Human
caagcuccuugggaggccccac

SEQ ID NO: 3471039 - RNA, 19 nt, Human
caagcucuaucaccaagga

SEQ ID NO: 3471040 - RNA, 17 nt, Human
caagcucugagggaaag

SEQ ID NO: 3471041 - RNA, 13 nt, Human
caagcucugcucc

SEQ ID NO: 3471042 - RNA, 17 nt, Human
caagcucugcuccucuc

SEQ ID NO: 3471043 - RNA, 21 nt, Human
caagcugaaauuuuagaaaua

SEQ ID NO: 3471044 - RNA, 15 nt, Human
caagcugaggugccc

SEQ ID NO: 3471045 - RNA, 17 nt, Human
caagcugaggugcccag

SEQ ID NO: 3471046 - RNA, 15 nt, Human
caagcugauuaaaug

SEQ ID NO: 3471047 - RNA, 13 nt, Human
caagcugcacccu

SEQ ID NO: 3471048 - RNA, 14 nt, Human
caagcugcaucuag

SEQ ID NO: 3471049 - RNA, 15 nt, Human
caagcugccucccug

SEQ ID NO: 3471050 - RNA, 18 nt, Human
caagcugcucugagccac

SEQ ID NO: 3471051 - RNA, 21 nt, Human
caagcugcucugagccacagu

SEQ ID NO: 3471052 - RNA, 22 nt, Human
caagcugcucugagccacagug

SEQ ID NO: 3471053 - RNA, 18 nt, Human
caagcuggaagcacaugu

SEQ ID NO: 3471054 - RNA, 17 nt, Human
caagcuggcuuacacug

SEQ ID NO: 3471055 - RNA, 16 nt, Human
caagcugggccccagc

SEQ ID NO: 3471056 - RNA, 19 nt, Human
caagcugggccccagccca

SEQ ID NO: 3471057 - RNA, 14 nt, Human
caagcugugccacc

SEQ ID NO: 3471058 - RNA, 19 nt, Human
caagcuguugaccaggcac

SEQ ID NO: 3471059 - RNA, 12 nt, Human
caagcuucccuc

SEQ ID NO: 3471060 - RNA, 23 nt, Human
caagcuuuuuuauuuuuuauaca

SEQ ID NO: 3471061 - RNA, 16 nt, Human
caaggaaaaagaaaau

SEQ ID NO: 3471062 - RNA, 17 nt, Human
caaggaaaccacagcug

SEQ ID NO: 3471063 - RNA, 18 nt, Human
caaggaaaccacagcugc

SEQ ID NO: 3471064 - RNA, 20 nt, Human
caaggaaaccacagcugcug

SEQ ID NO: 3471065 - RNA, 21 nt, Human
caaggaaaccacagcugcugg

SEQ ID NO: 3471066 - RNA, 22 nt, Human
caaggaaaccacagcugcugga

SEQ ID NO: 3471067 - RNA, 20 nt, Human
caaggaaacgcuaccucucu

SEQ ID NO: 3471068 - RNA, 23 nt, Human
caaggaaagggggucccaguggg

SEQ ID NO: 3471069 - RNA, 22 nt, Human
caaggaacuaauuucuucuccu

SEQ ID NO: 3471070 - RNA, 13 nt, Human
caaggaagaaauu

SEQ ID NO: 3471071 - RNA, 11 nt, Human
caaggaagagc

SEQ ID NO: 3471072 - RNA, 23 nt, Human
caaggaagguucauguagagaaa

SEQ ID NO: 3471073 - RNA, 16 nt, Human
caaggaaguagaaaca

SEQ ID NO: 3471074 - RNA, 18 nt, Human
caaggacaaagucuccag

SEQ ID NO: 3471075 - RNA, 22 nt, Human
caaggacaaagucuccagccca

SEQ ID NO: 3471076 - RNA, 18 nt, Human
caaggacagaaggcuccu

SEQ ID NO: 3471077 - RNA, 16 nt, Human
caaggacauucuugua

SEQ ID NO: 3471078 - RNA, 13 nt, Human
caaggaccaggac

SEQ ID NO: 3471079 - RNA, 14 nt, Human
caaggaccaggacu

SEQ ID NO: 3471080 - RNA, 18 nt, Human
caaggaccaggacucccu

SEQ ID NO: 3471081 - RNA, 13 nt, Human
caaggaccccuca

SEQ ID NO: 3471082 - RNA, 17 nt, Human
caaggaccccucaccuu

SEQ ID NO: 3471083 - RNA, 20 nt, Human
caaggaccuccucuuccccc

SEQ ID NO: 3471084 - RNA, 20 nt, Human
caaggacgcuucacaggaca

SEQ ID NO: 3471085 - RNA, 16 nt, Human
caaggacuaggguccu

SEQ ID NO: 3471086 - RNA, 12 nt, Human
caaggacugagc

SEQ ID NO: 3471087 - RNA, 14 nt, Human
caaggacugccgac

SEQ ID NO: 3471088 - RNA, 14 nt, Human
caaggacuuccugu

SEQ ID NO: 3471089 - RNA, 20 nt, Human
caaggacuugaaagcaucca

SEQ ID NO: 3471090 - RNA, 19 nt, Human
caaggagaaacagagacag

SEQ ID NO: 3471091 - RNA, 14 nt, Human
caaggagaacaaau

SEQ ID NO: 3471092 - RNA, 15 nt, Human
caaggagaacaaaua

SEQ ID NO: 3471093 - RNA, 18 nt, Human
caaggagaacaaauauuc

SEQ ID NO: 3471094 - RNA, 20 nt, Human
caaggagacacaacaacucc

SEQ ID NO: 3471095 - RNA, 13 nt, Human
caaggagaugaag

SEQ ID NO: 3471096 - RNA, 15 nt, Human
caaggagcacaagcc

SEQ ID NO: 3471097 - RNA, 16 nt, Human
caaggagcacaggucc

SEQ ID NO: 3471098 - RNA, 22 nt, Human
caaggagcugcuauagccuggg

SEQ ID NO: 3471099 - RNA, 14 nt, Human
caaggaggaaaaac

SEQ ID NO: 3471100 - RNA, 22 nt, Human
caaggaggcuggcuggggccua

SEQ ID NO: 3471101 - RNA, 12 nt, Human
caaggagggaga

SEQ ID NO: 3471102 - RNA, 20 nt, Human
caaggagggugagugcaagg

SEQ ID NO: 3471103 - RNA, 19 nt, Human
caaggaguuccaugaagac

SEQ ID NO: 3471104 - RNA, 18 nt, Human
caaggauaccuucuuauu

SEQ ID NO: 3471105 - RNA, 17 nt, Human
caaggauagaaguauac

SEQ ID NO: 3471106 - RNA, 17 nt, Human
caaggauagaugcuggc

SEQ ID NO: 3471107 - RNA, 21 nt, Human
caaggauagaugcuggcccag

SEQ ID NO: 3471108 - RNA, 17 nt, Human
caaggauccugagccag

SEQ ID NO: 3471109 - RNA, 20 nt, Human
caaggauccugagccagauu

SEQ ID NO: 3471110 - RNA, 22 nt, Human
caaggauccugagccagauuuc

SEQ ID NO: 3471111 - RNA, 14 nt, Human
caaggauugaaaau

SEQ ID NO: 3471112 - RNA, 15 nt, Human
caaggauugcuacug

SEQ ID NO: 3471113 - RNA, 20 nt, Human
caaggauugcuacuguccua

SEQ ID NO: 3471114 - RNA, 15 nt, Human
caaggcaaaaacaaa

SEQ ID NO: 3471115 - RNA, 14 nt, Human
caaggcaaggcagg

SEQ ID NO: 3471116 - RNA, 15 nt, Human
caaggcaccugcagg

SEQ ID NO: 3471117 - RNA, 19 nt, Human
caaggcacucuagauucca

SEQ ID NO: 3471118 - RNA, 18 nt, Human
caaggcacugccugaugg

SEQ ID NO: 3471119 - RNA, 16 nt, Human
caaggcacuguacuag

SEQ ID NO: 3471120 - RNA, 18 nt, Human
caaggcacuugaggggga

SEQ ID NO: 3471121 - RNA, 14 nt, Human
caaggcagaggccu

SEQ ID NO: 3471122 - RNA, 16 nt, Human
caaggcagaggccugg

SEQ ID NO: 3471123 - RNA, 19 nt, Human
caaggcagaggccugggcu

SEQ ID NO: 3471124 - RNA, 17 nt, Human
caaggcagcaaggcccg

SEQ ID NO: 3471125 - RNA, 13 nt, Human
caaggcagccgug

SEQ ID NO: 3471126 - RNA, 20 nt, Human
caaggcaggugccuccaggu

SEQ ID NO: 3471127 - RNA, 23 nt, Human
caaggcaggugccuccaggugug

SEQ ID NO: 3471128 - RNA, 18 nt, Human
caaggccaaaggaagcac

SEQ ID NO: 3471129 - RNA, 21 nt, Human
caaggccaaaggaagcacaug

SEQ ID NO: 3471130 - RNA, 13 nt, Human
caaggccaccucu

SEQ ID NO: 3471131 - RNA, 21 nt, Human
caaggccagaguggccuggcc

SEQ ID NO: 3471132 - RNA, 22 nt, Human
caaggccagaguggccuggcca

SEQ ID NO: 3471133 - RNA, 22 nt, Human
caaggccagcaagguggagugg

SEQ ID NO: 3471134 - RNA, 15 nt, Human
caaggccauccuucc

SEQ ID NO: 3471135 - RNA, 23 nt, Human
caaggccauccuucccugucugc

SEQ ID NO: 3471136 - RNA, 16 nt, Human
caaggcccagaugugg

SEQ ID NO: 3471137 - RNA, 12 nt, Human
caaggccccaga

SEQ ID NO: 3471138 - RNA, 16 nt, Human
caaggccccagagacu

SEQ ID NO: 3471139 - RNA, 14 nt, Human
caaggcccgagcag

SEQ ID NO: 3471140 - RNA, 17 nt, Human
caaggcccgagcagcug

SEQ ID NO: 3471141 - RNA, 18 nt, Human
caaggcccgagcagcuga

SEQ ID NO: 3471142 - RNA, 19 nt, Human
caaggcccgagcagcugag

SEQ ID NO: 3471143 - RNA, 20 nt, Human
caaggcccgagcagcugagc

SEQ ID NO: 3471144 - RNA, 21 nt, Human
caaggcccgagcagcugagca

SEQ ID NO: 3471145 - RNA, 20 nt, Human
caaggccgaagcucuggcug

SEQ ID NO: 3471146 - RNA, 22 nt, Human
caaggccgcuguucacccacag

SEQ ID NO: 3471147 - RNA, 15 nt, Human
caaggccucccacag

SEQ ID NO: 3471148 - RNA, 22 nt, Human
caaggccugguguuucuugaua

SEQ ID NO: 3471149 - RNA, 17 nt, Human
caaggccugucccuggc

SEQ ID NO: 3471150 - RNA, 18 nt, Human
caaggccugucccuggcc

SEQ ID NO: 3471151 - RNA, 21 nt, Human
caaggccuuccccuggcacug

SEQ ID NO: 3471152 - RNA, 15 nt, Human
caaggcucugagcaa

SEQ ID NO: 3471153 - RNA, 13 nt, Human
cugugaccugugg

SEQ ID NO: 3471154 - RNA, 14 nt, Human
cugugaccuguggg

SEQ ID NO: 3471155 - RNA, 15 nt, Human
cugugaccugugggg

SEQ ID NO: 3471156 - RNA, 17 nt, Human
cugugacuucagcucug

SEQ ID NO: 3471157 - RNA, 13 nt, Human
cugugagaaaacg

SEQ ID NO: 3471158 - RNA, 20 nt, Human
cugugagaagguuuauuguu

SEQ ID NO: 3471159 - RNA, 19 nt, Human
cugugagacagugggaaau

SEQ ID NO: 3471160 - RNA, 14 nt, Human
cugugagaccccca

SEQ ID NO: 3471161 - RNA, 15 nt, Human
cugugagacccccac

SEQ ID NO: 3471162 - RNA, 20 nt, Human
cugugagacccccacaccuc

SEQ ID NO: 3471163 - RNA, 21 nt, Human
cugugagaugcuagaacuccc

SEQ ID NO: 3471164 - RNA, 23 nt, Human
cugugagaugcuagaacucccuu

SEQ ID NO: 3471165 - RNA, 21 nt, Human
cugugagauuuugcuuuucca

SEQ ID NO: 3471166 - RNA, 19 nt, Human
cugugagcaucacaguuuu

SEQ ID NO: 3471167 - RNA, 13 nt, Human
cugugagccccug

SEQ ID NO: 3471168 - RNA, 15 nt, Human
cugugagccccuggu

SEQ ID NO: 3471169 - RNA, 15 nt, Human
cugugagccuuggcu

SEQ ID NO: 3471170 - RNA, 20 nt, Human
cugugagcucccaggugcag

SEQ ID NO: 3471171 - RNA, 17 nt, Human
cugugaggaaagcacac

SEQ ID NO: 3471172 - RNA, 19 nt, Human
cugugaggagccccaucug

SEQ ID NO: 3471173 - RNA, 13 nt, Human
cugugaggcaggg

SEQ ID NO: 3471174 - RNA, 15 nt, Human
cugugaggccccugg

SEQ ID NO: 3471175 - RNA, 15 nt, Human
cugugagggagggga

SEQ ID NO: 3471176 - RNA, 23 nt, Human
cugugaggugcagagugcccaga

SEQ ID NO: 3471177 - RNA, 20 nt, Human
cugugaguacuacaguccuc

SEQ ID NO: 3471178 - RNA, 23 nt, Human
cugugagucuuugguucuaagga

SEQ ID NO: 3471179 - RNA, 18 nt, Human
cugugaguucucccugua

SEQ ID NO: 3471180 - RNA, 22 nt, Human
cugugaguucucccuguacagu

SEQ ID NO: 3471181 - RNA, 19 nt, Human
cugugauaguucacccccu

SEQ ID NO: 3471182 - RNA, 14 nt, Human
cugugaucaagcaa

SEQ ID NO: 3471183 - RNA, 23 nt, Human
cugugaucaauauuuuuauauca

SEQ ID NO: 3471184 - RNA, 22 nt, Human
cugugaucccaguagaaaauau

SEQ ID NO: 3471185 - RNA, 17 nt, Human
cugugaucuuuuaaagu

SEQ ID NO: 3471186 - RNA, 13 nt, Human
cugugaugagcug

SEQ ID NO: 3471187 - RNA, 16 nt, Human
cugugaugagcugauc

SEQ ID NO: 3471188 - RNA, 22 nt, Human
cugugaugagcugaucugcgga

SEQ ID NO: 3471189 - RNA, 22 nt, Human
cugugaugaggggaggggggca

SEQ ID NO: 3471190 - RNA, 17 nt, Human
cugugaugauccucaua

SEQ ID NO: 3471191 - RNA, 14 nt, Human
cugugaugcugggc

SEQ ID NO: 3471192 - RNA, 18 nt, Human
cugugauggggcccugcc

SEQ ID NO: 3471193 - RNA, 19 nt, Human
cugugauggggcccugccu

SEQ ID NO: 3471194 - RNA, 23 nt, Human
cugugauggggcccugccuccuu

SEQ ID NO: 3471195 - RNA, 23 nt, Human
cugugauguuuguguauguggga

SEQ ID NO: 3471196 - RNA, 13 nt, Human
cugugauucagaa

SEQ ID NO: 3471197 - RNA, 15 nt, Human
cugugcaaaaaaauu

SEQ ID NO: 3471198 - RNA, 21 nt, Human
cugugcaacgccgugggcugc

SEQ ID NO: 3471199 - RNA, 20 nt, Human
cugugcaagguauuacacuc

SEQ ID NO: 3471200 - RNA, 18 nt, Human
cugugcacaaaguggcau

SEQ ID NO: 3471201 - RNA, 15 nt, Human
cugugcacacacaca

SEQ ID NO: 3471202 - RNA, 12 nt, Human
cugugcacagcc

SEQ ID NO: 3471203 - RNA, 18 nt, Human
cugugcacaucugugucu

SEQ ID NO: 3471204 - RNA, 12 nt, Human
cugugcacgcag

SEQ ID NO: 3471205 - RNA, 17 nt, Human
cugugcacgcaguggcc

SEQ ID NO: 3471206 - RNA, 21 nt, Human
cugugcacggccagcugcauc

SEQ ID NO: 3471207 - RNA, 16 nt, Human
cugugcagguucccac

SEQ ID NO: 3471208 - RNA, 17 nt, Human
cugugcagguucccacu

SEQ ID NO: 3471209 - RNA, 16 nt, Human
cugugcagucacugga

SEQ ID NO: 3471210 - RNA, 16 nt, Human
cugugcauagugcugg

SEQ ID NO: 3471211 - RNA, 20 nt, Human
cugugcaugggugaagggag

SEQ ID NO: 3471212 - RNA, 22 nt, Human
cugugcaugggugaagggagag

SEQ ID NO: 3471213 - RNA, 17 nt, Human
cugugcauguaugucuu

SEQ ID NO: 3471214 - RNA, 14 nt, Human
cugugcauucuccu

SEQ ID NO: 3471215 - RNA, 15 nt, Human
cugugcauucuccug

SEQ ID NO: 3471216 - RNA, 20 nt, Human
cugugcauucuccuggaugc

SEQ ID NO: 3471217 - RNA, 13 nt, Human
cugugccacaggc

SEQ ID NO: 3471218 - RNA, 18 nt, Human
cugugccacccaccaggg

SEQ ID NO: 3471219 - RNA, 23 nt, Human
cugugccacccugggcucugugg

SEQ ID NO: 3471220 - RNA, 21 nt, Human
cugugccacucaccgaagcca

SEQ ID NO: 3471221 - RNA, 15 nt, Human
cugugccagagccug

SEQ ID NO: 3471222 - RNA, 16 nt, Human
cugugccagagccugg

SEQ ID NO: 3471223 - RNA, 19 nt, Human
cugugccagagccuggggc

SEQ ID NO: 3471224 - RNA, 21 nt, Human
cugugccagagccuggggcuc

SEQ ID NO: 3471225 - RNA, 22 nt, Human
cugugccagagccuggggcucu

SEQ ID NO: 3471226 - RNA, 19 nt, Human
cugugccaggugaggucag

SEQ ID NO: 3471227 - RNA, 14 nt, Human
cugugccaugugcc

SEQ ID NO: 3471228 - RNA, 15 nt, Human
cugugccaugugcca

SEQ ID NO: 3471229 - RNA, 22 nt, Human
cugugccauuuuguauuuuacu

SEQ ID NO: 3471230 - RNA, 14 nt, Human
cugugcccaaguug

SEQ ID NO: 3471231 - RNA, 17 nt, Human
cugugcccacccuccac

SEQ ID NO: 3471232 - RNA, 16 nt, Human
cugugcccagcucagu

SEQ ID NO: 3471233 - RNA, 13 nt, Human
cugugcccauggg

SEQ ID NO: 3471234 - RNA, 20 nt, Human
cugugcccaugggcacugcu

SEQ ID NO: 3471235 - RNA, 21 nt, Human
cugugcccaugggcacugcug

SEQ ID NO: 3471236 - RNA, 21 nt, Human
cugugccccaugccuguccag

SEQ ID NO: 3471237 - RNA, 15 nt, Human
cugugccccuggccu

SEQ ID NO: 3471238 - RNA, 22 nt, Human
cugugccccuggccuugggauc

SEQ ID NO: 3471239 - RNA, 17 nt, Human
cugugccccuuccgcca

SEQ ID NO: 3471240 - RNA, 15 nt, Human
cugugcccucuugau

SEQ ID NO: 3471241 - RNA, 11 nt, Human
cugugcccugg

SEQ ID NO: 3471242 - RNA, 15 nt, Human
cugugcccuggugga

SEQ ID NO: 3471243 - RNA, 16 nt, Human
cugugcccugguggag

SEQ ID NO: 3471244 - RNA, 17 nt, Human
cugugcccugguggaga

SEQ ID NO: 3471245 - RNA, 18 nt, Human
cugugccuaacaccagcg

SEQ ID NO: 3471246 - RNA, 15 nt, Human
cugugccucagagac

SEQ ID NO: 3471247 - RNA, 18 nt, Human
cugugccucagagaccag

SEQ ID NO: 3471248 - RNA, 15 nt, Human
cugugccuccaucag

SEQ ID NO: 3471249 - RNA, 18 nt, Human
cugugccucccuccccag

SEQ ID NO: 3471250 - RNA, 19 nt, Human
cugugccucccuccccagu

SEQ ID NO: 3471251 - RNA, 23 nt, Human
cugugccucccuccccagugcaa

SEQ ID NO: 3471252 - RNA, 16 nt, Human
cugugccuccucccuc

SEQ ID NO: 3471253 - RNA, 17 nt, Human
cugugccucgcucccca

SEQ ID NO: 3471254 - RNA, 23 nt, Human
cugugccucggcuuuucucagcu

SEQ ID NO: 3471255 - RNA, 14 nt, Human
cugugccucugccu

SEQ ID NO: 3471256 - RNA, 15 nt, Human
cugugccucugccug

SEQ ID NO: 3471257 - RNA, 14 nt, Human
cugugccucuggga

SEQ ID NO: 3471258 - RNA, 15 nt, Human
cugugccugaauauu

SEQ ID NO: 3471259 - RNA, 18 nt, Human
cugugccugccugggagu

SEQ ID NO: 3471260 - RNA, 14 nt, Human
cugugccuggagcu

SEQ ID NO: 3471261 - RNA, 17 nt, Human
cugugccuggagcuccu

SEQ ID NO: 3471262 - RNA, 19 nt, Human
cugugccuggagcuccugg

SEQ ID NO: 3471263 - RNA, 15 nt, Human
cugugcguggggcuc

SEQ ID NO: 3471264 - RNA, 17 nt, Human
cugugcguuacuaauug

SEQ ID NO: 3471265 - RNA, 16 nt, Human
cugugcuacuuugccu

SEQ ID NO: 3471266 - RNA, 21 nt, Human
cugugcuagggaaacuucccg

SEQ ID NO: 3471267 - RNA, 13 nt, Human
cugugcucagaag

SEQ ID NO: 3471268 - RNA, 15 nt, Human
cugugcucagcccug

SEQ ID NO: 3471269 - RNA, 12 nt, Human
cugugcucagga

SEQ ID NO: 3471270 - RNA, 10 nt, Human
cugugcuccg

SEQ ID NO: 3471271 - RNA, 18 nt, Human
cugugcuccgugccucca

SEQ ID NO: 3471272 - RNA, 21 nt, Human
cugugcuccgugccuccacca

SEQ ID NO: 3471273 - RNA, 21 nt, Human
cugugcucggaggccaucucg

SEQ ID NO: 3471274 - RNA, 17 nt, Human
cugugcucuggacaggc

SEQ ID NO: 3471275 - RNA, 17 nt, Human
cugugcugacccuccug

SEQ ID NO: 3471276 - RNA, 12 nt, Human
cugugcugaggc

SEQ ID NO: 3471277 - RNA, 14 nt, Human
cugugcugagucug

SEQ ID NO: 3471278 - RNA, 20 nt, Human
cugugcugagucugaaggcu

SEQ ID NO: 3471279 - RNA, 11 nt, Human
cugugcugccc

SEQ ID NO: 3471280 - RNA, 20 nt, Human
cugugcugcccgucuucagc

SEQ ID NO: 3471281 - RNA, 14 nt, Human
cugugcugcccugc

SEQ ID NO: 3471282 - RNA, 15 nt, Human
cugugcugcccugcc

SEQ ID NO: 3471283 - RNA, 17 nt, Human
cugugcugcccugccca

SEQ ID NO: 3471284 - RNA, 19 nt, Human
cugugcugcuguuacuguu

SEQ ID NO: 3471285 - RNA, 14 nt, Human
cugugcuggagcca

SEQ ID NO: 3471286 - RNA, 16 nt, Human
cugugcuggagccacu

SEQ ID NO: 3471287 - RNA, 18 nt, Human
cugugcugguguccugac

SEQ ID NO: 3471288 - RNA, 20 nt, Human
cugugcugguguccugacca

SEQ ID NO: 3471289 - RNA, 21 nt, Human
cugugcugguguccugaccac

SEQ ID NO: 3471290 - RNA, 12 nt, Human
cugugcugugga

SEQ ID NO: 3471291 - RNA, 15 nt, Human
cugugcuguggaagc

SEQ ID NO: 3471292 - RNA, 11 nt, Human
cugugcugugu

SEQ ID NO: 3471293 - RNA, 13 nt, Human
cugugcugugugu

SEQ ID NO: 3471294 - RNA, 17 nt, Human
cugugcuuccuccugcc

SEQ ID NO: 3471295 - RNA, 21 nt, Human
cugugcuucgguaggcgacca

SEQ ID NO: 3471296 - RNA, 15 nt, Human
cugugcuugaaggcc

SEQ ID NO: 3471297 - RNA, 16 nt, Human
cugugcuuuccagcuc

SEQ ID NO: 3471298 - RNA, 20 nt, Human
cugugcuuuccagcucaccc

SEQ ID NO: 3471299 - RNA, 21 nt, Human
cugugcuuuccagcucacccc

SEQ ID NO: 3471300 - RNA, 12 nt, Human
cugugcuuucua

SEQ ID NO: 3471301 - RNA, 13 nt, Human
cugugcuuucuau

SEQ ID NO: 3471302 - RNA, 15 nt, Human
cugugcuuucuauug

SEQ ID NO: 3471303 - RNA, 16 nt, Human
cugugcuuugacucac

SEQ ID NO: 3471304 - RNA, 18 nt, Human
cuguggaaaaauauuuaa

SEQ ID NO: 3471305 - RNA, 14 nt, Human
cuguggaaagugua

SEQ ID NO: 3471306 - RNA, 15 nt, Human
cuguggaaaguguaa

SEQ ID NO: 3471307 - RNA, 21 nt, Human
cuguggaaaguguaaagcauu

SEQ ID NO: 3471308 - RNA, 22 nt, Human
cuguggaacuaauaaauacaua

SEQ ID NO: 3471309 - RNA, 13 nt, Human
cuguggaagggac

SEQ ID NO: 3471310 - RNA, 23 nt, Human
cuguggaccauggaguggcagcc

SEQ ID NO: 3471311 - RNA, 13 nt, Human
cuguggagaaaua

SEQ ID NO: 3471312 - RNA, 21 nt, Human
cuguggagacugcuccugagc

SEQ ID NO: 3471313 - RNA, 15 nt, Human
cuguggagcucagcc

SEQ ID NO: 3471314 - RNA, 20 nt, Human
cuguggaggaaggauuguaa

SEQ ID NO: 3471315 - RNA, 21 nt, Human
cuguggaggaaggauuguaaa

SEQ ID NO: 3471316 - RNA, 15 nt, Human
cuguggaucagagau

SEQ ID NO: 3471317 - RNA, 15 nt, Human
cuguggaugagcccu

SEQ ID NO: 3471318 - RNA, 19 nt, Human
cuguggaugagcccucaga

SEQ ID NO: 3471319 - RNA, 17 nt, Human
cuguggaugauaaaaca

SEQ ID NO: 3471320 - RNA, 18 nt, Human
cuguggaugcugcugccc

SEQ ID NO: 3471321 - RNA, 23 nt, Human
cuguggauuuuuuccuucaaagu

SEQ ID NO: 3471322 - RNA, 19 nt, Human
cuguggcacuugccugggu

SEQ ID NO: 3471323 - RNA, 19 nt, Human
cuguggcagaguuacaguu

SEQ ID NO: 3471324 - RNA, 14 nt, Human
cuguggcaggcagc

SEQ ID NO: 3471325 - RNA, 17 nt, Human
cuguggcaggcagcgcc

SEQ ID NO: 3471326 - RNA, 23 nt, Human
cuguggcaggcagcgccaagcaa

SEQ ID NO: 3471327 - RNA, 18 nt, Human
cuguggcaggccagcugu

SEQ ID NO: 3471328 - RNA, 23 nt, Human
cuguggcaguaaagagaaacuuu

SEQ ID NO: 3471329 - RNA, 14 nt, Human
cuguggcauaaauu

SEQ ID NO: 3471330 - RNA, 15 nt, Human
cuguggcauaaauug

SEQ ID NO: 3471331 - RNA, 18 nt, Human
cuguggcauaaauugcau

SEQ ID NO: 3471332 - RNA, 16 nt, Human
cuguggccaaguucuu

SEQ ID NO: 3471333 - RNA, 22 nt, Human
cuguggccacauuuucagccaa

SEQ ID NO: 3471334 - RNA, 14 nt, Human
cuguggccaggagg

SEQ ID NO: 3471335 - RNA, 20 nt, Human
cuguggccccacccugggcc

SEQ ID NO: 3471336 - RNA, 21 nt, Human
cuguggccccacccugggccc

SEQ ID NO: 3471337 - RNA, 13 nt, Human
cuguggcccuggc

SEQ ID NO: 3471338 - RNA, 15 nt, Human
cuguggcccuguccu

SEQ ID NO: 3471339 - RNA, 19 nt, Human
cuguggccucccugcucua

SEQ ID NO: 3471340 - RNA, 14 nt, Human
cuguggccugccag

SEQ ID NO: 3471341 - RNA, 23 nt, Human
cuguggccugugucccaugaccc

SEQ ID NO: 3471342 - RNA, 15 nt, Human
cuguggccuuggucu

SEQ ID NO: 3471343 - RNA, 14 nt, Human
cuguggcggugccu

SEQ ID NO: 3471344 - RNA, 15 nt, Human
cuguggcuagugaca

SEQ ID NO: 3471345 - RNA, 15 nt, Human
cuguggcuccaggcc

SEQ ID NO: 3471346 - RNA, 15 nt, Human
cuguggcuggugagc

SEQ ID NO: 3471347 - RNA, 14 nt, Human
cuguggcugucugg

SEQ ID NO: 3471348 - RNA, 11 nt, Human
cugugggaaau

SEQ ID NO: 3471349 - RNA, 16 nt, Human
cugugggaccccaggc

SEQ ID NO: 3471350 - RNA, 21 nt, Human
cugugggagccucgcaacccg

SEQ ID NO: 3471351 - RNA, 20 nt, Human
cugugggagggacuuugcug

SEQ ID NO: 3471352 - RNA, 22 nt, Human
cugugggaucccucugggcacu

SEQ ID NO: 3471353 - RNA, 18 nt, Human
cugugggcaauuuagaaa

SEQ ID NO: 3471354 - RNA, 17 nt, Human
cugugggcacaggucag

SEQ ID NO: 3471355 - RNA, 19 nt, Human
cugugggccucaaggacuu

SEQ ID NO: 3471356 - RNA, 19 nt, Human
cugugggcgggcccagcac

SEQ ID NO: 3471357 - RNA, 21 nt, Human
cugugggcgugagaccugccc

SEQ ID NO: 3471358 - RNA, 23 nt, Human
cugugggcgugagaccugccccu

SEQ ID NO: 3471359 - RNA, 15 nt, Human
cugugggcucccuuc

SEQ ID NO: 3471360 - RNA, 20 nt, Human
cugugggcugcacucugugc

SEQ ID NO: 3471361 - RNA, 21 nt, Human
cugugggcugcacucugugcc

SEQ ID NO: 3471362 - RNA, 15 nt, Human
cugugggcuggcagu

SEQ ID NO: 3471363 - RNA, 21 nt, Human
cuguggggaaccaauugcuuu

SEQ ID NO: 3471364 - RNA, 23 nt, Human
cuguggggacuccggcugugcug

SEQ ID NO: 3471365 - RNA, 20 nt, Human
cuguggggaucucaggggcu

SEQ ID NO: 3471366 - RNA, 17 nt, Human
cuguggggauuucuccc

SEQ ID NO: 3471367 - RNA, 20 nt, Human
cuguggggauuucucccagc

SEQ ID NO: 3471368 - RNA, 21 nt, Human
cuguggggauuucucccagcu

SEQ ID NO: 3471369 - RNA, 22 nt, Human
cuguggggcugguagcucaggu

SEQ ID NO: 3471370 - RNA, 19 nt, Human
cugugggggaagagcacag

SEQ ID NO: 3471371 - RNA, 20 nt, Human
cugugggggaagagcacagc

SEQ ID NO: 3471372 - RNA, 21 nt, Human
cugugggggaagagcacagcc

SEQ ID NO: 3471373 - RNA, 16 nt, Human
cugugggucugggagu

SEQ ID NO: 3471374 - RNA, 22 nt, Human
cugugggucugggagucacaca

SEQ ID NO: 3471375 - RNA, 15 nt, Human
cugugggugacccag

SEQ ID NO: 3471376 - RNA, 18 nt, Human
cugugggugauggggagg

SEQ ID NO: 3471377 - RNA, 21 nt, Human
cugugggugauggggaggggc

SEQ ID NO: 3471378 - RNA, 16 nt, Human
cugugggugugugacu

SEQ ID NO: 3471379 - RNA, 22 nt, Human
cuguggguuucuaaagcugcca

SEQ ID NO: 3471380 - RNA, 15 nt, Human
cugugguaaaugcca

SEQ ID NO: 3471381 - RNA, 16 nt, Human
cugugguaaaugccac

SEQ ID NO: 3471382 - RNA, 20 nt, Human
cuguggucaaggcuacagau

SEQ ID NO: 3471383 - RNA, 17 nt, Human
cuguggugacuuuggau

SEQ ID NO: 3471384 - RNA, 23 nt, Human
cuguggugacuuuggauaauaag

SEQ ID NO: 3471385 - RNA, 15 nt, Human
cugugguuccucugc

SEQ ID NO: 3471386 - RNA, 16 nt, Human
cugugguuccucugcu

SEQ ID NO: 3471387 - RNA, 15 nt, Human
cugugguuccugggg

SEQ ID NO: 3471388 - RNA, 21 nt, Human
cugugguuccuggggugcccu

SEQ ID NO: 3471389 - RNA, 17 nt, Human
cugugguuggcugggaa

SEQ ID NO: 3471390 - RNA, 20 nt, Human
cugugguuugggggagaaga

SEQ ID NO: 3471391 - RNA, 20 nt, Human
cugugguuuuccccucccug

SEQ ID NO: 3471392 - RNA, 14 nt, Human
cuguguaaacucau

SEQ ID NO: 3471393 - RNA, 21 nt, Human
cuguguaaacucaucugaaau

SEQ ID NO: 3471394 - RNA, 18 nt, Human
cuguguaaaguuagucua

SEQ ID NO: 3471395 - RNA, 13 nt, Human
cuguguaacagcu

SEQ ID NO: 3471396 - RNA, 17 nt, Human
cuguguaacagcuccuu

SEQ ID NO: 3471397 - RNA, 13 nt, Human
cuguguaacugcc

SEQ ID NO: 3471398 - RNA, 16 nt, Human
cuguguaacugcccaa

SEQ ID NO: 3471399 - RNA, 14 nt, Human
cuguguaagcugug

SEQ ID NO: 3471400 - RNA, 23 nt, Human
cuguguaagggccagaaauaucu

SEQ ID NO: 3471401 - RNA, 11 nt, Human
cuguguacugu

SEQ ID NO: 3471402 - RNA, 18 nt, Human
cuguguacuguauagaca

SEQ ID NO: 3471403 - RNA, 13 nt, Human
cuguguacuguuc

SEQ ID NO: 3471404 - RNA, 13 nt, Human
cuguguagcuggg

SEQ ID NO: 3471405 - RNA, 15 nt, Human
cuguguagcugugac

SEQ ID NO: 3471406 - RNA, 16 nt, Human
cuguguagcugugacc

SEQ ID NO: 3471407 - RNA, 17 nt, Human
cuguguagcugugaccu

SEQ ID NO: 3471408 - RNA, 21 nt, Human
cuguguauaugguauauauac

SEQ ID NO: 3471409 - RNA, 12 nt, Human
cuguguauauua

SEQ ID NO: 3471410 - RNA, 18 nt, Human
cuguguauauuauuuggc

SEQ ID NO: 3471411 - RNA, 20 nt, Human
cuguguauauuugauuuauu

SEQ ID NO: 3471412 - RNA, 22 nt, Human
cuguguauauuugauuuauuaa

SEQ ID NO: 3471413 - RNA, 14 nt, Human
cuguguauguacau

SEQ ID NO: 3471414 - RNA, 16 nt, Human
cuguguauucauugaa

SEQ ID NO: 3471415 - RNA, 21 nt, Human
cuguguauuuaauuguaaacu

SEQ ID NO: 3471416 - RNA, 16 nt, Human
cuguguauuugcuuuu

SEQ ID NO: 3471417 - RNA, 20 nt, Human
cugugucaauccagauggug

SEQ ID NO: 3471418 - RNA, 14 nt, Human
cugugucacuggcu

SEQ ID NO: 3471419 - RNA, 19 nt, Human
cugugucacuggcugccuc

SEQ ID NO: 3471420 - RNA, 20 nt, Human
cugugucacuggcugccucc

SEQ ID NO: 3471421 - RNA, 16 nt, Human
cugugucagccugucc

SEQ ID NO: 3471422 - RNA, 21 nt, Human
cugugucagguggggcagcuu

SEQ ID NO: 3471423 - RNA, 15 nt, Human
cugugucaguuuaug

SEQ ID NO: 3471424 - RNA, 19 nt, Human
cugugucaguuuauguuuu

SEQ ID NO: 3471425 - RNA, 23 nt, Human
cugugucauaaacagaugaauaa

SEQ ID NO: 3471426 - RNA, 22 nt, Human
cugugucauuuggcuuuccagu

SEQ ID NO: 3471427 - RNA, 17 nt, Human
cuguguccaccuguggg

SEQ ID NO: 3471428 - RNA, 19 nt, Human
cuguguccaugcgcucagg

SEQ ID NO: 3471429 - RNA, 21 nt, Human
cuguguccaugcgcucagggc

SEQ ID NO: 3471430 - RNA, 22 nt, Human
cuguguccaugcgcucagggcc

SEQ ID NO: 3471431 - RNA, 23 nt, Human
cuguguccaugcgcucagggcca

SEQ ID NO: 3471432 - RNA, 23 nt, Human
cuguguccugaaacgcuccuuug

SEQ ID NO: 3471433 - RNA, 13 nt, Human
cuguguccuggug

SEQ ID NO: 3471434 - RNA, 14 nt, Human
cuguguccuggugc

SEQ ID NO: 3471435 - RNA, 19 nt, Human
cuguguccuugcaccugca

SEQ ID NO: 3471436 - RNA, 22 nt, Human
cuguguccuugcaccugcaucc

SEQ ID NO: 3471437 - RNA, 16 nt, Human
cugugucguagccaag

SEQ ID NO: 3471438 - RNA, 16 nt, Human
cugugucuaaacugca

SEQ ID NO: 3471439 - RNA, 12 nt, Human
cugugucuaaga

SEQ ID NO: 3471440 - RNA, 18 nt, Human
cugugucuaagauucuag

SEQ ID NO: 3471441 - RNA, 17 nt, Human
cugugucucuuuucucu

SEQ ID NO: 3471442 - RNA, 18 nt, Human
cugugucugaguggcuuc

SEQ ID NO: 3471443 - RNA, 16 nt, Human
cugugucuguguuuua

SEQ ID NO: 3471444 - RNA, 16 nt, Human
cugugucuugcaaugg

SEQ ID NO: 3471445 - RNA, 23 nt, Human
cugugucuugcaauggcagccuu

SEQ ID NO: 3471446 - RNA, 20 nt, Human
cugugucuuugguuugugcu

SEQ ID NO: 3471447 - RNA, 12 nt, Human
cugugugaaaua

SEQ ID NO: 3471448 - RNA, 19 nt, Human
cugugugaaauaccagugu

SEQ ID NO: 3471449 - RNA, 18 nt, Human
cugugugaauaccugcuc

SEQ ID NO: 3471450 - RNA, 14 nt, Human
cugugugauuaaaa

SEQ ID NO: 3471451 - RNA, 15 nt, Human
cugugugcagugaag

SEQ ID NO: 3471452 - RNA, 17 nt, Human
cugugugcagugaaggu

SEQ ID NO: 3471453 - RNA, 16 nt, Human
cugugugccuggggga

SEQ ID NO: 3471454 - RNA, 16 nt, Human
cugugugcucaggagc

SEQ ID NO: 3471455 - RNA, 21 nt, Human
cugugugcucaggagcccugg

SEQ ID NO: 3471456 - RNA, 18 nt, Human
cugugugcuccuccuugg

SEQ ID NO: 3471457 - RNA, 23 nt, Human
cugugugcuccuccuuggugccu

SEQ ID NO: 3471458 - RNA, 13 nt, Human
cugugugcugugg

SEQ ID NO: 3471459 - RNA, 15 nt, Human
cugugugcuuggucu

SEQ ID NO: 3471460 - RNA, 20 nt, Human
cugugugcuuuuuuugugug

SEQ ID NO: 3471461 - RNA, 12 nt, Human
cuguguggaacu

SEQ ID NO: 3471462 - RNA, 18 nt, Human
cuguguggacugugaugc

SEQ ID NO: 3471463 - RNA, 12 nt, Human
cuguguggagag

SEQ ID NO: 3471464 - RNA, 22 nt, Human
cuguguggagagggaaugugaa

SEQ ID NO: 3471465 - RNA, 22 nt, Human
cugugugggacuguacacacuu

SEQ ID NO: 3471466 - RNA, 11 nt, Human
cugugugguug

SEQ ID NO: 3471467 - RNA, 23 nt, Human
cugugugguuuaguguaaaaaug

SEQ ID NO: 3471468 - RNA, 21 nt, Human
cugugugguuugguguguucc

SEQ ID NO: 3471469 - RNA, 17 nt, Human
cugugugucaguuuuca

SEQ ID NO: 3471470 - RNA, 18 nt, Human
cugugugucaguuuucau

SEQ ID NO: 3471471 - RNA, 15 nt, Human
cuguguguccaaaac

SEQ ID NO: 3471472 - RNA, 19 nt, Human
cuguguguccaaaacugcc

SEQ ID NO: 3471473 - RNA, 22 nt, Human
cuguguguccaaaacugccuca

SEQ ID NO: 3471474 - RNA, 19 nt, Human
cugugugucccaggcaggg

SEQ ID NO: 3471475 - RNA, 22 nt, Human
cugugugucccaggcagggaga

SEQ ID NO: 3471476 - RNA, 18 nt, Human
cugugugugaccccuccu

SEQ ID NO: 3471477 - RNA, 20 nt, Human
cugugugugaccccuccugg

SEQ ID NO: 3471478 - RNA, 21 nt, Human
cugugugugugaaugaacacu

SEQ ID NO: 3471479 - RNA, 23 nt, Human
cugugugugugaaugaacacucu

SEQ ID NO: 3471480 - RNA, 14 nt, Human
cuguguguguguau

SEQ ID NO: 3471481 - RNA, 15 nt, Human
cuguguguguguaug

SEQ ID NO: 3471482 - RNA, 18 nt, Human
cuguguguguguaugugg

SEQ ID NO: 3471483 - RNA, 18 nt, Human
cuguguguuaagcucugc

SEQ ID NO: 3471484 - RNA, 18 nt, Human
cuguguguuaguucccaa

SEQ ID NO: 3471485 - RNA, 15 nt, Human
cuguguguuccuggc

SEQ ID NO: 3471486 - RNA, 16 nt, Human
cuguguguugccuggg

SEQ ID NO: 3471487 - RNA, 17 nt, Human
cuguguguuuaugugug

SEQ ID NO: 3471488 - RNA, 20 nt, Human
cuguguguuuaugugugugu

SEQ ID NO: 3471489 - RNA, 19 nt, Human
cuguguguuuucauaauaa

SEQ ID NO: 3471490 - RNA, 16 nt, Human
cuguguuaauuuaagu

SEQ ID NO: 3471491 - RNA, 22 nt, Human
cuguguuacuaaaaaaaagaug

SEQ ID NO: 3471492 - RNA, 23 nt, Human
cuguguuacuaaaaaaaagauga

SEQ ID NO: 3471493 - RNA, 17 nt, Human
cuguguuaugcaaaagc

SEQ ID NO: 3471494 - RNA, 19 nt, Human
cuguguuaugcaaaagcaa

SEQ ID NO: 3471495 - RNA, 23 nt, Human
cuguguuauuauagagcagaaau

SEQ ID NO: 3471496 - RNA, 12 nt, Human
cuguguuccugg

SEQ ID NO: 3471497 - RNA, 13 nt, Human
cuguguuccuucc

SEQ ID NO: 3471498 - RNA, 18 nt, Human
cuguguucgacucagccu

SEQ ID NO: 3471499 - RNA, 21 nt, Human
cuguguucgacucagccucag

SEQ ID NO: 3471500 - RNA, 20 nt, Human
cuguguucuggugaggccuu

SEQ ID NO: 3471501 - RNA, 13 nt, Human
cuguguuguauua

SEQ ID NO: 3471502 - RNA, 23 nt, Human
cuguguuguugcuucuugugaag

SEQ ID NO: 3471503 - RNA, 17 nt, Human
cuguguuuacagagaug

SEQ ID NO: 3471504 - RNA, 19 nt, Human
cuguguuuauaaaauauaa

SEQ ID NO: 3471505 - RNA, 15 nt, Human
cuguguuuccaucuc

SEQ ID NO: 3471506 - RNA, 13 nt, Human
cuguguuucuugc

SEQ ID NO: 3471507 - RNA, 19 nt, Human
cuguguuucuuuugguucc

SEQ ID NO: 3471508 - RNA, 19 nt, Human
cuguguuugaacugaaguc

SEQ ID NO: 3471509 - RNA, 15 nt, Human
cuguguuugcagccu

SEQ ID NO: 3471510 - RNA, 22 nt, Human
cuguguuuggcuuucagggagg

SEQ ID NO: 3471511 - RNA, 16 nt, Human
cuguguuuugaaagaa

SEQ ID NO: 3471512 - RNA, 23 nt, Human
cuguguuuuugcuaucacacagu

SEQ ID NO: 3471513 - RNA, 16 nt, Human
cuguuaaaagaugaaa

SEQ ID NO: 3471514 - RNA, 19 nt, Human
cuguuaaaagaugaaaaua

SEQ ID NO: 3471515 - RNA, 23 nt, Human
cuguuaaaagaugaaaauauuug

SEQ ID NO: 3471516 - RNA, 12 nt, Human
cuguuaaaaucu

SEQ ID NO: 3471517 - RNA, 13 nt, Human
cuguuaaaaugca

SEQ ID NO: 3471518 - RNA, 23 nt, Human
cuguuaaaaugcaugauugcaga

SEQ ID NO: 3471519 - RNA, 15 nt, Human
cuguuaaacuguuag

SEQ ID NO: 3471520 - RNA, 19 nt, Human
cuguuaaauacaggaaaca

SEQ ID NO: 3471521 - RNA, 22 nt, Human
cuguuaaauugcuguguaucug

SEQ ID NO: 3471522 - RNA, 19 nt, Human
cuguuaagaaaucuguuuu

SEQ ID NO: 3471523 - RNA, 21 nt, Human
cuguuaaggcauccacuucac

SEQ ID NO: 3471524 - RNA, 16 nt, Human
cuguuaagugguuuca

SEQ ID NO: 3471525 - RNA, 19 nt, Human
cuguuaauagaucuuaggg

SEQ ID NO: 3471526 - RNA, 18 nt, Human
cuguuaauguauuuguuc

SEQ ID NO: 3471527 - RNA, 11 nt, Human
cuguuacaaaa

SEQ ID NO: 3471528 - RNA, 15 nt, Human
cuguuacaaaaugua

SEQ ID NO: 3471529 - RNA, 13 nt, Human
cuguuacacugga

SEQ ID NO: 3471530 - RNA, 16 nt, Human
cuguuacacuggagga

SEQ ID NO: 3471531 - RNA, 20 nt, Human
cuguuacaguaaugucauaa

SEQ ID NO: 3471532 - RNA, 15 nt, Human
cuguuaccaugucac

SEQ ID NO: 3471533 - RNA, 16 nt, Human
cuguuaccaugucacu

SEQ ID NO: 3471534 - RNA, 16 nt, Human
cuguuaccauuggaaa

SEQ ID NO: 3471535 - RNA, 21 nt, Human
cuguuaccauuggaaauuuca

SEQ ID NO: 3471536 - RNA, 21 nt, Human
cuguuaccucaacaagaagaa

SEQ ID NO: 3471537 - RNA, 22 nt, Human
cuguuaccucaacaagaagaau

SEQ ID NO: 3471538 - RNA, 20 nt, Human
cuguuacucaaugugugccg

SEQ ID NO: 3471539 - RNA, 20 nt, Human
cuguuacugggcccugaguc

SEQ ID NO: 3471540 - RNA, 18 nt, Human
cuguuacuguuaaccauu

SEQ ID NO: 3471541 - RNA, 18 nt, Human
cuguuacuugaaauacca

SEQ ID NO: 3471542 - RNA, 13 nt, Human
cuguuagaacacu

SEQ ID NO: 3471543 - RNA, 17 nt, Human
cuguuagaacacuauuu

SEQ ID NO: 3471544 - RNA, 22 nt, Human
cuguuagaacacuauuuucaga

SEQ ID NO: 3471545 - RNA, 20 nt, Human
cuguuagaugcuacuaagaa

SEQ ID NO: 3471546 - RNA, 14 nt, Human
cuguuagcacuguu

SEQ ID NO: 3471547 - RNA, 15 nt, Human
cuguuagcacuguug

SEQ ID NO: 3471548 - RNA, 13 nt, Human
cuguuagcagaca

SEQ ID NO: 3471549 - RNA, 19 nt, Human
cuguuagcuuuuuaaaaca

SEQ ID NO: 3471550 - RNA, 18 nt, Human
cuguuagucauuugcuga

SEQ ID NO: 3471551 - RNA, 22 nt, Human
cuguuauauaaaugguuaaaag

SEQ ID NO: 3471552 - RNA, 14 nt, Human
cuguuauauuucau

SEQ ID NO: 3471553 - RNA, 17 nt, Human
cuguuauauuucaucau

SEQ ID NO: 3471554 - RNA, 19 nt, Human
cuguuaucccugccugguc

SEQ ID NO: 3471555 - RNA, 13 nt, Human
cuguuauguacug

SEQ ID NO: 3471556 - RNA, 15 nt, Human
cuguuauguacugua

SEQ ID NO: 3471557 - RNA, 16 nt, Human
cuguuauguacuguac

SEQ ID NO: 3471558 - RNA, 12 nt, Human
cuguuaugucug

SEQ ID NO: 3471559 - RNA, 14 nt, Human
cuguuauuuagacu

SEQ ID NO: 3471560 - RNA, 16 nt, Human
cuguuauuuagacuca

SEQ ID NO: 3471561 - RNA, 19 nt, Human
cuguucaacaucacugaaa

SEQ ID NO: 3471562 - RNA, 21 nt, Human
cuguucaagagcacacuuggc

SEQ ID NO: 3471563 - RNA, 17 nt, Human
cuguucaaggccccuga

SEQ ID NO: 3471564 - RNA, 17 nt, Human
cuguucaauguuuaaug

SEQ ID NO: 3471565 - RNA, 19 nt, Human
cuguucacagccagacugg

SEQ ID NO: 3471566 - RNA, 18 nt, Human
cuguucacccacagggcu

SEQ ID NO: 3471567 - RNA, 17 nt, Human
cuguucacuuuuccucc

SEQ ID NO: 3471568 - RNA, 12 nt, Human
cuguucagcauu

SEQ ID NO: 3471569 - RNA, 13 nt, Human
cuguucagcauuc

SEQ ID NO: 3471570 - RNA, 17 nt, Human
cuguucagcguuuugca

SEQ ID NO: 3471571 - RNA, 16 nt, Human
cuguucagcuccagcu

SEQ ID NO: 3471572 - RNA, 12 nt, Human
cuguucagcugg

SEQ ID NO: 3471573 - RNA, 16 nt, Human
cuguucaguaacaggg

SEQ ID NO: 3471574 - RNA, 20 nt, Human
cuguucagugucccgggccc

SEQ ID NO: 3471575 - RNA, 19 nt, Human
cuguucaguuacagaaagu

SEQ ID NO: 3471576 - RNA, 15 nt, Human
cuguucaguugcacu

SEQ ID NO: 3471577 - RNA, 17 nt, Human
cuguucauacacuaacc

SEQ ID NO: 3471578 - RNA, 18 nt, Human
cuguucaugaaagauuca

SEQ ID NO: 3471579 - RNA, 23 nt, Human
cuguucaugaaagauucaaugcc

SEQ ID NO: 3471580 - RNA, 12 nt, Human
cuguucauugua

SEQ ID NO: 3471581 - RNA, 13 nt, Human
cuguucauuguaa

SEQ ID NO: 3471582 - RNA, 14 nt, Human
cuguuccaaauuca

SEQ ID NO: 3471583 - RNA, 21 nt, Human
cuguuccaaauucaguuucau

SEQ ID NO: 3471584 - RNA, 14 nt, Human
cuguuccagccugc

SEQ ID NO: 3471585 - RNA, 17 nt, Human
cuguucccaccugcugg

SEQ ID NO: 3471586 - RNA, 20 nt, Human
cuguucccauguagcccccu

SEQ ID NO: 3471587 - RNA, 14 nt, Human
cuguuccccagaga

SEQ ID NO: 3471588 - RNA, 16 nt, Human
cuguuccccagagaaa

SEQ ID NO: 3471589 - RNA, 12 nt, Human
cuguucccccug

SEQ ID NO: 3471590 - RNA, 14 nt, Human
cuguucccccuuca

SEQ ID NO: 3471591 - RNA, 16 nt, Human
cuguucccccuucaca

SEQ ID NO: 3471592 - RNA, 23 nt, Human
cuguuccccuaguaagugccuuc

SEQ ID NO: 3471593 - RNA, 17 nt, Human
cuguuccccucacugga

SEQ ID NO: 3471594 - RNA, 14 nt, Human
cuguuccccucucc

SEQ ID NO: 3471595 - RNA, 20 nt, Human
cuguuccccucucccuuccc

SEQ ID NO: 3471596 - RNA, 14 nt, Human
cuguucccucugcu

SEQ ID NO: 3471597 - RNA, 19 nt, Human
cuguucccucugcuccugg

SEQ ID NO: 3471598 - RNA, 21 nt, Human
cuguuccucucuuuuccuguu

SEQ ID NO: 3471599 - RNA, 15 nt, Human
cuguuccugcugcug

SEQ ID NO: 3471600 - RNA, 16 nt, Human
cuguuccugcugcugu

SEQ ID NO: 3471601 - RNA, 15 nt, Human
cuguuccuuagaccu

SEQ ID NO: 3471602 - RNA, 12 nt, Human
cuguuccuuuua

SEQ ID NO: 3471603 - RNA, 17 nt, Human
cuguucuaaagcucuga

SEQ ID NO: 3471604 - RNA, 15 nt, Human
cuguucuaacaugua

SEQ ID NO: 3471605 - RNA, 22 nt, Human
cuguucuaagggggaggggaag

SEQ ID NO: 3471606 - RNA, 20 nt, Human
cuguucuacauagaugcuua

SEQ ID NO: 3471607 - RNA, 19 nt, Human
cuguucuacccguuccaaa

SEQ ID NO: 3471608 - RNA, 22 nt, Human
cuguucuagcacuucaucuggc

SEQ ID NO: 3471609 - RNA, 14 nt, Human
cuguucuaguuuuu

SEQ ID NO: 3471610 - RNA, 19 nt, Human
cuguucuaguuuuuuacuu

SEQ ID NO: 3471611 - RNA, 14 nt, Human
cuguucucugcccu

SEQ ID NO: 3471612 - RNA, 20 nt, Human
cuguucucugcccuccaaga

SEQ ID NO: 3471613 - RNA, 11 nt, Human
cuguucuggaa

SEQ ID NO: 3471614 - RNA, 13 nt, Human
cuguucuggagga

SEQ ID NO: 3471615 - RNA, 23 nt, Human
cuguucuggaggaaagggaggag

SEQ ID NO: 3471616 - RNA, 16 nt, Human
cuguucuggcagaguu

SEQ ID NO: 3471617 - RNA, 20 nt, Human
cuguucugggugcagcugag

SEQ ID NO: 3471618 - RNA, 19 nt, Human
cuguucugucccuuggagc

SEQ ID NO: 3471619 - RNA, 15 nt, Human
cuguucuguggaaag

SEQ ID NO: 3471620 - RNA, 20 nt, Human
cuguucuguggaaaguguaa

SEQ ID NO: 3471621 - RNA, 11 nt, Human
cuguucugugu

SEQ ID NO: 3471622 - RNA, 13 nt, Human
cuguucugugucu

SEQ ID NO: 3471623 - RNA, 14 nt, Human
cuguucuguuucaa

SEQ ID NO: 3471624 - RNA, 21 nt, Human
cuguucuguuucaaggcacuc

SEQ ID NO: 3471625 - RNA, 17 nt, Human
cuguucuuagcucaaug

SEQ ID NO: 3471626 - RNA, 12 nt, Human
cuguucuuccuc

SEQ ID NO: 3471627 - RNA, 17 nt, Human
cuguucuuccucagcca

SEQ ID NO: 3471628 - RNA, 20 nt, Human
cuguucuuccucagccagcc

SEQ ID NO: 3471629 - RNA, 22 nt, Human
cuguucuuccucagccagccuc

SEQ ID NO: 3471630 - RNA, 13 nt, Human
cuguucuuccucc

SEQ ID NO: 3471631 - RNA, 14 nt, Human
cuguucuuccucca

SEQ ID NO: 3471632 - RNA, 23 nt, Human
cuguucuuccuccagcugcacca

SEQ ID NO: 3471633 - RNA, 12 nt, Human
cuguucuugaag

SEQ ID NO: 3471634 - RNA, 11 nt, Human
cuguucuugcu

SEQ ID NO: 3471635 - RNA, 15 nt, Human
cuguucuugcugcua

SEQ ID NO: 3471636 - RNA, 19 nt, Human
cuguucuugcugcuagaac

SEQ ID NO: 3471637 - RNA, 21 nt, Human
cuguucuugcugcuagaacuu

SEQ ID NO: 3471638 - RNA, 13 nt, Human
cuguucuuggggc

SEQ ID NO: 3471639 - RNA, 23 nt, Human
cuguucuuucuggcuaugcauuu

SEQ ID NO: 3471640 - RNA, 22 nt, Human
cuguugaaaagccauguuuaag

SEQ ID NO: 3471641 - RNA, 12 nt, Human
cuguugaaaauu

SEQ ID NO: 3471642 - RNA, 12 nt, Human
cuguugaaagca

SEQ ID NO: 3471643 - RNA, 19 nt, Human
cuguugaaagcaaaaaugc

SEQ ID NO: 3471644 - RNA, 17 nt, Human
cuguugaauuucccaca

SEQ ID NO: 3471645 - RNA, 17 nt, Human
cuguugacacaggucuu

SEQ ID NO: 3471646 - RNA, 16 nt, Human
cuguugacauauuuaa

SEQ ID NO: 3471647 - RNA, 17 nt, Human
cuguugaccaggcaccu

SEQ ID NO: 3471648 - RNA, 11 nt, Human
cuguugacucu

SEQ ID NO: 3471649 - RNA, 20 nt, Human
cuguugagcuguuuucccug

SEQ ID NO: 3471650 - RNA, 15 nt, Human
cuguugauaaaaacu

SEQ ID NO: 3471651 - RNA, 15 nt, Human
cuguugauaaaucca

SEQ ID NO: 3471652 - RNA, 20 nt, Human
cuguugaugaggccucuugg

SEQ ID NO: 3471653 - RNA, 17 nt, Human
cuguugaugggaugauu

SEQ ID NO: 3471654 - RNA, 13 nt, Human
cuguugauuaauu

SEQ ID NO: 3471655 - RNA, 19 nt, Human
cuguugauuaauuucugcc

SEQ ID NO: 3471656 - RNA, 15 nt, Human
cuguugauugcuaaa

SEQ ID NO: 3471657 - RNA, 17 nt, Human
cuguugauugcuaaaug

SEQ ID NO: 3471658 - RNA, 19 nt, Human
cuguugauugcuaaaugua

SEQ ID NO: 3471659 - RNA, 23 nt, Human
cuguugauugcuaaauguaacag

SEQ ID NO: 3471660 - RNA, 20 nt, Human
cuguugcacccagcccuggu

SEQ ID NO: 3471661 - RNA, 20 nt, Human
cuguugcacguguguuuuuc

SEQ ID NO: 3471662 - RNA, 15 nt, Human
cuguugcccacguuu

SEQ ID NO: 3471663 - RNA, 13 nt, Human
cuguugcccaggc

SEQ ID NO: 3471664 - RNA, 17 nt, Human
cuguugcccaggcuggc

SEQ ID NO: 3471665 - RNA, 14 nt, Human
cuguugccucaucu

SEQ ID NO: 3471666 - RNA, 18 nt, Human
cuguugcguaacuggcug

SEQ ID NO: 3471667 - RNA, 23 nt, Human
cuguugcuauagagccuaccugu

SEQ ID NO: 3471668 - RNA, 15 nt, Human
cuguugcugauuuua

SEQ ID NO: 3471669 - RNA, 17 nt, Human
cuguugcugccucaugc

SEQ ID NO: 3471670 - RNA, 21 nt, Human
cuguugcuguguuuaauuuga

SEQ ID NO: 3471671 - RNA, 15 nt, Human
cuguugcuuacaauu

SEQ ID NO: 3471672 - RNA, 11 nt, Human
cuguuggaagc

SEQ ID NO: 3471673 - RNA, 18 nt, Human
cuguuggacccgcucugg

SEQ ID NO: 3471674 - RNA, 18 nt, Human
cuguuggauuccaugcua

SEQ ID NO: 3471675 - RNA, 22 nt, Human
cuguuggauuuguuuaaaagga

SEQ ID NO: 3471676 - RNA, 18 nt, Human
cuguuggcacucacagac

SEQ ID NO: 3471677 - RNA, 22 nt, Human
cuguuggcacucacagaccugg

SEQ ID NO: 3471678 - RNA, 23 nt, Human
cuguuggcacucacagaccugga

SEQ ID NO: 3471679 - RNA, 16 nt, Human
cuguuggcaggcuggc

SEQ ID NO: 3471680 - RNA, 22 nt, Human
cuguuggcagugagugagccug

SEQ ID NO: 3471681 - RNA, 14 nt, Human
cuguuggcuggggg

SEQ ID NO: 3471682 - RNA, 22 nt, Human
cuguuggcugggggccucagug

SEQ ID NO: 3471683 - RNA, 20 nt, Human
cuguugggccaggagccucc

SEQ ID NO: 3471684 - RNA, 23 nt, Human
cuguugggguggguauaaaagau

SEQ ID NO: 3471685 - RNA, 11 nt, Human
cuguuguaacu

SEQ ID NO: 3471686 - RNA, 22 nt, Human
cuguuguaacuaggcucagaga

SEQ ID NO: 3471687 - RNA, 12 nt, Human
cuguuguaacuu

SEQ ID NO: 3471688 - RNA, 17 nt, Human
cuguuguaagaauucug

SEQ ID NO: 3471689 - RNA, 12 nt, Human
cuguuguacauu

SEQ ID NO: 3471690 - RNA, 13 nt, Human
cuguuguacauuu

SEQ ID NO: 3471691 - RNA, 19 nt, Human
cuguuguacauuuaugauu

SEQ ID NO: 3471692 - RNA, 15 nt, Human
cuguuguacuaugga

SEQ ID NO: 3471693 - RNA, 22 nt, Human
cuguuguauaaauuuauuuacu

SEQ ID NO: 3471694 - RNA, 18 nt, Human
cuguugucaccuucaccu

SEQ ID NO: 3471695 - RNA, 23 nt, Human
cuguugucaccuucaccuccuuu

SEQ ID NO: 3471696 - RNA, 14 nt, Human
cuguugucauugcu

SEQ ID NO: 3471697 - RNA, 16 nt, Human
cuguugucauugcuuu

SEQ ID NO: 3471698 - RNA, 16 nt, Human
cuguuguccuauggga

SEQ ID NO: 3471699 - RNA, 15 nt, Human
cuguugucucuucuc

SEQ ID NO: 3471700 - RNA, 13 nt, Human
cuguugugccaca

SEQ ID NO: 3471701 - RNA, 15 nt, Human
cuguugugccacaga

SEQ ID NO: 3471702 - RNA, 13 nt, Human
cuguuguuaucug

SEQ ID NO: 3471703 - RNA, 14 nt, Human
cuguuguuaugaug

SEQ ID NO: 3471704 - RNA, 15 nt, Human
cuguuguuaugaugu

SEQ ID NO: 3471705 - RNA, 17 nt, Human
cuguuguuauggaaacu

SEQ ID NO: 3471706 - RNA, 22 nt, Human
cuguuguuguuaaugaaaaugu

SEQ ID NO: 3471707 - RNA, 9 nt, Human
cuguuguuu

SEQ ID NO: 3471708 - RNA, 20 nt, Human
cuguuuaaauguuuuucuau

SEQ ID NO: 3471709 - RNA, 11 nt, Human
cuguuuaaauu

SEQ ID NO: 3471710 - RNA, 14 nt, Human
cuguuuaaauugcu

SEQ ID NO: 3471711 - RNA, 16 nt, Human
cuguuuaauauuuaaa

SEQ ID NO: 3471712 - RNA, 18 nt, Human
cuguuuaauauuuaaaca

SEQ ID NO: 3471713 - RNA, 20 nt, Human
cuguuuaauauuuaaacagc

SEQ ID NO: 3471714 - RNA, 18 nt, Human
cuguuuacaagaaaaaau

SEQ ID NO: 3471715 - RNA, 15 nt, Human
cuguuuacaguguuc

SEQ ID NO: 3471716 - RNA, 22 nt, Human
cuguuuagauuugccauagagu

SEQ ID NO: 3471717 - RNA, 17 nt, Human
cuguuuagcagcagccu

SEQ ID NO: 3471718 - RNA, 19 nt, Human
cuguuuaucccuuaagaau

SEQ ID NO: 3471719 - RNA, 13 nt, Human
cuguuuauggccu

SEQ ID NO: 3471720 - RNA, 22 nt, Human
cuguuuauuaaaguacaaccau

SEQ ID NO: 3471721 - RNA, 18 nt, Human
cuguuuauuaaucuuagu

SEQ ID NO: 3471722 - RNA, 19 nt, Human
cuguuuauuacuuccauga

SEQ ID NO: 3471723 - RNA, 21 nt, Human
cuguuuauucauaugcauauu

SEQ ID NO: 3471724 - RNA, 16 nt, Human
cuguuuauuucuguuu

SEQ ID NO: 3471725 - RNA, 14 nt, Human
cuguuucaaaguuc

SEQ ID NO: 3471726 - RNA, 16 nt, Human
cuguuucaaucacugu

SEQ ID NO: 3471727 - RNA, 16 nt, Human
cuguuucagaggcuca

SEQ ID NO: 3471728 - RNA, 12 nt, Human
cuguuucccagc

SEQ ID NO: 3471729 - RNA, 19 nt, Human
cuguuucccuucccuucca

SEQ ID NO: 3471730 - RNA, 17 nt, Human
cuguuucucagucucac

SEQ ID NO: 3471731 - RNA, 14 nt, Human
cuguuucucugcug

SEQ ID NO: 3471732 - RNA, 15 nt, Human
cuguuucucuugagc

SEQ ID NO: 3471733 - RNA, 20 nt, Human
cuguuucucuuuccuuggcu

SEQ ID NO: 3471734 - RNA, 15 nt, Human
cuguuucugaaaaga

SEQ ID NO: 3471735 - RNA, 17 nt, Human
cuguuucugaaaagaaa

SEQ ID NO: 3471736 - RNA, 17 nt, Human
cuguuucugcuugcucu

SEQ ID NO: 3471737 - RNA, 14 nt, Human
cuguuucuugcuug

SEQ ID NO: 3471738 - RNA, 21 nt, Human
cuguuugauauaccaaauuaa

SEQ ID NO: 3471739 - RNA, 23 nt, Human
cuguuugauauaccaaauuaaaa

SEQ ID NO: 3471740 - RNA, 12 nt, Human
cuguuugauucu

SEQ ID NO: 3471741 - RNA, 22 nt, Human
cuguuugcauuugauacauuuu

SEQ ID NO: 3471742 - RNA, 16 nt, Human
cuguuugcugaugguc

SEQ ID NO: 3471743 - RNA, 15 nt, Human
cuguuugcuguugcu

SEQ ID NO: 3471744 - RNA, 22 nt, Human
cuguuugcuguugcugauuuua

SEQ ID NO: 3471745 - RNA, 23 nt, Human
cuguuuggauuuuuaauuaaaaa

SEQ ID NO: 3471746 - RNA, 14 nt, Human
cuguuuggccucuc

SEQ ID NO: 3471747 - RNA, 17 nt, Human
cuguuugguuuuaaaau

SEQ ID NO: 3471748 - RNA, 21 nt, Human
cuguuugguuuuaaaauacug

SEQ ID NO: 3471749 - RNA, 16 nt, Human
cuguuugucuucuccc

SEQ ID NO: 3471750 - RNA, 12 nt, Human
cuguuuguuaug

SEQ ID NO: 3471751 - RNA, 13 nt, Human
cuguuuguuauug

SEQ ID NO: 3471752 - RNA, 15 nt, Human
cuguuuguuucaaga

SEQ ID NO: 3471753 - RNA, 21 nt, Human
cuguuuguuucugaaagggac

SEQ ID NO: 3471754 - RNA, 16 nt, Human
cuguuuuaaaaaccug

SEQ ID NO: 3471755 - RNA, 12 nt, Human
cuguuuuaaauu

SEQ ID NO: 3471756 - RNA, 14 nt, Human
cuguuuuaaguucu

SEQ ID NO: 3471757 - RNA, 22 nt, Human
cuguuuuacaaaaaagaaaaga

SEQ ID NO: 3471758 - RNA, 17 nt, Human
cuguuuuacaaguugga

SEQ ID NO: 3471759 - RNA, 17 nt, Human
cuguuuuacugcuuuua

SEQ ID NO: 3471760 - RNA, 14 nt, Human
cuguuuuauacugu

SEQ ID NO: 3471761 - RNA, 15 nt, Human
cuguuuuaugacuuc

SEQ ID NO: 3471762 - RNA, 16 nt, Human
cuguuuuaugacuuca

SEQ ID NO: 3471763 - RNA, 12 nt, Human
cuguuuuccccc

SEQ ID NO: 3471764 - RNA, 12 nt, Human
cuguuuuccucc

SEQ ID NO: 3471765 - RNA, 17 nt, Human
cuguuuuccucccuucu

SEQ ID NO: 3471766 - RNA, 19 nt, Human
cuguuuuccucccuucugc

SEQ ID NO: 3471767 - RNA, 20 nt, Human
cuguuuucuaguguaucaaa

SEQ ID NO: 3471768 - RNA, 13 nt, Human
cuguuuucucuug

SEQ ID NO: 3471769 - RNA, 17 nt, Human
cuguuuucugagcccgg

SEQ ID NO: 3471770 - RNA, 12 nt, Human
cuguuuucuucu

SEQ ID NO: 3471771 - RNA, 18 nt, Human
cuguuuugaaucucauaa

SEQ ID NO: 3471772 - RNA, 12 nt, Human
cuguuuugaauu

SEQ ID NO: 3471773 - RNA, 17 nt, Human
cuguuuuggguagcugc

SEQ ID NO: 3471774 - RNA, 21 nt, Human
cuguuuuguaaaguccccaga

SEQ ID NO: 3471775 - RNA, 19 nt, Human
cuguuuugugguuuggaau

SEQ ID NO: 3471776 - RNA, 20 nt, Human
cuguuuugugguuuggaaua

SEQ ID NO: 3471777 - RNA, 13 nt, Human
cuguuuuguuaua

SEQ ID NO: 3471778 - RNA, 19 nt, Human
cuguuuuguuauauaauuu

SEQ ID NO: 3471779 - RNA, 20 nt, Human
cuguuuuguuauauaauuua

SEQ ID NO: 3471780 - RNA, 22 nt, Human
cuguuuuguugacauucugaau

SEQ ID NO: 3471781 - RNA, 23 nt, Human
cuguuuuguuucgcucuuugaga

SEQ ID NO: 3471782 - RNA, 22 nt, Human
cuguuuuguuuuguuuuuuaaa

SEQ ID NO: 3471783 - RNA, 15 nt, Human
cuguuuuuaagcugu

SEQ ID NO: 3471784 - RNA, 19 nt, Human
cuguuuuuaagcuguuucc

SEQ ID NO: 3471785 - RNA, 23 nt, Human
cuguuuuuaagcuguuuccauag

SEQ ID NO: 3471786 - RNA, 15 nt, Human
cuguuuuuacccaua

SEQ ID NO: 3471787 - RNA, 20 nt, Human
cuguuuuuacccauaucccc

SEQ ID NO: 3471788 - RNA, 21 nt, Human
cuguuuuucagggagguggcu

SEQ ID NO: 3471789 - RNA, 18 nt, Human
cuguuuuuccauaguuuu

SEQ ID NO: 3471790 - RNA, 20 nt, Human
cuguuuuucggacaguuuau

SEQ ID NO: 3471791 - RNA, 22 nt, Human
cuguuuuucggacaguuuauuu

SEQ ID NO: 3471792 - RNA, 20 nt, Human
cuguuuuucuaggccugggg

SEQ ID NO: 3471793 - RNA, 19 nt, Human
cuguuuuuuaaacuaggaa

SEQ ID NO: 3471794 - RNA, 20 nt, Human
cuuaaaaaaaaaaaaaagcu

SEQ ID NO: 3471795 - RNA, 23 nt, Human
cuuaaaaaaaaaaaaaagcuuua

SEQ ID NO: 3471796 - RNA, 12 nt, Human
cuuaaaaaacuu

SEQ ID NO: 3471797 - RNA, 14 nt, Human
cuuaaaaaaugucc

SEQ ID NO: 3471798 - RNA, 12 nt, Human
cuuaaaaacaac

SEQ ID NO: 3471799 - RNA, 21 nt, Human
cuuaaaaaucacacuguaaau

SEQ ID NO: 3471800 - RNA, 15 nt, Human
cuuaaaaauguaaau

SEQ ID NO: 3471801 - RNA, 23 nt, Human
cuuaaaaauguuuuuucaugugu

SEQ ID NO: 3471802 - RNA, 21 nt, Human
cuuaaaaauuaaauuggaaag

SEQ ID NO: 3471803 - RNA, 15 nt, Human
cuuaaaaauuuauua

SEQ ID NO: 3471804 - RNA, 13 nt, Human
cuuaaaacaucau

SEQ ID NO: 3471805 - RNA, 18 nt, Human
cuuaaaacaucauuccuu

SEQ ID NO: 3471806 - RNA, 19 nt, Human
cuuaaaacaucauuccuuu

SEQ ID NO: 3471807 - RNA, 13 nt, Human
cuuaaaaccaaag

SEQ ID NO: 3471808 - RNA, 12 nt, Human
cuuaaaacuccu

SEQ ID NO: 3471809 - RNA, 13 nt, Human
cuuaaaagccauc

SEQ ID NO: 3471810 - RNA, 22 nt, Human
cuuaaaagcuaucuucauguaa

SEQ ID NO: 3471811 - RNA, 20 nt, Human
cuuaaaauaaacaguuguga

SEQ ID NO: 3471812 - RNA, 13 nt, Human
cuuaaaauaacuu

SEQ ID NO: 3471813 - RNA, 19 nt, Human
cuuaaaauaacuuauauca

SEQ ID NO: 3471814 - RNA, 15 nt, Human
cuuaaaauaagcagg

SEQ ID NO: 3471815 - RNA, 13 nt, Human
cuuaaaauacaag

SEQ ID NO: 3471816 - RNA, 13 nt, Human
cuuaaaauagaaa

SEQ ID NO: 3471817 - RNA, 22 nt, Human
cuuaaaauaggggauauuuaag

SEQ ID NO: 3471818 - RNA, 20 nt, Human
cuuaaaauauuccugcauuu

SEQ ID NO: 3471819 - RNA, 13 nt, Human
cuuaaaaugcaau

SEQ ID NO: 3471820 - RNA, 24 nt, Human
cuuaaaauguucacuuuugacaaa

SEQ ID NO: 3471821 - RNA, 16 nt, Human
cuuaaaauuugaaaca

SEQ ID NO: 3471822 - RNA, 23 nt, Human
cuuaaaauuugaaacauugcuuu

SEQ ID NO: 3471823 - RNA, 20 nt, Human
cuuaaacaguugcacagcau

SEQ ID NO: 3471824 - RNA, 14 nt, Human
cuuaaacugugugg

SEQ ID NO: 3471825 - RNA, 15 nt, Human
cuuaaacugugugga

SEQ ID NO: 3471826 - RNA, 13 nt, Human
cuuaaagaaacag

SEQ ID NO: 3471827 - RNA, 21 nt, Human
cuuaaagaaagucgaauuaau

SEQ ID NO: 3471828 - RNA, 15 nt, Human
cuuaaagaauucaaa

SEQ ID NO: 3471829 - RNA, 23 nt, Human
cuuaaagaauucaaauuuuaucu

SEQ ID NO: 3471830 - RNA, 15 nt, Human
cuuaaagaguguggc

SEQ ID NO: 3471831 - RNA, 21 nt, Human
cuuaaagaguguggcaaaaua

SEQ ID NO: 3471832 - RNA, 16 nt, Human
cuuaaagauuuaucaa

SEQ ID NO: 3471833 - RNA, 15 nt, Human
cuuaaagcuuucaga

SEQ ID NO: 3471834 - RNA, 16 nt, Human
cuuaaaggugucuucc

SEQ ID NO: 3471835 - RNA, 22 nt, Human
cuuaaagugccaguauuuuaaa

SEQ ID NO: 3471836 - RNA, 14 nt, Human
cuuaaaguugaauu

SEQ ID NO: 3471837 - RNA, 15 nt, Human
cuuaaaguugaauuu

SEQ ID NO: 3471838 - RNA, 22 nt, Human
cuuaaaguugaauuuauuggcu

SEQ ID NO: 3471839 - RNA, 22 nt, Human
cuuaaauaauaaagaucaugua

SEQ ID NO: 3471840 - RNA, 19 nt, Human
cuuaaauaaugcuucagau

SEQ ID NO: 3471841 - RNA, 15 nt, Human
cuuaaauauagcagu

SEQ ID NO: 3471842 - RNA, 13 nt, Human
cuuaaauauaguu

SEQ ID NO: 3471843 - RNA, 15 nt, Human
cuuaaauaucuuuua

SEQ ID NO: 3471844 - RNA, 11 nt, Human
cuuaaauuaaa

SEQ ID NO: 3471845 - RNA, 20 nt, Human
cuuaaauuaaacaauuuauu

SEQ ID NO: 3471846 - RNA, 20 nt, Human
cuuaaauuccucaacagugu

SEQ ID NO: 3471847 - RNA, 20 nt, Human
cuuaaauuucuuaugugaca

SEQ ID NO: 3471848 - RNA, 16 nt, Human
cuuaaauuuuaacuaa

SEQ ID NO: 3471849 - RNA, 18 nt, Human
cuuaaauuuuaacuaaau

SEQ ID NO: 3471850 - RNA, 16 nt, Human
cuuaaauuuuaauuua

SEQ ID NO: 3471851 - RNA, 17 nt, Human
cuuaacaaccuggccgc

SEQ ID NO: 3471852 - RNA, 16 nt, Human
cuuaacaguuguauuu

SEQ ID NO: 3471853 - RNA, 15 nt, Human
cuuaacaugcugugu

SEQ ID NO: 3471854 - RNA, 21 nt, Human
cuuaacaugcuguguaagcug

SEQ ID NO: 3471855 - RNA, 13 nt, Human
cuuaacaugggcu

SEQ ID NO: 3471856 - RNA, 14 nt, Human
cuuaacauucugua

SEQ ID NO: 3471857 - RNA, 17 nt, Human
cuuaaccagaucauugu

SEQ ID NO: 3471858 - RNA, 18 nt, Human
cuuaaccaguuguggugu

SEQ ID NO: 3471859 - RNA, 17 nt, Human
cuuaacggaccaaagca

SEQ ID NO: 3471860 - RNA, 20 nt, Human
cuuaacggaccaaagcaaga

SEQ ID NO: 3471861 - RNA, 16 nt, Human
cuuaacggcuccagga

SEQ ID NO: 3471862 - RNA, 17 nt, Human
cuuaacuccuuccagug

SEQ ID NO: 3471863 - RNA, 16 nt, Human
cuuaacuggucuccuu

SEQ ID NO: 3471864 - RNA, 22 nt, Human
cuuaacuuaaauuuuaauuuau

SEQ ID NO: 3471865 - RNA, 14 nt, Human
cuuaacuucacaua

SEQ ID NO: 3471866 - RNA, 17 nt, Human
cuuaacuucacauauug

SEQ ID NO: 3471867 - RNA, 22 nt, Human
cuuaacuucacauauugauuuc

SEQ ID NO: 3471868 - RNA, 15 nt, Human
cuuaacuucuugcuu

SEQ ID NO: 3471869 - RNA, 18 nt, Human
cuuaacuucuugcuucuu

SEQ ID NO: 3471870 - RNA, 21 nt, Human
cuuaacuucuugcuucuuucu

SEQ ID NO: 3471871 - RNA, 17 nt, Human
cuuaagaacacaaagcg

SEQ ID NO: 3471872 - RNA, 16 nt, Human
cuuaagaacugcuuuc

SEQ ID NO: 3471873 - RNA, 23 nt, Human
cuuaagaagacugcauuauauuu

SEQ ID NO: 3471874 - RNA, 19 nt, Human
cuuaagaaugaguuucuua

SEQ ID NO: 3471875 - RNA, 21 nt, Human
cuuaagaccaccucaaauuua

SEQ ID NO: 3471876 - RNA, 21 nt, Human
cuuaccuucaauaaaguaucu

SEQ ID NO: 3471877 - RNA, 17 nt, Human
cuuacgaauauuuucag

SEQ ID NO: 3471878 - RNA, 14 nt, Human
cuuacgcuuuguca

SEQ ID NO: 3471879 - RNA, 15 nt, Human
cuuacggcccuggcc

SEQ ID NO: 3471880 - RNA, 16 nt, Human
cuuacggcccuggccu

SEQ ID NO: 3471881 - RNA, 15 nt, Human
cuuacgugaguccug

SEQ ID NO: 3471882 - RNA, 13 nt, Human
cuuacuaaaaagu

SEQ ID NO: 3471883 - RNA, 21 nt, Human
cuuacuaagcuuugccagcug

SEQ ID NO: 3471884 - RNA, 18 nt, Human
cuuacuaauguaaaauga

SEQ ID NO: 3471885 - RNA, 15 nt, Human
cuuacuacagaaaug

SEQ ID NO: 3471886 - RNA, 22 nt, Human
cuuacuauuuugacaguuauuu

SEQ ID NO: 3471887 - RNA, 14 nt, Human
cuuacuccaggaga

SEQ ID NO: 3471888 - RNA, 15 nt, Human
cuuacuccuccucuu

SEQ ID NO: 3471889 - RNA, 16 nt, Human
cuuacuccuccucuuu

SEQ ID NO: 3471890 - RNA, 22 nt, Human
cuuacuccuccucuuucucucc

SEQ ID NO: 3471891 - RNA, 12 nt, Human
cuuacucuaaga

SEQ ID NO: 3471892 - RNA, 23 nt, Human
cuuacucuuuccuauuucagugu

SEQ ID NO: 3471893 - RNA, 15 nt, Human
cuuacugauauauuu

SEQ ID NO: 3471894 - RNA, 12 nt, Human
cuuacugcaaau

SEQ ID NO: 3471895 - RNA, 17 nt, Human
cuuacuguaagacauua

SEQ ID NO: 3471896 - RNA, 13 nt, Human
cuuacuguacaug

SEQ ID NO: 3471897 - RNA, 17 nt, Human
cuuacuguggaggaagg

SEQ ID NO: 3471898 - RNA, 19 nt, Human
cuuacuguggaggaaggau

SEQ ID NO: 3471899 - RNA, 15 nt, Human
cuuacuguuucuguc

SEQ ID NO: 3471900 - RNA, 19 nt, Human
cuuacuguuucugucagga

SEQ ID NO: 3471901 - RNA, 24 nt, Human
cuuacuugcauaccaaguugauac

SEQ ID NO: 3471902 - RNA, 14 nt, Human
cuuacuuggaacug

SEQ ID NO: 3471903 - RNA, 11 nt, Human
cuuacuuugua

SEQ ID NO: 3471904 - RNA, 15 nt, Human
cuuacuuuguaaauu

SEQ ID NO: 3471905 - RNA, 19 nt, Human
cuuacuuuguaaauucuga

SEQ ID NO: 3471906 - RNA, 17 nt, Human
cuuacuuuuuauauaua

SEQ ID NO: 3471907 - RNA, 20 nt, Human
cuuagaaaaaccaccaccau

SEQ ID NO: 3471908 - RNA, 18 nt, Human
cuuagaaagcaggggcua

SEQ ID NO: 3471909 - RNA, 22 nt, Human
cuuagaaauguaaacugccaua

SEQ ID NO: 3471910 - RNA, 14 nt, Human
cuuagaaauuuauu

SEQ ID NO: 3471911 - RNA, 16 nt, Human
cuuagaacauuuuaau

SEQ ID NO: 3471912 - RNA, 19 nt, Human
cuuagaacauuuuaauuca

SEQ ID NO: 3471913 - RNA, 16 nt, Human
cuuagaagaauauugu

SEQ ID NO: 3471914 - RNA, 21 nt, Human
cuuagaagaauauuguauugu

SEQ ID NO: 3471915 - RNA, 21 nt, Human
cuuagaagguauuaagauuau

SEQ ID NO: 3471916 - RNA, 18 nt, Human
cuuagaaguuuguuguga

SEQ ID NO: 3471917 - RNA, 16 nt, Human
cuuagaauacaguuuu

SEQ ID NO: 3471918 - RNA, 19 nt, Human
cuuagaauuaguggcacuu

SEQ ID NO: 3471919 - RNA, 18 nt, Human
cuuagaauuauuugcacu

SEQ ID NO: 3471920 - RNA, 16 nt, Human
cuuagacagucccugc

SEQ ID NO: 3471921 - RNA, 17 nt, Human
cuuagaccaccaagccu

SEQ ID NO: 3471922 - RNA, 14 nt, Human
cuuagacccucaug

SEQ ID NO: 3471923 - RNA, 19 nt, Human
cuuagacccucaugcugcc

SEQ ID NO: 3471924 - RNA, 13 nt, Human
cuuagaccucagc

SEQ ID NO: 3471925 - RNA, 20 nt, Human
cuuagaccucagccugugcu

SEQ ID NO: 3471926 - RNA, 19 nt, Human
cuuagacuucgacucagga

SEQ ID NO: 3471927 - RNA, 16 nt, Human
cuuagacuugaaauac

SEQ ID NO: 3471928 - RNA, 21 nt, Human
cuuagacuuuuccaauaugug

SEQ ID NO: 3471929 - RNA, 12 nt, Human
cuuagagccagg

SEQ ID NO: 3471930 - RNA, 15 nt, Human
cuuagagccaggcac

SEQ ID NO: 3471931 - RNA, 16 nt, Human
cuuagagccaggcaca

SEQ ID NO: 3471932 - RNA, 17 nt, Human
cuuagagccaggcacac

SEQ ID NO: 3471933 - RNA, 23 nt, Human
cuuagagccaggcacacacugug

SEQ ID NO: 3471934 - RNA, 16 nt, Human
cuuagagccucccuca

SEQ ID NO: 3471935 - RNA, 14 nt, Human
cuuagagcuuuuuu

SEQ ID NO: 3471936 - RNA, 18 nt, Human
cuuagaucauaguuuuau

SEQ ID NO: 3471937 - RNA, 19 nt, Human
cuuagaugcaguucugaag

SEQ ID NO: 3471938 - RNA, 22 nt, Human
cuuagaugcaguucugaagaag

SEQ ID NO: 3471939 - RNA, 16 nt, Human
cuuagauggauucucc

SEQ ID NO: 3471940 - RNA, 20 nt, Human
cuuagauguuccaguaaucu

SEQ ID NO: 3471941 - RNA, 14 nt, Human
cuuagauguucuaa

SEQ ID NO: 3471942 - RNA, 16 nt, Human
cuuagauuagcucugg

SEQ ID NO: 3471943 - RNA, 21 nt, Human
cuuagauuagcucuggaccag

SEQ ID NO: 3471944 - RNA, 14 nt, Human
cuuagauuucauag

SEQ ID NO: 3471945 - RNA, 13 nt, Human
cuuagauuuuaca

SEQ ID NO: 3471946 - RNA, 14 nt, Human
cuuagcagaugcug

SEQ ID NO: 3471947 - RNA, 22 nt, Human
cuuagcagcuaucucucaguga

SEQ ID NO: 3471948 - RNA, 23 nt, Human
cuuagcagcuaucucucagugaa

SEQ ID NO: 3471949 - RNA, 15 nt, Human
cuuagcagcuuccag

SEQ ID NO: 3471950 - RNA, 17 nt, Human
cuuagcagcuuccagau

SEQ ID NO: 3471951 - RNA, 14 nt, Human
cuuagcaggagagg

SEQ ID NO: 3471952 - RNA, 18 nt, Human
cuuagcagggaaacagcu

SEQ ID NO: 3471953 - RNA, 21 nt, Human
cuuagcagggaaacagcuaau

SEQ ID NO: 3471954 - RNA, 18 nt, Human
cuuagcaguccccuuccc

SEQ ID NO: 3471955 - RNA, 18 nt, Human
cuuagcauguguugaaaa

SEQ ID NO: 3471956 - RNA, 17 nt, Human
cuuagcauguuugcuga

SEQ ID NO: 3471957 - RNA, 19 nt, Human
cuuagccuggaccucugac

SEQ ID NO: 3471958 - RNA, 17 nt, Human
cuuagccuggagcaccu

SEQ ID NO: 3471959 - RNA, 19 nt, Human
cuuagcuaguuuuauucuu

SEQ ID NO: 3471960 - RNA, 18 nt, Human
cuuagcucaaugagcaug

SEQ ID NO: 3471961 - RNA, 19 nt, Human
cuuagcucaaugagcaugu

SEQ ID NO: 3471962 - RNA, 17 nt, Human
cuuagcuccccuccaac

SEQ ID NO: 3471963 - RNA, 17 nt, Human
cuuagcucuuaauuguu

SEQ ID NO: 3471964 - RNA, 15 nt, Human
cuuagcugccaagcc

SEQ ID NO: 3471965 - RNA, 14 nt, Human
cuuagcuuagaccu

SEQ ID NO: 3471966 - RNA, 16 nt, Human
cuuagcuuagaccuca

SEQ ID NO: 3471967 - RNA, 19 nt, Human
cuuagcuuagaccucagcc

SEQ ID NO: 3471968 - RNA, 20 nt, Human
cuuagcuuagaccucagccu

SEQ ID NO: 3471969 - RNA, 22 nt, Human
cuuagcuuagaccucagccugu

SEQ ID NO: 3471970 - RNA, 23 nt, Human
cuuagcuuagaccucagccugug

SEQ ID NO: 3471971 - RNA, 14 nt, Human
cuuagcuuaucaau

SEQ ID NO: 3471972 - RNA, 16 nt, Human
cuuagcuucaggaacc

SEQ ID NO: 3471973 - RNA, 18 nt, Human
cuuagcuucaggaaccuc

SEQ ID NO: 3471974 - RNA, 16 nt, Human
cuuagcuuuagaaaca

SEQ ID NO: 3471975 - RNA, 14 nt, Human
cuuagcuuuuuaau

SEQ ID NO: 3471976 - RNA, 16 nt, Human
cuuagcuuuuuaauug

SEQ ID NO: 3471977 - RNA, 17 nt, Human
cuuaggaagagaaacca

SEQ ID NO: 3471978 - RNA, 16 nt, Human
cuuaggaagagccuuc

SEQ ID NO: 3471979 - RNA, 18 nt, Human
cuuaggaugugugcaugu

SEQ ID NO: 3471980 - RNA, 23 nt, Human
cuuaggcaauggugaacugucau

SEQ ID NO: 3471981 - RNA, 15 nt, Human
cuuaggcagggaagu

SEQ ID NO: 3471982 - RNA, 15 nt, Human
cuuaggccagcacca

SEQ ID NO: 3471983 - RNA, 13 nt, Human
cuuaggccuuccu

SEQ ID NO: 3471984 - RNA, 23 nt, Human
cuuaggccuuccucucuccagau

SEQ ID NO: 3471985 - RNA, 16 nt, Human
cuuaggcugcugggau

SEQ ID NO: 3471986 - RNA, 13 nt, Human
cuuaggcuuugua

SEQ ID NO: 3471987 - RNA, 21 nt, Human
cuuagggaaggauacaaaagc

SEQ ID NO: 3471988 - RNA, 13 nt, Human
cuuagggcacugg

SEQ ID NO: 3471989 - RNA, 17 nt, Human
cuuagggcccuggaggc

SEQ ID NO: 3471990 - RNA, 16 nt, Human
cuuaggggcugcugac

SEQ ID NO: 3471991 - RNA, 17 nt, Human
cuuaggguuuucucucu

SEQ ID NO: 3471992 - RNA, 23 nt, Human
cuuaguaagcggcucaagcccag

SEQ ID NO: 3471993 - RNA, 19 nt, Human
cuuaguacaaaguuucaau

SEQ ID NO: 3471994 - RNA, 14 nt, Human
cuuaguacugaguu

SEQ ID NO: 3471995 - RNA, 17 nt, Human
cuuaguaucucaucaac

SEQ ID NO: 3471996 - RNA, 13 nt, Human
cuuagucacugcc

SEQ ID NO: 3471997 - RNA, 14 nt, Human
cuuagucacugccu

SEQ ID NO: 3471998 - RNA, 17 nt, Human
cuuagucccccaacucu

SEQ ID NO: 3471999 - RNA, 19 nt, Human
cuuagucucaguuugugug

SEQ ID NO: 3472000 - RNA, 23 nt, Human
cuuagucucaguuugugugucuu

SEQ ID NO: 3472001 - RNA, 21 nt, Human
cuuagucuucucauagcauua

SEQ ID NO: 3472002 - RNA, 16 nt, Human
cuuagugauguaauua

SEQ ID NO: 3472003 - RNA, 13 nt, Human
cuuaguggcuuuu

SEQ ID NO: 3472004 - RNA, 22 nt, Human
cuuaguggcuuuuuuccuccug

SEQ ID NO: 3472005 - RNA, 17 nt, Human
cuuagugggccagggcu

SEQ ID NO: 3472006 - RNA, 16 nt, Human
cuuaguguuucugugc

SEQ ID NO: 3472007 - RNA, 21 nt, Human
cuuaguguuuuaaaacaccuc

SEQ ID NO: 3472008 - RNA, 15 nt, Human
cuuaguucucacugu

SEQ ID NO: 3472009 - RNA, 19 nt, Human
cuuaguuuggauucuuaug

SEQ ID NO: 3472010 - RNA, 22 nt, Human
cuuaguuuguguguugucucuu

SEQ ID NO: 3472011 - RNA, 23 nt, Human
cuuaguuuguguguugucucuug

SEQ ID NO: 3472012 - RNA, 12 nt, Human
cuuauaaaacag

SEQ ID NO: 3472013 - RNA, 14 nt, Human
cuuauaaaacagag

SEQ ID NO: 3472014 - RNA, 20 nt, Human
cuuauaaaacagaguaaucu

SEQ ID NO: 3472015 - RNA, 19 nt, Human
cuuauaaaauccugugcaa

SEQ ID NO: 3472016 - RNA, 12 nt, Human
cuuauaaauaug

SEQ ID NO: 3472017 - RNA, 21 nt, Human
cuuauaaccuaguuaaagaaa

SEQ ID NO: 3472018 - RNA, 22 nt, Human
cuuauaaccuaguuaaagaaag

SEQ ID NO: 3472019 - RNA, 19 nt, Human
cuuauaagugaagugauac

SEQ ID NO: 3472020 - RNA, 20 nt, Human
cuuauaauaaaggacuguaa

SEQ ID NO: 3472021 - RNA, 20 nt, Human
cuugcuaaucagugucucac

SEQ ID NO: 3472022 - RNA, 23 nt, Human
cuugcuaaucagugucucacacu

SEQ ID NO: 3472023 - RNA, 13 nt, Human
cuugcuaccagua

SEQ ID NO: 3472024 - RNA, 18 nt, Human
cuugcuaccaguauuuag

SEQ ID NO: 3472025 - RNA, 14 nt, Human
cuugcuaccucagu

SEQ ID NO: 3472026 - RNA, 16 nt, Human
cuugcucauuaauuuu

SEQ ID NO: 3472027 - RNA, 17 nt, Human
cuugcucccugacuggg

SEQ ID NO: 3472028 - RNA, 20 nt, Human
cuugcucccuguguccaccu

SEQ ID NO: 3472029 - RNA, 19 nt, Human
cuugcucccuucagccccc

SEQ ID NO: 3472030 - RNA, 23 nt, Human
cuugcucccuucagcccccagcc

SEQ ID NO: 3472031 - RNA, 20 nt, Human
cuugcucgcuguaaaaucuu

SEQ ID NO: 3472032 - RNA, 14 nt, Human
cuugcucuaucuca

SEQ ID NO: 3472033 - RNA, 23 nt, Human
cuugcucuaucucacagcacacu

SEQ ID NO: 3472034 - RNA, 19 nt, Human
cuugcucuccccugcccug

SEQ ID NO: 3472035 - RNA, 14 nt, Human
cuugcucucccucu

SEQ ID NO: 3472036 - RNA, 14 nt, Human
cuugcucugcaccc

SEQ ID NO: 3472037 - RNA, 14 nt, Human
cuugcucugcaggc

SEQ ID NO: 3472038 - RNA, 14 nt, Human
cuugcucuguaauc

SEQ ID NO: 3472039 - RNA, 19 nt, Human
cuugcucuucagugggaga

SEQ ID NO: 3472040 - RNA, 19 nt, Human
cuugcucuugaugccuggc

SEQ ID NO: 3472041 - RNA, 22 nt, Human
cuugcugaaacgcaucuaguuc

SEQ ID NO: 3472042 - RNA, 17 nt, Human
cuugcugcacucuugca

SEQ ID NO: 3472043 - RNA, 23 nt, Human
cuugcugcacucuugcacaugga

SEQ ID NO: 3472044 - RNA, 21 nt, Human
cuugcugcaguaugaaaauaa

SEQ ID NO: 3472045 - RNA, 16 nt, Human
cuugcugcccuaggcu

SEQ ID NO: 3472046 - RNA, 23 nt, Human
cuugcugcccuaggcuccgucag

SEQ ID NO: 3472047 - RNA, 20 nt, Human
cuugcugcccugugcuccuc

SEQ ID NO: 3472048 - RNA, 13 nt, Human
cuugcugcuagaa

SEQ ID NO: 3472049 - RNA, 15 nt, Human
cuugcugcuagaacu

SEQ ID NO: 3472050 - RNA, 14 nt, Human
cuugcugcuauuuu

SEQ ID NO: 3472051 - RNA, 12 nt, Human
cuugcugcuguc

SEQ ID NO: 3472052 - RNA, 13 nt, Human
cuugcugcugucu

SEQ ID NO: 3472053 - RNA, 13 nt, Human
cuugcuggaagac

SEQ ID NO: 3472054 - RNA, 14 nt, Human
cuugcuggccccag

SEQ ID NO: 3472055 - RNA, 18 nt, Human
cuugcuggccccagcccu

SEQ ID NO: 3472056 - RNA, 20 nt, Human
cuugcuggccccagcccugc

SEQ ID NO: 3472057 - RNA, 17 nt, Human
cuugcugguuuucugga

SEQ ID NO: 3472058 - RNA, 14 nt, Human
cuugcuguccuagg

SEQ ID NO: 3472059 - RNA, 15 nt, Human
cuugcuguccuaggc

SEQ ID NO: 3472060 - RNA, 16 nt, Human
cuugcuguccuaggcc

SEQ ID NO: 3472061 - RNA, 20 nt, Human
cuugcuguccuaggccacac

SEQ ID NO: 3472062 - RNA, 18 nt, Human
cuugcuguccugaucugu

SEQ ID NO: 3472063 - RNA, 12 nt, Human
cuugcugucucu

SEQ ID NO: 3472064 - RNA, 17 nt, Human
cuugcugucucugcucg

SEQ ID NO: 3472065 - RNA, 15 nt, Human
cuugcugugaauuaa

SEQ ID NO: 3472066 - RNA, 15 nt, Human
cuugcugugacuuau

SEQ ID NO: 3472067 - RNA, 13 nt, Human
cuugcuguggucu

SEQ ID NO: 3472068 - RNA, 18 nt, Human
cuugcuguggucucuuug

SEQ ID NO: 3472069 - RNA, 20 nt, Human
cuugcuguugacauauuuaa

SEQ ID NO: 3472070 - RNA, 20 nt, Human
cuugcuguuggucauguggg

SEQ ID NO: 3472071 - RNA, 14 nt, Human
cuugcuuaaaugug

SEQ ID NO: 3472072 - RNA, 15 nt, Human
cuugcuuaaauguga

SEQ ID NO: 3472073 - RNA, 16 nt, Human
cuugcuuaaaugugaa

SEQ ID NO: 3472074 - RNA, 15 nt, Human
cuugcuuaccucuca

SEQ ID NO: 3472075 - RNA, 15 nt, Human
cuugcuucuuacuga

SEQ ID NO: 3472076 - RNA, 15 nt, Human
cuugcuucuuucuag

SEQ ID NO: 3472077 - RNA, 19 nt, Human
cuugcuucuuucuagaaag

SEQ ID NO: 3472078 - RNA, 19 nt, Human
cuugcuugccugcagggcc

SEQ ID NO: 3472079 - RNA, 18 nt, Human
cuugcuuggcugcuuggc

SEQ ID NO: 3472080 - RNA, 18 nt, Human
cuugcuuggggaacuugu

SEQ ID NO: 3472081 - RNA, 12 nt, Human
cuugcuuguacc

SEQ ID NO: 3472082 - RNA, 21 nt, Human
cuugcuuguugggauuccuga

SEQ ID NO: 3472083 - RNA, 19 nt, Human
cuugcuuuaccuuuucagg

SEQ ID NO: 3472084 - RNA, 11 nt, Human
cuugcuuucua

SEQ ID NO: 3472085 - RNA, 21 nt, Human
cuugcuuucuuuguuuggcug

SEQ ID NO: 3472086 - RNA, 18 nt, Human
cuugcuuuucaugcaaac

SEQ ID NO: 3472087 - RNA, 19 nt, Human
cuugcuuuucaugcaaacu

SEQ ID NO: 3472088 - RNA, 17 nt, Human
cuugcuuuucuguauuu

SEQ ID NO: 3472089 - RNA, 16 nt, Human
cuuggaaaaagugaug

SEQ ID NO: 3472090 - RNA, 20 nt, Human
cuuggaaaaauccagaaaga

SEQ ID NO: 3472091 - RNA, 23 nt, Human
cuuggaaaaguggcaagaccaaa

SEQ ID NO: 3472092 - RNA, 14 nt, Human
cuuggaaaccugcc

SEQ ID NO: 3472093 - RNA, 21 nt, Human
cuuggaaagcaucaccucagg

SEQ ID NO: 3472094 - RNA, 22 nt, Human
cuuggaaagcaucaccucaggc

SEQ ID NO: 3472095 - RNA, 18 nt, Human
cuuggaaauauuaaaaga

SEQ ID NO: 3472096 - RNA, 16 nt, Human
cuuggaaauuccugua

SEQ ID NO: 3472097 - RNA, 11 nt, Human
cuuggaacugc

SEQ ID NO: 3472098 - RNA, 15 nt, Human
cuuggaacuugccug

SEQ ID NO: 3472099 - RNA, 19 nt, Human
cuuggaacuugccugccuu

SEQ ID NO: 3472100 - RNA, 15 nt, Human
cuuggaagagccugc

SEQ ID NO: 3472101 - RNA, 13 nt, Human
cuuggaagcuccg

SEQ ID NO: 3472102 - RNA, 20 nt, Human
cuuggaagcuguuuggaaaa

SEQ ID NO: 3472103 - RNA, 19 nt, Human
cuuggaauaucugcuguau

SEQ ID NO: 3472104 - RNA, 22 nt, Human
cuuggaauuuguaaccucagcu

SEQ ID NO: 3472105 - RNA, 13 nt, Human
cuuggacacugua

SEQ ID NO: 3472106 - RNA, 21 nt, Human
cuuggacacuuaauucuguuc

SEQ ID NO: 3472107 - RNA, 15 nt, Human
cuuggacauccuccu

SEQ ID NO: 3472108 - RNA, 16 nt, Human
cuuggacauccuccuc

SEQ ID NO: 3472109 - RNA, 20 nt, Human
cuuggacauccuccucccac

SEQ ID NO: 3472110 - RNA, 16 nt, Human
cuuggacauuuuaugu

SEQ ID NO: 3472111 - RNA, 17 nt, Human
cuuggacauuuuauguc

SEQ ID NO: 3472112 - RNA, 19 nt, Human
cuuggacauuuuaugucuu

SEQ ID NO: 3472113 - RNA, 18 nt, Human
cuuggaccucgugcuuua

SEQ ID NO: 3472114 - RNA, 22 nt, Human
cuuggacuauuauaauuuaaug

SEQ ID NO: 3472115 - RNA, 11 nt, Human
cuuggacucau

SEQ ID NO: 3472116 - RNA, 16 nt, Human
cuuggacucauuuuaa

SEQ ID NO: 3472117 - RNA, 18 nt, Human
cuuggacucuugcucuuu

SEQ ID NO: 3472118 - RNA, 22 nt, Human
cuuggacuucuucucccccgcg

SEQ ID NO: 3472119 - RNA, 13 nt, Human
cuuggacuugagg

SEQ ID NO: 3472120 - RNA, 17 nt, Human
cuuggagaagucucagc

SEQ ID NO: 3472121 - RNA, 23 nt, Human
cuuggagaaugugagaagccagc

SEQ ID NO: 3472122 - RNA, 18 nt, Human
cuuggagccugcagagcu

SEQ ID NO: 3472123 - RNA, 19 nt, Human
cuuggagccugcagagcug

SEQ ID NO: 3472124 - RNA, 20 nt, Human
cuuggagcuauuuuccaggc

SEQ ID NO: 3472125 - RNA, 13 nt, Human
cuuggagcugagc

SEQ ID NO: 3472126 - RNA, 15 nt, Human
cuuggagcugagccu

SEQ ID NO: 3472127 - RNA, 21 nt, Human
cuuggagcugagccucucacc

SEQ ID NO: 3472128 - RNA, 14 nt, Human
cuuggagcugugag

SEQ ID NO: 3472129 - RNA, 21 nt, Human
cuuggagcuuacauaguuuua

SEQ ID NO: 3472130 - RNA, 22 nt, Human
cuuggaggaaggaaacccagcu

SEQ ID NO: 3472131 - RNA, 14 nt, Human
cuuggagggaccaa

SEQ ID NO: 3472132 - RNA, 15 nt, Human
cuuggagggucccaa

SEQ ID NO: 3472133 - RNA, 19 nt, Human
cuuggaggguugguccucu

SEQ ID NO: 3472134 - RNA, 18 nt, Human
cuuggaguauuggggucu

SEQ ID NO: 3472135 - RNA, 18 nt, Human
cuuggauaaugcuguugc

SEQ ID NO: 3472136 - RNA, 16 nt, Human
cuuggauacuuggauu

SEQ ID NO: 3472137 - RNA, 21 nt, Human
cuuggauagcuaauaaugagc

SEQ ID NO: 3472138 - RNA, 21 nt, Human
cuuggauuauuuuaaaucauu

SEQ ID NO: 3472139 - RNA, 14 nt, Human
cuuggauucucuaa

SEQ ID NO: 3472140 - RNA, 18 nt, Human
cuuggauucuuuccauuu

SEQ ID NO: 3472141 - RNA, 21 nt, Human
cuuggauucuuuccauuugca

SEQ ID NO: 3472142 - RNA, 14 nt, Human
cuuggauugucccc

SEQ ID NO: 3472143 - RNA, 20 nt, Human
cuuggauuguccccgacccu

SEQ ID NO: 3472144 - RNA, 22 nt, Human
cuuggauuguccccgacccuug

SEQ ID NO: 3472145 - RNA, 24 nt, Human
cuuggauuguccccgacccuugcc

SEQ ID NO: 3472146 - RNA, 15 nt, Human
cuuggcaaaagccuu

SEQ ID NO: 3472147 - RNA, 17 nt, Human
cuuggcaaaagccuugu

SEQ ID NO: 3472148 - RNA, 18 nt, Human
cuuggcaaaagccuugug

SEQ ID NO: 3472149 - RNA, 23 nt, Human
cuuggcaaaagccuuguguauau

SEQ ID NO: 3472150 - RNA, 13 nt, Human
cuuggcaacagaa

SEQ ID NO: 3472151 - RNA, 20 nt, Human
cuuggcaacagaagcaguug

SEQ ID NO: 3472152 - RNA, 21 nt, Human
cuuggcaauaaauuuugaaaa

SEQ ID NO: 3472153 - RNA, 13 nt, Human
cuuggcaccaaag

SEQ ID NO: 3472154 - RNA, 21 nt, Human
cuuggcaccagacacccagga

SEQ ID NO: 3472155 - RNA, 20 nt, Human
cuuggcacuuauugaauaua

SEQ ID NO: 3472156 - RNA, 18 nt, Human
cuuggcagcaccugucuc

SEQ ID NO: 3472157 - RNA, 19 nt, Human
cuuggcagcaccugucucc

SEQ ID NO: 3472158 - RNA, 18 nt, Human
cuuggcagccgagcucgu

SEQ ID NO: 3472159 - RNA, 17 nt, Human
cuuggccaagcagggag

SEQ ID NO: 3472160 - RNA, 16 nt, Human
cuuggccacagccagg

SEQ ID NO: 3472161 - RNA, 17 nt, Human
cuuggccagaagggggc

SEQ ID NO: 3472162 - RNA, 21 nt, Human
cuuggccagcaaguuagagaa

SEQ ID NO: 3472163 - RNA, 16 nt, Human
cuuggcccaggaguuu

SEQ ID NO: 3472164 - RNA, 21 nt, Human
cuuggcccagggggcuuccug

SEQ ID NO: 3472165 - RNA, 12 nt, Human
cuuguacaaaau

SEQ ID NO: 3472166 - RNA, 13 nt, Human
cuuguacaaaaua

SEQ ID NO: 3472167 - RNA, 15 nt, Human
cuuguacauaaugcg

SEQ ID NO: 3472168 - RNA, 21 nt, Human
cuuguacauaaugcgugcaua

SEQ ID NO: 3472169 - RNA, 19 nt, Human
cuuguacauguguagccug

SEQ ID NO: 3472170 - RNA, 17 nt, Human
cuuguagaacucacucu

SEQ ID NO: 3472171 - RNA, 17 nt, Human
cuuguagauuugauuuu

SEQ ID NO: 3472172 - RNA, 13 nt, Human
cuuguagccagcc

SEQ ID NO: 3472173 - RNA, 16 nt, Human
cuuguagccagccggg

SEQ ID NO: 3472174 - RNA, 14 nt, Human
cuuguagccuuuug

SEQ ID NO: 3472175 - RNA, 16 nt, Human
cuuguagccuuuugac

SEQ ID NO: 3472176 - RNA, 17 nt, Human
cuuguagccuuuugacu

SEQ ID NO: 3472177 - RNA, 17 nt, Human
cuuguagcgacuaaacu

SEQ ID NO: 3472178 - RNA, 18 nt, Human
cuuguagcuccuccccug

SEQ ID NO: 3472179 - RNA, 19 nt, Human
cuuguagcuccuccccugg

SEQ ID NO: 3472180 - RNA, 21 nt, Human
cuuguagcuccuccccuggag

SEQ ID NO: 3472181 - RNA, 14 nt, Human
cuuguagcuguaaa

SEQ ID NO: 3472182 - RNA, 15 nt, Human
cuuguagcuguaaaa

SEQ ID NO: 3472183 - RNA, 15 nt, Human
cuuguaguucuuuaa

SEQ ID NO: 3472184 - RNA, 21 nt, Human
cuuguaguuuaccucuuuaaa

SEQ ID NO: 3472185 - RNA, 21 nt, Human
cuuguauaaauguauauacac

SEQ ID NO: 3472186 - RNA, 12 nt, Human
cuuguauaauau

SEQ ID NO: 3472187 - RNA, 17 nt, Human
cuuguauaucuuguuuu

SEQ ID NO: 3472188 - RNA, 17 nt, Human
cuuguauauuuuaagaa

SEQ ID NO: 3472189 - RNA, 18 nt, Human
cuuguauccucugguucu

SEQ ID NO: 3472190 - RNA, 23 nt, Human
cuuguauuaaacucuucacaaaa

SEQ ID NO: 3472191 - RNA, 14 nt, Human
cuuguauuaagaau

SEQ ID NO: 3472192 - RNA, 17 nt, Human
cuuguauuaaguuguua

SEQ ID NO: 3472193 - RNA, 14 nt, Human
cuugucaaagaagg

SEQ ID NO: 3472194 - RNA, 23 nt, Human
cuugucaagccugugcaaaaaaa

SEQ ID NO: 3472195 - RNA, 23 nt, Human
cuugucaauaaaauccauacauu

SEQ ID NO: 3472196 - RNA, 19 nt, Human
cuugucaauauuuaaacau

SEQ ID NO: 3472197 - RNA, 14 nt, Human
cuugucacaauaaa

SEQ ID NO: 3472198 - RNA, 15 nt, Human
cuugucacaauaaau

SEQ ID NO: 3472199 - RNA, 17 nt, Human
cuugucacaauaaaugu

SEQ ID NO: 3472200 - RNA, 13 nt, Human
cuugucacgccag

SEQ ID NO: 3472201 - RNA, 18 nt, Human
cuugucacgccagacuuc

SEQ ID NO: 3472202 - RNA, 21 nt, Human
cuugucacugacacaaaggaa

SEQ ID NO: 3472203 - RNA, 16 nt, Human
cuugucacuugcaugu

SEQ ID NO: 3472204 - RNA, 16 nt, Human
cuugucagacauaaag

SEQ ID NO: 3472205 - RNA, 18 nt, Human
cuugucagacauaaagcc

SEQ ID NO: 3472206 - RNA, 21 nt, Human
cuugucagagcugggaggggu

SEQ ID NO: 3472207 - RNA, 21 nt, Human
cuugucaggagugugugugag

SEQ ID NO: 3472208 - RNA, 14 nt, Human
cuugucaugugaca

SEQ ID NO: 3472209 - RNA, 15 nt, Human
cuugucauguguaua

SEQ ID NO: 3472210 - RNA, 22 nt, Human
cuugucccacgugucuuccacu

SEQ ID NO: 3472211 - RNA, 18 nt, Human
cuugucccacuaucuggg

SEQ ID NO: 3472212 - RNA, 18 nt, Human
cuuguccccacacuccua

SEQ ID NO: 3472213 - RNA, 21 nt, Human
cuuguccccuccucacucccu

SEQ ID NO: 3472214 - RNA, 16 nt, Human
cuugucccugcccaga

SEQ ID NO: 3472215 - RNA, 18 nt, Human
cuuguccuagcuugggag

SEQ ID NO: 3472216 - RNA, 18 nt, Human
cuuguccuuagccuggac

SEQ ID NO: 3472217 - RNA, 20 nt, Human
cuuguccuuagccuggaccu

SEQ ID NO: 3472218 - RNA, 15 nt, Human
cuuguccuuucccuu

SEQ ID NO: 3472219 - RNA, 22 nt, Human
cuugucggccccaccagugccu

SEQ ID NO: 3472220 - RNA, 23 nt, Human
cuugucggccccaccagugccuc

SEQ ID NO: 3472221 - RNA, 14 nt, Human
cuugucggcuccag

SEQ ID NO: 3472222 - RNA, 16 nt, Human
cuugucucaaugcuca

SEQ ID NO: 3472223 - RNA, 18 nt, Human
cuugucucauuuuaaugu

SEQ ID NO: 3472224 - RNA, 19 nt, Human
cuugucucauuuuaaugua

SEQ ID NO: 3472225 - RNA, 23 nt, Human
cuugucucauuuuaauguaaaga

SEQ ID NO: 3472226 - RNA, 13 nt, Human
cuugucucugggc

SEQ ID NO: 3472227 - RNA, 14 nt, Human
cuugucucugggcu

SEQ ID NO: 3472228 - RNA, 20 nt, Human
cuugucuggcaaaagaaaaa

SEQ ID NO: 3472229 - RNA, 19 nt, Human
cuugucuuccuauuucaga

SEQ ID NO: 3472230 - RNA, 15 nt, Human
cuugucuuuggaccc

SEQ ID NO: 3472231 - RNA, 18 nt, Human
cuugucuuuucaaaauau

SEQ ID NO: 3472232 - RNA, 16 nt, Human
cuugugaaaauaauug

SEQ ID NO: 3472233 - RNA, 21 nt, Human
cuugugaaaauaauugacagg

SEQ ID NO: 3472234 - RNA, 20 nt, Human
cuugugaaggccaugauauu

SEQ ID NO: 3472235 - RNA, 19 nt, Human
cuugugaaucaagggucag

SEQ ID NO: 3472236 - RNA, 15 nt, Human
cuugugaaugcuucu

SEQ ID NO: 3472237 - RNA, 17 nt, Human
cuugugaaugcuucuca

SEQ ID NO: 3472238 - RNA, 19 nt, Human
cuugugacagauuauacag

SEQ ID NO: 3472239 - RNA, 12 nt, Human
cuugugacauau

SEQ ID NO: 3472240 - RNA, 17 nt, Human
cuugugacuagugcuga

SEQ ID NO: 3472241 - RNA, 19 nt, Human
cuugugacuagugcugaag

SEQ ID NO: 3472242 - RNA, 16 nt, Human
cuugugacuuuugcuu

SEQ ID NO: 3472243 - RNA, 13 nt, Human
cuugugaggaaag

SEQ ID NO: 3472244 - RNA, 23 nt, Human
cuugugauccacucgccucagcc

SEQ ID NO: 3472245 - RNA, 15 nt, Human
cuugugaucugggaa

SEQ ID NO: 3472246 - RNA, 16 nt, Human
cuugugaucugggaac

SEQ ID NO: 3472247 - RNA, 21 nt, Human
cuugugaugucauacagagaa

SEQ ID NO: 3472248 - RNA, 16 nt, Human
cuugugauuucuuuaa

SEQ ID NO: 3472249 - RNA, 23 nt, Human
cuugugauuucuuuaaaagaaug

SEQ ID NO: 3472250 - RNA, 16 nt, Human
cuugugcagaaaacau

SEQ ID NO: 3472251 - RNA, 21 nt, Human
cuugugcagaaaacauuguuc

SEQ ID NO: 3472252 - RNA, 18 nt, Human
cuugugccaacacucaag

SEQ ID NO: 3472253 - RNA, 15 nt, Human
cuugugccuggcuca

SEQ ID NO: 3472254 - RNA, 14 nt, Human
cuugugccuggggu

SEQ ID NO: 3472255 - RNA, 20 nt, Human
cuugugcugaucgugcuaaa

SEQ ID NO: 3472256 - RNA, 14 nt, Human
cuugugcuuugcuc

SEQ ID NO: 3472257 - RNA, 21 nt, Human
cuuguggaagcaaaaaucuga

SEQ ID NO: 3472258 - RNA, 13 nt, Human
cuuguggacacag

SEQ ID NO: 3472259 - RNA, 17 nt, Human
cuuguggacacagcucu

SEQ ID NO: 3472260 - RNA, 19 nt, Human
cuuguggacuaaaagauau

SEQ ID NO: 3472261 - RNA, 15 nt, Human
cuuguggauguuuua

SEQ ID NO: 3472262 - RNA, 17 nt, Human
cuuguggcagaggaugu

SEQ ID NO: 3472263 - RNA, 22 nt, Human
cuuguggcccucucccuuaccc

SEQ ID NO: 3472264 - RNA, 14 nt, Human
cuugugggccuggg

SEQ ID NO: 3472265 - RNA, 17 nt, Human
cuugugggccugggcuc

SEQ ID NO: 3472266 - RNA, 21 nt, Human
cuuguggggacccaggcuccg

SEQ ID NO: 3472267 - RNA, 14 nt, Human
cuuguggggccugg

SEQ ID NO: 3472268 - RNA, 21 nt, Human
cuugugggugugagcagcacc

SEQ ID NO: 3472269 - RNA, 14 nt, Human
cuugugguccaaau

SEQ ID NO: 3472270 - RNA, 19 nt, Human
cuuguggucccaccccaca

SEQ ID NO: 3472271 - RNA, 14 nt, Human
cuugugguuuaugu

SEQ ID NO: 3472272 - RNA, 14 nt, Human
cuuguguaaauaca

SEQ ID NO: 3472273 - RNA, 21 nt, Human
cuuguguaaauacaauuuugu

SEQ ID NO: 3472274 - RNA, 20 nt, Human
cuuguguaauuuaugugaaa

SEQ ID NO: 3472275 - RNA, 16 nt, Human
cuugugucaaacagua

SEQ ID NO: 3472276 - RNA, 10 nt, Human
cuugugucug

SEQ ID NO: 3472277 - RNA, 17 nt, Human
cuugugugguuuggccc

SEQ ID NO: 3472278 - RNA, 21 nt, Human
cuuguguguuccaaguuucca

SEQ ID NO: 3472279 - RNA, 13 nt, Human
cuuguguuggcug

SEQ ID NO: 3472280 - RNA, 17 nt, Human
cuuguguuggcuguggc

SEQ ID NO: 3472281 - RNA, 21 nt, Human
cuuguguuucuuuaguuuuug

SEQ ID NO: 3472282 - RNA, 14 nt, Human
cuuguuaauauucu

SEQ ID NO: 3472283 - RNA, 18 nt, Human
cuuguuaugguagaaaaa

SEQ ID NO: 3472284 - RNA, 15 nt, Human
cuuguuauugugaau

SEQ ID NO: 3472285 - RNA, 18 nt, Human
cuuguuauugugaaugau

SEQ ID NO: 3472286 - RNA, 16 nt, Human
cuuguucacacucuca

SEQ ID NO: 3472287 - RNA, 19 nt, Human
cuuguucaggaaaagguug

SEQ ID NO: 3472288 - RNA, 22 nt, Human
cuuguucaucauccagaugugg

SEQ ID NO: 3472289 - RNA, 14 nt, Human
cuuguucccucucc

SEQ ID NO: 3472290 - RNA, 13 nt, Human
cuuguucuacuca

SEQ ID NO: 3472291 - RNA, 22 nt, Human
cuuguucuacucauauauaucu

SEQ ID NO: 3472292 - RNA, 14 nt, Human
cuuguucuguuuug

SEQ ID NO: 3472293 - RNA, 13 nt, Human
cuuguucuuccaa

SEQ ID NO: 3472294 - RNA, 18 nt, Human
cuuguucuuccaaagcag

SEQ ID NO: 3472295 - RNA, 20 nt, Human
cuuguucuuccaaagcagag

SEQ ID NO: 3472296 - RNA, 12 nt, Human
cuuguugacaga

SEQ ID NO: 3472297 - RNA, 16 nt, Human
cuuguugaggguaugu

SEQ ID NO: 3472298 - RNA, 20 nt, Human
cuuguugaggguauguuuua

SEQ ID NO: 3472299 - RNA, 14 nt, Human
cuuguugcuuuguu

SEQ ID NO: 3472300 - RNA, 16 nt, Human
cuuguugcuuuguugc

SEQ ID NO: 3472301 - RNA, 21 nt, Human
cuuguuggauuuuugucuugu

SEQ ID NO: 3472302 - RNA, 13 nt, Human
cuuguuguuguua

SEQ ID NO: 3472303 - RNA, 15 nt, Human
cuuguuguuucuugc

SEQ ID NO: 3472304 - RNA, 19 nt, Human
cuuguuguuuuacuaaaga

SEQ ID NO: 3472305 - RNA, 21 nt, Human
cuuguuguuuuacuaaagaaa

SEQ ID NO: 3472306 - RNA, 16 nt, Human
cuuguuuaaugguagu

SEQ ID NO: 3472307 - RNA, 14 nt, Human
cuuguuuacaugcu

SEQ ID NO: 3472308 - RNA, 18 nt, Human
cuuguuuacaugcuuauu

SEQ ID NO: 3472309 - RNA, 22 nt, Human
cuuguuuacaugcuuauuccau

SEQ ID NO: 3472310 - RNA, 15 nt, Human
cuuuauagaucagcc

SEQ ID NO: 3472311 - RNA, 16 nt, Human
cuuuauauacaauaau

SEQ ID NO: 3472312 - RNA, 22 nt, Human
cuuuauauacaauaauggaaaa

SEQ ID NO: 3472313 - RNA, 19 nt, Human
cuuuauaugaacauagacu

SEQ ID NO: 3472314 - RNA, 12 nt, Human
cuuuauauuuag

SEQ ID NO: 3472315 - RNA, 20 nt, Human
cuuuaucaaugugucuuucu

SEQ ID NO: 3472316 - RNA, 17 nt, Human
cuuuaucacuuuuugaa

SEQ ID NO: 3472317 - RNA, 21 nt, Human
cuuuaucaugaaugcuuuuag

SEQ ID NO: 3472318 - RNA, 22 nt, Human
cuuuaucuaccaacuuucaaga

SEQ ID NO: 3472319 - RNA, 13 nt, Human
cuuuaucuguucu

SEQ ID NO: 3472320 - RNA, 14 nt, Human
cuuuaucuugacau

SEQ ID NO: 3472321 - RNA, 23 nt, Human
cuuuaugacuguuuuuguagugg

SEQ ID NO: 3472322 - RNA, 15 nt, Human
cuuuaugcacaaaau

SEQ ID NO: 3472323 - RNA, 18 nt, Human
cuuuaugcagcuuccuuu

SEQ ID NO: 3472324 - RNA, 22 nt, Human
cuuuaugccggaugugcuuuuc

SEQ ID NO: 3472325 - RNA, 15 nt, Human
cuuuaugcugaaaca

SEQ ID NO: 3472326 - RNA, 20 nt, Human
cuuuaugguccuaaaagcaa

SEQ ID NO: 3472327 - RNA, 13 nt, Human
cuuuaugguuucu

SEQ ID NO: 3472328 - RNA, 16 nt, Human
cuuuauguaauaaugu

SEQ ID NO: 3472329 - RNA, 14 nt, Human
cuuuaugugaauuu

SEQ ID NO: 3472330 - RNA, 23 nt, Human
cuuuauguggaaaacagaacauc

SEQ ID NO: 3472331 - RNA, 12 nt, Human
cuuuauguguaa

SEQ ID NO: 3472332 - RNA, 14 nt, Human
cuuuauuaaaaacu

SEQ ID NO: 3472333 - RNA, 17 nt, Human
cuuuauuaaaaacugag

SEQ ID NO: 3472334 - RNA, 14 nt, Human
cuuuauuaauguuu

SEQ ID NO: 3472335 - RNA, 15 nt, Human
cuuuauuaauguuuu

SEQ ID NO: 3472336 - RNA, 20 nt, Human
cuuuauuacccccuccuuca

SEQ ID NO: 3472337 - RNA, 14 nt, Human
cuuuauuauuuauu

SEQ ID NO: 3472338 - RNA, 21 nt, Human
cuuuauucaauaaaaaaaaga

SEQ ID NO: 3472339 - RNA, 13 nt, Human
cuuuauucuuuuc

SEQ ID NO: 3472340 - RNA, 13 nt, Human
cuuuauugagaaa

SEQ ID NO: 3472341 - RNA, 15 nt, Human
cuuuauugagaaaga

SEQ ID NO: 3472342 - RNA, 16 nt, Human
cuuuauugagaaagag

SEQ ID NO: 3472343 - RNA, 22 nt, Human
cuuuauugccaaaacccagcug

SEQ ID NO: 3472344 - RNA, 15 nt, Human
cuuuauugucuguaa

SEQ ID NO: 3472345 - RNA, 18 nt, Human
cuuuauugucuguaaauc

SEQ ID NO: 3472346 - RNA, 14 nt, Human
cuuuauugugaucu

SEQ ID NO: 3472347 - RNA, 16 nt, Human
cuuuauuguguuuguc

SEQ ID NO: 3472348 - RNA, 18 nt, Human
cuuuauuguguuugucau

SEQ ID NO: 3472349 - RNA, 19 nt, Human
cuuuauuguguuugucauu

SEQ ID NO: 3472350 - RNA, 20 nt, Human
cuuuauuguguuugucauua

SEQ ID NO: 3472351 - RNA, 14 nt, Human
cuuuauuucuguca

SEQ ID NO: 3472352 - RNA, 20 nt, Human
cuuuauuugaacaaugaagu

SEQ ID NO: 3472353 - RNA, 15 nt, Human
cuuuauuuguaaauu

SEQ ID NO: 3472354 - RNA, 17 nt, Human
cuuuauuuguaaauuua

SEQ ID NO: 3472355 - RNA, 20 nt, Human
cuuuauuuguacuuuuuccu

SEQ ID NO: 3472356 - RNA, 13 nt, Human
cuuuauuuguuuu

SEQ ID NO: 3472357 - RNA, 22 nt, Human
cuuuauuuuaaccuuugauaga

SEQ ID NO: 3472358 - RNA, 16 nt, Human
cuuuauuuuauauaau

SEQ ID NO: 3472359 - RNA, 18 nt, Human
cuuuauuuucugguagau

SEQ ID NO: 3472360 - RNA, 13 nt, Human
cuuuauuuugaga

SEQ ID NO: 3472361 - RNA, 22 nt, Human
cuuuauuuugagauguaaaaag

SEQ ID NO: 3472362 - RNA, 17 nt, Human
cuuuauuuuguguaaaa

SEQ ID NO: 3472363 - RNA, 22 nt, Human
cuuuauuuuuuaaguauuuaua

SEQ ID NO: 3472364 - RNA, 18 nt, Human
cuuucaaagaaggaauuc

SEQ ID NO: 3472365 - RNA, 15 nt, Human
cuuucaaagccauuu

SEQ ID NO: 3472366 - RNA, 12 nt, Human
cuuucaaagcuu

SEQ ID NO: 3472367 - RNA, 15 nt, Human
cuuucaaaggaacau

SEQ ID NO: 3472368 - RNA, 15 nt, Human
cuuucaagaacuugu

SEQ ID NO: 3472369 - RNA, 17 nt, Human
cuuucaagaacuuguuu

SEQ ID NO: 3472370 - RNA, 13 nt, Human
cuuucaagaauga

SEQ ID NO: 3472371 - RNA, 20 nt, Human
cuuucaagcagucgugccug

SEQ ID NO: 3472372 - RNA, 18 nt, Human
cuuucaauaaacuaaaga

SEQ ID NO: 3472373 - RNA, 15 nt, Human
cuuucaauaggaaaa

SEQ ID NO: 3472374 - RNA, 17 nt, Human
cuuucaauaggaaaaac

SEQ ID NO: 3472375 - RNA, 18 nt, Human
cuuucaauaggaaaaacu

SEQ ID NO: 3472376 - RNA, 21 nt, Human
cuuucaauaggaaaaacugau

SEQ ID NO: 3472377 - RNA, 21 nt, Human
cuuucaaugguuugcaaggaa

SEQ ID NO: 3472378 - RNA, 22 nt, Human
cuuucaaugguuugcaaggaag

SEQ ID NO: 3472379 - RNA, 21 nt, Human
cuuucaauuccguagccagcu

SEQ ID NO: 3472380 - RNA, 19 nt, Human
cuuucaauugucacuuuuu

SEQ ID NO: 3472381 - RNA, 21 nt, Human
cuuucacacuuccaccagccu

SEQ ID NO: 3472382 - RNA, 23 nt, Human
cuuucacacuuccaccagccugc

SEQ ID NO: 3472383 - RNA, 13 nt, Human
cuuucacagcucc

SEQ ID NO: 3472384 - RNA, 14 nt, Human
cuuucacagcuccu

SEQ ID NO: 3472385 - RNA, 18 nt, Human
cuuucacagcuccuccca

SEQ ID NO: 3472386 - RNA, 16 nt, Human
cuuucacauagauguc

SEQ ID NO: 3472387 - RNA, 18 nt, Human
cuuucacccacagaaaga

SEQ ID NO: 3472388 - RNA, 22 nt, Human
cuuucaccccagggccugagcc

SEQ ID NO: 3472389 - RNA, 23 nt, Human
cuuucaccccagggccugagccu

SEQ ID NO: 3472390 - RNA, 15 nt, Human
cuuucacccuuuucu

SEQ ID NO: 3472391 - RNA, 15 nt, Human
cuuucacuauuuccu

SEQ ID NO: 3472392 - RNA, 22 nt, Human
cuuucacuauuuccuuuauaau

SEQ ID NO: 3472393 - RNA, 13 nt, Human
cuuucacuucuuu

SEQ ID NO: 3472394 - RNA, 15 nt, Human
cuuucacuucuuucc

SEQ ID NO: 3472395 - RNA, 11 nt, Human
cuuucagaaag

SEQ ID NO: 3472396 - RNA, 15 nt, Human
cuuucagaaauauaa

SEQ ID NO: 3472397 - RNA, 22 nt, Human
cuuucagaaauauaacacauuu

SEQ ID NO: 3472398 - RNA, 14 nt, Human
cuuucagagacagc

SEQ ID NO: 3472399 - RNA, 11 nt, Human
cuuucagagcc

SEQ ID NO: 3472400 - RNA, 14 nt, Human
cuuucagagccucc

SEQ ID NO: 3472401 - RNA, 20 nt, Human
cuuucagauaacuguuauuu

SEQ ID NO: 3472402 - RNA, 13 nt, Human
cuuucagauacug

SEQ ID NO: 3472403 - RNA, 22 nt, Human
cuuucagauacuggauuguacu

SEQ ID NO: 3472404 - RNA, 20 nt, Human
cuuucagaugucuucugccu

SEQ ID NO: 3472405 - RNA, 21 nt, Human
cuuucagaugucuucugccug

SEQ ID NO: 3472406 - RNA, 14 nt, Human
cuuucagcaggcag

SEQ ID NO: 3472407 - RNA, 17 nt, Human
cuuucagcuccugacca

SEQ ID NO: 3472408 - RNA, 19 nt, Human
cuuucagcuccugaccagu

SEQ ID NO: 3472409 - RNA, 17 nt, Human
cuuucagcugucuuuug

SEQ ID NO: 3472410 - RNA, 13 nt, Human
cuuucagcuguga

SEQ ID NO: 3472411 - RNA, 17 nt, Human
cuuucaggaucuauuuu

SEQ ID NO: 3472412 - RNA, 13 nt, Human
cuuucagggccuc

SEQ ID NO: 3472413 - RNA, 15 nt, Human
cuuucaguacuuuuu

SEQ ID NO: 3472414 - RNA, 17 nt, Human
cuuucagugaaagcauc

SEQ ID NO: 3472415 - RNA, 23 nt, Human
cuuucauauaguuagcuaauaaa

SEQ ID NO: 3472416 - RNA, 14 nt, Human
cuuucauauuuuag

SEQ ID NO: 3472417 - RNA, 18 nt, Human
cuuucaucaaucauugua

SEQ ID NO: 3472418 - RNA, 18 nt, Human
cuuucaucacacugggug

SEQ ID NO: 3472419 - RNA, 16 nt, Human
cuuucauccccaccuu

SEQ ID NO: 3472420 - RNA, 17 nt, Human
cuuucauccccaccuug

SEQ ID NO: 3472421 - RNA, 17 nt, Human
cuuucauccugacucug

SEQ ID NO: 3472422 - RNA, 22 nt, Human
cuuucauccugacucugccccc

SEQ ID NO: 3472423 - RNA, 20 nt, Human
cuuucauguaaacugugcac

SEQ ID NO: 3472424 - RNA, 21 nt, Human
cuuucauuaaaggcuucucuc

SEQ ID NO: 3472425 - RNA, 18 nt, Human
cuuucauuccuucagauu

SEQ ID NO: 3472426 - RNA, 16 nt, Human
cuuucauuuacugugg

SEQ ID NO: 3472427 - RNA, 17 nt, Human
cuuucauuuacuguggc

SEQ ID NO: 3472428 - RNA, 14 nt, Human
cuuucauuugcuau

SEQ ID NO: 3472429 - RNA, 17 nt, Human
cuuucauuuucucucag

SEQ ID NO: 3472430 - RNA, 18 nt, Human
cuuucauuuucucucagg

SEQ ID NO: 3472431 - RNA, 13 nt, Human
cuuucauuuucug

SEQ ID NO: 3472432 - RNA, 17 nt, Human
cuuucauuuucuguuug

SEQ ID NO: 3472433 - RNA, 21 nt, Human
cuuucauuuugcuuuaauuuu

SEQ ID NO: 3472434 - RNA, 23 nt, Human
cuuuccaaagccaaugugaacag

SEQ ID NO: 3472435 - RNA, 22 nt, Human
cuuuccaaaugcccagcuuaaa

SEQ ID NO: 3472436 - RNA, 13 nt, Human
cuuuccaaauuau

SEQ ID NO: 3472437 - RNA, 15 nt, Human
cuuuccaaauuauuu

SEQ ID NO: 3472438 - RNA, 15 nt, Human
cuuuccaauucuccu

SEQ ID NO: 3472439 - RNA, 18 nt, Human
cuuuccaauucuccuuua

SEQ ID NO: 3472440 - RNA, 21 nt, Human
cuuuccacaccuggcacugcu

SEQ ID NO: 3472441 - RNA, 15 nt, Human
cuuuccaccacagcc

SEQ ID NO: 3472442 - RNA, 23 nt, Human
cuuuccaccacagccagcaccug

SEQ ID NO: 3472443 - RNA, 15 nt, Human
cuuuccacccccucc

SEQ ID NO: 3472444 - RNA, 21 nt, Human
cuuuccacccccucccuggcc

SEQ ID NO: 3472445 - RNA, 12 nt, Human
cuuuccacucug

SEQ ID NO: 3472446 - RNA, 14 nt, Human
cuuuccacucugga

SEQ ID NO: 3472447 - RNA, 17 nt, Human
cuuuccacuucuuccuu

SEQ ID NO: 3472448 - RNA, 9 nt, Human
cuuuccaga

SEQ ID NO: 3472449 - RNA, 21 nt, Human
cuuuccagcucaccccccaca

SEQ ID NO: 3472450 - RNA, 22 nt, Human
cuuuccaggcuauguauaaaau

SEQ ID NO: 3472451 - RNA, 23 nt, Human
cuuuccaggcuauguauaaaaua

SEQ ID NO: 3472452 - RNA, 15 nt, Human
cuuuccaucuacccu

SEQ ID NO: 3472453 - RNA, 12 nt, Human
cuuuccauuaca

SEQ ID NO: 3472454 - RNA, 12 nt, Human
cuuuccauuuug

SEQ ID NO: 3472455 - RNA, 21 nt, Human
cuuucuuuggugccuuuccug

SEQ ID NO: 3472456 - RNA, 18 nt, Human
cuuucuuuguuuggcugg

SEQ ID NO: 3472457 - RNA, 18 nt, Human
cuuucuuuugauucuucc

SEQ ID NO: 3472458 - RNA, 15 nt, Human
cuuucuuuuucuucu

SEQ ID NO: 3472459 - RNA, 15 nt, Human
cuuucuuuuuugaua

SEQ ID NO: 3472460 - RNA, 18 nt, Human
cuuucuuuuuuucccccc

SEQ ID NO: 3472461 - RNA, 19 nt, Human
cuuucuuuuuuuuuuuuga

SEQ ID NO: 3472462 - RNA, 19 nt, Human
cuuugaaaccugcucugua

SEQ ID NO: 3472463 - RNA, 19 nt, Human
cuuugaaagccccagaaau

SEQ ID NO: 3472464 - RNA, 13 nt, Human
cuuugaaauaccu

SEQ ID NO: 3472465 - RNA, 22 nt, Human
cuuugaaauaccucauguuuau

SEQ ID NO: 3472466 - RNA, 23 nt, Human
cuuugaaauugaaccuuugugcc

SEQ ID NO: 3472467 - RNA, 15 nt, Human
cuuugaaauuguuua

SEQ ID NO: 3472468 - RNA, 22 nt, Human
cuuugaacuaaugauaaaguaa

SEQ ID NO: 3472469 - RNA, 13 nt, Human
cuuugaagaggaa

SEQ ID NO: 3472470 - RNA, 20 nt, Human
cuuugaagaggaaaaugaau

SEQ ID NO: 3472471 - RNA, 23 nt, Human
cuuugaagcugaaaauauaaaac

SEQ ID NO: 3472472 - RNA, 13 nt, Human
cuuugaaguagcu

SEQ ID NO: 3472473 - RNA, 16 nt, Human
cuuugaagucauacca

SEQ ID NO: 3472474 - RNA, 21 nt, Human
cuuugaauaaagaauacuuga

SEQ ID NO: 3472475 - RNA, 16 nt, Human
cuuugaauaaaugugu

SEQ ID NO: 3472476 - RNA, 20 nt, Human
cuuugaauuuucauuuuaca

SEQ ID NO: 3472477 - RNA, 23 nt, Human
cuuugacaauugggagcugccaa

SEQ ID NO: 3472478 - RNA, 22 nt, Human
cuuugacacuuuucauaucauu

SEQ ID NO: 3472479 - RNA, 17 nt, Human
cuuugaccucaaccugu

SEQ ID NO: 3472480 - RNA, 21 nt, Human
cuuugaccucaaccugugaug

SEQ ID NO: 3472481 - RNA, 13 nt, Human
cuuugaccucugc

SEQ ID NO: 3472482 - RNA, 20 nt, Human
cuuugaccucugcagcaaua

SEQ ID NO: 3472483 - RNA, 15 nt, Human
cuuugaccugccucc

SEQ ID NO: 3472484 - RNA, 20 nt, Human
cuuugacgagucaccuucca

SEQ ID NO: 3472485 - RNA, 21 nt, Human
cuuugacgagucaccuuccag

SEQ ID NO: 3472486 - RNA, 13 nt, Human
cuuugacucagga

SEQ ID NO: 3472487 - RNA, 23 nt, Human
cuuugacucaggagccugugaca

SEQ ID NO: 3472488 - RNA, 14 nt, Human
cuuugacuuuuugc

SEQ ID NO: 3472489 - RNA, 19 nt, Human
cuuugagaagccuucagcu

SEQ ID NO: 3472490 - RNA, 17 nt, Human
cuuugagacaguuucuu

SEQ ID NO: 3472491 - RNA, 17 nt, Human
cuuugagacugggucuc

SEQ ID NO: 3472492 - RNA, 12 nt, Human
cuuugagagaga

SEQ ID NO: 3472493 - RNA, 19 nt, Human
cuuugagauagaagaacug

SEQ ID NO: 3472494 - RNA, 20 nt, Human
cuuugagauagaagaacugc

SEQ ID NO: 3472495 - RNA, 17 nt, Human
cuuugagaucuaaaaau

SEQ ID NO: 3472496 - RNA, 23 nt, Human
cuuugagcucccacuucugccag

SEQ ID NO: 3472497 - RNA, 13 nt, Human
cuuugagggacug

SEQ ID NO: 3472498 - RNA, 18 nt, Human
cuuugagggacugccucu

SEQ ID NO: 3472499 - RNA, 16 nt, Human
cuuugagguggaagag

SEQ ID NO: 3472500 - RNA, 17 nt, Human
cuuugagguggaagagg

SEQ ID NO: 3472501 - RNA, 15 nt, Human
cuuugagguugcuuu

SEQ ID NO: 3472502 - RNA, 21 nt, Human
cuuugaguagauccauuucca

SEQ ID NO: 3472503 - RNA, 13 nt, Human
cuuugagugaucc

SEQ ID NO: 3472504 - RNA, 21 nt, Human
cuuugagugucuuaauuaaaa

SEQ ID NO: 3472505 - RNA, 19 nt, Human
cuuugaguuuccucaggcu

SEQ ID NO: 3472506 - RNA, 20 nt, Human
cuuugaucaugaauaacuga

SEQ ID NO: 3472507 - RNA, 16 nt, Human
cuuugaugucaugugu

SEQ ID NO: 3472508 - RNA, 18 nt, Human
cuuugauguuaacacauu

SEQ ID NO: 3472509 - RNA, 23 nt, Human
cuuugauguuaacacauuuugua

SEQ ID NO: 3472510 - RNA, 17 nt, Human
cuuugauuaauccagaa

SEQ ID NO: 3472511 - RNA, 23 nt, Human
cuuugauuaguuuucuuguugcu

SEQ ID NO: 3472512 - RNA, 15 nt, Human
cuuugauuauuugca

SEQ ID NO: 3472513 - RNA, 24 nt, Human
cuuugauuauuugcauguuauguu

SEQ ID NO: 3472514 - RNA, 19 nt, Human
cuuugauucauaguaacuu

SEQ ID NO: 3472515 - RNA, 14 nt, Human
cuuugauucuccuu

SEQ ID NO: 3472516 - RNA, 20 nt, Human
cuuugauucuccuucagccc

SEQ ID NO: 3472517 - RNA, 15 nt, Human
cuuugcaaaggagcu

SEQ ID NO: 3472518 - RNA, 20 nt, Human
cuuugcacaggaugcuggcc

SEQ ID NO: 3472519 - RNA, 14 nt, Human
cuuugcacauuuug

SEQ ID NO: 3472520 - RNA, 23 nt, Human
cuuugcacgacgcccucucccca

SEQ ID NO: 3472521 - RNA, 14 nt, Human
cuuugcacugaggg

SEQ ID NO: 3472522 - RNA, 15 nt, Human
cuuugcacugagggc

SEQ ID NO: 3472523 - RNA, 16 nt, Human
cuuugcacugagggcc

SEQ ID NO: 3472524 - RNA, 22 nt, Human
cuuugcacugagggccacacua

SEQ ID NO: 3472525 - RNA, 23 nt, Human
cuuugcagaaacagauuugguga

SEQ ID NO: 3472526 - RNA, 13 nt, Human
cuuugcagggcag

SEQ ID NO: 3472527 - RNA, 17 nt, Human
cuuugcagguugcuuug

SEQ ID NO: 3472528 - RNA, 13 nt, Human
cuuugcauauuau

SEQ ID NO: 3472529 - RNA, 20 nt, Human
cuuugcauguuccacuaacc

SEQ ID NO: 3472530 - RNA, 16 nt, Human
cuuugcauuuggaauu

SEQ ID NO: 3472531 - RNA, 19 nt, Human
cuuugcauuuuaaaaauga

SEQ ID NO: 3472532 - RNA, 14 nt, Human
cuuugcauuuugga

SEQ ID NO: 3472533 - RNA, 20 nt, Human
cuuugccaagaccuuucaaa

SEQ ID NO: 3472534 - RNA, 17 nt, Human
cuuugccagcugcugcu

SEQ ID NO: 3472535 - RNA, 13 nt, Human
cuuugccagguga

SEQ ID NO: 3472536 - RNA, 15 nt, Human
cuuugcccaaccuca

SEQ ID NO: 3472537 - RNA, 17 nt, Human
cuuugcccaaccucagc

SEQ ID NO: 3472538 - RNA, 21 nt, Human
cuuugcccaaccucagcaacc

SEQ ID NO: 3472539 - RNA, 18 nt, Human
cuuugcccaguuggagac

SEQ ID NO: 3472540 - RNA, 21 nt, Human
cuuugcccuuuacuugucuuu

SEQ ID NO: 3472541 - RNA, 13 nt, Human
cuuugccuccccg

SEQ ID NO: 3472542 - RNA, 22 nt, Human
cuuugccuccuguguacugugu

SEQ ID NO: 3472543 - RNA, 22 nt, Human
cuuugccuguucaguuacagaa

SEQ ID NO: 3472544 - RNA, 15 nt, Human
cuuugccuucuuuug

SEQ ID NO: 3472545 - RNA, 18 nt, Human
cuuugccuugggcugcuc

SEQ ID NO: 3472546 - RNA, 22 nt, Human
cuuugccuugggcugcuccuca

SEQ ID NO: 3472547 - RNA, 17 nt, Human
cuuugcgcuccuggccc

SEQ ID NO: 3472548 - RNA, 15 nt, Human
cuuugcggacgggcu

SEQ ID NO: 3472549 - RNA, 14 nt, Human
cuuugcugacccuc

SEQ ID NO: 3472550 - RNA, 18 nt, Human
cuuugcugacccucccca

SEQ ID NO: 3472551 - RNA, 19 nt, Human
cuuugcugauuuccccucu

SEQ ID NO: 3472552 - RNA, 15 nt, Human
cuuugcugcagagaa

SEQ ID NO: 3472553 - RNA, 11 nt, Human
cuuugcugcca

SEQ ID NO: 3472554 - RNA, 22 nt, Human
cuuugcugucccauagucccug

SEQ ID NO: 3472555 - RNA, 21 nt, Human
cuuugcugugaggcuguccug

SEQ ID NO: 3472556 - RNA, 22 nt, Human
cuuugcugugaggcuguccugu

SEQ ID NO: 3472557 - RNA, 23 nt, Human
cuuugcuuaugaauauuuauaac

SEQ ID NO: 3472558 - RNA, 16 nt, Human
cuuugcuugaacacag

SEQ ID NO: 3472559 - RNA, 20 nt, Human
cuuugcuugaacacaguauu

SEQ ID NO: 3472560 - RNA, 13 nt, Human
cuuugcuugcuuu

SEQ ID NO: 3472561 - RNA, 19 nt, Human
cuuugcuugcuuugaagua

SEQ ID NO: 3472562 - RNA, 16 nt, Human
cuuugcuuuaauauaa

SEQ ID NO: 3472563 - RNA, 19 nt, Human
cuuugcuuuaauauaaaug

SEQ ID NO: 3472564 - RNA, 21 nt, Human
cuuugcuuuaauauaaaugca

SEQ ID NO: 3472565 - RNA, 15 nt, Human
cuuugcuuucugcuc

SEQ ID NO: 3472566 - RNA, 21 nt, Human
cuuugcuuucugcucagcuuc

SEQ ID NO: 3472567 - RNA, 19 nt, Human
cuuuggaaaaugcauugua

SEQ ID NO: 3472568 - RNA, 17 nt, Human
cuuuggaaacaggacca

SEQ ID NO: 3472569 - RNA, 19 nt, Human
cuuuggaaagaguaggaag

SEQ ID NO: 3472570 - RNA, 23 nt, Human
cuuuggaaagaguaggaagacuu

SEQ ID NO: 3472571 - RNA, 23 nt, Human
cuuuggaaaguacacucugcugu

SEQ ID NO: 3472572 - RNA, 19 nt, Human
cuuuggaaaguagaaaagc

SEQ ID NO: 3472573 - RNA, 16 nt, Human
cuuuggaacaagaugg

SEQ ID NO: 3472574 - RNA, 21 nt, Human
cuuuggaaccagacucuugcc

SEQ ID NO: 3472575 - RNA, 23 nt, Human
cuuuggaaccagacucuugccug

SEQ ID NO: 3472576 - RNA, 15 nt, Human
cuuuggaagaaaaaa

SEQ ID NO: 3472577 - RNA, 18 nt, Human
cuuuggacacacacagcu

SEQ ID NO: 3472578 - RNA, 19 nt, Human
cuuuggacacacacagcuu

SEQ ID NO: 3472579 - RNA, 21 nt, Human
cuuuggacacacacagcuucu

SEQ ID NO: 3472580 - RNA, 20 nt, Human
cuuuggacagaagcagcucu

SEQ ID NO: 3472581 - RNA, 20 nt, Human
cuuuggacccaaggaaaacu

SEQ ID NO: 3472582 - RNA, 15 nt, Human
cuuuggacccugagg

SEQ ID NO: 3472583 - RNA, 19 nt, Human
cuuuggacccugaggccca

SEQ ID NO: 3472584 - RNA, 20 nt, Human
cuuuggaccuaaauggccuc

SEQ ID NO: 3472585 - RNA, 18 nt, Human
cuuuggacgcacacagcu

SEQ ID NO: 3472586 - RNA, 19 nt, Human
cuuuggacgcacacagcuu

SEQ ID NO: 3472587 - RNA, 18 nt, Human
cuuuggagaugcugaggg

SEQ ID NO: 3472588 - RNA, 13 nt, Human
cuuuggagcuuuu

SEQ ID NO: 3472589 - RNA, 18 nt, Human
cuuuggaguccccucacc

SEQ ID NO: 3472590 - RNA, 22 nt, Human
cuuuggaguccccucaccuccu

SEQ ID NO: 3472591 - RNA, 14 nt, Human
cuuuggaguuaaaa

SEQ ID NO: 3472592 - RNA, 14 nt, Human
cuuuggauaauaag

SEQ ID NO: 3472593 - RNA, 13 nt, Human
cuuuggauagcau

SEQ ID NO: 3472594 - RNA, 21 nt, Human
cuuuggauucuaaauacaugc

SEQ ID NO: 3472595 - RNA, 14 nt, Human
cuuuggcagaguuc

SEQ ID NO: 3472596 - RNA, 13 nt, Human
cuuuggcaggugc

SEQ ID NO: 3472597 - RNA, 13 nt, Human
cuuuggcaguguu

SEQ ID NO: 3472598 - RNA, 15 nt, Human
gaacacuuuuaauaa

SEQ ID NO: 3472599 - RNA, 20 nt, Human
gaacagaaaacaacaaaaaa

SEQ ID NO: 3472600 - RNA, 15 nt, Human
gaacagaauguuuua

SEQ ID NO: 3472601 - RNA, 15 nt, Human
gaacagacaggagaa

SEQ ID NO: 3472602 - RNA, 18 nt, Human
gaacagacaggagaaaug

SEQ ID NO: 3472603 - RNA, 19 nt, Human
gaacagaccggagaggaca

SEQ ID NO: 3472604 - RNA, 22 nt, Human
gaacagacuggaagcacagcuu

SEQ ID NO: 3472605 - RNA, 18 nt, Human
gaacagauaaucagugug

SEQ ID NO: 3472606 - RNA, 19 nt, Human
gaacagaucuccaaagcuu

SEQ ID NO: 3472607 - RNA, 22 nt, Human
gaacagaugaccccugcccaga

SEQ ID NO: 3472608 - RNA, 21 nt, Human
gaacagauucacacugucugg

SEQ ID NO: 3472609 - RNA, 20 nt, Human
gaacagcaggcccaccuacc

SEQ ID NO: 3472610 - RNA, 19 nt, Human
gaacagcauggcacucccu

SEQ ID NO: 3472611 - RNA, 18 nt, Human
gaacagccgcuccugucu

SEQ ID NO: 3472612 - RNA, 21 nt, Human
gaacagcuaugggagccccag

SEQ ID NO: 3472613 - RNA, 13 nt, Human
gaacagcuggugu

SEQ ID NO: 3472614 - RNA, 19 nt, Human
gaacagcugguguagcuac

SEQ ID NO: 3472615 - RNA, 16 nt, Human
gaacagcuucagguua

SEQ ID NO: 3472616 - RNA, 11 nt, Human
gaacaggacua

SEQ ID NO: 3472617 - RNA, 17 nt, Human
gaacaggauauucucac

SEQ ID NO: 3472618 - RNA, 20 nt, Human
gaacagggaaaauaggcagg

SEQ ID NO: 3472619 - RNA, 16 nt, Human
gaacaggugguuuuua

SEQ ID NO: 3472620 - RNA, 18 nt, Human
gaacagugcuugccacag

SEQ ID NO: 3472621 - RNA, 22 nt, Human
gaacagugugcaaggcagccgu

SEQ ID NO: 3472622 - RNA, 17 nt, Human
gaacaguguuucccaua

SEQ ID NO: 3472623 - RNA, 21 nt, Human
gaacaguguuucccauaauuu

SEQ ID NO: 3472624 - RNA, 16 nt, Human
gaacaguuaagcagcc

SEQ ID NO: 3472625 - RNA, 20 nt, Human
gaacaguuaagcagccgcca

SEQ ID NO: 3472626 - RNA, 24 nt, Human
gaacaguuaccucugccucagaaa

SEQ ID NO: 3472627 - RNA, 14 nt, Human
gaacauaaaaagga

SEQ ID NO: 3472628 - RNA, 16 nt, Human
gaacauaauucuuauu

SEQ ID NO: 3472629 - RNA, 17 nt, Human
gaacauacaaaugcauc

SEQ ID NO: 3472630 - RNA, 22 nt, Human
gaacauacaaaugcaucuuuga

SEQ ID NO: 3472631 - RNA, 23 nt, Human
gaacauacaaaugcaucuuugau

SEQ ID NO: 3472632 - RNA, 22 nt, Human
gaacauaccccuuacaaaugaa

SEQ ID NO: 3472633 - RNA, 18 nt, Human
gaacauacuggcugguga

SEQ ID NO: 3472634 - RNA, 16 nt, Human
gaacauagacagaaga

SEQ ID NO: 3472635 - RNA, 19 nt, Human
gaacauagacuagagaaac

SEQ ID NO: 3472636 - RNA, 14 nt, Human
gaacaucacagcuu

SEQ ID NO: 3472637 - RNA, 22 nt, Human
gaacaucaucaaggcacugccu

SEQ ID NO: 3472638 - RNA, 15 nt, Human
gaacaucauuagaac

SEQ ID NO: 3472639 - RNA, 18 nt, Human
gaacauccaaccuuccca

SEQ ID NO: 3472640 - RNA, 14 nt, Human
gaacaucccuccug

SEQ ID NO: 3472641 - RNA, 14 nt, Human
gaacaucccugcca

SEQ ID NO: 3472642 - RNA, 19 nt, Human
gaacauccuuccuucccac

SEQ ID NO: 3472643 - RNA, 20 nt, Human
gaacauccuuugcagggcag

SEQ ID NO: 3472644 - RNA, 21 nt, Human
gaacauccuuugcagggcagc

SEQ ID NO: 3472645 - RNA, 19 nt, Human
gaacaucuaacccacuaga

SEQ ID NO: 3472646 - RNA, 18 nt, Human
gaacaucugaguccugga

SEQ ID NO: 3472647 - RNA, 17 nt, Human
gaacaucuguccuguga

SEQ ID NO: 3472648 - RNA, 21 nt, Human
gaacaucuuugacacucugca

SEQ ID NO: 3472649 - RNA, 16 nt, Human
gaacaugcaguuugaa

SEQ ID NO: 3472650 - RNA, 19 nt, Human
gaacauggacuuguauauu

SEQ ID NO: 3472651 - RNA, 15 nt, Human
gaacauggagagcua

SEQ ID NO: 3472652 - RNA, 18 nt, Human
gaacaugguuugacucau

SEQ ID NO: 3472653 - RNA, 22 nt, Human
gaacauguccuaauucuucugu

SEQ ID NO: 3472654 - RNA, 24 nt, Human
gaacauguccuaauucuucugucc

SEQ ID NO: 3472655 - RNA, 20 nt, Human
gaacauuccaaggaguugga

SEQ ID NO: 3472656 - RNA, 15 nt, Human
gaacauugcaauaga

SEQ ID NO: 3472657 - RNA, 17 nt, Human
gaacauuuauuuuauga

SEQ ID NO: 3472658 - RNA, 22 nt, Human
gaacauuuauuuuaugagaaau

SEQ ID NO: 3472659 - RNA, 21 nt, Human
gaacauuuggguuacuauuuc

SEQ ID NO: 3472660 - RNA, 15 nt, Human
gaacauuugugauau

SEQ ID NO: 3472661 - RNA, 20 nt, Human
gaaccaaagagacuggagca

SEQ ID NO: 3472662 - RNA, 11 nt, Human
gaaccaaagcg

SEQ ID NO: 3472663 - RNA, 13 nt, Human
gaaccaaagcuca

SEQ ID NO: 3472664 - RNA, 16 nt, Human
gaaccaaaucuggaag

SEQ ID NO: 3472665 - RNA, 13 nt, Human
gaaccaauauuug

SEQ ID NO: 3472666 - RNA, 14 nt, Human
gaaccacaagacug

SEQ ID NO: 3472667 - RNA, 21 nt, Human
gaaccacaucuugcucugcug

SEQ ID NO: 3472668 - RNA, 19 nt, Human
gaaccacauugaagaaugu

SEQ ID NO: 3472669 - RNA, 17 nt, Human
gaaccaccacacccagc

SEQ ID NO: 3472670 - RNA, 18 nt, Human
gaaccaccacacccagcc

SEQ ID NO: 3472671 - RNA, 21 nt, Human
gaaccaccacacccagcccac

SEQ ID NO: 3472672 - RNA, 22 nt, Human
gaaccaccacacccagcccacu

SEQ ID NO: 3472673 - RNA, 13 nt, Human
gaaccaccuaccc

SEQ ID NO: 3472674 - RNA, 14 nt, Human
gaaccaccuacccc

SEQ ID NO: 3472675 - RNA, 14 nt, Human
gaaccacuucccuc

SEQ ID NO: 3472676 - RNA, 18 nt, Human
gaaccacuuguagauuug

SEQ ID NO: 3472677 - RNA, 20 nt, Human
gaaccacuuguagauuugau

SEQ ID NO: 3472678 - RNA, 23 nt, Human
gaaccagaugaguaaaggaguaa

SEQ ID NO: 3472679 - RNA, 18 nt, Human
gaaccagccggggccuua

SEQ ID NO: 3472680 - RNA, 18 nt, Human
gaaccauaaaauguccag

SEQ ID NO: 3472681 - RNA, 19 nt, Human
gaaccauaaaauguccagu

SEQ ID NO: 3472682 - RNA, 15 nt, Human
gaaccauaaauucaa

SEQ ID NO: 3472683 - RNA, 20 nt, Human
gaaccauccacuuacauaua

SEQ ID NO: 3472684 - RNA, 16 nt, Human
gaaccaugaagacagg

SEQ ID NO: 3472685 - RNA, 17 nt, Human
gaaccaugaagacagga

SEQ ID NO: 3472686 - RNA, 21 nt, Human
gaaccauguugguugcacuuu

SEQ ID NO: 3472687 - RNA, 17 nt, Human
gaacccaaguccaagca

SEQ ID NO: 3472688 - RNA, 14 nt, Human
gaacccacacugca

SEQ ID NO: 3472689 - RNA, 13 nt, Human
gaacccaccugcu

SEQ ID NO: 3472690 - RNA, 18 nt, Human
gaacccagcaguucuguu

SEQ ID NO: 3472691 - RNA, 16 nt, Human
gaacccagcccacccc

SEQ ID NO: 3472692 - RNA, 18 nt, Human
gaacccagcccacccccg

SEQ ID NO: 3472693 - RNA, 19 nt, Human
gaacccaggacaagcaugg

SEQ ID NO: 3472694 - RNA, 17 nt, Human
gaacccaggacgcuucu

SEQ ID NO: 3472695 - RNA, 20 nt, Human
gaacccauggaaaaaugcca

SEQ ID NO: 3472696 - RNA, 21 nt, Human
gaaccccccucccacccaccg

SEQ ID NO: 3472697 - RNA, 20 nt, Human
gaaccccggggugcccacag

SEQ ID NO: 3472698 - RNA, 22 nt, Human
gaaccccuggcuccaggccagg

SEQ ID NO: 3472699 - RNA, 20 nt, Human
gaacccgggagcggagguug

SEQ ID NO: 3472700 - RNA, 17 nt, Human
gaacccgggaggcagag

SEQ ID NO: 3472701 - RNA, 16 nt, Human
gaacccugccauggaa

SEQ ID NO: 3472702 - RNA, 16 nt, Human
gaacccugcccacucc

SEQ ID NO: 3472703 - RNA, 18 nt, Human
gaacccugcguggggaca

SEQ ID NO: 3472704 - RNA, 19 nt, Human
gaacccugcguggggacag

SEQ ID NO: 3472705 - RNA, 21 nt, Human
gaacccuggggccugacugcu

SEQ ID NO: 3472706 - RNA, 22 nt, Human
gaacccuggugaggaagcucca

SEQ ID NO: 3472707 - RNA, 16 nt, Human
gaacccuuggcuugcc

SEQ ID NO: 3472708 - RNA, 17 nt, Human
gaacccuuggcuugccc

SEQ ID NO: 3472709 - RNA, 17 nt, Human
gaacccuuuuggccccc

SEQ ID NO: 3472710 - RNA, 19 nt, Human
gaacccuuuuggcccccga

SEQ ID NO: 3472711 - RNA, 14 nt, Human
gaaccgaaaggcca

SEQ ID NO: 3472712 - RNA, 17 nt, Human
gaaccgagcaaagauca

SEQ ID NO: 3472713 - RNA, 19 nt, Human
gaaccgagcaaagaucaaa

SEQ ID NO: 3472714 - RNA, 12 nt, Human
gaaccgaggcag

SEQ ID NO: 3472715 - RNA, 22 nt, Human
gaaccgagggggcugcucccac

SEQ ID NO: 3472716 - RNA, 21 nt, Human
gaaccgcacagcucaggaggc

SEQ ID NO: 3472717 - RNA, 14 nt, Human
gaaccgcaggaagc

SEQ ID NO: 3472718 - RNA, 15 nt, Human
gaaccgcaggaagcu

SEQ ID NO: 3472719 - RNA, 17 nt, Human
gaaccgcucaccuagag

SEQ ID NO: 3472720 - RNA, 18 nt, Human
gaaccgcucaccuagagc

SEQ ID NO: 3472721 - RNA, 20 nt, Human
gaaccuaacuccccacccca

SEQ ID NO: 3472722 - RNA, 14 nt, Human
gaaccuaacuguau

SEQ ID NO: 3472723 - RNA, 23 nt, Human
gaaccuacaguuuuaacugugga

SEQ ID NO: 3472724 - RNA, 18 nt, Human
gaaccuauuucucuuucu

SEQ ID NO: 3472725 - RNA, 16 nt, Human
gaaccucacgcaccuc

SEQ ID NO: 3472726 - RNA, 18 nt, Human
gaaccucacgcaccuccc

SEQ ID NO: 3472727 - RNA, 21 nt, Human
gaaccucacgcaccucccauc

SEQ ID NO: 3472728 - RNA, 18 nt, Human
gaaccucagccuggccag

SEQ ID NO: 3472729 - RNA, 19 nt, Human
gaaccucagccuggccaga

SEQ ID NO: 3472730 - RNA, 21 nt, Human
gaaccucagccuggccagaca

SEQ ID NO: 3472731 - RNA, 11 nt, Human
gaaccucaggc

SEQ ID NO: 3472732 - RNA, 18 nt, Human
gaaccucaggcuuccuug

SEQ ID NO: 3472733 - RNA, 12 nt, Human
gaaccucccaga

SEQ ID NO: 3472734 - RNA, 13 nt, Human
gaaccucccagag

SEQ ID NO: 3472735 - RNA, 18 nt, Human
gaaccucccagaggucca

SEQ ID NO: 3472736 - RNA, 19 nt, Human
gaaccucccagagguccag

SEQ ID NO: 3472737 - RNA, 16 nt, Human
gaaccuccccagccug

SEQ ID NO: 3472738 - RNA, 14 nt, Human
gaaccuccucugug

SEQ ID NO: 3472739 - RNA, 16 nt, Human
gaaccucgaguacugu

SEQ ID NO: 3472740 - RNA, 17 nt, Human
gaaccucgaguacugug

SEQ ID NO: 3472741 - RNA, 15 nt, Human
gaacuugcugcuguc

SEQ ID NO: 3472742 - RNA, 19 nt, Human
gaacuuggaaagaaaugcc

SEQ ID NO: 3472743 - RNA, 17 nt, Human
gaacuuggggaacaagg

SEQ ID NO: 3472744 - RNA, 19 nt, Human
gaacuuggugccuaauguu

SEQ ID NO: 3472745 - RNA, 22 nt, Human
gaacuuguaaaggaauuuaaaa

SEQ ID NO: 3472746 - RNA, 14 nt, Human
gaacuuguagcugu

SEQ ID NO: 3472747 - RNA, 14 nt, Human
gaacuuguuuaaua

SEQ ID NO: 3472748 - RNA, 23 nt, Human
gaacuuucauuuuuuuccaggcu

SEQ ID NO: 3472749 - RNA, 17 nt, Human
gaacuuuccaggaaggc

SEQ ID NO: 3472750 - RNA, 21 nt, Human
gaacuuucucuucauacuuuu

SEQ ID NO: 3472751 - RNA, 15 nt, Human
gaacuuugaagaccc

SEQ ID NO: 3472752 - RNA, 14 nt, Human
gaacuuugaaggac

SEQ ID NO: 3472753 - RNA, 22 nt, Human
gaacuuugaccucugcagcaau

SEQ ID NO: 3472754 - RNA, 12 nt, Human
gaacuuuguaua

SEQ ID NO: 3472755 - RNA, 15 nt, Human
gaacuuuguauaguu

SEQ ID NO: 3472756 - RNA, 16 nt, Human
gaacuuuuuauugauu

SEQ ID NO: 3472757 - RNA, 17 nt, Human
gaacuuuuuuaaauaaa

SEQ ID NO: 3472758 - RNA, 18 nt, Human
gaacuuuuuuaaauaaac

SEQ ID NO: 3472759 - RNA, 21 nt, Human
gaacuuuuuuaaauaaacuuu

SEQ ID NO: 3472760 - RNA, 22 nt, Human
gaacuuuuuuaaauaaacuuuu

SEQ ID NO: 3472761 - RNA, 11 nt, Human
gaagaaaaaaa

SEQ ID NO: 3472762 - RNA, 17 nt, Human
gaagaaaaaaaauaaca

SEQ ID NO: 3472763 - RNA, 13 nt, Human
gaagaaaaaauac

SEQ ID NO: 3472764 - RNA, 13 nt, Human
gaagaaaaagaag

SEQ ID NO: 3472765 - RNA, 19 nt, Human
gaagaaaacacuguuauca

SEQ ID NO: 3472766 - RNA, 9 nt, Human
gaagaaaag

SEQ ID NO: 3472767 - RNA, 12 nt, Human
gaagaaaauacu

SEQ ID NO: 3472768 - RNA, 19 nt, Human
gaagaaaauacuuaaaugu

SEQ ID NO: 3472769 - RNA, 20 nt, Human
gaagaaacaagguuuucagu

SEQ ID NO: 3472770 - RNA, 16 nt, Human
gaagaaagaacggaag

SEQ ID NO: 3472771 - RNA, 18 nt, Human
gaagaaaucacagaauca

SEQ ID NO: 3472772 - RNA, 22 nt, Human
gaagaaaucacagaaucauaug

SEQ ID NO: 3472773 - RNA, 21 nt, Human
gaagaaauguaguuuacauuu

SEQ ID NO: 3472774 - RNA, 18 nt, Human
gaagaaauuccuguagca

SEQ ID NO: 3472775 - RNA, 19 nt, Human
gaagaacaggccucuccau

SEQ ID NO: 3472776 - RNA, 13 nt, Human
gaagaaccagucc

SEQ ID NO: 3472777 - RNA, 19 nt, Human
gaagaaccaguccccccac

SEQ ID NO: 3472778 - RNA, 22 nt, Human
gaagaaccaguccccccacccu

SEQ ID NO: 3472779 - RNA, 13 nt, Human
gaagaacggggcu

SEQ ID NO: 3472780 - RNA, 20 nt, Human
gaagaacggggcucuucuca

SEQ ID NO: 3472781 - RNA, 22 nt, Human
gaagaacggggcucuucucauu

SEQ ID NO: 3472782 - RNA, 23 nt, Human
gaagaacggggcucuucucauuu

SEQ ID NO: 3472783 - RNA, 22 nt, Human
gaagaacuguguuucaaguuca

SEQ ID NO: 3472784 - RNA, 16 nt, Human
gaagaagaaaaaaacg

SEQ ID NO: 3472785 - RNA, 12 nt, Human
gaagaagaaaag

SEQ ID NO: 3472786 - RNA, 13 nt, Human
gaagaagaagaaa

SEQ ID NO: 3472787 - RNA, 15 nt, Human
gaagaagagccacag

SEQ ID NO: 3472788 - RNA, 14 nt, Human
gaagaagcagagag

SEQ ID NO: 3472789 - RNA, 17 nt, Human
gaagaagcuuaggcagg

SEQ ID NO: 3472790 - RNA, 21 nt, Human
gaagaaggaaaugaauuucuc

SEQ ID NO: 3472791 - RNA, 16 nt, Human
gaagaagggcacccua

SEQ ID NO: 3472792 - RNA, 21 nt, Human
gaagaagguggaccuuuuaaa

SEQ ID NO: 3472793 - RNA, 23 nt, Human
gaagaagguggaccuuuuaaagu

SEQ ID NO: 3472794 - RNA, 19 nt, Human
gaagaaguuucaucauuuu

SEQ ID NO: 3472795 - RNA, 18 nt, Human
gaagaauacaaacauauu

SEQ ID NO: 3472796 - RNA, 23 nt, Human
gaagaauagggcccaugggaggg

SEQ ID NO: 3472797 - RNA, 19 nt, Human
gaagaauauucaggacuua

SEQ ID NO: 3472798 - RNA, 19 nt, Human
gaagaauccuuuuguagaa

SEQ ID NO: 3472799 - RNA, 20 nt, Human
gaagaaucuguuucccagca

SEQ ID NO: 3472800 - RNA, 23 nt, Human
gaagaaugcacaagaauggauca

SEQ ID NO: 3472801 - RNA, 18 nt, Human
gaagaauguguuucaaac

SEQ ID NO: 3472802 - RNA, 19 nt, Human
gaagaauguuagaguaaug

SEQ ID NO: 3472803 - RNA, 16 nt, Human
gaagaauuaagauaca

SEQ ID NO: 3472804 - RNA, 23 nt, Human
gaagaauuuacuuuggaaaguag

SEQ ID NO: 3472805 - RNA, 13 nt, Human
gaagaauuuguua

SEQ ID NO: 3472806 - RNA, 13 nt, Human
gaagaauuuuaaa

SEQ ID NO: 3472807 - RNA, 23 nt, Human
gaagaauuuuaaaaaugaauccu

SEQ ID NO: 3472808 - RNA, 16 nt, Human
gaagacaaugacuuac

SEQ ID NO: 3472809 - RNA, 18 nt, Human
gaagacaauugacaacag

SEQ ID NO: 3472810 - RNA, 18 nt, Human
gaagacaauuugauacau

SEQ ID NO: 3472811 - RNA, 12 nt, Human
gaagacacagac

SEQ ID NO: 3472812 - RNA, 18 nt, Human
gaagacaccagagcagau

SEQ ID NO: 3472813 - RNA, 22 nt, Human
gaagacaccagagcagaugcag

SEQ ID NO: 3472814 - RNA, 13 nt, Human
gaagacagagcua

SEQ ID NO: 3472815 - RNA, 12 nt, Human
gaagacaggaaa

SEQ ID NO: 3472816 - RNA, 12 nt, Human
gaagacaguggc

SEQ ID NO: 3472817 - RNA, 20 nt, Human
gaagacauggagacuccugc

SEQ ID NO: 3472818 - RNA, 12 nt, Human
gaagacauguuu

SEQ ID NO: 3472819 - RNA, 14 nt, Human
gaagacauugcacc

SEQ ID NO: 3472820 - RNA, 15 nt, Human
gaagacauuucuuuu

SEQ ID NO: 3472821 - RNA, 23 nt, Human
gaagaccaaucucuugaauccca

SEQ ID NO: 3472822 - RNA, 22 nt, Human
gaagaccacauccacacacgca

SEQ ID NO: 3472823 - RNA, 19 nt, Human
gaagacccaacacauggga

SEQ ID NO: 3472824 - RNA, 22 nt, Human
gaagacccauuccuucccagag

SEQ ID NO: 3472825 - RNA, 14 nt, Human
gaagacccuccccg

SEQ ID NO: 3472826 - RNA, 17 nt, Human
gaagacccucuugccca

SEQ ID NO: 3472827 - RNA, 20 nt, Human
gaagaccuaaccagggccag

SEQ ID NO: 3472828 - RNA, 19 nt, Human
gaagaccucaccuagaaau

SEQ ID NO: 3472829 - RNA, 22 nt, Human
gaagaccuggcaaggacacaga

SEQ ID NO: 3472830 - RNA, 17 nt, Human
gaagaccuuuuucugca

SEQ ID NO: 3472831 - RNA, 22 nt, Human
gaagacgaggcccucgggccca

SEQ ID NO: 3472832 - RNA, 23 nt, Human
gaagacgaggcccucgggcccag

SEQ ID NO: 3472833 - RNA, 21 nt, Human
gaagacgccgucuccauggca

SEQ ID NO: 3472834 - RNA, 15 nt, Human
gaagacgccugagcu

SEQ ID NO: 3472835 - RNA, 18 nt, Human
gaagacucauucuucugu

SEQ ID NO: 3472836 - RNA, 15 nt, Human
gaagacuccagaaau

SEQ ID NO: 3472837 - RNA, 15 nt, Human
gaagacucuaccaga

SEQ ID NO: 3472838 - RNA, 23 nt, Human
gaagacucuaccagacuguguau

SEQ ID NO: 3472839 - RNA, 16 nt, Human
gaagacuggaagcuaa

SEQ ID NO: 3472840 - RNA, 17 nt, Human
gaagacuggaagcuaau

SEQ ID NO: 3472841 - RNA, 11 nt, Human
gaagacugugg

SEQ ID NO: 3472842 - RNA, 12 nt, Human
gaagagaaacag

SEQ ID NO: 3472843 - RNA, 15 nt, Human
gaagagaaccagcca

SEQ ID NO: 3472844 - RNA, 14 nt, Human
gaagagaagcugcu

SEQ ID NO: 3472845 - RNA, 15 nt, Human
gaagagaagcugcug

SEQ ID NO: 3472846 - RNA, 16 nt, Human
gaagagaagcugcuga

SEQ ID NO: 3472847 - RNA, 12 nt, Human
gaagagaaggag

SEQ ID NO: 3472848 - RNA, 14 nt, Human
gaagagaaggagca

SEQ ID NO: 3472849 - RNA, 17 nt, Human
gaagagaagggcagggc

SEQ ID NO: 3472850 - RNA, 19 nt, Human
gaagagaaugcacaaacag

SEQ ID NO: 3472851 - RNA, 23 nt, Human
gaagagacguuuaaaagccauca

SEQ ID NO: 3472852 - RNA, 19 nt, Human
gaagagagauauaucugaa

SEQ ID NO: 3472853 - RNA, 23 nt, Human
gaagagagauauaucugaaaacu

SEQ ID NO: 3472854 - RNA, 16 nt, Human
gaagagagaucaaaug

SEQ ID NO: 3472855 - RNA, 19 nt, Human
gaagagagaucaaauggaa

SEQ ID NO: 3472856 - RNA, 19 nt, Human
gaagagaggaguucaauga

SEQ ID NO: 3472857 - RNA, 21 nt, Human
gaagagaggaguucaaugauc

SEQ ID NO: 3472858 - RNA, 15 nt, Human
gaagagauccaaaga

SEQ ID NO: 3472859 - RNA, 16 nt, Human
gaagagcaaaaauauc

SEQ ID NO: 3472860 - RNA, 15 nt, Human
gaagagcacagcccu

SEQ ID NO: 3472861 - RNA, 12 nt, Human
gaagagcagccc

SEQ ID NO: 3472862 - RNA, 18 nt, Human
gaagagcaggacuccagg

SEQ ID NO: 3472863 - RNA, 23 nt, Human
gaagagcaggacuccaggcccaa

SEQ ID NO: 3472864 - RNA, 19 nt, Human
gaagagccccacucucaga

SEQ ID NO: 3472865 - RNA, 20 nt, Human
gaagagccccacucucagag

SEQ ID NO: 3472866 - RNA, 17 nt, Human
gaagagccuuccaccca

SEQ ID NO: 3472867 - RNA, 22 nt, Human
gaagagcgagagaucaaagaug

SEQ ID NO: 3472868 - RNA, 15 nt, Human
gaagagcucaaggga

SEQ ID NO: 3472869 - RNA, 23 nt, Human
gaagagcucaagggacaaggaca

SEQ ID NO: 3472870 - RNA, 22 nt, Human
gaagagcuccccuacggaccag

SEQ ID NO: 3472871 - RNA, 23 nt, Human
gaagagcuguucacagccagacu

SEQ ID NO: 3472872 - RNA, 17 nt, Human
gaagagcuuagaaacug

SEQ ID NO: 3472873 - RNA, 14 nt, Human
gaagagcuugcuuu

SEQ ID NO: 3472874 - RNA, 20 nt, Human
gaagagcuugcuuugauuua

SEQ ID NO: 3472875 - RNA, 17 nt, Human
gaagaggaaaaggcugg

SEQ ID NO: 3472876 - RNA, 15 nt, Human
gaagaggaaaaugaa

SEQ ID NO: 3472877 - RNA, 16 nt, Human
gaagaggcagauucaa

SEQ ID NO: 3472878 - RNA, 19 nt, Human
gaagaggcgggccagccag

SEQ ID NO: 3472879 - RNA, 11 nt, Human
gaagaggcuuc

SEQ ID NO: 3472880 - RNA, 20 nt, Human
gaagagggagaagcaugaaa

SEQ ID NO: 3472881 - RNA, 20 nt, Human
gaagagggccugugggagcc

SEQ ID NO: 3472882 - RNA, 12 nt, Human
gaagagggcugc

SEQ ID NO: 3472883 - RNA, 18 nt, Human
gaagaggggcagcccuug

SEQ ID NO: 3472884 - RNA, 23 nt, Human
gaagaguaagucaaccugccuga

SEQ ID NO: 3472885 - RNA, 20 nt, Human
gaagcggcccuaagggagug

SEQ ID NO: 3472886 - RNA, 14 nt, Human
gaagcggcuggcag

SEQ ID NO: 3472887 - RNA, 14 nt, Human
gaagcguauguuuu

SEQ ID NO: 3472888 - RNA, 13 nt, Human
gaagcguuguccu

SEQ ID NO: 3472889 - RNA, 14 nt, Human
gaagcuaacaggga

SEQ ID NO: 3472890 - RNA, 20 nt, Human
gaagcuaacagggaaggcag

SEQ ID NO: 3472891 - RNA, 21 nt, Human
gaagcuaacagggaaggcagg

SEQ ID NO: 3472892 - RNA, 14 nt, Human
gaagcuacagguua

SEQ ID NO: 3472893 - RNA, 19 nt, Human
gaagcuacagguuacaaca

SEQ ID NO: 3472894 - RNA, 22 nt, Human
gaagcuacagguuacaacagau

SEQ ID NO: 3472895 - RNA, 15 nt, Human
gaagcuacugugugu

SEQ ID NO: 3472896 - RNA, 20 nt, Human
gaagcuacugugugugugaa

SEQ ID NO: 3472897 - RNA, 15 nt, Human
gaagcuacuucucca

SEQ ID NO: 3472898 - RNA, 19 nt, Human
gaagcuacuuuguuuuuaa

SEQ ID NO: 3472899 - RNA, 14 nt, Human
gaagcuagcucccc

SEQ ID NO: 3472900 - RNA, 17 nt, Human
gaagcuagcuccccucc

SEQ ID NO: 3472901 - RNA, 22 nt, Human
gaagcuagcuccccuccucucc

SEQ ID NO: 3472902 - RNA, 13 nt, Human
gaagcucagccca

SEQ ID NO: 3472903 - RNA, 14 nt, Human
gaagcucagcccac

SEQ ID NO: 3472904 - RNA, 18 nt, Human
gaagcucagcccaccccc

SEQ ID NO: 3472905 - RNA, 22 nt, Human
gaagcucagcccaccccccuca

SEQ ID NO: 3472906 - RNA, 23 nt, Human
gaagcucagggccuggcucaggu

SEQ ID NO: 3472907 - RNA, 18 nt, Human
gaagcuccacugucaccc

SEQ ID NO: 3472908 - RNA, 19 nt, Human
gaagcuccacugucacccu

SEQ ID NO: 3472909 - RNA, 23 nt, Human
gaagcuccacugucacccuccac

SEQ ID NO: 3472910 - RNA, 19 nt, Human
gaagcuccaguccugcucu

SEQ ID NO: 3472911 - RNA, 12 nt, Human
gaagcuccccca

SEQ ID NO: 3472912 - RNA, 19 nt, Human
gaagcuccucuccccagcc

SEQ ID NO: 3472913 - RNA, 21 nt, Human
gaagcuccucuccccagccca

SEQ ID NO: 3472914 - RNA, 13 nt, Human
gaagcuccuggua

SEQ ID NO: 3472915 - RNA, 13 nt, Human
gaagcucugaagu

SEQ ID NO: 3472916 - RNA, 15 nt, Human
gaagcucugaaguca

SEQ ID NO: 3472917 - RNA, 20 nt, Human
gaagcucugaagucacauca

SEQ ID NO: 3472918 - RNA, 19 nt, Human
gaagcucuggcugaacccu

SEQ ID NO: 3472919 - RNA, 18 nt, Human
gaagcucuugaagacacu

SEQ ID NO: 3472920 - RNA, 22 nt, Human
gaagcugaaaaccuaaguccuu

SEQ ID NO: 3472921 - RNA, 14 nt, Human
gaagcugaaaauau

SEQ ID NO: 3472922 - RNA, 15 nt, Human
gaagcugaaaauaua

SEQ ID NO: 3472923 - RNA, 18 nt, Human
gaagcugacgaacuucca

SEQ ID NO: 3472924 - RNA, 12 nt, Human
gaagcugcagcu

SEQ ID NO: 3472925 - RNA, 13 nt, Human
gaagcugcaucca

SEQ ID NO: 3472926 - RNA, 18 nt, Human
gaagcugcauccagaggc

SEQ ID NO: 3472927 - RNA, 21 nt, Human
gaagcugccaggugagaaacu

SEQ ID NO: 3472928 - RNA, 16 nt, Human
gaagcugcccugccca

SEQ ID NO: 3472929 - RNA, 14 nt, Human
gaagcugcucaacu

SEQ ID NO: 3472930 - RNA, 13 nt, Human
gaagcugcuccag

SEQ ID NO: 3472931 - RNA, 17 nt, Human
gaagcuggccgaggguc

SEQ ID NO: 3472932 - RNA, 19 nt, Human
gaagcuggccugagagggg

SEQ ID NO: 3472933 - RNA, 21 nt, Human
gaagcuguuguacauuuauga

SEQ ID NO: 3472934 - RNA, 15 nt, Human
gaagcuguuuggaaa

SEQ ID NO: 3472935 - RNA, 18 nt, Human
gaagcuguuuggaaaaga

SEQ ID NO: 3472936 - RNA, 17 nt, Human
gaagcuuauuaaugcua

SEQ ID NO: 3472937 - RNA, 15 nt, Human
gaagcuucagaaguu

SEQ ID NO: 3472938 - RNA, 13 nt, Human
gaagcuuccaguc

SEQ ID NO: 3472939 - RNA, 23 nt, Human
gaagcuucugucuccagcuuccc

SEQ ID NO: 3472940 - RNA, 23 nt, Human
gaagcuucuuaaaugagaaggaa

SEQ ID NO: 3472941 - RNA, 15 nt, Human
gaagcuugacuccca

SEQ ID NO: 3472942 - RNA, 22 nt, Human
gaagcuuguguauccauuauca

SEQ ID NO: 3472943 - RNA, 12 nt, Human
gaagcuuuacca

SEQ ID NO: 3472944 - RNA, 18 nt, Human
gaagcuuuaccagcugaa

SEQ ID NO: 3472945 - RNA, 14 nt, Human
gaagcuuucaguau

SEQ ID NO: 3472946 - RNA, 20 nt, Human
gaagcuuuggugagaaccug

SEQ ID NO: 3472947 - RNA, 11 nt, Human
gaaggaaaaau

SEQ ID NO: 3472948 - RNA, 14 nt, Human
gaaggaaacccagc

SEQ ID NO: 3472949 - RNA, 21 nt, Human
gaaggaaacccagcucugguc

SEQ ID NO: 3472950 - RNA, 17 nt, Human
gaaggaaauaaaaaagu

SEQ ID NO: 3472951 - RNA, 22 nt, Human
gaaggaacucuggcuuccaggu

SEQ ID NO: 3472952 - RNA, 19 nt, Human
gaaggaagacuucaucccu

SEQ ID NO: 3472953 - RNA, 13 nt, Human
gaaggaagacuuu

SEQ ID NO: 3472954 - RNA, 20 nt, Human
gaaggaagccggggaagaga

SEQ ID NO: 3472955 - RNA, 19 nt, Human
gaaggaauauauggcagag

SEQ ID NO: 3472956 - RNA, 15 nt, Human
gaaggaauugacuuc

SEQ ID NO: 3472957 - RNA, 15 nt, Human
gaaggacacuuccug

SEQ ID NO: 3472958 - RNA, 18 nt, Human
gaaggacacuuccugccu

SEQ ID NO: 3472959 - RNA, 15 nt, Human
gaaggacagaaagga

SEQ ID NO: 3472960 - RNA, 21 nt, Human
gaaggacauugcggacagcca

SEQ ID NO: 3472961 - RNA, 20 nt, Human
gaaggaccacauuuuauauu

SEQ ID NO: 3472962 - RNA, 22 nt, Human
gaaggaccacauuuuauauuua

SEQ ID NO: 3472963 - RNA, 15 nt, Human
gaaggaccagcccuu

SEQ ID NO: 3472964 - RNA, 22 nt, Human
gaaggacccggaggggccuggc

SEQ ID NO: 3472965 - RNA, 23 nt, Human
gaaggacccggaggggccuggca

SEQ ID NO: 3472966 - RNA, 17 nt, Human
gaaggaccuauguuugc

SEQ ID NO: 3472967 - RNA, 16 nt, Human
gaaggaccuucacucu

SEQ ID NO: 3472968 - RNA, 20 nt, Human
gaaggacggguuggggccgg

SEQ ID NO: 3472969 - RNA, 21 nt, Human
gaaggacugugacaggcagca

SEQ ID NO: 3472970 - RNA, 16 nt, Human
gaaggagaaggaagga

SEQ ID NO: 3472971 - RNA, 18 nt, Human
gaaggagaaucaucagga

SEQ ID NO: 3472972 - RNA, 22 nt, Human
gaaggagaaucaucaggacccu

SEQ ID NO: 3472973 - RNA, 13 nt, Human
gaaggagacacag

SEQ ID NO: 3472974 - RNA, 14 nt, Human
gaaggagacacaga

SEQ ID NO: 3472975 - RNA, 17 nt, Human
gaaggagacacagaugu

SEQ ID NO: 3472976 - RNA, 15 nt, Human
gaaggagacaggcag

SEQ ID NO: 3472977 - RNA, 22 nt, Human
gaaggagacucaccucugccuc

SEQ ID NO: 3472978 - RNA, 12 nt, Human
gaaggagagaaa

SEQ ID NO: 3472979 - RNA, 17 nt, Human
gaaggagauagggaaaa

SEQ ID NO: 3472980 - RNA, 20 nt, Human
gaaggagccccauuccuggg

SEQ ID NO: 3472981 - RNA, 16 nt, Human
gaaggagcugccugga

SEQ ID NO: 3472982 - RNA, 17 nt, Human
gaaggagcugccuggac

SEQ ID NO: 3472983 - RNA, 16 nt, Human
gaaggaggagccuguc

SEQ ID NO: 3472984 - RNA, 12 nt, Human
gaaggaggccac

SEQ ID NO: 3472985 - RNA, 17 nt, Human
gaaggaggccaccuccu

SEQ ID NO: 3472986 - RNA, 21 nt, Human
gaaggaggcuaugcucagggg

SEQ ID NO: 3472987 - RNA, 18 nt, Human
gaaggaggcuccaggcag

SEQ ID NO: 3472988 - RNA, 19 nt, Human
gaaggaggcuccaggcagc

SEQ ID NO: 3472989 - RNA, 16 nt, Human
gaaggaggggaagcug

SEQ ID NO: 3472990 - RNA, 20 nt, Human
gaaggaggguacagcugggc

SEQ ID NO: 3472991 - RNA, 13 nt, Human
gaaggaguuuuau

SEQ ID NO: 3472992 - RNA, 19 nt, Human
gaaggaucccaugagcucc

SEQ ID NO: 3472993 - RNA, 21 nt, Human
gaaggaugaugucuuuuuauu

SEQ ID NO: 3472994 - RNA, 16 nt, Human
gaaggcaaaugacuuu

SEQ ID NO: 3472995 - RNA, 17 nt, Human
gaaggcaagagggggug

SEQ ID NO: 3472996 - RNA, 23 nt, Human
gaaggcaagaggggguggagggg

SEQ ID NO: 3472997 - RNA, 14 nt, Human
gaaggcaagccagg

SEQ ID NO: 3472998 - RNA, 18 nt, Human
gaaggcagaaagcaaaau

SEQ ID NO: 3472999 - RNA, 14 nt, Human
gaaggcagacagca

SEQ ID NO: 3473000 - RNA, 19 nt, Human
gaaggcagacagcaggcag

SEQ ID NO: 3473001 - RNA, 20 nt, Human
gaaggcagacagcaggcagc

SEQ ID NO: 3473002 - RNA, 21 nt, Human
gaaggcagacagcaggcagcg

SEQ ID NO: 3473003 - RNA, 13 nt, Human
gaaggcagagaaa

SEQ ID NO: 3473004 - RNA, 14 nt, Human
gaaggcagagaaau

SEQ ID NO: 3473005 - RNA, 13 nt, Human
gaaggcaggcagg

SEQ ID NO: 3473006 - RNA, 14 nt, Human
gaaggcaggcaggg

SEQ ID NO: 3473007 - RNA, 16 nt, Human
gaaggcaggcagggcu

SEQ ID NO: 3473008 - RNA, 13 nt, Human
gaaggcagggaaa

SEQ ID NO: 3473009 - RNA, 17 nt, Human
gaaggcagggaggaggc

SEQ ID NO: 3473010 - RNA, 18 nt, Human
gaaggcagggaggaggca

SEQ ID NO: 3473011 - RNA, 18 nt, Human
gaaggcagggagggccug

SEQ ID NO: 3473012 - RNA, 20 nt, Human
gaaggcagggagggccuggg

SEQ ID NO: 3473013 - RNA, 22 nt, Human
gaaggcagggggaagguggggu

SEQ ID NO: 3473014 - RNA, 13 nt, Human
gaaggcauggcgg

SEQ ID NO: 3473015 - RNA, 16 nt, Human
gaaggccaccugcagg

SEQ ID NO: 3473016 - RNA, 22 nt, Human
gaaggccagcugccccagccag

SEQ ID NO: 3473017 - RNA, 22 nt, Human
gaaggcccagcaccacccuccu

SEQ ID NO: 3473018 - RNA, 15 nt, Human
gaaggccccgcccag

SEQ ID NO: 3473019 - RNA, 18 nt, Human
gaaggccccgcccaggcu

SEQ ID NO: 3473020 - RNA, 19 nt, Human
gaaggccccgcccaggcuu

SEQ ID NO: 3473021 - RNA, 16 nt, Human
gaaggcccugcugagu

SEQ ID NO: 3473022 - RNA, 18 nt, Human
gaaggcccugcugaguca

SEQ ID NO: 3473023 - RNA, 15 nt, Human
gaaggccucgcagga

SEQ ID NO: 3473024 - RNA, 12 nt, Human
gaaggccucuug

SEQ ID NO: 3473025 - RNA, 13 nt, Human
gaaggccugacuu

SEQ ID NO: 3473026 - RNA, 14 nt, Human
gaaggcuaaaaagc

SEQ ID NO: 3473027 - RNA, 22 nt, Human
gaaggcuacuucggggcuggga

SEQ ID NO: 3473028 - RNA, 18 nt, Human
gaaggcuggcaugaucca

SEQ ID NO: 3473029 - RNA, 17 nt, Human
gaaggcuguccuuaccc

SEQ ID NO: 3473030 - RNA, 17 nt, Human
gaagugugggucugugu

SEQ ID NO: 3473031 - RNA, 19 nt, Human
gaagugugggucugugugu

SEQ ID NO: 3473032 - RNA, 13 nt, Human
gaaguguugcaug

SEQ ID NO: 3473033 - RNA, 15 nt, Human
gaaguguugcaugga

SEQ ID NO: 3473034 - RNA, 18 nt, Human
gaaguguugcauggaugu

SEQ ID NO: 3473035 - RNA, 16 nt, Human
gaaguguuuauguugu

SEQ ID NO: 3473036 - RNA, 21 nt, Human
gaaguguuucacgagagcccg

SEQ ID NO: 3473037 - RNA, 15 nt, Human
gaaguuaaagggaag

SEQ ID NO: 3473038 - RNA, 15 nt, Human
gaaguuaacagagac

SEQ ID NO: 3473039 - RNA, 22 nt, Human
gaaguuacacagaaaugcugcu

SEQ ID NO: 3473040 - RNA, 21 nt, Human
gaaguuacuguuacuugauaa

SEQ ID NO: 3473041 - RNA, 21 nt, Human
gaaguuagccuuuaucuacca

SEQ ID NO: 3473042 - RNA, 22 nt, Human
gaaguuagccuuuaucuaccaa

SEQ ID NO: 3473043 - RNA, 17 nt, Human
gaaguuaguuuguauau

SEQ ID NO: 3473044 - RNA, 15 nt, Human
gaaguucaagaucaa

SEQ ID NO: 3473045 - RNA, 15 nt, Human
gaaguucauaccuaa

SEQ ID NO: 3473046 - RNA, 22 nt, Human
gaaguucauaccuaaguacugu

SEQ ID NO: 3473047 - RNA, 17 nt, Human
gaaguucugccucugau

SEQ ID NO: 3473048 - RNA, 17 nt, Human
gaaguugaaguuuagga

SEQ ID NO: 3473049 - RNA, 18 nt, Human
gaaguugauauagaacag

SEQ ID NO: 3473050 - RNA, 21 nt, Human
gaaguugauauagaacagugc

SEQ ID NO: 3473051 - RNA, 20 nt, Human
gaaguugcauuccuuugucu

SEQ ID NO: 3473052 - RNA, 21 nt, Human
gaaguugcugcuucucccagg

SEQ ID NO: 3473053 - RNA, 22 nt, Human
gaaguuggagugaguguggcuc

SEQ ID NO: 3473054 - RNA, 18 nt, Human
gaaguugggcaauauaac

SEQ ID NO: 3473055 - RNA, 20 nt, Human
gaaguugugccuuuuauagc

SEQ ID NO: 3473056 - RNA, 20 nt, Human
gaaguuguggauuucaguuu

SEQ ID NO: 3473057 - RNA, 14 nt, Human
gaaguuguuuguca

SEQ ID NO: 3473058 - RNA, 13 nt, Human
gaaguuuaaaaca

SEQ ID NO: 3473059 - RNA, 20 nt, Human
gaaguuucugccgcagcccu

SEQ ID NO: 3473060 - RNA, 14 nt, Human
gaaguuugaauguu

SEQ ID NO: 3473061 - RNA, 19 nt, Human
gaaguuugaauguuaaaua

SEQ ID NO: 3473062 - RNA, 20 nt, Human
gaaguuugaauguuaaauaa

SEQ ID NO: 3473063 - RNA, 19 nt, Human
gaaguuugauauuaaagga

SEQ ID NO: 3473064 - RNA, 21 nt, Human
gaaguuuguguucuguuuguu

SEQ ID NO: 3473065 - RNA, 23 nt, Human
gaaguuuucaaugaugggcgagc

SEQ ID NO: 3473066 - RNA, 17 nt, Human
gaaguuuugcauuuaug

SEQ ID NO: 3473067 - RNA, 18 nt, Human
gaaguuuuuguacuguaa

SEQ ID NO: 3473068 - RNA, 19 nt, Human
gaaguuuuuguacuguaaa

SEQ ID NO: 3473069 - RNA, 17 nt, Human
gaauaaaauguugaaaa

SEQ ID NO: 3473070 - RNA, 21 nt, Human
gaauaaaauuauuuuggauuu

SEQ ID NO: 3473071 - RNA, 13 nt, Human
gaauaaaauugua

SEQ ID NO: 3473072 - RNA, 12 nt, Human
gaauaaaauuuu

SEQ ID NO: 3473073 - RNA, 15 nt, Human
gaauaaacauuuguu

SEQ ID NO: 3473074 - RNA, 15 nt, Human
gaauaaacuucagca

SEQ ID NO: 3473075 - RNA, 17 nt, Human
gaauaaacuucagcacc

SEQ ID NO: 3473076 - RNA, 18 nt, Human
gaauaaacuucagcacca

SEQ ID NO: 3473077 - RNA, 11 nt, Human
gaauaaagaau

SEQ ID NO: 3473078 - RNA, 17 nt, Human
gaauaaagaaugaaugg

SEQ ID NO: 3473079 - RNA, 11 nt, Human
gaauaaagcaa

SEQ ID NO: 3473080 - RNA, 14 nt, Human
gaauaaagcaauuu

SEQ ID NO: 3473081 - RNA, 14 nt, Human
gaauaaaguucuga

SEQ ID NO: 3473082 - RNA, 20 nt, Human
gaauaaaguucugaguguuu

SEQ ID NO: 3473083 - RNA, 23 nt, Human
gaauaaaugucacuuuuugaggc

SEQ ID NO: 3473084 - RNA, 12 nt, Human
gaauaaaugugu

SEQ ID NO: 3473085 - RNA, 16 nt, Human
gaauaaauguguuggg

SEQ ID NO: 3473086 - RNA, 19 nt, Human
gaauaaauuguacagccgg

SEQ ID NO: 3473087 - RNA, 14 nt, Human
gaauaacauguaau

SEQ ID NO: 3473088 - RNA, 12 nt, Human
gaauaagagacc

SEQ ID NO: 3473089 - RNA, 20 nt, Human
gaauaagagaccuguuuuaa

SEQ ID NO: 3473090 - RNA, 21 nt, Human
gaauaagccauucugacucau

SEQ ID NO: 3473091 - RNA, 22 nt, Human
gaauaagccauucugacucaua

SEQ ID NO: 3473092 - RNA, 12 nt, Human
gaauaaggccuu

SEQ ID NO: 3473093 - RNA, 19 nt, Human
gaauaagguacaagaagca

SEQ ID NO: 3473094 - RNA, 16 nt, Human
gaauaaguuauugcag

SEQ ID NO: 3473095 - RNA, 11 nt, Human
gaauaauaaau

SEQ ID NO: 3473096 - RNA, 14 nt, Human
gaauaauaagcagg

SEQ ID NO: 3473097 - RNA, 16 nt, Human
gaauaauaagcaggau

SEQ ID NO: 3473098 - RNA, 23 nt, Human
gaauaauaagcaggauguuggcc

SEQ ID NO: 3473099 - RNA, 20 nt, Human
gaauaaucacgcuuuccuga

SEQ ID NO: 3473100 - RNA, 16 nt, Human
gaauaaugccuuugua

SEQ ID NO: 3473101 - RNA, 22 nt, Human
gaauaauuuauaguaaugaguu

SEQ ID NO: 3473102 - RNA, 14 nt, Human
gaauaauuucuuac

SEQ ID NO: 3473103 - RNA, 17 nt, Human
gaauacaaacaccugga

SEQ ID NO: 3473104 - RNA, 22 nt, Human
gaauacaauauauagcuggcaa

SEQ ID NO: 3473105 - RNA, 18 nt, Human
gaauacagcagcaagaaa

SEQ ID NO: 3473106 - RNA, 23 nt, Human
gaauacagggcaugcauuuugca

SEQ ID NO: 3473107 - RNA, 21 nt, Human
gaauacaguaagcugcucuau

SEQ ID NO: 3473108 - RNA, 16 nt, Human
gaauaccacaucaaau

SEQ ID NO: 3473109 - RNA, 19 nt, Human
gaauaccacaucaaauaag

SEQ ID NO: 3473110 - RNA, 15 nt, Human
gaauaccacucugua

SEQ ID NO: 3473111 - RNA, 17 nt, Human
gaauaccacucuguaau

SEQ ID NO: 3473112 - RNA, 19 nt, Human
gaauaccacucuguaauug

SEQ ID NO: 3473113 - RNA, 13 nt, Human
gaauaccugcuca

SEQ ID NO: 3473114 - RNA, 13 nt, Human
gaauaccuguggu

SEQ ID NO: 3473115 - RNA, 15 nt, Human
gaauacugauggaau

SEQ ID NO: 3473116 - RNA, 13 nt, Human
gaauacugcuuga

SEQ ID NO: 3473117 - RNA, 14 nt, Human
gaauacuugaacca

SEQ ID NO: 3473118 - RNA, 22 nt, Human
gaauacuugaaccauaaaaugu

SEQ ID NO: 3473119 - RNA, 14 nt, Human
gaauacuugaacuu

SEQ ID NO: 3473120 - RNA, 16 nt, Human
gaauacuugaacuugu

SEQ ID NO: 3473121 - RNA, 15 nt, Human
gaauacuuuuuaaaa

SEQ ID NO: 3473122 - RNA, 14 nt, Human
gaauacuuuuuaca

SEQ ID NO: 3473123 - RNA, 20 nt, Human
gaauacuuuuuacaauuaaa

SEQ ID NO: 3473124 - RNA, 13 nt, Human
gaauagaaagaaa

SEQ ID NO: 3473125 - RNA, 16 nt, Human
gaauagaagcaaauua

SEQ ID NO: 3473126 - RNA, 12 nt, Human
gaauagaaggaa

SEQ ID NO: 3473127 - RNA, 13 nt, Human
gaauagaaggaaa

SEQ ID NO: 3473128 - RNA, 14 nt, Human
gaauagaaggaaac

SEQ ID NO: 3473129 - RNA, 16 nt, Human
gaauagacaucaaacu

SEQ ID NO: 3473130 - RNA, 19 nt, Human
gaauagacaucaaacucaa

SEQ ID NO: 3473131 - RNA, 19 nt, Human
gaauagauaugaaagcuga

SEQ ID NO: 3473132 - RNA, 15 nt, Human
gaauagaugcugacu

SEQ ID NO: 3473133 - RNA, 16 nt, Human
gaauagcaucuguaca

SEQ ID NO: 3473134 - RNA, 18 nt, Human
gaauagcauguuguagau

SEQ ID NO: 3473135 - RNA, 18 nt, Human
gaauagccauauuuguaa

SEQ ID NO: 3473136 - RNA, 23 nt, Human
gaauagccauauuuguaaaauga

SEQ ID NO: 3473137 - RNA, 22 nt, Human
gaauagccuagauaugaauaua

SEQ ID NO: 3473138 - RNA, 15 nt, Human
gaauagccuguggcc

SEQ ID NO: 3473139 - RNA, 14 nt, Human
gaauagcugaugug

SEQ ID NO: 3473140 - RNA, 14 nt, Human
gaauagcugggacu

SEQ ID NO: 3473141 - RNA, 15 nt, Human
gaauagcugggacua

SEQ ID NO: 3473142 - RNA, 22 nt, Human
gaauagcugggacuacaggugu

SEQ ID NO: 3473143 - RNA, 23 nt, Human
gaauagcugggacuacaggugug

SEQ ID NO: 3473144 - RNA, 19 nt, Human
gaauaggacuuguuuuugu

SEQ ID NO: 3473145 - RNA, 19 nt, Human
gaauagggcccaugggagg

SEQ ID NO: 3473146 - RNA, 16 nt, Human
gaauaguauccuccag

SEQ ID NO: 3473147 - RNA, 17 nt, Human
gaauauaaaugugugua

SEQ ID NO: 3473148 - RNA, 15 nt, Human
gaauauaacaugaaa

SEQ ID NO: 3473149 - RNA, 20 nt, Human
gaauauaacaugaaaugaua

SEQ ID NO: 3473150 - RNA, 19 nt, Human
gaauauaauauauuugugu

SEQ ID NO: 3473151 - RNA, 13 nt, Human
gaauauaauuauc

SEQ ID NO: 3473152 - RNA, 22 nt, Human
gaauauacagcaggugcucaau

SEQ ID NO: 3473153 - RNA, 21 nt, Human
gaauauaccccuuaguguuug

SEQ ID NO: 3473154 - RNA, 17 nt, Human
gaauauagauuaaauca

SEQ ID NO: 3473155 - RNA, 23 nt, Human
gaauauauggcauuugcagauuu

SEQ ID NO: 3473156 - RNA, 13 nt, Human
gaauauauuuauu

SEQ ID NO: 3473157 - RNA, 13 nt, Human
gaauaucaauaua

SEQ ID NO: 3473158 - RNA, 15 nt, Human
gaauaucaauauaau

SEQ ID NO: 3473159 - RNA, 20 nt, Human
gaauaucaauauaauguuuu

SEQ ID NO: 3473160 - RNA, 16 nt, Human
gaauauccaugaccua

SEQ ID NO: 3473161 - RNA, 22 nt, Human
gaauaucuccgucaacucauau

SEQ ID NO: 3473162 - RNA, 17 nt, Human
gaauaucuguaauggua

SEQ ID NO: 3473163 - RNA, 14 nt, Human
gaauaucuuucgau

SEQ ID NO: 3473164 - RNA, 17 nt, Human
gaauaugacggaagaac

SEQ ID NO: 3473165 - RNA, 19 nt, Human
gaauaugagcuuuauguaa

SEQ ID NO: 3473166 - RNA, 16 nt, Human
gaauaugcaacauugu

SEQ ID NO: 3473167 - RNA, 23 nt, Human
gaauauguaguaucuauaugacu

SEQ ID NO: 3473168 - RNA, 15 nt, Human
gaauauguuucaaac

SEQ ID NO: 3473169 - RNA, 15 nt, Human
gaauauguuuccuug

SEQ ID NO: 3473170 - RNA, 14 nt, Human
gaauauuaaaaaac

SEQ ID NO: 3473171 - RNA, 12 nt, Human
gaauauuagcuu

SEQ ID NO: 3473172 - RNA, 16 nt, Human
gaauauuauauuugga

SEQ ID NO: 3473173 - RNA, 20 nt, Human
gaauauucagagaauaucaa

SEQ ID NO: 3473174 - RNA, 11 nt, Human
gaauauucagg

SEQ ID NO: 3473175 - RNA, 22 nt, Human
gacggcacggucuucccucuuc

SEQ ID NO: 3473176 - RNA, 16 nt, Human
gacggcaggcucacug

SEQ ID NO: 3473177 - RNA, 11 nt, Human
gacggcccugc

SEQ ID NO: 3473178 - RNA, 12 nt, Human
gacggcccugca

SEQ ID NO: 3473179 - RNA, 13 nt, Human
gacggcccugcaa

SEQ ID NO: 3473180 - RNA, 22 nt, Human
gacggccugaugcucccucccc

SEQ ID NO: 3473181 - RNA, 18 nt, Human
gacggcugggcacacgcc

SEQ ID NO: 3473182 - RNA, 17 nt, Human
gacgggguuucaccaug

SEQ ID NO: 3473183 - RNA, 23 nt, Human
gacgggugggcggcuggagacca

SEQ ID NO: 3473184 - RNA, 16 nt, Human
gacggugcagucuggg

SEQ ID NO: 3473185 - RNA, 16 nt, Human
gacggugcccaagcca

SEQ ID NO: 3473186 - RNA, 18 nt, Human
gacggugcccaagccaga

SEQ ID NO: 3473187 - RNA, 21 nt, Human
gacggugggcauuugugaggc

SEQ ID NO: 3473188 - RNA, 17 nt, Human
gacgguucaccagccuc

SEQ ID NO: 3473189 - RNA, 15 nt, Human
gacgguuuccaggga

SEQ ID NO: 3473190 - RNA, 21 nt, Human
gacgucagauguuuaaaacac

SEQ ID NO: 3473191 - RNA, 12 nt, Human
gacgucccucca

SEQ ID NO: 3473192 - RNA, 15 nt, Human
gacgucccugcccau

SEQ ID NO: 3473193 - RNA, 18 nt, Human
gacguccugccaccuggg

SEQ ID NO: 3473194 - RNA, 16 nt, Human
gacgugauuuugcugu

SEQ ID NO: 3473195 - RNA, 17 nt, Human
gacgugauuuugcugua

SEQ ID NO: 3473196 - RNA, 11 nt, Human
gacgugcuggg

SEQ ID NO: 3473197 - RNA, 22 nt, Human
gacguggaaccucugucucauc

SEQ ID NO: 3473198 - RNA, 16 nt, Human
gacguggcucagccag

SEQ ID NO: 3473199 - RNA, 13 nt, Human
gacgugggcuggg

SEQ ID NO: 3473200 - RNA, 19 nt, Human
gacguguguuucuagagcc

SEQ ID NO: 3473201 - RNA, 14 nt, Human
gacguguuaugacu

SEQ ID NO: 3473202 - RNA, 12 nt, Human
gacguuccagcc

SEQ ID NO: 3473203 - RNA, 13 nt, Human
gacguuccagccg

SEQ ID NO: 3473204 - RNA, 15 nt, Human
gacguuccagccggc

SEQ ID NO: 3473205 - RNA, 21 nt, Human
gacguucggggcaugcugggg

SEQ ID NO: 3473206 - RNA, 19 nt, Human
gacguuuauaaacagaaau

SEQ ID NO: 3473207 - RNA, 13 nt, Human
gacuaaaagauau

SEQ ID NO: 3473208 - RNA, 23 nt, Human
gacuaaaagauauaagugcugua

SEQ ID NO: 3473209 - RNA, 18 nt, Human
gacuaaaccauugugcau

SEQ ID NO: 3473210 - RNA, 19 nt, Human
gacuaaaccauugugcauu

SEQ ID NO: 3473211 - RNA, 10 nt, Human
gacuaaagag

SEQ ID NO: 3473212 - RNA, 13 nt, Human
gacuaaagagaga

SEQ ID NO: 3473213 - RNA, 16 nt, Human
gacuaacacucagaag

SEQ ID NO: 3473214 - RNA, 19 nt, Human
gacuaacacucagaagccu

SEQ ID NO: 3473215 - RNA, 23 nt, Human
gacuaaccauguguuauguuuuc

SEQ ID NO: 3473216 - RNA, 18 nt, Human
gacuaacuaucaaauaga

SEQ ID NO: 3473217 - RNA, 23 nt, Human
gacuaacuugucuuuggacccug

SEQ ID NO: 3473218 - RNA, 16 nt, Human
gacuaagagaaguugu

SEQ ID NO: 3473219 - RNA, 22 nt, Human
gacuaagaucgguuaacaaaua

SEQ ID NO: 3473220 - RNA, 18 nt, Human
gacuaagccagcaccgga

SEQ ID NO: 3473221 - RNA, 14 nt, Human
gacuaagcccuguc

SEQ ID NO: 3473222 - RNA, 22 nt, Human
gacuaagcccugucgagacacu

SEQ ID NO: 3473223 - RNA, 23 nt, Human
gacuaagcccugucgagacacuu

SEQ ID NO: 3473224 - RNA, 21 nt, Human
gacuaagccuaccugcucucc

SEQ ID NO: 3473225 - RNA, 22 nt, Human
gacuaaucuuauucauuuucuc

SEQ ID NO: 3473226 - RNA, 16 nt, Human
gacuaauggcaugaga

SEQ ID NO: 3473227 - RNA, 21 nt, Human
gacuaauuccugcccugccca

SEQ ID NO: 3473228 - RNA, 18 nt, Human
gacuaauuuaaaaaauaa

SEQ ID NO: 3473229 - RNA, 23 nt, Human
gacuaauuuuacauguuuauaaa

SEQ ID NO: 3473230 - RNA, 15 nt, Human
gacuacaaaaaugaa

SEQ ID NO: 3473231 - RNA, 22 nt, Human
gacuacagcuggggugcaggga

SEQ ID NO: 3473232 - RNA, 15 nt, Human
gacuacaggcaccca

SEQ ID NO: 3473233 - RNA, 12 nt, Human
gacuacagggcc

SEQ ID NO: 3473234 - RNA, 21 nt, Human
gacuacaggugugagucacca

SEQ ID NO: 3473235 - RNA, 14 nt, Human
gacuacauuuagag

SEQ ID NO: 3473236 - RNA, 22 nt, Human
gacuacccacguucucacaccc

SEQ ID NO: 3473237 - RNA, 14 nt, Human
gacuacuauuuucu

SEQ ID NO: 3473238 - RNA, 14 nt, Human
gacuacuuagcauc

SEQ ID NO: 3473239 - RNA, 20 nt, Human
gacuagaaaauuuaaaacau

SEQ ID NO: 3473240 - RNA, 16 nt, Human
gacuagaaccuggagg

SEQ ID NO: 3473241 - RNA, 15 nt, Human
gacuagaagggccag

SEQ ID NO: 3473242 - RNA, 18 nt, Human
gacuagaauucuagugcu

SEQ ID NO: 3473243 - RNA, 21 nt, Human
gacuagaauucuagugcugcu

SEQ ID NO: 3473244 - RNA, 22 nt, Human
gacuagaauucuagugcugcug

SEQ ID NO: 3473245 - RNA, 19 nt, Human
gacuagacacacaaagcag

SEQ ID NO: 3473246 - RNA, 16 nt, Human
gacuagacguucauuu

SEQ ID NO: 3473247 - RNA, 16 nt, Human
gacuagaggcagggag

SEQ ID NO: 3473248 - RNA, 23 nt, Human
gacuagagggaccucucccaggg

SEQ ID NO: 3473249 - RNA, 14 nt, Human
gacuagaugaugga

SEQ ID NO: 3473250 - RNA, 18 nt, Human
gacuagauguaguauuuu

SEQ ID NO: 3473251 - RNA, 21 nt, Human
gacuagccccuguggagacug

SEQ ID NO: 3473252 - RNA, 17 nt, Human
gacuagccuggcuuggg

SEQ ID NO: 3473253 - RNA, 14 nt, Human
gacuaggagcacug

SEQ ID NO: 3473254 - RNA, 16 nt, Human
gacuagggagccaugu

SEQ ID NO: 3473255 - RNA, 19 nt, Human
gacuagggauucaggcugc

SEQ ID NO: 3473256 - RNA, 20 nt, Human
gacuagggauucaggcugcu

SEQ ID NO: 3473257 - RNA, 21 nt, Human
gacuagggauucaggcugcuu

SEQ ID NO: 3473258 - RNA, 18 nt, Human
gacuagugaggaaagauu

SEQ ID NO: 3473259 - RNA, 17 nt, Human
gacuauagcccaggucc

SEQ ID NO: 3473260 - RNA, 16 nt, Human
gacuauauaauuuauu

SEQ ID NO: 3473261 - RNA, 16 nt, Human
gacuauauacaugugu

SEQ ID NO: 3473262 - RNA, 22 nt, Human
gacuauauacauguguguauau

SEQ ID NO: 3473263 - RNA, 21 nt, Human
gacuauauuugggccugcucc

SEQ ID NO: 3473264 - RNA, 22 nt, Human
gacuaucuaaauguugaaagau

SEQ ID NO: 3473265 - RNA, 15 nt, Human
gacuauuauguuguu

SEQ ID NO: 3473266 - RNA, 21 nt, Human
gacuauuauguuguuagagaa

SEQ ID NO: 3473267 - RNA, 19 nt, Human
gacuauucuguaucuuuca

SEQ ID NO: 3473268 - RNA, 21 nt, Human
gacuauuuaaacuuauaaauc

SEQ ID NO: 3473269 - RNA, 13 nt, Human
gacuauuuuuguu

SEQ ID NO: 3473270 - RNA, 22 nt, Human
gacuauuuuuguuuuuauuaaa

SEQ ID NO: 3473271 - RNA, 18 nt, Human
gacucaaaguuucagaga

SEQ ID NO: 3473272 - RNA, 23 nt, Human
gacucaaauguucuaaguuucua

SEQ ID NO: 3473273 - RNA, 18 nt, Human
gacucaagaagugaagaa

SEQ ID NO: 3473274 - RNA, 19 nt, Human
gacucaagaagugaagaau

SEQ ID NO: 3473275 - RNA, 15 nt, Human
gacucaauaaaauca

SEQ ID NO: 3473276 - RNA, 15 nt, Human
gacucaaucccuagg

SEQ ID NO: 3473277 - RNA, 16 nt, Human
gacucaauuucucccc

SEQ ID NO: 3473278 - RNA, 19 nt, Human
gacucacaccacuagccuc

SEQ ID NO: 3473279 - RNA, 19 nt, Human
gacucacagguuggaagag

SEQ ID NO: 3473280 - RNA, 15 nt, Human
gacucaccucugccu

SEQ ID NO: 3473281 - RNA, 17 nt, Human
gacucaccucugccuca

SEQ ID NO: 3473282 - RNA, 15 nt, Human
gacucagaaacucca

SEQ ID NO: 3473283 - RNA, 15 nt, Human
gacucagaagccucu

SEQ ID NO: 3473284 - RNA, 17 nt, Human
gacucagaagccucugg

SEQ ID NO: 3473285 - RNA, 23 nt, Human
gacucagacaggaaagggaaggc

SEQ ID NO: 3473286 - RNA, 18 nt, Human
gacucagccugcaguuaa

SEQ ID NO: 3473287 - RNA, 15 nt, Human
gacucagccuucaga

SEQ ID NO: 3473288 - RNA, 19 nt, Human
gacucagccuucagacaga

SEQ ID NO: 3473289 - RNA, 23 nt, Human
gacucagcucugacauucugauu

SEQ ID NO: 3473290 - RNA, 17 nt, Human
gacucaggaugcccagg

SEQ ID NO: 3473291 - RNA, 22 nt, Human
gacucaggauuuaaaaacugga

SEQ ID NO: 3473292 - RNA, 18 nt, Human
gacucagggaggcuaaau

SEQ ID NO: 3473293 - RNA, 17 nt, Human
gacucagggcagcgcca

SEQ ID NO: 3473294 - RNA, 18 nt, Human
gacucagggcagcgccag

SEQ ID NO: 3473295 - RNA, 14 nt, Human
gacucagggcccca

SEQ ID NO: 3473296 - RNA, 13 nt, Human
gacucagggcucc

SEQ ID NO: 3473297 - RNA, 12 nt, Human
gacucaguguuc

SEQ ID NO: 3473298 - RNA, 15 nt, Human
gacucaguuugucag

SEQ ID NO: 3473299 - RNA, 21 nt, Human
gacucauauccccuauuuaac

SEQ ID NO: 3473300 - RNA, 20 nt, Human
gacucauccugaacagcaug

SEQ ID NO: 3473301 - RNA, 18 nt, Human
gacucaugguguguuaca

SEQ ID NO: 3473302 - RNA, 20 nt, Human
gacucauucccuagaucuuu

SEQ ID NO: 3473303 - RNA, 13 nt, Human
gacucauucugaa

SEQ ID NO: 3473304 - RNA, 17 nt, Human
gacucauucugaaggag

SEQ ID NO: 3473305 - RNA, 15 nt, Human
gacucauucuucugu

SEQ ID NO: 3473306 - RNA, 15 nt, Human
gacuccaaagaaaug

SEQ ID NO: 3473307 - RNA, 17 nt, Human
gacuccaagaacaauug

SEQ ID NO: 3473308 - RNA, 16 nt, Human
gacuccacccauccua

SEQ ID NO: 3473309 - RNA, 22 nt, Human
gacuccagaaaugucccuuucu

SEQ ID NO: 3473310 - RNA, 15 nt, Human
gacuccagaucugca

SEQ ID NO: 3473311 - RNA, 9 nt, Human
gacuccagc

SEQ ID NO: 3473312 - RNA, 10 nt, Human
gacuccagcc

SEQ ID NO: 3473313 - RNA, 12 nt, Human
gacuccagccag

SEQ ID NO: 3473314 - RNA, 19 nt, Human
gacuccagccagcgccucc

SEQ ID NO: 3473315 - RNA, 22 nt, Human
gacuccagcuggguuggaaaac

SEQ ID NO: 3473316 - RNA, 12 nt, Human
gacuccaggaga

SEQ ID NO: 3473317 - RNA, 17 nt, Human
gacuccaggcagcagac

SEQ ID NO: 3473318 - RNA, 14 nt, Human
gacuccaggcccaa

SEQ ID NO: 3473319 - RNA, 20 nt, Human
gacuggggaugugggaggga

SEQ ID NO: 3473320 - RNA, 19 nt, Human
gacuggggccacuacauuu

SEQ ID NO: 3473321 - RNA, 16 nt, Human
gacugggggcagacau

SEQ ID NO: 3473322 - RNA, 23 nt, Human
gacugggggcagacauggugggg

SEQ ID NO: 3473323 - RNA, 17 nt, Human
gacuggguaggaaagag

SEQ ID NO: 3473324 - RNA, 23 nt, Human
gacugggucucgcuuuguugccc

SEQ ID NO: 3473325 - RNA, 23 nt, Human
gacuggguuuggaccccagcugg

SEQ ID NO: 3473326 - RNA, 15 nt, Human
gacuggugacugauu

SEQ ID NO: 3473327 - RNA, 16 nt, Human
gacuggugcccuccuc

SEQ ID NO: 3473328 - RNA, 19 nt, Human
gacuggugcuauaggcugg

SEQ ID NO: 3473329 - RNA, 19 nt, Human
gacugguggcaggggcuuc

SEQ ID NO: 3473330 - RNA, 17 nt, Human
gacuguaaguugggcuu

SEQ ID NO: 3473331 - RNA, 17 nt, Human
gacuguacuccucccag

SEQ ID NO: 3473332 - RNA, 23 nt, Human
gacuguacuccucccaggcgccc

SEQ ID NO: 3473333 - RNA, 11 nt, Human
gacuguagaaa

SEQ ID NO: 3473334 - RNA, 22 nt, Human
gacuguagauugcuucuguagu

SEQ ID NO: 3473335 - RNA, 19 nt, Human
gacuguauauaaaggaaaa

SEQ ID NO: 3473336 - RNA, 15 nt, Human
gacuguaucugugua

SEQ ID NO: 3473337 - RNA, 17 nt, Human
gacuguaucuguguaga

SEQ ID NO: 3473338 - RNA, 18 nt, Human
gacuguauuauacauggg

SEQ ID NO: 3473339 - RNA, 15 nt, Human
gacuguauuugugac

SEQ ID NO: 3473340 - RNA, 21 nt, Human
gacugucucaagagggcacug

SEQ ID NO: 3473341 - RNA, 23 nt, Human
gacugucucaagagggcacuggu

SEQ ID NO: 3473342 - RNA, 14 nt, Human
gacugucuggggag

SEQ ID NO: 3473343 - RNA, 13 nt, Human
gacugucuuucag

SEQ ID NO: 3473344 - RNA, 18 nt, Human
gacugugacaggcagcag

SEQ ID NO: 3473345 - RNA, 19 nt, Human
gacugugauuugaauccag

SEQ ID NO: 3473346 - RNA, 18 nt, Human
gacuguggagacugcucc

SEQ ID NO: 3473347 - RNA, 21 nt, Human
gacuguggguuugugggggga

SEQ ID NO: 3473348 - RNA, 17 nt, Human
gacuguggugacuuugg

SEQ ID NO: 3473349 - RNA, 17 nt, Human
gacugugugcucaggag

SEQ ID NO: 3473350 - RNA, 21 nt, Human
gacuguguguugccacaggac

SEQ ID NO: 3473351 - RNA, 22 nt, Human
gacuguuagaaaauggacacug

SEQ ID NO: 3473352 - RNA, 15 nt, Human
gacuguugauguacu

SEQ ID NO: 3473353 - RNA, 14 nt, Human
gacuguugucccug

SEQ ID NO: 3473354 - RNA, 19 nt, Human
gacuguuguuaucuguuug

SEQ ID NO: 3473355 - RNA, 19 nt, Human
gacuguuuucucucggcuc

SEQ ID NO: 3473356 - RNA, 18 nt, Human
gacuguuuucucuugaga

SEQ ID NO: 3473357 - RNA, 17 nt, Human
gacuguuuuuacccaua

SEQ ID NO: 3473358 - RNA, 18 nt, Human
gacuguuuuuacccauau

SEQ ID NO: 3473359 - RNA, 18 nt, Human
gacuguuuuucggacagu

SEQ ID NO: 3473360 - RNA, 19 nt, Human
gacuguuuuucggacaguu

SEQ ID NO: 3473361 - RNA, 14 nt, Human
gacuguuuuuuccu

SEQ ID NO: 3473362 - RNA, 19 nt, Human
gacuguuuuuuccugagcu

SEQ ID NO: 3473363 - RNA, 19 nt, Human
gacuuaaaauauuccugca

SEQ ID NO: 3473364 - RNA, 17 nt, Human
gacuuaacauagccaaa

SEQ ID NO: 3473365 - RNA, 23 nt, Human
gacuuaacauagccaaaauguga

SEQ ID NO: 3473366 - RNA, 16 nt, Human
gacuuaacggcuccag

SEQ ID NO: 3473367 - RNA, 19 nt, Human
gacuuaacggcuccaggau

SEQ ID NO: 3473368 - RNA, 20 nt, Human
gacuuaagcaucuggcucua

SEQ ID NO: 3473369 - RNA, 21 nt, Human
gacuuaagcccagugcacuga

SEQ ID NO: 3473370 - RNA, 16 nt, Human
gacuuacaugauucau

SEQ ID NO: 3473371 - RNA, 19 nt, Human
gacuuacaugauucauuuu

SEQ ID NO: 3473372 - RNA, 14 nt, Human
gacuuaccaggaag

SEQ ID NO: 3473373 - RNA, 18 nt, Human
gacuuacuguacaugaaa

SEQ ID NO: 3473374 - RNA, 14 nt, Human
gacuuagaaagcag

SEQ ID NO: 3473375 - RNA, 17 nt, Human
gacuuagggcaccaggg

SEQ ID NO: 3473376 - RNA, 19 nt, Human
gacuuaguggacaggggag

SEQ ID NO: 3473377 - RNA, 20 nt, Human
gacuuauuguggauaacaaa

SEQ ID NO: 3473378 - RNA, 22 nt, Human
gacuuauuguggauaacaaaga

SEQ ID NO: 3473379 - RNA, 18 nt, Human
gacuuauuucuucaaauc

SEQ ID NO: 3473380 - RNA, 21 nt, Human
gacuucaagcauggcuauuuu

SEQ ID NO: 3473381 - RNA, 22 nt, Human
gacuucacacugcaagagccuu

SEQ ID NO: 3473382 - RNA, 18 nt, Human
gacuucagggcagggcuc

SEQ ID NO: 3473383 - RNA, 23 nt, Human
gacuucaggggcugcccgcuccc

SEQ ID NO: 3473384 - RNA, 21 nt, Human
gacuucaucaaacauggguuu

SEQ ID NO: 3473385 - RNA, 12 nt, Human
gacuucauccca

SEQ ID NO: 3473386 - RNA, 20 nt, Human
gacuucaucccaaaggacag

SEQ ID NO: 3473387 - RNA, 15 nt, Human
gacuucauuaauaau

SEQ ID NO: 3473388 - RNA, 12 nt, Human
gacuuccaaaga

SEQ ID NO: 3473389 - RNA, 22 nt, Human
gacuuccccgcauuccaggcuc

SEQ ID NO: 3473390 - RNA, 23 nt, Human
gacuuccccgcauuccaggcucc

SEQ ID NO: 3473391 - RNA, 18 nt, Human
gacuuccccggagggcug

SEQ ID NO: 3473392 - RNA, 23 nt, Human
gacuuccccggagggcugcggcg

SEQ ID NO: 3473393 - RNA, 13 nt, Human
gacuucccugugu

SEQ ID NO: 3473394 - RNA, 18 nt, Human
gacuuccucgccucuccc

SEQ ID NO: 3473395 - RNA, 18 nt, Human
gacuuccuguccagcucc

SEQ ID NO: 3473396 - RNA, 20 nt, Human
gacuuccuguccagcuccaa

SEQ ID NO: 3473397 - RNA, 22 nt, Human
gacuuccuguccagcuccaacc

SEQ ID NO: 3473398 - RNA, 16 nt, Human
gacuuccuugcucucc

SEQ ID NO: 3473399 - RNA, 15 nt, Human
gacuucgacucagga

SEQ ID NO: 3473400 - RNA, 18 nt, Human
gacuucuaaguaaaacca

SEQ ID NO: 3473401 - RNA, 23 nt, Human
gacuucuaaguaaaaccacagca

SEQ ID NO: 3473402 - RNA, 14 nt, Human
gacuucuccagguc

SEQ ID NO: 3473403 - RNA, 16 nt, Human
gacuucugccagcaua

SEQ ID NO: 3473404 - RNA, 13 nt, Human
gacuucuggggua

SEQ ID NO: 3473405 - RNA, 23 nt, Human
gacuucugucuucacaacagauu

SEQ ID NO: 3473406 - RNA, 19 nt, Human
gacuucuuuaauuuuggaa

SEQ ID NO: 3473407 - RNA, 21 nt, Human
gacuucuuucaaauugagaga

SEQ ID NO: 3473408 - RNA, 18 nt, Human
gacuucuuuucacauucu

SEQ ID NO: 3473409 - RNA, 19 nt, Human
gacuucuuuucacauucuu

SEQ ID NO: 3473410 - RNA, 22 nt, Human
gacuucuuuucacauucuuaua

SEQ ID NO: 3473411 - RNA, 11 nt, Human
gacuugaaaag

SEQ ID NO: 3473412 - RNA, 17 nt, Human
gacuugaaaagagacag

SEQ ID NO: 3473413 - RNA, 13 nt, Human
gacuugaaagcau

SEQ ID NO: 3473414 - RNA, 16 nt, Human
gacuugaaagcaucca

SEQ ID NO: 3473415 - RNA, 19 nt, Human
gacuugaaagcauccaugu

SEQ ID NO: 3473416 - RNA, 16 nt, Human
gacuugaagacuuaca

SEQ ID NO: 3473417 - RNA, 15 nt, Human
gacuugaaguuguua

SEQ ID NO: 3473418 - RNA, 20 nt, Human
gacuugaauuuucccacugc

SEQ ID NO: 3473419 - RNA, 16 nt, Human
gacuugacaguggaac

SEQ ID NO: 3473420 - RNA, 19 nt, Human
gacuugagaaacaaauaau

SEQ ID NO: 3473421 - RNA, 16 nt, Human
gacuugcacagggauu

SEQ ID NO: 3473422 - RNA, 18 nt, Human
gacuugcacagggauucu

SEQ ID NO: 3473423 - RNA, 19 nt, Human
gacuugcauaccugcuuuu

SEQ ID NO: 3473424 - RNA, 15 nt, Human
gacuugcaucgugga

SEQ ID NO: 3473425 - RNA, 15 nt, Human
gacuugcauuuuugc

SEQ ID NO: 3473426 - RNA, 22 nt, Human
gacuugccaacaccacagaaau

SEQ ID NO: 3473427 - RNA, 21 nt, Human
gacuugccagagccgggcaca

SEQ ID NO: 3473428 - RNA, 22 nt, Human
gacuugcuguuuuguucugugg

SEQ ID NO: 3473429 - RNA, 13 nt, Human
gacuuggaagcuc

SEQ ID NO: 3473430 - RNA, 14 nt, Human
gacuuggaagcucc

SEQ ID NO: 3473431 - RNA, 15 nt, Human
gacuuggaagcuccg

SEQ ID NO: 3473432 - RNA, 14 nt, Human
gacuuggcuggugu

SEQ ID NO: 3473433 - RNA, 19 nt, Human
gacuugggcacccccagcc

SEQ ID NO: 3473434 - RNA, 22 nt, Human
gacuugggcacccccagccugg

SEQ ID NO: 3473435 - RNA, 22 nt, Human
gacuugggggaacgaugugucu

SEQ ID NO: 3473436 - RNA, 14 nt, Human
gacuuggucugauu

SEQ ID NO: 3473437 - RNA, 15 nt, Human
gacuugguugguagg

SEQ ID NO: 3473438 - RNA, 22 nt, Human
gacuuguauagcaugaaauaaa

SEQ ID NO: 3473439 - RNA, 16 nt, Human
gacuuguauauuugua

SEQ ID NO: 3473440 - RNA, 19 nt, Human
gacuuguauauuuuaagaa

SEQ ID NO: 3473441 - RNA, 19 nt, Human
gacuugugacgguguaccu

SEQ ID NO: 3473442 - RNA, 13 nt, Human
gacuuguguccca

SEQ ID NO: 3473443 - RNA, 12 nt, Human
gacuuguuagau

SEQ ID NO: 3473444 - RNA, 16 nt, Human
gacuuguucuugauag

SEQ ID NO: 3473445 - RNA, 18 nt, Human
gacuuguuuuaugcucag

SEQ ID NO: 3473446 - RNA, 15 nt, Human
gacuuguuuuugcac

SEQ ID NO: 3473447 - RNA, 14 nt, Human
gacuuguuuuuguu

SEQ ID NO: 3473448 - RNA, 12 nt, Human
gacuuuaauuua

SEQ ID NO: 3473449 - RNA, 13 nt, Human
gacuuuagggacu

SEQ ID NO: 3473450 - RNA, 13 nt, Human
gacuuuauuauuu

SEQ ID NO: 3473451 - RNA, 19 nt, Human
gacuuuauuuucugguaga

SEQ ID NO: 3473452 - RNA, 12 nt, Human
gacuuucaggua

SEQ ID NO: 3473453 - RNA, 16 nt, Human
gacuuuccacccccuc

SEQ ID NO: 3473454 - RNA, 17 nt, Human
gacuuuccacccccucc

SEQ ID NO: 3473455 - RNA, 11 nt, Human
gacuuucccca

SEQ ID NO: 3473456 - RNA, 21 nt, Human
gacuuuccccaccagaugcug

SEQ ID NO: 3473457 - RNA, 11 nt, Human
gacuuuccucu

SEQ ID NO: 3473458 - RNA, 21 nt, Human
gacuuucucuaauaauaaaua

SEQ ID NO: 3473459 - RNA, 11 nt, Human
gacuuucuguu

SEQ ID NO: 3473460 - RNA, 19 nt, Human
gacuuucuuuuuguagcug

SEQ ID NO: 3473461 - RNA, 21 nt, Human
gacuuucuuuuuugauauaga

SEQ ID NO: 3473462 - RNA, 18 nt, Human
gacuuugaaaauauauac

SEQ ID NO: 3473463 - RNA, 16 nt, Human
gagaauucuuacaugu

SEQ ID NO: 3473464 - RNA, 17 nt, Human
gagaauugggauuacau

SEQ ID NO: 3473465 - RNA, 14 nt, Human
gagaauugggggcu

SEQ ID NO: 3473466 - RNA, 15 nt, Human
gagaauuguaucauu

SEQ ID NO: 3473467 - RNA, 15 nt, Human
gagaauuuuaaauua

SEQ ID NO: 3473468 - RNA, 11 nt, Human
gagacaaaaau

SEQ ID NO: 3473469 - RNA, 17 nt, Human
gagacaacgugcucuuu

SEQ ID NO: 3473470 - RNA, 18 nt, Human
gagacaaggagggcacag

SEQ ID NO: 3473471 - RNA, 22 nt, Human
gagacaaguuccaugggauaca

SEQ ID NO: 3473472 - RNA, 16 nt, Human
gagacaaugcagaugc

SEQ ID NO: 3473473 - RNA, 17 nt, Human
gagacaaugcagaugcc

SEQ ID NO: 3473474 - RNA, 18 nt, Human
gagacaaugcagaugcca

SEQ ID NO: 3473475 - RNA, 23 nt, Human
gagacaaugcagaugccagagca

SEQ ID NO: 3473476 - RNA, 14 nt, Human
gagacaaugucugc

SEQ ID NO: 3473477 - RNA, 15 nt, Human
gagacacaagccuuc

SEQ ID NO: 3473478 - RNA, 11 nt, Human
gagacacagga

SEQ ID NO: 3473479 - RNA, 17 nt, Human
gagacacaggaugaagc

SEQ ID NO: 3473480 - RNA, 16 nt, Human
gagacaccucagagcc

SEQ ID NO: 3473481 - RNA, 19 nt, Human
gagacaccucagagccccg

SEQ ID NO: 3473482 - RNA, 18 nt, Human
gagacaccugcaccuccc

SEQ ID NO: 3473483 - RNA, 19 nt, Human
gagacacguguggcgggca

SEQ ID NO: 3473484 - RNA, 20 nt, Human
gagacacuaacgacuucagg

SEQ ID NO: 3473485 - RNA, 21 nt, Human
gagacacucagaccagagaag

SEQ ID NO: 3473486 - RNA, 12 nt, Human
gagacagaagca

SEQ ID NO: 3473487 - RNA, 14 nt, Human
gagacagaauguau

SEQ ID NO: 3473488 - RNA, 15 nt, Human
gagacagacuagaag

SEQ ID NO: 3473489 - RNA, 17 nt, Human
gagacagacuagaaguu

SEQ ID NO: 3473490 - RNA, 9 nt, Human
gagacagag

SEQ ID NO: 3473491 - RNA, 22 nt, Human
gagacagagaggacgugggcgg

SEQ ID NO: 3473492 - RNA, 19 nt, Human
gagacagagcaaccccugg

SEQ ID NO: 3473493 - RNA, 15 nt, Human
gagacagauaccucc

SEQ ID NO: 3473494 - RNA, 16 nt, Human
gagacagauaccucca

SEQ ID NO: 3473495 - RNA, 13 nt, Human
gagacagccccag

SEQ ID NO: 3473496 - RNA, 14 nt, Human
gagacagcccgggc

SEQ ID NO: 3473497 - RNA, 24 nt, Human
gagacagcccgggcucugccuccc

SEQ ID NO: 3473498 - RNA, 13 nt, Human
gagacagcucugc

SEQ ID NO: 3473499 - RNA, 20 nt, Human
gagacagcucugcauacuca

SEQ ID NO: 3473500 - RNA, 19 nt, Human
gagacaggguuucaccaug

SEQ ID NO: 3473501 - RNA, 22 nt, Human
gagacaggguuuggcugugucu

SEQ ID NO: 3473502 - RNA, 16 nt, Human
gagacagucaccccag

SEQ ID NO: 3473503 - RNA, 18 nt, Human
gagacaguuauuuauagu

SEQ ID NO: 3473504 - RNA, 19 nt, Human
gagacauaaccacugcuuc

SEQ ID NO: 3473505 - RNA, 13 nt, Human
gagacaugugaca

SEQ ID NO: 3473506 - RNA, 19 nt, Human
gagacauuccugggcacag

SEQ ID NO: 3473507 - RNA, 22 nt, Human
gagaccaagauggcccauccug

SEQ ID NO: 3473508 - RNA, 18 nt, Human
gagaccacccauaucaug

SEQ ID NO: 3473509 - RNA, 14 nt, Human
gagaccagccuggc

SEQ ID NO: 3473510 - RNA, 14 nt, Human
gagaccaggcaaag

SEQ ID NO: 3473511 - RNA, 16 nt, Human
gagaccagggagccuu

SEQ ID NO: 3473512 - RNA, 23 nt, Human
gagaccaguugggagcacuggag

SEQ ID NO: 3473513 - RNA, 18 nt, Human
gagaccaucccugaaggc

SEQ ID NO: 3473514 - RNA, 15 nt, Human
gagaccauccuggcu

SEQ ID NO: 3473515 - RNA, 15 nt, Human
gagacccaagggcag

SEQ ID NO: 3473516 - RNA, 19 nt, Human
gagacccaccccaccugca

SEQ ID NO: 3473517 - RNA, 20 nt, Human
gagacccaccccaccugcag

SEQ ID NO: 3473518 - RNA, 11 nt, Human
gagacccagcg

SEQ ID NO: 3473519 - RNA, 12 nt, Human
gagacccccaca

SEQ ID NO: 3473520 - RNA, 14 nt, Human
gagacccccacacc

SEQ ID NO: 3473521 - RNA, 16 nt, Human
gagaccccuggccucc

SEQ ID NO: 3473522 - RNA, 23 nt, Human
gagacccucgcccaacuccacca

SEQ ID NO: 3473523 - RNA, 22 nt, Human
gagacccugcaaacagaacagg

SEQ ID NO: 3473524 - RNA, 15 nt, Human
gagaccgagugaacc

SEQ ID NO: 3473525 - RNA, 20 nt, Human
gagaccgggguauccugggg

SEQ ID NO: 3473526 - RNA, 22 nt, Human
gagaccguccucaccccugucc

SEQ ID NO: 3473527 - RNA, 20 nt, Human
gagaccgugaagauacuuug

SEQ ID NO: 3473528 - RNA, 15 nt, Human
gagaccuacaggcug

SEQ ID NO: 3473529 - RNA, 14 nt, Human
gagaccuaccucag

SEQ ID NO: 3473530 - RNA, 17 nt, Human
gagaccuaccucagguu

SEQ ID NO: 3473531 - RNA, 18 nt, Human
gagaccuaccucagguug

SEQ ID NO: 3473532 - RNA, 23 nt, Human
gagaccuaccucagguugcuggu

SEQ ID NO: 3473533 - RNA, 13 nt, Human
gagaccucagaag

SEQ ID NO: 3473534 - RNA, 13 nt, Human
gagaccucagcca

SEQ ID NO: 3473535 - RNA, 19 nt, Human
gagaccucaucaggaugaa

SEQ ID NO: 3473536 - RNA, 19 nt, Human
gagaccuggacacaggccu

SEQ ID NO: 3473537 - RNA, 12 nt, Human
gagaccuuaccc

SEQ ID NO: 3473538 - RNA, 15 nt, Human
gagacgacaggcgag

SEQ ID NO: 3473539 - RNA, 14 nt, Human
gagacggaguccca

SEQ ID NO: 3473540 - RNA, 23 nt, Human
gagacgggacugcggaggaagga

SEQ ID NO: 3473541 - RNA, 19 nt, Human
gagacggugucuuguucug

SEQ ID NO: 3473542 - RNA, 17 nt, Human
gagacgguuuccaggga

SEQ ID NO: 3473543 - RNA, 19 nt, Human
gagacgguuuccagggagg

SEQ ID NO: 3473544 - RNA, 14 nt, Human
gagacuaagcccug

SEQ ID NO: 3473545 - RNA, 15 nt, Human
gagacuaagcccugu

SEQ ID NO: 3473546 - RNA, 15 nt, Human
gagacuacuaagagg

SEQ ID NO: 3473547 - RNA, 16 nt, Human
gagacuagauugccuu

SEQ ID NO: 3473548 - RNA, 21 nt, Human
gagacuagauuuaugaauaca

SEQ ID NO: 3473549 - RNA, 20 nt, Human
gagacuaugcguuuuuauaa

SEQ ID NO: 3473550 - RNA, 14 nt, Human
gagacuauggagcc

SEQ ID NO: 3473551 - RNA, 22 nt, Human
gagacuauggagccuggcacag

SEQ ID NO: 3473552 - RNA, 15 nt, Human
gagacucaccucugc

SEQ ID NO: 3473553 - RNA, 17 nt, Human
gagacucaccucugccu

SEQ ID NO: 3473554 - RNA, 19 nt, Human
gagacucaccucugccuca

SEQ ID NO: 3473555 - RNA, 17 nt, Human
gagacucagggccccag

SEQ ID NO: 3473556 - RNA, 19 nt, Human
gagacuccagaccugaggc

SEQ ID NO: 3473557 - RNA, 18 nt, Human
gagacucccaugaagccu

SEQ ID NO: 3473558 - RNA, 19 nt, Human
gagacucccaugaagccuu

SEQ ID NO: 3473559 - RNA, 18 nt, Human
gagacuccgucucaagga

SEQ ID NO: 3473560 - RNA, 16 nt, Human
gagacuccuaggcagg

SEQ ID NO: 3473561 - RNA, 14 nt, Human
gagacuccugcagg

SEQ ID NO: 3473562 - RNA, 17 nt, Human
gagacuccugcaggcag

SEQ ID NO: 3473563 - RNA, 16 nt, Human
gagacucgacucugug

SEQ ID NO: 3473564 - RNA, 17 nt, Human
gagacucgacucugugc

SEQ ID NO: 3473565 - RNA, 15 nt, Human
gagacucgagaacuu

SEQ ID NO: 3473566 - RNA, 16 nt, Human
gagacucgagaacuuu

SEQ ID NO: 3473567 - RNA, 16 nt, Human
gagacucgcgacaaug

SEQ ID NO: 3473568 - RNA, 16 nt, Human
gagacucuagggucca

SEQ ID NO: 3473569 - RNA, 20 nt, Human
gagacucuaggguccagugg

SEQ ID NO: 3473570 - RNA, 16 nt, Human
gagacugcguucugca

SEQ ID NO: 3473571 - RNA, 17 nt, Human
gagacugcguucugcaa

SEQ ID NO: 3473572 - RNA, 19 nt, Human
gagacugcuccugagcccc

SEQ ID NO: 3473573 - RNA, 16 nt, Human
gagacuggagcaucug

SEQ ID NO: 3473574 - RNA, 19 nt, Human
gagacuggcgugaacccag

SEQ ID NO: 3473575 - RNA, 13 nt, Human
gagacugggaaga

SEQ ID NO: 3473576 - RNA, 17 nt, Human
gagacugggaaggcuug

SEQ ID NO: 3473577 - RNA, 16 nt, Human
gagacugguccugugu

SEQ ID NO: 3473578 - RNA, 13 nt, Human
gagacugucccug

SEQ ID NO: 3473579 - RNA, 12 nt, Human
gagacugugcug

SEQ ID NO: 3473580 - RNA, 22 nt, Human
gagacugugugugcccucuggg

SEQ ID NO: 3473581 - RNA, 17 nt, Human
gagacuguuuugaauuu

SEQ ID NO: 3473582 - RNA, 18 nt, Human
gagacuuagggcaccagg

SEQ ID NO: 3473583 - RNA, 13 nt, Human
gagacuuguauga

SEQ ID NO: 3473584 - RNA, 21 nt, Human
gagacuuuccauuacaaguau

SEQ ID NO: 3473585 - RNA, 20 nt, Human
gagacuuugacucuccagaa

SEQ ID NO: 3473586 - RNA, 14 nt, Human
gagacuuugauguc

SEQ ID NO: 3473587 - RNA, 21 nt, Human
gagacuuuuugguggauguaa

SEQ ID NO: 3473588 - RNA, 23 nt, Human
gagagaaaacagaccuaaugcuc

SEQ ID NO: 3473589 - RNA, 13 nt, Human
gagagaaaacuua

SEQ ID NO: 3473590 - RNA, 20 nt, Human
gagagaaaauaaaaaguuaa

SEQ ID NO: 3473591 - RNA, 11 nt, Human
gagagaaagaa

SEQ ID NO: 3473592 - RNA, 21 nt, Human
gagagaaagccaggcagguag

SEQ ID NO: 3473593 - RNA, 14 nt, Human
gagagaaaggacuc

SEQ ID NO: 3473594 - RNA, 15 nt, Human
gagagaaagugggug

SEQ ID NO: 3473595 - RNA, 18 nt, Human
gagagaaagugggugaga

SEQ ID NO: 3473596 - RNA, 22 nt, Human
gagagaaagugggugagaugcu

SEQ ID NO: 3473597 - RNA, 11 nt, Human
gagagaaauau

SEQ ID NO: 3473598 - RNA, 23 nt, Human
gagagaaauucuguuaaaaucua

SEQ ID NO: 3473599 - RNA, 20 nt, Human
gagagaaccuaacuguaucu

SEQ ID NO: 3473600 - RNA, 14 nt, Human
gagagaagagcccc

SEQ ID NO: 3473601 - RNA, 17 nt, Human
gagagaaggggaggagg

SEQ ID NO: 3473602 - RNA, 18 nt, Human
gagagaagugccccugcu

SEQ ID NO: 3473603 - RNA, 21 nt, Human
gagagaagugccccugcugcc

SEQ ID NO: 3473604 - RNA, 15 nt, Human
gagagacccaaggag

SEQ ID NO: 3473605 - RNA, 19 nt, Human
gagagaccgaggagggaga

SEQ ID NO: 3473606 - RNA, 17 nt, Human
gagagaccucaucagga

SEQ ID NO: 3473607 - RNA, 19 nt, Human
gagagacucccaugaagcc

SEQ ID NO: 3473608 - RNA, 15 nt, Human
gagaugaggccagac

SEQ ID NO: 3473609 - RNA, 21 nt, Human
gagaugcaccaccaagccaag

SEQ ID NO: 3473610 - RNA, 16 nt, Human
gagaugcagagguaaa

SEQ ID NO: 3473611 - RNA, 15 nt, Human
gagaugccuccaccg

SEQ ID NO: 3473612 - RNA, 19 nt, Human
gagaugccuccaccgcugc

SEQ ID NO: 3473613 - RNA, 23 nt, Human
gagaugccuccaccgcugccuaa

SEQ ID NO: 3473614 - RNA, 20 nt, Human
gagaugcuggagaagagagg

SEQ ID NO: 3473615 - RNA, 21 nt, Human
gagaugcuggagaagagagga

SEQ ID NO: 3473616 - RNA, 14 nt, Human
gagaugcugugccc

SEQ ID NO: 3473617 - RNA, 15 nt, Human
gagaugcugugcccc

SEQ ID NO: 3473618 - RNA, 12 nt, Human
gagauggaggag

SEQ ID NO: 3473619 - RNA, 13 nt, Human
gagauggaggagg

SEQ ID NO: 3473620 - RNA, 17 nt, Human
gagauggagucuugcua

SEQ ID NO: 3473621 - RNA, 20 nt, Human
gagaugggaaugagguggga

SEQ ID NO: 3473622 - RNA, 14 nt, Human
gagaugggagcucc

SEQ ID NO: 3473623 - RNA, 15 nt, Human
gagaugggagcuccu

SEQ ID NO: 3473624 - RNA, 23 nt, Human
gagaugggagcuccucuccugga

SEQ ID NO: 3473625 - RNA, 17 nt, Human
gagaugggcuucccaag

SEQ ID NO: 3473626 - RNA, 18 nt, Human
gagaugggcuuguuuucu

SEQ ID NO: 3473627 - RNA, 20 nt, Human
gagauggggaaagaauuccu

SEQ ID NO: 3473628 - RNA, 18 nt, Human
gagauggggauaaaauga

SEQ ID NO: 3473629 - RNA, 14 nt, Human
gagauggggugggg

SEQ ID NO: 3473630 - RNA, 21 nt, Human
gagaugguaugcacaauucca

SEQ ID NO: 3473631 - RNA, 21 nt, Human
gagaugucaucagagcuccuc

SEQ ID NO: 3473632 - RNA, 12 nt, Human
gagaugucuucg

SEQ ID NO: 3473633 - RNA, 22 nt, Human
gagaugucuucguacaguucuu

SEQ ID NO: 3473634 - RNA, 17 nt, Human
gagauguguaauuuuuc

SEQ ID NO: 3473635 - RNA, 17 nt, Human
gagauguguaucagugu

SEQ ID NO: 3473636 - RNA, 23 nt, Human
gagauguguguugauacuguugc

SEQ ID NO: 3473637 - RNA, 14 nt, Human
gagauguuuuuaaa

SEQ ID NO: 3473638 - RNA, 17 nt, Human
gagauguuuuuaaaagu

SEQ ID NO: 3473639 - RNA, 19 nt, Human
gagauguuuuuaaaaguuu

SEQ ID NO: 3473640 - RNA, 14 nt, Human
gagauuacaggcau

SEQ ID NO: 3473641 - RNA, 14 nt, Human
gagauucaauauug

SEQ ID NO: 3473642 - RNA, 23 nt, Human
gagauucccgcggguuccgcagg

SEQ ID NO: 3473643 - RNA, 23 nt, Human
gagauucucauaacuugagaccu

SEQ ID NO: 3473644 - RNA, 22 nt, Human
gagauugaauuucacugucuuu

SEQ ID NO: 3473645 - RNA, 18 nt, Human
gagauugagaaggagaga

SEQ ID NO: 3473646 - RNA, 12 nt, Human
gagauugcuaau

SEQ ID NO: 3473647 - RNA, 17 nt, Human
gagauuggacggccuga

SEQ ID NO: 3473648 - RNA, 13 nt, Human
gagauuuacaacu

SEQ ID NO: 3473649 - RNA, 16 nt, Human
gagauuuauuaaagaa

SEQ ID NO: 3473650 - RNA, 17 nt, Human
gagauuuauuaaagaaa

SEQ ID NO: 3473651 - RNA, 12 nt, Human
gagauuuuccuu

SEQ ID NO: 3473652 - RNA, 17 nt, Human
gagauuuuuuauugcua

SEQ ID NO: 3473653 - RNA, 20 nt, Human
gagcaaaaugcauguaauca

SEQ ID NO: 3473654 - RNA, 13 nt, Human
gagcaaaccugcc

SEQ ID NO: 3473655 - RNA, 14 nt, Human
gagcaaaccugccc

SEQ ID NO: 3473656 - RNA, 14 nt, Human
gagcaaagaucaaa

SEQ ID NO: 3473657 - RNA, 18 nt, Human
gagcaaagaucaaaauaa

SEQ ID NO: 3473658 - RNA, 22 nt, Human
gagcaaagaucaaaauaaaaag

SEQ ID NO: 3473659 - RNA, 12 nt, Human
gagcaaagccug

SEQ ID NO: 3473660 - RNA, 22 nt, Human
gagcaaaggggucccauagagg

SEQ ID NO: 3473661 - RNA, 20 nt, Human
gagcaaagugaagacacugg

SEQ ID NO: 3473662 - RNA, 15 nt, Human
gagcaaauguuucug

SEQ ID NO: 3473663 - RNA, 16 nt, Human
gagcaaauguuucugc

SEQ ID NO: 3473664 - RNA, 21 nt, Human
gagcaaccguggcccuuccug

SEQ ID NO: 3473665 - RNA, 23 nt, Human
gagcaaccguggcccuuccugga

SEQ ID NO: 3473666 - RNA, 20 nt, Human
gagcaaccucucacucccca

SEQ ID NO: 3473667 - RNA, 14 nt, Human
gagcaagagagcag

SEQ ID NO: 3473668 - RNA, 11 nt, Human
gagcaagagga

SEQ ID NO: 3473669 - RNA, 20 nt, Human
gagcaaggguucccucaaga

SEQ ID NO: 3473670 - RNA, 13 nt, Human
gagcaagucugca

SEQ ID NO: 3473671 - RNA, 16 nt, Human
gagcaagucugcaggu

SEQ ID NO: 3473672 - RNA, 16 nt, Human
gagcaauauuuaugga

SEQ ID NO: 3473673 - RNA, 17 nt, Human
gagcaaugucugugcua

SEQ ID NO: 3473674 - RNA, 21 nt, Human
gagcacaaaauucaaagcaug

SEQ ID NO: 3473675 - RNA, 14 nt, Human
gagcacaaacauuu

SEQ ID NO: 3473676 - RNA, 20 nt, Human
gagcacaaagacccuggcuu

SEQ ID NO: 3473677 - RNA, 18 nt, Human
gagcacaacccccagcuc

SEQ ID NO: 3473678 - RNA, 15 nt, Human
gagcacacuggcuca

SEQ ID NO: 3473679 - RNA, 15 nt, Human
gagcacacuguagca

SEQ ID NO: 3473680 - RNA, 20 nt, Human
gagcacacuuuaguggccga

SEQ ID NO: 3473681 - RNA, 13 nt, Human
gagcacagcccuc

SEQ ID NO: 3473682 - RNA, 20 nt, Human
gagcacagcccucccgcccc

SEQ ID NO: 3473683 - RNA, 14 nt, Human
gagcacagguccca

SEQ ID NO: 3473684 - RNA, 13 nt, Human
gagcaccaggcac

SEQ ID NO: 3473685 - RNA, 23 nt, Human
gagcaccaggcacgaacccaccu

SEQ ID NO: 3473686 - RNA, 13 nt, Human
gagcaccagggga

SEQ ID NO: 3473687 - RNA, 16 nt, Human
gagcaccccucucugc

SEQ ID NO: 3473688 - RNA, 14 nt, Human
gagcacccugaggg

SEQ ID NO: 3473689 - RNA, 15 nt, Human
gagcacccugagggc

SEQ ID NO: 3473690 - RNA, 15 nt, Human
gagcaccugcugucu

SEQ ID NO: 3473691 - RNA, 19 nt, Human
gagcaccuuccucacuucc

SEQ ID NO: 3473692 - RNA, 20 nt, Human
gagcacggccaacaaagcug

SEQ ID NO: 3473693 - RNA, 13 nt, Human
gagcacggcucug

SEQ ID NO: 3473694 - RNA, 20 nt, Human
gagcacucccaagucuacag

SEQ ID NO: 3473695 - RNA, 12 nt, Human
gagcacugccag

SEQ ID NO: 3473696 - RNA, 16 nt, Human
gagcacugccaggagg

SEQ ID NO: 3473697 - RNA, 19 nt, Human
gagcacuuaagagaauauu

SEQ ID NO: 3473698 - RNA, 18 nt, Human
gagcagaaggggagaugg

SEQ ID NO: 3473699 - RNA, 15 nt, Human
gagcagacaggagga

SEQ ID NO: 3473700 - RNA, 22 nt, Human
gagcagaccaccccgccugccc

SEQ ID NO: 3473701 - RNA, 14 nt, Human
gagcagacuacagc

SEQ ID NO: 3473702 - RNA, 15 nt, Human
gagcagagaauauaa

SEQ ID NO: 3473703 - RNA, 17 nt, Human
gagcagagaccaucccu

SEQ ID NO: 3473704 - RNA, 19 nt, Human
gagcagagaccaucccuga

SEQ ID NO: 3473705 - RNA, 12 nt, Human
gagcagagagcu

SEQ ID NO: 3473706 - RNA, 18 nt, Human
gagcagagcaagucugca

SEQ ID NO: 3473707 - RNA, 14 nt, Human
gagcagaggucucc

SEQ ID NO: 3473708 - RNA, 11 nt, Human
gagcagagucu

SEQ ID NO: 3473709 - RNA, 21 nt, Human
gagcagcaaggucuugcucuc

SEQ ID NO: 3473710 - RNA, 17 nt, Human
gagcagcacccauccac

SEQ ID NO: 3473711 - RNA, 14 nt, Human
gagcagcaccuccu

SEQ ID NO: 3473712 - RNA, 21 nt, Human
gagcagcaccuccucagccug

SEQ ID NO: 3473713 - RNA, 22 nt, Human
gagcagcaccuccucagccuga

SEQ ID NO: 3473714 - RNA, 18 nt, Human
gagcagcaggagggggga

SEQ ID NO: 3473715 - RNA, 22 nt, Human
gagcagcaggaggggggaggga

SEQ ID NO: 3473716 - RNA, 17 nt, Human
gagcagcagugaaaaca

SEQ ID NO: 3473717 - RNA, 14 nt, Human
gagcagccaggaga

SEQ ID NO: 3473718 - RNA, 17 nt, Human
gagcagccucagaacaa

SEQ ID NO: 3473719 - RNA, 22 nt, Human
gagcagccuggagcccuggaga

SEQ ID NO: 3473720 - RNA, 13 nt, Human
gagcagccugugg

SEQ ID NO: 3473721 - RNA, 15 nt, Human
gagcagcgagccugc

SEQ ID NO: 3473722 - RNA, 13 nt, Human
gagcagcugagca

SEQ ID NO: 3473723 - RNA, 14 nt, Human
gagcagcugagcag

SEQ ID NO: 3473724 - RNA, 14 nt, Human
gagcaggaaggccu

SEQ ID NO: 3473725 - RNA, 15 nt, Human
gagcaggaaggccug

SEQ ID NO: 3473726 - RNA, 20 nt, Human
gagcaggacuccaggcccaa

SEQ ID NO: 3473727 - RNA, 20 nt, Human
gagcaggaggccuaggaggg

SEQ ID NO: 3473728 - RNA, 21 nt, Human
gagcaggaggccuaggagggu

SEQ ID NO: 3473729 - RNA, 21 nt, Human
gagcaggcacggguggucccc

SEQ ID NO: 3473730 - RNA, 18 nt, Human
gagcaggcuggcagcucu

SEQ ID NO: 3473731 - RNA, 20 nt, Human
gagcaggcuggcagcucucc

SEQ ID NO: 3473732 - RNA, 22 nt, Human
gagcaggcuggcagcucuccag

SEQ ID NO: 3473733 - RNA, 16 nt, Human
gagcagggaaggccug

SEQ ID NO: 3473734 - RNA, 16 nt, Human
gagcagggugcugugg

SEQ ID NO: 3473735 - RNA, 17 nt, Human
gagcaguaucaugaagc

SEQ ID NO: 3473736 - RNA, 16 nt, Human
gagcaguccaugcaug

SEQ ID NO: 3473737 - RNA, 13 nt, Human
gagcaguccuugg

SEQ ID NO: 3473738 - RNA, 22 nt, Human
gagcaguccuuggccugcuaag

SEQ ID NO: 3473739 - RNA, 17 nt, Human
gagcagugcaggcacag

SEQ ID NO: 3473740 - RNA, 15 nt, Human
gagcagugcuuuugg

SEQ ID NO: 3473741 - RNA, 14 nt, Human
gagcaguggcuggu

SEQ ID NO: 3473742 - RNA, 11 nt, Human
gagcagugucu

SEQ ID NO: 3473743 - RNA, 17 nt, Human
gagcagugucuuccaua

SEQ ID NO: 3473744 - RNA, 16 nt, Human
gagcagugugucuccu

SEQ ID NO: 3473745 - RNA, 19 nt, Human
gagcagugugucuccugca

SEQ ID NO: 3473746 - RNA, 17 nt, Human
gagcaguuucuguccug

SEQ ID NO: 3473747 - RNA, 21 nt, Human
gagcauacaucuuaaaucuuu

SEQ ID NO: 3473748 - RNA, 14 nt, Human
gagcauagaaggca

SEQ ID NO: 3473749 - RNA, 16 nt, Human
gagcauagaaggcagg

SEQ ID NO: 3473750 - RNA, 14 nt, Human
gagcaucacagaau

SEQ ID NO: 3473751 - RNA, 14 nt, Human
gagcaucaugccuc

SEQ ID NO: 3473752 - RNA, 17 nt, Human
gagcaucaugccucuga

SEQ ID NO: 3473753 - RNA, 20 nt, Human
gagcaucaugccucugaggc

SEQ ID NO: 3473754 - RNA, 17 nt, Human
ggagagggucuggagaa

SEQ ID NO: 3473755 - RNA, 23 nt, Human
ggagagggucuggagaagcagug

SEQ ID NO: 3473756 - RNA, 14 nt, Human
ggagaggugccagc

SEQ ID NO: 3473757 - RNA, 13 nt, Human
ggagagguggagc

SEQ ID NO: 3473758 - RNA, 21 nt, Human
ggagagguuauaggucacucc

SEQ ID NO: 3473759 - RNA, 17 nt, Human
ggagagucccagagcag

SEQ ID NO: 3473760 - RNA, 21 nt, Human
ggagagucccagagcaggagg

SEQ ID NO: 3473761 - RNA, 22 nt, Human
ggagagucccagagcaggaggc

SEQ ID NO: 3473762 - RNA, 17 nt, Human
ggagagucuugcaguga

SEQ ID NO: 3473763 - RNA, 13 nt, Human
ggagagugggggu

SEQ ID NO: 3473764 - RNA, 21 nt, Human
ggagagugucaaccagacaga

SEQ ID NO: 3473765 - RNA, 21 nt, Human
ggagauaacaaucuguauaua

SEQ ID NO: 3473766 - RNA, 18 nt, Human
ggagauacugguggaagu

SEQ ID NO: 3473767 - RNA, 23 nt, Human
ggagauacuuggucacagccagg

SEQ ID NO: 3473768 - RNA, 20 nt, Human
ggagauagccccacaggagg

SEQ ID NO: 3473769 - RNA, 15 nt, Human
ggagauccuccugca

SEQ ID NO: 3473770 - RNA, 19 nt, Human
ggagaugaagcaaacacau

SEQ ID NO: 3473771 - RNA, 14 nt, Human
ggagaugaggccag

SEQ ID NO: 3473772 - RNA, 21 nt, Human
ggagaugccaugagccgccca

SEQ ID NO: 3473773 - RNA, 14 nt, Human
ggagaugcugugcc

SEQ ID NO: 3473774 - RNA, 24 nt, Human
ggagaugcugugccccuggccuug

SEQ ID NO: 3473775 - RNA, 13 nt, Human
ggagauggggaga

SEQ ID NO: 3473776 - RNA, 14 nt, Human
ggagaugucuucgu

SEQ ID NO: 3473777 - RNA, 15 nt, Human
ggagauugaccugga

SEQ ID NO: 3473778 - RNA, 16 nt, Human
ggagauugagaaggag

SEQ ID NO: 3473779 - RNA, 17 nt, Human
ggagauuggacggccug

SEQ ID NO: 3473780 - RNA, 19 nt, Human
ggagauuuuagguguugau

SEQ ID NO: 3473781 - RNA, 21 nt, Human
ggagauuuugagguaaagaua

SEQ ID NO: 3473782 - RNA, 22 nt, Human
ggagauuuuuuugagucaaaga

SEQ ID NO: 3473783 - RNA, 21 nt, Human
ggagcaaacugcaugcccaga

SEQ ID NO: 3473784 - RNA, 14 nt, Human
ggagcaaagccugu

SEQ ID NO: 3473785 - RNA, 24 nt, Human
ggagcaaagccuguucauggcaga

SEQ ID NO: 3473786 - RNA, 15 nt, Human
ggagcaaauguuucu

SEQ ID NO: 3473787 - RNA, 20 nt, Human
ggagcaaauguuucugcagu

SEQ ID NO: 3473788 - RNA, 13 nt, Human
ggagcaagaggag

SEQ ID NO: 3473789 - RNA, 17 nt, Human
ggagcacaaagacccug

SEQ ID NO: 3473790 - RNA, 15 nt, Human
ggagcacacccagcc

SEQ ID NO: 3473791 - RNA, 17 nt, Human
ggagcacacccagcccc

SEQ ID NO: 3473792 - RNA, 16 nt, Human
ggagcacacuggcuca

SEQ ID NO: 3473793 - RNA, 14 nt, Human
ggagcacagguccc

SEQ ID NO: 3473794 - RNA, 17 nt, Human
ggagcaccaggcacgaa

SEQ ID NO: 3473795 - RNA, 15 nt, Human
ggagcacugggcucc

SEQ ID NO: 3473796 - RNA, 19 nt, Human
ggagcagagcaagucugca

SEQ ID NO: 3473797 - RNA, 23 nt, Human
ggagcagagcugauggagaagga

SEQ ID NO: 3473798 - RNA, 21 nt, Human
ggagcagccacauuccugaug

SEQ ID NO: 3473799 - RNA, 13 nt, Human
ggagcagccucag

SEQ ID NO: 3473800 - RNA, 13 nt, Human
ggagcaggaacaa

SEQ ID NO: 3473801 - RNA, 15 nt, Human
ggagcaggagauuga

SEQ ID NO: 3473802 - RNA, 16 nt, Human
ggagcaggagauugag

SEQ ID NO: 3473803 - RNA, 22 nt, Human
ggagcaggagauugagaaggag

SEQ ID NO: 3473804 - RNA, 16 nt, Human
ggagcaggcagccagc

SEQ ID NO: 3473805 - RNA, 23 nt, Human
ggagcaggcgguggggagagaug

SEQ ID NO: 3473806 - RNA, 16 nt, Human
ggagcagggaaggccu

SEQ ID NO: 3473807 - RNA, 19 nt, Human
ggagcagggaaggccugac

SEQ ID NO: 3473808 - RNA, 21 nt, Human
ggagcagggaaggccugacuu

SEQ ID NO: 3473809 - RNA, 18 nt, Human
ggagcagggacagaucau

SEQ ID NO: 3473810 - RNA, 15 nt, Human
ggagcaggggcgugg

SEQ ID NO: 3473811 - RNA, 18 nt, Human
ggagcaguaucaugaagc

SEQ ID NO: 3473812 - RNA, 16 nt, Human
ggagcaguccaugcau

SEQ ID NO: 3473813 - RNA, 18 nt, Human
ggagcagugcaggcacag

SEQ ID NO: 3473814 - RNA, 13 nt, Human
ggagcagugucuu

SEQ ID NO: 3473815 - RNA, 17 nt, Human
ggagcagugucuuccau

SEQ ID NO: 3473816 - RNA, 15 nt, Human
ggagcaucaagccac

SEQ ID NO: 3473817 - RNA, 18 nt, Human
ggagcauccaccuccuuc

SEQ ID NO: 3473818 - RNA, 21 nt, Human
ggagcaucccggaggaaaucu

SEQ ID NO: 3473819 - RNA, 16 nt, Human
ggagcaucucuugagg

SEQ ID NO: 3473820 - RNA, 20 nt, Human
ggagcaucucuugaggccag

SEQ ID NO: 3473821 - RNA, 17 nt, Human
ggagcauggcugugagg

SEQ ID NO: 3473822 - RNA, 19 nt, Human
ggagcauguuuuguauaca

SEQ ID NO: 3473823 - RNA, 19 nt, Human
ggagcauuggcugagagac

SEQ ID NO: 3473824 - RNA, 15 nt, Human
ggagcauugggaccu

SEQ ID NO: 3473825 - RNA, 19 nt, Human
ggagcauuuggagagaagg

SEQ ID NO: 3473826 - RNA, 16 nt, Human
ggagccaagggaugga

SEQ ID NO: 3473827 - RNA, 18 nt, Human
ggagccaagggauggaca

SEQ ID NO: 3473828 - RNA, 17 nt, Human
ggagccaaguccagauu

SEQ ID NO: 3473829 - RNA, 14 nt, Human
ggagccaccaguuc

SEQ ID NO: 3473830 - RNA, 13 nt, Human
ggagccaccuguc

SEQ ID NO: 3473831 - RNA, 13 nt, Human
ggagccagacaga

SEQ ID NO: 3473832 - RNA, 14 nt, Human
ggagccagccgagc

SEQ ID NO: 3473833 - RNA, 15 nt, Human
ggagccagccucccu

SEQ ID NO: 3473834 - RNA, 21 nt, Human
ggagccagcucccucuauuua

SEQ ID NO: 3473835 - RNA, 11 nt, Human
ggagccaggcg

SEQ ID NO: 3473836 - RNA, 17 nt, Human
ggagcccacgacacugc

SEQ ID NO: 3473837 - RNA, 12 nt, Human
ggagcccacugu

SEQ ID NO: 3473838 - RNA, 22 nt, Human
ggagcccacuguacuugcucuu

SEQ ID NO: 3473839 - RNA, 16 nt, Human
ggagcccagcccuccc

SEQ ID NO: 3473840 - RNA, 19 nt, Human
ggagcccagcccuccccau

SEQ ID NO: 3473841 - RNA, 16 nt, Human
ggagcccagcucugaa

SEQ ID NO: 3473842 - RNA, 15 nt, Human
ggagcccaggccagg

SEQ ID NO: 3473843 - RNA, 16 nt, Human
ggagcccaggccagga

SEQ ID NO: 3473844 - RNA, 24 nt, Human
ggagcccaggccaggacucugcag

SEQ ID NO: 3473845 - RNA, 15 nt, Human
ggagcccagggcauc

SEQ ID NO: 3473846 - RNA, 13 nt, Human
ggagccccagccc

SEQ ID NO: 3473847 - RNA, 20 nt, Human
ggagccccagcccccuuugg

SEQ ID NO: 3473848 - RNA, 14 nt, Human
ggagccccaggguc

SEQ ID NO: 3473849 - RNA, 14 nt, Human
ggagccccagugcc

SEQ ID NO: 3473850 - RNA, 16 nt, Human
ggagccccauuccugg

SEQ ID NO: 3473851 - RNA, 13 nt, Human
ggagcccccagcc

SEQ ID NO: 3473852 - RNA, 18 nt, Human
ggagcccccagccuguca

SEQ ID NO: 3473853 - RNA, 14 nt, Human
ggagccccugggug

SEQ ID NO: 3473854 - RNA, 16 nt, Human
ggagccccuggguggg

SEQ ID NO: 3473855 - RNA, 21 nt, Human
ggagccccuggguggguggug

SEQ ID NO: 3473856 - RNA, 22 nt, Human
ggagccccuggguggguggugg

SEQ ID NO: 3473857 - RNA, 19 nt, Human
ggagccccuucugcucagc

SEQ ID NO: 3473858 - RNA, 21 nt, Human
ggagcccgaggcaccaguguc

SEQ ID NO: 3473859 - RNA, 16 nt, Human
ggagcccgucucagug

SEQ ID NO: 3473860 - RNA, 18 nt, Human
ggagcccuccgccuucac

SEQ ID NO: 3473861 - RNA, 14 nt, Human
ggagcccugccucu

SEQ ID NO: 3473862 - RNA, 19 nt, Human
ggagcccugccucuccgcc

SEQ ID NO: 3473863 - RNA, 12 nt, Human
ggagcccuggga

SEQ ID NO: 3473864 - RNA, 13 nt, Human
ggagcccugggag

SEQ ID NO: 3473865 - RNA, 16 nt, Human
ggagcccugggaggcu

SEQ ID NO: 3473866 - RNA, 20 nt, Human
ggagcccuuaucugugcuca

SEQ ID NO: 3473867 - RNA, 22 nt, Human
ggagcccuuaucugugcucagg

SEQ ID NO: 3473868 - RNA, 13 nt, Human
ggagcccuugggu

SEQ ID NO: 3473869 - RNA, 19 nt, Human
ggagccgaagcccaggggc

SEQ ID NO: 3473870 - RNA, 14 nt, Human
ggagccgcuggcag

SEQ ID NO: 3473871 - RNA, 16 nt, Human
ggagccgggagccuga

SEQ ID NO: 3473872 - RNA, 17 nt, Human
ggagccgggucugccuc

SEQ ID NO: 3473873 - RNA, 22 nt, Human
ggagccucccugccucaggccu

SEQ ID NO: 3473874 - RNA, 13 nt, Human
ggagccuccugcc

SEQ ID NO: 3473875 - RNA, 15 nt, Human
ggagccuccugcccu

SEQ ID NO: 3473876 - RNA, 23 nt, Human
ggagccugagucagggcccagag

SEQ ID NO: 3473877 - RNA, 22 nt, Human
ggagccugcaaacucacugcuc

SEQ ID NO: 3473878 - RNA, 11 nt, Human
ggagccugcag

SEQ ID NO: 3473879 - RNA, 17 nt, Human
ggagccugcagagcugc

SEQ ID NO: 3473880 - RNA, 13 nt, Human
ggagccugcaggg

SEQ ID NO: 3473881 - RNA, 16 nt, Human
ggagccugcagggugg

SEQ ID NO: 3473882 - RNA, 13 nt, Human
ggagccugcuggu

SEQ ID NO: 3473883 - RNA, 13 nt, Human
ggagccuggcaca

SEQ ID NO: 3473884 - RNA, 14 nt, Human
ggagccuggcacag

SEQ ID NO: 3473885 - RNA, 19 nt, Human
ggagccuggcacaggacug

SEQ ID NO: 3473886 - RNA, 16 nt, Human
ggagccuguccugccu

SEQ ID NO: 3473887 - RNA, 20 nt, Human
ggagccuguccugccugugg

SEQ ID NO: 3473888 - RNA, 14 nt, Human
ggagccugugaacc

SEQ ID NO: 3473889 - RNA, 22 nt, Human
ggagccugugaacccaggacaa

SEQ ID NO: 3473890 - RNA, 16 nt, Human
ggagccuguguaacag

SEQ ID NO: 3473891 - RNA, 17 nt, Human
ggagccuguguaacagc

SEQ ID NO: 3473892 - RNA, 21 nt, Human
ggagccuucccaaguugugcu

SEQ ID NO: 3473893 - RNA, 23 nt, Human
ggagcgaacuggcgccuccgagg

SEQ ID NO: 3473894 - RNA, 15 nt, Human
ggagcgcaccugccc

SEQ ID NO: 3473895 - RNA, 19 nt, Human
ggagcgcaccugcccccug

SEQ ID NO: 3473896 - RNA, 21 nt, Human
ggagcgcaccugcccccuggu

SEQ ID NO: 3473897 - RNA, 23 nt, Human
ggagcgcaccugcccccuggugg

SEQ ID NO: 3473898 - RNA, 15 nt, Human
ggagcggcagauggg

SEQ ID NO: 3473899 - RNA, 19 nt, Human
ggagggccacaugggaggc

SEQ ID NO: 3473900 - RNA, 23 nt, Human
ggagggccacaugggaggcucac

SEQ ID NO: 3473901 - RNA, 16 nt, Human
ggagggcccuaccuga

SEQ ID NO: 3473902 - RNA, 23 nt, Human
ggagggccugggccuggcucccu

SEQ ID NO: 3473903 - RNA, 16 nt, Human
ggagggcuagaaccua

SEQ ID NO: 3473904 - RNA, 20 nt, Human
ggagggcuagaaccuggcag

SEQ ID NO: 3473905 - RNA, 23 nt, Human
ggagggcuagaaccuggcagguu

SEQ ID NO: 3473906 - RNA, 18 nt, Human
ggaggggaaaaaaauguu

SEQ ID NO: 3473907 - RNA, 16 nt, Human
ggaggggaagaggccu

SEQ ID NO: 3473908 - RNA, 14 nt, Human
ggaggggaagcugc

SEQ ID NO: 3473909 - RNA, 17 nt, Human
ggaggggaagcugcagc

SEQ ID NO: 3473910 - RNA, 12 nt, Human
ggaggggagcuc

SEQ ID NO: 3473911 - RNA, 13 nt, Human
ggaggggcaggcu

SEQ ID NO: 3473912 - RNA, 20 nt, Human
ggaggggcauggccagcagc

SEQ ID NO: 3473913 - RNA, 21 nt, Human
ggaggggccccugcuucucca

SEQ ID NO: 3473914 - RNA, 18 nt, Human
ggaggggcccgcuugccu

SEQ ID NO: 3473915 - RNA, 21 nt, Human
ggaggggccuaggccucagcc

SEQ ID NO: 3473916 - RNA, 13 nt, Human
ggaggggccuggc

SEQ ID NO: 3473917 - RNA, 14 nt, Human
ggaggggccuggca

SEQ ID NO: 3473918 - RNA, 12 nt, Human
ggaggggcgcug

SEQ ID NO: 3473919 - RNA, 19 nt, Human
ggaggggcgcuggcccagc

SEQ ID NO: 3473920 - RNA, 23 nt, Human
ggagggggagaaaaggaaaagaa

SEQ ID NO: 3473921 - RNA, 14 nt, Human
ggagggggauccga

SEQ ID NO: 3473922 - RNA, 13 nt, Human
ggagggggcaaag

SEQ ID NO: 3473923 - RNA, 16 nt, Human
ggagggggcuugaagc

SEQ ID NO: 3473924 - RNA, 12 nt, Human
ggaggggggagc

SEQ ID NO: 3473925 - RNA, 15 nt, Human
ggaggggggagccau

SEQ ID NO: 3473926 - RNA, 15 nt, Human
ggaggggggagggaa

SEQ ID NO: 3473927 - RNA, 16 nt, Human
ggaggggggagggaag

SEQ ID NO: 3473928 - RNA, 14 nt, Human
ggaggggggaggug

SEQ ID NO: 3473929 - RNA, 22 nt, Human
ggagggggucguggagagcuag

SEQ ID NO: 3473930 - RNA, 22 nt, Human
ggaggggguuugcuggggaacu

SEQ ID NO: 3473931 - RNA, 23 nt, Human
ggaggggguuugcuggggaacug

SEQ ID NO: 3473932 - RNA, 15 nt, Human
ggagggguguggcuc

SEQ ID NO: 3473933 - RNA, 17 nt, Human
ggagggguugccacagg

SEQ ID NO: 3473934 - RNA, 19 nt, Human
ggagggguugccacaggcc

SEQ ID NO: 3473935 - RNA, 21 nt, Human
ggagggguugccacaggccuc

SEQ ID NO: 3473936 - RNA, 20 nt, Human
ggaggguaaauaaaccacug

SEQ ID NO: 3473937 - RNA, 23 nt, Human
ggaggguaaaugauguggugccu

SEQ ID NO: 3473938 - RNA, 16 nt, Human
ggaggguacagcuggg

SEQ ID NO: 3473939 - RNA, 18 nt, Human
ggaggguagagcggagaa

SEQ ID NO: 3473940 - RNA, 15 nt, Human
ggaggguaggcagga

SEQ ID NO: 3473941 - RNA, 16 nt, Human
ggagggucaggaagga

SEQ ID NO: 3473942 - RNA, 21 nt, Human
ggagggugacgggggugaacu

SEQ ID NO: 3473943 - RNA, 13 nt, Human
ggagggugggaag

SEQ ID NO: 3473944 - RNA, 19 nt, Human
ggagggugggagagcccag

SEQ ID NO: 3473945 - RNA, 20 nt, Human
ggaggguuucauugucugug

SEQ ID NO: 3473946 - RNA, 14 nt, Human
ggagguaaugacca

SEQ ID NO: 3473947 - RNA, 20 nt, Human
ggaggucacauucaggaaga

SEQ ID NO: 3473948 - RNA, 23 nt, Human
ggaggucacauucaggaagauga

SEQ ID NO: 3473949 - RNA, 13 nt, Human
ggaggucacugga

SEQ ID NO: 3473950 - RNA, 15 nt, Human
ggaggucaggcccug

SEQ ID NO: 3473951 - RNA, 18 nt, Human
ggaggucgguagguucag

SEQ ID NO: 3473952 - RNA, 18 nt, Human
ggaggucugccaggcugu

SEQ ID NO: 3473953 - RNA, 17 nt, Human
ggaggugagaccaccuc

SEQ ID NO: 3473954 - RNA, 18 nt, Human
ggaggugauagcauugcu

SEQ ID NO: 3473955 - RNA, 14 nt, Human
ggaggugccagcaa

SEQ ID NO: 3473956 - RNA, 19 nt, Human
ggaggugccagcaaagccc

SEQ ID NO: 3473957 - RNA, 17 nt, Human
ggagguggaagaaggga

SEQ ID NO: 3473958 - RNA, 19 nt, Human
ggagguggagguugcagug

SEQ ID NO: 3473959 - RNA, 20 nt, Human
ggagguggauuccgaguggu

SEQ ID NO: 3473960 - RNA, 17 nt, Human
ggagguggcagcccugu

SEQ ID NO: 3473961 - RNA, 22 nt, Human
ggaggugggauccuccaggugc

SEQ ID NO: 3473962 - RNA, 19 nt, Human
ggaggugggccguggcccu

SEQ ID NO: 3473963 - RNA, 17 nt, Human
ggagguggggaugagaa

SEQ ID NO: 3473964 - RNA, 22 nt, Human
ggaggugucacauggugccccu

SEQ ID NO: 3473965 - RNA, 15 nt, Human
ggaggugucaggcug

SEQ ID NO: 3473966 - RNA, 19 nt, Human
ggaggugucaggcugcugg

SEQ ID NO: 3473967 - RNA, 16 nt, Human
ggaggugucucaggcu

SEQ ID NO: 3473968 - RNA, 17 nt, Human
ggaggugucucaggcug

SEQ ID NO: 3473969 - RNA, 15 nt, Human
ggaggugugaggcag

SEQ ID NO: 3473970 - RNA, 17 nt, Human
ggagguuaaggcugagg

SEQ ID NO: 3473971 - RNA, 16 nt, Human
ggagguucucucggag

SEQ ID NO: 3473972 - RNA, 20 nt, Human
ggagguugcagugagcugag

SEQ ID NO: 3473973 - RNA, 17 nt, Human
ggagguugcauugagcu

SEQ ID NO: 3473974 - RNA, 15 nt, Human
ggagguugggugggc

SEQ ID NO: 3473975 - RNA, 12 nt, Human
ggaguacaaggc

SEQ ID NO: 3473976 - RNA, 17 nt, Human
ggaguacaggugaagca

SEQ ID NO: 3473977 - RNA, 14 nt, Human
ggaguaucugggaa

SEQ ID NO: 3473978 - RNA, 13 nt, Human
ggaguauugaaug

SEQ ID NO: 3473979 - RNA, 18 nt, Human
ggagucauuugagucucu

SEQ ID NO: 3473980 - RNA, 15 nt, Human
ggaguccacucccag

SEQ ID NO: 3473981 - RNA, 19 nt, Human
ggaguccacucccagugcu

SEQ ID NO: 3473982 - RNA, 15 nt, Human
ggaguccaggcacag

SEQ ID NO: 3473983 - RNA, 16 nt, Human
ggaguccaggcacagg

SEQ ID NO: 3473984 - RNA, 21 nt, Human
ggaguccaggccauggaggca

SEQ ID NO: 3473985 - RNA, 16 nt, Human
ggagucccaaggaaag

SEQ ID NO: 3473986 - RNA, 22 nt, Human
ggagucccaccuuggcugcagg

SEQ ID NO: 3473987 - RNA, 13 nt, Human
ggaguccccucac

SEQ ID NO: 3473988 - RNA, 15 nt, Human
ggaguccccucaccu

SEQ ID NO: 3473989 - RNA, 22 nt, Human
ggagucguggggugugcuggga

SEQ ID NO: 3473990 - RNA, 14 nt, Human
ggagucugaagcag

SEQ ID NO: 3473991 - RNA, 16 nt, Human
ggagucugagguccug

SEQ ID NO: 3473992 - RNA, 18 nt, Human
ggagucugagguccugag

SEQ ID NO: 3473993 - RNA, 19 nt, Human
ggagucugagguccugagc

SEQ ID NO: 3473994 - RNA, 21 nt, Human
ggagucugagguccugagcac

SEQ ID NO: 3473995 - RNA, 23 nt, Human
ggagucugagguccugagcacug

SEQ ID NO: 3473996 - RNA, 20 nt, Human
ggagucugccacccaggauc

SEQ ID NO: 3473997 - RNA, 14 nt, Human
ggagucugccaggg

SEQ ID NO: 3473998 - RNA, 15 nt, Human
ggagucugccagggc

SEQ ID NO: 3473999 - RNA, 22 nt, Human
ggagucugccagggccccucuc

SEQ ID NO: 3474000 - RNA, 18 nt, Human
ggagucuggagugggcag

SEQ ID NO: 3474001 - RNA, 12 nt, Human
ggagucuugcuc

SEQ ID NO: 3474002 - RNA, 15 nt, Human
ggagugaagaggggc

SEQ ID NO: 3474003 - RNA, 20 nt, Human
ggagugaagaggggcagccc

SEQ ID NO: 3474004 - RNA, 22 nt, Human
ggagugaagaggggcagcccuu

SEQ ID NO: 3474005 - RNA, 11 nt, Human
ggagugacaga

SEQ ID NO: 3474006 - RNA, 16 nt, Human
ggagugacagaggcag

SEQ ID NO: 3474007 - RNA, 21 nt, Human
ggagugacagaggcagcccca

SEQ ID NO: 3474008 - RNA, 23 nt, Human
ggagugaggaauaguugagcccc

SEQ ID NO: 3474009 - RNA, 18 nt, Human
ggagugaggcaggugaca

SEQ ID NO: 3474010 - RNA, 18 nt, Human
ggagugcagggaggagag

SEQ ID NO: 3474011 - RNA, 22 nt, Human
ggagugcaguggcgaaaucccu

SEQ ID NO: 3474012 - RNA, 22 nt, Human
ggagugcggaccacccucacug

SEQ ID NO: 3474013 - RNA, 19 nt, Human
ggaguggcagcccagccag

SEQ ID NO: 3474014 - RNA, 20 nt, Human
ggaguggcagcccagccagc

SEQ ID NO: 3474015 - RNA, 14 nt, Human
ggagugggcagagc

SEQ ID NO: 3474016 - RNA, 16 nt, Human
ggagugugcguggugg

SEQ ID NO: 3474017 - RNA, 16 nt, Human
ggaguguguauuguuc

SEQ ID NO: 3474018 - RNA, 14 nt, Human
ggaguguuauguau

SEQ ID NO: 3474019 - RNA, 16 nt, Human
ggaguguuauguauuu

SEQ ID NO: 3474020 - RNA, 15 nt, Human
ggaguuaagaccugg

SEQ ID NO: 3474021 - RNA, 15 nt, Human
ggaguuagaggccag

SEQ ID NO: 3474022 - RNA, 16 nt, Human
ggaguuagaggccagc

SEQ ID NO: 3474023 - RNA, 19 nt, Human
ggaguuagggacugaccag

SEQ ID NO: 3474024 - RNA, 22 nt, Human
ggaguuagggacugaccagcag

SEQ ID NO: 3474025 - RNA, 16 nt, Human
ggaguucaaugaucua

SEQ ID NO: 3474026 - RNA, 18 nt, Human
ggaguucgagaccagccu

SEQ ID NO: 3474027 - RNA, 15 nt, Human
ggaguucgaggcugc

SEQ ID NO: 3474028 - RNA, 16 nt, Human
ggaguucuaugcucuc

SEQ ID NO: 3474029 - RNA, 20 nt, Human
ggaguugaucgccuuuccca

SEQ ID NO: 3474030 - RNA, 23 nt, Human
ggaguugaucgccuuucccaggu

SEQ ID NO: 3474031 - RNA, 14 nt, Human
ggaguugaucugga

SEQ ID NO: 3474032 - RNA, 18 nt, Human
ggaguuggaguagaaugu

SEQ ID NO: 3474033 - RNA, 13 nt, Human
ggaguugugggua

SEQ ID NO: 3474034 - RNA, 20 nt, Human
ggaguuuagggaacaauuug

SEQ ID NO: 3474035 - RNA, 13 nt, Human
ggaguuugaggcu

SEQ ID NO: 3474036 - RNA, 19 nt, Human
ggaguuugaggcugcagcg

SEQ ID NO: 3474037 - RNA, 15 nt, Human
ggaguuuggccagaa

SEQ ID NO: 3474038 - RNA, 18 nt, Human
ggauaaaaugacuacuua

SEQ ID NO: 3474039 - RNA, 15 nt, Human
ggauaaaaugagguu

SEQ ID NO: 3474040 - RNA, 19 nt, Human
ggauaaacuuuuagaaacu

SEQ ID NO: 3474041 - RNA, 13 nt, Human
ggauaaagcagcu

SEQ ID NO: 3474042 - RNA, 14 nt, Human
ggauaacaaagaua

SEQ ID NO: 3474043 - RNA, 16 nt, Human
ggauaacaaagauauc

SEQ ID NO: 3474044 - RNA, 16 nt, Human
ggauguguccugacac

SEQ ID NO: 3474045 - RNA, 13 nt, Human
ggaugugugcaug

SEQ ID NO: 3474046 - RNA, 18 nt, Human
ggauguuacuccaaaacu

SEQ ID NO: 3474047 - RNA, 15 nt, Human
ggauguucuggcccu

SEQ ID NO: 3474048 - RNA, 12 nt, Human
ggauuaaacuua

SEQ ID NO: 3474049 - RNA, 16 nt, Human
ggauuaaacuuaugaa

SEQ ID NO: 3474050 - RNA, 20 nt, Human
ggauuaaacuuaugaauguu

SEQ ID NO: 3474051 - RNA, 23 nt, Human
ggauuaaacuuaugaauguuucc

SEQ ID NO: 3474052 - RNA, 20 nt, Human
ggauuaacccacuagcucuu

SEQ ID NO: 3474053 - RNA, 15 nt, Human
ggauuaaccucugca

SEQ ID NO: 3474054 - RNA, 19 nt, Human
ggauuacaagcgugagcca

SEQ ID NO: 3474055 - RNA, 19 nt, Human
ggauuacaggcaugugcca

SEQ ID NO: 3474056 - RNA, 21 nt, Human
ggauuacaggcaugugccacc

SEQ ID NO: 3474057 - RNA, 19 nt, Human
ggauuacaggcgugagcca

SEQ ID NO: 3474058 - RNA, 17 nt, Human
ggauuagggagagaaga

SEQ ID NO: 3474059 - RNA, 18 nt, Human
ggauuaguuuagaacagg

SEQ ID NO: 3474060 - RNA, 15 nt, Human
ggauuauucauuuaa

SEQ ID NO: 3474061 - RNA, 21 nt, Human
ggauuauucauuuaaaaugau

SEQ ID NO: 3474062 - RNA, 22 nt, Human
ggauuauuuaauaacauuaccu

SEQ ID NO: 3474063 - RNA, 13 nt, Human
ggauuauuuuuuc

SEQ ID NO: 3474064 - RNA, 14 nt, Human
ggauuauuuuuuca

SEQ ID NO: 3474065 - RNA, 19 nt, Human
ggauucacaccccaccugc

SEQ ID NO: 3474066 - RNA, 21 nt, Human
ggauucaggaaaaggccuggg

SEQ ID NO: 3474067 - RNA, 15 nt, Human
ggauucaggcugcuu

SEQ ID NO: 3474068 - RNA, 16 nt, Human
ggauucauuacagcuu

SEQ ID NO: 3474069 - RNA, 22 nt, Human
ggauucauucucauaauuccua

SEQ ID NO: 3474070 - RNA, 13 nt, Human
ggauucauuuccu

SEQ ID NO: 3474071 - RNA, 16 nt, Human
ggauucauuuccugcc

SEQ ID NO: 3474072 - RNA, 17 nt, Human
ggauucauuuccugccc

SEQ ID NO: 3474073 - RNA, 18 nt, Human
ggauucauuuccugcccu

SEQ ID NO: 3474074 - RNA, 22 nt, Human
ggauuccacucguguguuucua

SEQ ID NO: 3474075 - RNA, 13 nt, Human
ggauuccaugcua

SEQ ID NO: 3474076 - RNA, 23 nt, Human
ggauuccuaaucacucagagcag

SEQ ID NO: 3474077 - RNA, 18 nt, Human
ggauuccucuuuucucug

SEQ ID NO: 3474078 - RNA, 14 nt, Human
ggauucuaaauaca

SEQ ID NO: 3474079 - RNA, 15 nt, Human
ggauucuaaauacau

SEQ ID NO: 3474080 - RNA, 23 nt, Human
ggauucuacuuuaagcacuacau

SEQ ID NO: 3474081 - RNA, 16 nt, Human
ggauucucaccagcug

SEQ ID NO: 3474082 - RNA, 19 nt, Human
ggauucugguuccaggguc

SEQ ID NO: 3474083 - RNA, 13 nt, Human
ggauucuuaaagu

SEQ ID NO: 3474084 - RNA, 16 nt, Human
ggauucuuaaaguuga

SEQ ID NO: 3474085 - RNA, 19 nt, Human
ggauucuuaaaguugaauu

SEQ ID NO: 3474086 - RNA, 20 nt, Human
ggauucuuaaaguugaauuu

SEQ ID NO: 3474087 - RNA, 16 nt, Human
ggauucuuccucccuc

SEQ ID NO: 3474088 - RNA, 19 nt, Human
ggauugaaaauguccagga

SEQ ID NO: 3474089 - RNA, 19 nt, Human
ggauugaaggaugcugucu

SEQ ID NO: 3474090 - RNA, 17 nt, Human
ggauugauuuuaaaaug

SEQ ID NO: 3474091 - RNA, 16 nt, Human
ggauugcgagagaugu

SEQ ID NO: 3474092 - RNA, 17 nt, Human
ggauugcuacuguccua

SEQ ID NO: 3474093 - RNA, 15 nt, Human
ggauuggcacuguuu

SEQ ID NO: 3474094 - RNA, 20 nt, Human
ggauuggcuuguguguuuca

SEQ ID NO: 3474095 - RNA, 17 nt, Human
ggauugggccccugcca

SEQ ID NO: 3474096 - RNA, 12 nt, Human
ggauuggggaag

SEQ ID NO: 3474097 - RNA, 15 nt, Human
ggauuguaaaauggu

SEQ ID NO: 3474098 - RNA, 20 nt, Human
ggauuguccccgacccuugc

SEQ ID NO: 3474099 - RNA, 17 nt, Human
ggauuuaaaaacuggaa

SEQ ID NO: 3474100 - RNA, 16 nt, Human
ggauuuaaaagccugc

SEQ ID NO: 3474101 - RNA, 17 nt, Human
ggauuuaaaagccugcu

SEQ ID NO: 3474102 - RNA, 19 nt, Human
ggauuuaaaagccugcuca

SEQ ID NO: 3474103 - RNA, 16 nt, Human
ggauuuaacagaaaug

SEQ ID NO: 3474104 - RNA, 22 nt, Human
ggauuuaacagaaauguacagc

SEQ ID NO: 3474105 - RNA, 14 nt, Human
ggauuuauuuaaaa

SEQ ID NO: 3474106 - RNA, 14 nt, Human
ggauuuauuuuucc

SEQ ID NO: 3474107 - RNA, 19 nt, Human
ggauuuccagccagggcug

SEQ ID NO: 3474108 - RNA, 23 nt, Human
ggauuuccugcuuugggaagccg

SEQ ID NO: 3474109 - RNA, 22 nt, Human
ggauuugcacagaagcacaugc

SEQ ID NO: 3474110 - RNA, 14 nt, Human
ggauuugccccuuc

SEQ ID NO: 3474111 - RNA, 22 nt, Human
ggauuugccccuucccaucucu

SEQ ID NO: 3474112 - RNA, 17 nt, Human
ggauuuggagagaaaua

SEQ ID NO: 3474113 - RNA, 22 nt, Human
ggauuuucuauuguuacucugg

SEQ ID NO: 3474114 - RNA, 12 nt, Human
ggauuuugagua

SEQ ID NO: 3474115 - RNA, 21 nt, Human
ggauuuugauccaagcugguc

SEQ ID NO: 3474116 - RNA, 11 nt, Human
ggcaaaaacaa

SEQ ID NO: 3474117 - RNA, 15 nt, Human
ggcaaaagccuugug

SEQ ID NO: 3474118 - RNA, 10 nt, Human
ggcaaaauaa

SEQ ID NO: 3474119 - RNA, 17 nt, Human
ggcaaacauuugaagga

SEQ ID NO: 3474120 - RNA, 13 nt, Human
ggcaaacccauca

SEQ ID NO: 3474121 - RNA, 14 nt, Human
ggcaaacuggccgc

SEQ ID NO: 3474122 - RNA, 16 nt, Human
ggcaaagacagaagcc

SEQ ID NO: 3474123 - RNA, 20 nt, Human
ggcaaagagacccagucaau

SEQ ID NO: 3474124 - RNA, 22 nt, Human
ggcaaagcacgaaauguuauuu

SEQ ID NO: 3474125 - RNA, 14 nt, Human
ggcaaagccagguc

SEQ ID NO: 3474126 - RNA, 13 nt, Human
ggcaaagcuguuc

SEQ ID NO: 3474127 - RNA, 20 nt, Human
ggcaaagggagcagaacuga

SEQ ID NO: 3474128 - RNA, 16 nt, Human
ggcaaagggggaggag

SEQ ID NO: 3474129 - RNA, 12 nt, Human
ggcaaauaaaag

SEQ ID NO: 3474130 - RNA, 17 nt, Human
ggcaaauccgaaaucag

SEQ ID NO: 3474131 - RNA, 18 nt, Human
ggcaaaugccagggcccg

SEQ ID NO: 3474132 - RNA, 16 nt, Human
ggcaaauuaacuugag

SEQ ID NO: 3474133 - RNA, 18 nt, Human
ggcaaauuuuuauuuuuu

SEQ ID NO: 3474134 - RNA, 16 nt, Human
ggcaacaaacugcaca

SEQ ID NO: 3474135 - RNA, 18 nt, Human
ggcaacaaacugcacaug

SEQ ID NO: 3474136 - RNA, 17 nt, Human
ggcaacagagcaagacu

SEQ ID NO: 3474137 - RNA, 14 nt, Human
ggcaacaucuuuau

SEQ ID NO: 3474138 - RNA, 18 nt, Human
ggcaacauuccaagaaua

SEQ ID NO: 3474139 - RNA, 16 nt, Human
ggcaaccccaguucug

SEQ ID NO: 3474140 - RNA, 23 nt, Human
ggcaaccccaguucugcuccucu

SEQ ID NO: 3474141 - RNA, 18 nt, Human
ggcaacccccagccugcu

SEQ ID NO: 3474142 - RNA, 18 nt, Human
ggcaaccugauuguaaac

SEQ ID NO: 3474143 - RNA, 20 nt, Human
ggcaacgaagaaaaaaaaua

SEQ ID NO: 3474144 - RNA, 16 nt, Human
ggcaacugaacaaaaa

SEQ ID NO: 3474145 - RNA, 14 nt, Human
ggcaacugaggcag

SEQ ID NO: 3474146 - RNA, 23 nt, Human
ggcaacuucaguccugggagacc

SEQ ID NO: 3474147 - RNA, 18 nt, Human
ggcaacuugggaacuaga

SEQ ID NO: 3474148 - RNA, 22 nt, Human
ggcaagagcccccuugacaccg

SEQ ID NO: 3474149 - RNA, 12 nt, Human
ggcaagaggggu

SEQ ID NO: 3474150 - RNA, 18 nt, Human
ggcaagcaccuccugccu

SEQ ID NO: 3474151 - RNA, 21 nt, Human
ggcaagcaggcgcugugcuau

SEQ ID NO: 3474152 - RNA, 20 nt, Human
ggcaagcuagaaccuggagg

SEQ ID NO: 3474153 - RNA, 23 nt, Human
ggcaagcugugacuucuccaggu

SEQ ID NO: 3474154 - RNA, 10 nt, Human
ggcaaggaaa

SEQ ID NO: 3474155 - RNA, 19 nt, Human
ggcaaggaaaaagaaaaua

SEQ ID NO: 3474156 - RNA, 22 nt, Human
ggcaaggaaaggggagaaggga

SEQ ID NO: 3474157 - RNA, 16 nt, Human
ggcaaggacacagaug

SEQ ID NO: 3474158 - RNA, 18 nt, Human
ggcaaggacuuuguacau

SEQ ID NO: 3474159 - RNA, 13 nt, Human
ggcaaggcaggug

SEQ ID NO: 3474160 - RNA, 14 nt, Human
ggcaaggcaggugc

SEQ ID NO: 3474161 - RNA, 16 nt, Human
ggcaaggcuguggacc

SEQ ID NO: 3474162 - RNA, 19 nt, Human
ggcaagggccaugcugaag

SEQ ID NO: 3474163 - RNA, 21 nt, Human
ggcaagggccaugcugaaggg

SEQ ID NO: 3474164 - RNA, 17 nt, Human
ggcaaggguuaaggccu

SEQ ID NO: 3474165 - RNA, 20 nt, Human
ggcaaguuuuccauauuuuu

SEQ ID NO: 3474166 - RNA, 16 nt, Human
ggcaauaaaagcccag

SEQ ID NO: 3474167 - RNA, 20 nt, Human
ggcaaucaauaaacagcagg

SEQ ID NO: 3474168 - RNA, 19 nt, Human
ggcaaucauggugcucaga

SEQ ID NO: 3474169 - RNA, 23 nt, Human
ggcaaugcuggcuguuggcuggg

SEQ ID NO: 3474170 - RNA, 17 nt, Human
ggcaaugguaguuucug

SEQ ID NO: 3474171 - RNA, 16 nt, Human
ggcaauguuuugcuuu

SEQ ID NO: 3474172 - RNA, 17 nt, Human
ggcaauuaauuccuuca

SEQ ID NO: 3474173 - RNA, 20 nt, Human
ggcaauuaauuccuucagca

SEQ ID NO: 3474174 - RNA, 12 nt, Human
ggcaauuggaac

SEQ ID NO: 3474175 - RNA, 13 nt, Human
ggcaauuggaaca

SEQ ID NO: 3474176 - RNA, 13 nt, Human
ggcaauugucuau

SEQ ID NO: 3474177 - RNA, 16 nt, Human
ggcaauuuagaaaaag

SEQ ID NO: 3474178 - RNA, 22 nt, Human
ggcacaagcaaaagggugucug

SEQ ID NO: 3474179 - RNA, 23 nt, Human
ggcacaaguccuggauguugugu

SEQ ID NO: 3474180 - RNA, 14 nt, Human
ggcacacagcuacu

SEQ ID NO: 3474181 - RNA, 18 nt, Human
ggcacaccgggcacucag

SEQ ID NO: 3474182 - RNA, 16 nt, Human
ggcacaccuccuccca

SEQ ID NO: 3474183 - RNA, 21 nt, Human
ggcacaccuccucccacugcc

SEQ ID NO: 3474184 - RNA, 17 nt, Human
ggcacacgccucccacu

SEQ ID NO: 3474185 - RNA, 18 nt, Human
ggcacacgccucccacug

SEQ ID NO: 3474186 - RNA, 22 nt, Human
ggcacacgcugcucugccccag

SEQ ID NO: 3474187 - RNA, 23 nt, Human
ggcacagaaaauggaagacagcu

SEQ ID NO: 3474188 - RNA, 12 nt, Human
ggcagcagccag

SEQ ID NO: 3474189 - RNA, 13 nt, Human
ggcagcagccagc

SEQ ID NO: 3474190 - RNA, 15 nt, Human
ggcagcagccagccc

SEQ ID NO: 3474191 - RNA, 22 nt, Human
ggcagcagccagcccugccugg

SEQ ID NO: 3474192 - RNA, 12 nt, Human
ggcagcagcccc

SEQ ID NO: 3474193 - RNA, 14 nt, Human
ggcagcagccccca

SEQ ID NO: 3474194 - RNA, 23 nt, Human
ggcagcagcccccagcucccacc

SEQ ID NO: 3474195 - RNA, 21 nt, Human
ggcagcaggccuguugcuuuu

SEQ ID NO: 3474196 - RNA, 18 nt, Human
ggcagcagggcuacccug

SEQ ID NO: 3474197 - RNA, 13 nt, Human
ggcagcaguguga

SEQ ID NO: 3474198 - RNA, 20 nt, Human
ggcagcagugugaggccagg

SEQ ID NO: 3474199 - RNA, 22 nt, Human
ggcagcagugugaggccagggc

SEQ ID NO: 3474200 - RNA, 20 nt, Human
ggcagccacacuucucagga

SEQ ID NO: 3474201 - RNA, 21 nt, Human
ggcagccacacuucucaggac

SEQ ID NO: 3474202 - RNA, 11 nt, Human
ggcagccagac

SEQ ID NO: 3474203 - RNA, 15 nt, Human
ggcagccagaccagc

SEQ ID NO: 3474204 - RNA, 16 nt, Human
ggcagccagcaucugg

SEQ ID NO: 3474205 - RNA, 15 nt, Human
ggcagccaggccaca

SEQ ID NO: 3474206 - RNA, 17 nt, Human
ggcagccaggccacaag

SEQ ID NO: 3474207 - RNA, 19 nt, Human
ggcagccaggcugccaagg

SEQ ID NO: 3474208 - RNA, 17 nt, Human
ggcagccagggagagcc

SEQ ID NO: 3474209 - RNA, 19 nt, Human
ggcagccagggagagccca

SEQ ID NO: 3474210 - RNA, 22 nt, Human
ggcagccagugagaugagggau

SEQ ID NO: 3474211 - RNA, 22 nt, Human
ggcagccagugcccugagccag

SEQ ID NO: 3474212 - RNA, 23 nt, Human
ggcagccagugcccugagccagg

SEQ ID NO: 3474213 - RNA, 11 nt, Human
ggcagcccagc

SEQ ID NO: 3474214 - RNA, 12 nt, Human
ggcagcccagcc

SEQ ID NO: 3474215 - RNA, 16 nt, Human
ggcagcccagccagcg

SEQ ID NO: 3474216 - RNA, 14 nt, Human
ggcagccccagcac

SEQ ID NO: 3474217 - RNA, 14 nt, Human
ggcagccccagccu

SEQ ID NO: 3474218 - RNA, 14 nt, Human
ggcagccccaggcc

SEQ ID NO: 3474219 - RNA, 17 nt, Human
ggcagcccgcaucagcu

SEQ ID NO: 3474220 - RNA, 13 nt, Human
ggcagcccuguag

SEQ ID NO: 3474221 - RNA, 15 nt, Human
ggcagcccuguaggg

SEQ ID NO: 3474222 - RNA, 11 nt, Human
ggcagcccuug

SEQ ID NO: 3474223 - RNA, 22 nt, Human
ggcagccgugccuucagcucua

SEQ ID NO: 3474224 - RNA, 21 nt, Human
ggcagccuacuagggaccugg

SEQ ID NO: 3474225 - RNA, 16 nt, Human
ggcagccuccagccug

SEQ ID NO: 3474226 - RNA, 14 nt, Human
ggcagccucccauc

SEQ ID NO: 3474227 - RNA, 12 nt, Human
ggcagccucugg

SEQ ID NO: 3474228 - RNA, 23 nt, Human
ggcagccucugggcccacauccg

SEQ ID NO: 3474229 - RNA, 20 nt, Human
ggcagccucugggggguggc

SEQ ID NO: 3474230 - RNA, 16 nt, Human
ggcagccucuucaaaa

SEQ ID NO: 3474231 - RNA, 13 nt, Human
ggcagccugagag

SEQ ID NO: 3474232 - RNA, 20 nt, Human
ggcagccuggacauagagag

SEQ ID NO: 3474233 - RNA, 18 nt, Human
ggcagccuggcucccagg

SEQ ID NO: 3474234 - RNA, 23 nt, Human
ggcagcgccaagcaaccuggguc

SEQ ID NO: 3474235 - RNA, 18 nt, Human
ggcagcgccaagugcgug

SEQ ID NO: 3474236 - RNA, 22 nt, Human
ggcagcgccaagugcgugccgu

SEQ ID NO: 3474237 - RNA, 21 nt, Human
ggcagcgcccuuccucuccac

SEQ ID NO: 3474238 - RNA, 18 nt, Human
ggcagcgcggggagcccg

SEQ ID NO: 3474239 - RNA, 21 nt, Human
ggcagcguacucaucaucaac

SEQ ID NO: 3474240 - RNA, 18 nt, Human
ggcagcucaccucucccu

SEQ ID NO: 3474241 - RNA, 12 nt, Human
ggcagcucagcu

SEQ ID NO: 3474242 - RNA, 23 nt, Human
ggcagcucauagaguccccccuc

SEQ ID NO: 3474243 - RNA, 13 nt, Human
ggcagcuccucug

SEQ ID NO: 3474244 - RNA, 16 nt, Human
ggcagcuccucugucu

SEQ ID NO: 3474245 - RNA, 18 nt, Human
ggcagcuccucugucucg

SEQ ID NO: 3474246 - RNA, 14 nt, Human
ggcagcucuccagu

SEQ ID NO: 3474247 - RNA, 17 nt, Human
ggcagcugaccauggaa

SEQ ID NO: 3474248 - RNA, 12 nt, Human
ggcagcugccac

SEQ ID NO: 3474249 - RNA, 14 nt, Human
ggcagcugccagag

SEQ ID NO: 3474250 - RNA, 16 nt, Human
ggcagcugccagagaa

SEQ ID NO: 3474251 - RNA, 17 nt, Human
ggcagcugccagagaag

SEQ ID NO: 3474252 - RNA, 21 nt, Human
ggcagcugcgguccacccagg

SEQ ID NO: 3474253 - RNA, 23 nt, Human
ggcagcugcgguccacccaggag

SEQ ID NO: 3474254 - RNA, 24 nt, Human
ggcagcugcgguccacccaggagc

SEQ ID NO: 3474255 - RNA, 11 nt, Human
ggcagcugcua

SEQ ID NO: 3474256 - RNA, 22 nt, Human
ggcagcugcuuuugucuauggg

SEQ ID NO: 3474257 - RNA, 16 nt, Human
ggcagcuggaugagac

SEQ ID NO: 3474258 - RNA, 14 nt, Human
ggcagcugggccca

SEQ ID NO: 3474259 - RNA, 18 nt, Human
ggcagcugggcccaaccc

SEQ ID NO: 3474260 - RNA, 16 nt, Human
ggcagcuguugucucu

SEQ ID NO: 3474261 - RNA, 16 nt, Human
ggcagcuuagggcccu

SEQ ID NO: 3474262 - RNA, 21 nt, Human
ggcagcuuagggcccuggagg

SEQ ID NO: 3474263 - RNA, 22 nt, Human
ggcagcuuagggcccuggaggc

SEQ ID NO: 3474264 - RNA, 20 nt, Human
ggcagcuucuauuagccagu

SEQ ID NO: 3474265 - RNA, 13 nt, Human
ggcagcuucuuug

SEQ ID NO: 3474266 - RNA, 15 nt, Human
ggcagcuugccccgg

SEQ ID NO: 3474267 - RNA, 21 nt, Human
ggcagcuuuaaccauuaaaac

SEQ ID NO: 3474268 - RNA, 13 nt, Human
ggcagcuuuuaaa

SEQ ID NO: 3474269 - RNA, 14 nt, Human
ggcaggaaggcuga

SEQ ID NO: 3474270 - RNA, 19 nt, Human
ggcaggacaacgaggaagc

SEQ ID NO: 3474271 - RNA, 19 nt, Human
ggcaggacacugcagaaca

SEQ ID NO: 3474272 - RNA, 23 nt, Human
ggcaggacaugcugaagccaaag

SEQ ID NO: 3474273 - RNA, 17 nt, Human
ggcaggaccagcccacg

SEQ ID NO: 3474274 - RNA, 18 nt, Human
ggcaggaccagcccacgc

SEQ ID NO: 3474275 - RNA, 14 nt, Human
ggcaggaccaggac

SEQ ID NO: 3474276 - RNA, 15 nt, Human
ggcaggaccaggacu

SEQ ID NO: 3474277 - RNA, 21 nt, Human
ggcaggaccucagaguccagg

SEQ ID NO: 3474278 - RNA, 21 nt, Human
ggcaggaccuucgggcugugc

SEQ ID NO: 3474279 - RNA, 21 nt, Human
ggcaggacucagcuccccaga

SEQ ID NO: 3474280 - RNA, 23 nt, Human
ggcaggagacuguggagacugcu

SEQ ID NO: 3474281 - RNA, 18 nt, Human
ggcaggaggaucacuuga

SEQ ID NO: 3474282 - RNA, 14 nt, Human
ggcaggagggaggu

SEQ ID NO: 3474283 - RNA, 19 nt, Human
ggcaggauggccuggccag

SEQ ID NO: 3474284 - RNA, 22 nt, Human
ggcaggauuggggaagagagcc

SEQ ID NO: 3474285 - RNA, 18 nt, Human
ggcaggcacagcacaggg

SEQ ID NO: 3474286 - RNA, 14 nt, Human
ggcaggcagcgcca

SEQ ID NO: 3474287 - RNA, 10 nt, Human
ggcaggcagg

SEQ ID NO: 3474288 - RNA, 18 nt, Human
ggcaggcaggcucccagg

SEQ ID NO: 3474289 - RNA, 23 nt, Human
ggcaggcagggcucuccuggcuu

SEQ ID NO: 3474290 - RNA, 10 nt, Human
ggcaggcagu

SEQ ID NO: 3474291 - RNA, 17 nt, Human
ggcaggcauggcccugg

SEQ ID NO: 3474292 - RNA, 13 nt, Human
ggcaggcauugag

SEQ ID NO: 3474293 - RNA, 10 nt, Human
ggcaggcccu

SEQ ID NO: 3474294 - RNA, 11 nt, Human
ggcaggcccug

SEQ ID NO: 3474295 - RNA, 16 nt, Human
ggcaggcccugcacug

SEQ ID NO: 3474296 - RNA, 22 nt, Human
ggcaggcccugcacuguccugc

SEQ ID NO: 3474297 - RNA, 17 nt, Human
ggcaggcuaaggcgugg

SEQ ID NO: 3474298 - RNA, 10 nt, Human
ggcaggcugg

SEQ ID NO: 3474299 - RNA, 20 nt, Human
ggcaggcuggccaguccagg

SEQ ID NO: 3474300 - RNA, 16 nt, Human
ggcaggcuggcuggcc

SEQ ID NO: 3474301 - RNA, 14 nt, Human
ggcaggcugggcca

SEQ ID NO: 3474302 - RNA, 23 nt, Human
ggcagggaaggggaggcagccgg

SEQ ID NO: 3474303 - RNA, 15 nt, Human
ggcagggaggcagcc

SEQ ID NO: 3474304 - RNA, 15 nt, Human
ggcagggaggucagg

SEQ ID NO: 3474305 - RNA, 14 nt, Human
ggcagggcacaggg

SEQ ID NO: 3474306 - RNA, 18 nt, Human
ggcagggcacagggccug

SEQ ID NO: 3474307 - RNA, 23 nt, Human
ggcagggcacagggccuggccca

SEQ ID NO: 3474308 - RNA, 15 nt, Human
ggcagggcaggacca

SEQ ID NO: 3474309 - RNA, 18 nt, Human
ggcagggccaacccuucu

SEQ ID NO: 3474310 - RNA, 16 nt, Human
ggcagggccccaggca

SEQ ID NO: 3474311 - RNA, 22 nt, Human
ggcagggccgcccgggcccaga

SEQ ID NO: 3474312 - RNA, 19 nt, Human
ggcagggccuagcugcuac

SEQ ID NO: 3474313 - RNA, 16 nt, Human
ggcagggccuugccca

SEQ ID NO: 3474314 - RNA, 19 nt, Human
ggcagggcgggcagagggc

SEQ ID NO: 3474315 - RNA, 21 nt, Human
ggcagggcgggcagagggcug

SEQ ID NO: 3474316 - RNA, 17 nt, Human
ggcagggcucccacaga

SEQ ID NO: 3474317 - RNA, 12 nt, Human
ggcagggcucuc

SEQ ID NO: 3474318 - RNA, 20 nt, Human
ggcagggcucuccuggcuuc

SEQ ID NO: 3474319 - RNA, 15 nt, Human
ggcagggcugacucu

SEQ ID NO: 3474320 - RNA, 11 nt, Human
ggcagggcugu

SEQ ID NO: 3474321 - RNA, 16 nt, Human
ggcaggggaggccauc

SEQ ID NO: 3474322 - RNA, 20 nt, Human
ggcaggggaggccaucugga

SEQ ID NO: 3474323 - RNA, 20 nt, Human
ggcaggggagggucagccag

SEQ ID NO: 3474324 - RNA, 12 nt, Human
ggcaggggccgg

SEQ ID NO: 3474325 - RNA, 14 nt, Human
ggcaggggcuuccu

SEQ ID NO: 3474326 - RNA, 15 nt, Human
ggcagggggcugcug

SEQ ID NO: 3474327 - RNA, 16 nt, Human
ggcagggggcugcugc

SEQ ID NO: 3474328 - RNA, 14 nt, Human
ggcagggguggggg

SEQ ID NO: 3474329 - RNA, 14 nt, Human
ggcagggugauaaa

SEQ ID NO: 3474330 - RNA, 14 nt, Human
ggcagguagccagg

SEQ ID NO: 3474331 - RNA, 15 nt, Human
ggcagguagccaggg

SEQ ID NO: 3474332 - RNA, 13 nt, Human
ggcagguccaggg

SEQ ID NO: 3474333 - RNA, 19 nt, Human
ggcagguccccagacucca

SEQ ID NO: 3474334 - RNA, 22 nt, Human
ggcuuucauuauuaguacugcu

SEQ ID NO: 3474335 - RNA, 19 nt, Human
ggcuuucauuuucucucag

SEQ ID NO: 3474336 - RNA, 22 nt, Human
ggcuuucccacuucccacccug

SEQ ID NO: 3474337 - RNA, 16 nt, Human
ggcuuucccuuaucaa

SEQ ID NO: 3474338 - RNA, 21 nt, Human
ggcuuucguccacagcuuccu

SEQ ID NO: 3474339 - RNA, 12 nt, Human
ggcuuucuggag

SEQ ID NO: 3474340 - RNA, 15 nt, Human
ggcuuugcaaccauu

SEQ ID NO: 3474341 - RNA, 17 nt, Human
ggcuuugccauugugaa

SEQ ID NO: 3474342 - RNA, 13 nt, Human
ggcuuuggcuucu

SEQ ID NO: 3474343 - RNA, 15 nt, Human
ggcuuuguauagaac

SEQ ID NO: 3474344 - RNA, 18 nt, Human
ggcuuugucccacagcuu

SEQ ID NO: 3474345 - RNA, 11 nt, Human
ggcuuuguguu

SEQ ID NO: 3474346 - RNA, 18 nt, Human
ggcuuuuacugaagccuu

SEQ ID NO: 3474347 - RNA, 14 nt, Human
ggcuuuucacugcu

SEQ ID NO: 3474348 - RNA, 15 nt, Human
ggcuuuucacugcug

SEQ ID NO: 3474349 - RNA, 17 nt, Human
ggcuuuucacugcuggc

SEQ ID NO: 3474350 - RNA, 19 nt, Human
ggcuuuucacugcuggcug

SEQ ID NO: 3474351 - RNA, 16 nt, Human
ggcuuuuuuuuucucu

SEQ ID NO: 3474352 - RNA, 17 nt, Human
ggcuuuuuuuuucucuu

SEQ ID NO: 3474353 - RNA, 16 nt, Human
gggaaaaaaaucaucu

SEQ ID NO: 3474354 - RNA, 20 nt, Human
gggaaaaaguugaugucaau

SEQ ID NO: 3474355 - RNA, 23 nt, Human
gggaaaagcauuuuucaauauau

SEQ ID NO: 3474356 - RNA, 22 nt, Human
gggaaacagcaucuccaagcag

SEQ ID NO: 3474357 - RNA, 20 nt, Human
gggaaaccuagagaagauaa

SEQ ID NO: 3474358 - RNA, 18 nt, Human
gggaaacuaagauucuuu

SEQ ID NO: 3474359 - RNA, 14 nt, Human
gggaaacuuggcuc

SEQ ID NO: 3474360 - RNA, 17 nt, Human
gggaaagacacugccug

SEQ ID NO: 3474361 - RNA, 20 nt, Human
gggaaagcaaagcacagaga

SEQ ID NO: 3474362 - RNA, 15 nt, Human
gggaaagccaccucu

SEQ ID NO: 3474363 - RNA, 21 nt, Human
gggaaaguauucucuuuucaa

SEQ ID NO: 3474364 - RNA, 14 nt, Human
gggaacaauuuggc

SEQ ID NO: 3474365 - RNA, 19 nt, Human
gggaacagacaacagaagu

SEQ ID NO: 3474366 - RNA, 14 nt, Human
gggaacagacugga

SEQ ID NO: 3474367 - RNA, 22 nt, Human
gggaacagacuggaagcacagc

SEQ ID NO: 3474368 - RNA, 20 nt, Human
gggaacagugugcaaggcag

SEQ ID NO: 3474369 - RNA, 14 nt, Human
gggaacaugccccc

SEQ ID NO: 3474370 - RNA, 12 nt, Human
gggaacaugggg

SEQ ID NO: 3474371 - RNA, 14 nt, Human
gggaacauggggag

SEQ ID NO: 3474372 - RNA, 19 nt, Human
gggaacauuucuguaaaua

SEQ ID NO: 3474373 - RNA, 18 nt, Human
gggaaccaugaagacagg

SEQ ID NO: 3474374 - RNA, 23 nt, Human
gggaacccugcccacucccagga

SEQ ID NO: 3474375 - RNA, 12 nt, Human
gggaaccucacu

SEQ ID NO: 3474376 - RNA, 17 nt, Human
gggaaccucccagaggu

SEQ ID NO: 3474377 - RNA, 16 nt, Human
gggaacgcccacuucc

SEQ ID NO: 3474378 - RNA, 16 nt, Human
gggaacucagauccag

SEQ ID NO: 3474379 - RNA, 19 nt, Human
gggaacucugacaagggcu

SEQ ID NO: 3474380 - RNA, 15 nt, Human
gggaacuggccaagc

SEQ ID NO: 3474381 - RNA, 20 nt, Human
gggaacuggccaagcugagg

SEQ ID NO: 3474382 - RNA, 19 nt, Human
gggaagaaaagagcuuucu

SEQ ID NO: 3474383 - RNA, 16 nt, Human
gggaagaaagagaagg

SEQ ID NO: 3474384 - RNA, 16 nt, Human
gggaagaagcagagag

SEQ ID NO: 3474385 - RNA, 22 nt, Human
gggaagacccauuccuucccag

SEQ ID NO: 3474386 - RNA, 15 nt, Human
gggaagacgaggccc

SEQ ID NO: 3474387 - RNA, 12 nt, Human
gggaagagaaac

SEQ ID NO: 3474388 - RNA, 22 nt, Human
gggaagagagccugcaggaucu

SEQ ID NO: 3474389 - RNA, 17 nt, Human
gggaagagaggaguuca

SEQ ID NO: 3474390 - RNA, 21 nt, Human
gggaagagaggaguucaauga

SEQ ID NO: 3474391 - RNA, 22 nt, Human
gggaagagaggaguucaaugau

SEQ ID NO: 3474392 - RNA, 23 nt, Human
gggaagagaggaguucaaugauc

SEQ ID NO: 3474393 - RNA, 17 nt, Human
gggaagagauccaaaga

SEQ ID NO: 3474394 - RNA, 19 nt, Human
gggaagagauccaaagacu

SEQ ID NO: 3474395 - RNA, 16 nt, Human
gggaagagcacagccc

SEQ ID NO: 3474396 - RNA, 17 nt, Human
gggaagaguguacuggg

SEQ ID NO: 3474397 - RNA, 22 nt, Human
gggaagauaggcucugcacaga

SEQ ID NO: 3474398 - RNA, 12 nt, Human
gggaagccagac

SEQ ID NO: 3474399 - RNA, 18 nt, Human
gggaagcccauccugacc

SEQ ID NO: 3474400 - RNA, 15 nt, Human
gggaagcuagucuuu

SEQ ID NO: 3474401 - RNA, 21 nt, Human
gggaagcugaggcgggagaau

SEQ ID NO: 3474402 - RNA, 13 nt, Human
gggaagcugcagc

SEQ ID NO: 3474403 - RNA, 16 nt, Human
gggaagcugcagcuug

SEQ ID NO: 3474404 - RNA, 22 nt, Human
gggaagcugcagcuugggagag

SEQ ID NO: 3474405 - RNA, 16 nt, Human
gggaagcuggccugag

SEQ ID NO: 3474406 - RNA, 19 nt, Human
gggaaggacagaaaggaga

SEQ ID NO: 3474407 - RNA, 13 nt, Human
gggaaggauacaa

SEQ ID NO: 3474408 - RNA, 23 nt, Human
gggaaggauacaaaagcauguga

SEQ ID NO: 3474409 - RNA, 21 nt, Human
gggaaggcaggcagggcucuc

SEQ ID NO: 3474410 - RNA, 22 nt, Human
gggaaggcagggagggccuggg

SEQ ID NO: 3474411 - RNA, 15 nt, Human
gggaaggccaccugc

SEQ ID NO: 3474412 - RNA, 12 nt, Human
gggaaggccagc

SEQ ID NO: 3474413 - RNA, 11 nt, Human
gggaaggccuc

SEQ ID NO: 3474414 - RNA, 22 nt, Human
gggaagggagccaagggaugga

SEQ ID NO: 3474415 - RNA, 16 nt, Human
gggaagggccagucug

SEQ ID NO: 3474416 - RNA, 16 nt, Human
gggaagggccugccca

SEQ ID NO: 3474417 - RNA, 16 nt, Human
gggaagggggcuggga

SEQ ID NO: 3474418 - RNA, 17 nt, Human
gggaagggggcugggac

SEQ ID NO: 3474419 - RNA, 20 nt, Human
gggaaguaguuaucauguua

SEQ ID NO: 3474420 - RNA, 14 nt, Human
gggaaguccccagg

SEQ ID NO: 3474421 - RNA, 23 nt, Human
gggaaguccccgaguuuccccag

SEQ ID NO: 3474422 - RNA, 17 nt, Human
gggaagugaggaagcca

SEQ ID NO: 3474423 - RNA, 16 nt, Human
gggaauauuguuucuu

SEQ ID NO: 3474424 - RNA, 13 nt, Human
gggaauauuugaa

SEQ ID NO: 3474425 - RNA, 12 nt, Human
gggaauauuuua

SEQ ID NO: 3474426 - RNA, 18 nt, Human
gggaauccaagccuccac

SEQ ID NO: 3474427 - RNA, 19 nt, Human
gggaauccccgaaggugcu

SEQ ID NO: 3474428 - RNA, 14 nt, Human
gggaaugaagcuug

SEQ ID NO: 3474429 - RNA, 15 nt, Human
gggaaugagcccaga

SEQ ID NO: 3474430 - RNA, 11 nt, Human
gggaaugaggg

SEQ ID NO: 3474431 - RNA, 16 nt, Human
gggaauggcacagccc

SEQ ID NO: 3474432 - RNA, 22 nt, Human
gggaauggcacagcccaaagaa

SEQ ID NO: 3474433 - RNA, 14 nt, Human
gggaauggcagcag

SEQ ID NO: 3474434 - RNA, 21 nt, Human
gggaauguaacugcugaaaac

SEQ ID NO: 3474435 - RNA, 20 nt, Human
gggaauguauuauucugcag

SEQ ID NO: 3474436 - RNA, 19 nt, Human
gggaauguuugccucugcc

SEQ ID NO: 3474437 - RNA, 23 nt, Human
gggaauguuugggcagaagggag

SEQ ID NO: 3474438 - RNA, 20 nt, Human
gggaauucucagugccaacu

SEQ ID NO: 3474439 - RNA, 14 nt, Human
gggaauucucuugg

SEQ ID NO: 3474440 - RNA, 22 nt, Human
gggaauugaggucugcucggcc

SEQ ID NO: 3474441 - RNA, 17 nt, Human
gggaauuucuucaacuc

SEQ ID NO: 3474442 - RNA, 15 nt, Human
gggacaaagaggccu

SEQ ID NO: 3474443 - RNA, 17 nt, Human
gggacaaaggagccugu

SEQ ID NO: 3474444 - RNA, 18 nt, Human
gggacaaauuuaaaacaa

SEQ ID NO: 3474445 - RNA, 15 nt, Human
gggacaaccuuggcu

SEQ ID NO: 3474446 - RNA, 18 nt, Human
gggacaaguggacucagg

SEQ ID NO: 3474447 - RNA, 19 nt, Human
gggacaaguggacucaggg

SEQ ID NO: 3474448 - RNA, 19 nt, Human
gggacacacuuagcuggag

SEQ ID NO: 3474449 - RNA, 17 nt, Human
gggacaccagggaagaa

SEQ ID NO: 3474450 - RNA, 22 nt, Human
gggacaccuaggcuaggguggg

SEQ ID NO: 3474451 - RNA, 14 nt, Human
gggacaccugcccu

SEQ ID NO: 3474452 - RNA, 17 nt, Human
gggacagagacaccugc

SEQ ID NO: 3474453 - RNA, 18 nt, Human
gggacagagacaccugca

SEQ ID NO: 3474454 - RNA, 18 nt, Human
gggacagaggccugcccg

SEQ ID NO: 3474455 - RNA, 14 nt, Human
gggacagauucagu

SEQ ID NO: 3474456 - RNA, 22 nt, Human
gggacagauucagucuugccuu

SEQ ID NO: 3474457 - RNA, 15 nt, Human
gggacaggaccccag

SEQ ID NO: 3474458 - RNA, 17 nt, Human
gggacaggaccccagcu

SEQ ID NO: 3474459 - RNA, 19 nt, Human
gggacaggaccccagcucu

SEQ ID NO: 3474460 - RNA, 12 nt, Human
gggacaggccuc

SEQ ID NO: 3474461 - RNA, 17 nt, Human
gggacaggccucaccuc

SEQ ID NO: 3474462 - RNA, 14 nt, Human
gggacagggcucgc

SEQ ID NO: 3474463 - RNA, 17 nt, Human
gggacagggcuggccca

SEQ ID NO: 3474464 - RNA, 18 nt, Human
gggacagggcuggcccag

SEQ ID NO: 3474465 - RNA, 19 nt, Human
gggacagggcuggcccagc

SEQ ID NO: 3474466 - RNA, 21 nt, Human
gggacagggcuggcccagccc

SEQ ID NO: 3474467 - RNA, 17 nt, Human
gggacaggggcaggagg

SEQ ID NO: 3474468 - RNA, 22 nt, Human
gggacagucaccucauggaauu

SEQ ID NO: 3474469 - RNA, 15 nt, Human
gggacagucucacca

SEQ ID NO: 3474470 - RNA, 17 nt, Human
gggacaucacagggugg

SEQ ID NO: 3474471 - RNA, 20 nt, Human
gggacauuccaaagaacagc

SEQ ID NO: 3474472 - RNA, 21 nt, Human
gggacauuugcucauggaauu

SEQ ID NO: 3474473 - RNA, 12 nt, Human
gggaccaaggca

SEQ ID NO: 3474474 - RNA, 17 nt, Human
gggaccaaggcaaggca

SEQ ID NO: 3474475 - RNA, 19 nt, Human
gggaccaaggcaaggcagg

SEQ ID NO: 3474476 - RNA, 21 nt, Human
gggaccacaggugcccgccac

SEQ ID NO: 3474477 - RNA, 19 nt, Human
gggaccacccugagccggc

SEQ ID NO: 3474478 - RNA, 20 nt, Human
gggccucaccgagugggggc

SEQ ID NO: 3474479 - RNA, 14 nt, Human
gggccucagugcca

SEQ ID NO: 3474480 - RNA, 22 nt, Human
gggccuccauuccuggagcccg

SEQ ID NO: 3474481 - RNA, 21 nt, Human
gggccuccucuguccagggcc

SEQ ID NO: 3474482 - RNA, 23 nt, Human
gggccucggaccccacuccggcc

SEQ ID NO: 3474483 - RNA, 14 nt, Human
gggccucgggaccu

SEQ ID NO: 3474484 - RNA, 20 nt, Human
gggccucuuaugggcugggu

SEQ ID NO: 3474485 - RNA, 14 nt, Human
gggccugagagaau

SEQ ID NO: 3474486 - RNA, 21 nt, Human
gggccugagcaguccuuggcc

SEQ ID NO: 3474487 - RNA, 17 nt, Human
gggccugagccaagcua

SEQ ID NO: 3474488 - RNA, 16 nt, Human
gggccugagccuggcc

SEQ ID NO: 3474489 - RNA, 16 nt, Human
gggccugauggggagg

SEQ ID NO: 3474490 - RNA, 21 nt, Human
gggccugcaggaccugccugu

SEQ ID NO: 3474491 - RNA, 24 nt, Human
gggccugcaggaccugccuguagc

SEQ ID NO: 3474492 - RNA, 14 nt, Human
gggccugccgggcu

SEQ ID NO: 3474493 - RNA, 21 nt, Human
gggccugccgggcugagggcc

SEQ ID NO: 3474494 - RNA, 12 nt, Human
gggccugccuca

SEQ ID NO: 3474495 - RNA, 14 nt, Human
gggccugccucacc

SEQ ID NO: 3474496 - RNA, 15 nt, Human
gggccugccucacca

SEQ ID NO: 3474497 - RNA, 14 nt, Human
gggccugccuggcc

SEQ ID NO: 3474498 - RNA, 13 nt, Human
gggccugcugcug

SEQ ID NO: 3474499 - RNA, 16 nt, Human
gggccugcugcugaga

SEQ ID NO: 3474500 - RNA, 22 nt, Human
gggccugcugcugagaaccugg

SEQ ID NO: 3474501 - RNA, 22 nt, Human
gggccuggcagccgugccuuca

SEQ ID NO: 3474502 - RNA, 15 nt, Human
gggccuggcucaggu

SEQ ID NO: 3474503 - RNA, 16 nt, Human
gggccuggcucaggug

SEQ ID NO: 3474504 - RNA, 13 nt, Human
gggccuggcuccc

SEQ ID NO: 3474505 - RNA, 15 nt, Human
gggccuggcuggcug

SEQ ID NO: 3474506 - RNA, 21 nt, Human
gggccugggacuuccaugccu

SEQ ID NO: 3474507 - RNA, 12 nt, Human
gggccugggagg

SEQ ID NO: 3474508 - RNA, 12 nt, Human
gggccugggcuc

SEQ ID NO: 3474509 - RNA, 13 nt, Human
gggccuggggccu

SEQ ID NO: 3474510 - RNA, 17 nt, Human
gggccuggggccugaga

SEQ ID NO: 3474511 - RNA, 18 nt, Human
gggccuggggccugagag

SEQ ID NO: 3474512 - RNA, 19 nt, Human
gggccuggggccugagaga

SEQ ID NO: 3474513 - RNA, 23 nt, Human
gggccuggucucacccuggaggc

SEQ ID NO: 3474514 - RNA, 15 nt, Human
gggccuguacagucu

SEQ ID NO: 3474515 - RNA, 17 nt, Human
gggccuguacagucugu

SEQ ID NO: 3474516 - RNA, 17 nt, Human
gggccuguacugccugc

SEQ ID NO: 3474517 - RNA, 16 nt, Human
gggccuguccacaggc

SEQ ID NO: 3474518 - RNA, 20 nt, Human
gggccuuaggaagagccuuc

SEQ ID NO: 3474519 - RNA, 18 nt, Human
gggccuuggccuggagca

SEQ ID NO: 3474520 - RNA, 13 nt, Human
gggccuugggcuc

SEQ ID NO: 3474521 - RNA, 21 nt, Human
gggccuuuucuggcaccgcag

SEQ ID NO: 3474522 - RNA, 12 nt, Human
gggcgaggcaga

SEQ ID NO: 3474523 - RNA, 13 nt, Human
gggcgaggcagag

SEQ ID NO: 3474524 - RNA, 21 nt, Human
gggcgcccaccuccccacgcc

SEQ ID NO: 3474525 - RNA, 13 nt, Human
gggcgccuguggu

SEQ ID NO: 3474526 - RNA, 23 nt, Human
gggcgcggccagccccggcccug

SEQ ID NO: 3474527 - RNA, 14 nt, Human
gggcgcggcuggga

SEQ ID NO: 3474528 - RNA, 20 nt, Human
gggcgcgugaggcccguggg

SEQ ID NO: 3474529 - RNA, 12 nt, Human
gggcgcuggccc

SEQ ID NO: 3474530 - RNA, 14 nt, Human
gggcgcuggcccag

SEQ ID NO: 3474531 - RNA, 14 nt, Human
gggcggcacagccu

SEQ ID NO: 3474532 - RNA, 13 nt, Human
gggcggcugagag

SEQ ID NO: 3474533 - RNA, 20 nt, Human
gggcgggcagcacagcaagg

SEQ ID NO: 3474534 - RNA, 15 nt, Human
gggcgggccccucau

SEQ ID NO: 3474535 - RNA, 14 nt, Human
gggcggggccuugc

SEQ ID NO: 3474536 - RNA, 14 nt, Human
gggcggggguggcg

SEQ ID NO: 3474537 - RNA, 19 nt, Human
gggcgugagaccugccccu

SEQ ID NO: 3474538 - RNA, 13 nt, Human
gggcguggaggga

SEQ ID NO: 3474539 - RNA, 15 nt, Human
gggcgugguggcagg

SEQ ID NO: 3474540 - RNA, 15 nt, Human
gggcgugguggugag

SEQ ID NO: 3474541 - RNA, 13 nt, Human
gggcuacaagagg

SEQ ID NO: 3474542 - RNA, 23 nt, Human
gggcuacaccuuagccugcccuc

SEQ ID NO: 3474543 - RNA, 12 nt, Human
gggcuaccagga

SEQ ID NO: 3474544 - RNA, 13 nt, Human
gggcuacccugag

SEQ ID NO: 3474545 - RNA, 20 nt, Human
gggcuacugcagcuuuacau

SEQ ID NO: 3474546 - RNA, 17 nt, Human
gggcuagaaccuggagg

SEQ ID NO: 3474547 - RNA, 17 nt, Human
gggcuagguagaaaaag

SEQ ID NO: 3474548 - RNA, 16 nt, Human
gggcuauggacacagg

SEQ ID NO: 3474549 - RNA, 17 nt, Human
gggcuauggacacaggg

SEQ ID NO: 3474550 - RNA, 17 nt, Human
gggcuaugguguggacu

SEQ ID NO: 3474551 - RNA, 18 nt, Human
gggcucaaucucuggggg

SEQ ID NO: 3474552 - RNA, 18 nt, Human
gggcucagagugggguag

SEQ ID NO: 3474553 - RNA, 10 nt, Human
gggcucagca

SEQ ID NO: 3474554 - RNA, 13 nt, Human
gggcucagcaagg

SEQ ID NO: 3474555 - RNA, 15 nt, Human
gggcucagcaaggcc

SEQ ID NO: 3474556 - RNA, 21 nt, Human
gggcucagcaaggccaccucu

SEQ ID NO: 3474557 - RNA, 11 nt, Human
gggcucagccu

SEQ ID NO: 3474558 - RNA, 12 nt, Human
gggcucagccug

SEQ ID NO: 3474559 - RNA, 13 nt, Human
gggcucagccugg

SEQ ID NO: 3474560 - RNA, 17 nt, Human
gggcucagcggggacag

SEQ ID NO: 3474561 - RNA, 14 nt, Human
gggcucagcucugg

SEQ ID NO: 3474562 - RNA, 17 nt, Human
gggcucagggaccacag

SEQ ID NO: 3474563 - RNA, 13 nt, Human
gggcuccagacac

SEQ ID NO: 3474564 - RNA, 13 nt, Human
gggcuccagccau

SEQ ID NO: 3474565 - RNA, 18 nt, Human
gggcuccccuuucgccca

SEQ ID NO: 3474566 - RNA, 15 nt, Human
gggcucccgggcccc

SEQ ID NO: 3474567 - RNA, 20 nt, Human
gggcucccggguccuuggcc

SEQ ID NO: 3474568 - RNA, 18 nt, Human
gggcucccugacugggag

SEQ ID NO: 3474569 - RNA, 17 nt, Human
gggcucccuucccaccu

SEQ ID NO: 3474570 - RNA, 18 nt, Human
gggcucccuucccaccuc

SEQ ID NO: 3474571 - RNA, 13 nt, Human
gggcucccuuccu

SEQ ID NO: 3474572 - RNA, 22 nt, Human
gggcuccuccaggguggcagca

SEQ ID NO: 3474573 - RNA, 21 nt, Human
gggcuccugccuucuguccug

SEQ ID NO: 3474574 - RNA, 12 nt, Human
gggcuccuggaa

SEQ ID NO: 3474575 - RNA, 20 nt, Human
gggcuccuggaaaggcucag

SEQ ID NO: 3474576 - RNA, 23 nt, Human
gggcuccuggaaaggcucagucu

SEQ ID NO: 3474577 - RNA, 18 nt, Human
gggcuccuggcagaaggg

SEQ ID NO: 3474578 - RNA, 14 nt, Human
gggcuccugugccc

SEQ ID NO: 3474579 - RNA, 15 nt, Human
gggcuccugugcccu

SEQ ID NO: 3474580 - RNA, 14 nt, Human
gggcucggaggcug

SEQ ID NO: 3474581 - RNA, 21 nt, Human
gggcucuaacgccugagccca

SEQ ID NO: 3474582 - RNA, 17 nt, Human
gggcucuccaccucagc

SEQ ID NO: 3474583 - RNA, 18 nt, Human
gggcucuccaccucagcc

SEQ ID NO: 3474584 - RNA, 21 nt, Human
gggcucuccaccucagccuug

SEQ ID NO: 3474585 - RNA, 13 nt, Human
gggcucugcccca

SEQ ID NO: 3474586 - RNA, 20 nt, Human
gggcucugccucccaucacc

SEQ ID NO: 3474587 - RNA, 14 nt, Human
gggcucuggagaga

SEQ ID NO: 3474588 - RNA, 15 nt, Human
gggcucuggagagaa

SEQ ID NO: 3474589 - RNA, 16 nt, Human
gggcucuggagagaaa

SEQ ID NO: 3474590 - RNA, 11 nt, Human
gggcucugugg

SEQ ID NO: 3474591 - RNA, 12 nt, Human
gggcucuucuca

SEQ ID NO: 3474592 - RNA, 15 nt, Human
gggcucuucucauuu

SEQ ID NO: 3474593 - RNA, 17 nt, Human
gggcugaagguugaaga

SEQ ID NO: 3474594 - RNA, 19 nt, Human
gggcugaagguugaagagg

SEQ ID NO: 3474595 - RNA, 20 nt, Human
gggcugaccuuccucgcaga

SEQ ID NO: 3474596 - RNA, 16 nt, Human
gggcugacugggccag

SEQ ID NO: 3474597 - RNA, 10 nt, Human
gggcugagac

SEQ ID NO: 3474598 - RNA, 18 nt, Human
gggcugagagaaccucac

SEQ ID NO: 3474599 - RNA, 14 nt, Human
gggcugagccccua

SEQ ID NO: 3474600 - RNA, 15 nt, Human
gggcugagccccuac

SEQ ID NO: 3474601 - RNA, 23 nt, Human
gggcugagccccuaccccacacc

SEQ ID NO: 3474602 - RNA, 17 nt, Human
gggcugagcccuggcag

SEQ ID NO: 3474603 - RNA, 18 nt, Human
gggcugagcccuggcagg

SEQ ID NO: 3474604 - RNA, 18 nt, Human
gggcugaggggcaacgaa

SEQ ID NO: 3474605 - RNA, 20 nt, Human
gggcugcaccggcuggccug

SEQ ID NO: 3474606 - RNA, 19 nt, Human
gggcugcacucugugccca

SEQ ID NO: 3474607 - RNA, 20 nt, Human
gggcugcacucugugcccau

SEQ ID NO: 3474608 - RNA, 11 nt, Human
gggcugcauga

SEQ ID NO: 3474609 - RNA, 18 nt, Human
gggcugcaugcgggcuuc

SEQ ID NO: 3474610 - RNA, 20 nt, Human
gggcugccccuaaucucugu

SEQ ID NO: 3474611 - RNA, 19 nt, Human
gggcugcccgcucccagug

SEQ ID NO: 3474612 - RNA, 12 nt, Human
gggcugcccugc

SEQ ID NO: 3474613 - RNA, 14 nt, Human
gggcugcccuggug

SEQ ID NO: 3474614 - RNA, 21 nt, Human
gggcugcccuggugcugccac

SEQ ID NO: 3474615 - RNA, 13 nt, Human
gggcugccugggc

SEQ ID NO: 3474616 - RNA, 13 nt, Human
gggcugcucccac

SEQ ID NO: 3474617 - RNA, 21 nt, Human
gggcugcucccaccuggcucu

SEQ ID NO: 3474618 - RNA, 22 nt, Human
gggcugcucccaccuggcucug

SEQ ID NO: 3474619 - RNA, 11 nt, Human
gggcugcuccu

SEQ ID NO: 3474620 - RNA, 18 nt, Human
gggcugcuccuccagggc

SEQ ID NO: 3474621 - RNA, 17 nt, Human
gggcugcuuccuccugg

SEQ ID NO: 3474622 - RNA, 19 nt, Human
gggcugcuuccuccuggaa

SEQ ID NO: 3474623 - RNA, 23 nt, Human
gggcuggaacagauucacacugu

SEQ ID NO: 3474624 - RNA, 15 nt, Human
gggcuggacugaggc

SEQ ID NO: 3474625 - RNA, 19 nt, Human
guaacacuaauauauuuaa

SEQ ID NO: 3474626 - RNA, 22 nt, Human
guaacacuaauauauuuaaaaa

SEQ ID NO: 3474627 - RNA, 13 nt, Human
guaacagacauug

SEQ ID NO: 3474628 - RNA, 14 nt, Human
guaacagacauugu

SEQ ID NO: 3474629 - RNA, 16 nt, Human
guaacagcuccuuggg

SEQ ID NO: 3474630 - RNA, 18 nt, Human
guaacagcuccuugggag

SEQ ID NO: 3474631 - RNA, 21 nt, Human
guaacagcuccuugggaggaa

SEQ ID NO: 3474632 - RNA, 16 nt, Human
guaacagcugaggucu

SEQ ID NO: 3474633 - RNA, 20 nt, Human
guaacaggaaaauuuuaaaa

SEQ ID NO: 3474634 - RNA, 14 nt, Human
guaacaggucuccu

SEQ ID NO: 3474635 - RNA, 18 nt, Human
guaacagucugaucguga

SEQ ID NO: 3474636 - RNA, 15 nt, Human
guaacaucaaagauu

SEQ ID NO: 3474637 - RNA, 19 nt, Human
guaacaucacuauccaugc

SEQ ID NO: 3474638 - RNA, 17 nt, Human
guaacauccuuucuauu

SEQ ID NO: 3474639 - RNA, 23 nt, Human
guaacauguguuaaguauuuuca

SEQ ID NO: 3474640 - RNA, 23 nt, Human
guaacauuggguccugggucuuu

SEQ ID NO: 3474641 - RNA, 19 nt, Human
guaacauuugcuguuuuaa

SEQ ID NO: 3474642 - RNA, 12 nt, Human
guaaccucagcu

SEQ ID NO: 3474643 - RNA, 18 nt, Human
guaaccucagcucuggga

SEQ ID NO: 3474644 - RNA, 18 nt, Human
guaaccugagauggcccu

SEQ ID NO: 3474645 - RNA, 18 nt, Human
guaacgugugcuguguuu

SEQ ID NO: 3474646 - RNA, 15 nt, Human
guaacguugcugugg

SEQ ID NO: 3474647 - RNA, 13 nt, Human
guaacucaucugu

SEQ ID NO: 3474648 - RNA, 17 nt, Human
guaacuccaccaaccca

SEQ ID NO: 3474649 - RNA, 13 nt, Human
guaacugacauga

SEQ ID NO: 3474650 - RNA, 18 nt, Human
guaacugcauugagaacu

SEQ ID NO: 3474651 - RNA, 12 nt, Human
guaacugccagg

SEQ ID NO: 3474652 - RNA, 14 nt, Human
guaacugccuagaa

SEQ ID NO: 3474653 - RNA, 17 nt, Human
guaacugccuagaaaca

SEQ ID NO: 3474654 - RNA, 19 nt, Human
guaacugcuuucuguucca

SEQ ID NO: 3474655 - RNA, 22 nt, Human
guaacugcuuucuguuccaaau

SEQ ID NO: 3474656 - RNA, 12 nt, Human
guaacugucagg

SEQ ID NO: 3474657 - RNA, 13 nt, Human
guaacuguccugu

SEQ ID NO: 3474658 - RNA, 16 nt, Human
guaacuguccuguccu

SEQ ID NO: 3474659 - RNA, 14 nt, Human
guaacugugucaug

SEQ ID NO: 3474660 - RNA, 12 nt, Human
guaacuguuacc

SEQ ID NO: 3474661 - RNA, 13 nt, Human
guaacuguucuug

SEQ ID NO: 3474662 - RNA, 15 nt, Human
guaacuuauauugaa

SEQ ID NO: 3474663 - RNA, 19 nt, Human
guaacuuauauugaagaca

SEQ ID NO: 3474664 - RNA, 15 nt, Human
guaacuuauguagau

SEQ ID NO: 3474665 - RNA, 20 nt, Human
guaacuucacauuaaaaaau

SEQ ID NO: 3474666 - RNA, 18 nt, Human
guaacuuccaaauaaaua

SEQ ID NO: 3474667 - RNA, 20 nt, Human
guaacuucuuauggaauuga

SEQ ID NO: 3474668 - RNA, 21 nt, Human
guaacuugauccauuucuaau

SEQ ID NO: 3474669 - RNA, 17 nt, Human
guaacuugguuauacau

SEQ ID NO: 3474670 - RNA, 18 nt, Human
guaacuugguuauacaug

SEQ ID NO: 3474671 - RNA, 23 nt, Human
guaacuugguuauacaugacacu

SEQ ID NO: 3474672 - RNA, 15 nt, Human
guaacuuuaugugua

SEQ ID NO: 3474673 - RNA, 18 nt, Human
guaacuuuauucuugaaa

SEQ ID NO: 3474674 - RNA, 14 nt, Human
guaacuuuuguaag

SEQ ID NO: 3474675 - RNA, 17 nt, Human
guaacuuuuguaagaca

SEQ ID NO: 3474676 - RNA, 22 nt, Human
guaagaaaauauuuugucuaaa

SEQ ID NO: 3474677 - RNA, 22 nt, Human
guaagaaaucucccaugugcau

SEQ ID NO: 3474678 - RNA, 15 nt, Human
guaagaagacaugaa

SEQ ID NO: 3474679 - RNA, 22 nt, Human
guaagaaguuucuuaaacauug

SEQ ID NO: 3474680 - RNA, 17 nt, Human
guaagaauucagaagac

SEQ ID NO: 3474681 - RNA, 10 nt, Human
guaagagacu

SEQ ID NO: 3474682 - RNA, 15 nt, Human
guaagagcaaaagaa

SEQ ID NO: 3474683 - RNA, 14 nt, Human
guaagaguguuuau

SEQ ID NO: 3474684 - RNA, 11 nt, Human
guaagaugcug

SEQ ID NO: 3474685 - RNA, 14 nt, Human
guaagauuuugaaa

SEQ ID NO: 3474686 - RNA, 16 nt, Human
guaagauuuugaaaac

SEQ ID NO: 3474687 - RNA, 15 nt, Human
guaagcaucuacuuc

SEQ ID NO: 3474688 - RNA, 21 nt, Human
guaagcggcucaagcccagga

SEQ ID NO: 3474689 - RNA, 12 nt, Human
guaagcuguuua

SEQ ID NO: 3474690 - RNA, 18 nt, Human
guaagcuguuugguuuua

SEQ ID NO: 3474691 - RNA, 14 nt, Human
guaaggaaugcuug

SEQ ID NO: 3474692 - RNA, 14 nt, Human
guaaggcaugaagg

SEQ ID NO: 3474693 - RNA, 13 nt, Human
guaaggcucuaga

SEQ ID NO: 3474694 - RNA, 15 nt, Human
guaagggauuucuua

SEQ ID NO: 3474695 - RNA, 14 nt, Human
guaaggugagggaa

SEQ ID NO: 3474696 - RNA, 17 nt, Human
guaaggugcuuggaguu

SEQ ID NO: 3474697 - RNA, 18 nt, Human
guaaguaauuaugcacua

SEQ ID NO: 3474698 - RNA, 13 nt, Human
guaaguacagaga

SEQ ID NO: 3474699 - RNA, 14 nt, Human
guaaguacagagaa

SEQ ID NO: 3474700 - RNA, 17 nt, Human
guaaguacagagaagcc

SEQ ID NO: 3474701 - RNA, 18 nt, Human
guaaguacagagaagcca

SEQ ID NO: 3474702 - RNA, 12 nt, Human
guaagugccuuc

SEQ ID NO: 3474703 - RNA, 14 nt, Human
guaagugccuucca

SEQ ID NO: 3474704 - RNA, 16 nt, Human
guaagugggcccaccc

SEQ ID NO: 3474705 - RNA, 17 nt, Human
guaagugggcccacccg

SEQ ID NO: 3474706 - RNA, 18 nt, Human
guaaguuaauguauauaa

SEQ ID NO: 3474707 - RNA, 19 nt, Human
guaaguugggcuugcuauu

SEQ ID NO: 3474708 - RNA, 13 nt, Human
guaaguuucaggu

SEQ ID NO: 3474709 - RNA, 13 nt, Human
guaaguuuuuuga

SEQ ID NO: 3474710 - RNA, 12 nt, Human
guaauaaaguau

SEQ ID NO: 3474711 - RNA, 12 nt, Human
guaauaaagugu

SEQ ID NO: 3474712 - RNA, 13 nt, Human
guaauaaauauga

SEQ ID NO: 3474713 - RNA, 14 nt, Human
guaauaaauaugag

SEQ ID NO: 3474714 - RNA, 16 nt, Human
guaauaaauaugagug

SEQ ID NO: 3474715 - RNA, 21 nt, Human
guaauaagcacuguaaacuuc

SEQ ID NO: 3474716 - RNA, 13 nt, Human
guaauaauaccuc

SEQ ID NO: 3474717 - RNA, 21 nt, Human
guaauaauaccucaauguuug

SEQ ID NO: 3474718 - RNA, 16 nt, Human
guaauaauagacugua

SEQ ID NO: 3474719 - RNA, 19 nt, Human
guaauaaugcuaaagaaaa

SEQ ID NO: 3474720 - RNA, 17 nt, Human
guaauaaugugaaucau

SEQ ID NO: 3474721 - RNA, 21 nt, Human
guaauaccucuaauaguauaa

SEQ ID NO: 3474722 - RNA, 22 nt, Human
guaauaccucuaauaguauaaa

SEQ ID NO: 3474723 - RNA, 23 nt, Human
guaauacuucuuguguguaugca

SEQ ID NO: 3474724 - RNA, 15 nt, Human
guaauagaaaacuga

SEQ ID NO: 3474725 - RNA, 12 nt, Human
guaauauaaaag

SEQ ID NO: 3474726 - RNA, 19 nt, Human
guaauauaauggaagagaa

SEQ ID NO: 3474727 - RNA, 18 nt, Human
guaauauauugcugcugg

SEQ ID NO: 3474728 - RNA, 12 nt, Human
guaauauauuua

SEQ ID NO: 3474729 - RNA, 18 nt, Human
guaauaugcacacauuuu

SEQ ID NO: 3474730 - RNA, 19 nt, Human
guaauauugacuuguauau

SEQ ID NO: 3474731 - RNA, 20 nt, Human
guaauauugacuuguauauu

SEQ ID NO: 3474732 - RNA, 12 nt, Human
guaauauuuaca

SEQ ID NO: 3474733 - RNA, 18 nt, Human
guaauauuuacaauguau

SEQ ID NO: 3474734 - RNA, 19 nt, Human
guaauauuuacaauguauu

SEQ ID NO: 3474735 - RNA, 18 nt, Human
guaauauuuauauauuua

SEQ ID NO: 3474736 - RNA, 13 nt, Human
guaauauuuauua

SEQ ID NO: 3474737 - RNA, 14 nt, Human
guaauauuuauuaa

SEQ ID NO: 3474738 - RNA, 18 nt, Human
guaauauuuuuauauaca

SEQ ID NO: 3474739 - RNA, 18 nt, Human
guaaucaauaaacgauuu

SEQ ID NO: 3474740 - RNA, 19 nt, Human
guaaucaauaaagaaaacu

SEQ ID NO: 3474741 - RNA, 12 nt, Human
guaaucauauua

SEQ ID NO: 3474742 - RNA, 16 nt, Human
guaaucaucuaaguca

SEQ ID NO: 3474743 - RNA, 21 nt, Human
guaauccaagcaaaugugaau

SEQ ID NO: 3474744 - RNA, 12 nt, Human
guaaucccagca

SEQ ID NO: 3474745 - RNA, 16 nt, Human
guaaucccagcacacu

SEQ ID NO: 3474746 - RNA, 16 nt, Human
guaaucccagcacuuu

SEQ ID NO: 3474747 - RNA, 20 nt, Human
guaaucccagcuacuuggga

SEQ ID NO: 3474748 - RNA, 19 nt, Human
guaaucccccaggagaaca

SEQ ID NO: 3474749 - RNA, 17 nt, Human
guaauccccuaaaauaa

SEQ ID NO: 3474750 - RNA, 17 nt, Human
guaaucugagaaacaau

SEQ ID NO: 3474751 - RNA, 17 nt, Human
guaaucugaucguucuu

SEQ ID NO: 3474752 - RNA, 16 nt, Human
guaaucuguauaauac

SEQ ID NO: 3474753 - RNA, 12 nt, Human
guaaucugugua

SEQ ID NO: 3474754 - RNA, 17 nt, Human
guaaucuuguugguuca

SEQ ID NO: 3474755 - RNA, 19 nt, Human
guaaucuuuaccuguauac

SEQ ID NO: 3474756 - RNA, 19 nt, Human
guaaugaaccgcugaauau

SEQ ID NO: 3474757 - RNA, 21 nt, Human
guaaugaauuuuuaugauauu

SEQ ID NO: 3474758 - RNA, 21 nt, Human
guaaugauauagccagaaaaa

SEQ ID NO: 3474759 - RNA, 15 nt, Human
guaaugcgauuuuau

SEQ ID NO: 3474760 - RNA, 16 nt, Human
guaaugcgauuuuauu

SEQ ID NO: 3474761 - RNA, 14 nt, Human
guaaugcugcacuu

SEQ ID NO: 3474762 - RNA, 21 nt, Human
guaaugcuuaagggaguuuaa

SEQ ID NO: 3474763 - RNA, 16 nt, Human
guaauggcaguuauau

SEQ ID NO: 3474764 - RNA, 14 nt, Human
guaaugguguagaa

SEQ ID NO: 3474765 - RNA, 20 nt, Human
guaaugucaccaccuuccca

SEQ ID NO: 3474766 - RNA, 22 nt, Human
guaaugucaccaccuucccagc

SEQ ID NO: 3474767 - RNA, 18 nt, Human
guaauguuaauauugauu

SEQ ID NO: 3474768 - RNA, 21 nt, Human
guaauguuacugaucaugcau

SEQ ID NO: 3474769 - RNA, 14 nt, Human
guaauguugugaau

SEQ ID NO: 3474770 - RNA, 18 nt, Human
guaauguugugaauaauu

SEQ ID NO: 3474771 - RNA, 13 nt, Human
guaauuaaacugu

SEQ ID NO: 3474772 - RNA, 17 nt, Human
guaguucucuugguguu

SEQ ID NO: 3474773 - RNA, 20 nt, Human
guaguucugcuccagacagg

SEQ ID NO: 3474774 - RNA, 19 nt, Human
guaguugaggaaagcacag

SEQ ID NO: 3474775 - RNA, 18 nt, Human
guaguugcaauagaacag

SEQ ID NO: 3474776 - RNA, 17 nt, Human
guaguugccuuaaaaua

SEQ ID NO: 3474777 - RNA, 12 nt, Human
guaguugucuuu

SEQ ID NO: 3474778 - RNA, 16 nt, Human
guaguugucuuuccug

SEQ ID NO: 3474779 - RNA, 13 nt, Human
guaguuuuuucaa

SEQ ID NO: 3474780 - RNA, 15 nt, Human
guauaaaaaaaauag

SEQ ID NO: 3474781 - RNA, 23 nt, Human
guauaaaaauaaaaaagauccca

SEQ ID NO: 3474782 - RNA, 18 nt, Human
guauaaaacuuuccucgc

SEQ ID NO: 3474783 - RNA, 19 nt, Human
guauaaaacuuuccucgcc

SEQ ID NO: 3474784 - RNA, 21 nt, Human
guauaaaacuuuccucgccug

SEQ ID NO: 3474785 - RNA, 12 nt, Human
guauaaaagaug

SEQ ID NO: 3474786 - RNA, 17 nt, Human
guauaaaagccuguuua

SEQ ID NO: 3474787 - RNA, 12 nt, Human
guauaaaauaca

SEQ ID NO: 3474788 - RNA, 15 nt, Human
guauaaaaucagcca

SEQ ID NO: 3474789 - RNA, 14 nt, Human
guauaaacaaaguu

SEQ ID NO: 3474790 - RNA, 15 nt, Human
guauaaacaagaaaa

SEQ ID NO: 3474791 - RNA, 23 nt, Human
guauaaacaagaaaaauaaagaa

SEQ ID NO: 3474792 - RNA, 12 nt, Human
guauaaacuuuu

SEQ ID NO: 3474793 - RNA, 13 nt, Human
guauaaauaggag

SEQ ID NO: 3474794 - RNA, 23 nt, Human
guauaaaugaaguuuauacagua

SEQ ID NO: 3474795 - RNA, 14 nt, Human
guauaaauguauau

SEQ ID NO: 3474796 - RNA, 18 nt, Human
guauaaaugucuuuaaug

SEQ ID NO: 3474797 - RNA, 12 nt, Human
guauaaauuuau

SEQ ID NO: 3474798 - RNA, 14 nt, Human
guauaaauuuauuu

SEQ ID NO: 3474799 - RNA, 15 nt, Human
guauaacagguuauu

SEQ ID NO: 3474800 - RNA, 20 nt, Human
guauaacagguuauuuuagu

SEQ ID NO: 3474801 - RNA, 22 nt, Human
guauaacagguuauuuuaguuu

SEQ ID NO: 3474802 - RNA, 20 nt, Human
guauaacuucuuaaaaguug

SEQ ID NO: 3474803 - RNA, 18 nt, Human
guauaacuuuaacuucug

SEQ ID NO: 3474804 - RNA, 17 nt, Human
guauaagaaaugcauau

SEQ ID NO: 3474805 - RNA, 14 nt, Human
guauaagauccuag

SEQ ID NO: 3474806 - RNA, 16 nt, Human
guauaaguaagaaaau

SEQ ID NO: 3474807 - RNA, 21 nt, Human
guauaaguggaggcacuuuag

SEQ ID NO: 3474808 - RNA, 13 nt, Human
guauaauauugaa

SEQ ID NO: 3474809 - RNA, 15 nt, Human
guauaauguuuauua

SEQ ID NO: 3474810 - RNA, 13 nt, Human
guauaauuaacau

SEQ ID NO: 3474811 - RNA, 22 nt, Human
guauaauuaacauguuaaacca

SEQ ID NO: 3474812 - RNA, 12 nt, Human
guauaauugugu

SEQ ID NO: 3474813 - RNA, 21 nt, Human
guauaauugugugauauuuca

SEQ ID NO: 3474814 - RNA, 19 nt, Human
guauacaaauauauuguua

SEQ ID NO: 3474815 - RNA, 18 nt, Human
guauacaagauaagcuuc

SEQ ID NO: 3474816 - RNA, 14 nt, Human
guauacaaguacug

SEQ ID NO: 3474817 - RNA, 14 nt, Human
guauacaauauaua

SEQ ID NO: 3474818 - RNA, 18 nt, Human
guauacaauauauaaaaa

SEQ ID NO: 3474819 - RNA, 19 nt, Human
guauacaauauauaaaaau

SEQ ID NO: 3474820 - RNA, 21 nt, Human
guauacaauauauaaaaauau

SEQ ID NO: 3474821 - RNA, 22 nt, Human
guauacaauauauaaaaauaua

SEQ ID NO: 3474822 - RNA, 18 nt, Human
guauacauccuggguaau

SEQ ID NO: 3474823 - RNA, 19 nt, Human
guauaccggaauuacuuuu

SEQ ID NO: 3474824 - RNA, 15 nt, Human
guauacuguaggcac

SEQ ID NO: 3474825 - RNA, 21 nt, Human
guauacuuccuuacuuuuaag

SEQ ID NO: 3474826 - RNA, 12 nt, Human
guauacuuuaaa

SEQ ID NO: 3474827 - RNA, 23 nt, Human
guauacuuuaaauaauuuaacua

SEQ ID NO: 3474828 - RNA, 13 nt, Human
guauacuuuagua

SEQ ID NO: 3474829 - RNA, 22 nt, Human
guauagaaaugcugguuuuuca

SEQ ID NO: 3474830 - RNA, 18 nt, Human
guauagaagucuucauga

SEQ ID NO: 3474831 - RNA, 22 nt, Human
guauagacaguuuguaaauguu

SEQ ID NO: 3474832 - RNA, 23 nt, Human
guauagacaguuuguaaauguua

SEQ ID NO: 3474833 - RNA, 16 nt, Human
guauagaugcaagaua

SEQ ID NO: 3474834 - RNA, 23 nt, Human
guauagccuauggcagaaaaaau

SEQ ID NO: 3474835 - RNA, 13 nt, Human
guauaguauuuga

SEQ ID NO: 3474836 - RNA, 14 nt, Human
guauaguauuugaa

SEQ ID NO: 3474837 - RNA, 16 nt, Human
guauaguguaaaauaa

SEQ ID NO: 3474838 - RNA, 14 nt, Human
guauaguuaacaca

SEQ ID NO: 3474839 - RNA, 22 nt, Human
guauauaaaggaaaaaagagaa

SEQ ID NO: 3474840 - RNA, 20 nt, Human
guauauaaaugggaacauuu

SEQ ID NO: 3474841 - RNA, 21 nt, Human
guauauaaaugggaacauuua

SEQ ID NO: 3474842 - RNA, 21 nt, Human
guauauaauuuuuuuauguuu

SEQ ID NO: 3474843 - RNA, 12 nt, Human
guauauacuuug

SEQ ID NO: 3474844 - RNA, 17 nt, Human
guauauauaagaaagac

SEQ ID NO: 3474845 - RNA, 13 nt, Human
guauauauacaua

SEQ ID NO: 3474846 - RNA, 14 nt, Human
guauauauacauaa

SEQ ID NO: 3474847 - RNA, 18 nt, Human
guauauauauauauaugu

SEQ ID NO: 3474848 - RNA, 23 nt, Human
guauauauauauauauguacagu

SEQ ID NO: 3474849 - RNA, 20 nt, Human
guauauauaugccaugaugg

SEQ ID NO: 3474850 - RNA, 21 nt, Human
guauauauaugccaugaugga

SEQ ID NO: 3474851 - RNA, 22 nt, Human
guauauaucugcuucaguggag

SEQ ID NO: 3474852 - RNA, 13 nt, Human
guauauaugugug

SEQ ID NO: 3474853 - RNA, 20 nt, Human
guauauauguguguuuaaau

SEQ ID NO: 3474854 - RNA, 14 nt, Human
guauauauucccaa

SEQ ID NO: 3474855 - RNA, 19 nt, Human
guauaucagaaaagggaag

SEQ ID NO: 3474856 - RNA, 12 nt, Human
guauaucaugua

SEQ ID NO: 3474857 - RNA, 24 nt, Human
guauaucauguaaagaaaugucuu

SEQ ID NO: 3474858 - RNA, 17 nt, Human
guauaucauucuaaaga

SEQ ID NO: 3474859 - RNA, 19 nt, Human
guauaugguauauauacau

SEQ ID NO: 3474860 - RNA, 16 nt, Human
guauaugguauuuauu

SEQ ID NO: 3474861 - RNA, 15 nt, Human
guauauggugguaau

SEQ ID NO: 3474862 - RNA, 13 nt, Human
guauauuaaaaaa

SEQ ID NO: 3474863 - RNA, 11 nt, Human
guauauuaaac

SEQ ID NO: 3474864 - RNA, 14 nt, Human
guauauuacaauga

SEQ ID NO: 3474865 - RNA, 17 nt, Human
guauauuacaaugauca

SEQ ID NO: 3474866 - RNA, 18 nt, Human
guauauuacaaugaucac

SEQ ID NO: 3474867 - RNA, 17 nt, Human
guauauuacacauuugu

SEQ ID NO: 3474868 - RNA, 14 nt, Human
guauauuauaauag

SEQ ID NO: 3474869 - RNA, 21 nt, Human
guauauuauguauuuauauuu

SEQ ID NO: 3474870 - RNA, 22 nt, Human
guauauuauuucuaggaagaau

SEQ ID NO: 3474871 - RNA, 14 nt, Human
guauauuauuuggc

SEQ ID NO: 3474872 - RNA, 19 nt, Human
guauauugguuuuaugaug

SEQ ID NO: 3474873 - RNA, 19 nt, Human
guauauuguguuuguguau

SEQ ID NO: 3474874 - RNA, 20 nt, Human
guauauuguguuuguguauu

SEQ ID NO: 3474875 - RNA, 22 nt, Human
guauauuuaaacucaagacaau

SEQ ID NO: 3474876 - RNA, 12 nt, Human
guauauuugaaa

SEQ ID NO: 3474877 - RNA, 18 nt, Human
guauauuugauuuauuaa

SEQ ID NO: 3474878 - RNA, 13 nt, Human
guauauuuguaca

SEQ ID NO: 3474879 - RNA, 18 nt, Human
guauauuuguaugauauu

SEQ ID NO: 3474880 - RNA, 21 nt, Human
guauauuugugauagcacuuu

SEQ ID NO: 3474881 - RNA, 14 nt, Human
guauauuuuccuau

SEQ ID NO: 3474882 - RNA, 21 nt, Human
guauauuuugggaaucuuuuc

SEQ ID NO: 3474883 - RNA, 22 nt, Human
guauauuuuuaucuauauaaaa

SEQ ID NO: 3474884 - RNA, 22 nt, Human
guauauuuuuguuuguuuugug

SEQ ID NO: 3474885 - RNA, 13 nt, Human
guaucaaaaugcu

SEQ ID NO: 3474886 - RNA, 14 nt, Human
guaucaaauacauu

SEQ ID NO: 3474887 - RNA, 24 nt, Human
guaucaaauauuagaugugauuua

SEQ ID NO: 3474888 - RNA, 19 nt, Human
guaucaaucuuuagaaaag

SEQ ID NO: 3474889 - RNA, 19 nt, Human
guaucacgggucacuugaa

SEQ ID NO: 3474890 - RNA, 18 nt, Human
guaucacugucuuuccua

SEQ ID NO: 3474891 - RNA, 19 nt, Human
guaucagaauugaaacacu

SEQ ID NO: 3474892 - RNA, 15 nt, Human
guaucagaggccuau

SEQ ID NO: 3474893 - RNA, 17 nt, Human
guaucagaggccuauaa

SEQ ID NO: 3474894 - RNA, 21 nt, Human
guaucaggaaauauauaugug

SEQ ID NO: 3474895 - RNA, 18 nt, Human
guaucaggacccagagga

SEQ ID NO: 3474896 - RNA, 18 nt, Human
guaucaggccugccagac

SEQ ID NO: 3474897 - RNA, 22 nt, Human
guaucaggccugccagacggca

SEQ ID NO: 3474898 - RNA, 21 nt, Human
guaucaguggauuucccaucc

SEQ ID NO: 3474899 - RNA, 24 nt, Human
guaucaguguuuaugugcuauuaa

SEQ ID NO: 3474900 - RNA, 20 nt, Human
guaucaguguuuuaaauucu

SEQ ID NO: 3474901 - RNA, 19 nt, Human
guaucauaauuaccaagug

SEQ ID NO: 3474902 - RNA, 13 nt, Human
guaucaucagugu

SEQ ID NO: 3474903 - RNA, 14 nt, Human
guaucaucuggaua

SEQ ID NO: 3474904 - RNA, 24 nt, Human
guaucaucuggauaggagccugcu

SEQ ID NO: 3474905 - RNA, 18 nt, Human
guaucaugcccugugcaa

SEQ ID NO: 3474906 - RNA, 22 nt, Human
guaucauuguuguuugauuucu

SEQ ID NO: 3474907 - RNA, 18 nt, Human
guauccacuguuuauuca

SEQ ID NO: 3474908 - RNA, 19 nt, Human
guauccauuaucaugugua

SEQ ID NO: 3474909 - RNA, 14 nt, Human
guauccccccaucu

SEQ ID NO: 3474910 - RNA, 17 nt, Human
guauccccccaucuugc

SEQ ID NO: 3474911 - RNA, 20 nt, Human
guauccccccccuguauagu

SEQ ID NO: 3474912 - RNA, 13 nt, Human
guauccccugcag

SEQ ID NO: 3474913 - RNA, 18 nt, Human
guaucccgagucugggac

SEQ ID NO: 3474914 - RNA, 19 nt, Human
guaucccgagucugggaca

SEQ ID NO: 3474915 - RNA, 18 nt, Human
guaucccuucucacagca

SEQ ID NO: 3474916 - RNA, 18 nt, Human
gugaauuacuaacuucua

SEQ ID NO: 3474917 - RNA, 21 nt, Human
gugaauuaucccuuuucuuga

SEQ ID NO: 3474918 - RNA, 17 nt, Human
gugaauuauugacacug

SEQ ID NO: 3474919 - RNA, 16 nt, Human
gugaauugauaauaaa

SEQ ID NO: 3474920 - RNA, 23 nt, Human
gugaauugccugcagagagaagc

SEQ ID NO: 3474921 - RNA, 17 nt, Human
gugaauuguuugaaccu

SEQ ID NO: 3474922 - RNA, 13 nt, Human
gugaauuugaaug

SEQ ID NO: 3474923 - RNA, 18 nt, Human
gugaauuugaaugaaaaa

SEQ ID NO: 3474924 - RNA, 11 nt, Human
gugaauuuuua

SEQ ID NO: 3474925 - RNA, 15 nt, Human
gugaauuuuucucua

SEQ ID NO: 3474926 - RNA, 13 nt, Human
gugaauuuuugca

SEQ ID NO: 3474927 - RNA, 17 nt, Human
gugaauuuuugcaauaa

SEQ ID NO: 3474928 - RNA, 17 nt, Human
gugaauuuuuuuuuccu

SEQ ID NO: 3474929 - RNA, 20 nt, Human
gugacaaaauuuuauaagca

SEQ ID NO: 3474930 - RNA, 16 nt, Human
gugacaaaccauccag

SEQ ID NO: 3474931 - RNA, 14 nt, Human
gugacaagagccug

SEQ ID NO: 3474932 - RNA, 20 nt, Human
gugacaaggauugcuacugu

SEQ ID NO: 3474933 - RNA, 13 nt, Human
gugacaaggcccc

SEQ ID NO: 3474934 - RNA, 18 nt, Human
gugacacaaacacacaca

SEQ ID NO: 3474935 - RNA, 18 nt, Human
gugacacacuacaccaca

SEQ ID NO: 3474936 - RNA, 23 nt, Human
gugacacacuacaccacacacaa

SEQ ID NO: 3474937 - RNA, 23 nt, Human
gugacaccagccuuucucccagg

SEQ ID NO: 3474938 - RNA, 17 nt, Human
gugacacucuccuugca

SEQ ID NO: 3474939 - RNA, 19 nt, Human
gugacacucuccuugcagu

SEQ ID NO: 3474940 - RNA, 16 nt, Human
gugacagacuccugag

SEQ ID NO: 3474941 - RNA, 22 nt, Human
gugacagacuccugaggacagc

SEQ ID NO: 3474942 - RNA, 13 nt, Human
gugacagaggcag

SEQ ID NO: 3474943 - RNA, 14 nt, Human
gugacagaggcagc

SEQ ID NO: 3474944 - RNA, 15 nt, Human
gugacagaggcagcc

SEQ ID NO: 3474945 - RNA, 18 nt, Human
gugacagaggcagcccca

SEQ ID NO: 3474946 - RNA, 22 nt, Human
gugacagagugagacucugucu

SEQ ID NO: 3474947 - RNA, 15 nt, Human
gugacaggcagcaga

SEQ ID NO: 3474948 - RNA, 18 nt, Human
gugacagggaagcuacag

SEQ ID NO: 3474949 - RNA, 22 nt, Human
gugacagggaagcuacagguua

SEQ ID NO: 3474950 - RNA, 14 nt, Human
gugacagggccagu

SEQ ID NO: 3474951 - RNA, 21 nt, Human
gugacagucaucaucagggcc

SEQ ID NO: 3474952 - RNA, 17 nt, Human
gugacagugccugggaa

SEQ ID NO: 3474953 - RNA, 23 nt, Human
gugacagugccugggaauguauu

SEQ ID NO: 3474954 - RNA, 18 nt, Human
gugacaguggauugcauu

SEQ ID NO: 3474955 - RNA, 22 nt, Human
gugacauccacaaaugcaguuu

SEQ ID NO: 3474956 - RNA, 15 nt, Human
gugacauggugccug

SEQ ID NO: 3474957 - RNA, 19 nt, Human
gugacauggugccugagag

SEQ ID NO: 3474958 - RNA, 18 nt, Human
gugacaugugaaaccuuu

SEQ ID NO: 3474959 - RNA, 22 nt, Human
gugacaugugaaaccuuuuuua

SEQ ID NO: 3474960 - RNA, 22 nt, Human
gugacauguguuggcagccucu

SEQ ID NO: 3474961 - RNA, 22 nt, Human
gugacauuugggagacauguga

SEQ ID NO: 3474962 - RNA, 23 nt, Human
gugaccaacuagacauucugucg

SEQ ID NO: 3474963 - RNA, 22 nt, Human
gugaccaacuguguuguauuaa

SEQ ID NO: 3474964 - RNA, 16 nt, Human
gugaccaaugucuuga

SEQ ID NO: 3474965 - RNA, 14 nt, Human
gugacccacaugcc

SEQ ID NO: 3474966 - RNA, 15 nt, Human
gugacccacuucuca

SEQ ID NO: 3474967 - RNA, 23 nt, Human
gugaccccagggcacaggagcua

SEQ ID NO: 3474968 - RNA, 12 nt, Human
gugaccccaggu

SEQ ID NO: 3474969 - RNA, 18 nt, Human
gugaccccuccuggggcc

SEQ ID NO: 3474970 - RNA, 19 nt, Human
gugaccccuuuucagcuuc

SEQ ID NO: 3474971 - RNA, 23 nt, Human
gugaccccuuuucagcuucugcu

SEQ ID NO: 3474972 - RNA, 18 nt, Human
gugacccggcacccccug

SEQ ID NO: 3474973 - RNA, 23 nt, Human
gugacccggcacccccugcagcu

SEQ ID NO: 3474974 - RNA, 20 nt, Human
gugacccuccaaauggagaa

SEQ ID NO: 3474975 - RNA, 13 nt, Human
gugacccucugaa

SEQ ID NO: 3474976 - RNA, 12 nt, Human
gugaccucaggc

SEQ ID NO: 3474977 - RNA, 14 nt, Human
gugaccugaaguuc

SEQ ID NO: 3474978 - RNA, 19 nt, Human
gugaccugaaguucaccau

SEQ ID NO: 3474979 - RNA, 16 nt, Human
gugaccugaggaagcg

SEQ ID NO: 3474980 - RNA, 23 nt, Human
gugaccugccccgcccagcugca

SEQ ID NO: 3474981 - RNA, 13 nt, Human
gugaccuguuuau

SEQ ID NO: 3474982 - RNA, 15 nt, Human
gugaccuuaguguuu

SEQ ID NO: 3474983 - RNA, 19 nt, Human
gugaccuuccaagagccug

SEQ ID NO: 3474984 - RNA, 17 nt, Human
gugacgccugcccuccc

SEQ ID NO: 3474985 - RNA, 15 nt, Human
gugacgcugaauaaa

SEQ ID NO: 3474986 - RNA, 18 nt, Human
gugacgcugaauaaaugu

SEQ ID NO: 3474987 - RNA, 19 nt, Human
gugacgcugaauaaauguc

SEQ ID NO: 3474988 - RNA, 19 nt, Human
gugacuaauuguauaacag

SEQ ID NO: 3474989 - RNA, 20 nt, Human
gugacuaauuguauaacagg

SEQ ID NO: 3474990 - RNA, 13 nt, Human
gugacuagugcug

SEQ ID NO: 3474991 - RNA, 14 nt, Human
gugacuagugcuga

SEQ ID NO: 3474992 - RNA, 22 nt, Human
gugacuagugcugaagcuuauu

SEQ ID NO: 3474993 - RNA, 14 nt, Human
gugacuaugaacuu

SEQ ID NO: 3474994 - RNA, 19 nt, Human
gugacuccaggagaggagc

SEQ ID NO: 3474995 - RNA, 21 nt, Human
gugacucgggcuccugugccc

SEQ ID NO: 3474996 - RNA, 14 nt, Human
gugacucuccaggg

SEQ ID NO: 3474997 - RNA, 14 nt, Human
gugacucugaagcu

SEQ ID NO: 3474998 - RNA, 20 nt, Human
gugacucuuuuuagggccag

SEQ ID NO: 3474999 - RNA, 15 nt, Human
gugacugaauuucuu

SEQ ID NO: 3475000 - RNA, 16 nt, Human
gugacugccccaacuc

SEQ ID NO: 3475001 - RNA, 21 nt, Human
gugacugccccaacuccugga

SEQ ID NO: 3475002 - RNA, 18 nt, Human
gugacuguggcacacgcc

SEQ ID NO: 3475003 - RNA, 20 nt, Human
gugacuuuggcugcaugcga

SEQ ID NO: 3475004 - RNA, 22 nt, Human
gugagaaaaagcuccuguccuc

SEQ ID NO: 3475005 - RNA, 15 nt, Human
gugagaaaacuguga

SEQ ID NO: 3475006 - RNA, 19 nt, Human
gugagaaacaucucaauaa

SEQ ID NO: 3475007 - RNA, 20 nt, Human
gugagaaaccuguaucuuuc

SEQ ID NO: 3475008 - RNA, 15 nt, Human
gugagaaauuuaaac

SEQ ID NO: 3475009 - RNA, 11 nt, Human
gugagaagaau

SEQ ID NO: 3475010 - RNA, 14 nt, Human
gugagaagaauauu

SEQ ID NO: 3475011 - RNA, 20 nt, Human
gugagaagguuuauuguuaa

SEQ ID NO: 3475012 - RNA, 22 nt, Human
gugagaagugaaugcugggacu

SEQ ID NO: 3475013 - RNA, 19 nt, Human
gugagacaguccagccugg

SEQ ID NO: 3475014 - RNA, 16 nt, Human
gugagacagugggaaa

SEQ ID NO: 3475015 - RNA, 22 nt, Human
gugagacccugucucaaaaaaa

SEQ ID NO: 3475016 - RNA, 14 nt, Human
gugagaccugcccc

SEQ ID NO: 3475017 - RNA, 15 nt, Human
gugagaccugccccu

SEQ ID NO: 3475018 - RNA, 16 nt, Human
gugagaccugccccuc

SEQ ID NO: 3475019 - RNA, 23 nt, Human
gugagacugggaaggcuugggau

SEQ ID NO: 3475020 - RNA, 15 nt, Human
gugagagaguggcug

SEQ ID NO: 3475021 - RNA, 16 nt, Human
gugagagaguggcugg

SEQ ID NO: 3475022 - RNA, 19 nt, Human
gugagagaguggcuggggc

SEQ ID NO: 3475023 - RNA, 21 nt, Human
gugagaugagggaugggccug

SEQ ID NO: 3475024 - RNA, 15 nt, Human
gugagaugcuggaga

SEQ ID NO: 3475025 - RNA, 14 nt, Human
gugagauuuuuuau

SEQ ID NO: 3475026 - RNA, 18 nt, Human
gugagcaaaccugcccca

SEQ ID NO: 3475027 - RNA, 21 nt, Human
gugagcaagaagucaaaguaa

SEQ ID NO: 3475028 - RNA, 18 nt, Human
gugagcaggaaggccugg

SEQ ID NO: 3475029 - RNA, 19 nt, Human
gugagcaggaaggccuggg

SEQ ID NO: 3475030 - RNA, 20 nt, Human
gugagcaggaaggccugggu

SEQ ID NO: 3475031 - RNA, 16 nt, Human
gugagcagucaggaaa

SEQ ID NO: 3475032 - RNA, 12 nt, Human
gugagcagugug

SEQ ID NO: 3475033 - RNA, 13 nt, Human
gugagcauguuug

SEQ ID NO: 3475034 - RNA, 15 nt, Human
gugagccaccacgcc

SEQ ID NO: 3475035 - RNA, 22 nt, Human
gugagccaccgugccuggccac

SEQ ID NO: 3475036 - RNA, 20 nt, Human
gugagccagguaaugaggga

SEQ ID NO: 3475037 - RNA, 18 nt, Human
gugagcccauggcccucc

SEQ ID NO: 3475038 - RNA, 16 nt, Human
gugagccccaucuuca

SEQ ID NO: 3475039 - RNA, 21 nt, Human
gugagccgcaucuucuccauc

SEQ ID NO: 3475040 - RNA, 16 nt, Human
gugagccuggcucuug

SEQ ID NO: 3475041 - RNA, 23 nt, Human
gugagccuggcucuugugcugga

SEQ ID NO: 3475042 - RNA, 16 nt, Human
gugagcggagaucgca

SEQ ID NO: 3475043 - RNA, 17 nt, Human
gugagcugagcaggcca

SEQ ID NO: 3475044 - RNA, 12 nt, Human
gugagcugggca

SEQ ID NO: 3475045 - RNA, 16 nt, Human
gugagcuuugcugcua

SEQ ID NO: 3475046 - RNA, 15 nt, Human
gugaggaaagucauu

SEQ ID NO: 3475047 - RNA, 17 nt, Human
gugaggagccccaucug

SEQ ID NO: 3475048 - RNA, 14 nt, Human
gugaggagcugcug

SEQ ID NO: 3475049 - RNA, 17 nt, Human
gugaggagcugcuggcu

SEQ ID NO: 3475050 - RNA, 18 nt, Human
gugaggaugucacucaga

SEQ ID NO: 3475051 - RNA, 22 nt, Human
gugaggaugucacucagaugga

SEQ ID NO: 3475052 - RNA, 11 nt, Human
gugaggccaga

SEQ ID NO: 3475053 - RNA, 13 nt, Human
gugaggccagaga

SEQ ID NO: 3475054 - RNA, 22 nt, Human
gugaggccagagacacaagccu

SEQ ID NO: 3475055 - RNA, 15 nt, Human
gugaggccagggcag

SEQ ID NO: 3475056 - RNA, 13 nt, Human
gugaggccccugg

SEQ ID NO: 3475057 - RNA, 11 nt, Human
gugaggccugu

SEQ ID NO: 3475058 - RNA, 21 nt, Human
gugaggccugucugugaccug

SEQ ID NO: 3475059 - RNA, 13 nt, Human
gugaggccuugcu

SEQ ID NO: 3475060 - RNA, 21 nt, Human
gugcccaugggcacugcuggg

SEQ ID NO: 3475061 - RNA, 17 nt, Human
gugcccauuccucaccu

SEQ ID NO: 3475062 - RNA, 13 nt, Human
gugccccaccugc

SEQ ID NO: 3475063 - RNA, 14 nt, Human
gugccccaccugcc

SEQ ID NO: 3475064 - RNA, 15 nt, Human
gugccccaccugcca

SEQ ID NO: 3475065 - RNA, 12 nt, Human
gugccccaggac

SEQ ID NO: 3475066 - RNA, 14 nt, Human
gugcccccaggguc

SEQ ID NO: 3475067 - RNA, 16 nt, Human
gugcccccaggguccu

SEQ ID NO: 3475068 - RNA, 17 nt, Human
gugccccccauccuggc

SEQ ID NO: 3475069 - RNA, 19 nt, Human
gugccccccauccuggccc

SEQ ID NO: 3475070 - RNA, 20 nt, Human
gugccccccuugccagacau

SEQ ID NO: 3475071 - RNA, 21 nt, Human
gugcccccuucaagccugugc

SEQ ID NO: 3475072 - RNA, 12 nt, Human
gugccccugcug

SEQ ID NO: 3475073 - RNA, 19 nt, Human
gugccccugcugccucccc

SEQ ID NO: 3475074 - RNA, 21 nt, Human
gugcccggggcagcagcagcc

SEQ ID NO: 3475075 - RNA, 18 nt, Human
gugcccuccacugcccuc

SEQ ID NO: 3475076 - RNA, 18 nt, Human
gugcccucucccacccuc

SEQ ID NO: 3475077 - RNA, 20 nt, Human
gugcccucucccacccucuu

SEQ ID NO: 3475078 - RNA, 12 nt, Human
gugcccugagcc

SEQ ID NO: 3475079 - RNA, 13 nt, Human
gugcccugauccc

SEQ ID NO: 3475080 - RNA, 12 nt, Human
gugcccugcccc

SEQ ID NO: 3475081 - RNA, 18 nt, Human
gugcccuggaugcccagg

SEQ ID NO: 3475082 - RNA, 15 nt, Human
gugcccugguggaga

SEQ ID NO: 3475083 - RNA, 22 nt, Human
gugccgagaaggaagccuccca

SEQ ID NO: 3475084 - RNA, 13 nt, Human
gugccgagcccuu

SEQ ID NO: 3475085 - RNA, 23 nt, Human
gugccgccugcccgucucucucc

SEQ ID NO: 3475086 - RNA, 12 nt, Human
gugccguggcac

SEQ ID NO: 3475087 - RNA, 13 nt, Human
gugccgugugagu

SEQ ID NO: 3475088 - RNA, 18 nt, Human
gugccguuacucuccaac

SEQ ID NO: 3475089 - RNA, 15 nt, Human
gugccuaauguguuu

SEQ ID NO: 3475090 - RNA, 14 nt, Human
gugccuaguauuga

SEQ ID NO: 3475091 - RNA, 18 nt, Human
gugccuaguauugacaaa

SEQ ID NO: 3475092 - RNA, 20 nt, Human
gugccuaguauugacaaaau

SEQ ID NO: 3475093 - RNA, 18 nt, Human
gugccuauugcuagagcu

SEQ ID NO: 3475094 - RNA, 21 nt, Human
gugccuauugcuagagcuccu

SEQ ID NO: 3475095 - RNA, 19 nt, Human
gugccuauuuguguggaca

SEQ ID NO: 3475096 - RNA, 15 nt, Human
gugccucaagagaag

SEQ ID NO: 3475097 - RNA, 15 nt, Human
gugccucagagacca

SEQ ID NO: 3475098 - RNA, 19 nt, Human
gugccucagagaccagggc

SEQ ID NO: 3475099 - RNA, 15 nt, Human
gugccuccaccacca

SEQ ID NO: 3475100 - RNA, 13 nt, Human
gugccuccaggug

SEQ ID NO: 3475101 - RNA, 15 nt, Human
gugccuccaggugug

SEQ ID NO: 3475102 - RNA, 13 nt, Human
gugccuccucccu

SEQ ID NO: 3475103 - RNA, 14 nt, Human
gugccuccucccuc

SEQ ID NO: 3475104 - RNA, 22 nt, Human
gugccuccucccucccucuccg

SEQ ID NO: 3475105 - RNA, 18 nt, Human
gugccuccuuccaccucc

SEQ ID NO: 3475106 - RNA, 15 nt, Human
gugccucgcucccca

SEQ ID NO: 3475107 - RNA, 19 nt, Human
gugccucgcuccccacucu

SEQ ID NO: 3475108 - RNA, 15 nt, Human
gugccucuagcugaa

SEQ ID NO: 3475109 - RNA, 16 nt, Human
gugccucugcaguacu

SEQ ID NO: 3475110 - RNA, 12 nt, Human
gugccucuggga

SEQ ID NO: 3475111 - RNA, 16 nt, Human
gugccugacugcccag

SEQ ID NO: 3475112 - RNA, 18 nt, Human
gugccugauucggcuguc

SEQ ID NO: 3475113 - RNA, 22 nt, Human
gugccugauucggcugucucag

SEQ ID NO: 3475114 - RNA, 17 nt, Human
gugccugcaccaggaga

SEQ ID NO: 3475115 - RNA, 11 nt, Human
gugccugcagc

SEQ ID NO: 3475116 - RNA, 22 nt, Human
gugccuggacauuugccuugcu

SEQ ID NO: 3475117 - RNA, 17 nt, Human
gugccuggagcuccugg

SEQ ID NO: 3475118 - RNA, 12 nt, Human
gugccuggcuca

SEQ ID NO: 3475119 - RNA, 16 nt, Human
gugccuggcucagagc

SEQ ID NO: 3475120 - RNA, 23 nt, Human
gugccugggaaccuuccugucuu

SEQ ID NO: 3475121 - RNA, 16 nt, Human
gugccugggaauguau

SEQ ID NO: 3475122 - RNA, 17 nt, Human
gugccugggaauguauu

SEQ ID NO: 3475123 - RNA, 14 nt, Human
gugccugggggagu

SEQ ID NO: 3475124 - RNA, 11 nt, Human
gugccuggggu

SEQ ID NO: 3475125 - RNA, 21 nt, Human
gugccuggguggaugggccac

SEQ ID NO: 3475126 - RNA, 17 nt, Human
gugccuggguggggcug

SEQ ID NO: 3475127 - RNA, 22 nt, Human
gugccuggguggggcugcuccu

SEQ ID NO: 3475128 - RNA, 20 nt, Human
gugccuguaaucacagcuac

SEQ ID NO: 3475129 - RNA, 15 nt, Human
gugccugugaggcag

SEQ ID NO: 3475130 - RNA, 11 nt, Human
gugccuuaugg

SEQ ID NO: 3475131 - RNA, 14 nt, Human
gugccuuauggaac

SEQ ID NO: 3475132 - RNA, 18 nt, Human
gugccuuauguugaaaaa

SEQ ID NO: 3475133 - RNA, 22 nt, Human
gugccuucaagaaaacaggcac

SEQ ID NO: 3475134 - RNA, 12 nt, Human
gugccuuccaac

SEQ ID NO: 3475135 - RNA, 15 nt, Human
gugccuuccauaauu

SEQ ID NO: 3475136 - RNA, 17 nt, Human
gugccuuccauaauuau

SEQ ID NO: 3475137 - RNA, 20 nt, Human
gugccuuccaugucggccuc

SEQ ID NO: 3475138 - RNA, 21 nt, Human
gugccuuccaugucggccucu

SEQ ID NO: 3475139 - RNA, 23 nt, Human
gugccuuccuguuuuucacauuu

SEQ ID NO: 3475140 - RNA, 14 nt, Human
gugccuucucucuc

SEQ ID NO: 3475141 - RNA, 23 nt, Human
gugccuucuuauucucacuccac

SEQ ID NO: 3475142 - RNA, 23 nt, Human
gugccuuggagggucccaagcug

SEQ ID NO: 3475143 - RNA, 20 nt, Human
gugccuuggggaauuuccuc

SEQ ID NO: 3475144 - RNA, 21 nt, Human
gugccuuggggaauuuccucu

SEQ ID NO: 3475145 - RNA, 21 nt, Human
gugccuuggggacaagagcag

SEQ ID NO: 3475146 - RNA, 13 nt, Human
gugccuuucaaau

SEQ ID NO: 3475147 - RNA, 22 nt, Human
gugccuuuccuguucagcauuc

SEQ ID NO: 3475148 - RNA, 21 nt, Human
gugccuuugaguuuccucagg

SEQ ID NO: 3475149 - RNA, 14 nt, Human
gugccuuuuauagc

SEQ ID NO: 3475150 - RNA, 18 nt, Human
gugccuuuuauagcuauu

SEQ ID NO: 3475151 - RNA, 22 nt, Human
gugccuuuugcaccccucccau

SEQ ID NO: 3475152 - RNA, 21 nt, Human
gugccuuuugccauccccuca

SEQ ID NO: 3475153 - RNA, 22 nt, Human
gugccuuuuuucacggaaguuu

SEQ ID NO: 3475154 - RNA, 20 nt, Human
gugcgaccccaucugcccag

SEQ ID NO: 3475155 - RNA, 18 nt, Human
gugcgagggacccagcua

SEQ ID NO: 3475156 - RNA, 14 nt, Human
gugcgagugugugc

SEQ ID NO: 3475157 - RNA, 21 nt, Human
gugcgaucuggguucacugca

SEQ ID NO: 3475158 - RNA, 18 nt, Human
gugcgcaucuugccucca

SEQ ID NO: 3475159 - RNA, 24 nt, Human
gugcgcaucuugccuccaggugca

SEQ ID NO: 3475160 - RNA, 19 nt, Human
gugcggcagggacacccga

SEQ ID NO: 3475161 - RNA, 14 nt, Human
gugcggccuuuggc

SEQ ID NO: 3475162 - RNA, 19 nt, Human
gugcggcggucccagcucc

SEQ ID NO: 3475163 - RNA, 17 nt, Human
gugcgggcacaauaaau

SEQ ID NO: 3475164 - RNA, 20 nt, Human
gugcgucaguccaagggguc

SEQ ID NO: 3475165 - RNA, 13 nt, Human
gugcguccugucg

SEQ ID NO: 3475166 - RNA, 22 nt, Human
gugcuaaauggucgcccaggag

SEQ ID NO: 3475167 - RNA, 13 nt, Human
gugcuaagugcuu

SEQ ID NO: 3475168 - RNA, 17 nt, Human
gugcuaauaacagugca

SEQ ID NO: 3475169 - RNA, 13 nt, Human
gugcuacaaaaac

SEQ ID NO: 3475170 - RNA, 15 nt, Human
gugcuacaaaaacac

SEQ ID NO: 3475171 - RNA, 22 nt, Human
gugcuacaaaaacacagcaagg

SEQ ID NO: 3475172 - RNA, 16 nt, Human
gugcuacaggggccag

SEQ ID NO: 3475173 - RNA, 19 nt, Human
gugcuacaggggccagaag

SEQ ID NO: 3475174 - RNA, 16 nt, Human
gugcuacugauuguuu

SEQ ID NO: 3475175 - RNA, 18 nt, Human
gugcuacuggggaaacug

SEQ ID NO: 3475176 - RNA, 17 nt, Human
gugcuaggaacacuccu

SEQ ID NO: 3475177 - RNA, 18 nt, Human
gugcuaguaauuggaaag

SEQ ID NO: 3475178 - RNA, 23 nt, Human
gugcuauaaucuguuuuuacgua

SEQ ID NO: 3475179 - RNA, 21 nt, Human
gugcuauacugcauacuuuuu

SEQ ID NO: 3475180 - RNA, 16 nt, Human
gugcuauaggcuggag

SEQ ID NO: 3475181 - RNA, 19 nt, Human
gugcuauaggcuggagaag

SEQ ID NO: 3475182 - RNA, 21 nt, Human
gugcuauaggcuggagaagcu

SEQ ID NO: 3475183 - RNA, 15 nt, Human
gugcuaucuccccca

SEQ ID NO: 3475184 - RNA, 16 nt, Human
gugcuauggugcucug

SEQ ID NO: 3475185 - RNA, 24 nt, Human
gugcuauuacgaaguucaagauca

SEQ ID NO: 3475186 - RNA, 19 nt, Human
gugcucaccaugcuuccag

SEQ ID NO: 3475187 - RNA, 18 nt, Human
gugcucagcccugaggac

SEQ ID NO: 3475188 - RNA, 16 nt, Human
gugcucaggagcccug

SEQ ID NO: 3475189 - RNA, 18 nt, Human
gugcucaggagcccuggg

SEQ ID NO: 3475190 - RNA, 13 nt, Human
gugcucaguugua

SEQ ID NO: 3475191 - RNA, 14 nt, Human
gugcuccuccuugg

SEQ ID NO: 3475192 - RNA, 15 nt, Human
gugcucgcuguugcu

SEQ ID NO: 3475193 - RNA, 16 nt, Human
gugcucuggacaggca

SEQ ID NO: 3475194 - RNA, 17 nt, Human
gugcucuggacaggcau

SEQ ID NO: 3475195 - RNA, 18 nt, Human
gugcucuggacaggcaug

SEQ ID NO: 3475196 - RNA, 14 nt, Human
gugcugaagcuuau

SEQ ID NO: 3475197 - RNA, 15 nt, Human
gugcugacagcugcu

SEQ ID NO: 3475198 - RNA, 18 nt, Human
gugcugacccuccuguug

SEQ ID NO: 3475199 - RNA, 15 nt, Human
gugcugaccucuggu

SEQ ID NO: 3475200 - RNA, 15 nt, Human
gugcugacggaagcc

SEQ ID NO: 3475201 - RNA, 21 nt, Human
gugcugaguguacagagugga

SEQ ID NO: 3475202 - RNA, 14 nt, Human
gugcugcagcuccc

SEQ ID NO: 3475203 - RNA, 19 nt, Human
gugcugcagcucccuggcu

SEQ ID NO: 3475204 - RNA, 13 nt, Human
gugcugcaguaug

SEQ ID NO: 3475205 - RNA, 22 nt, Human
gccaagauaggaccuugggcca

SEQ ID NO: 3475206 - RNA, 18 nt, Human
gccaagaucgcgccacug

SEQ ID NO: 3475207 - RNA, 13 nt, Human
gccaagcaaccug

SEQ ID NO: 3475208 - RNA, 18 nt, Human
gccaagcaaccugggucc

SEQ ID NO: 3475209 - RNA, 19 nt, Human
gccaagcaaccugggucca

SEQ ID NO: 3475210 - RNA, 12 nt, Human
gccaagcacagu

SEQ ID NO: 3475211 - RNA, 13 nt, Human
gccaagcuagaau

SEQ ID NO: 3475212 - RNA, 23 nt, Human
gccaagcucaggaccaggcaaug

SEQ ID NO: 3475213 - RNA, 17 nt, Human
gccaagcuccuugggag

SEQ ID NO: 3475214 - RNA, 19 nt, Human
gccaagcuccuugggaggc

SEQ ID NO: 3475215 - RNA, 15 nt, Human
gccaagcugaggugc

SEQ ID NO: 3475216 - RNA, 11 nt, Human
gccaaggagcu

SEQ ID NO: 3475217 - RNA, 12 nt, Human
gccaaggagcug

SEQ ID NO: 3475218 - RNA, 20 nt, Human
gccaaggagggugagugcaa

SEQ ID NO: 3475219 - RNA, 17 nt, Human
gccaaggccaaaggaag

SEQ ID NO: 3475220 - RNA, 20 nt, Human
gccaaggccagaguggccug

SEQ ID NO: 3475221 - RNA, 18 nt, Human
gccaaggccuucuccucc

SEQ ID NO: 3475222 - RNA, 21 nt, Human
gccaaggcugggggaagaagc

SEQ ID NO: 3475223 - RNA, 12 nt, Human
gccaagggaaag

SEQ ID NO: 3475224 - RNA, 22 nt, Human
gccaagggaaaggggugcuuuu

SEQ ID NO: 3475225 - RNA, 18 nt, Human
gccaagggaaccuguguc

SEQ ID NO: 3475226 - RNA, 20 nt, Human
gccaagggaauuauagcugc

SEQ ID NO: 3475227 - RNA, 22 nt, Human
gccaagggcaacagaucaguaa

SEQ ID NO: 3475228 - RNA, 20 nt, Human
gccaagggcccaaagaaaga

SEQ ID NO: 3475229 - RNA, 21 nt, Human
gccaaggggagucaccuuccc

SEQ ID NO: 3475230 - RNA, 18 nt, Human
gccaaggggcuucagguc

SEQ ID NO: 3475231 - RNA, 22 nt, Human
gccaagguagccaucccaugaa

SEQ ID NO: 3475232 - RNA, 16 nt, Human
gccaaggugggcugag

SEQ ID NO: 3475233 - RNA, 14 nt, Human
gccaagguguccua

SEQ ID NO: 3475234 - RNA, 18 nt, Human
gccaagguguccuacaga

SEQ ID NO: 3475235 - RNA, 20 nt, Human
gccaagguguccuacagaaa

SEQ ID NO: 3475236 - RNA, 16 nt, Human
gccaaguaagaaagug

SEQ ID NO: 3475237 - RNA, 16 nt, Human
gccaaguauaauuuuu

SEQ ID NO: 3475238 - RNA, 14 nt, Human
gccaaguccagauu

SEQ ID NO: 3475239 - RNA, 21 nt, Human
gccaaguccagguccuggugg

SEQ ID NO: 3475240 - RNA, 23 nt, Human
gccaagucccaccgguugcuucu

SEQ ID NO: 3475241 - RNA, 20 nt, Human
gccaagugcaggcuggcacc

SEQ ID NO: 3475242 - RNA, 17 nt, Human
gccaagugccaaaugcu

SEQ ID NO: 3475243 - RNA, 18 nt, Human
gccaagugcgugccgugu

SEQ ID NO: 3475244 - RNA, 19 nt, Human
gccaagugcgugccgugug

SEQ ID NO: 3475245 - RNA, 23 nt, Human
gccaagugcgugccgugugagug

SEQ ID NO: 3475246 - RNA, 15 nt, Human
gccaaguuuauauac

SEQ ID NO: 3475247 - RNA, 17 nt, Human
gccaaguuuauauacaa

SEQ ID NO: 3475248 - RNA, 13 nt, Human
gccaauauccuaa

SEQ ID NO: 3475249 - RNA, 15 nt, Human
gccaauauccuaaua

SEQ ID NO: 3475250 - RNA, 16 nt, Human
gccaauauccuaauaa

SEQ ID NO: 3475251 - RNA, 23 nt, Human
gccaauauguauuguaaacaugu

SEQ ID NO: 3475252 - RNA, 18 nt, Human
gccaaucugcaauuucua

SEQ ID NO: 3475253 - RNA, 19 nt, Human
gccaauggagacugucuca

SEQ ID NO: 3475254 - RNA, 20 nt, Human
gccaauuauguuaaacuagc

SEQ ID NO: 3475255 - RNA, 13 nt, Human
gccaauuuuucug

SEQ ID NO: 3475256 - RNA, 23 nt, Human
gccacaagaaauuugauuucuau

SEQ ID NO: 3475257 - RNA, 14 nt, Human
gccacaaggacuuc

SEQ ID NO: 3475258 - RNA, 17 nt, Human
gccacaaggacuuccug

SEQ ID NO: 3475259 - RNA, 20 nt, Human
gccacaaugcaguucugagc

SEQ ID NO: 3475260 - RNA, 21 nt, Human
gccacaaugcaguucugagca

SEQ ID NO: 3475261 - RNA, 11 nt, Human
gccacacacac

SEQ ID NO: 3475262 - RNA, 13 nt, Human
gccacacacacag

SEQ ID NO: 3475263 - RNA, 17 nt, Human
gccacacacacagaaaa

SEQ ID NO: 3475264 - RNA, 19 nt, Human
gccacacacacagaaaaua

SEQ ID NO: 3475265 - RNA, 12 nt, Human
gccacacaccuu

SEQ ID NO: 3475266 - RNA, 15 nt, Human
gccacacagaccacc

SEQ ID NO: 3475267 - RNA, 18 nt, Human
gccacacaugggcaucua

SEQ ID NO: 3475268 - RNA, 17 nt, Human
gccacaccaagcugugc

SEQ ID NO: 3475269 - RNA, 22 nt, Human
gccacaccaagcugugccaccc

SEQ ID NO: 3475270 - RNA, 13 nt, Human
gccacaccaggau

SEQ ID NO: 3475271 - RNA, 12 nt, Human
gccacacccagg

SEQ ID NO: 3475272 - RNA, 19 nt, Human
gccacaccucuaucccggc

SEQ ID NO: 3475273 - RNA, 22 nt, Human
gccacacucugggcuccagagu

SEQ ID NO: 3475274 - RNA, 20 nt, Human
gccacacucuuucuccugcu

SEQ ID NO: 3475275 - RNA, 19 nt, Human
gccacacuucaaacuacuu

SEQ ID NO: 3475276 - RNA, 18 nt, Human
gccacagaagccaggagc

SEQ ID NO: 3475277 - RNA, 20 nt, Human
gccacagagaaaguacuucu

SEQ ID NO: 3475278 - RNA, 23 nt, Human
gccacagagaaaguacuucucca

SEQ ID NO: 3475279 - RNA, 23 nt, Human
gccacagaggacucacuugccca

SEQ ID NO: 3475280 - RNA, 14 nt, Human
gccacagcagcauu

SEQ ID NO: 3475281 - RNA, 16 nt, Human
gccacagcagccucug

SEQ ID NO: 3475282 - RNA, 17 nt, Human
gccacagcagccucuga

SEQ ID NO: 3475283 - RNA, 16 nt, Human
gccacagccagaaccc

SEQ ID NO: 3475284 - RNA, 14 nt, Human
gccacagccagggg

SEQ ID NO: 3475285 - RNA, 22 nt, Human
gccacagcccaggccuccagcu

SEQ ID NO: 3475286 - RNA, 14 nt, Human
gccacagcccuguc

SEQ ID NO: 3475287 - RNA, 21 nt, Human
gccacagcccugucagcauga

SEQ ID NO: 3475288 - RNA, 13 nt, Human
gccacagcccuuu

SEQ ID NO: 3475289 - RNA, 16 nt, Human
gccacagcgccagccu

SEQ ID NO: 3475290 - RNA, 11 nt, Human
gccacagcucu

SEQ ID NO: 3475291 - RNA, 18 nt, Human
gccacagcuuuugcaacu

SEQ ID NO: 3475292 - RNA, 13 nt, Human
gccacaggccuga

SEQ ID NO: 3475293 - RNA, 15 nt, Human
gccacaggccugaga

SEQ ID NO: 3475294 - RNA, 20 nt, Human
gccacaggccugagauuuca

SEQ ID NO: 3475295 - RNA, 18 nt, Human
gccacaguauggaugggu

SEQ ID NO: 3475296 - RNA, 22 nt, Human
gccacaguauggauggguggau

SEQ ID NO: 3475297 - RNA, 17 nt, Human
gccacauacuugcagcu

SEQ ID NO: 3475298 - RNA, 17 nt, Human
gccacauccccgcuggc

SEQ ID NO: 3475299 - RNA, 18 nt, Human
gccacauccccgcuggcu

SEQ ID NO: 3475300 - RNA, 20 nt, Human
gccacauccccgcuggcugg

SEQ ID NO: 3475301 - RNA, 14 nt, Human
gccacauuagaacu

SEQ ID NO: 3475302 - RNA, 16 nt, Human
gccacauuccugaugc

SEQ ID NO: 3475303 - RNA, 19 nt, Human
gccacauuuggaauacuuu

SEQ ID NO: 3475304 - RNA, 21 nt, Human
gccaccaacagccacucagaa

SEQ ID NO: 3475305 - RNA, 19 nt, Human
gccaccaacauacucccau

SEQ ID NO: 3475306 - RNA, 22 nt, Human
gccaccaacauacucccaucug

SEQ ID NO: 3475307 - RNA, 22 nt, Human
gccaccaagagggacgccuggg

SEQ ID NO: 3475308 - RNA, 13 nt, Human
gccaccacccccc

SEQ ID NO: 3475309 - RNA, 18 nt, Human
gccaccaccucuguggca

SEQ ID NO: 3475310 - RNA, 16 nt, Human
gccaccacguccagcu

SEQ ID NO: 3475311 - RNA, 21 nt, Human
gccaccagaugugacaguguu

SEQ ID NO: 3475312 - RNA, 12 nt, Human
gccaccaggaug

SEQ ID NO: 3475313 - RNA, 14 nt, Human
gccaccaggcuggc

SEQ ID NO: 3475314 - RNA, 16 nt, Human
gccaccaggucaucuc

SEQ ID NO: 3475315 - RNA, 20 nt, Human
gccaccaggugccuuucaaa

SEQ ID NO: 3475316 - RNA, 13 nt, Human
gccaccaguucuc

SEQ ID NO: 3475317 - RNA, 22 nt, Human
gccaccauauucagugcugugg

SEQ ID NO: 3475318 - RNA, 12 nt, Human
gccaccauccug

SEQ ID NO: 3475319 - RNA, 16 nt, Human
gccaccaugcccagcu

SEQ ID NO: 3475320 - RNA, 14 nt, Human
gccaccauggccag

SEQ ID NO: 3475321 - RNA, 18 nt, Human
gccaccauggccagccaa

SEQ ID NO: 3475322 - RNA, 17 nt, Human
gccacccaccucccugc

SEQ ID NO: 3475323 - RNA, 15 nt, Human
gccacccagccccag

SEQ ID NO: 3475324 - RNA, 23 nt, Human
gccacccagccccagccagggcu

SEQ ID NO: 3475325 - RNA, 18 nt, Human
gccaccccacccucccug

SEQ ID NO: 3475326 - RNA, 23 nt, Human
gccaccccagccuggccacgcag

SEQ ID NO: 3475327 - RNA, 17 nt, Human
gccaccccgagggcuga

SEQ ID NO: 3475328 - RNA, 18 nt, Human
gccaccccgggcucucug

SEQ ID NO: 3475329 - RNA, 18 nt, Human
gccaccccuaaacuccag

SEQ ID NO: 3475330 - RNA, 15 nt, Human
gccaccccuccuucc

SEQ ID NO: 3475331 - RNA, 22 nt, Human
gccacccguucugcuggccugg

SEQ ID NO: 3475332 - RNA, 23 nt, Human
gccacccguucugcuggccugga

SEQ ID NO: 3475333 - RNA, 19 nt, Human
gccacccuaccuguucagu

SEQ ID NO: 3475334 - RNA, 12 nt, Human
gccacccuagcc

SEQ ID NO: 3475335 - RNA, 15 nt, Human
gccacccucaugcug

SEQ ID NO: 3475336 - RNA, 15 nt, Human
gccacccucccagcu

SEQ ID NO: 3475337 - RNA, 13 nt, Human
gccacccugagga

SEQ ID NO: 3475338 - RNA, 16 nt, Human
gccacccugaggaguc

SEQ ID NO: 3475339 - RNA, 20 nt, Human
gccacccugaggagucugag

SEQ ID NO: 3475340 - RNA, 14 nt, Human
gccacccugggcuc

SEQ ID NO: 3475341 - RNA, 17 nt, Human
gccacccugggcucugu

SEQ ID NO: 3475342 - RNA, 19 nt, Human
gccacccugggcucugugg

SEQ ID NO: 3475343 - RNA, 19 nt, Human
gccaccgccuccuacagcc

SEQ ID NO: 3475344 - RNA, 16 nt, Human
gccaccgccuugccca

SEQ ID NO: 3475345 - RNA, 17 nt, Human
gccaccgcgccuggccg

SEQ ID NO: 3475346 - RNA, 20 nt, Human
gccaccuaucucgugggaga

SEQ ID NO: 3475347 - RNA, 11 nt, Human
gccaccucccc

SEQ ID NO: 3475348 - RNA, 18 nt, Human
gccaccuccccuugccag

SEQ ID NO: 3475349 - RNA, 22 nt, Human
gccggguacugagagucugcac

SEQ ID NO: 3475350 - RNA, 13 nt, Human
gccgggugcggug

SEQ ID NO: 3475351 - RNA, 16 nt, Human
gccgggugcucagggc

SEQ ID NO: 3475352 - RNA, 22 nt, Human
gccggucgggggggacccucca

SEQ ID NO: 3475353 - RNA, 20 nt, Human
gccggucugcaagucagagg

SEQ ID NO: 3475354 - RNA, 17 nt, Human
gccggugagaauaagag

SEQ ID NO: 3475355 - RNA, 15 nt, Human
gccgguggugcaggu

SEQ ID NO: 3475356 - RNA, 22 nt, Human
gccgguuccugucccugcgccu

SEQ ID NO: 3475357 - RNA, 13 nt, Human
gccguaauuuaac

SEQ ID NO: 3475358 - RNA, 15 nt, Human
gccguaccccacccu

SEQ ID NO: 3475359 - RNA, 21 nt, Human
gccguaucuccggcucccagc

SEQ ID NO: 3475360 - RNA, 21 nt, Human
gccguccucccgggcccuccc

SEQ ID NO: 3475361 - RNA, 13 nt, Human
gccguccuugucu

SEQ ID NO: 3475362 - RNA, 16 nt, Human
gccgucuaccugaggg

SEQ ID NO: 3475363 - RNA, 22 nt, Human
gccgucuaccugaggggccucu

SEQ ID NO: 3475364 - RNA, 23 nt, Human
gccgucuaccugaggggccucuu

SEQ ID NO: 3475365 - RNA, 22 nt, Human
gccgucuucacucgcccccggg

SEQ ID NO: 3475366 - RNA, 12 nt, Human
gccgugaacuuu

SEQ ID NO: 3475367 - RNA, 16 nt, Human
gccgugaaugggugcc

SEQ ID NO: 3475368 - RNA, 16 nt, Human
gccgugaguucucagg

SEQ ID NO: 3475369 - RNA, 18 nt, Human
gccgugaguucucagggc

SEQ ID NO: 3475370 - RNA, 23 nt, Human
gccgugaguucucagggcuccug

SEQ ID NO: 3475371 - RNA, 14 nt, Human
gccgugcccugccc

SEQ ID NO: 3475372 - RNA, 20 nt, Human
gccguggcugcugugggaaa

SEQ ID NO: 3475373 - RNA, 11 nt, Human
gccguggcuuc

SEQ ID NO: 3475374 - RNA, 18 nt, Human
gccgugggccccacccuc

SEQ ID NO: 3475375 - RNA, 18 nt, Human
gccguguccccugacagg

SEQ ID NO: 3475376 - RNA, 18 nt, Human
gccguuacucuccaaccu

SEQ ID NO: 3475377 - RNA, 20 nt, Human
gccguugccaagaacugaaa

SEQ ID NO: 3475378 - RNA, 23 nt, Human
gccguugccaagaacugaaaaca

SEQ ID NO: 3475379 - RNA, 12 nt, Human
gccguuggccac

SEQ ID NO: 3475380 - RNA, 17 nt, Human
gccuaaaaaugcaacuu

SEQ ID NO: 3475381 - RNA, 18 nt, Human
gccuaaaacuggccugac

SEQ ID NO: 3475382 - RNA, 23 nt, Human
gccuaaaagugggcuugauucug

SEQ ID NO: 3475383 - RNA, 15 nt, Human
gccuaaaccucaguu

SEQ ID NO: 3475384 - RNA, 13 nt, Human
gccuaaauccauu

SEQ ID NO: 3475385 - RNA, 22 nt, Human
gccuaaauccauuuggaaaucu

SEQ ID NO: 3475386 - RNA, 18 nt, Human
gccuaaauuuaaugcugc

SEQ ID NO: 3475387 - RNA, 13 nt, Human
gccuaagaggcug

SEQ ID NO: 3475388 - RNA, 20 nt, Human
gccuaagaggcugcccuccu

SEQ ID NO: 3475389 - RNA, 14 nt, Human
gccuaaggacuucu

SEQ ID NO: 3475390 - RNA, 15 nt, Human
gccuaaggacuucuu

SEQ ID NO: 3475391 - RNA, 14 nt, Human
gccuaaggcugaac

SEQ ID NO: 3475392 - RNA, 19 nt, Human
gccuaauacauuaaagcag

SEQ ID NO: 3475393 - RNA, 20 nt, Human
gccuaauacauuaaagcagu

SEQ ID NO: 3475394 - RNA, 21 nt, Human
gccuaauacauuaaagcaguc

SEQ ID NO: 3475395 - RNA, 20 nt, Human
gccuacagaacuucagaaag

SEQ ID NO: 3475396 - RNA, 17 nt, Human
gccuacaggagugagca

SEQ ID NO: 3475397 - RNA, 19 nt, Human
gccuacaugcuuugugaac

SEQ ID NO: 3475398 - RNA, 15 nt, Human
gccuaccaauauuua

SEQ ID NO: 3475399 - RNA, 17 nt, Human
gccuacccacccccagg

SEQ ID NO: 3475400 - RNA, 18 nt, Human
gccuacuagggaccuggg

SEQ ID NO: 3475401 - RNA, 20 nt, Human
gccuacuagggaccugggga

SEQ ID NO: 3475402 - RNA, 22 nt, Human
gccuacuagggaccuggggaag

SEQ ID NO: 3475403 - RNA, 23 nt, Human
gccuacuccugucuucugcuuug

SEQ ID NO: 3475404 - RNA, 12 nt, Human
gccuagaaacaa

SEQ ID NO: 3475405 - RNA, 20 nt, Human
gccuagaaacaacacuguag

SEQ ID NO: 3475406 - RNA, 23 nt, Human
gccuagaccagcagacagagcca

SEQ ID NO: 3475407 - RNA, 20 nt, Human
gccuagauccacacacagag

SEQ ID NO: 3475408 - RNA, 16 nt, Human
gccuagcaagcuggcc

SEQ ID NO: 3475409 - RNA, 15 nt, Human
gccuagcacagcagc

SEQ ID NO: 3475410 - RNA, 12 nt, Human
gccuagcauacg

SEQ ID NO: 3475411 - RNA, 21 nt, Human
gccuagcauacguacacauuu

SEQ ID NO: 3475412 - RNA, 23 nt, Human
gccuagcccacccugcugccuuc

SEQ ID NO: 3475413 - RNA, 16 nt, Human
gccuagccgaccucag

SEQ ID NO: 3475414 - RNA, 17 nt, Human
gccuagccgaccucagc

SEQ ID NO: 3475415 - RNA, 19 nt, Human
gccuagccgaccucagccu

SEQ ID NO: 3475416 - RNA, 20 nt, Human
gccuagcgaucucuccuggc

SEQ ID NO: 3475417 - RNA, 19 nt, Human
gccuagcugccuagcaagc

SEQ ID NO: 3475418 - RNA, 16 nt, Human
gccuagcugcuacaaa

SEQ ID NO: 3475419 - RNA, 22 nt, Human
gccuagcugcuacaaagaagac

SEQ ID NO: 3475420 - RNA, 24 nt, Human
gccuagcugcuacaaagaagacau

SEQ ID NO: 3475421 - RNA, 12 nt, Human
gccuagcugcug

SEQ ID NO: 3475422 - RNA, 15 nt, Human
gccuagcugcuguca

SEQ ID NO: 3475423 - RNA, 22 nt, Human
gccuaggaccacucagccccua

SEQ ID NO: 3475424 - RNA, 18 nt, Human
gccuaggagauaucugag

SEQ ID NO: 3475425 - RNA, 15 nt, Human
gccuaggauucuaaa

SEQ ID NO: 3475426 - RNA, 13 nt, Human
gccuaggccaggu

SEQ ID NO: 3475427 - RNA, 17 nt, Human
gccuaggccuaguccug

SEQ ID NO: 3475428 - RNA, 13 nt, Human
gccuaggccucag

SEQ ID NO: 3475429 - RNA, 16 nt, Human
gccuaggccucagcca

SEQ ID NO: 3475430 - RNA, 17 nt, Human
gccuaggggucagggac

SEQ ID NO: 3475431 - RNA, 22 nt, Human
gccuaggggucagggaccaagg

SEQ ID NO: 3475432 - RNA, 13 nt, Human
gccuaggugacag

SEQ ID NO: 3475433 - RNA, 14 nt, Human
gccuaggugacaga

SEQ ID NO: 3475434 - RNA, 18 nt, Human
gccuagucagccacaugg

SEQ ID NO: 3475435 - RNA, 21 nt, Human
gccuaguucauccaauccuca

SEQ ID NO: 3475436 - RNA, 16 nt, Human
gccuaguuuacuguuu

SEQ ID NO: 3475437 - RNA, 21 nt, Human
gccuaguuuuuaguaaucugu

SEQ ID NO: 3475438 - RNA, 16 nt, Human
gccuauaaugaagcuu

SEQ ID NO: 3475439 - RNA, 13 nt, Human
gccuauaguccca

SEQ ID NO: 3475440 - RNA, 15 nt, Human
gccuauauuuuccug

SEQ ID NO: 3475441 - RNA, 20 nt, Human
gccuaucagaguugcugcaa

SEQ ID NO: 3475442 - RNA, 14 nt, Human
gccuaucagugugc

SEQ ID NO: 3475443 - RNA, 16 nt, Human
gccuaucagugugccc

SEQ ID NO: 3475444 - RNA, 14 nt, Human
gccuauccuggcca

SEQ ID NO: 3475445 - RNA, 17 nt, Human
gccuaugacuugggcac

SEQ ID NO: 3475446 - RNA, 16 nt, Human
gccuaugagcauccug

SEQ ID NO: 3475447 - RNA, 20 nt, Human
gccuaugcacauauggacuc

SEQ ID NO: 3475448 - RNA, 21 nt, Human
gccuauuaucugucagcugca

SEQ ID NO: 3475449 - RNA, 22 nt, Human
gccuauucccacaccuccacag

SEQ ID NO: 3475450 - RNA, 17 nt, Human
gccuauugcuagagcuc

SEQ ID NO: 3475451 - RNA, 20 nt, Human
gccuauugcuagagcuccuc

SEQ ID NO: 3475452 - RNA, 21 nt, Human
gccuauuucaguggcacguca

SEQ ID NO: 3475453 - RNA, 21 nt, Human
gccuauuuucaugauuucuuu

SEQ ID NO: 3475454 - RNA, 22 nt, Human
gccucaacccucccucagcccc

SEQ ID NO: 3475455 - RNA, 17 nt, Human
gccucaacuccucccau

SEQ ID NO: 3475456 - RNA, 21 nt, Human
gccucaagguuuuagguucua

SEQ ID NO: 3475457 - RNA, 21 nt, Human
gccucaagugauucuccugcc

SEQ ID NO: 3475458 - RNA, 17 nt, Human
gccucaauaagccuugu

SEQ ID NO: 3475459 - RNA, 13 nt, Human
gccucacagaaga

SEQ ID NO: 3475460 - RNA, 16 nt, Human
gccucacagaagaaua

SEQ ID NO: 3475461 - RNA, 15 nt, Human
gccucacagcaguga

SEQ ID NO: 3475462 - RNA, 13 nt, Human
gccucacaguccu

SEQ ID NO: 3475463 - RNA, 17 nt, Human
gccucaccgcuucccuc

SEQ ID NO: 3475464 - RNA, 20 nt, Human
gccucaccgcuucccuccug

SEQ ID NO: 3475465 - RNA, 18 nt, Human
gccucaccucuacccaaa

SEQ ID NO: 3475466 - RNA, 16 nt, Human
gccucacuccaggaag

SEQ ID NO: 3475467 - RNA, 22 nt, Human
gccucacugauauauuuuccag

SEQ ID NO: 3475468 - RNA, 20 nt, Human
gccucacuucuaggguaugg

SEQ ID NO: 3475469 - RNA, 22 nt, Human
gccucacuuggucugccaggcc

SEQ ID NO: 3475470 - RNA, 22 nt, Human
gccucacuuuuaaugaacaaau

SEQ ID NO: 3475471 - RNA, 17 nt, Human
gccucagaaaccagacu

SEQ ID NO: 3475472 - RNA, 13 nt, Human
gccucagaagugc

SEQ ID NO: 3475473 - RNA, 19 nt, Human
gccucagaagugcaucugg

SEQ ID NO: 3475474 - RNA, 17 nt, Human
gccucagaugauuuccc

SEQ ID NO: 3475475 - RNA, 15 nt, Human
gccucagauuccuuc

SEQ ID NO: 3475476 - RNA, 16 nt, Human
gccucagauuccuucc

SEQ ID NO: 3475477 - RNA, 16 nt, Human
gccucagcauccuggc

SEQ ID NO: 3475478 - RNA, 14 nt, Human
gccucagccagaga

SEQ ID NO: 3475479 - RNA, 22 nt, Human
gccucagccucccaaagugcug

SEQ ID NO: 3475480 - RNA, 23 nt, Human
gccucagccucccaaagugcugg

SEQ ID NO: 3475481 - RNA, 14 nt, Human
gccucagccucccg

SEQ ID NO: 3475482 - RNA, 15 nt, Human
gccucagccucccga

SEQ ID NO: 3475483 - RNA, 18 nt, Human
gccucagccuccugagua

SEQ ID NO: 3475484 - RNA, 16 nt, Human
gccucagcucccacaa

SEQ ID NO: 3475485 - RNA, 19 nt, Human
gccucagcugaaugccucc

SEQ ID NO: 3475486 - RNA, 16 nt, Human
gccucagcugccucac

SEQ ID NO: 3475487 - RNA, 20 nt, Human
gccucagcugccucacuucc

SEQ ID NO: 3475488 - RNA, 15 nt, Human
gccucaggccucugu

SEQ ID NO: 3475489 - RNA, 21 nt, Human
gccucagggcagccugccugg

SEQ ID NO: 3475490 - RNA, 22 nt, Human
gccucagggcagccugccugga

SEQ ID NO: 3475491 - RNA, 14 nt, Human
gccucagguuccua

SEQ ID NO: 3475492 - RNA, 15 nt, Human
gccucaguccucccc

SEQ ID NO: 3475493 - RNA, 20 nt, Human
gccuggagcccuccgccuuc

SEQ ID NO: 3475494 - RNA, 22 nt, Human
gccuggagcccuccgccuucac

SEQ ID NO: 3475495 - RNA, 16 nt, Human
gccuggagcccuggag

SEQ ID NO: 3475496 - RNA, 17 nt, Human
gccuggagcccuggaga

SEQ ID NO: 3475497 - RNA, 12 nt, Human
gccuggagcucc

SEQ ID NO: 3475498 - RNA, 14 nt, Human
gccuggaggaccug

SEQ ID NO: 3475499 - RNA, 20 nt, Human
gccuggaggaccugagccug

SEQ ID NO: 3475500 - RNA, 22 nt, Human
gccuggaggccgggugcucagg

SEQ ID NO: 3475501 - RNA, 21 nt, Human
gccuggauauuauucuuguag

SEQ ID NO: 3475502 - RNA, 12 nt, Human
gccuggaucucc

SEQ ID NO: 3475503 - RNA, 14 nt, Human
gccuggauggggcu

SEQ ID NO: 3475504 - RNA, 15 nt, Human
gccuggauggggcug

SEQ ID NO: 3475505 - RNA, 16 nt, Human
gccuggauucauuucc

SEQ ID NO: 3475506 - RNA, 18 nt, Human
gccuggauucauuuccug

SEQ ID NO: 3475507 - RNA, 20 nt, Human
gccuggauucauuuccugcc

SEQ ID NO: 3475508 - RNA, 20 nt, Human
gccuggcaauagaccgagac

SEQ ID NO: 3475509 - RNA, 16 nt, Human
gccuggcacacaucag

SEQ ID NO: 3475510 - RNA, 15 nt, Human
gccuggcacaggacu

SEQ ID NO: 3475511 - RNA, 17 nt, Human
gccuggcacaggacuga

SEQ ID NO: 3475512 - RNA, 13 nt, Human
gccuggcacaggg

SEQ ID NO: 3475513 - RNA, 19 nt, Human
gccuggcacagggcagugg

SEQ ID NO: 3475514 - RNA, 20 nt, Human
gccuggcagccgugccuuca

SEQ ID NO: 3475515 - RNA, 20 nt, Human
gccuggccaacauggcgaaa

SEQ ID NO: 3475516 - RNA, 17 nt, Human
gccuggccacgcagcca

SEQ ID NO: 3475517 - RNA, 21 nt, Human
gccuggccacgcagccaggac

SEQ ID NO: 3475518 - RNA, 14 nt, Human
gccuggccagacac

SEQ ID NO: 3475519 - RNA, 16 nt, Human
gccuggccagacacag

SEQ ID NO: 3475520 - RNA, 16 nt, Human
gccuggccagaugcac

SEQ ID NO: 3475521 - RNA, 22 nt, Human
gccuggccagaugcaccagccc

SEQ ID NO: 3475522 - RNA, 15 nt, Human
gccuggccaggagca

SEQ ID NO: 3475523 - RNA, 15 nt, Human
gccuggccaggcaga

SEQ ID NO: 3475524 - RNA, 17 nt, Human
gccuggccagggccugg

SEQ ID NO: 3475525 - RNA, 18 nt, Human
gccuggcccaccccaccc

SEQ ID NO: 3475526 - RNA, 11 nt, Human
gccuggcccag

SEQ ID NO: 3475527 - RNA, 12 nt, Human
gccuggcccagc

SEQ ID NO: 3475528 - RNA, 14 nt, Human
gccuggcccagcuc

SEQ ID NO: 3475529 - RNA, 15 nt, Human
gccuggcccagcucc

SEQ ID NO: 3475530 - RNA, 14 nt, Human
gccuggcccauaga

SEQ ID NO: 3475531 - RNA, 12 nt, Human
gccuggcccaug

SEQ ID NO: 3475532 - RNA, 10 nt, Human
gccuggcccc

SEQ ID NO: 3475533 - RNA, 13 nt, Human
gccuggcccccaa

SEQ ID NO: 3475534 - RNA, 20 nt, Human
gccuggcccccaaccucagg

SEQ ID NO: 3475535 - RNA, 22 nt, Human
gccuggcccccaaccucagggc

SEQ ID NO: 3475536 - RNA, 14 nt, Human
gccuggccccucag

SEQ ID NO: 3475537 - RNA, 17 nt, Human
gccuggccccucagggu

SEQ ID NO: 3475538 - RNA, 12 nt, Human
gccuggcccugc

SEQ ID NO: 3475539 - RNA, 19 nt, Human
gccuggcccugcccugagg

SEQ ID NO: 3475540 - RNA, 14 nt, Human
gccuggccggccag

SEQ ID NO: 3475541 - RNA, 22 nt, Human
gccuggccggccagccagccac

SEQ ID NO: 3475542 - RNA, 18 nt, Human
gccuggccuccaggcccg

SEQ ID NO: 3475543 - RNA, 15 nt, Human
gccuggccuccugcc

SEQ ID NO: 3475544 - RNA, 13 nt, Human
gccuggccugagc

SEQ ID NO: 3475545 - RNA, 19 nt, Human
gccuggccuggcccugccc

SEQ ID NO: 3475546 - RNA, 23 nt, Human
gccuggccuuguccucagccagu

SEQ ID NO: 3475547 - RNA, 21 nt, Human
gccuggcgggaugggccaccg

SEQ ID NO: 3475548 - RNA, 14 nt, Human
gccuggcucagagc

SEQ ID NO: 3475549 - RNA, 18 nt, Human
gccuggcucagagccagu

SEQ ID NO: 3475550 - RNA, 13 nt, Human
gccuggcuccccu

SEQ ID NO: 3475551 - RNA, 14 nt, Human
gccuggcuccccug

SEQ ID NO: 3475552 - RNA, 17 nt, Human
gccuggcuccccugggg

SEQ ID NO: 3475553 - RNA, 17 nt, Human
gccuggcuccgcugugu

SEQ ID NO: 3475554 - RNA, 19 nt, Human
gccuggcucuugugcugga

SEQ ID NO: 3475555 - RNA, 23 nt, Human
gccuggcugcagccugcgccacc

SEQ ID NO: 3475556 - RNA, 12 nt, Human
gccuggcuggcu

SEQ ID NO: 3475557 - RNA, 14 nt, Human
gccuggcuggcuga

SEQ ID NO: 3475558 - RNA, 15 nt, Human
gccuggcuggcugag

SEQ ID NO: 3475559 - RNA, 18 nt, Human
gccuggcuggcugagggc

SEQ ID NO: 3475560 - RNA, 21 nt, Human
gccuggcuggcugagggcagu

SEQ ID NO: 3475561 - RNA, 13 nt, Human
gccuggcuucucc

SEQ ID NO: 3475562 - RNA, 13 nt, Human
gccuggcuucugg

SEQ ID NO: 3475563 - RNA, 15 nt, Human
gccugggaauguauu

SEQ ID NO: 3475564 - RNA, 19 nt, Human
gccugggacaacugcuccc

SEQ ID NO: 3475565 - RNA, 15 nt, Human
gccugggaggcacag

SEQ ID NO: 3475566 - RNA, 18 nt, Human
gccugggaucccucaucc

SEQ ID NO: 3475567 - RNA, 21 nt, Human
gccugggaucccucauccuca

SEQ ID NO: 3475568 - RNA, 20 nt, Human
gccugggcaacacagcgaga

SEQ ID NO: 3475569 - RNA, 20 nt, Human
gccugggcaacagagcaaga

SEQ ID NO: 3475570 - RNA, 21 nt, Human
gccugggcaacagagcaagac

SEQ ID NO: 3475571 - RNA, 17 nt, Human
gccugggcagaaggaag

SEQ ID NO: 3475572 - RNA, 19 nt, Human
gccugggcagcauagcaag

SEQ ID NO: 3475573 - RNA, 20 nt, Human
gccugggcagccaggcugcc

SEQ ID NO: 3475574 - RNA, 15 nt, Human
gccugggcccaucuc

SEQ ID NO: 3475575 - RNA, 16 nt, Human
gccugggcccaucucc

SEQ ID NO: 3475576 - RNA, 18 nt, Human
gccugggcccaucucccu

SEQ ID NO: 3475577 - RNA, 21 nt, Human
gccugggccguagcuugucug

SEQ ID NO: 3475578 - RNA, 19 nt, Human
gccugggccuauggagagc

SEQ ID NO: 3475579 - RNA, 11 nt, Human
gccugggccug

SEQ ID NO: 3475580 - RNA, 20 nt, Human
gccugggcgacagagcgaga

SEQ ID NO: 3475581 - RNA, 21 nt, Human
gccugggcgcugguccuuucu

SEQ ID NO: 3475582 - RNA, 10 nt, Human
gccugggcuc

SEQ ID NO: 3475583 - RNA, 17 nt, Human
gccugggcuccuggacc

SEQ ID NO: 3475584 - RNA, 20 nt, Human
gccugggcuguuggcacuca

SEQ ID NO: 3475585 - RNA, 16 nt, Human
gccuggggccugagag

SEQ ID NO: 3475586 - RNA, 22 nt, Human
gccuggggcuccuuucuccagc

SEQ ID NO: 3475587 - RNA, 23 nt, Human
gccuggggcucuaacgccugagc

SEQ ID NO: 3475588 - RNA, 17 nt, Human
gccugggggccuggcug

SEQ ID NO: 3475589 - RNA, 18 nt, Human
gccugggggccuggcugg

SEQ ID NO: 3475590 - RNA, 21 nt, Human
gccugggggcugggcagagga

SEQ ID NO: 3475591 - RNA, 16 nt, Human
gccugggggugccagg

SEQ ID NO: 3475592 - RNA, 19 nt, Human
gccuggggugacccggcac

SEQ ID NO: 3475593 - RNA, 21 nt, Human
gccugggguguuaguggcacc

SEQ ID NO: 3475594 - RNA, 16 nt, Human
gccuggguccagggga

SEQ ID NO: 3475595 - RNA, 14 nt, Human
gccugggucugugu

SEQ ID NO: 3475596 - RNA, 20 nt, Human
gccugggugacaaagcgaga

SEQ ID NO: 3475597 - RNA, 23 nt, Human
gccugggugacaaagugagacuc

SEQ ID NO: 3475598 - RNA, 22 nt, Human
gccugggugacagagcaagacu

SEQ ID NO: 3475599 - RNA, 20 nt, Human
gccugggugacagagugaga

SEQ ID NO: 3475600 - RNA, 23 nt, Human
gccugggugacagagugagacuc

SEQ ID NO: 3475601 - RNA, 12 nt, Human
gccugggugcug

SEQ ID NO: 3475602 - RNA, 20 nt, Human
gccugggugcuggcugccca

SEQ ID NO: 3475603 - RNA, 16 nt, Human
gccuggguggggcugc

SEQ ID NO: 3475604 - RNA, 20 nt, Human
gccuggguuuaaggggagag

SEQ ID NO: 3475605 - RNA, 19 nt, Human
gccuggguuugguguaugg

SEQ ID NO: 3475606 - RNA, 20 nt, Human
gccugguauauccaaaagcu

SEQ ID NO: 3475607 - RNA, 20 nt, Human
gccugguccaugcagggggc

SEQ ID NO: 3475608 - RNA, 15 nt, Human
gccuggucccuggga

SEQ ID NO: 3475609 - RNA, 16 nt, Human
gccuggucccugggag

SEQ ID NO: 3475610 - RNA, 19 nt, Human
gccuggucucacccuggag

SEQ ID NO: 3475611 - RNA, 13 nt, Human
gccuggugcugcu

SEQ ID NO: 3475612 - RNA, 20 nt, Human
gccugguggaaggaggcgca

SEQ ID NO: 3475613 - RNA, 18 nt, Human
gccugguggcagcugcgg

SEQ ID NO: 3475614 - RNA, 13 nt, Human
gccuggugggccu

SEQ ID NO: 3475615 - RNA, 21 nt, Human
gccugguuaaauaaggcaggg

SEQ ID NO: 3475616 - RNA, 15 nt, Human
gccugguugaagaag

SEQ ID NO: 3475617 - RNA, 19 nt, Human
gccugguugaagaagauga

SEQ ID NO: 3475618 - RNA, 22 nt, Human
gccuguaacacuccucugcguc

SEQ ID NO: 3475619 - RNA, 19 nt, Human
gccuguaaucccagcacuu

SEQ ID NO: 3475620 - RNA, 17 nt, Human
gccuguaaucccagcag

SEQ ID NO: 3475621 - RNA, 18 nt, Human
gccuguaaucccagcagu

SEQ ID NO: 3475622 - RNA, 16 nt, Human
gccuguaaucccagcu

SEQ ID NO: 3475623 - RNA, 19 nt, Human
gccuguaaucccagcuacu

SEQ ID NO: 3475624 - RNA, 21 nt, Human
gccuguacagucugucuucug

SEQ ID NO: 3475625 - RNA, 15 nt, Human
gccuguagaguugcu

SEQ ID NO: 3475626 - RNA, 21 nt, Human
gccuguagccccagugacagc

SEQ ID NO: 3475627 - RNA, 19 nt, Human
gccuguauacuuuaguaug

SEQ ID NO: 3475628 - RNA, 15 nt, Human
gccugucagauccag

SEQ ID NO: 3475629 - RNA, 15 nt, Human
gccuguccacaggcu

SEQ ID NO: 3475630 - RNA, 23 nt, Human
gccuguccacaggcuucugagca

SEQ ID NO: 3475631 - RNA, 14 nt, Human
gccuguccagccug

SEQ ID NO: 3475632 - RNA, 15 nt, Human
gccuguccagccugg

SEQ ID NO: 3475633 - RNA, 13 nt, Human
gccugucccuggc

SEQ ID NO: 3475634 - RNA, 14 nt, Human
gccuguccugccug

SEQ ID NO: 3475635 - RNA, 19 nt, Human
gccuguccugccuguggcc

SEQ ID NO: 3475636 - RNA, 16 nt, Human
gccuguccugggcugg

SEQ ID NO: 3475637 - RNA, 17 nt, Human
gccugucucauccccag

SEQ ID NO: 3475638 - RNA, 12 nt, Human
gcugacaguccu

SEQ ID NO: 3475639 - RNA, 19 nt, Human
gcugacaguccucuccacc

SEQ ID NO: 3475640 - RNA, 22 nt, Human
gcugacaucuugaauccuucca

SEQ ID NO: 3475641 - RNA, 21 nt, Human
gcugacaugaagcuguugugu

SEQ ID NO: 3475642 - RNA, 21 nt, Human
gcugacauuguggcacauucu

SEQ ID NO: 3475643 - RNA, 16 nt, Human
gcugaccaauugugcu

SEQ ID NO: 3475644 - RNA, 20 nt, Human
gcugaccaauugugcugcca

SEQ ID NO: 3475645 - RNA, 13 nt, Human
gcugacccagucc

SEQ ID NO: 3475646 - RNA, 16 nt, Human
gcugacccagucccug

SEQ ID NO: 3475647 - RNA, 19 nt, Human
gcugacccaugggcaggag

SEQ ID NO: 3475648 - RNA, 20 nt, Human
gcugacccaugggcaggaga

SEQ ID NO: 3475649 - RNA, 13 nt, Human
gcugaccccccuc

SEQ ID NO: 3475650 - RNA, 15 nt, Human
gcugacccuccuguu

SEQ ID NO: 3475651 - RNA, 16 nt, Human
gcugaccuccacagcu

SEQ ID NO: 3475652 - RNA, 16 nt, Human
gcugaccucugguggc

SEQ ID NO: 3475653 - RNA, 15 nt, Human
gcugaccugccucuc

SEQ ID NO: 3475654 - RNA, 15 nt, Human
gcugacgaacuucca

SEQ ID NO: 3475655 - RNA, 14 nt, Human
gcugacgaggcugg

SEQ ID NO: 3475656 - RNA, 15 nt, Human
gcugacgaggcuggg

SEQ ID NO: 3475657 - RNA, 16 nt, Human
gcugacuacagggccg

SEQ ID NO: 3475658 - RNA, 15 nt, Human
gcugacuagaagggc

SEQ ID NO: 3475659 - RNA, 17 nt, Human
gcugacucacaccugaa

SEQ ID NO: 3475660 - RNA, 22 nt, Human
gcugacugccaauaacauucuu

SEQ ID NO: 3475661 - RNA, 20 nt, Human
gcugacuguacuccucccag

SEQ ID NO: 3475662 - RNA, 16 nt, Human
gcugacuguccucucc

SEQ ID NO: 3475663 - RNA, 20 nt, Human
gcugacuucacuuauuaguc

SEQ ID NO: 3475664 - RNA, 16 nt, Human
gcugacuuggcuggug

SEQ ID NO: 3475665 - RNA, 16 nt, Human
gcugagaauagaagga

SEQ ID NO: 3475666 - RNA, 15 nt, Human
gcugagacugugcug

SEQ ID NO: 3475667 - RNA, 14 nt, Human
gcugagagacccaa

SEQ ID NO: 3475668 - RNA, 15 nt, Human
gcugagagccccagc

SEQ ID NO: 3475669 - RNA, 17 nt, Human
gcugagagccccagcug

SEQ ID NO: 3475670 - RNA, 14 nt, Human
gcugagauccugga

SEQ ID NO: 3475671 - RNA, 13 nt, Human
gcugagccaggcu

SEQ ID NO: 3475672 - RNA, 14 nt, Human
gcugagccccuacc

SEQ ID NO: 3475673 - RNA, 22 nt, Human
gcugagccucacagcagugaga

SEQ ID NO: 3475674 - RNA, 12 nt, Human
gcugagccucag

SEQ ID NO: 3475675 - RNA, 16 nt, Human
gcugagccucagucuc

SEQ ID NO: 3475676 - RNA, 20 nt, Human
gcugagccucugcuccccag

SEQ ID NO: 3475677 - RNA, 12 nt, Human
gcugagccugca

SEQ ID NO: 3475678 - RNA, 19 nt, Human
gcugagccugcagggaagc

SEQ ID NO: 3475679 - RNA, 21 nt, Human
gcugagcucacaaggcagcaa

SEQ ID NO: 3475680 - RNA, 22 nt, Human
gcugagcucacaaggcagcaag

SEQ ID NO: 3475681 - RNA, 17 nt, Human
gcugagcucugagaggc

SEQ ID NO: 3475682 - RNA, 22 nt, Human
gcugagcugcccacagcaggcc

SEQ ID NO: 3475683 - RNA, 12 nt, Human
gcugaggaaagg

SEQ ID NO: 3475684 - RNA, 18 nt, Human
gcugaggaggcaccuaca

SEQ ID NO: 3475685 - RNA, 21 nt, Human
gcugaggaggccuccaucuca

SEQ ID NO: 3475686 - RNA, 18 nt, Human
gcugaggauuucaagccu

SEQ ID NO: 3475687 - RNA, 19 nt, Human
gcugaggcacaagaaucac

SEQ ID NO: 3475688 - RNA, 16 nt, Human
gcugaggcagaagaau

SEQ ID NO: 3475689 - RNA, 23 nt, Human
gcugaggcagcagugugaggcca

SEQ ID NO: 3475690 - RNA, 21 nt, Human
gcugaggccuggacuuuccug

SEQ ID NO: 3475691 - RNA, 16 nt, Human
gcugaggccugggccg

SEQ ID NO: 3475692 - RNA, 17 nt, Human
gcugaggccugggccgc

SEQ ID NO: 3475693 - RNA, 18 nt, Human
gcugaggcuggcacagga

SEQ ID NO: 3475694 - RNA, 23 nt, Human
gcugaggcugggggagagccgug

SEQ ID NO: 3475695 - RNA, 16 nt, Human
gcugagggaccagcca

SEQ ID NO: 3475696 - RNA, 22 nt, Human
gcugagggauggacugaugcuu

SEQ ID NO: 3475697 - RNA, 12 nt, Human
gcugagggcagu

SEQ ID NO: 3475698 - RNA, 12 nt, Human
gcugagggccug

SEQ ID NO: 3475699 - RNA, 14 nt, Human
gcugagggccugcu

SEQ ID NO: 3475700 - RNA, 17 nt, Human
gcugagggccugcugga

SEQ ID NO: 3475701 - RNA, 22 nt, Human
gcugagggccugcuggaggccu

SEQ ID NO: 3475702 - RNA, 21 nt, Human
gcugaggggggccgugcccag

SEQ ID NO: 3475703 - RNA, 17 nt, Human
gcugaggucucuugagg

SEQ ID NO: 3475704 - RNA, 17 nt, Human
gcugaggugcccaggag

SEQ ID NO: 3475705 - RNA, 14 nt, Human
gcugaggugggagg

SEQ ID NO: 3475706 - RNA, 21 nt, Human
gcugaggugggaggaucucuu

SEQ ID NO: 3475707 - RNA, 21 nt, Human
gcugaggugucuuaagccuuu

SEQ ID NO: 3475708 - RNA, 17 nt, Human
gcugagguuucacccuu

SEQ ID NO: 3475709 - RNA, 20 nt, Human
gcugaguagaugcgcagccc

SEQ ID NO: 3475710 - RNA, 20 nt, Human
gcugaguauggagcagccug

SEQ ID NO: 3475711 - RNA, 21 nt, Human
gcugaguauguuaagcucuuu

SEQ ID NO: 3475712 - RNA, 22 nt, Human
gcugagucaugaucucccugcc

SEQ ID NO: 3475713 - RNA, 21 nt, Human
gcugagucccaggcugagccu

SEQ ID NO: 3475714 - RNA, 16 nt, Human
gcugagucugaaggcu

SEQ ID NO: 3475715 - RNA, 18 nt, Human
gcugagucugaaggcugg

SEQ ID NO: 3475716 - RNA, 12 nt, Human
gcugagugagcu

SEQ ID NO: 3475717 - RNA, 14 nt, Human
gcugagugcaggcc

SEQ ID NO: 3475718 - RNA, 18 nt, Human
gcugagugcaggcccacc

SEQ ID NO: 3475719 - RNA, 21 nt, Human
gcugagugcaggcccacccug

SEQ ID NO: 3475720 - RNA, 23 nt, Human
gcugagugcaggcccacccugcu

SEQ ID NO: 3475721 - RNA, 17 nt, Human
gcugaguggcaggggac

SEQ ID NO: 3475722 - RNA, 22 nt, Human
gcugagugggagaaggcaguga

SEQ ID NO: 3475723 - RNA, 22 nt, Human
gcugagugggggaucacagccu

SEQ ID NO: 3475724 - RNA, 11 nt, Human
gcugaguuucc

SEQ ID NO: 3475725 - RNA, 12 nt, Human
gcugaguuuccu

SEQ ID NO: 3475726 - RNA, 13 nt, Human
gcugaguuuccua

SEQ ID NO: 3475727 - RNA, 20 nt, Human
gcugaguuuucucuuugugg

SEQ ID NO: 3475728 - RNA, 13 nt, Human
gcugauaauuuua

SEQ ID NO: 3475729 - RNA, 14 nt, Human
gcugauaauuuuaa

SEQ ID NO: 3475730 - RNA, 17 nt, Human
gcugauauaaauucugu

SEQ ID NO: 3475731 - RNA, 17 nt, Human
gcugauauuuucucuag

SEQ ID NO: 3475732 - RNA, 22 nt, Human
gcugaucaucgccagaggugcu

SEQ ID NO: 3475733 - RNA, 18 nt, Human
gcugauccagagcacaga

SEQ ID NO: 3475734 - RNA, 15 nt, Human
gcugaucgcuucucc

SEQ ID NO: 3475735 - RNA, 14 nt, Human
gcugaucucaggga

SEQ ID NO: 3475736 - RNA, 16 nt, Human
gcugaugcugggcugg

SEQ ID NO: 3475737 - RNA, 19 nt, Human
gcugaugcugggcugggug

SEQ ID NO: 3475738 - RNA, 13 nt, Human
gcugauggucugg

SEQ ID NO: 3475739 - RNA, 16 nt, Human
gcugauggugcaauga

SEQ ID NO: 3475740 - RNA, 13 nt, Human
gcugauguucagu

SEQ ID NO: 3475741 - RNA, 21 nt, Human
gcugauguucaguguaauuuc

SEQ ID NO: 3475742 - RNA, 21 nt, Human
gcugauuaaaccaaggcuaga

SEQ ID NO: 3475743 - RNA, 19 nt, Human
gcugauuuaaacacauuaa

SEQ ID NO: 3475744 - RNA, 15 nt, Human
gcugauuuccccucu

SEQ ID NO: 3475745 - RNA, 14 nt, Human
gcugauuuuaaugg

SEQ ID NO: 3475746 - RNA, 17 nt, Human
gcugcaaaagugagggc

SEQ ID NO: 3475747 - RNA, 15 nt, Human
gcugcaacaaaaugu

SEQ ID NO: 3475748 - RNA, 18 nt, Human
gcugcaagcacagcccuu

SEQ ID NO: 3475749 - RNA, 19 nt, Human
gcugcaaggccuuucugug

SEQ ID NO: 3475750 - RNA, 20 nt, Human
gcugcaagugacaucucuuu

SEQ ID NO: 3475751 - RNA, 21 nt, Human
gcugcacagggcagcugggcc

SEQ ID NO: 3475752 - RNA, 17 nt, Human
gcugcaccaacccagcc

SEQ ID NO: 3475753 - RNA, 15 nt, Human
gcugcaccccuuccu

SEQ ID NO: 3475754 - RNA, 16 nt, Human
gcugcacccucaggca

SEQ ID NO: 3475755 - RNA, 17 nt, Human
gcugcaccggcuggccu

SEQ ID NO: 3475756 - RNA, 19 nt, Human
gcugcaccggcuggccugg

SEQ ID NO: 3475757 - RNA, 18 nt, Human
gcugcaccugccagccug

SEQ ID NO: 3475758 - RNA, 21 nt, Human
gcugcaccugccagccuggcu

SEQ ID NO: 3475759 - RNA, 15 nt, Human
gcugcacucugugcc

SEQ ID NO: 3475760 - RNA, 16 nt, Human
gcugcacucugugccc

SEQ ID NO: 3475761 - RNA, 20 nt, Human
gcugcacugaugcugccccu

SEQ ID NO: 3475762 - RNA, 17 nt, Human
gcugcagaaggccaaga

SEQ ID NO: 3475763 - RNA, 18 nt, Human
gcugcagagacagagagg

SEQ ID NO: 3475764 - RNA, 19 nt, Human
gcugcagagccacccugug

SEQ ID NO: 3475765 - RNA, 13 nt, Human
gcugcagaggggc

SEQ ID NO: 3475766 - RNA, 23 nt, Human
gcugcagaggggcaggcccugca

SEQ ID NO: 3475767 - RNA, 23 nt, Human
gcugcagagucacaagccucgag

SEQ ID NO: 3475768 - RNA, 21 nt, Human
gcugcagauuugggcuggaac

SEQ ID NO: 3475769 - RNA, 20 nt, Human
gcugcagcaccgaggggccu

SEQ ID NO: 3475770 - RNA, 20 nt, Human
gcugcagcagcgguggccuc

SEQ ID NO: 3475771 - RNA, 23 nt, Human
gcugcagccaggccacuggcccc

SEQ ID NO: 3475772 - RNA, 15 nt, Human
gcugcagccucagga

SEQ ID NO: 3475773 - RNA, 22 nt, Human
gcugcagccucaggacugggag

SEQ ID NO: 3475774 - RNA, 23 nt, Human
gcugcagccucaggacugggagc

SEQ ID NO: 3475775 - RNA, 21 nt, Human
gcugcagccugcgccaccgcc

SEQ ID NO: 3475776 - RNA, 23 nt, Human
gcugcagcucccuggcuucugug

SEQ ID NO: 3475777 - RNA, 14 nt, Human
gcugcagcuggaca

SEQ ID NO: 3475778 - RNA, 15 nt, Human
gcugcagcuggacag

SEQ ID NO: 3475779 - RNA, 16 nt, Human
gcugcagcuggacaga

SEQ ID NO: 3475780 - RNA, 15 nt, Human
gcugcagcugggagc

SEQ ID NO: 3475781 - RNA, 22 nt, Human
gcugcaggaaucaaaaauugaa

SEQ ID NO: 3475782 - RNA, 11 nt, Human
gcuggcccagc

SEQ ID NO: 3475783 - RNA, 20 nt, Human
gcuggcccagcccugcuggc

SEQ ID NO: 3475784 - RNA, 16 nt, Human
gcuggcccagccggcc

SEQ ID NO: 3475785 - RNA, 19 nt, Human
gcuggcccagccggccucu

SEQ ID NO: 3475786 - RNA, 23 nt, Human
gcuggcccagccggccucucugg

SEQ ID NO: 3475787 - RNA, 19 nt, Human
gcuggcccagggcccagag

SEQ ID NO: 3475788 - RNA, 15 nt, Human
gcuggccccagcccu

SEQ ID NO: 3475789 - RNA, 16 nt, Human
gcuggccccagcccug

SEQ ID NO: 3475790 - RNA, 20 nt, Human
gcuggcccccacuggcugug

SEQ ID NO: 3475791 - RNA, 22 nt, Human
gcuggccccgccgccugguacu

SEQ ID NO: 3475792 - RNA, 24 nt, Human
gcuggccccgccgccugguacuca

SEQ ID NO: 3475793 - RNA, 11 nt, Human
gcuggccccuc

SEQ ID NO: 3475794 - RNA, 14 nt, Human
gcuggccccucacc

SEQ ID NO: 3475795 - RNA, 14 nt, Human
gcuggccccuuugg

SEQ ID NO: 3475796 - RNA, 22 nt, Human
gcuggccccuuugggcccugca

SEQ ID NO: 3475797 - RNA, 19 nt, Human
gcuggcccgugacagacuc

SEQ ID NO: 3475798 - RNA, 12 nt, Human
gcuggcccugcc

SEQ ID NO: 3475799 - RNA, 15 nt, Human
gcuggccgagggucc

SEQ ID NO: 3475800 - RNA, 24 nt, Human
gcuggccgaggguccuggcuccug

SEQ ID NO: 3475801 - RNA, 15 nt, Human
gcuggccggacaccc

SEQ ID NO: 3475802 - RNA, 22 nt, Human
gcuggccggagcaaacucugcu

SEQ ID NO: 3475803 - RNA, 17 nt, Human
gcuggccgggagccuga

SEQ ID NO: 3475804 - RNA, 18 nt, Human
gcuggccgugggccuggg

SEQ ID NO: 3475805 - RNA, 16 nt, Human
gcuggccucagacuca

SEQ ID NO: 3475806 - RNA, 21 nt, Human
gcuggccucccaaaugagcca

SEQ ID NO: 3475807 - RNA, 16 nt, Human
gcuggccucuaccaca

SEQ ID NO: 3475808 - RNA, 15 nt, Human
gcuggccucucuagc

SEQ ID NO: 3475809 - RNA, 23 nt, Human
gcuggccucuggcucucaugggg

SEQ ID NO: 3475810 - RNA, 12 nt, Human
gcuggccuggau

SEQ ID NO: 3475811 - RNA, 14 nt, Human
gcuggccuggaucu

SEQ ID NO: 3475812 - RNA, 12 nt, Human
gcuggccuggcc

SEQ ID NO: 3475813 - RNA, 17 nt, Human
gcuggccuggccggcaa

SEQ ID NO: 3475814 - RNA, 20 nt, Human
gcuggccuggggucaggccg

SEQ ID NO: 3475815 - RNA, 12 nt, Human
gcuggccuuccu

SEQ ID NO: 3475816 - RNA, 15 nt, Human
gcuggccuuccugcc

SEQ ID NO: 3475817 - RNA, 19 nt, Human
gcuggccuuccugcccuac

SEQ ID NO: 3475818 - RNA, 23 nt, Human
gcuggccuuccugcccuacagag

SEQ ID NO: 3475819 - RNA, 19 nt, Human
gcuggccuugugguccaaa

SEQ ID NO: 3475820 - RNA, 15 nt, Human
gcuggcgagagucug

SEQ ID NO: 3475821 - RNA, 20 nt, Human
gcuggcgagagucuggcccu

SEQ ID NO: 3475822 - RNA, 13 nt, Human
gcuggcgcagcca

SEQ ID NO: 3475823 - RNA, 15 nt, Human
gcuggcgccucugca

SEQ ID NO: 3475824 - RNA, 21 nt, Human
gcuggcggcuacucagcagcc

SEQ ID NO: 3475825 - RNA, 14 nt, Human
gcuggcgugcagug

SEQ ID NO: 3475826 - RNA, 15 nt, Human
gcuggcgugcagugg

SEQ ID NO: 3475827 - RNA, 17 nt, Human
gcuggcucacaguacag

SEQ ID NO: 3475828 - RNA, 23 nt, Human
gcuggcucacaguacagcaugug

SEQ ID NO: 3475829 - RNA, 17 nt, Human
gcuggcuccagaugcag

SEQ ID NO: 3475830 - RNA, 15 nt, Human
gcuggcuccagccug

SEQ ID NO: 3475831 - RNA, 19 nt, Human
gcuggcucccagggccaug

SEQ ID NO: 3475832 - RNA, 17 nt, Human
gcuggcuccccaaaggg

SEQ ID NO: 3475833 - RNA, 13 nt, Human
gcuggcuccccug

SEQ ID NO: 3475834 - RNA, 16 nt, Human
gcuggcuccccugcag

SEQ ID NO: 3475835 - RNA, 18 nt, Human
gcuggcuccccugcagcc

SEQ ID NO: 3475836 - RNA, 21 nt, Human
gcuggcuccccugcagcccug

SEQ ID NO: 3475837 - RNA, 13 nt, Human
gcuggcuccugau

SEQ ID NO: 3475838 - RNA, 14 nt, Human
gcuggcuccugauc

SEQ ID NO: 3475839 - RNA, 21 nt, Human
gcuggcucuauaaggcagccu

SEQ ID NO: 3475840 - RNA, 16 nt, Human
gcuggcucugagcgcc

SEQ ID NO: 3475841 - RNA, 14 nt, Human
gcuggcucuucugc

SEQ ID NO: 3475842 - RNA, 15 nt, Human
gcuggcugagggcag

SEQ ID NO: 3475843 - RNA, 14 nt, Human
gcuggcugcaguga

SEQ ID NO: 3475844 - RNA, 19 nt, Human
gcuggcugcccagaccccu

SEQ ID NO: 3475845 - RNA, 20 nt, Human
gcuggcugccuuagaaccuu

SEQ ID NO: 3475846 - RNA, 12 nt, Human
gcuggcuggccu

SEQ ID NO: 3475847 - RNA, 21 nt, Human
gcuggcugggguggccugugu

SEQ ID NO: 3475848 - RNA, 22 nt, Human
gcuggcugggguggccugugug

SEQ ID NO: 3475849 - RNA, 18 nt, Human
gcuggcuguuggcugggg

SEQ ID NO: 3475850 - RNA, 19 nt, Human
gcuggcuguuggcuggggg

SEQ ID NO: 3475851 - RNA, 21 nt, Human
gcuggcuuuucuguuuccugu

SEQ ID NO: 3475852 - RNA, 23 nt, Human
gcugggaacucaccuggggcugc

SEQ ID NO: 3475853 - RNA, 19 nt, Human
gcugggaacugcagaccug

SEQ ID NO: 3475854 - RNA, 20 nt, Human
gcugggacaugggaaagggg

SEQ ID NO: 3475855 - RNA, 16 nt, Human
gcugggacgcucugcu

SEQ ID NO: 3475856 - RNA, 17 nt, Human
gcugggacguggcucag

SEQ ID NO: 3475857 - RNA, 22 nt, Human
gcugggacguggcucagccagc

SEQ ID NO: 3475858 - RNA, 20 nt, Human
gcugggacuacaggcaccca

SEQ ID NO: 3475859 - RNA, 12 nt, Human
gcugggacucag

SEQ ID NO: 3475860 - RNA, 15 nt, Human
gcugggacucagccu

SEQ ID NO: 3475861 - RNA, 17 nt, Human
gcugggacugagccagu

SEQ ID NO: 3475862 - RNA, 15 nt, Human
gcugggacugggaac

SEQ ID NO: 3475863 - RNA, 12 nt, Human
gcugggagagcc

SEQ ID NO: 3475864 - RNA, 18 nt, Human
gcugggagagccuuccag

SEQ ID NO: 3475865 - RNA, 13 nt, Human
gcugggagcucca

SEQ ID NO: 3475866 - RNA, 16 nt, Human
gcugggagcuccacuc

SEQ ID NO: 3475867 - RNA, 15 nt, Human
gcugggagcucugca

SEQ ID NO: 3475868 - RNA, 18 nt, Human
gcugggaggagggagagg

SEQ ID NO: 3475869 - RNA, 22 nt, Human
gcugggaggagggagagggagg

SEQ ID NO: 3475870 - RNA, 17 nt, Human
gcugggaucugacugca

SEQ ID NO: 3475871 - RNA, 17 nt, Human
gcugggauuacaggcgu

SEQ ID NO: 3475872 - RNA, 21 nt, Human
gcugggauuacaggcuccugc

SEQ ID NO: 3475873 - RNA, 22 nt, Human
gcugggauuacaggcuccugcc

SEQ ID NO: 3475874 - RNA, 23 nt, Human
gcugggauuacaggcuccugcca

SEQ ID NO: 3475875 - RNA, 14 nt, Human
gcugggauuuuaaa

SEQ ID NO: 3475876 - RNA, 15 nt, Human
gcugggauuuuaaac

SEQ ID NO: 3475877 - RNA, 16 nt, Human
gcugggcaaggaaaaa

SEQ ID NO: 3475878 - RNA, 19 nt, Human
gcugggcaaggaaaaagaa

SEQ ID NO: 3475879 - RNA, 20 nt, Human
gcugggcacacgccucccac

SEQ ID NO: 3475880 - RNA, 20 nt, Human
gcugggcacugcucucaccu

SEQ ID NO: 3475881 - RNA, 13 nt, Human
gcugggcacuucc

SEQ ID NO: 3475882 - RNA, 13 nt, Human
gcugggcagaagg

SEQ ID NO: 3475883 - RNA, 14 nt, Human
gcugggcagaggaa

SEQ ID NO: 3475884 - RNA, 12 nt, Human
gcugggcagcua

SEQ ID NO: 3475885 - RNA, 22 nt, Human
gcugggcaugguaccagcccug

SEQ ID NO: 3475886 - RNA, 23 nt, Human
gcugggcaugguaccagcccugg

SEQ ID NO: 3475887 - RNA, 19 nt, Human
gcugggcccaacccugucu

SEQ ID NO: 3475888 - RNA, 18 nt, Human
gcugggcccagaggcaca

SEQ ID NO: 3475889 - RNA, 21 nt, Human
gcugggcccagaggcacagcc

SEQ ID NO: 3475890 - RNA, 13 nt, Human
gcugggccccagc

SEQ ID NO: 3475891 - RNA, 15 nt, Human
gcugggccccagccc

SEQ ID NO: 3475892 - RNA, 20 nt, Human
gcugggccccagcccacccu

SEQ ID NO: 3475893 - RNA, 20 nt, Human
gcugggccccccagcucagg

SEQ ID NO: 3475894 - RNA, 14 nt, Human
gcugggccccugcc

SEQ ID NO: 3475895 - RNA, 21 nt, Human
gcugggccccugccucucugc

SEQ ID NO: 3475896 - RNA, 21 nt, Human
gcugggcccgacauggcuccg

SEQ ID NO: 3475897 - RNA, 22 nt, Human
gcugggcccgacauggcuccgg

SEQ ID NO: 3475898 - RNA, 18 nt, Human
gcugggcccucucuucuc

SEQ ID NO: 3475899 - RNA, 12 nt, Human
gcugggccuggu

SEQ ID NO: 3475900 - RNA, 22 nt, Human
gcugggccuggucucacccugg

SEQ ID NO: 3475901 - RNA, 16 nt, Human
gcugggcucccuuccc

SEQ ID NO: 3475902 - RNA, 17 nt, Human
gcugggcucccuuccca

SEQ ID NO: 3475903 - RNA, 13 nt, Human
gcugggcucucca

SEQ ID NO: 3475904 - RNA, 19 nt, Human
gcugggcucuccaccucag

SEQ ID NO: 3475905 - RNA, 20 nt, Human
gcugggcucuccaccucagc

SEQ ID NO: 3475906 - RNA, 14 nt, Human
gcugggcugagccc

SEQ ID NO: 3475907 - RNA, 18 nt, Human
gcugggcugagccccuac

SEQ ID NO: 3475908 - RNA, 13 nt, Human
gcugggcuggcuc

SEQ ID NO: 3475909 - RNA, 12 nt, Human
gcugggcugggg

SEQ ID NO: 3475910 - RNA, 14 nt, Human
gcugggcuggggcc

SEQ ID NO: 3475911 - RNA, 15 nt, Human
gcugggcuggggccu

SEQ ID NO: 3475912 - RNA, 22 nt, Human
gcugggcuucaguggcagcugc

SEQ ID NO: 3475913 - RNA, 16 nt, Human
gcuggggaagacagug

SEQ ID NO: 3475914 - RNA, 13 nt, Human
gcuggggaaggaa

SEQ ID NO: 3475915 - RNA, 22 nt, Human
gcuggggauccccgccuggcca

SEQ ID NO: 3475916 - RNA, 17 nt, Human
gcuggggcaagucccug

SEQ ID NO: 3475917 - RNA, 16 nt, Human
gcuggggccaggcugg

SEQ ID NO: 3475918 - RNA, 19 nt, Human
gcuggggccaggcuggguc

SEQ ID NO: 3475919 - RNA, 20 nt, Human
gcuggggccuaucagugugc

SEQ ID NO: 3475920 - RNA, 21 nt, Human
gcuggggccuaucagugugcc

SEQ ID NO: 3475921 - RNA, 12 nt, Human
gcuggggccugg

SEQ ID NO: 3475922 - RNA, 23 nt, Human
gcugggggaagaagcucucuccu

SEQ ID NO: 3475923 - RNA, 21 nt, Human
gcugggggcagccugcguggc

SEQ ID NO: 3475924 - RNA, 23 nt, Human
gcugggggccaugagcuccagac

SEQ ID NO: 3475925 - RNA, 16 nt, Human
gcuggggucccagcag

SEQ ID NO: 3475926 - RNA, 23 nt, Human
guugccagucaccccggccaccu

SEQ ID NO: 3475927 - RNA, 20 nt, Human
guugcccagccucuuucccu

SEQ ID NO: 3475928 - RNA, 12 nt, Human
guugcccaggca

SEQ ID NO: 3475929 - RNA, 13 nt, Human
guugcccaggcug

SEQ ID NO: 3475930 - RNA, 14 nt, Human
guugcccaggcugg

SEQ ID NO: 3475931 - RNA, 20 nt, Human
guugcccaggcuggagugca

SEQ ID NO: 3475932 - RNA, 20 nt, Human
guugcccagggauuuguccu

SEQ ID NO: 3475933 - RNA, 16 nt, Human
guugccccgucucugu

SEQ ID NO: 3475934 - RNA, 15 nt, Human
guugccuaaauccau

SEQ ID NO: 3475935 - RNA, 16 nt, Human
guugccuaaauccauu

SEQ ID NO: 3475936 - RNA, 17 nt, Human
guugccuaaauccauuu

SEQ ID NO: 3475937 - RNA, 21 nt, Human
guugccuaagcauugccuggc

SEQ ID NO: 3475938 - RNA, 23 nt, Human
guugccuauaagccaaaauuaag

SEQ ID NO: 3475939 - RNA, 15 nt, Human
guugccugucgcuuu

SEQ ID NO: 3475940 - RNA, 18 nt, Human
guugccuuaaagaaaguc

SEQ ID NO: 3475941 - RNA, 20 nt, Human
guugccuuuuucauuuucca

SEQ ID NO: 3475942 - RNA, 20 nt, Human
guugcgacggagagaaaaaa

SEQ ID NO: 3475943 - RNA, 13 nt, Human
guugcgggacaga

SEQ ID NO: 3475944 - RNA, 13 nt, Human
guugcggggggag

SEQ ID NO: 3475945 - RNA, 18 nt, Human
guugcgugacacucuccu

SEQ ID NO: 3475946 - RNA, 17 nt, Human
guugcuauuuuuguaaa

SEQ ID NO: 3475947 - RNA, 22 nt, Human
guugcuccgccucugcuggcac

SEQ ID NO: 3475948 - RNA, 22 nt, Human
guugcuccgccuggccuggcca

SEQ ID NO: 3475949 - RNA, 18 nt, Human
guugcuggaucaggaagc

SEQ ID NO: 3475950 - RNA, 16 nt, Human
guugcugggagcugaa

SEQ ID NO: 3475951 - RNA, 20 nt, Human
guugcugguuauaagcagca

SEQ ID NO: 3475952 - RNA, 22 nt, Human
guugcugugggaacgagagggg

SEQ ID NO: 3475953 - RNA, 23 nt, Human
guugcuuaggaugugugcaugug

SEQ ID NO: 3475954 - RNA, 13 nt, Human
guugcuucuggga

SEQ ID NO: 3475955 - RNA, 14 nt, Human
guugcuuucacucu

SEQ ID NO: 3475956 - RNA, 11 nt, Human
guugcuuuguu

SEQ ID NO: 3475957 - RNA, 21 nt, Human
guugcuuuugaaggaauacaa

SEQ ID NO: 3475958 - RNA, 16 nt, Human
guuggaaagcaggugg

SEQ ID NO: 3475959 - RNA, 15 nt, Human
guuggaagaggaaca

SEQ ID NO: 3475960 - RNA, 22 nt, Human
guuggaagcuagcuccccuccu

SEQ ID NO: 3475961 - RNA, 22 nt, Human
guuggaaugaauuaaauaaacc

SEQ ID NO: 3475962 - RNA, 16 nt, Human
guuggaauuaaaacaa

SEQ ID NO: 3475963 - RNA, 21 nt, Human
guuggacaaaugugaagaugc

SEQ ID NO: 3475964 - RNA, 21 nt, Human
guuggacaccuuuagguucuu

SEQ ID NO: 3475965 - RNA, 19 nt, Human
guuggacagcaaaaccauu

SEQ ID NO: 3475966 - RNA, 15 nt, Human
guuggacccgcucug

SEQ ID NO: 3475967 - RNA, 23 nt, Human
guuggacuaaaugccuaguuuuu

SEQ ID NO: 3475968 - RNA, 17 nt, Human
guuggacuuuucguuaa

SEQ ID NO: 3475969 - RNA, 21 nt, Human
guuggacuuuucguuaacauu

SEQ ID NO: 3475970 - RNA, 19 nt, Human
guuggagccugcagggugg

SEQ ID NO: 3475971 - RNA, 14 nt, Human
guuggagugcagug

SEQ ID NO: 3475972 - RNA, 15 nt, Human
guuggagugcagugg

SEQ ID NO: 3475973 - RNA, 13 nt, Human
guuggaucuucaa

SEQ ID NO: 3475974 - RNA, 16 nt, Human
guuggauuccaugcua

SEQ ID NO: 3475975 - RNA, 17 nt, Human
guuggauuccaugcuaa

SEQ ID NO: 3475976 - RNA, 21 nt, Human
guuggauuuauaaaugcuauu

SEQ ID NO: 3475977 - RNA, 14 nt, Human
guuggcaaaaaggc

SEQ ID NO: 3475978 - RNA, 16 nt, Human
guuggcaccuuccccc

SEQ ID NO: 3475979 - RNA, 19 nt, Human
guuggcacucacagaccug

SEQ ID NO: 3475980 - RNA, 14 nt, Human
guuggcaggcuggc

SEQ ID NO: 3475981 - RNA, 16 nt, Human
guuggcagugagugag

SEQ ID NO: 3475982 - RNA, 15 nt, Human
guuggcauagcucug

SEQ ID NO: 3475983 - RNA, 18 nt, Human
guuggcauagcucugggg

SEQ ID NO: 3475984 - RNA, 23 nt, Human
guuggccaaagccaaagcuaggc

SEQ ID NO: 3475985 - RNA, 20 nt, Human
guuggccacgucuuccuucu

SEQ ID NO: 3475986 - RNA, 19 nt, Human
guuggccaggcugcucuug

SEQ ID NO: 3475987 - RNA, 14 nt, Human
guuggccaggcugg

SEQ ID NO: 3475988 - RNA, 13 nt, Human
guuggccccugcc

SEQ ID NO: 3475989 - RNA, 13 nt, Human
guuggccugcacu

SEQ ID NO: 3475990 - RNA, 18 nt, Human
guuggcgagaggaggggc

SEQ ID NO: 3475991 - RNA, 21 nt, Human
guuggcgcacccuccccuccc

SEQ ID NO: 3475992 - RNA, 18 nt, Human
guuggcguaggcuacaga

SEQ ID NO: 3475993 - RNA, 19 nt, Human
guuggcucugccaguccug

SEQ ID NO: 3475994 - RNA, 23 nt, Human
guuggcucugccaguccuguccu

SEQ ID NO: 3475995 - RNA, 14 nt, Human
guuggcugggccca

SEQ ID NO: 3475996 - RNA, 12 nt, Human
guuggcuggggg

SEQ ID NO: 3475997 - RNA, 19 nt, Human
guuggcugggggccucagu

SEQ ID NO: 3475998 - RNA, 16 nt, Human
guuggcuuaccuggcc

SEQ ID NO: 3475999 - RNA, 16 nt, Human
guugggacccaguggc

SEQ ID NO: 3476000 - RNA, 20 nt, Human
guugggacccaguggcaggg

SEQ ID NO: 3476001 - RNA, 21 nt, Human
guugggacccaguggcagggc

SEQ ID NO: 3476002 - RNA, 13 nt, Human
guugggagcugau

SEQ ID NO: 3476003 - RNA, 14 nt, Human
guugggaggauucu

SEQ ID NO: 3476004 - RNA, 18 nt, Human
guugggauacugcagggc

SEQ ID NO: 3476005 - RNA, 18 nt, Human
guugggauuccugaccca

SEQ ID NO: 3476006 - RNA, 21 nt, Human
guugggauuccugacccaggc

SEQ ID NO: 3476007 - RNA, 21 nt, Human
guugggauugggggcuggugc

SEQ ID NO: 3476008 - RNA, 14 nt, Human
guugggcagccaga

SEQ ID NO: 3476009 - RNA, 15 nt, Human
guugggccaggagcc

SEQ ID NO: 3476010 - RNA, 21 nt, Human
guugggccauacuggccucgc

SEQ ID NO: 3476011 - RNA, 13 nt, Human
guugggcccagau

SEQ ID NO: 3476012 - RNA, 13 nt, Human
guugggcuggugu

SEQ ID NO: 3476013 - RNA, 13 nt, Human
guuggggugacag

SEQ ID NO: 3476014 - RNA, 23 nt, Human
guuggggugguuuuugagccaug

SEQ ID NO: 3476015 - RNA, 19 nt, Human
guuggguggcaauuccaau

SEQ ID NO: 3476016 - RNA, 18 nt, Human
guugguauauuuuauauu

SEQ ID NO: 3476017 - RNA, 18 nt, Human
guuggucccccuuccaug

SEQ ID NO: 3476018 - RNA, 16 nt, Human
guuggucgguggguug

SEQ ID NO: 3476019 - RNA, 23 nt, Human
guuggucucugcauuuuucugca

SEQ ID NO: 3476020 - RNA, 14 nt, Human
guugguguguuuuu

SEQ ID NO: 3476021 - RNA, 18 nt, Human
guugguuccaagcccugg

SEQ ID NO: 3476022 - RNA, 14 nt, Human
guugguuggauaag

SEQ ID NO: 3476023 - RNA, 14 nt, Human
guugguugguuuuc

SEQ ID NO: 3476024 - RNA, 16 nt, Human
guugguugugucuuuu

SEQ ID NO: 3476025 - RNA, 15 nt, Human
guugguuuacuuuca

SEQ ID NO: 3476026 - RNA, 12 nt, Human
guugguuuucuu

SEQ ID NO: 3476027 - RNA, 15 nt, Human
guugguuuucuucuu

SEQ ID NO: 3476028 - RNA, 13 nt, Human
guuguaaaaagaa

SEQ ID NO: 3476029 - RNA, 14 nt, Human
guuguaaaauauag

SEQ ID NO: 3476030 - RNA, 16 nt, Human
guuguaaacaggaagc

SEQ ID NO: 3476031 - RNA, 18 nt, Human
guuguaaauauauaaaua

SEQ ID NO: 3476032 - RNA, 17 nt, Human
guuguaaccugcuguga

SEQ ID NO: 3476033 - RNA, 19 nt, Human
guuguaacuaggcucagag

SEQ ID NO: 3476034 - RNA, 21 nt, Human
guuguaacuaggcucagagau

SEQ ID NO: 3476035 - RNA, 12 nt, Human
guuguaacuuau

SEQ ID NO: 3476036 - RNA, 22 nt, Human
guuguaacuuauauugaagaca

SEQ ID NO: 3476037 - RNA, 18 nt, Human
guuguaacuuauguagau

SEQ ID NO: 3476038 - RNA, 12 nt, Human
guuguacaugaa

SEQ ID NO: 3476039 - RNA, 18 nt, Human
guuguacauuuaugauuu

SEQ ID NO: 3476040 - RNA, 20 nt, Human
guuguacauuuaugauuuaa

SEQ ID NO: 3476041 - RNA, 16 nt, Human
guuguaccaagugaaa

SEQ ID NO: 3476042 - RNA, 23 nt, Human
guuguaccucuuuugcuugccaa

SEQ ID NO: 3476043 - RNA, 23 nt, Human
guuguacuauggaaaaucagcug

SEQ ID NO: 3476044 - RNA, 13 nt, Human
guuguacuuuaaa

SEQ ID NO: 3476045 - RNA, 13 nt, Human
guuguagaaugua

SEQ ID NO: 3476046 - RNA, 19 nt, Human
guuguagauacaaucagcu

SEQ ID NO: 3476047 - RNA, 15 nt, Human
guuguaguguccccc

SEQ ID NO: 3476048 - RNA, 21 nt, Human
guuguauaaauuuauuuacug

SEQ ID NO: 3476049 - RNA, 14 nt, Human
guuguauaauuucg

SEQ ID NO: 3476050 - RNA, 14 nt, Human
guuguauuagaugu

SEQ ID NO: 3476051 - RNA, 22 nt, Human
guuguauucuuugauguuaaca

SEQ ID NO: 3476052 - RNA, 18 nt, Human
guugucaagaauagcauu

SEQ ID NO: 3476053 - RNA, 22 nt, Human
guugucaagucucugcuggccc

SEQ ID NO: 3476054 - RNA, 16 nt, Human
guugucaauauuaaau

SEQ ID NO: 3476055 - RNA, 17 nt, Human
guugucaauauuaaaua

SEQ ID NO: 3476056 - RNA, 18 nt, Human
guugucagcaucuucuca

SEQ ID NO: 3476057 - RNA, 12 nt, Human
guugucagcuga

SEQ ID NO: 3476058 - RNA, 22 nt, Human
guuguccaauuguugacaguuc

SEQ ID NO: 3476059 - RNA, 19 nt, Human
guuguccgguuuacuuuaa

SEQ ID NO: 3476060 - RNA, 17 nt, Human
guuguccucagccccgc

SEQ ID NO: 3476061 - RNA, 23 nt, Human
guuguccucagccccgcguggaa

SEQ ID NO: 3476062 - RNA, 18 nt, Human
guugucuaagaaauugaa

SEQ ID NO: 3476063 - RNA, 14 nt, Human
guugucucccuggc

SEQ ID NO: 3476064 - RNA, 12 nt, Human
guugucucuucu

SEQ ID NO: 3476065 - RNA, 19 nt, Human
guugucugaagucacugca

SEQ ID NO: 3476066 - RNA, 19 nt, Human
guugucugcaacucugaag

SEQ ID NO: 3476067 - RNA, 17 nt, Human
guugugaagauguuugc

SEQ ID NO: 3476068 - RNA, 17 nt, Human
guugugaccugaaguuc

SEQ ID NO: 3476069 - RNA, 16 nt, Human
guugugccccuuucca

SEQ ID NO: 3476070 - RNA, 21 nt, Human
guuguggagagugcaacagua

SEQ ID NO: 3476071 - RNA, 12 nt, Human
guuuauguuuug

SEQ ID NO: 3476072 - RNA, 14 nt, Human
guuuauuaaaugcu

SEQ ID NO: 3476073 - RNA, 18 nt, Human
guuuauuaagcaucagaa

SEQ ID NO: 3476074 - RNA, 18 nt, Human
guuuauuaaucuuagugu

SEQ ID NO: 3476075 - RNA, 23 nt, Human
guuuauuaaucuuaguguaugau

SEQ ID NO: 3476076 - RNA, 15 nt, Human
guuuauuacuuauuu

SEQ ID NO: 3476077 - RNA, 19 nt, Human
guuuauuacuuccaugaau

SEQ ID NO: 3476078 - RNA, 18 nt, Human
guuuauucauaugcauau

SEQ ID NO: 3476079 - RNA, 20 nt, Human
guuuauucuucuagaguuca

SEQ ID NO: 3476080 - RNA, 22 nt, Human
guuuauugaauucauuucacug

SEQ ID NO: 3476081 - RNA, 13 nt, Human
guuuauuucacac

SEQ ID NO: 3476082 - RNA, 16 nt, Human
guuuauuucacuugau

SEQ ID NO: 3476083 - RNA, 18 nt, Human
guuuauuuguuuuuccag

SEQ ID NO: 3476084 - RNA, 16 nt, Human
guuuauuuuaaaacaa

SEQ ID NO: 3476085 - RNA, 19 nt, Human
guuuauuuucaagaauaau

SEQ ID NO: 3476086 - RNA, 21 nt, Human
guuuauuuucuacguuucuuu

SEQ ID NO: 3476087 - RNA, 23 nt, Human
guuuauuuucuacguuucuuuaa

SEQ ID NO: 3476088 - RNA, 14 nt, Human
guuuauuuuucaua

SEQ ID NO: 3476089 - RNA, 17 nt, Human
guuuauuuuucauauug

SEQ ID NO: 3476090 - RNA, 19 nt, Human
guuucaaaaacuguauuga

SEQ ID NO: 3476091 - RNA, 13 nt, Human
guuucaaaaaucu

SEQ ID NO: 3476092 - RNA, 16 nt, Human
guuucaaaauaaaaac

SEQ ID NO: 3476093 - RNA, 22 nt, Human
guuucaaagccaagaccucaca

SEQ ID NO: 3476094 - RNA, 23 nt, Human
guuucaaggcacucuagauucca

SEQ ID NO: 3476095 - RNA, 14 nt, Human
guuucaauaaaguu

SEQ ID NO: 3476096 - RNA, 19 nt, Human
guuucaaugugauucuaau

SEQ ID NO: 3476097 - RNA, 15 nt, Human
guuucaauucagugc

SEQ ID NO: 3476098 - RNA, 23 nt, Human
guuucacagccuauaaccagaca

SEQ ID NO: 3476099 - RNA, 21 nt, Human
guuucacuuucacauagaugu

SEQ ID NO: 3476100 - RNA, 11 nt, Human
guuucagaaau

SEQ ID NO: 3476101 - RNA, 12 nt, Human
guuucagcacua

SEQ ID NO: 3476102 - RNA, 23 nt, Human
guuucagcacuagccaaaccuca

SEQ ID NO: 3476103 - RNA, 21 nt, Human
guuucagcuaagggaagacau

SEQ ID NO: 3476104 - RNA, 22 nt, Human
guuucagcuaagggaagacauu

SEQ ID NO: 3476105 - RNA, 23 nt, Human
guuucaggagagaguugaaccua

SEQ ID NO: 3476106 - RNA, 19 nt, Human
guuucaggauacaugugcc

SEQ ID NO: 3476107 - RNA, 10 nt, Human
guuucaggug

SEQ ID NO: 3476108 - RNA, 14 nt, Human
guuucaggugacau

SEQ ID NO: 3476109 - RNA, 15 nt, Human
guuucaggugacaug

SEQ ID NO: 3476110 - RNA, 15 nt, Human
guuucaguuuguugg

SEQ ID NO: 3476111 - RNA, 17 nt, Human
guuucauacucuagauu

SEQ ID NO: 3476112 - RNA, 22 nt, Human
guuucauauuuuucauagcuaa

SEQ ID NO: 3476113 - RNA, 15 nt, Human
guuucauccuuccca

SEQ ID NO: 3476114 - RNA, 16 nt, Human
guuucauccuuuucau

SEQ ID NO: 3476115 - RNA, 11 nt, Human
guuucauugac

SEQ ID NO: 3476116 - RNA, 20 nt, Human
guuucauuuagucaugugac

SEQ ID NO: 3476117 - RNA, 18 nt, Human
guuucauuuaugauacaa

SEQ ID NO: 3476118 - RNA, 19 nt, Human
guuucauuucuacugugac

SEQ ID NO: 3476119 - RNA, 16 nt, Human
guuuccacagccugca

SEQ ID NO: 3476120 - RNA, 22 nt, Human
guuuccacgaugaaaaacuucc

SEQ ID NO: 3476121 - RNA, 13 nt, Human
guuuccagcauuc

SEQ ID NO: 3476122 - RNA, 14 nt, Human
guuucccaggccca

SEQ ID NO: 3476123 - RNA, 15 nt, Human
guuucccauaauuuu

SEQ ID NO: 3476124 - RNA, 20 nt, Human
guuucccauaauuuucuuca

SEQ ID NO: 3476125 - RNA, 15 nt, Human
guuuccccaccagug

SEQ ID NO: 3476126 - RNA, 18 nt, Human
guuucccuacugaagccc

SEQ ID NO: 3476127 - RNA, 17 nt, Human
guuuccgugcguggcac

SEQ ID NO: 3476128 - RNA, 16 nt, Human
guuuccuaaaaguuca

SEQ ID NO: 3476129 - RNA, 16 nt, Human
guuuccucaggcugcu

SEQ ID NO: 3476130 - RNA, 17 nt, Human
guuuccuccaagcuauu

SEQ ID NO: 3476131 - RNA, 20 nt, Human
guuuccucuguucaaagcug

SEQ ID NO: 3476132 - RNA, 17 nt, Human
guuuccugcccugggag

SEQ ID NO: 3476133 - RNA, 19 nt, Human
guuuccuggcacuggaccc

SEQ ID NO: 3476134 - RNA, 14 nt, Human
guuuccuucagugc

SEQ ID NO: 3476135 - RNA, 17 nt, Human
guuuccuuucauuuacu

SEQ ID NO: 3476136 - RNA, 23 nt, Human
guuuccuuucauuuacuguggcu

SEQ ID NO: 3476137 - RNA, 14 nt, Human
guuuccuuuuuucc

SEQ ID NO: 3476138 - RNA, 15 nt, Human
guuuccuuuuuuccc

SEQ ID NO: 3476139 - RNA, 14 nt, Human
guuucguuucugua

SEQ ID NO: 3476140 - RNA, 15 nt, Human
guuucuaaacuggag

SEQ ID NO: 3476141 - RNA, 18 nt, Human
guuucuaaacuggagacu

SEQ ID NO: 3476142 - RNA, 15 nt, Human
guuucuaaagcugcc

SEQ ID NO: 3476143 - RNA, 14 nt, Human
guuucuaagauucu

SEQ ID NO: 3476144 - RNA, 16 nt, Human
guuucuaagauucuaa

SEQ ID NO: 3476145 - RNA, 19 nt, Human
guuucuaagauucuaaagg

SEQ ID NO: 3476146 - RNA, 17 nt, Human
guuucuaauuugcugcu

SEQ ID NO: 3476147 - RNA, 15 nt, Human
guuucuaccucccag

SEQ ID NO: 3476148 - RNA, 19 nt, Human
guuucuagagccugcugga

SEQ ID NO: 3476149 - RNA, 18 nt, Human
guuucuagcacuggccug

SEQ ID NO: 3476150 - RNA, 23 nt, Human
guuucuauucucuccucagacug

SEQ ID NO: 3476151 - RNA, 17 nt, Human
guuucuauuuuuugaaa

SEQ ID NO: 3476152 - RNA, 17 nt, Human
guuucucaaagaaauuu

SEQ ID NO: 3476153 - RNA, 14 nt, Human
guuucucaaaucuu

SEQ ID NO: 3476154 - RNA, 14 nt, Human
guuucucagauccu

SEQ ID NO: 3476155 - RNA, 14 nt, Human
guuucucagcuccc

SEQ ID NO: 3476156 - RNA, 13 nt, Human
guuucucauucuu

SEQ ID NO: 3476157 - RNA, 14 nt, Human
guuucucauuuguu

SEQ ID NO: 3476158 - RNA, 22 nt, Human
guuucucccccauguucugucc

SEQ ID NO: 3476159 - RNA, 14 nt, Human
guuucucccccugg

SEQ ID NO: 3476160 - RNA, 15 nt, Human
guuucuccugagcua

SEQ ID NO: 3476161 - RNA, 18 nt, Human
guuucuccugagcuagga

SEQ ID NO: 3476162 - RNA, 16 nt, Human
guuucucucuacagug

SEQ ID NO: 3476163 - RNA, 12 nt, Human
guuucucugcug

SEQ ID NO: 3476164 - RNA, 18 nt, Human
guuucucuugagcuggcc

SEQ ID NO: 3476165 - RNA, 14 nt, Human
guuucucuuuccuu

SEQ ID NO: 3476166 - RNA, 12 nt, Human
guuucugaaaag

SEQ ID NO: 3476167 - RNA, 20 nt, Human
guuucugaaaauuaacacug

SEQ ID NO: 3476168 - RNA, 19 nt, Human
guuucugaaaauuccagaa

SEQ ID NO: 3476169 - RNA, 22 nt, Human
guuucugaggcuuuaugauaau

SEQ ID NO: 3476170 - RNA, 22 nt, Human
guuucugcaugaauaucauaca

SEQ ID NO: 3476171 - RNA, 21 nt, Human
guuucugcccacauuggaccc

SEQ ID NO: 3476172 - RNA, 14 nt, Human
guuucuggauuuca

SEQ ID NO: 3476173 - RNA, 19 nt, Human
guuucuggguccugaagaa

SEQ ID NO: 3476174 - RNA, 17 nt, Human
guuucugucaggagagc

SEQ ID NO: 3476175 - RNA, 21 nt, Human
guuucugucaggagagcagcg

SEQ ID NO: 3476176 - RNA, 13 nt, Human
guuucugugcaug

SEQ ID NO: 3476177 - RNA, 12 nt, Human
guuucuguucca

SEQ ID NO: 3476178 - RNA, 13 nt, Human
guuucuguuccaa

SEQ ID NO: 3476179 - RNA, 15 nt, Human
guuucuguucugugg

SEQ ID NO: 3476180 - RNA, 17 nt, Human
guuucuguucuguggaa

SEQ ID NO: 3476181 - RNA, 18 nt, Human
guuucuguuugauucuuu

SEQ ID NO: 3476182 - RNA, 21 nt, Human
guuucuuaaauaagaaacuuu

SEQ ID NO: 3476183 - RNA, 22 nt, Human
guuucuuaacccuuuccagagu

SEQ ID NO: 3476184 - RNA, 18 nt, Human
guuucuuaauuuggaaac

SEQ ID NO: 3476185 - RNA, 14 nt, Human
guuucuucacuuuu

SEQ ID NO: 3476186 - RNA, 13 nt, Human
guuucuuccaaag

SEQ ID NO: 3476187 - RNA, 20 nt, Human
guuucuucugcgccucaggc

SEQ ID NO: 3476188 - RNA, 17 nt, Human
guuucuugcuuguaccu

SEQ ID NO: 3476189 - RNA, 19 nt, Human
guuucuuuaaccuuguaua

SEQ ID NO: 3476190 - RNA, 16 nt, Human
guuucuuuagcaguuu

SEQ ID NO: 3476191 - RNA, 19 nt, Human
guuucuuucucugaggaca

SEQ ID NO: 3476192 - RNA, 20 nt, Human
guuucuuucucugaggacaa

SEQ ID NO: 3476193 - RNA, 12 nt, Human
guuucuuucuuu

SEQ ID NO: 3476194 - RNA, 23 nt, Human
guuucuuucuuucuuuauuuuga

SEQ ID NO: 3476195 - RNA, 18 nt, Human
guuucuuuguaaugaaaa

SEQ ID NO: 3476196 - RNA, 19 nt, Human
guuucuuuguaaugaaaac

SEQ ID NO: 3476197 - RNA, 14 nt, Human
guuucuuuguguug

SEQ ID NO: 3476198 - RNA, 14 nt, Human
guuucuuuuaaaga

SEQ ID NO: 3476199 - RNA, 23 nt, Human
guuucuuuuauaaaaaaaaugaa

SEQ ID NO: 3476200 - RNA, 14 nt, Human
guuucuuuuguuug

SEQ ID NO: 3476201 - RNA, 18 nt, Human
guuucuuuuguuugguaa

SEQ ID NO: 3476202 - RNA, 21 nt, Human
guuugaaaauauuaucuuugu

SEQ ID NO: 3476203 - RNA, 18 nt, Human
guuugaaaauauuuucau

SEQ ID NO: 3476204 - RNA, 15 nt, Human
guuugaaacaaagaa

SEQ ID NO: 3476205 - RNA, 17 nt, Human
guuugaaacaaagaagg

SEQ ID NO: 3476206 - RNA, 18 nt, Human
guuugaaagugaauaaac

SEQ ID NO: 3476207 - RNA, 19 nt, Human
guuugaaagugaauaaacu

SEQ ID NO: 3476208 - RNA, 15 nt, Human
guuugaaauucugaa

SEQ ID NO: 3476209 - RNA, 18 nt, Human
guuugaaauucugaauuu

SEQ ID NO: 3476210 - RNA, 19 nt, Human
guuugaaauucugaauuug

SEQ ID NO: 3476211 - RNA, 12 nt, Human
guuugaacuuca

SEQ ID NO: 3476212 - RNA, 15 nt, Human
guuugaagccuggaa

SEQ ID NO: 3476213 - RNA, 15 nt, Human
guuugaaggaaacag

SEQ ID NO: 3476214 - RNA, 16 nt, Human
guuugaaggaaacagu

SEQ ID NO: 3476215 - RNA, 21 nt, Human
guuugaaucuauuuaucuuca

SEQ ID NO: 3476216 - RNA, 15 nt, Human
guuugaauguuaaau

SEQ ID NO: 3476217 - RNA, 17 nt, Human
guuugagaucagccugg

SEQ ID NO: 3476218 - RNA, 18 nt, Human
guuugagaucagccuggg

SEQ ID NO: 3476219 - RNA, 19 nt, Human
guuugagaucagccugggc

SEQ ID NO: 3476220 - RNA, 17 nt, Human
guuugagauggacacac

SEQ ID NO: 3476221 - RNA, 20 nt, Human
guuugagcucugcagcccag

SEQ ID NO: 3476222 - RNA, 13 nt, Human
guuugagcugccu

SEQ ID NO: 3476223 - RNA, 15 nt, Human
guuugagcugccuuc

SEQ ID NO: 3476224 - RNA, 16 nt, Human
guuugaggcugcagcg

SEQ ID NO: 3476225 - RNA, 19 nt, Human
guuugagguuuuuaagccu

SEQ ID NO: 3476226 - RNA, 16 nt, Human
guuugauagauuuucu

SEQ ID NO: 3476227 - RNA, 13 nt, Human
guuugaucuuccu

SEQ ID NO: 3476228 - RNA, 21 nt, Human
guuugaucuuccucugcuaaa

SEQ ID NO: 3476229 - RNA, 19 nt, Human
guuugaugaggcccuccac

SEQ ID NO: 3476230 - RNA, 23 nt, Human
guuugauuaaauucuugcaaagu

SEQ ID NO: 3476231 - RNA, 16 nt, Human
guuugauucagacagc

SEQ ID NO: 3476232 - RNA, 21 nt, Human
guuugauuugucacugcuuca

SEQ ID NO: 3476233 - RNA, 14 nt, Human
guuugcaaggaagc

SEQ ID NO: 3476234 - RNA, 17 nt, Human
guuugcaaggaagccac

SEQ ID NO: 3476235 - RNA, 19 nt, Human
guuugcacucaaaucuuaa

SEQ ID NO: 3476236 - RNA, 19 nt, Human
guuugcacuguaugcugga

SEQ ID NO: 3476237 - RNA, 22 nt, Human
guuugcacuguaugcuggacgg

SEQ ID NO: 3476238 - RNA, 19 nt, Human
guuugcagaaaagcaccug

SEQ ID NO: 3476239 - RNA, 21 nt, Human
guuugcagaaaagcaccugcc

SEQ ID NO: 3476240 - RNA, 16 nt, Human
guuugcagaugacaaa

SEQ ID NO: 3476241 - RNA, 11 nt, Human
guuugcagccu

SEQ ID NO: 3476242 - RNA, 14 nt, Human
guuugcauagguga

SEQ ID NO: 3476243 - RNA, 19 nt, Human
guuugcaucugaaaauuga

SEQ ID NO: 3476244 - RNA, 12 nt, Human
guuugcauuccu

SEQ ID NO: 3476245 - RNA, 15 nt, Human
guuugcauuucagaa

SEQ ID NO: 3476246 - RNA, 19 nt, Human
guuugccccguucuguuug

SEQ ID NO: 3476247 - RNA, 15 nt, Human
guuugccggauacaa

SEQ ID NO: 3476248 - RNA, 13 nt, Human
guuugccucugcc

SEQ ID NO: 3476249 - RNA, 13 nt, Human
guuugcuaaguga

SEQ ID NO: 3476250 - RNA, 17 nt, Human
guuugcucaccuggggu

SEQ ID NO: 3476251 - RNA, 18 nt, Human
guuugcucagaacacauu

SEQ ID NO: 3476252 - RNA, 16 nt, Human
guuugcugauggucug

SEQ ID NO: 3476253 - RNA, 21 nt, Human
guuugcugucaagccauuuuu

SEQ ID NO: 3476254 - RNA, 13 nt, Human
guuugcugugaac

SEQ ID NO: 3476255 - RNA, 14 nt, Human
guuugcuguugcug

SEQ ID NO: 3476256 - RNA, 13 nt, Human
guuugcuuauugu

SEQ ID NO: 3476257 - RNA, 18 nt, Human
guuugcuuauuguuccaa

SEQ ID NO: 3476258 - RNA, 16 nt, Human
guuugcuucauaaaug

SEQ ID NO: 3476259 - RNA, 21 nt, Human
guuugcuucaugugucccaga

SEQ ID NO: 3476260 - RNA, 14 nt, Human
guuugcuuguuucu

SEQ ID NO: 3476261 - RNA, 11 nt, Human
guuugcuuucu

SEQ ID NO: 3476262 - RNA, 20 nt, Human
guuugcuuuguaugcacuuu

SEQ ID NO: 3476263 - RNA, 13 nt, Human
guuuggaaggagc

SEQ ID NO: 3476264 - RNA, 16 nt, Human
guuuggaaggagcaga

SEQ ID NO: 3476265 - RNA, 19 nt, Human
guuuggacaaaauggaaua

SEQ ID NO: 3476266 - RNA, 15 nt, Human
guuuggaccccagcu

SEQ ID NO: 3476267 - RNA, 23 nt, Human
guuuggagacauuccugggcaca

SEQ ID NO: 3476268 - RNA, 17 nt, Human
guuuggagagagcagac

SEQ ID NO: 3476269 - RNA, 20 nt, Human
guuuggauauguaaaacauu

SEQ ID NO: 3476270 - RNA, 20 nt, Human
guuuggaugggagugagaca

SEQ ID NO: 3476271 - RNA, 15 nt, Human
guuuggcaaggaaag

SEQ ID NO: 3476272 - RNA, 19 nt, Human
guuuggcaauaguuugcau

SEQ ID NO: 3476273 - RNA, 22 nt, Human
guuuggcauguaaauguaaacu

SEQ ID NO: 3476274 - RNA, 18 nt, Human
guuuggccagaagucaag

SEQ ID NO: 3476275 - RNA, 19 nt, Human
guuuggcugugucuaaacu

SEQ ID NO: 3476276 - RNA, 13 nt, Human
guuuggcuuucag

SEQ ID NO: 3476277 - RNA, 23 nt, Human
guuugggaagagcuuagaaacug

SEQ ID NO: 3476278 - RNA, 16 nt, Human
guuugggaccccuggu

SEQ ID NO: 3476279 - RNA, 20 nt, Human
guuugggccccagaggcugg

SEQ ID NO: 3476280 - RNA, 21 nt, Human
guuuggggcaagucauguaaa

SEQ ID NO: 3476281 - RNA, 15 nt, Human
guuuggggcaggagu

SEQ ID NO: 3476282 - RNA, 17 nt, Human
guuuggggcaggaguag

SEQ ID NO: 3476283 - RNA, 18 nt, Human
guuuggggcgaggcagag

SEQ ID NO: 3476284 - RNA, 19 nt, Human
guuuggguaaaauacuuuu

SEQ ID NO: 3476285 - RNA, 16 nt, Human
guuuggguauauucau

SEQ ID NO: 3476286 - RNA, 18 nt, Human
guuugguauuguauuuau

SEQ ID NO: 3476287 - RNA, 16 nt, Human
guuugguccagccugg

SEQ ID NO: 3476288 - RNA, 15 nt, Human
guuugguccuguagg

SEQ ID NO: 3476289 - RNA, 23 nt, Human
guuuggucugggacuuccuugcu

SEQ ID NO: 3476290 - RNA, 13 nt, Human
guuuggugcuucu

SEQ ID NO: 3476291 - RNA, 22 nt, Human
guuugguggggguagagcugau

SEQ ID NO: 3476292 - RNA, 15 nt, Human
guuugguguguccca

SEQ ID NO: 3476293 - RNA, 22 nt, Human
guuugguucaaauguguuuugg

SEQ ID NO: 3476294 - RNA, 22 nt, Human
guuugguucacuuacagauagu

SEQ ID NO: 3476295 - RNA, 18 nt, Human
guuugguuccucucuggu

SEQ ID NO: 3476296 - RNA, 14 nt, Human
guuuguaaauguua

SEQ ID NO: 3476297 - RNA, 19 nt, Human
guuuguaaauuaacuuuua

SEQ ID NO: 3476298 - RNA, 17 nt, Human
guuuguaguuguuuuaa

SEQ ID NO: 3476299 - RNA, 16 nt, Human
guuuguauguauaauu

SEQ ID NO: 3476300 - RNA, 20 nt, Human
guuuguauguguguagacaa

SEQ ID NO: 3476301 - RNA, 17 nt, Human
guuugucacaugaaaca

SEQ ID NO: 3476302 - RNA, 14 nt, Human
guuugucuauuuua

SEQ ID NO: 3476303 - RNA, 18 nt, Human
guuugucucuccuuuucu

SEQ ID NO: 3476304 - RNA, 21 nt, Human
guuugucucuccuuuucuuuu

SEQ ID NO: 3476305 - RNA, 15 nt, Human
guuugucucuucugg

SEQ ID NO: 3476306 - RNA, 15 nt, Human
guuugucugucuuca

SEQ ID NO: 3476307 - RNA, 21 nt, Human
guuugucuuccauuccauugu

SEQ ID NO: 3476308 - RNA, 16 nt, Human
guuugucuucucccca

SEQ ID NO: 3476309 - RNA, 17 nt, Human
guuugucuucuccccag

SEQ ID NO: 3476310 - RNA, 19 nt, Human
guuuguggaaaaugaaaau

SEQ ID NO: 3476311 - RNA, 14 nt, Human
guuuguggccucag

SEQ ID NO: 3476312 - RNA, 22 nt, Human
guuuguggcugggggcaggagg

SEQ ID NO: 3476313 - RNA, 15 nt, Human
guuugugugucuuaa

SEQ ID NO: 3476314 - RNA, 20 nt, Human
guuuguguguugucucuuga

SEQ ID NO: 3476315 - RNA, 15 nt, Human
guuuguguucuguuu

SEQ ID NO: 3476316 - RNA, 22 nt, Human
guuuguguucuguuuguuaaaa

SEQ ID NO: 3476317 - RNA, 14 nt, Human
guuuguuccagaau

SEQ ID NO: 3476318 - RNA, 21 nt, Human
guuuguugagcugguaacauc

SEQ ID NO: 3476319 - RNA, 22 nt, Human
guuuguugagcugguaacaucg

SEQ ID NO: 3476320 - RNA, 13 nt, Human
guuuguuggaaag

SEQ ID NO: 3476321 - RNA, 21 nt, Human
guuuguuucucccccugggcu

SEQ ID NO: 3476322 - RNA, 20 nt, Human
guuuguuucugaaagggacg

SEQ ID NO: 3476323 - RNA, 16 nt, Human
guuuguuucuuugaau

SEQ ID NO: 3476324 - RNA, 14 nt, Human
guuuguuucuuugu

SEQ ID NO: 3476325 - RNA, 15 nt, Human
guuuguuucuuugug

SEQ ID NO: 3476326 - RNA, 11 nt, Human
guuuguuuguc

SEQ ID NO: 3476327 - RNA, 14 nt, Human
guuuguuugucugu

SEQ ID NO: 3476328 - RNA, 12 nt, Human
guuuguuuguuu

SEQ ID NO: 3476329 - RNA, 14 nt, Human
guuuguuuguuuca

SEQ ID NO: 3476330 - RNA, 19 nt, Human
guuuuaaaaaaauaaaaca

SEQ ID NO: 3476331 - RNA, 22 nt, Human
guuuuaaaaaaauaaaacauuu

SEQ ID NO: 3476332 - RNA, 15 nt, Human
guuuuaaaaugagaa

SEQ ID NO: 3476333 - RNA, 16 nt, Human
guuuuaaacuuucaau

SEQ ID NO: 3476334 - RNA, 15 nt, Human
guuuuaaagcuucca

SEQ ID NO: 3476335 - RNA, 12 nt, Human
guuuuaaauucu

SEQ ID NO: 3476336 - RNA, 16 nt, Human
guuuuaaauucugaga

SEQ ID NO: 3476337 - RNA, 19 nt, Human
guuuuaacuagaauuuauu

SEQ ID NO: 3476338 - RNA, 14 nt, Human
guuuuaagaggcag

SEQ ID NO: 3476339 - RNA, 16 nt, Human
guuuuaaggaagaaaa

SEQ ID NO: 3476340 - RNA, 19 nt, Human
guuuuaaggaagaaaaauc

SEQ ID NO: 3476341 - RNA, 19 nt, Human
guuuuaaggacugacugag

SEQ ID NO: 3476342 - RNA, 22 nt, Human
guuuuaagugaaagugaggaaa

SEQ ID NO: 3476343 - RNA, 21 nt, Human
guuuuaaucugaaauucuaaa

SEQ ID NO: 3476344 - RNA, 23 nt, Human
guuuuaauuccaauaugaugacu

SEQ ID NO: 3476345 - RNA, 14 nt, Human
guuuuaauuccaug

SEQ ID NO: 3476346 - RNA, 14 nt, Human
guuuuaauuuaaac

SEQ ID NO: 3476347 - RNA, 21 nt, Human
guuuuaauuuaaacaccuccu

SEQ ID NO: 3476348 - RNA, 21 nt, Human
guuuuaauuuauacuggcaug

SEQ ID NO: 3476349 - RNA, 11 nt, Human
guuuuacaaua

SEQ ID NO: 3476350 - RNA, 13 nt, Human
guuuuacaauagu

SEQ ID NO: 3476351 - RNA, 16 nt, Human
guuuuacaauaguucu

SEQ ID NO: 3476352 - RNA, 11 nt, Human
guuuuacacug

SEQ ID NO: 3476353 - RNA, 16 nt, Human
guuuuacccuauaucu

SEQ ID NO: 3476354 - RNA, 16 nt, Human
guuuuacugcagcuuu

SEQ ID NO: 3476355 - RNA, 14 nt, Human
guuuuacugcuuuu

SEQ ID NO: 3476356 - RNA, 13 nt, Human
guuuuacugucua

SEQ ID NO: 3476357 - RNA, 15 nt, Human
guuuuacugucuauu

SEQ ID NO: 3476358 - RNA, 18 nt, Human
guuuuacuuuuaaacugu

SEQ ID NO: 3476359 - RNA, 13 nt, Human
guuuuagaaugau

SEQ ID NO: 3476360 - RNA, 18 nt, Human
guuuuagaguaagaaauu

SEQ ID NO: 3476361 - RNA, 20 nt, Human
guuuuagauuuucugguucu

SEQ ID NO: 3476362 - RNA, 12 nt, Human
guuuuucaauua

SEQ ID NO: 3476363 - RNA, 16 nt, Human
guuuuucaauuaaacg

SEQ ID NO: 3476364 - RNA, 18 nt, Human
guuuuucaauuaaacgga

SEQ ID NO: 3476365 - RNA, 20 nt, Human
guuuuucaguucaaagucau

SEQ ID NO: 3476366 - RNA, 12 nt, Human
guuuuucaguuu

SEQ ID NO: 3476367 - RNA, 14 nt, Human
guuuuucaguuuuc

SEQ ID NO: 3476368 - RNA, 15 nt, Human
guuuuucauaaagca

SEQ ID NO: 3476369 - RNA, 16 nt, Human
guuuuucauuuuaaaa

SEQ ID NO: 3476370 - RNA, 17 nt, Human
guuuuuccacuacugcu

SEQ ID NO: 3476371 - RNA, 13 nt, Human
guuuuucuaaagg

SEQ ID NO: 3476372 - RNA, 19 nt, Human
guuuuucuacuuuuaaaga

SEQ ID NO: 3476373 - RNA, 12 nt, Human
guuuuucuauua

SEQ ID NO: 3476374 - RNA, 15 nt, Human
guuuuucuauuaaaa

SEQ ID NO: 3476375 - RNA, 16 nt, Human
guuuuucuauuaaaag

SEQ ID NO: 3476376 - RNA, 21 nt, Human
guuuuucuauuaaaagacuca

SEQ ID NO: 3476377 - RNA, 14 nt, Human
guuuuucugccagg

SEQ ID NO: 3476378 - RNA, 14 nt, Human
guuuuucugcuuua

SEQ ID NO: 3476379 - RNA, 18 nt, Human
guuuuucugcuuuagacu

SEQ ID NO: 3476380 - RNA, 19 nt, Human
guuuuucugcuuuagacuu

SEQ ID NO: 3476381 - RNA, 22 nt, Human
guuuuucugcuuuagacuugaa

SEQ ID NO: 3476382 - RNA, 20 nt, Human
guuuuucuuaaauaauaaag

SEQ ID NO: 3476383 - RNA, 16 nt, Human
guuuuucuuaauauau

SEQ ID NO: 3476384 - RNA, 23 nt, Human
guuuuucuucaacaucaauguuc

SEQ ID NO: 3476385 - RNA, 15 nt, Human
guuuuucuucucccu

SEQ ID NO: 3476386 - RNA, 15 nt, Human
guuuuucuugcaugg

SEQ ID NO: 3476387 - RNA, 19 nt, Human
guuuuugaaggcagaaagc

SEQ ID NO: 3476388 - RNA, 13 nt, Human
guuuuugagauau

SEQ ID NO: 3476389 - RNA, 23 nt, Human
guuuuugaggcuuucuguugcca

SEQ ID NO: 3476390 - RNA, 18 nt, Human
guuuuugauagcuuuauu

SEQ ID NO: 3476391 - RNA, 15 nt, Human
guuuuugcacauguu

SEQ ID NO: 3476392 - RNA, 17 nt, Human
guuuuugggaugucuua

SEQ ID NO: 3476393 - RNA, 19 nt, Human
guuuuugggugcaagaggg

SEQ ID NO: 3476394 - RNA, 12 nt, Human
guuuuuguaaag

SEQ ID NO: 3476395 - RNA, 15 nt, Human
guuuuuguaaagaaa

SEQ ID NO: 3476396 - RNA, 19 nt, Human
guuuuuguaaagaaaaaua

SEQ ID NO: 3476397 - RNA, 22 nt, Human
guuuuuguaaagauuucuguuc

SEQ ID NO: 3476398 - RNA, 14 nt, Human
guuuuuguacugua

SEQ ID NO: 3476399 - RNA, 15 nt, Human
guuuuuguuuggaga

SEQ ID NO: 3476400 - RNA, 17 nt, Human
guuuuuguuuggagagc

SEQ ID NO: 3476401 - RNA, 22 nt, Human
guuuuuuaucuuuucuacagca

SEQ ID NO: 3476402 - RNA, 23 nt, Human
guuuuuuaucuuuucuacagcaa

SEQ ID NO: 3476403 - RNA, 15 nt, Human
guuuuuuaugcuaau

SEQ ID NO: 3476404 - RNA, 18 nt, Human
guuuuuucaaaauagaaa

SEQ ID NO: 3476405 - RNA, 22 nt, Human
guuuuuuguuggaguguuucua

SEQ ID NO: 3476406 - RNA, 18 nt, Human
guuuuuuguuuuucugcu

SEQ ID NO: 3476407 - RNA, 13 nt, Human
guuuuuuuaauga

SEQ ID NO: 3476408 - RNA, 14 nt, Human
guuuuuuuauuucu

SEQ ID NO: 3476409 - RNA, 23 nt, Human
guuuuuuucauugccaaaaacua

SEQ ID NO: 3476410 - RNA, 10 nt, Human
guuuuuuugc

SEQ ID NO: 3476411 - RNA, 17 nt, Human
guuuuuuuguuauuaaa

SEQ ID NO: 3476412 - RNA, 16 nt, Human
guuuuuuuucagccac

SEQ ID NO: 3476413 - RNA, 23 nt, Human
guuuuuuuuuaaaaaagaaacau

SEQ ID NO: 3476414 - RNA, 20 nt, Human
guuuuuuuuuauacacugua

SEQ ID NO: 3476415 - RNA, 18 nt, Human
guuuuuuuuuucuugucu

SEQ ID NO: 3476416 - RNA, 17 nt, Human
guuuuuuuuuuguuugu

SEQ ID NO: 3476417 - RNA, 21 nt, Human
guuuuuuuuuuuaaaaaaaga

SEQ ID NO: 3476418 - RNA, 23 nt, Human
guuuuuuuuuuuaaaaaaagaaa

SEQ ID NO: 3476419 - RNA, 20 nt, Human
uaaaaaaaaaaaaaagcuuu

SEQ ID NO: 3476420 - RNA, 18 nt, Human
uaaaaaaaaaaaaaggaa

SEQ ID NO: 3476421 - RNA, 20 nt, Human
uaaaaaaaaaaaaaggaaaa

SEQ ID NO: 3476422 - RNA, 23 nt, Human
uaaaaaaaaaaaaaggaaaaaaa

SEQ ID NO: 3476423 - RNA, 16 nt, Human
uaaaaaaaaaaaagua

SEQ ID NO: 3476424 - RNA, 18 nt, Human
uaaaaaaaaaaaaguuau

SEQ ID NO: 3476425 - RNA, 20 nt, Human
uaaaaaaaaaaaaguuauau

SEQ ID NO: 3476426 - RNA, 22 nt, Human
uaaaaaaaaaaaccaaaacugu

SEQ ID NO: 3476427 - RNA, 19 nt, Human
uaaaaaaaaaaagauugua

SEQ ID NO: 3476428 - RNA, 16 nt, Human
uaaaaaaaaaagucac

SEQ ID NO: 3476429 - RNA, 18 nt, Human
uaaaaaaaaaauugggga

SEQ ID NO: 3476430 - RNA, 23 nt, Human
uaaaaaaaaauagaugucuuuua

SEQ ID NO: 3476431 - RNA, 22 nt, Human
uaaaaaaaacaaaaagaacaaa

SEQ ID NO: 3476432 - RNA, 11 nt, Human
uaaaaaaaaga

SEQ ID NO: 3476433 - RNA, 16 nt, Human
uaaaaaaaagaaaaaa

SEQ ID NO: 3476434 - RNA, 17 nt, Human
uaaaaaaaagaaaaaag

SEQ ID NO: 3476435 - RNA, 15 nt, Human
uaaaaaaaagaugaa

SEQ ID NO: 3476436 - RNA, 16 nt, Human
uaaaaaaaauaguuga

SEQ ID NO: 3476437 - RNA, 23 nt, Human
uaaaaaaaauaguugagccagca

SEQ ID NO: 3476438 - RNA, 20 nt, Human
uaaaaaaaauccuucuaauc

SEQ ID NO: 3476439 - RNA, 17 nt, Human
uaaaaaaaaugaaaugu

SEQ ID NO: 3476440 - RNA, 22 nt, Human
uaaaaaaaccaccaaaaacaaa

SEQ ID NO: 3476441 - RNA, 10 nt, Human
uaaaaaaaga

SEQ ID NO: 3476442 - RNA, 12 nt, Human
uaaaaaaagaaa

SEQ ID NO: 3476443 - RNA, 11 nt, Human
uaaaaaaauaa

SEQ ID NO: 3476444 - RNA, 17 nt, Human
uaaaaaaauaaaacauu

SEQ ID NO: 3476445 - RNA, 18 nt, Human
uaaaaaaauaaaacauuu

SEQ ID NO: 3476446 - RNA, 14 nt, Human
uaaaaaacaaagaa

SEQ ID NO: 3476447 - RNA, 19 nt, Human
uaaaaaacaaagaagacaa

SEQ ID NO: 3476448 - RNA, 11 nt, Human
uaaaaaacaac

SEQ ID NO: 3476449 - RNA, 11 nt, Human
uaaaaaacacu

SEQ ID NO: 3476450 - RNA, 16 nt, Human
uaaaaaagauaaacac

SEQ ID NO: 3476451 - RNA, 19 nt, Human
uaaaaaagauauauuaaaa

SEQ ID NO: 3476452 - RNA, 17 nt, Human
uaaaaaagaucccaaau

SEQ ID NO: 3476453 - RNA, 19 nt, Human
uaaaaaagcuuaaaacuuu

SEQ ID NO: 3476454 - RNA, 17 nt, Human
uaaaaaagucucuauuu

SEQ ID NO: 3476455 - RNA, 18 nt, Human
uaaaaaagucucuauuua

SEQ ID NO: 3476456 - RNA, 18 nt, Human
uaaaaaaguuuaaaaugu

SEQ ID NO: 3476457 - RNA, 17 nt, Human
uaaaaaauaaucuauuu

SEQ ID NO: 3476458 - RNA, 14 nt, Human
uaaaaaauauuuuc

SEQ ID NO: 3476459 - RNA, 18 nt, Human
uaaaaaauauuuucucug

SEQ ID NO: 3476460 - RNA, 22 nt, Human
uaaaaaaucaugccaguauuuu

SEQ ID NO: 3476461 - RNA, 14 nt, Human
uaaaaaauggucac

SEQ ID NO: 3476462 - RNA, 15 nt, Human
uaaaaacaaaaggca

SEQ ID NO: 3476463 - RNA, 22 nt, Human
uaaaaacaaaggagauaaaucu

SEQ ID NO: 3476464 - RNA, 13 nt, Human
uaaaaacaacuuu

SEQ ID NO: 3476465 - RNA, 19 nt, Human
uaaaaacaacuuuauaccc

SEQ ID NO: 3476466 - RNA, 20 nt, Human
uaaaaacagauuuggaaaga

SEQ ID NO: 3476467 - RNA, 17 nt, Human
uaaaaacagcauugcuu

SEQ ID NO: 3476468 - RNA, 15 nt, Human
uaaaaacaggcagcu

SEQ ID NO: 3476469 - RNA, 17 nt, Human
uaaaaacauaacauaaa

SEQ ID NO: 3476470 - RNA, 14 nt, Human
uaaaaacuaguagu

SEQ ID NO: 3476471 - RNA, 17 nt, Human
uaaaaacuauuuaacuu

SEQ ID NO: 3476472 - RNA, 20 nt, Human
uaaaaacucaggcaaagaaa

SEQ ID NO: 3476473 - RNA, 16 nt, Human
uaaaaacugaaguucu

SEQ ID NO: 3476474 - RNA, 16 nt, Human
uaaaaacugacuccuu

SEQ ID NO: 3476475 - RNA, 16 nt, Human
uaaaaacugagugacu

SEQ ID NO: 3476476 - RNA, 21 nt, Human
uaaaaacugagugacucuaua

SEQ ID NO: 3476477 - RNA, 20 nt, Human
uaaaaagaaaaaccacuccc

SEQ ID NO: 3476478 - RNA, 21 nt, Human
uaaaaagaaaacaaaaccaaa

SEQ ID NO: 3476479 - RNA, 17 nt, Human
uaaaaagaaaagauaaa

SEQ ID NO: 3476480 - RNA, 20 nt, Human
uaaaaagaaggaaaaugauc

SEQ ID NO: 3476481 - RNA, 22 nt, Human
uaaaaagauaaaaaaacagcuu

SEQ ID NO: 3476482 - RNA, 16 nt, Human
uaaaaagauaaucuca

SEQ ID NO: 3476483 - RNA, 15 nt, Human
uaaaaagauuagcaa

SEQ ID NO: 3476484 - RNA, 13 nt, Human
uaaaaagauuugu

SEQ ID NO: 3476485 - RNA, 20 nt, Human
uaaaaagccacuagacucuu

SEQ ID NO: 3476486 - RNA, 17 nt, Human
uaaaaaggaacugcagc

SEQ ID NO: 3476487 - RNA, 11 nt, Human
uaaaaaggaca

SEQ ID NO: 3476488 - RNA, 18 nt, Human
uaaaaaggaguauacaaa

SEQ ID NO: 3476489 - RNA, 20 nt, Human
uaaaaaggaguauacaaaca

SEQ ID NO: 3476490 - RNA, 16 nt, Human
uaaaaaggccuccugg

SEQ ID NO: 3476491 - RNA, 13 nt, Human
uaaaaaggugacc

SEQ ID NO: 3476492 - RNA, 14 nt, Human
uaaaaaguauuuuu

SEQ ID NO: 3476493 - RNA, 23 nt, Human
uaaaaagucugcauuacauuccu

SEQ ID NO: 3476494 - RNA, 14 nt, Human
uaaaaagucuucac

SEQ ID NO: 3476495 - RNA, 15 nt, Human
uaaaaagugacacag

SEQ ID NO: 3476496 - RNA, 13 nt, Human
uaaaaaguuaaaa

SEQ ID NO: 3476497 - RNA, 15 nt, Human
uaaaaaguuaaaaag

SEQ ID NO: 3476498 - RNA, 17 nt, Human
uaaaaaguuaaaaaguu

SEQ ID NO: 3476499 - RNA, 16 nt, Human
uaaaaauaacuguaau

SEQ ID NO: 3476500 - RNA, 17 nt, Human
uaaaaauaacuguaauu

SEQ ID NO: 3476501 - RNA, 19 nt, Human
uaaaaauaagucaacagua

SEQ ID NO: 3476502 - RNA, 12 nt, Human
uaaaaauacaaa

SEQ ID NO: 3476503 - RNA, 14 nt, Human
uaaaaauacauauc

SEQ ID NO: 3476504 - RNA, 14 nt, Human
uaaaaauagaaaca

SEQ ID NO: 3476505 - RNA, 17 nt, Human
uaaaaauauacauguuu

SEQ ID NO: 3476506 - RNA, 23 nt, Human
uaaaaauaucaaauuaauugugu

SEQ ID NO: 3476507 - RNA, 21 nt, Human
uaaaagguaugcaaucaaauc

SEQ ID NO: 3476508 - RNA, 22 nt, Human
uaaaagguauuaaauugauguu

SEQ ID NO: 3476509 - RNA, 12 nt, Human
uaaaaggugacc

SEQ ID NO: 3476510 - RNA, 19 nt, Human
uaaaaggugaccaaugaug

SEQ ID NO: 3476511 - RNA, 14 nt, Human
uaaaaguaaaaugu

SEQ ID NO: 3476512 - RNA, 16 nt, Human
uaaaaguaaaaugucu

SEQ ID NO: 3476513 - RNA, 12 nt, Human
uaaaaguaaaca

SEQ ID NO: 3476514 - RNA, 13 nt, Human
uaaaagucuugug

SEQ ID NO: 3476515 - RNA, 13 nt, Human
uaaaagugaucaa

SEQ ID NO: 3476516 - RNA, 15 nt, Human
uaaaagugaucaaua

SEQ ID NO: 3476517 - RNA, 17 nt, Human
uaaaagugccauuaaca

SEQ ID NO: 3476518 - RNA, 19 nt, Human
uaaaagugggcuugauucu

SEQ ID NO: 3476519 - RNA, 23 nt, Human
uaaaagugggcuugauucugcag

SEQ ID NO: 3476520 - RNA, 16 nt, Human
uaaaaguguccauuga

SEQ ID NO: 3476521 - RNA, 14 nt, Human
uaaaaguugugauu

SEQ ID NO: 3476522 - RNA, 21 nt, Human
uaaaaguugugauuccagaua

SEQ ID NO: 3476523 - RNA, 17 nt, Human
uaaaauaaaauaaaaau

SEQ ID NO: 3476524 - RNA, 14 nt, Human
uaaaauaaaaugaa

SEQ ID NO: 3476525 - RNA, 20 nt, Human
uaaaauaaaaugaaaauugu

SEQ ID NO: 3476526 - RNA, 13 nt, Human
uaaaauaaauaaa

SEQ ID NO: 3476527 - RNA, 18 nt, Human
uaaaauaaauauugucuu

SEQ ID NO: 3476528 - RNA, 21 nt, Human
uaaaauaacuaguguugcuug

SEQ ID NO: 3476529 - RNA, 16 nt, Human
uaaaauaagcaggugg

SEQ ID NO: 3476530 - RNA, 14 nt, Human
uaaaauaagucuga

SEQ ID NO: 3476531 - RNA, 15 nt, Human
uaaaauaagucugau

SEQ ID NO: 3476532 - RNA, 15 nt, Human
uaaaauaaugggauu

SEQ ID NO: 3476533 - RNA, 19 nt, Human
uaaaauaauuauauaacug

SEQ ID NO: 3476534 - RNA, 15 nt, Human
uaaaauaauucuaaa

SEQ ID NO: 3476535 - RNA, 16 nt, Human
uaaaauaauucuaaag

SEQ ID NO: 3476536 - RNA, 16 nt, Human
uaaaauaauucugagu

SEQ ID NO: 3476537 - RNA, 20 nt, Human
uaaaauaauuuuuauauuug

SEQ ID NO: 3476538 - RNA, 22 nt, Human
uaaaauaauuuuuauauuugaa

SEQ ID NO: 3476539 - RNA, 14 nt, Human
uaaaauacauuuaa

SEQ ID NO: 3476540 - RNA, 18 nt, Human
uaaaauacgguaccuggc

SEQ ID NO: 3476541 - RNA, 21 nt, Human
uaaaauacuauuuuuacugcc

SEQ ID NO: 3476542 - RNA, 14 nt, Human
uaaaauacuuuuac

SEQ ID NO: 3476543 - RNA, 22 nt, Human
uaaaauagaaauauagccaaaa

SEQ ID NO: 3476544 - RNA, 16 nt, Human
uaaaauagaguguagu

SEQ ID NO: 3476545 - RNA, 15 nt, Human
uaaaauagauauaaa

SEQ ID NO: 3476546 - RNA, 13 nt, Human
uaaaauagcaaaa

SEQ ID NO: 3476547 - RNA, 16 nt, Human
uaaaauagcaaaagaa

SEQ ID NO: 3476548 - RNA, 17 nt, Human
uaaaauagcaaaagaag

SEQ ID NO: 3476549 - RNA, 21 nt, Human
uaaaauagcaaaagaagaagu

SEQ ID NO: 3476550 - RNA, 15 nt, Human
uaaaauagccacuua

SEQ ID NO: 3476551 - RNA, 17 nt, Human
uaaaauagcguucuugu

SEQ ID NO: 3476552 - RNA, 19 nt, Human
uaaaauagcguucuuguaa

SEQ ID NO: 3476553 - RNA, 20 nt, Human
uaaaauagcguucuuguaau

SEQ ID NO: 3476554 - RNA, 19 nt, Human
uaaaauaggggauauuuaa

SEQ ID NO: 3476555 - RNA, 16 nt, Human
uaaaauaguaugaaaa

SEQ ID NO: 3476556 - RNA, 23 nt, Human
uaaaauaguuguccauauuuuca

SEQ ID NO: 3476557 - RNA, 18 nt, Human
uaaaauauagcuguacaa

SEQ ID NO: 3476558 - RNA, 14 nt, Human
uaaaauaucauuca

SEQ ID NO: 3476559 - RNA, 18 nt, Human
uaaaauaucuuuugaccu

SEQ ID NO: 3476560 - RNA, 14 nt, Human
uaaaauaugcacua

SEQ ID NO: 3476561 - RNA, 23 nt, Human
uaaaauaugcacuaagucucuuu

SEQ ID NO: 3476562 - RNA, 22 nt, Human
uaaaauauuccugcauuuguga

SEQ ID NO: 3476563 - RNA, 12 nt, Human
uaaaauauuuau

SEQ ID NO: 3476564 - RNA, 14 nt, Human
uaaaauauuuauga

SEQ ID NO: 3476565 - RNA, 22 nt, Human
uaaaauauuuaugaagaaaaua

SEQ ID NO: 3476566 - RNA, 12 nt, Human
uaaaauauuuuc

SEQ ID NO: 3476567 - RNA, 14 nt, Human
uaaaauauuuucug

SEQ ID NO: 3476568 - RNA, 21 nt, Human
uaaaauauuuucuguguguuc

SEQ ID NO: 3476569 - RNA, 23 nt, Human
uaaaauauuuucuguguguuccu

SEQ ID NO: 3476570 - RNA, 24 nt, Human
uaaaauauuuucuguguguuccug

SEQ ID NO: 3476571 - RNA, 20 nt, Human
uaaaauauuuugaaucaaua

SEQ ID NO: 3476572 - RNA, 17 nt, Human
uaaaauauuuuugaaag

SEQ ID NO: 3476573 - RNA, 17 nt, Human
uaaaaucaaguuuuaag

SEQ ID NO: 3476574 - RNA, 15 nt, Human
uaaaaucacguuaaa

SEQ ID NO: 3476575 - RNA, 18 nt, Human
uaaaaucacuaacauuau

SEQ ID NO: 3476576 - RNA, 22 nt, Human
uaaaaucagccaauuauguuaa

SEQ ID NO: 3476577 - RNA, 15 nt, Human
uaaaaucauguacau

SEQ ID NO: 3476578 - RNA, 10 nt, Human
uaaaaucauu

SEQ ID NO: 3476579 - RNA, 18 nt, Human
uaaaaucauuucugcauc

SEQ ID NO: 3476580 - RNA, 19 nt, Human
uaaaauccccaugccugug

SEQ ID NO: 3476581 - RNA, 15 nt, Human
uaaaauccugugcaa

SEQ ID NO: 3476582 - RNA, 20 nt, Human
uaaaaucugagggaaauguu

SEQ ID NO: 3476583 - RNA, 22 nt, Human
uaaaaucugagggaaauguuuu

SEQ ID NO: 3476584 - RNA, 19 nt, Human
uaaaaucuuauaguucuag

SEQ ID NO: 3476585 - RNA, 15 nt, Human
uaaaaucuuauuaaa

SEQ ID NO: 3476586 - RNA, 16 nt, Human
uaaaaucuugaaaaug

SEQ ID NO: 3476587 - RNA, 13 nt, Human
uaaaaucuuggaa

SEQ ID NO: 3476588 - RNA, 17 nt, Human
uaaaaucuuggaaguac

SEQ ID NO: 3476589 - RNA, 24 nt, Human
uaaaaucuuggaaguacaugaaua

SEQ ID NO: 3476590 - RNA, 19 nt, Human
uaaaaucuuggcacagaaa

SEQ ID NO: 3476591 - RNA, 22 nt, Human
uaaaaucuugucauguguauaa

SEQ ID NO: 3476592 - RNA, 23 nt, Human
uaaaaucuugucauguguauaaa

SEQ ID NO: 3476593 - RNA, 22 nt, Human
uaaaaucuuucuuucuuagaaa

SEQ ID NO: 3476594 - RNA, 15 nt, Human
uaaaaugaaaauugu

SEQ ID NO: 3476595 - RNA, 21 nt, Human
uaaaaugacaaucaugugugu

SEQ ID NO: 3476596 - RNA, 13 nt, Human
uaaaaugagaaau

SEQ ID NO: 3476597 - RNA, 23 nt, Human
uaaaaugauauuguuauauacau

SEQ ID NO: 3476598 - RNA, 22 nt, Human
uaaaaugauuguaaaauagcuu

SEQ ID NO: 3476599 - RNA, 14 nt, Human
uaaaaugauuuuau

SEQ ID NO: 3476600 - RNA, 15 nt, Human
uaaaaugauuuuauc

SEQ ID NO: 3476601 - RNA, 13 nt, Human
uaaaaugcaaaaa

SEQ ID NO: 3476602 - RNA, 15 nt, Human
uaaaaugcaaaaaau

SEQ ID NO: 3476603 - RNA, 18 nt, Human
uaaaaugcaaaaaaucuu

SEQ ID NO: 3476604 - RNA, 19 nt, Human
uaaaaugcaaaaaaucuua

SEQ ID NO: 3476605 - RNA, 18 nt, Human
uaaaaugcaauauuugua

SEQ ID NO: 3476606 - RNA, 20 nt, Human
uaaaaugccucaguguauuu

SEQ ID NO: 3476607 - RNA, 23 nt, Human
uaaaaugcuuacauuugaacuug

SEQ ID NO: 3476608 - RNA, 20 nt, Human
uaaaauggaaaacuuaguuu

SEQ ID NO: 3476609 - RNA, 18 nt, Human
uaaaauggcaacaaacug

SEQ ID NO: 3476610 - RNA, 17 nt, Human
uaaaauggguuuuacug

SEQ ID NO: 3476611 - RNA, 9 nt, Human
uaaaauggu

SEQ ID NO: 3476612 - RNA, 16 nt, Human
uaaaaugguuuguccu

SEQ ID NO: 3476613 - RNA, 23 nt, Human
uaaaauguaaagccaugcuggaa

SEQ ID NO: 3476614 - RNA, 19 nt, Human
uaaaauguaauuuaaauga

SEQ ID NO: 3476615 - RNA, 20 nt, Human
uaaaauguaauuuaaaugaa

SEQ ID NO: 3476616 - RNA, 14 nt, Human
uaaaauguacaugu

SEQ ID NO: 3476617 - RNA, 17 nt, Human
uaaaauguacauguauu

SEQ ID NO: 3476618 - RNA, 16 nt, Human
uaaaauguauaaguug

SEQ ID NO: 3476619 - RNA, 16 nt, Human
uaaaauguaugcaugu

SEQ ID NO: 3476620 - RNA, 17 nt, Human
uaaaauguauuuuucua

SEQ ID NO: 3476621 - RNA, 21 nt, Human
uaaaauguccaguaagaucac

SEQ ID NO: 3476622 - RNA, 16 nt, Human
uaaaaugucuuuccaa

SEQ ID NO: 3476623 - RNA, 14 nt, Human
uaaaauguguugaa

SEQ ID NO: 3476624 - RNA, 15 nt, Human
uaaaauguguugaaa

SEQ ID NO: 3476625 - RNA, 14 nt, Human
uaaaauguuaaaac

SEQ ID NO: 3476626 - RNA, 15 nt, Human
uaaaauuaaaaguuu

SEQ ID NO: 3476627 - RNA, 16 nt, Human
uaaaauuaaagcugaa

SEQ ID NO: 3476628 - RNA, 18 nt, Human
uaaaauuaaagcugaaaa

SEQ ID NO: 3476629 - RNA, 19 nt, Human
uaaaauuaaagcugaaaac

SEQ ID NO: 3476630 - RNA, 18 nt, Human
uaaaauuaagaauguucu

SEQ ID NO: 3476631 - RNA, 13 nt, Human
uaaaauuacaacu

SEQ ID NO: 3476632 - RNA, 18 nt, Human
uaaaauuacaguggauug

SEQ ID NO: 3476633 - RNA, 16 nt, Human
uaaaauuagaugcaug

SEQ ID NO: 3476634 - RNA, 15 nt, Human
uaaaauuauacugug

SEQ ID NO: 3476635 - RNA, 19 nt, Human
uaaaauuauacugugugug

SEQ ID NO: 3476636 - RNA, 19 nt, Human
uaaaauuauagaugggaau

SEQ ID NO: 3476637 - RNA, 18 nt, Human
uaaaauuauagcucuaau

SEQ ID NO: 3476638 - RNA, 17 nt, Human
uaaaauuaugaaucuga

SEQ ID NO: 3476639 - RNA, 14 nt, Human
uaaaauuauuuugg

SEQ ID NO: 3476640 - RNA, 15 nt, Human
uaaaauuauuuugga

SEQ ID NO: 3476641 - RNA, 22 nt, Human
uaaaauucaguuuuuuuccagu

SEQ ID NO: 3476642 - RNA, 22 nt, Human
uaaaauuccacugcguugucca

SEQ ID NO: 3476643 - RNA, 16 nt, Human
uaaaauucuacuguau

SEQ ID NO: 3476644 - RNA, 23 nt, Human
uaaaauugaguucuuccuguaau

SEQ ID NO: 3476645 - RNA, 14 nt, Human
uaaaauugcacuuu

SEQ ID NO: 3476646 - RNA, 21 nt, Human
uaaaauugcauggguuuugua

SEQ ID NO: 3476647 - RNA, 22 nt, Human
uaaaauugcauggguuuuguag

SEQ ID NO: 3476648 - RNA, 13 nt, Human
uaaaauugccaua

SEQ ID NO: 3476649 - RNA, 16 nt, Human
uaaaauugccauauug

SEQ ID NO: 3476650 - RNA, 19 nt, Human
uaaaauugccauauugcac

SEQ ID NO: 3476651 - RNA, 19 nt, Human
uaaggaauguagcugguuu

SEQ ID NO: 3476652 - RNA, 22 nt, Human
uaaggaauuuuauuuuuuucug

SEQ ID NO: 3476653 - RNA, 18 nt, Human
uaaggacaaaaaugaacu

SEQ ID NO: 3476654 - RNA, 16 nt, Human
uaaggacaaagugcca

SEQ ID NO: 3476655 - RNA, 20 nt, Human
uaaggacaaagugccaaaga

SEQ ID NO: 3476656 - RNA, 23 nt, Human
uaaggacaaagugccaaagaaag

SEQ ID NO: 3476657 - RNA, 19 nt, Human
uaaggacugacugaggcag

SEQ ID NO: 3476658 - RNA, 10 nt, Human
uaaggacugc

SEQ ID NO: 3476659 - RNA, 13 nt, Human
uaaggacugcaug

SEQ ID NO: 3476660 - RNA, 16 nt, Human
uaaggacuucuuuaau

SEQ ID NO: 3476661 - RNA, 13 nt, Human
uaaggacuuguua

SEQ ID NO: 3476662 - RNA, 17 nt, Human
uaaggagaaucauguuu

SEQ ID NO: 3476663 - RNA, 20 nt, Human
uaaggagaaucauguuucuu

SEQ ID NO: 3476664 - RNA, 16 nt, Human
uaaggagaugggccuu

SEQ ID NO: 3476665 - RNA, 19 nt, Human
uaaggagauguaagagcuu

SEQ ID NO: 3476666 - RNA, 17 nt, Human
uaaggauccggaaagaa

SEQ ID NO: 3476667 - RNA, 21 nt, Human
uaaggaugcuuguacauaaug

SEQ ID NO: 3476668 - RNA, 22 nt, Human
uaaggaugcuuguacauaaugc

SEQ ID NO: 3476669 - RNA, 18 nt, Human
uaaggaugggaaggaggg

SEQ ID NO: 3476670 - RNA, 16 nt, Human
uaaggauguagcuuuu

SEQ ID NO: 3476671 - RNA, 21 nt, Human
uaaggauguagcuuuucaccu

SEQ ID NO: 3476672 - RNA, 20 nt, Human
uaaggauuuuaugcuuuaaa

SEQ ID NO: 3476673 - RNA, 20 nt, Human
uaaggcaacugaacaaaaaa

SEQ ID NO: 3476674 - RNA, 15 nt, Human
uaaggcaaucauggu

SEQ ID NO: 3476675 - RNA, 16 nt, Human
uaaggcaggacagaga

SEQ ID NO: 3476676 - RNA, 14 nt, Human
uaaggcaggcauug

SEQ ID NO: 3476677 - RNA, 18 nt, Human
uaaggccuaggauucuaa

SEQ ID NO: 3476678 - RNA, 19 nt, Human
uaaggccuaggauucuaaa

SEQ ID NO: 3476679 - RNA, 20 nt, Human
uaaggccuaggauucuaaaa

SEQ ID NO: 3476680 - RNA, 14 nt, Human
uaaggccugaauca

SEQ ID NO: 3476681 - RNA, 20 nt, Human
uaaggcguggagcugccuga

SEQ ID NO: 3476682 - RNA, 22 nt, Human
uaaggcucuaugagucuagaug

SEQ ID NO: 3476683 - RNA, 14 nt, Human
uaaggcucugagag

SEQ ID NO: 3476684 - RNA, 19 nt, Human
uaaggcucugagagucuag

SEQ ID NO: 3476685 - RNA, 24 nt, Human
uaaggcucugagagucuagauucu

SEQ ID NO: 3476686 - RNA, 13 nt, Human
uaaggcugaggaa

SEQ ID NO: 3476687 - RNA, 13 nt, Human
uaaggcuguguaa

SEQ ID NO: 3476688 - RNA, 15 nt, Human
uaagggaaaaaucaa

SEQ ID NO: 3476689 - RNA, 17 nt, Human
uaagggaaaagauaaag

SEQ ID NO: 3476690 - RNA, 18 nt, Human
uaagggaagacauuucuu

SEQ ID NO: 3476691 - RNA, 21 nt, Human
uaagggaaggaacucuggcuu

SEQ ID NO: 3476692 - RNA, 21 nt, Human
uaagggaggaggagcuucugg

SEQ ID NO: 3476693 - RNA, 17 nt, Human
uaagggauuucuuaggg

SEQ ID NO: 3476694 - RNA, 14 nt, Human
uaagggcacugacg

SEQ ID NO: 3476695 - RNA, 15 nt, Human
uaaggggaagaauga

SEQ ID NO: 3476696 - RNA, 20 nt, Human
uaaggggaagaaugaaagcu

SEQ ID NO: 3476697 - RNA, 19 nt, Human
uaaggggaggaaccagagu

SEQ ID NO: 3476698 - RNA, 18 nt, Human
uaagggugggugcucaga

SEQ ID NO: 3476699 - RNA, 20 nt, Human
uaagggugggugcucagaau

SEQ ID NO: 3476700 - RNA, 15 nt, Human
uaaggguuaagaaaa

SEQ ID NO: 3476701 - RNA, 22 nt, Human
uaaggguuucccccaacauaua

SEQ ID NO: 3476702 - RNA, 22 nt, Human
uaagguauaucauucuaaagau

SEQ ID NO: 3476703 - RNA, 17 nt, Human
uaaggucagcucagagc

SEQ ID NO: 3476704 - RNA, 18 nt, Human
uaagguccgguguucuaa

SEQ ID NO: 3476705 - RNA, 22 nt, Human
uaaggucuguuugcuguugcug

SEQ ID NO: 3476706 - RNA, 18 nt, Human
uaaggucuuucaguacuu

SEQ ID NO: 3476707 - RNA, 21 nt, Human
uaaggucuuucaguacuuuuu

SEQ ID NO: 3476708 - RNA, 19 nt, Human
uaagguguagccacaccag

SEQ ID NO: 3476709 - RNA, 21 nt, Human
uaagguguagccacaccagga

SEQ ID NO: 3476710 - RNA, 17 nt, Human
uaagguguuugaaaaua

SEQ ID NO: 3476711 - RNA, 21 nt, Human
uaagguguuugaaaauaguuu

SEQ ID NO: 3476712 - RNA, 16 nt, Human
uaagguguuuucugug

SEQ ID NO: 3476713 - RNA, 20 nt, Human
uaagguguuuucuguguaac

SEQ ID NO: 3476714 - RNA, 18 nt, Human
uaagguuaccuuuguucc

SEQ ID NO: 3476715 - RNA, 13 nt, Human
uaaguaaaaccac

SEQ ID NO: 3476716 - RNA, 15 nt, Human
uaaguaaaaccacag

SEQ ID NO: 3476717 - RNA, 17 nt, Human
uaaguaaaaccacagca

SEQ ID NO: 3476718 - RNA, 12 nt, Human
uaaguaaacuaa

SEQ ID NO: 3476719 - RNA, 16 nt, Human
uaaguaaaugucugug

SEQ ID NO: 3476720 - RNA, 15 nt, Human
uaaguaagaaaauau

SEQ ID NO: 3476721 - RNA, 15 nt, Human
uaaguaaucaucuaa

SEQ ID NO: 3476722 - RNA, 11 nt, Human
uaaguacagag

SEQ ID NO: 3476723 - RNA, 14 nt, Human
uaaguacagagaag

SEQ ID NO: 3476724 - RNA, 17 nt, Human
uaaguacagagaagcca

SEQ ID NO: 3476725 - RNA, 17 nt, Human
uaaguacuguaauaaua

SEQ ID NO: 3476726 - RNA, 19 nt, Human
uaaguacuguaauaauacc

SEQ ID NO: 3476727 - RNA, 23 nt, Human
uaaguacuguaauaauaccucaa

SEQ ID NO: 3476728 - RNA, 15 nt, Human
uaaguagauuucaug

SEQ ID NO: 3476729 - RNA, 17 nt, Human
uaaguauaucauguaaa

SEQ ID NO: 3476730 - RNA, 19 nt, Human
uaaguaucaaguauagaaa

SEQ ID NO: 3476731 - RNA, 14 nt, Human
uaaguaucagaaag

SEQ ID NO: 3476732 - RNA, 15 nt, Human
uaaguaucugacauc

SEQ ID NO: 3476733 - RNA, 14 nt, Human
uaaguauguuauuu

SEQ ID NO: 3476734 - RNA, 16 nt, Human
uaaguauuaaaacauu

SEQ ID NO: 3476735 - RNA, 16 nt, Human
uaaguauucuaaauuu

SEQ ID NO: 3476736 - RNA, 11 nt, Human
uaaguauugca

SEQ ID NO: 3476737 - RNA, 17 nt, Human
uaaguauugcaucugua

SEQ ID NO: 3476738 - RNA, 14 nt, Human
uaaguauuuauaua

SEQ ID NO: 3476739 - RNA, 15 nt, Human
uaaguauuuauauau

SEQ ID NO: 3476740 - RNA, 17 nt, Human
uaaguauuuauauauuu

SEQ ID NO: 3476741 - RNA, 19 nt, Human
uaaguauuucagaugcuuu

SEQ ID NO: 3476742 - RNA, 14 nt, Human
uaaguauuucccag

SEQ ID NO: 3476743 - RNA, 21 nt, Human
uaaguauuuuccuguugucaa

SEQ ID NO: 3476744 - RNA, 16 nt, Human
uaagucaacaguaaac

SEQ ID NO: 3476745 - RNA, 17 nt, Human
uaagucaacaguaaacc

SEQ ID NO: 3476746 - RNA, 14 nt, Human
uaagucaguguuga

SEQ ID NO: 3476747 - RNA, 21 nt, Human
uaagucauguuccuucaagau

SEQ ID NO: 3476748 - RNA, 22 nt, Human
uaagucauguuccuucaagauc

SEQ ID NO: 3476749 - RNA, 17 nt, Human
uaagucccugcccccuc

SEQ ID NO: 3476750 - RNA, 15 nt, Human
uaagucccugucacc

SEQ ID NO: 3476751 - RNA, 23 nt, Human
uaaguccuacuuuacauaugcuu

SEQ ID NO: 3476752 - RNA, 12 nt, Human
uaagucucugug

SEQ ID NO: 3476753 - RNA, 14 nt, Human
uaagucugauuuaa

SEQ ID NO: 3476754 - RNA, 21 nt, Human
uaagucuguuuuaugacuuca

SEQ ID NO: 3476755 - RNA, 20 nt, Human
uaagucuuacauaaaccauu

SEQ ID NO: 3476756 - RNA, 20 nt, Human
uaagucuuaucaagcagcca

SEQ ID NO: 3476757 - RNA, 22 nt, Human
uaagucuuaucaagcagccaag

SEQ ID NO: 3476758 - RNA, 20 nt, Human
uaagucuugccuauauuuuc

SEQ ID NO: 3476759 - RNA, 15 nt, Human
uaagugaaaaacaug

SEQ ID NO: 3476760 - RNA, 15 nt, Human
uaagugaaaauauag

SEQ ID NO: 3476761 - RNA, 15 nt, Human
uaagugacauuugua

SEQ ID NO: 3476762 - RNA, 12 nt, Human
uaagugagagag

SEQ ID NO: 3476763 - RNA, 21 nt, Human
uaagugaggaaaucaaagugc

SEQ ID NO: 3476764 - RNA, 15 nt, Human
uaagugagugugcug

SEQ ID NO: 3476765 - RNA, 22 nt, Human
uaagugauugcugguuuuaguu

SEQ ID NO: 3476766 - RNA, 16 nt, Human
uaagugauuguaugaa

SEQ ID NO: 3476767 - RNA, 22 nt, Human
uaagugcacaacauuacaggga

SEQ ID NO: 3476768 - RNA, 15 nt, Human
uaagugcacacagaa

SEQ ID NO: 3476769 - RNA, 18 nt, Human
uaagugcacacagaaaua

SEQ ID NO: 3476770 - RNA, 15 nt, Human
uaagugcagccccgu

SEQ ID NO: 3476771 - RNA, 19 nt, Human
uaagugccucacauuuuuu

SEQ ID NO: 3476772 - RNA, 16 nt, Human
uaagugccuuccaugu

SEQ ID NO: 3476773 - RNA, 16 nt, Human
uaagugcguguguaga

SEQ ID NO: 3476774 - RNA, 17 nt, Human
uaagugcguguguagag

SEQ ID NO: 3476775 - RNA, 19 nt, Human
uaagugcuacauaaauugg

SEQ ID NO: 3476776 - RNA, 16 nt, Human
uaagugcugcauuuaa

SEQ ID NO: 3476777 - RNA, 13 nt, Human
uaagugcuuugua

SEQ ID NO: 3476778 - RNA, 16 nt, Human
uaaguggaggcacuuu

SEQ ID NO: 3476779 - RNA, 19 nt, Human
uaaguggaggcacuuuagg

SEQ ID NO: 3476780 - RNA, 13 nt, Human
uaaguggcugcug

SEQ ID NO: 3476781 - RNA, 19 nt, Human
uaaguggggcaaaaccuug

SEQ ID NO: 3476782 - RNA, 18 nt, Human
uaagugguuuuaauaaaa

SEQ ID NO: 3476783 - RNA, 18 nt, Human
uaaguguacauaugugcu

SEQ ID NO: 3476784 - RNA, 15 nt, Human
uaaguguacuaauua

SEQ ID NO: 3476785 - RNA, 14 nt, Human
uaaguguauuuuga

SEQ ID NO: 3476786 - RNA, 18 nt, Human
uaaguguauuuuucaaua

SEQ ID NO: 3476787 - RNA, 14 nt, Human
uaagugugaacugg

SEQ ID NO: 3476788 - RNA, 15 nt, Human
uaagugugaacugga

SEQ ID NO: 3476789 - RNA, 22 nt, Human
uaagugugaacuggacccuguu

SEQ ID NO: 3476790 - RNA, 19 nt, Human
uaagugugaguaagagcug

SEQ ID NO: 3476791 - RNA, 21 nt, Human
uaagugugaguaagagcuggu

SEQ ID NO: 3476792 - RNA, 14 nt, Human
uaagugugugugug

SEQ ID NO: 3476793 - RNA, 17 nt, Human
uaaguguuggaaaaaau

SEQ ID NO: 3476794 - RNA, 16 nt, Human
uaaguuaauaagcaaa

SEQ ID NO: 3476795 - RNA, 20 nt, Human
uaaguuaauguauauaaaaa

SEQ ID NO: 3476796 - RNA, 14 nt, Human
uaauaucauucacu

SEQ ID NO: 3476797 - RNA, 14 nt, Human
uaauauccuaaaca

SEQ ID NO: 3476798 - RNA, 19 nt, Human
uaauaucuuugugauaauu

SEQ ID NO: 3476799 - RNA, 20 nt, Human
uaauaucuuugugauaauuu

SEQ ID NO: 3476800 - RNA, 21 nt, Human
uaauaucuuugugauaauuua

SEQ ID NO: 3476801 - RNA, 14 nt, Human
uaauaugaaaacuu

SEQ ID NO: 3476802 - RNA, 15 nt, Human
uaauaugaaaacuua

SEQ ID NO: 3476803 - RNA, 13 nt, Human
uaauaugaaguau

SEQ ID NO: 3476804 - RNA, 15 nt, Human
uaauaugcacacauu

SEQ ID NO: 3476805 - RNA, 17 nt, Human
uaauaugcacacauuuu

SEQ ID NO: 3476806 - RNA, 21 nt, Human
uaauaugcugcaacaaaaugu

SEQ ID NO: 3476807 - RNA, 16 nt, Human
uaauaugcugccaaau

SEQ ID NO: 3476808 - RNA, 18 nt, Human
uaauaugcugccaaauuu

SEQ ID NO: 3476809 - RNA, 15 nt, Human
uaauauggaucugua

SEQ ID NO: 3476810 - RNA, 18 nt, Human
uaauauggcuaugcuuaa

SEQ ID NO: 3476811 - RNA, 15 nt, Human
uaauaugggcauugu

SEQ ID NO: 3476812 - RNA, 19 nt, Human
uaauaugggcauuguaguu

SEQ ID NO: 3476813 - RNA, 20 nt, Human
uaauaugggcauuguaguua

SEQ ID NO: 3476814 - RNA, 16 nt, Human
uaauauggggaugcag

SEQ ID NO: 3476815 - RNA, 20 nt, Human
uaauauguuaaccucagugu

SEQ ID NO: 3476816 - RNA, 21 nt, Human
uaauauguuaaccucaguguc

SEQ ID NO: 3476817 - RNA, 18 nt, Human
uaauauguuuccuucccu

SEQ ID NO: 3476818 - RNA, 18 nt, Human
uaauauuaaaaauaugga

SEQ ID NO: 3476819 - RNA, 22 nt, Human
uaauauuaaaaauauggaacuu

SEQ ID NO: 3476820 - RNA, 13 nt, Human
uaauauuaaagcc

SEQ ID NO: 3476821 - RNA, 20 nt, Human
uaauauuaaagccauguuua

SEQ ID NO: 3476822 - RNA, 11 nt, Human
uaauauuauua

SEQ ID NO: 3476823 - RNA, 23 nt, Human
uaauauuauuacuguugauaauu

SEQ ID NO: 3476824 - RNA, 20 nt, Human
uaauauucaggguaaauagg

SEQ ID NO: 3476825 - RNA, 16 nt, Human
uaauauuccucaguuc

SEQ ID NO: 3476826 - RNA, 21 nt, Human
uaauauugauaugcuuauaca

SEQ ID NO: 3476827 - RNA, 20 nt, Human
uaauauuguuugguaaaugu

SEQ ID NO: 3476828 - RNA, 21 nt, Human
uaauauuguuugguaaauguu

SEQ ID NO: 3476829 - RNA, 19 nt, Human
uaauauuguuuuucuuucu

SEQ ID NO: 3476830 - RNA, 13 nt, Human
uaauauuuacaau

SEQ ID NO: 3476831 - RNA, 16 nt, Human
uaauauuuacaaugua

SEQ ID NO: 3476832 - RNA, 21 nt, Human
uaauauuuaugucuauuuaag

SEQ ID NO: 3476833 - RNA, 23 nt, Human
uaauauuuaugucuauuuaagcc

SEQ ID NO: 3476834 - RNA, 14 nt, Human
uaauauuuauugcu

SEQ ID NO: 3476835 - RNA, 17 nt, Human
uaauauuuauugcuuua

SEQ ID NO: 3476836 - RNA, 20 nt, Human
uaauauuuuccuccugagug

SEQ ID NO: 3476837 - RNA, 22 nt, Human
uaauauuuuccuccugagugcu

SEQ ID NO: 3476838 - RNA, 16 nt, Human
uaauauuuuguauuau

SEQ ID NO: 3476839 - RNA, 20 nt, Human
uaauauuuuguauuauugcu

SEQ ID NO: 3476840 - RNA, 15 nt, Human
uaauauuuuuaauua

SEQ ID NO: 3476841 - RNA, 17 nt, Human
uaaucaaaagcuauuua

SEQ ID NO: 3476842 - RNA, 23 nt, Human
uaaucaaauuuguaggguuucua

SEQ ID NO: 3476843 - RNA, 22 nt, Human
uaaucaacauggcuacuugcuu

SEQ ID NO: 3476844 - RNA, 17 nt, Human
uaaucaacugaaagugu

SEQ ID NO: 3476845 - RNA, 21 nt, Human
uaaucaacugggcugaacacu

SEQ ID NO: 3476846 - RNA, 21 nt, Human
uaaucaaguuguaacuuauau

SEQ ID NO: 3476847 - RNA, 14 nt, Human
uaaucaauaaagaa

SEQ ID NO: 3476848 - RNA, 20 nt, Human
uaaucaaugaauauugaagu

SEQ ID NO: 3476849 - RNA, 22 nt, Human
uaaucaauuaauuuuuuuauug

SEQ ID NO: 3476850 - RNA, 21 nt, Human
uaaucacccuaccaacuuuac

SEQ ID NO: 3476851 - RNA, 20 nt, Human
uaaucacucuaauuaauugu

SEQ ID NO: 3476852 - RNA, 10 nt, Human
uaaucacugu

SEQ ID NO: 3476853 - RNA, 22 nt, Human
uaaucacuguguauauuugauu

SEQ ID NO: 3476854 - RNA, 18 nt, Human
uaaucacuuuuuuccaca

SEQ ID NO: 3476855 - RNA, 15 nt, Human
uaaucagaaauuuuu

SEQ ID NO: 3476856 - RNA, 20 nt, Human
uaaucagcaagaauuugauc

SEQ ID NO: 3476857 - RNA, 11 nt, Human
uaaucagccuc

SEQ ID NO: 3476858 - RNA, 13 nt, Human
uaaucagccucuu

SEQ ID NO: 3476859 - RNA, 14 nt, Human
uaaucagccucuua

SEQ ID NO: 3476860 - RNA, 15 nt, Human
uaaucagccucuuaa

SEQ ID NO: 3476861 - RNA, 19 nt, Human
uaaucagguccucagagaa

SEQ ID NO: 3476862 - RNA, 22 nt, Human
uaaucagguccucagagaauuu

SEQ ID NO: 3476863 - RNA, 22 nt, Human
uaaucaguguagccccaagaag

SEQ ID NO: 3476864 - RNA, 11 nt, Human
uaaucaguguc

SEQ ID NO: 3476865 - RNA, 17 nt, Human
uaaucauaguuacugug

SEQ ID NO: 3476866 - RNA, 23 nt, Human
uaaucauaguuacuguguaaacu

SEQ ID NO: 3476867 - RNA, 12 nt, Human
uaaucauauaaa

SEQ ID NO: 3476868 - RNA, 12 nt, Human
uaaucauauuag

SEQ ID NO: 3476869 - RNA, 14 nt, Human
uaaucauauuagac

SEQ ID NO: 3476870 - RNA, 16 nt, Human
uaaucaugaaauuacu

SEQ ID NO: 3476871 - RNA, 16 nt, Human
uaaucaugaaugugua

SEQ ID NO: 3476872 - RNA, 22 nt, Human
uaaucauuucuugggcccuccu

SEQ ID NO: 3476873 - RNA, 12 nt, Human
uaaucauuuuca

SEQ ID NO: 3476874 - RNA, 17 nt, Human
uaaucauuuucauuccu

SEQ ID NO: 3476875 - RNA, 12 nt, Human
uaaucauuuuuu

SEQ ID NO: 3476876 - RNA, 17 nt, Human
uaauccaggcagaucca

SEQ ID NO: 3476877 - RNA, 23 nt, Human
uaaucccagcacuuugggaggcc

SEQ ID NO: 3476878 - RNA, 14 nt, Human
uaaucccccaggag

SEQ ID NO: 3476879 - RNA, 18 nt, Human
uaauccccuucuccccug

SEQ ID NO: 3476880 - RNA, 17 nt, Human
uaaucccgauucacccu

SEQ ID NO: 3476881 - RNA, 14 nt, Human
uaaucccugcuuuu

SEQ ID NO: 3476882 - RNA, 17 nt, Human
uaaucccugcuuuuugu

SEQ ID NO: 3476883 - RNA, 21 nt, Human
uaaucccugcuuuuuguguuu

SEQ ID NO: 3476884 - RNA, 22 nt, Human
uaaucccugggcauugcuuucc

SEQ ID NO: 3476885 - RNA, 23 nt, Human
uaauccucucaaccaccuuucag

SEQ ID NO: 3476886 - RNA, 20 nt, Human
uaauccuucuaguuucccac

SEQ ID NO: 3476887 - RNA, 16 nt, Human
uaauccuugauaauau

SEQ ID NO: 3476888 - RNA, 20 nt, Human
uaauccuuucugccgacccc

SEQ ID NO: 3476889 - RNA, 18 nt, Human
uaauccuuuguuuucuga

SEQ ID NO: 3476890 - RNA, 22 nt, Human
uaauccuuuguuuucugacuaa

SEQ ID NO: 3476891 - RNA, 14 nt, Human
uaaucgaccugccu

SEQ ID NO: 3476892 - RNA, 16 nt, Human
uaaucggcccacagcu

SEQ ID NO: 3476893 - RNA, 22 nt, Human
uaaucggcccacagcucccacc

SEQ ID NO: 3476894 - RNA, 12 nt, Human
uaaucuaaaugg

SEQ ID NO: 3476895 - RNA, 13 nt, Human
uaaucuaaaugga

SEQ ID NO: 3476896 - RNA, 17 nt, Human
uaaucuaauucuaagga

SEQ ID NO: 3476897 - RNA, 14 nt, Human
uaaucuacugcauu

SEQ ID NO: 3476898 - RNA, 14 nt, Human
uaaucuagacaaua

SEQ ID NO: 3476899 - RNA, 15 nt, Human
uaaucuaguuuacag

SEQ ID NO: 3476900 - RNA, 19 nt, Human
uaaucuauuggguucauua

SEQ ID NO: 3476901 - RNA, 20 nt, Human
uaaucucauaccucugacca

SEQ ID NO: 3476902 - RNA, 13 nt, Human
uaaucuccacagu

SEQ ID NO: 3476903 - RNA, 16 nt, Human
uaaucucguuucaaaa

SEQ ID NO: 3476904 - RNA, 17 nt, Human
uaaucucguuucaaaaa

SEQ ID NO: 3476905 - RNA, 19 nt, Human
uaaucucguuucaaaaaca

SEQ ID NO: 3476906 - RNA, 17 nt, Human
uaaucucuaggaaguca

SEQ ID NO: 3476907 - RNA, 21 nt, Human
uaaucucuguuauguacugua

SEQ ID NO: 3476908 - RNA, 14 nt, Human
uaaucucuucuuau

SEQ ID NO: 3476909 - RNA, 15 nt, Human
uaaucucuucuuaua

SEQ ID NO: 3476910 - RNA, 16 nt, Human
uaaucugaaauucuaa

SEQ ID NO: 3476911 - RNA, 20 nt, Human
uaaucugaauaaaguguaac

SEQ ID NO: 3476912 - RNA, 21 nt, Human
uaaucugaauaaaguguaaca

SEQ ID NO: 3476913 - RNA, 22 nt, Human
uaaucugaauaaaguguaacaa

SEQ ID NO: 3476914 - RNA, 20 nt, Human
uaaucugaucguucuuucua

SEQ ID NO: 3476915 - RNA, 21 nt, Human
uaaucugauggcuucuccagg

SEQ ID NO: 3476916 - RNA, 15 nt, Human
uaaucugccucccuc

SEQ ID NO: 3476917 - RNA, 18 nt, Human
uaaucugcuaugcuugaa

SEQ ID NO: 3476918 - RNA, 21 nt, Human
uaaucuggacuccucugucca

SEQ ID NO: 3476919 - RNA, 18 nt, Human
uaaucugggccagaauuu

SEQ ID NO: 3476920 - RNA, 23 nt, Human
uaaucugggccagaauuucaaac

SEQ ID NO: 3476921 - RNA, 18 nt, Human
uaaucuguacauuuuguu

SEQ ID NO: 3476922 - RNA, 23 nt, Human
uaaucuguacauuuuguuguaaa

SEQ ID NO: 3476923 - RNA, 19 nt, Human
uaaucugucaaaacacugu

SEQ ID NO: 3476924 - RNA, 13 nt, Human
uaaucuguuaugu

SEQ ID NO: 3476925 - RNA, 18 nt, Human
uaaucuguuuauuuacaa

SEQ ID NO: 3476926 - RNA, 16 nt, Human
uaaucuuaauguauau

SEQ ID NO: 3476927 - RNA, 19 nt, Human
uaaucuuaggggagagcuu

SEQ ID NO: 3476928 - RNA, 18 nt, Human
uaaucuuaucaagaguug

SEQ ID NO: 3476929 - RNA, 15 nt, Human
uaaucuucaauaguu

SEQ ID NO: 3476930 - RNA, 20 nt, Human
uaaucuucaguuuuaucuuu

SEQ ID NO: 3476931 - RNA, 15 nt, Human
uaaucuucugccuuc

SEQ ID NO: 3476932 - RNA, 19 nt, Human
uaaucuuguugauaaaaau

SEQ ID NO: 3476933 - RNA, 19 nt, Human
uaaucuuuaccuguauaca

SEQ ID NO: 3476934 - RNA, 19 nt, Human
uaaucuuucaaaccagcuu

SEQ ID NO: 3476935 - RNA, 22 nt, Human
uaaucuuuggguaacuucaaaa

SEQ ID NO: 3476936 - RNA, 15 nt, Human
uaaucuuuucacaaa

SEQ ID NO: 3476937 - RNA, 18 nt, Human
uaaucuuuucacaaauaa

SEQ ID NO: 3476938 - RNA, 19 nt, Human
uaaucuuuucacaaauaaa

SEQ ID NO: 3476939 - RNA, 21 nt, Human
uaaugaaaacagaaugucucu

SEQ ID NO: 3476940 - RNA, 17 nt, Human
uaauuaggcaaggcuau

SEQ ID NO: 3476941 - RNA, 21 nt, Human
uaauuaggcaaggcuauguga

SEQ ID NO: 3476942 - RNA, 22 nt, Human
uaauuaggcaaggcuaugugau

SEQ ID NO: 3476943 - RNA, 18 nt, Human
uaauuaggguacauuuau

SEQ ID NO: 3476944 - RNA, 19 nt, Human
uaauuaggguacauuuaua

SEQ ID NO: 3476945 - RNA, 20 nt, Human
uaauuaggguacauuuauaa

SEQ ID NO: 3476946 - RNA, 16 nt, Human
uaauuagguuaacuau

SEQ ID NO: 3476947 - RNA, 17 nt, Human
uaauuagguuaacuaug

SEQ ID NO: 3476948 - RNA, 21 nt, Human
uaauuagugccacuuaaugua

SEQ ID NO: 3476949 - RNA, 22 nt, Human
uaauuagugccacuuaauguau

SEQ ID NO: 3476950 - RNA, 23 nt, Human
uaauuaguuccucauuagcauuu

SEQ ID NO: 3476951 - RNA, 17 nt, Human
uaauuauaucugaggaa

SEQ ID NO: 3476952 - RNA, 22 nt, Human
uaauuauaucugaggaauucug

SEQ ID NO: 3476953 - RNA, 21 nt, Human
uaauuauaugcuauuucuaua

SEQ ID NO: 3476954 - RNA, 17 nt, Human
uaauuaucggaagcagu

SEQ ID NO: 3476955 - RNA, 18 nt, Human
uaauuaucggaagcagug

SEQ ID NO: 3476956 - RNA, 21 nt, Human
uaauuaucgggaacaguguuu

SEQ ID NO: 3476957 - RNA, 16 nt, Human
uaauuaucuaaaguau

SEQ ID NO: 3476958 - RNA, 20 nt, Human
uaauuauggagucauuuuua

SEQ ID NO: 3476959 - RNA, 22 nt, Human
uaauuauggagucauuuuuaca

SEQ ID NO: 3476960 - RNA, 14 nt, Human
uaauuauguagcuc

SEQ ID NO: 3476961 - RNA, 14 nt, Human
uaauuauguuauug

SEQ ID NO: 3476962 - RNA, 19 nt, Human
uaauuauguuauugaaaaa

SEQ ID NO: 3476963 - RNA, 20 nt, Human
uaauuauuaacuacauuuau

SEQ ID NO: 3476964 - RNA, 22 nt, Human
uaauuauuauucagaaaugacu

SEQ ID NO: 3476965 - RNA, 17 nt, Human
uaauuauuauuuccagu

SEQ ID NO: 3476966 - RNA, 14 nt, Human
uaauuauuauuugu

SEQ ID NO: 3476967 - RNA, 18 nt, Human
uaauuauugauguuuuca

SEQ ID NO: 3476968 - RNA, 21 nt, Human
uaauuauuuugguacuuuuau

SEQ ID NO: 3476969 - RNA, 12 nt, Human
uaauucaaagca

SEQ ID NO: 3476970 - RNA, 20 nt, Human
uaauucaaggaauuucuuaa

SEQ ID NO: 3476971 - RNA, 22 nt, Human
uaauucaaggaauuucuuaacu

SEQ ID NO: 3476972 - RNA, 14 nt, Human
uaauucacagugcu

SEQ ID NO: 3476973 - RNA, 22 nt, Human
uaauucacagugcucuuuucuc

SEQ ID NO: 3476974 - RNA, 18 nt, Human
uaauucaccaaaguauuu

SEQ ID NO: 3476975 - RNA, 21 nt, Human
uaauucacucaagcacugaua

SEQ ID NO: 3476976 - RNA, 20 nt, Human
uaauucacuguacuaucagg

SEQ ID NO: 3476977 - RNA, 19 nt, Human
uaauucagccauguacaga

SEQ ID NO: 3476978 - RNA, 22 nt, Human
uaauucaggggcugacacuuca

SEQ ID NO: 3476979 - RNA, 18 nt, Human
uaauucaguauguuuuac

SEQ ID NO: 3476980 - RNA, 22 nt, Human
uaauucaguauguuuuacacug

SEQ ID NO: 3476981 - RNA, 19 nt, Human
uaauucaucccaacugucu

SEQ ID NO: 3476982 - RNA, 15 nt, Human
uaauucauguuucuu

SEQ ID NO: 3476983 - RNA, 15 nt, Human
uaauuccacaccuuu

SEQ ID NO: 3476984 - RNA, 17 nt, Human
uaauuccacaccuuuua

SEQ ID NO: 3476985 - RNA, 13 nt, Human
uaauuccacagcu

SEQ ID NO: 3476986 - RNA, 16 nt, Human
uaauuccauaugcugu

SEQ ID NO: 3476987 - RNA, 17 nt, Human
uaauucccauuuugcaa

SEQ ID NO: 3476988 - RNA, 20 nt, Human
uaauucccauuuugcaaaau

SEQ ID NO: 3476989 - RNA, 20 nt, Human
uaauucccuaucuuuuaguu

SEQ ID NO: 3476990 - RNA, 21 nt, Human
uaauuccuucagcacuuuaga

SEQ ID NO: 3476991 - RNA, 11 nt, Human
uaauucuaaag

SEQ ID NO: 3476992 - RNA, 15 nt, Human
uaauucuaugagaua

SEQ ID NO: 3476993 - RNA, 15 nt, Human
uaauucuaugccugu

SEQ ID NO: 3476994 - RNA, 15 nt, Human
uaauucucaggccau

SEQ ID NO: 3476995 - RNA, 14 nt, Human
uaauucucauuaaa

SEQ ID NO: 3476996 - RNA, 18 nt, Human
uaauucucauuaaaagaa

SEQ ID NO: 3476997 - RNA, 16 nt, Human
uaauucugaaguuaua

SEQ ID NO: 3476998 - RNA, 13 nt, Human
uaauucuguaaau

SEQ ID NO: 3476999 - RNA, 17 nt, Human
uaauucuguacugauuu

SEQ ID NO: 3477000 - RNA, 15 nt, Human
uaauucuguucugau

SEQ ID NO: 3477001 - RNA, 22 nt, Human
uaauucuguucugauauuaauu

SEQ ID NO: 3477002 - RNA, 14 nt, Human
uaauucuuauucca

SEQ ID NO: 3477003 - RNA, 15 nt, Human
uaauucuuauuccau

SEQ ID NO: 3477004 - RNA, 17 nt, Human
uaauucuuauuccauau

SEQ ID NO: 3477005 - RNA, 20 nt, Human
uaauucuucaccuuaggaau

SEQ ID NO: 3477006 - RNA, 23 nt, Human
uaauucuucagcguaaaauggug

SEQ ID NO: 3477007 - RNA, 16 nt, Human
uaauucuuguauauua

SEQ ID NO: 3477008 - RNA, 14 nt, Human
uaauucuuuaauga

SEQ ID NO: 3477009 - RNA, 18 nt, Human
uaauucuuucaauacaga

SEQ ID NO: 3477010 - RNA, 20 nt, Human
uaauucuuucaauacagaua

SEQ ID NO: 3477011 - RNA, 12 nt, Human
uaauucuuugau

SEQ ID NO: 3477012 - RNA, 15 nt, Human
uaauucuuuuuuauu

SEQ ID NO: 3477013 - RNA, 15 nt, Human
uaauugaaagaaugu

SEQ ID NO: 3477014 - RNA, 17 nt, Human
uaauugaaagaauguaa

SEQ ID NO: 3477015 - RNA, 22 nt, Human
uaauugaaguguauaauauaaa

SEQ ID NO: 3477016 - RNA, 23 nt, Human
uaauugacgguuuuuuauuauug

SEQ ID NO: 3477017 - RNA, 16 nt, Human
uaauugagaagaaaaa

SEQ ID NO: 3477018 - RNA, 20 nt, Human
uaauugagaagaaaaacuca

SEQ ID NO: 3477019 - RNA, 18 nt, Human
uaauugaucaaauucauu

SEQ ID NO: 3477020 - RNA, 19 nt, Human
uaauugaucaaauucauuu

SEQ ID NO: 3477021 - RNA, 22 nt, Human
uaauugaugcaaauaacacaaa

SEQ ID NO: 3477022 - RNA, 17 nt, Human
uaauugcauugacuuuc

SEQ ID NO: 3477023 - RNA, 23 nt, Human
uaauugccaccucuaacagcacc

SEQ ID NO: 3477024 - RNA, 23 nt, Human
uaauugccacugagagaucugcu

SEQ ID NO: 3477025 - RNA, 12 nt, Human
uaauugccaugu

SEQ ID NO: 3477026 - RNA, 14 nt, Human
uaauugcuguugaa

SEQ ID NO: 3477027 - RNA, 15 nt, Human
uaauugcuuacauuu

SEQ ID NO: 3477028 - RNA, 21 nt, Human
uaauugcuuacauuuuuacaa

SEQ ID NO: 3477029 - RNA, 23 nt, Human
uaauugcuuacauuuuuacaaua

SEQ ID NO: 3477030 - RNA, 12 nt, Human
uaauuggcagca

SEQ ID NO: 3477031 - RNA, 22 nt, Human
uaauuguaaaguaaaagcuaua

SEQ ID NO: 3477032 - RNA, 15 nt, Human
uaauuguacaaaauu

SEQ ID NO: 3477033 - RNA, 22 nt, Human
uaauuguacaaaauuaagcaaa

SEQ ID NO: 3477034 - RNA, 18 nt, Human
uaauuguacuaaagccaa

SEQ ID NO: 3477035 - RNA, 23 nt, Human
uaauuguacuaaagccaaacaua

SEQ ID NO: 3477036 - RNA, 12 nt, Human
uaauuguauuuu

SEQ ID NO: 3477037 - RNA, 12 nt, Human
uaauugucaugg

SEQ ID NO: 3477038 - RNA, 14 nt, Human
uaauugugaauuga

SEQ ID NO: 3477039 - RNA, 19 nt, Human
uaauugugugauauuucag

SEQ ID NO: 3477040 - RNA, 22 nt, Human
uaauugugugauauuucagaaa

SEQ ID NO: 3477041 - RNA, 14 nt, Human
uaauuguguggauu

SEQ ID NO: 3477042 - RNA, 22 nt, Human
uaauuguguuuacauuuuaugg

SEQ ID NO: 3477043 - RNA, 22 nt, Human
uaauuguucauuuugagcugaa

SEQ ID NO: 3477044 - RNA, 12 nt, Human
uaauuguuccag

SEQ ID NO: 3477045 - RNA, 22 nt, Human
uaauuguuguuuguauguauaa

SEQ ID NO: 3477046 - RNA, 15 nt, Human
uaauuguuucagaau

SEQ ID NO: 3477047 - RNA, 16 nt, Human
uaauuguuuugcacuu

SEQ ID NO: 3477048 - RNA, 16 nt, Human
uaauuuaaaauuguga

SEQ ID NO: 3477049 - RNA, 20 nt, Human
uaauuuaaaauugugaugug

SEQ ID NO: 3477050 - RNA, 20 nt, Human
uaauuuaaacaggcccagca

SEQ ID NO: 3477051 - RNA, 12 nt, Human
uaauuuaaagcc

SEQ ID NO: 3477052 - RNA, 18 nt, Human
uaauuuaaaugauuuaaa

SEQ ID NO: 3477053 - RNA, 21 nt, Human
uaauuuaagagcuaaccaguu

SEQ ID NO: 3477054 - RNA, 18 nt, Human
uaauuuaaggucuguuug

SEQ ID NO: 3477055 - RNA, 14 nt, Human
uaauuuaaguuuug

SEQ ID NO: 3477056 - RNA, 14 nt, Human
uaauuuaaugcaug

SEQ ID NO: 3477057 - RNA, 21 nt, Human
uaauuuacaaaaauauaaaau

SEQ ID NO: 3477058 - RNA, 22 nt, Human
uaauuuacaaaaauauaaaaua

SEQ ID NO: 3477059 - RNA, 18 nt, Human
uaauuuaccugaagucuu

SEQ ID NO: 3477060 - RNA, 14 nt, Human
uaauuuagaaaacu

SEQ ID NO: 3477061 - RNA, 18 nt, Human
uaauuuaggguacuaaau

SEQ ID NO: 3477062 - RNA, 23 nt, Human
uaauuuaggguacuaaauuuaaa

SEQ ID NO: 3477063 - RNA, 20 nt, Human
uaauuuaguaaauguuaucu

SEQ ID NO: 3477064 - RNA, 16 nt, Human
uaauuuagugaucuua

SEQ ID NO: 3477065 - RNA, 15 nt, Human
uaauuuaguuauuga

SEQ ID NO: 3477066 - RNA, 16 nt, Human
uaauuuaguuauugau

SEQ ID NO: 3477067 - RNA, 17 nt, Human
uaauuuauacaggucau

SEQ ID NO: 3477068 - RNA, 15 nt, Human
uaauuuaucagauug

SEQ ID NO: 3477069 - RNA, 15 nt, Human
uaauuuaucuaaauu

SEQ ID NO: 3477070 - RNA, 21 nt, Human
uaauuuaucuaaauuaaagcc

SEQ ID NO: 3477071 - RNA, 22 nt, Human
uaauuuaugcacuuauaaggug

SEQ ID NO: 3477072 - RNA, 14 nt, Human
uaauuuaugcagaa

SEQ ID NO: 3477073 - RNA, 14 nt, Human
uaauuuaugugaaa

SEQ ID NO: 3477074 - RNA, 18 nt, Human
uaauuuauuaauugcuuu

SEQ ID NO: 3477075 - RNA, 20 nt, Human
uaauuuauuguuuuuccuug

SEQ ID NO: 3477076 - RNA, 20 nt, Human
uaauuuauuuaauauuuaau

SEQ ID NO: 3477077 - RNA, 14 nt, Human
uaauuuauuuuguc

SEQ ID NO: 3477078 - RNA, 18 nt, Human
uaauuuauuuuugcaugg

SEQ ID NO: 3477079 - RNA, 12 nt, Human
uaauuucaaaau

SEQ ID NO: 3477080 - RNA, 19 nt, Human
uaauuucaagcuuauuuug

SEQ ID NO: 3477081 - RNA, 21 nt, Human
uaauuucagcuucuauauauu

SEQ ID NO: 3477082 - RNA, 21 nt, Human
uaauuucaggaggaauacuga

SEQ ID NO: 3477083 - RNA, 22 nt, Human
uacaacauaaucuaguuuacag

SEQ ID NO: 3477084 - RNA, 14 nt, Human
uacaaccaagcucu

SEQ ID NO: 3477085 - RNA, 17 nt, Human
uacaaccaagcucucug

SEQ ID NO: 3477086 - RNA, 19 nt, Human
uacaaccaagcucucugca

SEQ ID NO: 3477087 - RNA, 16 nt, Human
uacaaccaauggaaug

SEQ ID NO: 3477088 - RNA, 15 nt, Human
uacaaccucccucuu

SEQ ID NO: 3477089 - RNA, 16 nt, Human
uacaaccucccucuug

SEQ ID NO: 3477090 - RNA, 20 nt, Human
uacaacuaacgcaaccaagu

SEQ ID NO: 3477091 - RNA, 17 nt, Human
uacaacucauacacucg

SEQ ID NO: 3477092 - RNA, 17 nt, Human
uacaacucauuccagau

SEQ ID NO: 3477093 - RNA, 18 nt, Human
uacaacucauuccagauc

SEQ ID NO: 3477094 - RNA, 20 nt, Human
uacaacugaguccuuaaaca

SEQ ID NO: 3477095 - RNA, 17 nt, Human
uacaagacaacauugua

SEQ ID NO: 3477096 - RNA, 16 nt, Human
uacaagacugccauau

SEQ ID NO: 3477097 - RNA, 20 nt, Human
uacaagacugccauauuaaa

SEQ ID NO: 3477098 - RNA, 16 nt, Human
uacaagagcagccugu

SEQ ID NO: 3477099 - RNA, 19 nt, Human
uacaagagcuuaacagugu

SEQ ID NO: 3477100 - RNA, 24 nt, Human
uacaagaugaaggagaggcaacau

SEQ ID NO: 3477101 - RNA, 21 nt, Human
uacaagcauucugucuugaag

SEQ ID NO: 3477102 - RNA, 18 nt, Human
uacaagccagcuggagaa

SEQ ID NO: 3477103 - RNA, 15 nt, Human
uacaagcccccccuu

SEQ ID NO: 3477104 - RNA, 19 nt, Human
uacaagcccccccuuccac

SEQ ID NO: 3477105 - RNA, 21 nt, Human
uacaagcgugagccacugcac

SEQ ID NO: 3477106 - RNA, 17 nt, Human
uacaaggaagguggugg

SEQ ID NO: 3477107 - RNA, 14 nt, Human
uacaaggacagccc

SEQ ID NO: 3477108 - RNA, 14 nt, Human
uacaaggcaacaua

SEQ ID NO: 3477109 - RNA, 18 nt, Human
uacaagggcauaaaguaa

SEQ ID NO: 3477110 - RNA, 19 nt, Human
uacaagggcauaaaguaaa

SEQ ID NO: 3477111 - RNA, 19 nt, Human
uacaaggggccauuuggca

SEQ ID NO: 3477112 - RNA, 18 nt, Human
uacaagggucuagggaga

SEQ ID NO: 3477113 - RNA, 16 nt, Human
uacaagguauaauaaa

SEQ ID NO: 3477114 - RNA, 19 nt, Human
uacaagguauaauaaaauu

SEQ ID NO: 3477115 - RNA, 20 nt, Human
uacaaguagggguugugggu

SEQ ID NO: 3477116 - RNA, 17 nt, Human
uacaaguaguucuguau

SEQ ID NO: 3477117 - RNA, 18 nt, Human
uacaaguaguucuguauu

SEQ ID NO: 3477118 - RNA, 21 nt, Human
uacaaguaguucuguauuuga

SEQ ID NO: 3477119 - RNA, 22 nt, Human
uacaaguaguucuguauuugaa

SEQ ID NO: 3477120 - RNA, 23 nt, Human
uacaaguaguucuguauuugaaa

SEQ ID NO: 3477121 - RNA, 18 nt, Human
uacaagucagcuccagcu

SEQ ID NO: 3477122 - RNA, 21 nt, Human
uacaaguguauaucagaaaag

SEQ ID NO: 3477123 - RNA, 15 nt, Human
uacaaguuagaaaac

SEQ ID NO: 3477124 - RNA, 11 nt, Human
uacaauaaacu

SEQ ID NO: 3477125 - RNA, 19 nt, Human
uacaauaaacuauuggaaa

SEQ ID NO: 3477126 - RNA, 15 nt, Human
uacaauaaauaaucu

SEQ ID NO: 3477127 - RNA, 16 nt, Human
uacaauaaauugcuaa

SEQ ID NO: 3477128 - RNA, 14 nt, Human
uacaauauauaaaa

SEQ ID NO: 3477129 - RNA, 17 nt, Human
uacaauauauaaaaaua

SEQ ID NO: 3477130 - RNA, 21 nt, Human
uacaauauguacauuucuaag

SEQ ID NO: 3477131 - RNA, 15 nt, Human
uacaauauugauugg

SEQ ID NO: 3477132 - RNA, 20 nt, Human
uacaauauuuuaagcauuac

SEQ ID NO: 3477133 - RNA, 20 nt, Human
uacaaucaaaggaaaauagu

SEQ ID NO: 3477134 - RNA, 13 nt, Human
uacaaucagcugc

SEQ ID NO: 3477135 - RNA, 15 nt, Human
uacaaucagcugcuu

SEQ ID NO: 3477136 - RNA, 17 nt, Human
uacaaucauugcugaaa

SEQ ID NO: 3477137 - RNA, 13 nt, Human
uacaaucuauuua

SEQ ID NO: 3477138 - RNA, 17 nt, Human
uacaaucuauuuauugg

SEQ ID NO: 3477139 - RNA, 21 nt, Human
uacaaugaacacuuauaagug

SEQ ID NO: 3477140 - RNA, 21 nt, Human
uacaaugaacccccaugaugu

SEQ ID NO: 3477141 - RNA, 14 nt, Human
uacaaugacuuuau

SEQ ID NO: 3477142 - RNA, 13 nt, Human
uacaaugcugugc

SEQ ID NO: 3477143 - RNA, 21 nt, Human
uacaaugcugugcccuaaagu

SEQ ID NO: 3477144 - RNA, 14 nt, Human
uacaauggaaacaa

SEQ ID NO: 3477145 - RNA, 13 nt, Human
uacaauguagaug

SEQ ID NO: 3477146 - RNA, 13 nt, Human
uacaauguauuaa

SEQ ID NO: 3477147 - RNA, 20 nt, Human
uacaauguauuuauuuaaaa

SEQ ID NO: 3477148 - RNA, 17 nt, Human
uacaaugucauauacug

SEQ ID NO: 3477149 - RNA, 17 nt, Human
uacaaugugaacuuuau

SEQ ID NO: 3477150 - RNA, 14 nt, Human
uacaaugugacuuu

SEQ ID NO: 3477151 - RNA, 20 nt, Human
uacaaugugacuuugaaaau

SEQ ID NO: 3477152 - RNA, 13 nt, Human
uacaauguguuuu

SEQ ID NO: 3477153 - RNA, 19 nt, Human
uacaauguguuuuucucca

SEQ ID NO: 3477154 - RNA, 12 nt, Human
uacaauguuuua

SEQ ID NO: 3477155 - RNA, 21 nt, Human
uacaauuaauaguuugucuau

SEQ ID NO: 3477156 - RNA, 15 nt, Human
uacaauuauaucagu

SEQ ID NO: 3477157 - RNA, 22 nt, Human
uacaauuauuuuuacaguucuc

SEQ ID NO: 3477158 - RNA, 17 nt, Human
uacaauucccugcuguc

SEQ ID NO: 3477159 - RNA, 18 nt, Human
uacaauucuacauuguca

SEQ ID NO: 3477160 - RNA, 16 nt, Human
uacaauugaaaugacu

SEQ ID NO: 3477161 - RNA, 17 nt, Human
uacaauuguaaaacuga

SEQ ID NO: 3477162 - RNA, 21 nt, Human
uacaauuguaaaacugaggca

SEQ ID NO: 3477163 - RNA, 13 nt, Human
uacaauugugggc

SEQ ID NO: 3477164 - RNA, 15 nt, Human
uacaauuuacaaagu

SEQ ID NO: 3477165 - RNA, 22 nt, Human
uacaauuuacaaaguguguauu

SEQ ID NO: 3477166 - RNA, 21 nt, Human
uacaauuuuuuuaauuuugua

SEQ ID NO: 3477167 - RNA, 18 nt, Human
uacaauuuuuuuuauuag

SEQ ID NO: 3477168 - RNA, 21 nt, Human
uacaauuuuuuuuauuaguau

SEQ ID NO: 3477169 - RNA, 20 nt, Human
uacacaaaaucaaauaauac

SEQ ID NO: 3477170 - RNA, 13 nt, Human
uacacaacucacu

SEQ ID NO: 3477171 - RNA, 15 nt, Human
uacacaacucacucc

SEQ ID NO: 3477172 - RNA, 16 nt, Human
uacacaauagaauuau

SEQ ID NO: 3477173 - RNA, 13 nt, Human
uacacaauguguc

SEQ ID NO: 3477174 - RNA, 9 nt, Human
uacacacac

SEQ ID NO: 3477175 - RNA, 10 nt, Human
uacacacaca

SEQ ID NO: 3477176 - RNA, 17 nt, Human
uacacacacaaagagag

SEQ ID NO: 3477177 - RNA, 19 nt, Human
uacacacacaaagagaguu

SEQ ID NO: 3477178 - RNA, 11 nt, Human
uacacacacac

SEQ ID NO: 3477179 - RNA, 12 nt, Human
uacacacacaca

SEQ ID NO: 3477180 - RNA, 14 nt, Human
uacacacacacaca

SEQ ID NO: 3477181 - RNA, 15 nt, Human
uacacacacacacac

SEQ ID NO: 3477182 - RNA, 16 nt, Human
uacacacacacacaca

SEQ ID NO: 3477183 - RNA, 23 nt, Human
uacacacacacacacagccacac

SEQ ID NO: 3477184 - RNA, 16 nt, Human
uacacacacagaugug

SEQ ID NO: 3477185 - RNA, 17 nt, Human
uacacaccuaagggaca

SEQ ID NO: 3477186 - RNA, 22 nt, Human
uacacaccuaagggacauguuu

SEQ ID NO: 3477187 - RNA, 18 nt, Human
uacacaccuuauauuuac

SEQ ID NO: 3477188 - RNA, 16 nt, Human
uacacacgcugccuuc

SEQ ID NO: 3477189 - RNA, 17 nt, Human
uacacacucaaaucaag

SEQ ID NO: 3477190 - RNA, 18 nt, Human
uacacacugguacuuaga

SEQ ID NO: 3477191 - RNA, 18 nt, Human
uacacacuguacacauaa

SEQ ID NO: 3477192 - RNA, 18 nt, Human
uacacagaaauacaguua

SEQ ID NO: 3477193 - RNA, 15 nt, Human
uacacagaaaugcug

SEQ ID NO: 3477194 - RNA, 19 nt, Human
uacacagaaaugcugcugg

SEQ ID NO: 3477195 - RNA, 20 nt, Human
uacacagaaaugcugcuggc

SEQ ID NO: 3477196 - RNA, 21 nt, Human
uacacagaaaugcugcuggcc

SEQ ID NO: 3477197 - RNA, 23 nt, Human
uacacagaaaugcugcuggccaa

SEQ ID NO: 3477198 - RNA, 18 nt, Human
uacacagagcaggacugc

SEQ ID NO: 3477199 - RNA, 13 nt, Human
uacacagucagcu

SEQ ID NO: 3477200 - RNA, 17 nt, Human
uacacagucugcaagau

SEQ ID NO: 3477201 - RNA, 19 nt, Human
uacacauaauuaaaguguc

SEQ ID NO: 3477202 - RNA, 23 nt, Human
uacacauagcauguaaugguauc

SEQ ID NO: 3477203 - RNA, 21 nt, Human
uacacauauaccuauaaugug

SEQ ID NO: 3477204 - RNA, 21 nt, Human
uacacauguaucuaugcauuu

SEQ ID NO: 3477205 - RNA, 21 nt, Human
uacacauuugcuacuguugua

SEQ ID NO: 3477206 - RNA, 13 nt, Human
uacacauuuguac

SEQ ID NO: 3477207 - RNA, 16 nt, Human
uacacauuuuuaaauu

SEQ ID NO: 3477208 - RNA, 17 nt, Human
uacacauuuuuaaauug

SEQ ID NO: 3477209 - RNA, 20 nt, Human
uacacauuuuuaaauuguua

SEQ ID NO: 3477210 - RNA, 15 nt, Human
uacacauuuuucaga

SEQ ID NO: 3477211 - RNA, 14 nt, Human
uacaccacacacaa

SEQ ID NO: 3477212 - RNA, 16 nt, Human
uacaccacacacaaca

SEQ ID NO: 3477213 - RNA, 18 nt, Human
uacaccaccucacuccug

SEQ ID NO: 3477214 - RNA, 14 nt, Human
uacaccacucuggc

SEQ ID NO: 3477215 - RNA, 19 nt, Human
uacaccacucuggcagcca

SEQ ID NO: 3477216 - RNA, 18 nt, Human
uacaccagcauuccuuuu

SEQ ID NO: 3477217 - RNA, 20 nt, Human
uacaccagcauuccuuuuga

SEQ ID NO: 3477218 - RNA, 14 nt, Human
uacaccauuaugug

SEQ ID NO: 3477219 - RNA, 15 nt, Human
uacacccagacccca

SEQ ID NO: 3477220 - RNA, 20 nt, Human
uacacccagaccccaggcug

SEQ ID NO: 3477221 - RNA, 20 nt, Human
uacacccccucuucugagca

SEQ ID NO: 3477222 - RNA, 15 nt, Human
uacacccuuuuccag

SEQ ID NO: 3477223 - RNA, 17 nt, Human
uacaccgggccuggaga

SEQ ID NO: 3477224 - RNA, 16 nt, Human
uacaccuauuauccca

SEQ ID NO: 3477225 - RNA, 21 nt, Human
uacaccucguuagggaagaga

SEQ ID NO: 3477226 - RNA, 24 nt, Human
uacaccucguuagggaagagaaac

SEQ ID NO: 3477227 - RNA, 12 nt, Human
uacaccuggcug

SEQ ID NO: 3477228 - RNA, 16 nt, Human
uagaaugauuucaugc

SEQ ID NO: 3477229 - RNA, 19 nt, Human
uagaauggugauuuuaaau

SEQ ID NO: 3477230 - RNA, 20 nt, Human
uagaauggugauuuuaaaug

SEQ ID NO: 3477231 - RNA, 17 nt, Human
uagaauguaaaugucuc

SEQ ID NO: 3477232 - RNA, 14 nt, Human
uagaauguaguuug

SEQ ID NO: 3477233 - RNA, 16 nt, Human
uagaauguauuguacc

SEQ ID NO: 3477234 - RNA, 16 nt, Human
uagaauuaacacauga

SEQ ID NO: 3477235 - RNA, 15 nt, Human
uagaauuaccauuug

SEQ ID NO: 3477236 - RNA, 19 nt, Human
uagaauuaccauuuguuaa

SEQ ID NO: 3477237 - RNA, 14 nt, Human
uagaauuagcuuuu

SEQ ID NO: 3477238 - RNA, 22 nt, Human
uagaauuauaacuguaaagaug

SEQ ID NO: 3477239 - RNA, 17 nt, Human
uagaauuauaagucaca

SEQ ID NO: 3477240 - RNA, 12 nt, Human
uagaauuauuua

SEQ ID NO: 3477241 - RNA, 18 nt, Human
uagaauuauuuuucacuc

SEQ ID NO: 3477242 - RNA, 22 nt, Human
uagaauuauuuuucacucuaag

SEQ ID NO: 3477243 - RNA, 19 nt, Human
uagaauucccucucucuga

SEQ ID NO: 3477244 - RNA, 20 nt, Human
uagaauucuagugcugcuga

SEQ ID NO: 3477245 - RNA, 11 nt, Human
uagaauucugu

SEQ ID NO: 3477246 - RNA, 21 nt, Human
uagaauucuguauagauuaga

SEQ ID NO: 3477247 - RNA, 18 nt, Human
uagaauugaagguuuuug

SEQ ID NO: 3477248 - RNA, 19 nt, Human
uagaauugaagguuuuuga

SEQ ID NO: 3477249 - RNA, 20 nt, Human
uagaauugaagguuuuugau

SEQ ID NO: 3477250 - RNA, 21 nt, Human
uagaauugaagguuuuugaua

SEQ ID NO: 3477251 - RNA, 19 nt, Human
uagaauugacauugaaauc

SEQ ID NO: 3477252 - RNA, 20 nt, Human
uagaauugaguguuuaaagu

SEQ ID NO: 3477253 - RNA, 17 nt, Human
uagaauugcaaucuaua

SEQ ID NO: 3477254 - RNA, 13 nt, Human
uagaauugcauug

SEQ ID NO: 3477255 - RNA, 12 nt, Human
uagaauuguuau

SEQ ID NO: 3477256 - RNA, 22 nt, Human
uagaauuuauucaauuccucug

SEQ ID NO: 3477257 - RNA, 15 nt, Human
uagacaaaaaguaua

SEQ ID NO: 3477258 - RNA, 14 nt, Human
uagacaaauacuca

SEQ ID NO: 3477259 - RNA, 20 nt, Human
uagacaaauacucaugugua

SEQ ID NO: 3477260 - RNA, 15 nt, Human
uagacaacccugcaa

SEQ ID NO: 3477261 - RNA, 19 nt, Human
uagacaagauauuguacau

SEQ ID NO: 3477262 - RNA, 13 nt, Human
uagacaagccaga

SEQ ID NO: 3477263 - RNA, 16 nt, Human
uagacaaucauuguuu

SEQ ID NO: 3477264 - RNA, 18 nt, Human
uagacaauuuauuauggc

SEQ ID NO: 3477265 - RNA, 13 nt, Human
uagacacaugaag

SEQ ID NO: 3477266 - RNA, 22 nt, Human
uagacacaugaagguaaauaaa

SEQ ID NO: 3477267 - RNA, 14 nt, Human
uagacacauuuaag

SEQ ID NO: 3477268 - RNA, 15 nt, Human
uagacacauuuaagg

SEQ ID NO: 3477269 - RNA, 14 nt, Human
uagacaccaaaguu

SEQ ID NO: 3477270 - RNA, 21 nt, Human
uagacaccaaaguucuaauaa

SEQ ID NO: 3477271 - RNA, 17 nt, Human
uagacacccauuuucac

SEQ ID NO: 3477272 - RNA, 14 nt, Human
uagacacccuggca

SEQ ID NO: 3477273 - RNA, 19 nt, Human
uagacacuggcugccagcu

SEQ ID NO: 3477274 - RNA, 15 nt, Human
uagacagaagaaaca

SEQ ID NO: 3477275 - RNA, 10 nt, Human
uagacagagu

SEQ ID NO: 3477276 - RNA, 19 nt, Human
uagacagcuuugacuggag

SEQ ID NO: 3477277 - RNA, 19 nt, Human
uagacaggagaagaaagaa

SEQ ID NO: 3477278 - RNA, 16 nt, Human
uagacagguccugauu

SEQ ID NO: 3477279 - RNA, 22 nt, Human
uagacaguaugagucaaugugc

SEQ ID NO: 3477280 - RNA, 13 nt, Human
uagacaucaaacu

SEQ ID NO: 3477281 - RNA, 14 nt, Human
uagacaucuguccu

SEQ ID NO: 3477282 - RNA, 11 nt, Human
uagacaugaaa

SEQ ID NO: 3477283 - RNA, 21 nt, Human
uagacauggagguucuaaggc

SEQ ID NO: 3477284 - RNA, 16 nt, Human
uagacauucugucgcc

SEQ ID NO: 3477285 - RNA, 18 nt, Human
uagacauuuuaacaagaa

SEQ ID NO: 3477286 - RNA, 14 nt, Human
uagaccaagcuugu

SEQ ID NO: 3477287 - RNA, 18 nt, Human
uagaccaagcuuguccaa

SEQ ID NO: 3477288 - RNA, 12 nt, Human
uagaccaauaaa

SEQ ID NO: 3477289 - RNA, 19 nt, Human
uagaccagcagacagagcc

SEQ ID NO: 3477290 - RNA, 16 nt, Human
uagaccaggauuucua

SEQ ID NO: 3477291 - RNA, 15 nt, Human
uagacccaucuucuu

SEQ ID NO: 3477292 - RNA, 18 nt, Human
uagacccucaugcugcca

SEQ ID NO: 3477293 - RNA, 13 nt, Human
uagaccguuauaa

SEQ ID NO: 3477294 - RNA, 12 nt, Human
uagaccuacagg

SEQ ID NO: 3477295 - RNA, 15 nt, Human
uagaccuacaggggg

SEQ ID NO: 3477296 - RNA, 22 nt, Human
uagaccuagggaggaccuuauc

SEQ ID NO: 3477297 - RNA, 15 nt, Human
uagaccucagccugu

SEQ ID NO: 3477298 - RNA, 21 nt, Human
uagaccucagccugugcugcc

SEQ ID NO: 3477299 - RNA, 16 nt, Human
uagaccugucuccugg

SEQ ID NO: 3477300 - RNA, 20 nt, Human
uagaccuuuuuuuuuuuucc

SEQ ID NO: 3477301 - RNA, 22 nt, Human
uagaccuuuuuuuuuuuuccaa

SEQ ID NO: 3477302 - RNA, 23 nt, Human
uagacggagcccuggcaugucaa

SEQ ID NO: 3477303 - RNA, 13 nt, Human
uagacuaaaugaa

SEQ ID NO: 3477304 - RNA, 23 nt, Human
uagacuaaggccauuauuguacu

SEQ ID NO: 3477305 - RNA, 14 nt, Human
uagacuacuguuca

SEQ ID NO: 3477306 - RNA, 14 nt, Human
uagacuagagaaac

SEQ ID NO: 3477307 - RNA, 15 nt, Human
uagacuauaaauguu

SEQ ID NO: 3477308 - RNA, 19 nt, Human
uagacuauauacaugugug

SEQ ID NO: 3477309 - RNA, 17 nt, Human
uagacucaucuuacugu

SEQ ID NO: 3477310 - RNA, 19 nt, Human
uagacucaucuuacuguac

SEQ ID NO: 3477311 - RNA, 15 nt, Human
uagacuccaacaaca

SEQ ID NO: 3477312 - RNA, 16 nt, Human
uagacucuaguauuua

SEQ ID NO: 3477313 - RNA, 17 nt, Human
uagacucuuacuuuuua

SEQ ID NO: 3477314 - RNA, 20 nt, Human
uagacucuuacuuuuuaaaa

SEQ ID NO: 3477315 - RNA, 11 nt, Human
uagacugccag

SEQ ID NO: 3477316 - RNA, 12 nt, Human
uagacugccagc

SEQ ID NO: 3477317 - RNA, 13 nt, Human
uagacugccagcu

SEQ ID NO: 3477318 - RNA, 22 nt, Human
uagacugccagcucuuccuagc

SEQ ID NO: 3477319 - RNA, 17 nt, Human
uagacugccuggguucc

SEQ ID NO: 3477320 - RNA, 14 nt, Human
uagacuggacagcu

SEQ ID NO: 3477321 - RNA, 14 nt, Human
uagacuggugacug

SEQ ID NO: 3477322 - RNA, 20 nt, Human
uagacuggugacugauucuu

SEQ ID NO: 3477323 - RNA, 21 nt, Human
uagacuggugacugauucuuc

SEQ ID NO: 3477324 - RNA, 23 nt, Human
uagacuggugacugauucuucag

SEQ ID NO: 3477325 - RNA, 17 nt, Human
uagacugugauucagaa

SEQ ID NO: 3477326 - RNA, 18 nt, Human
uagacugugauucagaaa

SEQ ID NO: 3477327 - RNA, 18 nt, Human
uagacuuaauagaaacau

SEQ ID NO: 3477328 - RNA, 22 nt, Human
uagacuucaagcauggcuauuu

SEQ ID NO: 3477329 - RNA, 21 nt, Human
uagacuucagggagucagcug

SEQ ID NO: 3477330 - RNA, 18 nt, Human
uagacuucgacucaggau

SEQ ID NO: 3477331 - RNA, 19 nt, Human
uagacuucugcuuuccaca

SEQ ID NO: 3477332 - RNA, 12 nt, Human
uagacuugaaaa

SEQ ID NO: 3477333 - RNA, 16 nt, Human
uagacuuggauucuuu

SEQ ID NO: 3477334 - RNA, 20 nt, Human
uagacuuggauucuuuccau

SEQ ID NO: 3477335 - RNA, 14 nt, Human
uagacuuuaacaua

SEQ ID NO: 3477336 - RNA, 19 nt, Human
uagacuuuagaaauaaaug

SEQ ID NO: 3477337 - RNA, 21 nt, Human
uagacuuuaggcuuucagcuu

SEQ ID NO: 3477338 - RNA, 17 nt, Human
uagagaacgcagcccua

SEQ ID NO: 3477339 - RNA, 17 nt, Human
uagagaacuaaacuagu

SEQ ID NO: 3477340 - RNA, 22 nt, Human
uagagaacugaaaagagagcag

SEQ ID NO: 3477341 - RNA, 18 nt, Human
uagagaagacaggcugga

SEQ ID NO: 3477342 - RNA, 19 nt, Human
uagagaaguauacauaagu

SEQ ID NO: 3477343 - RNA, 13 nt, Human
uagagaaugcaca

SEQ ID NO: 3477344 - RNA, 22 nt, Human
uagagaaugcacagauauacuu

SEQ ID NO: 3477345 - RNA, 17 nt, Human
uagagaauguuccagac

SEQ ID NO: 3477346 - RNA, 14 nt, Human
uagagacuggaaca

SEQ ID NO: 3477347 - RNA, 17 nt, Human
uagagacuuuuuucuag

SEQ ID NO: 3477348 - RNA, 13 nt, Human
uagagagcuauuu

SEQ ID NO: 3477349 - RNA, 14 nt, Human
uagagaguguugaa

SEQ ID NO: 3477350 - RNA, 19 nt, Human
uagagauaugcagaaggaa

SEQ ID NO: 3477351 - RNA, 16 nt, Human
uagagauauuuuguaa

SEQ ID NO: 3477352 - RNA, 17 nt, Human
uagagaucugguuuugc

SEQ ID NO: 3477353 - RNA, 17 nt, Human
uagagaugacugagucc

SEQ ID NO: 3477354 - RNA, 19 nt, Human
uagagauggaggaggaggc

SEQ ID NO: 3477355 - RNA, 13 nt, Human
uagagaugugcaa

SEQ ID NO: 3477356 - RNA, 12 nt, Human
uagagauguuuu

SEQ ID NO: 3477357 - RNA, 20 nt, Human
uagagauguuuuuaaaaguu

SEQ ID NO: 3477358 - RNA, 15 nt, Human
uagagauuugucuaa

SEQ ID NO: 3477359 - RNA, 16 nt, Human
uagagcagacuacagc

SEQ ID NO: 3477360 - RNA, 17 nt, Human
uagagcagacuacagcu

SEQ ID NO: 3477361 - RNA, 19 nt, Human
uagagcagaugaccccucc

SEQ ID NO: 3477362 - RNA, 12 nt, Human
uagagcagccca

SEQ ID NO: 3477363 - RNA, 19 nt, Human
uagagcagcccuggaguca

SEQ ID NO: 3477364 - RNA, 16 nt, Human
uagagcaggacugaug

SEQ ID NO: 3477365 - RNA, 17 nt, Human
uagagcaggacugaugu

SEQ ID NO: 3477366 - RNA, 22 nt, Human
uagagcaggcguucagcucacu

SEQ ID NO: 3477367 - RNA, 22 nt, Human
uagagcaguuucuguccugcug

SEQ ID NO: 3477368 - RNA, 14 nt, Human
uagagccaggcaca

SEQ ID NO: 3477369 - RNA, 15 nt, Human
uagagccaggcacac

SEQ ID NO: 3477370 - RNA, 14 nt, Human
uagagccagggucu

SEQ ID NO: 3477371 - RNA, 21 nt, Human
uagagccggguguccccaaca

SEQ ID NO: 3477372 - RNA, 16 nt, Human
uagagccugccuggag

SEQ ID NO: 3477373 - RNA, 17 nt, Human
uagagccugccuggagc

SEQ ID NO: 3477374 - RNA, 18 nt, Human
uagauucaaagguucuag

SEQ ID NO: 3477375 - RNA, 13 nt, Human
uagauucaccugu

SEQ ID NO: 3477376 - RNA, 17 nt, Human
uagauucaccuguaaaa

SEQ ID NO: 3477377 - RNA, 20 nt, Human
uagauucaccuguaaaacuu

SEQ ID NO: 3477378 - RNA, 17 nt, Human
uagauucagguaauaca

SEQ ID NO: 3477379 - RNA, 23 nt, Human
uagauuccccauugccuccuccu

SEQ ID NO: 3477380 - RNA, 13 nt, Human
uagauucuaaaga

SEQ ID NO: 3477381 - RNA, 22 nt, Human
uagauucucugugucuaagauu

SEQ ID NO: 3477382 - RNA, 15 nt, Human
uagauugagaaaugu

SEQ ID NO: 3477383 - RNA, 14 nt, Human
uagauugauuguau

SEQ ID NO: 3477384 - RNA, 16 nt, Human
uagauugauuguauug

SEQ ID NO: 3477385 - RNA, 23 nt, Human
uagauugcagaaaauucugugcc

SEQ ID NO: 3477386 - RNA, 16 nt, Human
uagauuguuaaaauaa

SEQ ID NO: 3477387 - RNA, 23 nt, Human
uagauuuaauauaaaguuuuaua

SEQ ID NO: 3477388 - RNA, 11 nt, Human
uagauuuaugg

SEQ ID NO: 3477389 - RNA, 21 nt, Human
uagauuuauuuuucaguucca

SEQ ID NO: 3477390 - RNA, 22 nt, Human
uagauuuauuuuucaguuccaa

SEQ ID NO: 3477391 - RNA, 16 nt, Human
uagauuucauaguuca

SEQ ID NO: 3477392 - RNA, 18 nt, Human
uagauuucauaguucaga

SEQ ID NO: 3477393 - RNA, 19 nt, Human
uagauuucauaguucagaa

SEQ ID NO: 3477394 - RNA, 20 nt, Human
uagauuucauaguucagaau

SEQ ID NO: 3477395 - RNA, 14 nt, Human
uagauuucugauuu

SEQ ID NO: 3477396 - RNA, 17 nt, Human
uagauuucugauuuuau

SEQ ID NO: 3477397 - RNA, 12 nt, Human
uagauuugaccu

SEQ ID NO: 3477398 - RNA, 21 nt, Human
uagauuugccauagaguacac

SEQ ID NO: 3477399 - RNA, 20 nt, Human
uagauuuggcuccucugcuu

SEQ ID NO: 3477400 - RNA, 19 nt, Human
uagauuugugugcaucagg

SEQ ID NO: 3477401 - RNA, 22 nt, Human
uagauuugugugcaucaggcuu

SEQ ID NO: 3477402 - RNA, 18 nt, Human
uagauuuuaaucaaauuu

SEQ ID NO: 3477403 - RNA, 15 nt, Human
uagauuuuacaugaa

SEQ ID NO: 3477404 - RNA, 18 nt, Human
uagauuuuacaugaagua

SEQ ID NO: 3477405 - RNA, 22 nt, Human
uagauuuuacaugaaguauuuu

SEQ ID NO: 3477406 - RNA, 13 nt, Human
uagauuuuauagu

SEQ ID NO: 3477407 - RNA, 15 nt, Human
uagauuuuauagugu

SEQ ID NO: 3477408 - RNA, 13 nt, Human
uagauuuucugcu

SEQ ID NO: 3477409 - RNA, 16 nt, Human
uagauuuucuuuaaaa

SEQ ID NO: 3477410 - RNA, 19 nt, Human
uagauuuucuuuaaaagaa

SEQ ID NO: 3477411 - RNA, 22 nt, Human
uagauuuuguguuuauucuuga

SEQ ID NO: 3477412 - RNA, 18 nt, Human
uagcaaaaaaaacccaug

SEQ ID NO: 3477413 - RNA, 20 nt, Human
uagcaaaaaaaguuguauga

SEQ ID NO: 3477414 - RNA, 23 nt, Human
uagcaaaaaaaguuguaugaucu

SEQ ID NO: 3477415 - RNA, 18 nt, Human
uagcaaaaacauguaugu

SEQ ID NO: 3477416 - RNA, 14 nt, Human
uagcaaaaaguggg

SEQ ID NO: 3477417 - RNA, 15 nt, Human
uagcaaaacuuuuaa

SEQ ID NO: 3477418 - RNA, 18 nt, Human
uagcaaaacuuuuaaacu

SEQ ID NO: 3477419 - RNA, 15 nt, Human
uagcaaaauaaaaca

SEQ ID NO: 3477420 - RNA, 16 nt, Human
uagcaaaauaaaacau

SEQ ID NO: 3477421 - RNA, 17 nt, Human
uagcaaaauaaaacaua

SEQ ID NO: 3477422 - RNA, 19 nt, Human
uagcaaaauaaaacauagc

SEQ ID NO: 3477423 - RNA, 21 nt, Human
uagcaaaauucuuaaguaugu

SEQ ID NO: 3477424 - RNA, 15 nt, Human
uagcaaacagaggaa

SEQ ID NO: 3477425 - RNA, 14 nt, Human
uagcaaagaauuga

SEQ ID NO: 3477426 - RNA, 17 nt, Human
uagcaaagauaucucau

SEQ ID NO: 3477427 - RNA, 22 nt, Human
uagcaaaugagacagcagucuu

SEQ ID NO: 3477428 - RNA, 18 nt, Human
uagcaacaacaauuggua

SEQ ID NO: 3477429 - RNA, 12 nt, Human
uagcaacaggaa

SEQ ID NO: 3477430 - RNA, 16 nt, Human
uagcaaggcaugaugu

SEQ ID NO: 3477431 - RNA, 17 nt, Human
uagcaaggucauuucuu

SEQ ID NO: 3477432 - RNA, 17 nt, Human
uagcaaguucuagagaa

SEQ ID NO: 3477433 - RNA, 19 nt, Human
uagcacaaguuauuuaaau

SEQ ID NO: 3477434 - RNA, 18 nt, Human
uagcacacacuuuugguu

SEQ ID NO: 3477435 - RNA, 14 nt, Human
uagcacagacccug

SEQ ID NO: 3477436 - RNA, 16 nt, Human
uagcacagacccugcc

SEQ ID NO: 3477437 - RNA, 19 nt, Human
uagcacagacccugcccug

SEQ ID NO: 3477438 - RNA, 16 nt, Human
uagcacagauuuuaau

SEQ ID NO: 3477439 - RNA, 21 nt, Human
uagcacaggcugagugcaggc

SEQ ID NO: 3477440 - RNA, 16 nt, Human
uagcaccagggaaggg

SEQ ID NO: 3477441 - RNA, 18 nt, Human
uagcacguuuaaaguucu

SEQ ID NO: 3477442 - RNA, 19 nt, Human
uagcacguuuaaaguucug

SEQ ID NO: 3477443 - RNA, 20 nt, Human
uagcacuaccacuccugcca

SEQ ID NO: 3477444 - RNA, 17 nt, Human
uagcacucacaugcugg

SEQ ID NO: 3477445 - RNA, 15 nt, Human
uagcacucaggcucu

SEQ ID NO: 3477446 - RNA, 19 nt, Human
uagcacucauuuucuauaa

SEQ ID NO: 3477447 - RNA, 11 nt, Human
uagcacuguug

SEQ ID NO: 3477448 - RNA, 18 nt, Human
uagcacuguugauguauc

SEQ ID NO: 3477449 - RNA, 21 nt, Human
uagcacuucagggcagauuuu

SEQ ID NO: 3477450 - RNA, 21 nt, Human
uagcacuuccuugccagucuu

SEQ ID NO: 3477451 - RNA, 23 nt, Human
uagcacuuucauugccagugucu

SEQ ID NO: 3477452 - RNA, 19 nt, Human
uagcacuuugaaauaccuc

SEQ ID NO: 3477453 - RNA, 17 nt, Human
uagcagaagaaaggaac

SEQ ID NO: 3477454 - RNA, 20 nt, Human
uagcagaaucaaaaugaccu

SEQ ID NO: 3477455 - RNA, 19 nt, Human
uagcagacaggccccguga

SEQ ID NO: 3477456 - RNA, 23 nt, Human
uagcagagaaugaaagggcccag

SEQ ID NO: 3477457 - RNA, 13 nt, Human
uagcagaguuaaa

SEQ ID NO: 3477458 - RNA, 14 nt, Human
uagcagaguuaaau

SEQ ID NO: 3477459 - RNA, 17 nt, Human
uagcagaucuguuuugu

SEQ ID NO: 3477460 - RNA, 14 nt, Human
uagcagauuuuaau

SEQ ID NO: 3477461 - RNA, 18 nt, Human
uagcagcaaaaauauaaa

SEQ ID NO: 3477462 - RNA, 20 nt, Human
uagcagcaaaaauauaaaau

SEQ ID NO: 3477463 - RNA, 16 nt, Human
uagcagccaguucaaa

SEQ ID NO: 3477464 - RNA, 18 nt, Human
uagcagccaguucaaaaa

SEQ ID NO: 3477465 - RNA, 14 nt, Human
uagcagcccacccu

SEQ ID NO: 3477466 - RNA, 20 nt, Human
uagcagccuggcuccccugg

SEQ ID NO: 3477467 - RNA, 16 nt, Human
uagcagccuuucucuc

SEQ ID NO: 3477468 - RNA, 14 nt, Human
uagcagcuaucucu

SEQ ID NO: 3477469 - RNA, 20 nt, Human
uagcagcugacuuucaaagu

SEQ ID NO: 3477470 - RNA, 11 nt, Human
uagcagcugga

SEQ ID NO: 3477471 - RNA, 15 nt, Human
uagcagcuuccagau

SEQ ID NO: 3477472 - RNA, 21 nt, Human
uagcaggagaggagagccaga

SEQ ID NO: 3477473 - RNA, 16 nt, Human
uagcaggggcugcagu

SEQ ID NO: 3477474 - RNA, 17 nt, Human
uagcagguaccacugau

SEQ ID NO: 3477475 - RNA, 15 nt, Human
uagcaggugguccug

SEQ ID NO: 3477476 - RNA, 22 nt, Human
uagcaggugguccugagaccug

SEQ ID NO: 3477477 - RNA, 21 nt, Human
uagcagugauuuuuauccaau

SEQ ID NO: 3477478 - RNA, 15 nt, Human
uagcaguggcaggca

SEQ ID NO: 3477479 - RNA, 19 nt, Human
uagcauagcuuauuauuga

SEQ ID NO: 3477480 - RNA, 18 nt, Human
uagcauauaauucuauau

SEQ ID NO: 3477481 - RNA, 22 nt, Human
uagcauauauguguccauuucc

SEQ ID NO: 3477482 - RNA, 14 nt, Human
uagcauaugaguuu

SEQ ID NO: 3477483 - RNA, 15 nt, Human
uagcaucacuuaaaa

SEQ ID NO: 3477484 - RNA, 17 nt, Human
uagcaucacuuaaaaca

SEQ ID NO: 3477485 - RNA, 18 nt, Human
uagcaucacuuaaaacac

SEQ ID NO: 3477486 - RNA, 15 nt, Human
uagcauccuaagaaa

SEQ ID NO: 3477487 - RNA, 16 nt, Human
uagcauccuaagaaau

SEQ ID NO: 3477488 - RNA, 23 nt, Human
uagcauccuaagaaauaugugag

SEQ ID NO: 3477489 - RNA, 15 nt, Human
uagcauccuggaaua

SEQ ID NO: 3477490 - RNA, 22 nt, Human
uagcaucucaggagauuucaug

SEQ ID NO: 3477491 - RNA, 15 nt, Human
uagcaucuguacaaa

SEQ ID NO: 3477492 - RNA, 13 nt, Human
uagcaucuucugg

SEQ ID NO: 3477493 - RNA, 16 nt, Human
uagcaucuucuggagu

SEQ ID NO: 3477494 - RNA, 23 nt, Human
uagcaucuucuggagucuccagu

SEQ ID NO: 3477495 - RNA, 17 nt, Human
uagcaugacaagcccca

SEQ ID NO: 3477496 - RNA, 18 nt, Human
uagcaugacaagccccag

SEQ ID NO: 3477497 - RNA, 20 nt, Human
uagcaugacaagccccaggc

SEQ ID NO: 3477498 - RNA, 21 nt, Human
uagcaugacaagccccaggca

SEQ ID NO: 3477499 - RNA, 14 nt, Human
uagcaugcacaaag

SEQ ID NO: 3477500 - RNA, 14 nt, Human
uagcaugccaacaa

SEQ ID NO: 3477501 - RNA, 23 nt, Human
uagcaugcuuguugcaauugccu

SEQ ID NO: 3477502 - RNA, 18 nt, Human
uagcauggcauauuuuuc

SEQ ID NO: 3477503 - RNA, 12 nt, Human
uagcauguaaug

SEQ ID NO: 3477504 - RNA, 15 nt, Human
uagcauguauugugu

SEQ ID NO: 3477505 - RNA, 18 nt, Human
uagcauguccuaaugcuu

SEQ ID NO: 3477506 - RNA, 21 nt, Human
uagcauguguuugguucuggg

SEQ ID NO: 3477507 - RNA, 15 nt, Human
uagcauguuguagau

SEQ ID NO: 3477508 - RNA, 14 nt, Human
uagcauucuuugga

SEQ ID NO: 3477509 - RNA, 24 nt, Human
uagcauuguaaaauuauuucauga

SEQ ID NO: 3477510 - RNA, 22 nt, Human
uagcauuguaagcguauggcuu

SEQ ID NO: 3477511 - RNA, 22 nt, Human
uagcauuuaguccaaugucuuu

SEQ ID NO: 3477512 - RNA, 22 nt, Human
uagcauuuaugguaaucauauu

SEQ ID NO: 3477513 - RNA, 16 nt, Human
uagcauuucauucuuc

SEQ ID NO: 3477514 - RNA, 17 nt, Human
uagcauuucauucuucu

SEQ ID NO: 3477515 - RNA, 12 nt, Human
uagcauuucuug

SEQ ID NO: 3477516 - RNA, 13 nt, Human
uagcauuucuuga

SEQ ID NO: 3477517 - RNA, 16 nt, Human
uagcauuucuugaugu

SEQ ID NO: 3477518 - RNA, 19 nt, Human
uagcucuuugucagggagu

SEQ ID NO: 3477519 - RNA, 14 nt, Human
uagcucuuuuccua

SEQ ID NO: 3477520 - RNA, 19 nt, Human
uagcucuuuuuuguuuguu

SEQ ID NO: 3477521 - RNA, 21 nt, Human
uagcugaagaauugaaaaguu

SEQ ID NO: 3477522 - RNA, 18 nt, Human
uagcugacaaaauacuug

SEQ ID NO: 3477523 - RNA, 17 nt, Human
uagcugacagaaucucu

SEQ ID NO: 3477524 - RNA, 21 nt, Human
uagcugacccagccccuugag

SEQ ID NO: 3477525 - RNA, 23 nt, Human
uagcugacccagccccuugagaa

SEQ ID NO: 3477526 - RNA, 17 nt, Human
uagcugagcgugguggc

SEQ ID NO: 3477527 - RNA, 11 nt, Human
uagcugagcuc

SEQ ID NO: 3477528 - RNA, 21 nt, Human
uagcugagcucacaaggcagc

SEQ ID NO: 3477529 - RNA, 11 nt, Human
uagcugagugu

SEQ ID NO: 3477530 - RNA, 14 nt, Human
uagcugaucaguuu

SEQ ID NO: 3477531 - RNA, 23 nt, Human
uagcugaugaacuuauucuguag

SEQ ID NO: 3477532 - RNA, 16 nt, Human
uagcugcaaaggacag

SEQ ID NO: 3477533 - RNA, 11 nt, Human
uagcugcagaa

SEQ ID NO: 3477534 - RNA, 21 nt, Human
uagcugcauccuccaagaauc

SEQ ID NO: 3477535 - RNA, 20 nt, Human
uagcugccaagccccauccu

SEQ ID NO: 3477536 - RNA, 15 nt, Human
uagcugccacuugaa

SEQ ID NO: 3477537 - RNA, 21 nt, Human
uagcugccacuugaacaaaau

SEQ ID NO: 3477538 - RNA, 17 nt, Human
uagcugcugucacauuu

SEQ ID NO: 3477539 - RNA, 19 nt, Human
uagcuggagaggagcccug

SEQ ID NO: 3477540 - RNA, 19 nt, Human
uagcugggacuacaggcac

SEQ ID NO: 3477541 - RNA, 18 nt, Human
uagcugggacuacaggug

SEQ ID NO: 3477542 - RNA, 22 nt, Human
uagcugggagaaagagagagcu

SEQ ID NO: 3477543 - RNA, 15 nt, Human
uagcugggauuuuaa

SEQ ID NO: 3477544 - RNA, 20 nt, Human
uagcugggggugggccaggc

SEQ ID NO: 3477545 - RNA, 17 nt, Human
uagcuguaaggcaugaa

SEQ ID NO: 3477546 - RNA, 18 nt, Human
uagcuguacaaauauaag

SEQ ID NO: 3477547 - RNA, 15 nt, Human
uagcugucuagagua

SEQ ID NO: 3477548 - RNA, 21 nt, Human
uagcugucugcucagacagaa

SEQ ID NO: 3477549 - RNA, 18 nt, Human
uagcugugaccugcugag

SEQ ID NO: 3477550 - RNA, 13 nt, Human
uagcugugggggu

SEQ ID NO: 3477551 - RNA, 14 nt, Human
uagcuguggugagg

SEQ ID NO: 3477552 - RNA, 22 nt, Human
uagcugugugaauaccugcuca

SEQ ID NO: 3477553 - RNA, 14 nt, Human
uagcuuaagaaaaa

SEQ ID NO: 3477554 - RNA, 18 nt, Human
uagcuuacaugagaacag

SEQ ID NO: 3477555 - RNA, 15 nt, Human
uagcuuaccugacac

SEQ ID NO: 3477556 - RNA, 16 nt, Human
uagcuuagaccucagc

SEQ ID NO: 3477557 - RNA, 17 nt, Human
uagcuuagagccucccu

SEQ ID NO: 3477558 - RNA, 15 nt, Human
uagcuucugcuuuuc

SEQ ID NO: 3477559 - RNA, 16 nt, Human
uagcuugcaccuuguc

SEQ ID NO: 3477560 - RNA, 15 nt, Human
uagcuuggaaacugg

SEQ ID NO: 3477561 - RNA, 19 nt, Human
uagcuugggaggcuucccc

SEQ ID NO: 3477562 - RNA, 15 nt, Human
uagcuuggggccagg

SEQ ID NO: 3477563 - RNA, 17 nt, Human
uagcuuguauaguguaa

SEQ ID NO: 3477564 - RNA, 23 nt, Human
uagcuuuaaugauaugcuuguaa

SEQ ID NO: 3477565 - RNA, 19 nt, Human
uagcuuuacuguuuguuau

SEQ ID NO: 3477566 - RNA, 16 nt, Human
uagcuuuagacccugg

SEQ ID NO: 3477567 - RNA, 18 nt, Human
uagcuuuauauauggaca

SEQ ID NO: 3477568 - RNA, 13 nt, Human
uagcuuuauucuu

SEQ ID NO: 3477569 - RNA, 19 nt, Human
uagcuuuauuuuuuaagua

SEQ ID NO: 3477570 - RNA, 20 nt, Human
uagcuuuauuuuuuaaguau

SEQ ID NO: 3477571 - RNA, 11 nt, Human
uagcuuugcuc

SEQ ID NO: 3477572 - RNA, 15 nt, Human
uagcuuugcucuuug

SEQ ID NO: 3477573 - RNA, 17 nt, Human
uagcuuuggaaguuuag

SEQ ID NO: 3477574 - RNA, 22 nt, Human
uagcuuuguguuugguuuacau

SEQ ID NO: 3477575 - RNA, 23 nt, Human
uagcuuuguguuugguuuacauu

SEQ ID NO: 3477576 - RNA, 16 nt, Human
uagcuuuucaccuuua

SEQ ID NO: 3477577 - RNA, 13 nt, Human
uagcuuuucccuu

SEQ ID NO: 3477578 - RNA, 16 nt, Human
uagcuuuugugucuua

SEQ ID NO: 3477579 - RNA, 14 nt, Human
uaggaaaaacugau

SEQ ID NO: 3477580 - RNA, 17 nt, Human
uaggaaaaacugauuuu

SEQ ID NO: 3477581 - RNA, 21 nt, Human
uaggaaaagaaaucuauagaa

SEQ ID NO: 3477582 - RNA, 13 nt, Human
uaggaaacaagug

SEQ ID NO: 3477583 - RNA, 19 nt, Human
uaggaaagaccauuuuucc

SEQ ID NO: 3477584 - RNA, 21 nt, Human
uaggaaagccucacugauaua

SEQ ID NO: 3477585 - RNA, 11 nt, Human
uaggaaaggau

SEQ ID NO: 3477586 - RNA, 16 nt, Human
uaggaaauaaaaccuu

SEQ ID NO: 3477587 - RNA, 16 nt, Human
uaggaaaugaaugugu

SEQ ID NO: 3477588 - RNA, 22 nt, Human
uaggaacaaaucuuccuggucg

SEQ ID NO: 3477589 - RNA, 18 nt, Human
uaggaacugcugggcuug

SEQ ID NO: 3477590 - RNA, 15 nt, Human
uaggaacuucagaga

SEQ ID NO: 3477591 - RNA, 16 nt, Human
uaggaacuugagaacu

SEQ ID NO: 3477592 - RNA, 12 nt, Human
uaggaagaaaga

SEQ ID NO: 3477593 - RNA, 15 nt, Human
uaggaagaauuuuaa

SEQ ID NO: 3477594 - RNA, 17 nt, Human
uaggaagaauuuuaaaa

SEQ ID NO: 3477595 - RNA, 18 nt, Human
uaggaagagcaggacucc

SEQ ID NO: 3477596 - RNA, 16 nt, Human
uaggaagguacuguau

SEQ ID NO: 3477597 - RNA, 15 nt, Human
uaggaagguuaaugu

SEQ ID NO: 3477598 - RNA, 16 nt, Human
uaggaaguuuucugua

SEQ ID NO: 3477599 - RNA, 17 nt, Human
uaggaaguuuucuguag

SEQ ID NO: 3477600 - RNA, 12 nt, Human
uaggaauaaaua

SEQ ID NO: 3477601 - RNA, 23 nt, Human
uaggaauagcaugucacuaaagc

SEQ ID NO: 3477602 - RNA, 15 nt, Human
uaggaauauuauauu

SEQ ID NO: 3477603 - RNA, 16 nt, Human
uaggaauauuauauuu

SEQ ID NO: 3477604 - RNA, 18 nt, Human
uaggaauauuauauuugg

SEQ ID NO: 3477605 - RNA, 14 nt, Human
uaggaaucagcaag

SEQ ID NO: 3477606 - RNA, 15 nt, Human
uaggaaucagcaaga

SEQ ID NO: 3477607 - RNA, 17 nt, Human
uaggaaucauucagaaa

SEQ ID NO: 3477608 - RNA, 20 nt, Human
uaggaauugacccacaagaa

SEQ ID NO: 3477609 - RNA, 20 nt, Human
uaggacaaucaguccccucc

SEQ ID NO: 3477610 - RNA, 20 nt, Human
uaggaccaggauccagccuc

SEQ ID NO: 3477611 - RNA, 19 nt, Human
uaggaccaugguuaagagu

SEQ ID NO: 3477612 - RNA, 23 nt, Human
uaggaccaugguuaagaguccaa

SEQ ID NO: 3477613 - RNA, 16 nt, Human
uaggacccaagcagag

SEQ ID NO: 3477614 - RNA, 19 nt, Human
uaggacccgucuccagcug

SEQ ID NO: 3477615 - RNA, 19 nt, Human
uaggaccuuuccaccacag

SEQ ID NO: 3477616 - RNA, 22 nt, Human
uaggaccuuuccaccacagcca

SEQ ID NO: 3477617 - RNA, 15 nt, Human
uaggacucugaggcu

SEQ ID NO: 3477618 - RNA, 16 nt, Human
uaggagaagccaggaa

SEQ ID NO: 3477619 - RNA, 13 nt, Human
uaggagacuugua

SEQ ID NO: 3477620 - RNA, 14 nt, Human
uaggagagaaggua

SEQ ID NO: 3477621 - RNA, 18 nt, Human
uaggagaggaugagagcc

SEQ ID NO: 3477622 - RNA, 22 nt, Human
uaggagauaccagguugaaaga

SEQ ID NO: 3477623 - RNA, 15 nt, Human
uaggagaucagaaaa

SEQ ID NO: 3477624 - RNA, 23 nt, Human
uaggagccugcuggucacagccu

SEQ ID NO: 3477625 - RNA, 23 nt, Human
uaggagcugccuuggcucagaca

SEQ ID NO: 3477626 - RNA, 14 nt, Human
uaggagcugggagg

SEQ ID NO: 3477627 - RNA, 18 nt, Human
uaggagcugggaggaaaa

SEQ ID NO: 3477628 - RNA, 19 nt, Human
uaggagcuuugacucagga

SEQ ID NO: 3477629 - RNA, 13 nt, Human
uaggaggaugggc

SEQ ID NO: 3477630 - RNA, 20 nt, Human
uaggagugugugacauucca

SEQ ID NO: 3477631 - RNA, 18 nt, Human
uaggauagcuaacuguaa

SEQ ID NO: 3477632 - RNA, 22 nt, Human
uaggauaugguggguggacagg

SEQ ID NO: 3477633 - RNA, 18 nt, Human
uaggaugcucaguugcua

SEQ ID NO: 3477634 - RNA, 19 nt, Human
uaggauguauauuuuauau

SEQ ID NO: 3477635 - RNA, 23 nt, Human
uaggauguauauuuuauauaaag

SEQ ID NO: 3477636 - RNA, 18 nt, Human
uaggauguuuuucaugaa

SEQ ID NO: 3477637 - RNA, 19 nt, Human
uaggauguuuuucaugaaa

SEQ ID NO: 3477638 - RNA, 12 nt, Human
uaggauucacac

SEQ ID NO: 3477639 - RNA, 20 nt, Human
uaggauucacaccccaccug

SEQ ID NO: 3477640 - RNA, 18 nt, Human
uaggauuugaacacuugg

SEQ ID NO: 3477641 - RNA, 23 nt, Human
uaggauuuuaacuuaacugaaau

SEQ ID NO: 3477642 - RNA, 22 nt, Human
uaggauuuuuuuuaauguuuaa

SEQ ID NO: 3477643 - RNA, 20 nt, Human
uaggcaaauguuuaaacauu

SEQ ID NO: 3477644 - RNA, 19 nt, Human
uaggcaaggcuaugugauu

SEQ ID NO: 3477645 - RNA, 13 nt, Human
uaggcacccaucc

SEQ ID NO: 3477646 - RNA, 16 nt, Human
uaggcacuuuaaaaca

SEQ ID NO: 3477647 - RNA, 14 nt, Human
uaggcagacacagg

SEQ ID NO: 3477648 - RNA, 22 nt, Human
uaggcagacucuuuaugcuugc

SEQ ID NO: 3477649 - RNA, 16 nt, Human
uaggcagagccuuugg

SEQ ID NO: 3477650 - RNA, 22 nt, Human
uaggcaggaagcccaauugcug

SEQ ID NO: 3477651 - RNA, 17 nt, Human
uaggcaggacaugcuga

SEQ ID NO: 3477652 - RNA, 22 nt, Human
uaggcaggacaugcugaagcca

SEQ ID NO: 3477653 - RNA, 15 nt, Human
uaggcagggauuuga

SEQ ID NO: 3477654 - RNA, 17 nt, Human
uaggcagggauuugagg

SEQ ID NO: 3477655 - RNA, 20 nt, Human
uaggcaguaggccggugugc

SEQ ID NO: 3477656 - RNA, 15 nt, Human
uaggcaguauaaaga

SEQ ID NO: 3477657 - RNA, 16 nt, Human
uaggcaucccagggga

SEQ ID NO: 3477658 - RNA, 20 nt, Human
uaggcaugaagagcaaaaau

SEQ ID NO: 3477659 - RNA, 21 nt, Human
uaggcaugagggaucacaggg

SEQ ID NO: 3477660 - RNA, 19 nt, Human
uaggcauuaauguuucuau

SEQ ID NO: 3477661 - RNA, 13 nt, Human
uaggcauucugga

SEQ ID NO: 3477662 - RNA, 14 nt, Human
uaguaaaacacaga

SEQ ID NO: 3477663 - RNA, 11 nt, Human
uaguaaaccaa

SEQ ID NO: 3477664 - RNA, 17 nt, Human
uaguaaaccaauccuau

SEQ ID NO: 3477665 - RNA, 21 nt, Human
uaguaaaucacgcuuuuugaa

SEQ ID NO: 3477666 - RNA, 22 nt, Human
uaguaaaucacgcuuuuugaaa

SEQ ID NO: 3477667 - RNA, 16 nt, Human
uaguaaauguaguuca

SEQ ID NO: 3477668 - RNA, 23 nt, Human
uaguaaaugucuuuguaagucag

SEQ ID NO: 3477669 - RNA, 15 nt, Human
uaguaacacuaauau

SEQ ID NO: 3477670 - RNA, 20 nt, Human
uaguaacucccaucaccucu

SEQ ID NO: 3477671 - RNA, 13 nt, Human
uaguaacugacau

SEQ ID NO: 3477672 - RNA, 18 nt, Human
uaguaagaagacaaacug

SEQ ID NO: 3477673 - RNA, 13 nt, Human
uaguaagauacug

SEQ ID NO: 3477674 - RNA, 12 nt, Human
uaguaagcauag

SEQ ID NO: 3477675 - RNA, 16 nt, Human
uaguaagcaucuacuu

SEQ ID NO: 3477676 - RNA, 16 nt, Human
uaguaaguaauuaugc

SEQ ID NO: 3477677 - RNA, 14 nt, Human
uaguaagugccuuc

SEQ ID NO: 3477678 - RNA, 15 nt, Human
uaguaaguuaaugua

SEQ ID NO: 3477679 - RNA, 12 nt, Human
uaguaauaccuc

SEQ ID NO: 3477680 - RNA, 13 nt, Human
uaguaauaccucu

SEQ ID NO: 3477681 - RNA, 15 nt, Human
uaguaauaccucuaa

SEQ ID NO: 3477682 - RNA, 18 nt, Human
uaguaauauauuuaaagg

SEQ ID NO: 3477683 - RNA, 12 nt, Human
uaguaaucauau

SEQ ID NO: 3477684 - RNA, 14 nt, Human
uaguaaucugcauu

SEQ ID NO: 3477685 - RNA, 17 nt, Human
uaguaaucugcauuauu

SEQ ID NO: 3477686 - RNA, 17 nt, Human
uaguaaugaguuuaaaa

SEQ ID NO: 3477687 - RNA, 15 nt, Human
uaguaauucucaggc

SEQ ID NO: 3477688 - RNA, 14 nt, Human
uaguaauugacaug

SEQ ID NO: 3477689 - RNA, 14 nt, Human
uaguaauuucuuuu

SEQ ID NO: 3477690 - RNA, 16 nt, Human
uaguacaaauuauaaa

SEQ ID NO: 3477691 - RNA, 12 nt, Human
uaguacauaaag

SEQ ID NO: 3477692 - RNA, 19 nt, Human
uaguaccaaaugcuuuaaa

SEQ ID NO: 3477693 - RNA, 16 nt, Human
uaguaccaaucauuuu

SEQ ID NO: 3477694 - RNA, 14 nt, Human
uaguacccaccuga

SEQ ID NO: 3477695 - RNA, 16 nt, Human
uaguaccugaaaagua

SEQ ID NO: 3477696 - RNA, 20 nt, Human
uaguaccuucagauccuacc

SEQ ID NO: 3477697 - RNA, 14 nt, Human
uaguaccuuugcuc

SEQ ID NO: 3477698 - RNA, 16 nt, Human
uaguaccuuugcucuu

SEQ ID NO: 3477699 - RNA, 21 nt, Human
uaguacuccugcaaaauuuua

SEQ ID NO: 3477700 - RNA, 17 nt, Human
uaguacuccuuaagaac

SEQ ID NO: 3477701 - RNA, 23 nt, Human
uaguacuggauuauucaggcuuu

SEQ ID NO: 3477702 - RNA, 14 nt, Human
uaguacugugaauc

SEQ ID NO: 3477703 - RNA, 16 nt, Human
uaguacuucuucugua

SEQ ID NO: 3477704 - RNA, 22 nt, Human
uaguacuugaaaucuaggauua

SEQ ID NO: 3477705 - RNA, 13 nt, Human
uaguacuuuauag

SEQ ID NO: 3477706 - RNA, 14 nt, Human
uaguacuuuauaga

SEQ ID NO: 3477707 - RNA, 14 nt, Human
uaguagagacaggg

SEQ ID NO: 3477708 - RNA, 21 nt, Human
uaguagagguacacuugugaa

SEQ ID NO: 3477709 - RNA, 18 nt, Human
uaguagcccuuucugugu

SEQ ID NO: 3477710 - RNA, 19 nt, Human
uaguagcccuuucugugug

SEQ ID NO: 3477711 - RNA, 19 nt, Human
uaguagcguuuuuuaaaug

SEQ ID NO: 3477712 - RNA, 14 nt, Human
uaguaggauaugcc

SEQ ID NO: 3477713 - RNA, 13 nt, Human
uaguaggcaagau

SEQ ID NO: 3477714 - RNA, 16 nt, Human
uaguaggcauuuuuac

SEQ ID NO: 3477715 - RNA, 16 nt, Human
uaguagggguaccacu

SEQ ID NO: 3477716 - RNA, 20 nt, Human
uaguaggugaguuuucaccu

SEQ ID NO: 3477717 - RNA, 16 nt, Human
uaguauaucuggacaa

SEQ ID NO: 3477718 - RNA, 13 nt, Human
uaguauauuaaaa

SEQ ID NO: 3477719 - RNA, 18 nt, Human
uaguauauuuauauaauu

SEQ ID NO: 3477720 - RNA, 21 nt, Human
uaguaucaaauauuagaugug

SEQ ID NO: 3477721 - RNA, 12 nt, Human
uaguauccucca

SEQ ID NO: 3477722 - RNA, 15 nt, Human
uaguaucuaacaugu

SEQ ID NO: 3477723 - RNA, 15 nt, Human
uaguaugaaauuaua

SEQ ID NO: 3477724 - RNA, 23 nt, Human
uaguaugaaauuauauaaguauu

SEQ ID NO: 3477725 - RNA, 20 nt, Human
uaguaugacgcugauacaua

SEQ ID NO: 3477726 - RNA, 17 nt, Human
uaguaugaggcauuugu

SEQ ID NO: 3477727 - RNA, 16 nt, Human
uaguauggccuguguc

SEQ ID NO: 3477728 - RNA, 16 nt, Human
uaguaugguggcuggg

SEQ ID NO: 3477729 - RNA, 23 nt, Human
uaguauuaucaaagggauaaaga

SEQ ID NO: 3477730 - RNA, 22 nt, Human
uaguauuaucuuguucaggaaa

SEQ ID NO: 3477731 - RNA, 17 nt, Human
uaguauucauucugcau

SEQ ID NO: 3477732 - RNA, 22 nt, Human
uaguauugaauacuuacauucu

SEQ ID NO: 3477733 - RNA, 22 nt, Human
uaguauuguuguccuuuucaua

SEQ ID NO: 3477734 - RNA, 16 nt, Human
uaguauuuauuuaugu

SEQ ID NO: 3477735 - RNA, 18 nt, Human
uaguauuucuaugaaaua

SEQ ID NO: 3477736 - RNA, 19 nt, Human
uaguauuucuaugaaauau

SEQ ID NO: 3477737 - RNA, 14 nt, Human
uaguauuugaaaac

SEQ ID NO: 3477738 - RNA, 13 nt, Human
uaguauuugaauu

SEQ ID NO: 3477739 - RNA, 18 nt, Human
uaguauuugaauuaaaac

SEQ ID NO: 3477740 - RNA, 20 nt, Human
uaguauuugauucaaaauau

SEQ ID NO: 3477741 - RNA, 15 nt, Human
uaguauuuuuaucca

SEQ ID NO: 3477742 - RNA, 15 nt, Human
uagucaauaagaaaa

SEQ ID NO: 3477743 - RNA, 16 nt, Human
uagucacacguggucu

SEQ ID NO: 3477744 - RNA, 23 nt, Human
uagucacauggccuaugcacaua

SEQ ID NO: 3477745 - RNA, 20 nt, Human
uagucacuuuuuuuuuccaa

SEQ ID NO: 3477746 - RNA, 21 nt, Human
uagucaggugccucaagagaa

SEQ ID NO: 3477747 - RNA, 15 nt, Human
uagucauguuuaucu

SEQ ID NO: 3477748 - RNA, 15 nt, Human
uagucauucuucccu

SEQ ID NO: 3477749 - RNA, 14 nt, Human
uagucauuuacuaa

SEQ ID NO: 3477750 - RNA, 14 nt, Human
uagucccagcuacu

SEQ ID NO: 3477751 - RNA, 20 nt, Human
uagucccagcuacucaggag

SEQ ID NO: 3477752 - RNA, 12 nt, Human
uagucccuucca

SEQ ID NO: 3477753 - RNA, 15 nt, Human
uagucccuuccccuc

SEQ ID NO: 3477754 - RNA, 22 nt, Human
uagucccuuccccucccuggcu

SEQ ID NO: 3477755 - RNA, 23 nt, Human
uagucccuuccccucccuggcuc

SEQ ID NO: 3477756 - RNA, 21 nt, Human
uaguccgugcugacagcugcu

SEQ ID NO: 3477757 - RNA, 23 nt, Human
uaguccgugcugacagcugcucc

SEQ ID NO: 3477758 - RNA, 15 nt, Human
uaguccuagugaacc

SEQ ID NO: 3477759 - RNA, 16 nt, Human
uaguccuagugaaccu

SEQ ID NO: 3477760 - RNA, 22 nt, Human
uaguccuauucuauugcaguua

SEQ ID NO: 3477761 - RNA, 13 nt, Human
uaguccuuggcau

SEQ ID NO: 3477762 - RNA, 19 nt, Human
uagucguggagaugucuuc

SEQ ID NO: 3477763 - RNA, 20 nt, Human
uagucguggagaugucuucg

SEQ ID NO: 3477764 - RNA, 17 nt, Human
uagucuaagacuauaua

SEQ ID NO: 3477765 - RNA, 22 nt, Human
uagucuacucuuaagccaucuu

SEQ ID NO: 3477766 - RNA, 18 nt, Human
uagucuagauggcuccuc

SEQ ID NO: 3477767 - RNA, 13 nt, Human
uagucuaguguag

SEQ ID NO: 3477768 - RNA, 14 nt, Human
uagucuauuagcca

SEQ ID NO: 3477769 - RNA, 13 nt, Human
uagucucaagaau

SEQ ID NO: 3477770 - RNA, 12 nt, Human
uagucucaggac

SEQ ID NO: 3477771 - RNA, 15 nt, Human
uagucucagugaaga

SEQ ID NO: 3477772 - RNA, 18 nt, Human
uagucucagugaagacua

SEQ ID NO: 3477773 - RNA, 21 nt, Human
uagucucauuacuuuugaagu

SEQ ID NO: 3477774 - RNA, 19 nt, Human
uagucuccuuugcacugag

SEQ ID NO: 3477775 - RNA, 20 nt, Human
uagucuccuuugcacugagg

SEQ ID NO: 3477776 - RNA, 20 nt, Human
uagucucuaucauuaaaguu

SEQ ID NO: 3477777 - RNA, 23 nt, Human
uagucugcaaaaugaggaaugua

SEQ ID NO: 3477778 - RNA, 22 nt, Human
uagucugugugggacuguacac

SEQ ID NO: 3477779 - RNA, 17 nt, Human
uagucuuaagaacugcu

SEQ ID NO: 3477780 - RNA, 17 nt, Human
uagucuucaagcagauu

SEQ ID NO: 3477781 - RNA, 12 nt, Human
uagucuucucau

SEQ ID NO: 3477782 - RNA, 11 nt, Human
uagucuuggaa

SEQ ID NO: 3477783 - RNA, 17 nt, Human
uagucuugucucagauu

SEQ ID NO: 3477784 - RNA, 18 nt, Human
uagucuuugccagucauu

SEQ ID NO: 3477785 - RNA, 15 nt, Human
uagucuuuggagaaa

SEQ ID NO: 3477786 - RNA, 15 nt, Human
uagucuuuugcuuuu

SEQ ID NO: 3477787 - RNA, 21 nt, Human
uagucuuuugcuuuuggcaaa

SEQ ID NO: 3477788 - RNA, 20 nt, Human
uagugaaaauuguuuaguga

SEQ ID NO: 3477789 - RNA, 24 nt, Human
uagugaaaccccaucucuacugaa

SEQ ID NO: 3477790 - RNA, 18 nt, Human
uagugaauacugcuacag

SEQ ID NO: 3477791 - RNA, 21 nt, Human
uagugaaucacguaaagcuag

SEQ ID NO: 3477792 - RNA, 15 nt, Human
uagugacccacaugc

SEQ ID NO: 3477793 - RNA, 22 nt, Human
uagugaccccuucccuguccuu

SEQ ID NO: 3477794 - RNA, 18 nt, Human
uagugacccggaggccac

SEQ ID NO: 3477795 - RNA, 23 nt, Human
uagugacuaaaccauugugcauu

SEQ ID NO: 3477796 - RNA, 16 nt, Human
uagugacuuguguccc

SEQ ID NO: 3477797 - RNA, 11 nt, Human
uagugacuuuu

SEQ ID NO: 3477798 - RNA, 16 nt, Human
uagugagaagaauauu

SEQ ID NO: 3477799 - RNA, 18 nt, Human
uagugagaagaauauugu

SEQ ID NO: 3477800 - RNA, 22 nt, Human
uagugagcagucaggaaagaga

SEQ ID NO: 3477801 - RNA, 17 nt, Human
uagugaucaagaagacu

SEQ ID NO: 3477802 - RNA, 20 nt, Human
uagugaucacagcagcuucu

SEQ ID NO: 3477803 - RNA, 21 nt, Human
uagugauuuuuaugccaccug

SEQ ID NO: 3477804 - RNA, 14 nt, Human
uagugcaaaucaua

SEQ ID NO: 3477805 - RNA, 22 nt, Human
uagugcaauauauuuuguaugc

SEQ ID NO: 3477806 - RNA, 12 nt, Human
uagugcagcuga

SEQ ID NO: 3477807 - RNA, 15 nt, Human
uaugcuguacccagu

SEQ ID NO: 3477808 - RNA, 13 nt, Human
uaugcuuaaaaua

SEQ ID NO: 3477809 - RNA, 19 nt, Human
uaugcuuaaaauaagcagg

SEQ ID NO: 3477810 - RNA, 12 nt, Human
uaugcuucauac

SEQ ID NO: 3477811 - RNA, 14 nt, Human
uaugcuucauacag

SEQ ID NO: 3477812 - RNA, 14 nt, Human
uaugcuuccagaaa

SEQ ID NO: 3477813 - RNA, 17 nt, Human
uaugcuuccagaaacac

SEQ ID NO: 3477814 - RNA, 23 nt, Human
uaugcuuccagaaacacccacag

SEQ ID NO: 3477815 - RNA, 16 nt, Human
uaugcuucuguuuuau

SEQ ID NO: 3477816 - RNA, 13 nt, Human
uaugcuucuuuca

SEQ ID NO: 3477817 - RNA, 13 nt, Human
uaugcuugcucua

SEQ ID NO: 3477818 - RNA, 13 nt, Human
uaugcuuuccuuc

SEQ ID NO: 3477819 - RNA, 15 nt, Human
uaugcuuugaaugua

SEQ ID NO: 3477820 - RNA, 15 nt, Human
uauggaaaaauaaaa

SEQ ID NO: 3477821 - RNA, 17 nt, Human
uauggaaacccgagggu

SEQ ID NO: 3477822 - RNA, 15 nt, Human
uauggaaauauauau

SEQ ID NO: 3477823 - RNA, 16 nt, Human
uauggaacacucugag

SEQ ID NO: 3477824 - RNA, 13 nt, Human
uauggaacuucua

SEQ ID NO: 3477825 - RNA, 17 nt, Human
uauggaauacaguguua

SEQ ID NO: 3477826 - RNA, 14 nt, Human
uauggaauuacaug

SEQ ID NO: 3477827 - RNA, 18 nt, Human
uauggaauuacauguaaa

SEQ ID NO: 3477828 - RNA, 19 nt, Human
uauggaauuuauaauucag

SEQ ID NO: 3477829 - RNA, 22 nt, Human
uauggaauuuauaauucaguau

SEQ ID NO: 3477830 - RNA, 20 nt, Human
uauggaauuuuucauugaua

SEQ ID NO: 3477831 - RNA, 17 nt, Human
uauggacaaugacccag

SEQ ID NO: 3477832 - RNA, 18 nt, Human
uauggacagcauugccag

SEQ ID NO: 3477833 - RNA, 12 nt, Human
uauggacucugc

SEQ ID NO: 3477834 - RNA, 17 nt, Human
uauggagaauugcugaa

SEQ ID NO: 3477835 - RNA, 15 nt, Human
uauggagagcccugg

SEQ ID NO: 3477836 - RNA, 21 nt, Human
uauggagcagccuggagaccc

SEQ ID NO: 3477837 - RNA, 17 nt, Human
uauggagcucagagagg

SEQ ID NO: 3477838 - RNA, 18 nt, Human
uauggauaugaaaaauga

SEQ ID NO: 3477839 - RNA, 19 nt, Human
uauggaugauucagaaauu

SEQ ID NO: 3477840 - RNA, 16 nt, Human
uauggaugauuuaagu

SEQ ID NO: 3477841 - RNA, 13 nt, Human
uauggauucuaaa

SEQ ID NO: 3477842 - RNA, 16 nt, Human
uauggauucuaaaaug

SEQ ID NO: 3477843 - RNA, 15 nt, Human
uauggauuuguuaca

SEQ ID NO: 3477844 - RNA, 14 nt, Human
uauggcaaaaaugg

SEQ ID NO: 3477845 - RNA, 15 nt, Human
uauggcagaagacac

SEQ ID NO: 3477846 - RNA, 18 nt, Human
uauggcagaguuguaaau

SEQ ID NO: 3477847 - RNA, 16 nt, Human
uauggcagugucuuuc

SEQ ID NO: 3477848 - RNA, 19 nt, Human
uauggcauuugcagauuuu

SEQ ID NO: 3477849 - RNA, 22 nt, Human
uauggccaggaaguagcacagg

SEQ ID NO: 3477850 - RNA, 22 nt, Human
uauggcccagugucaaguugug

SEQ ID NO: 3477851 - RNA, 21 nt, Human
uauggcccuggccuagcauac

SEQ ID NO: 3477852 - RNA, 23 nt, Human
uauggccucagcugccucacuuc

SEQ ID NO: 3477853 - RNA, 14 nt, Human
uauggccuguguca

SEQ ID NO: 3477854 - RNA, 17 nt, Human
uauggcguaaguacaga

SEQ ID NO: 3477855 - RNA, 19 nt, Human
uauggcguaaguacagaga

SEQ ID NO: 3477856 - RNA, 21 nt, Human
uauggcguaaguacagagaag

SEQ ID NO: 3477857 - RNA, 22 nt, Human
uauggcguaaguacagagaagc

SEQ ID NO: 3477858 - RNA, 23 nt, Human
uauggcguaaguacagagaagcc

SEQ ID NO: 3477859 - RNA, 21 nt, Human
uauggcuagaauauccuacuu

SEQ ID NO: 3477860 - RNA, 22 nt, Human
uauggcuagaauauccuacuuc

SEQ ID NO: 3477861 - RNA, 17 nt, Human
uauggcuuuugugcauu

SEQ ID NO: 3477862 - RNA, 23 nt, Human
uauggcuuuugugcauuaucuag

SEQ ID NO: 3477863 - RNA, 23 nt, Human
uaugggaaaugagaggcauuucc

SEQ ID NO: 3477864 - RNA, 18 nt, Human
uaugggaacacuggcaga

SEQ ID NO: 3477865 - RNA, 23 nt, Human
uaugggacucaaugcacugacau

SEQ ID NO: 3477866 - RNA, 18 nt, Human
uaugggacugagccuggc

SEQ ID NO: 3477867 - RNA, 16 nt, Human
uaugggagagugucaa

SEQ ID NO: 3477868 - RNA, 15 nt, Human
uaugggagccccagg

SEQ ID NO: 3477869 - RNA, 15 nt, Human
uaugggcaaaaaacu

SEQ ID NO: 3477870 - RNA, 23 nt, Human
uauggggaagguuaucagugcuu

SEQ ID NO: 3477871 - RNA, 22 nt, Human
uauggggagaaaagacaugaau

SEQ ID NO: 3477872 - RNA, 23 nt, Human
uauggggagaggaacuccuuggc

SEQ ID NO: 3477873 - RNA, 20 nt, Human
uauggggauagaugugugga

SEQ ID NO: 3477874 - RNA, 22 nt, Human
uaugggggccuggauucauuuc

SEQ ID NO: 3477875 - RNA, 19 nt, Human
uauggggguuguaaauugg

SEQ ID NO: 3477876 - RNA, 23 nt, Human
uauggggguuguaaauuggcaug

SEQ ID NO: 3477877 - RNA, 19 nt, Human
uauggguaggguaaaucag

SEQ ID NO: 3477878 - RNA, 14 nt, Human
uaugggucuaggac

SEQ ID NO: 3477879 - RNA, 18 nt, Human
uaugguaaucauauuaga

SEQ ID NO: 3477880 - RNA, 14 nt, Human
uaugguagaaaaau

SEQ ID NO: 3477881 - RNA, 13 nt, Human
uaugguauaaugg

SEQ ID NO: 3477882 - RNA, 17 nt, Human
uaugguauauauacaua

SEQ ID NO: 3477883 - RNA, 20 nt, Human
uauggucaucuuuuucucua

SEQ ID NO: 3477884 - RNA, 16 nt, Human
uauggucuaauguuua

SEQ ID NO: 3477885 - RNA, 23 nt, Human
uauggucuaauguuuaagcagaa

SEQ ID NO: 3477886 - RNA, 12 nt, Human
uauggugagaug

SEQ ID NO: 3477887 - RNA, 15 nt, Human
uauggugcucugucu

SEQ ID NO: 3477888 - RNA, 17 nt, Human
uaugguggauccaaacu

SEQ ID NO: 3477889 - RNA, 19 nt, Human
uaugguguuucucccucuc

SEQ ID NO: 3477890 - RNA, 22 nt, Human
uaugguuacuucuucucuuaga

SEQ ID NO: 3477891 - RNA, 13 nt, Human
uaugguuaugaaa

SEQ ID NO: 3477892 - RNA, 21 nt, Human
uauguaaaaggccaaaccucu

SEQ ID NO: 3477893 - RNA, 17 nt, Human
uauguaaaauaaaauua

SEQ ID NO: 3477894 - RNA, 14 nt, Human
uauguaaaauuuug

SEQ ID NO: 3477895 - RNA, 15 nt, Human
uauguaaacaggaga

SEQ ID NO: 3477896 - RNA, 18 nt, Human
uauguaaacauaauucuu

SEQ ID NO: 3477897 - RNA, 20 nt, Human
uauguaaaguauguaaacag

SEQ ID NO: 3477898 - RNA, 20 nt, Human
uauguaaauagguuucuaaa

SEQ ID NO: 3477899 - RNA, 12 nt, Human
uauguaaauccc

SEQ ID NO: 3477900 - RNA, 15 nt, Human
uauguaaaucccauu

SEQ ID NO: 3477901 - RNA, 13 nt, Human
uauguaaaugugc

SEQ ID NO: 3477902 - RNA, 15 nt, Human
uauguaaauuaugua

SEQ ID NO: 3477903 - RNA, 16 nt, Human
uauguaacaauuguuu

SEQ ID NO: 3477904 - RNA, 16 nt, Human
uauguaauaaugugaa

SEQ ID NO: 3477905 - RNA, 14 nt, Human
uauguacaaguguu

SEQ ID NO: 3477906 - RNA, 13 nt, Human
uauguacauuucu

SEQ ID NO: 3477907 - RNA, 16 nt, Human
uauguacauuucuaag

SEQ ID NO: 3477908 - RNA, 14 nt, Human
uauguaccaagaau

SEQ ID NO: 3477909 - RNA, 19 nt, Human
uauguacccucugaaauac

SEQ ID NO: 3477910 - RNA, 14 nt, Human
uauguaccucuuuu

SEQ ID NO: 3477911 - RNA, 20 nt, Human
uauguacuccucuuuacacu

SEQ ID NO: 3477912 - RNA, 15 nt, Human
uauguacuugucaaa

SEQ ID NO: 3477913 - RNA, 23 nt, Human
uauguagaaaaaaguaaauguga

SEQ ID NO: 3477914 - RNA, 17 nt, Human
uauguagauauuuggcu

SEQ ID NO: 3477915 - RNA, 20 nt, Human
uauguagauguaugcacaca

SEQ ID NO: 3477916 - RNA, 23 nt, Human
uauguagccuucacacagauaga

SEQ ID NO: 3477917 - RNA, 18 nt, Human
uauguaggaaaaaaauag

SEQ ID NO: 3477918 - RNA, 14 nt, Human
uauguaguaauuga

SEQ ID NO: 3477919 - RNA, 20 nt, Human
uauguaguaauugacaugug

SEQ ID NO: 3477920 - RNA, 18 nt, Human
uauguaguccgugcugac

SEQ ID NO: 3477921 - RNA, 12 nt, Human
uauguauaaaau

SEQ ID NO: 3477922 - RNA, 19 nt, Human
uauguauauuuuuuuaauu

SEQ ID NO: 3477923 - RNA, 14 nt, Human
uauguauguaaaaa

SEQ ID NO: 3477924 - RNA, 16 nt, Human
uauguaugugaaaguu

SEQ ID NO: 3477925 - RNA, 22 nt, Human
uauguauguguuuagaauugaa

SEQ ID NO: 3477926 - RNA, 22 nt, Human
uauguauguuuacacugucaaa

SEQ ID NO: 3477927 - RNA, 17 nt, Human
uauguauguuuacauau

SEQ ID NO: 3477928 - RNA, 22 nt, Human
uauguauuaauaaauagagcaa

SEQ ID NO: 3477929 - RNA, 17 nt, Human
uauguauuagugauauu

SEQ ID NO: 3477930 - RNA, 22 nt, Human
uauguauuagugauauuucucu

SEQ ID NO: 3477931 - RNA, 23 nt, Human
uauguauuagugauauuucucua

SEQ ID NO: 3477932 - RNA, 12 nt, Human
uauguauucuuu

SEQ ID NO: 3477933 - RNA, 12 nt, Human
uauguauuuaua

SEQ ID NO: 3477934 - RNA, 16 nt, Human
uaugucaagaggcuga

SEQ ID NO: 3477935 - RNA, 15 nt, Human
uaugucacuagaaug

SEQ ID NO: 3477936 - RNA, 15 nt, Human
uaugucaucauacau

SEQ ID NO: 3477937 - RNA, 13 nt, Human
uaugucauuucau

SEQ ID NO: 3477938 - RNA, 16 nt, Human
uaugucauuucauuuc

SEQ ID NO: 3477939 - RNA, 17 nt, Human
uauguccacuguguaua

SEQ ID NO: 3477940 - RNA, 20 nt, Human
uaugucccuucacauaguuu

SEQ ID NO: 3477941 - RNA, 13 nt, Human
uauguccuaagga

SEQ ID NO: 3477942 - RNA, 12 nt, Human
uaugucuauuua

SEQ ID NO: 3477943 - RNA, 13 nt, Human
uaugucuauuuaa

SEQ ID NO: 3477944 - RNA, 15 nt, Human
uaugucuauuuaagc

SEQ ID NO: 3477945 - RNA, 18 nt, Human
uaugucugguucucaauu

SEQ ID NO: 3477946 - RNA, 14 nt, Human
uaugucuguuuaag

SEQ ID NO: 3477947 - RNA, 16 nt, Human
uaugucuguuuaagaa

SEQ ID NO: 3477948 - RNA, 17 nt, Human
uaugucuuggacacugu

SEQ ID NO: 3477949 - RNA, 21 nt, Human
uaugucuuggacacuguacaa

SEQ ID NO: 3477950 - RNA, 23 nt, Human
uaugucuuuugaugaauagaagu

SEQ ID NO: 3477951 - RNA, 14 nt, Human
uaugugaaacaugu

SEQ ID NO: 3477952 - RNA, 14 nt, Human
uauuacaauauuug

SEQ ID NO: 3477953 - RNA, 15 nt, Human
uauuacaaugaucac

SEQ ID NO: 3477954 - RNA, 18 nt, Human
uauuacacauuuguacag

SEQ ID NO: 3477955 - RNA, 17 nt, Human
uauuacagauaaaaugu

SEQ ID NO: 3477956 - RNA, 14 nt, Human
uauuacaguauaau

SEQ ID NO: 3477957 - RNA, 18 nt, Human
uauuacaguauaauuaac

SEQ ID NO: 3477958 - RNA, 22 nt, Human
uauuacauaaaggcuaacuaug

SEQ ID NO: 3477959 - RNA, 13 nt, Human
uauuacauaaaua

SEQ ID NO: 3477960 - RNA, 17 nt, Human
uauuacauauaucauua

SEQ ID NO: 3477961 - RNA, 20 nt, Human
uauuacauguaauuugauga

SEQ ID NO: 3477962 - RNA, 17 nt, Human
uauuaccaaaagucaac

SEQ ID NO: 3477963 - RNA, 20 nt, Human
uauuaccacugaagauagaa

SEQ ID NO: 3477964 - RNA, 19 nt, Human
uauuaccagcaagaauaaa

SEQ ID NO: 3477965 - RNA, 21 nt, Human
uauuaccagcaagaauaaaaa

SEQ ID NO: 3477966 - RNA, 22 nt, Human
uauuacguaugucugguucuca

SEQ ID NO: 3477967 - RNA, 17 nt, Human
uauuacuaaauugaccu

SEQ ID NO: 3477968 - RNA, 22 nt, Human
uauuacuaaggaguaaucugug

SEQ ID NO: 3477969 - RNA, 21 nt, Human
uauuacuagaagaugaauaca

SEQ ID NO: 3477970 - RNA, 22 nt, Human
uauuacuaugacugcuccccag

SEQ ID NO: 3477971 - RNA, 16 nt, Human
uauuacugacauuucu

SEQ ID NO: 3477972 - RNA, 18 nt, Human
uauuacugacauuucuuc

SEQ ID NO: 3477973 - RNA, 21 nt, Human
uauuacuggcguggauuaaac

SEQ ID NO: 3477974 - RNA, 22 nt, Human
uauuacuggcguggauuaaacu

SEQ ID NO: 3477975 - RNA, 21 nt, Human
uauuacuguugauaauucuua

SEQ ID NO: 3477976 - RNA, 15 nt, Human
uauuacuguuuauua

SEQ ID NO: 3477977 - RNA, 21 nt, Human
uauuacuguuugucuucuccc

SEQ ID NO: 3477978 - RNA, 13 nt, Human
uauuacuuccaug

SEQ ID NO: 3477979 - RNA, 19 nt, Human
uauuacuuccaugaauuuu

SEQ ID NO: 3477980 - RNA, 22 nt, Human
uauuacuuguaaauauaaagac

SEQ ID NO: 3477981 - RNA, 14 nt, Human
uauuacuuuaacau

SEQ ID NO: 3477982 - RNA, 15 nt, Human
uauuacuuuaacaug

SEQ ID NO: 3477983 - RNA, 17 nt, Human
uauuacuuuaacaugcc

SEQ ID NO: 3477984 - RNA, 14 nt, Human
uauuagaaaacuuu

SEQ ID NO: 3477985 - RNA, 17 nt, Human
uauuagaaaacuuuguu

SEQ ID NO: 3477986 - RNA, 18 nt, Human
uauuagaaaacuuuguua

SEQ ID NO: 3477987 - RNA, 15 nt, Human
uauuagaaaggcucu

SEQ ID NO: 3477988 - RNA, 15 nt, Human
uauuagaauaccaca

SEQ ID NO: 3477989 - RNA, 22 nt, Human
uauuagaaucaaacauuuugaa

SEQ ID NO: 3477990 - RNA, 23 nt, Human
uauuagaaucaaacauuuugaaa

SEQ ID NO: 3477991 - RNA, 12 nt, Human
uauuagaugaau

SEQ ID NO: 3477992 - RNA, 14 nt, Human
uauuagaugaauua

SEQ ID NO: 3477993 - RNA, 14 nt, Human
uauuagaugugauu

SEQ ID NO: 3477994 - RNA, 16 nt, Human
uauuagaugugauuua

SEQ ID NO: 3477995 - RNA, 21 nt, Human
uauuagauguucucuaucauu

SEQ ID NO: 3477996 - RNA, 15 nt, Human
uauuagccacaaaau

SEQ ID NO: 3477997 - RNA, 13 nt, Human
uauuagccaggau

SEQ ID NO: 3477998 - RNA, 16 nt, Human
uauuagccagucuuua

SEQ ID NO: 3477999 - RNA, 17 nt, Human
uauuagcccugcauuuu

SEQ ID NO: 3478000 - RNA, 22 nt, Human
uauuagcccuucuccauggccc

SEQ ID NO: 3478001 - RNA, 23 nt, Human
uauuagcgacaacagauuggauu

SEQ ID NO: 3478002 - RNA, 19 nt, Human
uauuaggaaguguuuaugu

SEQ ID NO: 3478003 - RNA, 15 nt, Human
uauuagggagaaaau

SEQ ID NO: 3478004 - RNA, 18 nt, Human
uauuagggguaauauauu

SEQ ID NO: 3478005 - RNA, 17 nt, Human
uauuaggugcaauuuca

SEQ ID NO: 3478006 - RNA, 13 nt, Human
uauuaguauuguu

SEQ ID NO: 3478007 - RNA, 15 nt, Human
uauuaguauuguugu

SEQ ID NO: 3478008 - RNA, 17 nt, Human
uauuaguauuguugucc

SEQ ID NO: 3478009 - RNA, 18 nt, Human
uauuagucauagaagaac

SEQ ID NO: 3478010 - RNA, 21 nt, Human
uauuagucuuggggcaggaug

SEQ ID NO: 3478011 - RNA, 14 nt, Human
uauuagugauauuu

SEQ ID NO: 3478012 - RNA, 16 nt, Human
uauuaguguuauauga

SEQ ID NO: 3478013 - RNA, 23 nt, Human
uauuaguguuauaugaacauaca

SEQ ID NO: 3478014 - RNA, 13 nt, Human
uauuaguuaauau

SEQ ID NO: 3478015 - RNA, 19 nt, Human
uauuaguuaauggauuaaa

SEQ ID NO: 3478016 - RNA, 12 nt, Human
uauuaguugcuu

SEQ ID NO: 3478017 - RNA, 15 nt, Human
uauuaguuuugcaua

SEQ ID NO: 3478018 - RNA, 24 nt, Human
uauuauaaaaggggguccguggaa

SEQ ID NO: 3478019 - RNA, 19 nt, Human
uauuauaaacaagaaugaa

SEQ ID NO: 3478020 - RNA, 16 nt, Human
uauuauaacuuaaaaa

SEQ ID NO: 3478021 - RNA, 17 nt, Human
uauuauaagcauugaaa

SEQ ID NO: 3478022 - RNA, 21 nt, Human
uauuauaagcauugaaauuau

SEQ ID NO: 3478023 - RNA, 19 nt, Human
uauuauaagucuuacauaa

SEQ ID NO: 3478024 - RNA, 19 nt, Human
uauuauacaggaaagcaau

SEQ ID NO: 3478025 - RNA, 12 nt, Human
uauuauaccuuu

SEQ ID NO: 3478026 - RNA, 15 nt, Human
uauuauacuaagaaa

SEQ ID NO: 3478027 - RNA, 18 nt, Human
uauuauacuaagaaaaga

SEQ ID NO: 3478028 - RNA, 19 nt, Human
uauuauacuaagaaaagau

SEQ ID NO: 3478029 - RNA, 14 nt, Human
uauuauacuguauu

SEQ ID NO: 3478030 - RNA, 17 nt, Human
uauuauacuuguaauua

SEQ ID NO: 3478031 - RNA, 20 nt, Human
uauuauagagaguuaugaac

SEQ ID NO: 3478032 - RNA, 22 nt, Human
uauuauagagcagaaauucugu

SEQ ID NO: 3478033 - RNA, 12 nt, Human
uauuauauggaa

SEQ ID NO: 3478034 - RNA, 17 nt, Human
uauuauauguucuagaa

SEQ ID NO: 3478035 - RNA, 23 nt, Human
uauuauauucauucuuuuugaaa

SEQ ID NO: 3478036 - RNA, 12 nt, Human
uauuauauuugg

SEQ ID NO: 3478037 - RNA, 17 nt, Human
uauuauauuuggaugca

SEQ ID NO: 3478038 - RNA, 16 nt, Human
uauuaucaaguagacu

SEQ ID NO: 3478039 - RNA, 16 nt, Human
uauuaucaauguuuac

SEQ ID NO: 3478040 - RNA, 22 nt, Human
uauuaucaugcaaaugcuguau

SEQ ID NO: 3478041 - RNA, 13 nt, Human
uauuaucugucag

SEQ ID NO: 3478042 - RNA, 20 nt, Human
uauuaucuuguucaggaaaa

SEQ ID NO: 3478043 - RNA, 13 nt, Human
uauuaucuuugua

SEQ ID NO: 3478044 - RNA, 12 nt, Human
uauuaugaaacu

SEQ ID NO: 3478045 - RNA, 22 nt, Human
uauuaugaaacuuguguaaaua

SEQ ID NO: 3478046 - RNA, 14 nt, Human
uauuaugaauguga

SEQ ID NO: 3478047 - RNA, 20 nt, Human
uauuaugaaugugaagccuu

SEQ ID NO: 3478048 - RNA, 17 nt, Human
uauuaugagaugcuggc

SEQ ID NO: 3478049 - RNA, 24 nt, Human
uauuaugcccaguuucugccucug

SEQ ID NO: 3478050 - RNA, 13 nt, Human
uauuaugcuucuu

SEQ ID NO: 3478051 - RNA, 19 nt, Human
uauuaugcuuuauuggaaa

SEQ ID NO: 3478052 - RNA, 21 nt, Human
uauuauggaagauuuuaaauu

SEQ ID NO: 3478053 - RNA, 15 nt, Human
uauuauguaaauccc

SEQ ID NO: 3478054 - RNA, 17 nt, Human
uauuaugucucuucuga

SEQ ID NO: 3478055 - RNA, 16 nt, Human
uauuauguuaaaacug

SEQ ID NO: 3478056 - RNA, 17 nt, Human
uauuauuacuuguaaau

SEQ ID NO: 3478057 - RNA, 18 nt, Human
uauuauuacuuguaaaua

SEQ ID NO: 3478058 - RNA, 22 nt, Human
uauuauucaccauguaaaacaa

SEQ ID NO: 3478059 - RNA, 16 nt, Human
uauuauugaaauugua

SEQ ID NO: 3478060 - RNA, 16 nt, Human
uauuauugcuguugcu

SEQ ID NO: 3478061 - RNA, 19 nt, Human
uauuauugcuguugcuuga

SEQ ID NO: 3478062 - RNA, 21 nt, Human
uauuauugugguaggccuuuu

SEQ ID NO: 3478063 - RNA, 22 nt, Human
uauuauugugguaggccuuuua

SEQ ID NO: 3478064 - RNA, 12 nt, Human
uauuauuguucu

SEQ ID NO: 3478065 - RNA, 15 nt, Human
uauuauuuauuucug

SEQ ID NO: 3478066 - RNA, 19 nt, Human
uauuauuucuaggaagaau

SEQ ID NO: 3478067 - RNA, 22 nt, Human
uauuauuucuaggaagaauuuu

SEQ ID NO: 3478068 - RNA, 12 nt, Human
uauuauuucuau

SEQ ID NO: 3478069 - RNA, 20 nt, Human
uauuauuugcagugcaguau

SEQ ID NO: 3478070 - RNA, 23 nt, Human
uauuauuuggcaguuugguauuu

SEQ ID NO: 3478071 - RNA, 16 nt, Human
uauuauuuucaccugu

SEQ ID NO: 3478072 - RNA, 13 nt, Human
uauuauuuuccaa

SEQ ID NO: 3478073 - RNA, 18 nt, Human
uauuauuuuggggucucu

SEQ ID NO: 3478074 - RNA, 20 nt, Human
uauuauuuuuauaauuguac

SEQ ID NO: 3478075 - RNA, 17 nt, Human
uauuauuuuuuccacau

SEQ ID NO: 3478076 - RNA, 18 nt, Human
uauucaaaguugccuaaa

SEQ ID NO: 3478077 - RNA, 21 nt, Human
uauucaaaguugccuaaaucc

SEQ ID NO: 3478078 - RNA, 17 nt, Human
uauucaagaaagccagu

SEQ ID NO: 3478079 - RNA, 19 nt, Human
uauucaagaaagccagucu

SEQ ID NO: 3478080 - RNA, 20 nt, Human
uauucaagaaagccagucuu

SEQ ID NO: 3478081 - RNA, 22 nt, Human
uauucaagaaagccagucuuaa

SEQ ID NO: 3478082 - RNA, 19 nt, Human
uauucaagguaaaauucua

SEQ ID NO: 3478083 - RNA, 20 nt, Human
uauucaagguaaaauucuaa

SEQ ID NO: 3478084 - RNA, 11 nt, Human
uauucaauaaa

SEQ ID NO: 3478085 - RNA, 17 nt, Human
uauucaauaagagauua

SEQ ID NO: 3478086 - RNA, 16 nt, Human
uauucaauucuuuuaa

SEQ ID NO: 3478087 - RNA, 21 nt, Human
uauucacgugcagcagcaaca

SEQ ID NO: 3478088 - RNA, 21 nt, Human
uauucacugaaguucuccuga

SEQ ID NO: 3478089 - RNA, 13 nt, Human
uauucacugauuu

SEQ ID NO: 3478090 - RNA, 19 nt, Human
uauucacugauuugacaua

SEQ ID NO: 3478091 - RNA, 14 nt, Human
uauucacugggcca

SEQ ID NO: 3478092 - RNA, 16 nt, Human
uauucagaaucuuugu

SEQ ID NO: 3478093 - RNA, 22 nt, Human
uauucagacaagcaacagguuu

SEQ ID NO: 3478094 - RNA, 22 nt, Human
uauucagcaaggcgcuaacuug

SEQ ID NO: 3478095 - RNA, 23 nt, Human
uauucagcaccaagcauguccca

SEQ ID NO: 3478096 - RNA, 19 nt, Human
uauugccaaacauuaaugu

SEQ ID NO: 3478097 - RNA, 22 nt, Human
uauugccaaacauuaauguuga

SEQ ID NO: 3478098 - RNA, 22 nt, Human
uauugccaggaaaggagaguac

SEQ ID NO: 3478099 - RNA, 21 nt, Human
uauugcccaugauauaacuuu

SEQ ID NO: 3478100 - RNA, 13 nt, Human
uauugccucacuu

SEQ ID NO: 3478101 - RNA, 22 nt, Human
uauugccuucucaccagcugca

SEQ ID NO: 3478102 - RNA, 17 nt, Human
uauugccuuuuaauuuu

SEQ ID NO: 3478103 - RNA, 13 nt, Human
uauugcuacuucc

SEQ ID NO: 3478104 - RNA, 15 nt, Human
uauugcuagagcucc

SEQ ID NO: 3478105 - RNA, 19 nt, Human
uauugcugagagaaauaug

SEQ ID NO: 3478106 - RNA, 22 nt, Human
uauugcugauggugcaaugacc

SEQ ID NO: 3478107 - RNA, 15 nt, Human
uauugcuguugcuug

SEQ ID NO: 3478108 - RNA, 18 nt, Human
uauugcuuaguaaaauuu

SEQ ID NO: 3478109 - RNA, 21 nt, Human
uauugcuugauacuuuugaca

SEQ ID NO: 3478110 - RNA, 19 nt, Human
uauugcuuguuggauuuuu

SEQ ID NO: 3478111 - RNA, 15 nt, Human
uauuggaaaaaucac

SEQ ID NO: 3478112 - RNA, 18 nt, Human
uauuggaaauggaugcaa

SEQ ID NO: 3478113 - RNA, 19 nt, Human
uauuggaaauggaugcaaa

SEQ ID NO: 3478114 - RNA, 17 nt, Human
uauuggacaaagaaccu

SEQ ID NO: 3478115 - RNA, 19 nt, Human
uauuggccaaggaaaggca

SEQ ID NO: 3478116 - RNA, 22 nt, Human
uauuggccauaagcaacaauuu

SEQ ID NO: 3478117 - RNA, 12 nt, Human
uauuggccugga

SEQ ID NO: 3478118 - RNA, 14 nt, Human
uauuggccuggagg

SEQ ID NO: 3478119 - RNA, 14 nt, Human
uauuggcugggagu

SEQ ID NO: 3478120 - RNA, 14 nt, Human
uauuggcuuuucug

SEQ ID NO: 3478121 - RNA, 18 nt, Human
uauuggcuuuucugaucc

SEQ ID NO: 3478122 - RNA, 22 nt, Human
uauuggcuuuucugauccaguu

SEQ ID NO: 3478123 - RNA, 18 nt, Human
uauuggggccaugaguaa

SEQ ID NO: 3478124 - RNA, 16 nt, Human
uauuggguucauuauu

SEQ ID NO: 3478125 - RNA, 17 nt, Human
uauuggguuccauucuc

SEQ ID NO: 3478126 - RNA, 18 nt, Human
uauuguaaacauguguuu

SEQ ID NO: 3478127 - RNA, 16 nt, Human
uauuguaaauacaagu

SEQ ID NO: 3478128 - RNA, 15 nt, Human
uauuguaaauauugu

SEQ ID NO: 3478129 - RNA, 13 nt, Human
uauuguaaauuau

SEQ ID NO: 3478130 - RNA, 17 nt, Human
uauuguaagaaauacug

SEQ ID NO: 3478131 - RNA, 12 nt, Human
uauuguaagaua

SEQ ID NO: 3478132 - RNA, 16 nt, Human
uauuguacaaaguauu

SEQ ID NO: 3478133 - RNA, 15 nt, Human
uauuguacacuuuuu

SEQ ID NO: 3478134 - RNA, 20 nt, Human
uauuguacacuuuuuugggg

SEQ ID NO: 3478135 - RNA, 12 nt, Human
uauuguacaguu

SEQ ID NO: 3478136 - RNA, 11 nt, Human
uauuguacaua

SEQ ID NO: 3478137 - RNA, 13 nt, Human
uauuguacauaaa

SEQ ID NO: 3478138 - RNA, 15 nt, Human
uauuguacauaaaag

SEQ ID NO: 3478139 - RNA, 16 nt, Human
uauuguacauaaaaga

SEQ ID NO: 3478140 - RNA, 17 nt, Human
uauuguacauaaaagaa

SEQ ID NO: 3478141 - RNA, 16 nt, Human
uauuguacguuuaaag

SEQ ID NO: 3478142 - RNA, 18 nt, Human
uauuguagcauccuggaa

SEQ ID NO: 3478143 - RNA, 21 nt, Human
uauuguagcauccuggaauau

SEQ ID NO: 3478144 - RNA, 17 nt, Human
uauuguagcauuucuug

SEQ ID NO: 3478145 - RNA, 22 nt, Human
uauuguauaagauuagaaugaa

SEQ ID NO: 3478146 - RNA, 16 nt, Human
uauuguauuguuagau

SEQ ID NO: 3478147 - RNA, 17 nt, Human
uauuguauuguuagaug

SEQ ID NO: 3478148 - RNA, 18 nt, Human
uauuguauuuauuccaua

SEQ ID NO: 3478149 - RNA, 13 nt, Human
uauugucaaagug

SEQ ID NO: 3478150 - RNA, 17 nt, Human
uauuguccauuguccaa

SEQ ID NO: 3478151 - RNA, 20 nt, Human
uauugucccuggcuuccuua

SEQ ID NO: 3478152 - RNA, 17 nt, Human
uauuguccuauuagugu

SEQ ID NO: 3478153 - RNA, 18 nt, Human
uauuguccuauuaguguu

SEQ ID NO: 3478154 - RNA, 23 nt, Human
uauugucugaacuugcauuguga

SEQ ID NO: 3478155 - RNA, 15 nt, Human
uauugugaaguacau

SEQ ID NO: 3478156 - RNA, 19 nt, Human
uauugugaaguacauauua

SEQ ID NO: 3478157 - RNA, 13 nt, Human
uauugugaucuau

SEQ ID NO: 3478158 - RNA, 22 nt, Human
uauugugauuucccguggcccc

SEQ ID NO: 3478159 - RNA, 18 nt, Human
uauugugauuugacuguu

SEQ ID NO: 3478160 - RNA, 20 nt, Human
uauugugauuugacuguuuu

SEQ ID NO: 3478161 - RNA, 19 nt, Human
uauugugcaauguaaauau

SEQ ID NO: 3478162 - RNA, 23 nt, Human
uauugugcaauguguauaaacaa

SEQ ID NO: 3478163 - RNA, 15 nt, Human
uauugugcuguucua

SEQ ID NO: 3478164 - RNA, 18 nt, Human
uauuguggauaacaaaga

SEQ ID NO: 3478165 - RNA, 20 nt, Human
uauugugggacuuauuacaa

SEQ ID NO: 3478166 - RNA, 22 nt, Human
uauugugggacuuauuacaauu

SEQ ID NO: 3478167 - RNA, 13 nt, Human
uauugugguauug

SEQ ID NO: 3478168 - RNA, 14 nt, Human
uauuguguuccuuu

SEQ ID NO: 3478169 - RNA, 17 nt, Human
uauuguguugacuuuau

SEQ ID NO: 3478170 - RNA, 22 nt, Human
uauuguguugacuuuauaaauu

SEQ ID NO: 3478171 - RNA, 21 nt, Human
uauuguguuugucauuagccu

SEQ ID NO: 3478172 - RNA, 22 nt, Human
uauuguuacguagccuaaggcu

SEQ ID NO: 3478173 - RNA, 14 nt, Human
uauuguuacucuua

SEQ ID NO: 3478174 - RNA, 18 nt, Human
uauuguuacucuuacgaa

SEQ ID NO: 3478175 - RNA, 23 nt, Human
uauuguuccagcaguuuucaagu

SEQ ID NO: 3478176 - RNA, 13 nt, Human
uauuguucccagu

SEQ ID NO: 3478177 - RNA, 13 nt, Human
uauuguuccuaag

SEQ ID NO: 3478178 - RNA, 18 nt, Human
uauuguuccuaaguucuu

SEQ ID NO: 3478179 - RNA, 17 nt, Human
uauuguugaaaaaguuu

SEQ ID NO: 3478180 - RNA, 22 nt, Human
uauuguuguccuuuucauaggu

SEQ ID NO: 3478181 - RNA, 17 nt, Human
uauuguuuaaaaucauu

SEQ ID NO: 3478182 - RNA, 17 nt, Human
uauuguuuaaagcaacu

SEQ ID NO: 3478183 - RNA, 12 nt, Human
uauuguuucugc

SEQ ID NO: 3478184 - RNA, 16 nt, Human
uauuguuugguaaaug

SEQ ID NO: 3478185 - RNA, 17 nt, Human
uauuguuuuacaauagu

SEQ ID NO: 3478186 - RNA, 22 nt, Human
uauuguuuuacaauaguucugu

SEQ ID NO: 3478187 - RNA, 20 nt, Human
uauuguuuucaguguacaug

SEQ ID NO: 3478188 - RNA, 22 nt, Human
uauuguuuucaguguacaugga

SEQ ID NO: 3478189 - RNA, 20 nt, Human
uauuuaaaaaacuaaaaacu

SEQ ID NO: 3478190 - RNA, 13 nt, Human
uauuuaaaaacaa

SEQ ID NO: 3478191 - RNA, 13 nt, Human
uauuuaaaaauaa

SEQ ID NO: 3478192 - RNA, 15 nt, Human
uauuuaaaaauagaa

SEQ ID NO: 3478193 - RNA, 18 nt, Human
uauuuaaaaaugucuugc

SEQ ID NO: 3478194 - RNA, 15 nt, Human
uauuuaaaauagcaa

SEQ ID NO: 3478195 - RNA, 21 nt, Human
uauuuaaaccgcuaaaagaaa

SEQ ID NO: 3478196 - RNA, 12 nt, Human
uauuuaaacuau

SEQ ID NO: 3478197 - RNA, 17 nt, Human
uauuuaaacucaagaca

SEQ ID NO: 3478198 - RNA, 21 nt, Human
uauuuaaacuuauaaaucaua

SEQ ID NO: 3478199 - RNA, 17 nt, Human
uauuuaaagacaaagac

SEQ ID NO: 3478200 - RNA, 12 nt, Human
uauuuaaaggga

SEQ ID NO: 3478201 - RNA, 17 nt, Human
uauuuaaauagaugaca

SEQ ID NO: 3478202 - RNA, 12 nt, Human
uauuuaaauguc

SEQ ID NO: 3478203 - RNA, 19 nt, Human
uauuuaaaugucuaaugua

SEQ ID NO: 3478204 - RNA, 14 nt, Human
uauuuaaauuacaa

SEQ ID NO: 3478205 - RNA, 13 nt, Human
uauuuaaauucuu

SEQ ID NO: 3478206 - RNA, 14 nt, Human
uauuuaaauucuuu

SEQ ID NO: 3478207 - RNA, 15 nt, Human
uauuuaacaagaucu

SEQ ID NO: 3478208 - RNA, 23 nt, Human
uauuuaacagcugaauuaucuau

SEQ ID NO: 3478209 - RNA, 15 nt, Human
uauuuaacauuauuu

SEQ ID NO: 3478210 - RNA, 13 nt, Human
uauuuaacugacu

SEQ ID NO: 3478211 - RNA, 14 nt, Human
uauuuaacuugagg

SEQ ID NO: 3478212 - RNA, 14 nt, Human
uauuuaagacuaaa

SEQ ID NO: 3478213 - RNA, 16 nt, Human
uauuuaagaugugaaa

SEQ ID NO: 3478214 - RNA, 18 nt, Human
uauuuaagaugugaaaau

SEQ ID NO: 3478215 - RNA, 16 nt, Human
uauuuaagcaaauacu

SEQ ID NO: 3478216 - RNA, 18 nt, Human
uauuuaagccucauauuu

SEQ ID NO: 3478217 - RNA, 22 nt, Human
uauuuaaggagauguaagagcu

SEQ ID NO: 3478218 - RNA, 23 nt, Human
uauuuaaggagauguaagagcuu

SEQ ID NO: 3478219 - RNA, 21 nt, Human
uauuuaagguagcuucagcua

SEQ ID NO: 3478220 - RNA, 15 nt, Human
uauuuaaguauucaa

SEQ ID NO: 3478221 - RNA, 18 nt, Human
uauuuaaguauucaagaa

SEQ ID NO: 3478222 - RNA, 21 nt, Human
uauuuaaguauucaagaaagc

SEQ ID NO: 3478223 - RNA, 13 nt, Human
uauuuaauagcaa

SEQ ID NO: 3478224 - RNA, 14 nt, Human
uauuuaauagguuu

SEQ ID NO: 3478225 - RNA, 15 nt, Human
uauuuaauaugcuua

SEQ ID NO: 3478226 - RNA, 13 nt, Human
uauuuaaucuuuu

SEQ ID NO: 3478227 - RNA, 14 nt, Human
uauuuaaugcugug

SEQ ID NO: 3478228 - RNA, 18 nt, Human
uauuuaauguugaacaaa

SEQ ID NO: 3478229 - RNA, 23 nt, Human
uauuuaauguugaacaaaauaaa

SEQ ID NO: 3478230 - RNA, 20 nt, Human
uauuuaauguuuuaaaugua

SEQ ID NO: 3478231 - RNA, 22 nt, Human
uauuuaauguuuuaaauguaca

SEQ ID NO: 3478232 - RNA, 17 nt, Human
uauuuaauuagugcuaa

SEQ ID NO: 3478233 - RNA, 18 nt, Human
uauuuaauuagugcuaag

SEQ ID NO: 3478234 - RNA, 19 nt, Human
uauuuaauuagugcuaagu

SEQ ID NO: 3478235 - RNA, 20 nt, Human
uauuuaauuguaaacuguac

SEQ ID NO: 3478236 - RNA, 13 nt, Human
uauuuaauuugaa

SEQ ID NO: 3478237 - RNA, 14 nt, Human
uauuuacaaauguu

SEQ ID NO: 3478238 - RNA, 15 nt, Human
uauuuacaagaagaa

SEQ ID NO: 3478239 - RNA, 22 nt, Human
uauuuacagugaaaauguaagc

SEQ ID NO: 3478240 - RNA, 14 nt, Human
uauuuacauaugaa

SEQ ID NO: 3478241 - RNA, 16 nt, Human
uauuugcaacauuuac

SEQ ID NO: 3478242 - RNA, 23 nt, Human
uauuugcagucauggagaaccac

SEQ ID NO: 3478243 - RNA, 15 nt, Human
uauuugcauauguau

SEQ ID NO: 3478244 - RNA, 15 nt, Human
uauuugcauguuaug

SEQ ID NO: 3478245 - RNA, 16 nt, Human
uauuugccaugggcuu

SEQ ID NO: 3478246 - RNA, 11 nt, Human
uauuugcuuuu

SEQ ID NO: 3478247 - RNA, 15 nt, Human
uauuuggauaucugu

SEQ ID NO: 3478248 - RNA, 15 nt, Human
uauuuggaugcagag

SEQ ID NO: 3478249 - RNA, 21 nt, Human
uauuuggcaguuugguauuug

SEQ ID NO: 3478250 - RNA, 14 nt, Human
uauuugggaaguga

SEQ ID NO: 3478251 - RNA, 21 nt, Human
uauuugggguugcaucagaaa

SEQ ID NO: 3478252 - RNA, 22 nt, Human
uauuuggugauuacauuuuaaa

SEQ ID NO: 3478253 - RNA, 23 nt, Human
uauuuguaaaagaacaguaaaca

SEQ ID NO: 3478254 - RNA, 16 nt, Human
uauuuguaaaaugaca

SEQ ID NO: 3478255 - RNA, 13 nt, Human
uauuuguaaaucu

SEQ ID NO: 3478256 - RNA, 17 nt, Human
uauuuguaaaucugcca

SEQ ID NO: 3478257 - RNA, 20 nt, Human
uauuuguaaauuuaguguuu

SEQ ID NO: 3478258 - RNA, 12 nt, Human
uauuuguaagau

SEQ ID NO: 3478259 - RNA, 20 nt, Human
uauuuguaauagauguuuga

SEQ ID NO: 3478260 - RNA, 13 nt, Human
uauuuguaauuaa

SEQ ID NO: 3478261 - RNA, 14 nt, Human
uauuuguaauuaaa

SEQ ID NO: 3478262 - RNA, 15 nt, Human
uauuuguaauuaaaa

SEQ ID NO: 3478263 - RNA, 12 nt, Human
uauuuguacaaa

SEQ ID NO: 3478264 - RNA, 22 nt, Human
uauuuguaggggaacucauuug

SEQ ID NO: 3478265 - RNA, 20 nt, Human
uauuugucaugcugggauuu

SEQ ID NO: 3478266 - RNA, 14 nt, Human
uauuugucucagau

SEQ ID NO: 3478267 - RNA, 15 nt, Human
uauuugucuuucagg

SEQ ID NO: 3478268 - RNA, 20 nt, Human
uauuugugacuaauuguaua

SEQ ID NO: 3478269 - RNA, 21 nt, Human
uauuugugacuaauuguauaa

SEQ ID NO: 3478270 - RNA, 22 nt, Human
uauuugugacuaauuguauaac

SEQ ID NO: 3478271 - RNA, 15 nt, Human
uauuugugagacugu

SEQ ID NO: 3478272 - RNA, 18 nt, Human
uauuugugaugacaacug

SEQ ID NO: 3478273 - RNA, 18 nt, Human
uauuugugcuauaguauu

SEQ ID NO: 3478274 - RNA, 13 nt, Human
uauuuguguauuu

SEQ ID NO: 3478275 - RNA, 12 nt, Human
uauuugugugcu

SEQ ID NO: 3478276 - RNA, 18 nt, Human
uauuugugugcuaaacgu

SEQ ID NO: 3478277 - RNA, 22 nt, Human
uauuuguguguucacuaaacuc

SEQ ID NO: 3478278 - RNA, 17 nt, Human
uauuuguuaaauauuua

SEQ ID NO: 3478279 - RNA, 19 nt, Human
uauuuguuaauaguuccug

SEQ ID NO: 3478280 - RNA, 22 nt, Human
uauuuguuaaugguuugaauau

SEQ ID NO: 3478281 - RNA, 18 nt, Human
uauuuguuauuuucagua

SEQ ID NO: 3478282 - RNA, 15 nt, Human
uauuuguuugcauag

SEQ ID NO: 3478283 - RNA, 14 nt, Human
uauuuuaaaagcca

SEQ ID NO: 3478284 - RNA, 16 nt, Human
uauuuuaaaauaaacu

SEQ ID NO: 3478285 - RNA, 23 nt, Human
uauuuuaaaauagcguucuugua

SEQ ID NO: 3478286 - RNA, 13 nt, Human
uauuuuaaaauuu

SEQ ID NO: 3478287 - RNA, 22 nt, Human
uauuuuaaauuauaaggacugc

SEQ ID NO: 3478288 - RNA, 18 nt, Human
uauuuuaaccugcauaaa

SEQ ID NO: 3478289 - RNA, 14 nt, Human
uauuuuaagacgaa

SEQ ID NO: 3478290 - RNA, 19 nt, Human
uauuuuaagcacucuuaaa

SEQ ID NO: 3478291 - RNA, 19 nt, Human
uauuuuaagcauuacucuu

SEQ ID NO: 3478292 - RNA, 22 nt, Human
uauuuuaagcauuacucuugua

SEQ ID NO: 3478293 - RNA, 14 nt, Human
uauuuuaaguauug

SEQ ID NO: 3478294 - RNA, 16 nt, Human
uauuuuaaucucagaa

SEQ ID NO: 3478295 - RNA, 13 nt, Human
uauuuuaauguga

SEQ ID NO: 3478296 - RNA, 14 nt, Human
uauuuuaaugugau

SEQ ID NO: 3478297 - RNA, 21 nt, Human
uauuuuaaugugaugauguaa

SEQ ID NO: 3478298 - RNA, 19 nt, Human
uauuuuaauuagguuaacu

SEQ ID NO: 3478299 - RNA, 17 nt, Human
uauuuuacacagaaaca

SEQ ID NO: 3478300 - RNA, 23 nt, Human
uauuuuacacagaaacacugccu

SEQ ID NO: 3478301 - RNA, 18 nt, Human
uauuuuaccacugcugug

SEQ ID NO: 3478302 - RNA, 13 nt, Human
uauuuuaccauac

SEQ ID NO: 3478303 - RNA, 16 nt, Human
uauuuuacuacugugg

SEQ ID NO: 3478304 - RNA, 17 nt, Human
uauuuuacuauuggaau

SEQ ID NO: 3478305 - RNA, 15 nt, Human
uauuuuacugucuua

SEQ ID NO: 3478306 - RNA, 16 nt, Human
uauuuuacugucuuaa

SEQ ID NO: 3478307 - RNA, 17 nt, Human
uauuuuacugucuuaau

SEQ ID NO: 3478308 - RNA, 18 nt, Human
uauuuuacuucuagagau

SEQ ID NO: 3478309 - RNA, 21 nt, Human
uauuuuacuuggaaauauuaa

SEQ ID NO: 3478310 - RNA, 21 nt, Human
uauuuuagacaaaucuaaggg

SEQ ID NO: 3478311 - RNA, 18 nt, Human
uauuuuaggcagggauuu

SEQ ID NO: 3478312 - RNA, 21 nt, Human
uauuuuaguggacccugaaau

SEQ ID NO: 3478313 - RNA, 16 nt, Human
uauuuuaguuucuguu

SEQ ID NO: 3478314 - RNA, 21 nt, Human
uauuuuaguuucuguucugug

SEQ ID NO: 3478315 - RNA, 21 nt, Human
uauuuuauaaaauuaaagaaa

SEQ ID NO: 3478316 - RNA, 14 nt, Human
uauuuuauaagaaa

SEQ ID NO: 3478317 - RNA, 16 nt, Human
uauuuuauacauuaac

SEQ ID NO: 3478318 - RNA, 23 nt, Human
uauuuuauacucauggaagagau

SEQ ID NO: 3478319 - RNA, 20 nt, Human
uauuuuauauaauaaaguau

SEQ ID NO: 3478320 - RNA, 12 nt, Human
uauuuuaugaga

SEQ ID NO: 3478321 - RNA, 17 nt, Human
uauuuuaugagaaaugu

SEQ ID NO: 3478322 - RNA, 13 nt, Human
uauuuuaugguua

SEQ ID NO: 3478323 - RNA, 16 nt, Human
uauuuuaugguuaugu

SEQ ID NO: 3478324 - RNA, 13 nt, Human
uauuuuauguuua

SEQ ID NO: 3478325 - RNA, 20 nt, Human
uauuuuauuauccuagauua

SEQ ID NO: 3478326 - RNA, 18 nt, Human
uauuuuauuaugaaacuu

SEQ ID NO: 3478327 - RNA, 16 nt, Human
uauuuuauucaaggua

SEQ ID NO: 3478328 - RNA, 13 nt, Human
uauuuuauucccu

SEQ ID NO: 3478329 - RNA, 18 nt, Human
uauuuuauuguaacagac

SEQ ID NO: 3478330 - RNA, 20 nt, Human
uauuuuauuuagacaagaga

SEQ ID NO: 3478331 - RNA, 20 nt, Human
uauuuuauuuuuagaauuuu

SEQ ID NO: 3478332 - RNA, 14 nt, Human
uauuuucaaaacca

SEQ ID NO: 3478333 - RNA, 16 nt, Human
uauuuucaaaaccagg

SEQ ID NO: 3478334 - RNA, 17 nt, Human
uauuuucaaaaccaggu

SEQ ID NO: 3478335 - RNA, 18 nt, Human
uauuuucaauagccacua

SEQ ID NO: 3478336 - RNA, 22 nt, Human
uauuuucaauucaaaaauguac

SEQ ID NO: 3478337 - RNA, 14 nt, Human
uauuuucaccauuu

SEQ ID NO: 3478338 - RNA, 12 nt, Human
uauuuucagaau

SEQ ID NO: 3478339 - RNA, 14 nt, Human
uauuuucagaaucu

SEQ ID NO: 3478340 - RNA, 21 nt, Human
uauuuucagaaucugaaugua

SEQ ID NO: 3478341 - RNA, 14 nt, Human
uauuuucaugaaaa

SEQ ID NO: 3478342 - RNA, 20 nt, Human
uauuuucaugaaaauaccau

SEQ ID NO: 3478343 - RNA, 17 nt, Human
uauuuucauuacaaugg

SEQ ID NO: 3478344 - RNA, 14 nt, Human
uauuuucauucaaa

SEQ ID NO: 3478345 - RNA, 11 nt, Human
uauuuuccagg

SEQ ID NO: 3478346 - RNA, 23 nt, Human
uauuuucccaauagcacuuucau

SEQ ID NO: 3478347 - RNA, 18 nt, Human
uauuuucccccuuuucug

SEQ ID NO: 3478348 - RNA, 16 nt, Human
uauuuuccccuaucau

SEQ ID NO: 3478349 - RNA, 18 nt, Human
uauuuuccugauagcaua

SEQ ID NO: 3478350 - RNA, 14 nt, Human
uauuuuccuguaaa

SEQ ID NO: 3478351 - RNA, 17 nt, Human
uauuuucguaugaaaau

SEQ ID NO: 3478352 - RNA, 14 nt, Human
uauuuucuaaagua

SEQ ID NO: 3478353 - RNA, 14 nt, Human
uauuuucuacagug

SEQ ID NO: 3478354 - RNA, 15 nt, Human
uauuuucuacagugg

SEQ ID NO: 3478355 - RNA, 20 nt, Human
uauuuucuacguuucuuuaa

SEQ ID NO: 3478356 - RNA, 12 nt, Human
uauuuucuguca

SEQ ID NO: 3478357 - RNA, 13 nt, Human
uauuuucugucag

SEQ ID NO: 3478358 - RNA, 17 nt, Human
uauuuucugucagauga

SEQ ID NO: 3478359 - RNA, 20 nt, Human
uauuuucugucagaugagaa

SEQ ID NO: 3478360 - RNA, 22 nt, Human
uauuuucugucagaugagaaca

SEQ ID NO: 3478361 - RNA, 12 nt, Human
uauuuucugugu

SEQ ID NO: 3478362 - RNA, 19 nt, Human
uauuuucuguguguuccug

SEQ ID NO: 3478363 - RNA, 20 nt, Human
uauuuucuguguguuccugg

SEQ ID NO: 3478364 - RNA, 12 nt, Human
uauuuucuucau

SEQ ID NO: 3478365 - RNA, 12 nt, Human
uauuuucuuucu

SEQ ID NO: 3478366 - RNA, 14 nt, Human
uauuuucuuugaaa

SEQ ID NO: 3478367 - RNA, 16 nt, Human
uauuuucuuuuguaaa

SEQ ID NO: 3478368 - RNA, 16 nt, Human
uauuuugaaaagcuuc

SEQ ID NO: 3478369 - RNA, 14 nt, Human
uauuuugaaguuua

SEQ ID NO: 3478370 - RNA, 19 nt, Human
uauuuugaaguuuacauuu

SEQ ID NO: 3478371 - RNA, 22 nt, Human
uauuuugaaguuuacauuuuua

SEQ ID NO: 3478372 - RNA, 12 nt, Human
uauuuugaauca

SEQ ID NO: 3478373 - RNA, 22 nt, Human
uauuuugaaucaauaauauauu

SEQ ID NO: 3478374 - RNA, 14 nt, Human
uauuuugacuuguu

SEQ ID NO: 3478375 - RNA, 20 nt, Human
uauuuugacuuguugagggu

SEQ ID NO: 3478376 - RNA, 18 nt, Human
uauuuugauaauaaauug

SEQ ID NO: 3478377 - RNA, 14 nt, Human
uauuuugaucuuca

SEQ ID NO: 3478378 - RNA, 16 nt, Human
uauuuugaucuucaac

SEQ ID NO: 3478379 - RNA, 13 nt, Human
uauuuugaugcag

SEQ ID NO: 3478380 - RNA, 15 nt, Human
uauuuugaugcagca

SEQ ID NO: 3478381 - RNA, 19 nt, Human
uauuuugaugcagcauuug

SEQ ID NO: 3478382 - RNA, 22 nt, Human
uauuuugccaagggcauaaauu

SEQ ID NO: 3478383 - RNA, 13 nt, Human
uauuuugcuuugu

SEQ ID NO: 3478384 - RNA, 14 nt, Human
uauuuuggaaaguu

SEQ ID NO: 3478385 - RNA, 15 nt, Human
uauuuuggaaaguuu

SEQ ID NO: 3478386 - RNA, 20 nt, Human
uauuuuggauuguauauugu

SEQ ID NO: 3478387 - RNA, 18 nt, Human
aaguauccugcuucugau

SEQ ID NO: 3478388 - RNA, 17 nt, Human
aaguaucuacaugcggu

SEQ ID NO: 3478389 - RNA, 15 nt, Human
aaguaucugacaucu

SEQ ID NO: 3478390 - RNA, 21 nt, Human
aaguaugcauuauuaaauugu

SEQ ID NO: 3478391 - RNA, 22 nt, Human
aaguaugcauuauuaaauugua

SEQ ID NO: 3478392 - RNA, 21 nt, Human
aaguauguaaacaggagacag

SEQ ID NO: 3478393 - RNA, 12 nt, Human
aaguauguaaag

SEQ ID NO: 3478394 - RNA, 18 nt, Human
aaguaugugagugugucc

SEQ ID NO: 3478395 - RNA, 18 nt, Human
aaguauguuagugcaaau

SEQ ID NO: 3478396 - RNA, 19 nt, Human
aaguauguuagugcaaauu

SEQ ID NO: 3478397 - RNA, 13 nt, Human
aaguauguucuaa

SEQ ID NO: 3478398 - RNA, 16 nt, Human
aaguauguuuuagcau

SEQ ID NO: 3478399 - RNA, 17 nt, Human
aaguauuaaaacauugg

SEQ ID NO: 3478400 - RNA, 13 nt, Human
aaguauuaagcau

SEQ ID NO: 3478401 - RNA, 14 nt, Human
aaguauuaagcaua

SEQ ID NO: 3478402 - RNA, 17 nt, Human
aaguauuaagcauauau

SEQ ID NO: 3478403 - RNA, 13 nt, Human
aaguauuauaaau

SEQ ID NO: 3478404 - RNA, 15 nt, Human
aaguauuauaccuuu

SEQ ID NO: 3478405 - RNA, 16 nt, Human
aaguauuauaccuuuu

SEQ ID NO: 3478406 - RNA, 19 nt, Human
aaguauuauaccuuuuuua

SEQ ID NO: 3478407 - RNA, 12 nt, Human
aaguauuauuag

SEQ ID NO: 3478408 - RNA, 20 nt, Human
aaguauuccaccuuaaauua

SEQ ID NO: 3478409 - RNA, 18 nt, Human
aaguauucugccuuugca

SEQ ID NO: 3478410 - RNA, 18 nt, Human
aaguauucuuauuuaaug

SEQ ID NO: 3478411 - RNA, 19 nt, Human
aaguauucuuauuuaauga

SEQ ID NO: 3478412 - RNA, 13 nt, Human
aaguauugccaaa

SEQ ID NO: 3478413 - RNA, 21 nt, Human
aaguauugcugaguccaacaa

SEQ ID NO: 3478414 - RNA, 14 nt, Human
aaguauuguaaauu

SEQ ID NO: 3478415 - RNA, 20 nt, Human
aaguauuguaaauuauauuu

SEQ ID NO: 3478416 - RNA, 20 nt, Human
aaguauuuaauuagugcuaa

SEQ ID NO: 3478417 - RNA, 21 nt, Human
aaguauuuaauuagugcuaag

SEQ ID NO: 3478418 - RNA, 22 nt, Human
aaguauuuaauuagugcuaagu

SEQ ID NO: 3478419 - RNA, 23 nt, Human
aaguauuuaauuagugcuaagug

SEQ ID NO: 3478420 - RNA, 21 nt, Human
aaguauuucaaauuggagcuu

SEQ ID NO: 3478421 - RNA, 17 nt, Human
aaguauuuucauaagua

SEQ ID NO: 3478422 - RNA, 11 nt, Human
aaguauuuucu

SEQ ID NO: 3478423 - RNA, 23 nt, Human
aaguauuuugaaguuuacauuuu

SEQ ID NO: 3478424 - RNA, 18 nt, Human
aaguauuuuguguuugga

SEQ ID NO: 3478425 - RNA, 16 nt, Human
aaguauuuuuucagua

SEQ ID NO: 3478426 - RNA, 22 nt, Human
aagucaaaauauuuuuaaaaga

SEQ ID NO: 3478427 - RNA, 19 nt, Human
aagucaacaguaaaccacu

SEQ ID NO: 3478428 - RNA, 22 nt, Human
aagucaaccaauguagaaagcu

SEQ ID NO: 3478429 - RNA, 15 nt, Human
aagucaacuuagcau

SEQ ID NO: 3478430 - RNA, 20 nt, Human
aagucaauauguggaagcaa

SEQ ID NO: 3478431 - RNA, 17 nt, Human
aagucaaucauuucuca

SEQ ID NO: 3478432 - RNA, 22 nt, Human
aagucaaucauuucucacugug

SEQ ID NO: 3478433 - RNA, 17 nt, Human
aagucaauguuuucagu

SEQ ID NO: 3478434 - RNA, 21 nt, Human
aagucacacauuacaaaguua

SEQ ID NO: 3478435 - RNA, 14 nt, Human
aagucacagggcag

SEQ ID NO: 3478436 - RNA, 13 nt, Human
aagucacaguuaa

SEQ ID NO: 3478437 - RNA, 16 nt, Human
aagucacaguuaagga

SEQ ID NO: 3478438 - RNA, 16 nt, Human
aagucacccggccccc

SEQ ID NO: 3478439 - RNA, 20 nt, Human
aagucacccuagcccucucc

SEQ ID NO: 3478440 - RNA, 19 nt, Human
aagucacugcaaaaccagg

SEQ ID NO: 3478441 - RNA, 20 nt, Human
aagucagaaacuaaaacaaa

SEQ ID NO: 3478442 - RNA, 16 nt, Human
aagucagaaucagaag

SEQ ID NO: 3478443 - RNA, 16 nt, Human
aagucagacugcuggg

SEQ ID NO: 3478444 - RNA, 20 nt, Human
aagucagacugcugggacug

SEQ ID NO: 3478445 - RNA, 12 nt, Human
aagucagaggau

SEQ ID NO: 3478446 - RNA, 13 nt, Human
aagucagaugugg

SEQ ID NO: 3478447 - RNA, 13 nt, Human
aagucagauguuu

SEQ ID NO: 3478448 - RNA, 16 nt, Human
aagucagguccaauuu

SEQ ID NO: 3478449 - RNA, 20 nt, Human
aagucagugcccaacuguua

SEQ ID NO: 3478450 - RNA, 18 nt, Human
aagucagugggaacguga

SEQ ID NO: 3478451 - RNA, 15 nt, Human
aagucaguguugaga

SEQ ID NO: 3478452 - RNA, 16 nt, Human
aagucaguguugagau

SEQ ID NO: 3478453 - RNA, 22 nt, Human
aagucaguugcucaaaaagaaa

SEQ ID NO: 3478454 - RNA, 14 nt, Human
aagucauaauugca

SEQ ID NO: 3478455 - RNA, 13 nt, Human
aagucaucuugcu

SEQ ID NO: 3478456 - RNA, 14 nt, Human
aagucaucuugcua

SEQ ID NO: 3478457 - RNA, 15 nt, Human
aagucaugaagccca

SEQ ID NO: 3478458 - RNA, 19 nt, Human
aagucaugcaaaggcuggg

SEQ ID NO: 3478459 - RNA, 20 nt, Human
aagucaugcaaaggcuggga

SEQ ID NO: 3478460 - RNA, 20 nt, Human
aagucaugcguuuaaucaca

SEQ ID NO: 3478461 - RNA, 20 nt, Human
aagucauggcagguacagua

SEQ ID NO: 3478462 - RNA, 17 nt, Human
aagucauguaaauacug

SEQ ID NO: 3478463 - RNA, 19 nt, Human
aagucauguauguuucucu

SEQ ID NO: 3478464 - RNA, 15 nt, Human
aagucaugugcauuu

SEQ ID NO: 3478465 - RNA, 12 nt, Human
aagucauguucc

SEQ ID NO: 3478466 - RNA, 13 nt, Human
aagucauuaaacu

SEQ ID NO: 3478467 - RNA, 18 nt, Human
aagucauuuuaacuuuau

SEQ ID NO: 3478468 - RNA, 22 nt, Human
aagucauuuuaacuuuaucaca

SEQ ID NO: 3478469 - RNA, 12 nt, Human
aaguccaaugug

SEQ ID NO: 3478470 - RNA, 20 nt, Human
aagugcuaagguucuaaggc

SEQ ID NO: 3478471 - RNA, 21 nt, Human
aagugcuaagguucuaaggcc

SEQ ID NO: 3478472 - RNA, 17 nt, Human
aagugcucaucuguugu

SEQ ID NO: 3478473 - RNA, 15 nt, Human
aagugcugcacucaa

SEQ ID NO: 3478474 - RNA, 19 nt, Human
aagugcuggagucuccuga

SEQ ID NO: 3478475 - RNA, 22 nt, Human
aagugcuggcaaccacuaagaa

SEQ ID NO: 3478476 - RNA, 19 nt, Human
aagugcuguauaaaaucag

SEQ ID NO: 3478477 - RNA, 22 nt, Human
aagugcuguauaaaaucagcca

SEQ ID NO: 3478478 - RNA, 23 nt, Human
aagugcuuggaacauacuguuca

SEQ ID NO: 3478479 - RNA, 14 nt, Human
aagugcuuguguaa

SEQ ID NO: 3478480 - RNA, 19 nt, Human
aaguggaaaaauagccugc

SEQ ID NO: 3478481 - RNA, 12 nt, Human
aaguggaaggaa

SEQ ID NO: 3478482 - RNA, 15 nt, Human
aaguggaaggaaaga

SEQ ID NO: 3478483 - RNA, 21 nt, Human
aaguggaauuucuuguuucuc

SEQ ID NO: 3478484 - RNA, 18 nt, Human
aaguggacaaauuuugag

SEQ ID NO: 3478485 - RNA, 17 nt, Human
aaguggacucagggcag

SEQ ID NO: 3478486 - RNA, 16 nt, Human
aaguggaggcacuuua

SEQ ID NO: 3478487 - RNA, 22 nt, Human
aaguggcaaagcuguucuuccu

SEQ ID NO: 3478488 - RNA, 17 nt, Human
aaguggcaugugcugug

SEQ ID NO: 3478489 - RNA, 18 nt, Human
aaguggcaugugcuguga

SEQ ID NO: 3478490 - RNA, 14 nt, Human
aaguggcauguuuu

SEQ ID NO: 3478491 - RNA, 13 nt, Human
aaguggccucuuu

SEQ ID NO: 3478492 - RNA, 19 nt, Human
aagugggcccacccggugg

SEQ ID NO: 3478493 - RNA, 12 nt, Human
aagugggcuuga

SEQ ID NO: 3478494 - RNA, 15 nt, Human
aaguggggacagagc

SEQ ID NO: 3478495 - RNA, 23 nt, Human
aaguggggcgggcuucauagaga

SEQ ID NO: 3478496 - RNA, 19 nt, Human
aagugggggcagagggcag

SEQ ID NO: 3478497 - RNA, 18 nt, Human
aaguggggugcugggagg

SEQ ID NO: 3478498 - RNA, 19 nt, Human
aaguggguacccccaggac

SEQ ID NO: 3478499 - RNA, 14 nt, Human
aagugggugagaug

SEQ ID NO: 3478500 - RNA, 17 nt, Human
aaguggguuuuuuaguu

SEQ ID NO: 3478501 - RNA, 13 nt, Human
aagugguauagaa

SEQ ID NO: 3478502 - RNA, 22 nt, Human
aagugguccuagaggcccuuug

SEQ ID NO: 3478503 - RNA, 15 nt, Human
aaguggugcucaguu

SEQ ID NO: 3478504 - RNA, 11 nt, Human
aaguguaaagc

SEQ ID NO: 3478505 - RNA, 16 nt, Human
aaguguaaagcauucc

SEQ ID NO: 3478506 - RNA, 17 nt, Human
aaguguaaagcauucca

SEQ ID NO: 3478507 - RNA, 22 nt, Human
aaguguaaagcauuccaacaaa

SEQ ID NO: 3478508 - RNA, 15 nt, Human
aaguguaacagcuga

SEQ ID NO: 3478509 - RNA, 16 nt, Human
aaguguaacagcugag

SEQ ID NO: 3478510 - RNA, 21 nt, Human
aaguguaacauaugcaaacau

SEQ ID NO: 3478511 - RNA, 16 nt, Human
aaguguaauaauauga

SEQ ID NO: 3478512 - RNA, 16 nt, Human
aaguguaauagauuau

SEQ ID NO: 3478513 - RNA, 14 nt, Human
aaguguacauaugu

SEQ ID NO: 3478514 - RNA, 14 nt, Human
aaguguacuaauua

SEQ ID NO: 3478515 - RNA, 17 nt, Human
aaguguaggcagacaca

SEQ ID NO: 3478516 - RNA, 14 nt, Human
aaguguauaauaua

SEQ ID NO: 3478517 - RNA, 18 nt, Human
aaguguaugcacgugugc

SEQ ID NO: 3478518 - RNA, 21 nt, Human
aaguguauuuggaaauaaagu

SEQ ID NO: 3478519 - RNA, 19 nt, Human
aaguguauuuuauaaaauu

SEQ ID NO: 3478520 - RNA, 21 nt, Human
aaguguauuuuuuuacuaaua

SEQ ID NO: 3478521 - RNA, 16 nt, Human
aagugucaacucuuug

SEQ ID NO: 3478522 - RNA, 16 nt, Human
aagugucaccuuuucu

SEQ ID NO: 3478523 - RNA, 21 nt, Human
aaguguccauugacauguaca

SEQ ID NO: 3478524 - RNA, 22 nt, Human
aaguguccauugacauguacag

SEQ ID NO: 3478525 - RNA, 23 nt, Human
aaguguccauugacauguacaga

SEQ ID NO: 3478526 - RNA, 17 nt, Human
aaguguccgagaacuaa

SEQ ID NO: 3478527 - RNA, 21 nt, Human
aagugucucacuaaagcauga

SEQ ID NO: 3478528 - RNA, 16 nt, Human
aagugucucugccuug

SEQ ID NO: 3478529 - RNA, 17 nt, Human
aagugugaacaaaagau

SEQ ID NO: 3478530 - RNA, 13 nt, Human
aagugugaacugg

SEQ ID NO: 3478531 - RNA, 13 nt, Human
aagugugagcaaa

SEQ ID NO: 3478532 - RNA, 15 nt, Human
aagugugagcaguga

SEQ ID NO: 3478533 - RNA, 20 nt, Human
aagugugauugggaauaaau

SEQ ID NO: 3478534 - RNA, 21 nt, Human
aagugugcuuuaugcugaaac

SEQ ID NO: 3478535 - RNA, 10 nt, Human
aagugugggu

SEQ ID NO: 3478536 - RNA, 13 nt, Human
aagugugguagag

SEQ ID NO: 3478537 - RNA, 12 nt, Human
aaguguguaugu

SEQ ID NO: 3478538 - RNA, 13 nt, Human
aaguguguauuaa

SEQ ID NO: 3478539 - RNA, 15 nt, Human
aaguguguauuaaaa

SEQ ID NO: 3478540 - RNA, 23 nt, Human
aaguguguggucccaaguuggaa

SEQ ID NO: 3478541 - RNA, 13 nt, Human
aagugugugugcg

SEQ ID NO: 3478542 - RNA, 17 nt, Human
aaguguguuuccuucag

SEQ ID NO: 3478543 - RNA, 16 nt, Human
aaguguuaauacuagu

SEQ ID NO: 3478544 - RNA, 11 nt, Human
aaguguuacuu

SEQ ID NO: 3478545 - RNA, 22 nt, Human
aaguguuagccuuuuuucccca

SEQ ID NO: 3478546 - RNA, 17 nt, Human
aaguguucuguuacaaa

SEQ ID NO: 3478547 - RNA, 20 nt, Human
aaguguucuguuacaaaaug

SEQ ID NO: 3478548 - RNA, 18 nt, Human
aaguguuguaaauauuua

SEQ ID NO: 3478549 - RNA, 19 nt, Human
aaguguuuauguuguuuau

SEQ ID NO: 3478550 - RNA, 15 nt, Human
aaguguuuauuuuuc

SEQ ID NO: 3478551 - RNA, 21 nt, Human
aaguguuuauuuuucauauug

SEQ ID NO: 3478552 - RNA, 20 nt, Human
aaguguuuccuucauuucug

SEQ ID NO: 3478553 - RNA, 14 nt, Human
aaguguuucuguua

SEQ ID NO: 3478554 - RNA, 23 nt, Human
aaguguuucuguuauuaacaaac

SEQ ID NO: 3478555 - RNA, 15 nt, Human
aaguguuuucagagc

SEQ ID NO: 3478556 - RNA, 13 nt, Human
aaguguuuucucu

SEQ ID NO: 3478557 - RNA, 17 nt, Human
aaguuaaaaaaaauaau

SEQ ID NO: 3478558 - RNA, 18 nt, Human
aaguuaaacauugaagua

SEQ ID NO: 3478559 - RNA, 17 nt, Human
aauaugcaaugugaagc

SEQ ID NO: 3478560 - RNA, 16 nt, Human
aauaugcacacauuuu

SEQ ID NO: 3478561 - RNA, 21 nt, Human
aauaugccccauucaacaucu

SEQ ID NO: 3478562 - RNA, 16 nt, Human
aauaugccucuccuuu

SEQ ID NO: 3478563 - RNA, 21 nt, Human
aauaugccucuccuuuguaua

SEQ ID NO: 3478564 - RNA, 15 nt, Human
aauaugcuaauuugg

SEQ ID NO: 3478565 - RNA, 17 nt, Human
aauaugcugcaacaaaa

SEQ ID NO: 3478566 - RNA, 18 nt, Human
aauaugcugcaacaaaau

SEQ ID NO: 3478567 - RNA, 19 nt, Human
aauaugcugccaaauuuug

SEQ ID NO: 3478568 - RNA, 14 nt, Human
aauaugcuggcugg

SEQ ID NO: 3478569 - RNA, 19 nt, Human
aauaugcuuaaaauaagca

SEQ ID NO: 3478570 - RNA, 17 nt, Human
aauaugcuuauaaccua

SEQ ID NO: 3478571 - RNA, 21 nt, Human
aauaugcuuauauuguucacu

SEQ ID NO: 3478572 - RNA, 16 nt, Human
aauauggaacuuacau

SEQ ID NO: 3478573 - RNA, 20 nt, Human
aauauggaacuuacauuguu

SEQ ID NO: 3478574 - RNA, 17 nt, Human
aauauggacucaguuuu

SEQ ID NO: 3478575 - RNA, 15 nt, Human
aauauggacugcuca

SEQ ID NO: 3478576 - RNA, 19 nt, Human
aauaugggcauuguaguua

SEQ ID NO: 3478577 - RNA, 16 nt, Human
aauaugguugauaguu

SEQ ID NO: 3478578 - RNA, 12 nt, Human
aauauguaccaa

SEQ ID NO: 3478579 - RNA, 19 nt, Human
aauauguaccaagaaucuu

SEQ ID NO: 3478580 - RNA, 16 nt, Human
aauauguaguaucuau

SEQ ID NO: 3478581 - RNA, 15 nt, Human
aauauguauuguaaa

SEQ ID NO: 3478582 - RNA, 11 nt, Human
aauauguauuu

SEQ ID NO: 3478583 - RNA, 13 nt, Human
aauauguauuuua

SEQ ID NO: 3478584 - RNA, 21 nt, Human
aauauguauuuuauguauguu

SEQ ID NO: 3478585 - RNA, 13 nt, Human
aauauguccuggg

SEQ ID NO: 3478586 - RNA, 21 nt, Human
aauaugugaaggaccuucacu

SEQ ID NO: 3478587 - RNA, 18 nt, Human
aauaugugagauuuuuua

SEQ ID NO: 3478588 - RNA, 23 nt, Human
aauauguggaguucaucuugaau

SEQ ID NO: 3478589 - RNA, 15 nt, Human
aauauguuuaaaaua

SEQ ID NO: 3478590 - RNA, 15 nt, Human
aauauguuucaaacu

SEQ ID NO: 3478591 - RNA, 16 nt, Human
aauauguuucaaacuu

SEQ ID NO: 3478592 - RNA, 13 nt, Human
aauauguuucaca

SEQ ID NO: 3478593 - RNA, 14 nt, Human
aauauguuuccuug

SEQ ID NO: 3478594 - RNA, 18 nt, Human
aauauguuuccuuguuua

SEQ ID NO: 3478595 - RNA, 21 nt, Human
aauauguuuuuuagaucaaau

SEQ ID NO: 3478596 - RNA, 21 nt, Human
aauauuaaaaagucuuuuaaa

SEQ ID NO: 3478597 - RNA, 12 nt, Human
aauauuaaaaga

SEQ ID NO: 3478598 - RNA, 13 nt, Human
aauauuaaagcca

SEQ ID NO: 3478599 - RNA, 15 nt, Human
aauauuaaagccaug

SEQ ID NO: 3478600 - RNA, 13 nt, Human
aauauuaaauaca

SEQ ID NO: 3478601 - RNA, 20 nt, Human
aauauuaaauacagacacua

SEQ ID NO: 3478602 - RNA, 13 nt, Human
aauauuaaaucug

SEQ ID NO: 3478603 - RNA, 13 nt, Human
aauauuaagaaag

SEQ ID NO: 3478604 - RNA, 14 nt, Human
aauauuaagacaau

SEQ ID NO: 3478605 - RNA, 13 nt, Human
aauauuaagcaug

SEQ ID NO: 3478606 - RNA, 14 nt, Human
aauauuaccuaaug

SEQ ID NO: 3478607 - RNA, 19 nt, Human
aauauuaccuaaugaaagu

SEQ ID NO: 3478608 - RNA, 17 nt, Human
aauauuacuccuauuuu

SEQ ID NO: 3478609 - RNA, 20 nt, Human
aauauuacuccuauuuuugu

SEQ ID NO: 3478610 - RNA, 20 nt, Human
aauauuacuguuuauuucug

SEQ ID NO: 3478611 - RNA, 14 nt, Human
aauauuagauguga

SEQ ID NO: 3478612 - RNA, 15 nt, Human
aauauuagaugugau

SEQ ID NO: 3478613 - RNA, 16 nt, Human
aauauuagaugugauu

SEQ ID NO: 3478614 - RNA, 17 nt, Human
aauauuagaugugauuu

SEQ ID NO: 3478615 - RNA, 15 nt, Human
aauauuagcuuuacu

SEQ ID NO: 3478616 - RNA, 22 nt, Human
aauauuauaacucauuuguugu

SEQ ID NO: 3478617 - RNA, 15 nt, Human
aauauuauacuaaga

SEQ ID NO: 3478618 - RNA, 13 nt, Human
aauauuauauuug

SEQ ID NO: 3478619 - RNA, 15 nt, Human
aauauuaucuuugua

SEQ ID NO: 3478620 - RNA, 16 nt, Human
aauauuauuccucaaa

SEQ ID NO: 3478621 - RNA, 14 nt, Human
aauauucaauaaag

SEQ ID NO: 3478622 - RNA, 16 nt, Human
aauauucacugggcca

SEQ ID NO: 3478623 - RNA, 18 nt, Human
aauauucauauuggaaaa

SEQ ID NO: 3478624 - RNA, 20 nt, Human
aauauucauauuggaaaaau

SEQ ID NO: 3478625 - RNA, 12 nt, Human
aauauuccagag

SEQ ID NO: 3478626 - RNA, 13 nt, Human
aauauucccaagc

SEQ ID NO: 3478627 - RNA, 20 nt, Human
aauauuccccuaucucuaga

SEQ ID NO: 3478628 - RNA, 15 nt, Human
aauauucccuagaaa

SEQ ID NO: 3478629 - RNA, 17 nt, Human
aauauucccuagaaacu

SEQ ID NO: 3478630 - RNA, 20 nt, Human
aauauuccuuugcauauuau

SEQ ID NO: 3478631 - RNA, 21 nt, Human
aauauuccuuugcauauuaua

SEQ ID NO: 3478632 - RNA, 18 nt, Human
aauauucucuauuugaau

SEQ ID NO: 3478633 - RNA, 17 nt, Human
aauauucucuguacaua

SEQ ID NO: 3478634 - RNA, 18 nt, Human
aauauucucuguacauau

SEQ ID NO: 3478635 - RNA, 10 nt, Human
aauauucugg

SEQ ID NO: 3478636 - RNA, 19 nt, Human
aauauucuuucaauaacga

SEQ ID NO: 3478637 - RNA, 13 nt, Human
aauauugaaaauu

SEQ ID NO: 3478638 - RNA, 20 nt, Human
aauauugaaaauugaaaagu

SEQ ID NO: 3478639 - RNA, 21 nt, Human
aauauugaaaauugaaaagua

SEQ ID NO: 3478640 - RNA, 20 nt, Human
aauauugaaaggcaaacauu

SEQ ID NO: 3478641 - RNA, 15 nt, Human
aauauugaacuuuuu

SEQ ID NO: 3478642 - RNA, 13 nt, Human
aauauugaauuuu

SEQ ID NO: 3478643 - RNA, 22 nt, Human
aauauugaauuuuuauuuuuga

SEQ ID NO: 3478644 - RNA, 12 nt, Human
aauauugacauu

SEQ ID NO: 3478645 - RNA, 14 nt, Human
aauauugagcaaua

SEQ ID NO: 3478646 - RNA, 18 nt, Human
aauauugagcaauauguc

SEQ ID NO: 3478647 - RNA, 22 nt, Human
aauauugaggcuuuguguugua

SEQ ID NO: 3478648 - RNA, 20 nt, Human
aauauugauugggaaaacau

SEQ ID NO: 3478649 - RNA, 21 nt, Human
aauauugauugggaaaacauu

SEQ ID NO: 3478650 - RNA, 23 nt, Human
aauauugauugggaaaacauuug

SEQ ID NO: 3478651 - RNA, 14 nt, Human
aauauugcaaaaua

SEQ ID NO: 3478652 - RNA, 23 nt, Human
aauauugccaaugcuacaguaau

SEQ ID NO: 3478653 - RNA, 22 nt, Human
aauauugcuccaugaugacuua

SEQ ID NO: 3478654 - RNA, 13 nt, Human
aauauuguacagu

SEQ ID NO: 3478655 - RNA, 14 nt, Human
aauauuguacaguu

SEQ ID NO: 3478656 - RNA, 23 nt, Human
aauauuguacaguuuuuauugcu

SEQ ID NO: 3478657 - RNA, 13 nt, Human
aauauugucuuuu

SEQ ID NO: 3478658 - RNA, 10 nt, Human
aauauugugu

SEQ ID NO: 3478659 - RNA, 14 nt, Human
aauauuguuaaggg

SEQ ID NO: 3478660 - RNA, 24 nt, Human
aauauuguuccuaaguucuuagau

SEQ ID NO: 3478661 - RNA, 20 nt, Human
aauauuguugacaacuguga

SEQ ID NO: 3478662 - RNA, 14 nt, Human
aauauuguuucugc

SEQ ID NO: 3478663 - RNA, 21 nt, Human
aauauuguuugguaaauguuu

SEQ ID NO: 3478664 - RNA, 22 nt, Human
aauauuguuugguaaauguuuc

SEQ ID NO: 3478665 - RNA, 12 nt, Human
aaugaaugucua

SEQ ID NO: 3478666 - RNA, 13 nt, Human
aaugaaugucuuu

SEQ ID NO: 3478667 - RNA, 23 nt, Human
aaugaauguuuacacucuuugua

SEQ ID NO: 3478668 - RNA, 13 nt, Human
aaugacaacagaa

SEQ ID NO: 3478669 - RNA, 15 nt, Human
aaugacaacagaagc

SEQ ID NO: 3478670 - RNA, 17 nt, Human
aaugacacucauauaau

SEQ ID NO: 3478671 - RNA, 19 nt, Human
aaugacacucauauaauua

SEQ ID NO: 3478672 - RNA, 21 nt, Human
aaugacauacgcuuuuaauga

SEQ ID NO: 3478673 - RNA, 18 nt, Human
aaugacaucaccacaguu

SEQ ID NO: 3478674 - RNA, 16 nt, Human
aaugacaucuuuuuaa

SEQ ID NO: 3478675 - RNA, 19 nt, Human
aaugacaucuuuuuaaagc

SEQ ID NO: 3478676 - RNA, 20 nt, Human
aaugacaucuuuuuaaagcu

SEQ ID NO: 3478677 - RNA, 19 nt, Human
aaugacaugaauuuuagcu

SEQ ID NO: 3478678 - RNA, 12 nt, Human
aaugacaugcac

SEQ ID NO: 3478679 - RNA, 15 nt, Human
aaugacaugcacuga

SEQ ID NO: 3478680 - RNA, 19 nt, Human
aaugacaugcacugacccu

SEQ ID NO: 3478681 - RNA, 22 nt, Human
aaugacaugcacugacccuucc

SEQ ID NO: 3478682 - RNA, 19 nt, Human
aaugaccacaccugccucu

SEQ ID NO: 3478683 - RNA, 18 nt, Human
aaugaccaguaauuguga

SEQ ID NO: 3478684 - RNA, 21 nt, Human
aaugaccaguaauugugaaaa

SEQ ID NO: 3478685 - RNA, 13 nt, Human
aaugaccuuguaa

SEQ ID NO: 3478686 - RNA, 14 nt, Human
aaugaccuuguaau

SEQ ID NO: 3478687 - RNA, 19 nt, Human
aaugaccuuguaauguaac

SEQ ID NO: 3478688 - RNA, 14 nt, Human
aaugaccuuucaau

SEQ ID NO: 3478689 - RNA, 21 nt, Human
aaugaccuuucaauaggaaaa

SEQ ID NO: 3478690 - RNA, 17 nt, Human
aaugacuaaaaauauua

SEQ ID NO: 3478691 - RNA, 22 nt, Human
aaugacuaagaggaaaguacau

SEQ ID NO: 3478692 - RNA, 16 nt, Human
aaugacuaauuagggu

SEQ ID NO: 3478693 - RNA, 23 nt, Human
aaugacuaauuaggguacauuua

SEQ ID NO: 3478694 - RNA, 15 nt, Human
aaugacuauauaauu

SEQ ID NO: 3478695 - RNA, 16 nt, Human
aaugacucaaagucug

SEQ ID NO: 3478696 - RNA, 14 nt, Human
aaugacuuacugua

SEQ ID NO: 3478697 - RNA, 19 nt, Human
aaugacuuccccaauaucu

SEQ ID NO: 3478698 - RNA, 21 nt, Human
aaugacuuccccaauaucuug

SEQ ID NO: 3478699 - RNA, 15 nt, Human
aaugacuuuauuauu

SEQ ID NO: 3478700 - RNA, 22 nt, Human
aaugagaaaucuaaaaaacgaa

SEQ ID NO: 3478701 - RNA, 21 nt, Human
aaugagaacauguugguauuu

SEQ ID NO: 3478702 - RNA, 15 nt, Human
aaugagaaggcagcc

SEQ ID NO: 3478703 - RNA, 17 nt, Human
aaugagacuugccuucc

SEQ ID NO: 3478704 - RNA, 15 nt, Human
aaugagacuugcucu

SEQ ID NO: 3478705 - RNA, 20 nt, Human
aaugagacuuuaaaagcauu

SEQ ID NO: 3478706 - RNA, 23 nt, Human
aaugagagaauaagucauguucc

SEQ ID NO: 3478707 - RNA, 22 nt, Human
aaugagagacacacugaagaag

SEQ ID NO: 3478708 - RNA, 19 nt, Human
aaugagagggcaguguuuc

SEQ ID NO: 3478709 - RNA, 21 nt, Human
aaugagauagaagauguuugc

SEQ ID NO: 3478710 - RNA, 21 nt, Human
aaugagaucucauuaaaaggu

SEQ ID NO: 3478711 - RNA, 15 nt, Human
aaugagauugaauuu

SEQ ID NO: 3478712 - RNA, 16 nt, Human
aaugagcauguuuaga

SEQ ID NO: 3478713 - RNA, 22 nt, Human
aaugagcauguuuagacuuuaa

SEQ ID NO: 3478714 - RNA, 15 nt, Human
aaugagccuggcaag

SEQ ID NO: 3478715 - RNA, 18 nt, Human
aaugagcuauuaaaacuc

SEQ ID NO: 3478716 - RNA, 22 nt, Human
aaugagcucgcauuugucaaug

SEQ ID NO: 3478717 - RNA, 12 nt, Human
aaugagcuuucu

SEQ ID NO: 3478718 - RNA, 13 nt, Human
aaugagcuuucug

SEQ ID NO: 3478719 - RNA, 16 nt, Human
aaugagcuuucugaac

SEQ ID NO: 3478720 - RNA, 21 nt, Human
aaugagcuuucugaacagcug

SEQ ID NO: 3478721 - RNA, 17 nt, Human
aaugaggaaaauucuua

SEQ ID NO: 3478722 - RNA, 16 nt, Human
aaugaggagagaaaau

SEQ ID NO: 3478723 - RNA, 16 nt, Human
aaugaggccauggacu

SEQ ID NO: 3478724 - RNA, 13 nt, Human
aaugaggcuugcu

SEQ ID NO: 3478725 - RNA, 15 nt, Human
aaugaggcuugcuga

SEQ ID NO: 3478726 - RNA, 24 nt, Human
aaugaggcuuggggcuggagagga

SEQ ID NO: 3478727 - RNA, 15 nt, Human
aaugaggucagcaug

SEQ ID NO: 3478728 - RNA, 16 nt, Human
aaugaggucugaaaug

SEQ ID NO: 3478729 - RNA, 19 nt, Human
aaugaggucugaaauggag

SEQ ID NO: 3478730 - RNA, 16 nt, Human
aaugaggucugggcua

SEQ ID NO: 3478731 - RNA, 18 nt, Human
aaugaguccaaacuggaa

SEQ ID NO: 3478732 - RNA, 13 nt, Human
aaugagugugcau

SEQ ID NO: 3478733 - RNA, 13 nt, Human
aaugaguugugaa

SEQ ID NO: 3478734 - RNA, 15 nt, Human
aaugaguuucuuuua

SEQ ID NO: 3478735 - RNA, 14 nt, Human
aaugauaacuggaa

SEQ ID NO: 3478736 - RNA, 16 nt, Human
aaugauaacuggaaac

SEQ ID NO: 3478737 - RNA, 18 nt, Human
aaugauaguaagaaaagu

SEQ ID NO: 3478738 - RNA, 16 nt, Human
aaugauauugcugaag

SEQ ID NO: 3478739 - RNA, 21 nt, Human
aaugauccuguauucagacag

SEQ ID NO: 3478740 - RNA, 20 nt, Human
aaugaucugccucuaaaagc

SEQ ID NO: 3478741 - RNA, 19 nt, Human
aaugaugacaaaaaauguu

SEQ ID NO: 3478742 - RNA, 12 nt, Human
aaugaugaugac

SEQ ID NO: 3478743 - RNA, 19 nt, Human
aaugaugccaugaggaaca

SEQ ID NO: 3478744 - RNA, 17 nt, Human
aaugaugcccugcucca

SEQ ID NO: 3478745 - RNA, 22 nt, Human
aaugauggacccaaugcacaca

SEQ ID NO: 3478746 - RNA, 21 nt, Human
aaugauggcagugguuugaaa

SEQ ID NO: 3478747 - RNA, 20 nt, Human
aaugauggcccauucuacuu

SEQ ID NO: 3478748 - RNA, 20 nt, Human
aaugauguauguugaagccu

SEQ ID NO: 3478749 - RNA, 19 nt, Human
aaugaugugccugcuucag

SEQ ID NO: 3478750 - RNA, 12 nt, Human
aaugauuaauua

SEQ ID NO: 3478751 - RNA, 21 nt, Human
aaugauuauuuucauuacaau

SEQ ID NO: 3478752 - RNA, 21 nt, Human
aaugauucaaaaagucacagu

SEQ ID NO: 3478753 - RNA, 14 nt, Human
aaugauucaguguu

SEQ ID NO: 3478754 - RNA, 16 nt, Human
aaugauucauguuaua

SEQ ID NO: 3478755 - RNA, 13 nt, Human
aaugauugaaaau

SEQ ID NO: 3478756 - RNA, 23 nt, Human
aauaucgaucagaugacuagaaa

SEQ ID NO: 3478757 - RNA, 14 nt, Human
aauaucuaaaguua

SEQ ID NO: 3478758 - RNA, 18 nt, Human
aauaucuaauaaaaaguc

SEQ ID NO: 3478759 - RNA, 14 nt, Human
aauaucuaauauau

SEQ ID NO: 3478760 - RNA, 22 nt, Human
aauaucuaauauauaugaauaa

SEQ ID NO: 3478761 - RNA, 21 nt, Human
aauaucuaguaauauauuuaa

SEQ ID NO: 3478762 - RNA, 18 nt, Human
aauaucucugaguucugu

SEQ ID NO: 3478763 - RNA, 17 nt, Human
aauaucugaaaauguau

SEQ ID NO: 3478764 - RNA, 18 nt, Human
aauaucugaaaauguaug

SEQ ID NO: 3478765 - RNA, 19 nt, Human
aauaucugaaaauguaugu

SEQ ID NO: 3478766 - RNA, 21 nt, Human
aauaucugaacauuuacuaca

SEQ ID NO: 3478767 - RNA, 21 nt, Human
aauaucuguauuuaauuuuga

SEQ ID NO: 3478768 - RNA, 23 nt, Human
aauaucuguauuuaauuuugaca

SEQ ID NO: 3478769 - RNA, 14 nt, Human
aauaucugugaaau

SEQ ID NO: 3478770 - RNA, 14 nt, Human
aauaucuuguguug

SEQ ID NO: 3478771 - RNA, 18 nt, Human
aauaucuuuuauguuuga

SEQ ID NO: 3478772 - RNA, 21 nt, Human
aauaucuuuuauguuugaaua

SEQ ID NO: 3478773 - RNA, 23 nt, Human
aauaucuuuuauguuugaauaug

SEQ ID NO: 3478774 - RNA, 18 nt, Human
aauaugaacccuuuguuu

SEQ ID NO: 3478775 - RNA, 20 nt, Human
aauaugaacccuuuguuucu

SEQ ID NO: 3478776 - RNA, 19 nt, Human
aauaugaacggugagcauu

SEQ ID NO: 3478777 - RNA, 23 nt, Human
aauaugaaguuacuuucuuaaug

SEQ ID NO: 3478778 - RNA, 20 nt, Human
aauaugacuuuuuauaaaau

SEQ ID NO: 3478779 - RNA, 16 nt, Human
aauaugauguuaaaaa

SEQ ID NO: 3478780 - RNA, 20 nt, Human
aauaugauuaguaaagaaau

SEQ ID NO: 3478781 - RNA, 15 nt, Human
aauaugcaaagcacu

SEQ ID NO: 3478782 - RNA, 17 nt, Human
aauaugcaaagcacuga

SEQ ID NO: 3478783 - RNA, 14 nt, Human
aauaugcaaagucu

SEQ ID NO: 3478784 - RNA, 22 nt, Human
aauguuauuuguuauuuucagu

SEQ ID NO: 3478785 - RNA, 17 nt, Human
aauguucaucaauuccc

SEQ ID NO: 3478786 - RNA, 12 nt, Human
aauguucauugu

SEQ ID NO: 3478787 - RNA, 21 nt, Human
aauguuccugccuccuugaua

SEQ ID NO: 3478788 - RNA, 13 nt, Human
aauguucuaaguu

SEQ ID NO: 3478789 - RNA, 12 nt, Human
aauguucugaca

SEQ ID NO: 3478790 - RNA, 19 nt, Human
aauguucugacauuaacag

SEQ ID NO: 3478791 - RNA, 20 nt, Human
aauguucuuaugcaaaaugg

SEQ ID NO: 3478792 - RNA, 14 nt, Human
aauguucuuuggaa

SEQ ID NO: 3478793 - RNA, 20 nt, Human
aauguucuuuggaaaguaca

SEQ ID NO: 3478794 - RNA, 22 nt, Human
aauguucuuuggaaaguacacu

SEQ ID NO: 3478795 - RNA, 21 nt, Human
aauguugaacaaaauaaauug

SEQ ID NO: 3478796 - RNA, 18 nt, Human
aauguugagaaucccaaa

SEQ ID NO: 3478797 - RNA, 14 nt, Human
aauguugauuucua

SEQ ID NO: 3478798 - RNA, 15 nt, Human
aauguugauuucuag

SEQ ID NO: 3478799 - RNA, 18 nt, Human
aauguugauuucuaguua

SEQ ID NO: 3478800 - RNA, 20 nt, Human
aauguugcuaugugccuuau

SEQ ID NO: 3478801 - RNA, 13 nt, Human
aauguugcugaaa

SEQ ID NO: 3478802 - RNA, 20 nt, Human
aauguuggacaccuuuaggu

SEQ ID NO: 3478803 - RNA, 21 nt, Human
aauguuggacaccuuuagguu

SEQ ID NO: 3478804 - RNA, 19 nt, Human
aauguuggauuuauaaaug

SEQ ID NO: 3478805 - RNA, 21 nt, Human
aauguugggacugcuaaauaa

SEQ ID NO: 3478806 - RNA, 18 nt, Human
aauguugguuuacuuuca

SEQ ID NO: 3478807 - RNA, 21 nt, Human
aauguugguuuacuuucaaau

SEQ ID NO: 3478808 - RNA, 14 nt, Human
aauguuguaguguc

SEQ ID NO: 3478809 - RNA, 17 nt, Human
aauguugugaauaauua

SEQ ID NO: 3478810 - RNA, 18 nt, Human
aauguugugaauaauuac

SEQ ID NO: 3478811 - RNA, 16 nt, Human
aauguugugguuuguu

SEQ ID NO: 3478812 - RNA, 16 nt, Human
aauguuuaaacauuuu

SEQ ID NO: 3478813 - RNA, 13 nt, Human
aauguuuaaucau

SEQ ID NO: 3478814 - RNA, 18 nt, Human
aauguuuaaucauauaaa

SEQ ID NO: 3478815 - RNA, 23 nt, Human
aauguuuaaucauauaaauagaa

SEQ ID NO: 3478816 - RNA, 22 nt, Human
aauguuuacagauccccaagcc

SEQ ID NO: 3478817 - RNA, 16 nt, Human
aauuagguuuuguaca

SEQ ID NO: 3478818 - RNA, 17 nt, Human
aauuagguuuuuccuua

SEQ ID NO: 3478819 - RNA, 21 nt, Human
aauuaguacagaaauauccau

SEQ ID NO: 3478820 - RNA, 18 nt, Human
aauuaguauuuauuuaau

SEQ ID NO: 3478821 - RNA, 23 nt, Human
aauuaguuuccuuuuuaauaugc

SEQ ID NO: 3478822 - RNA, 20 nt, Human
aauuaguuuuauaugcuucu

SEQ ID NO: 3478823 - RNA, 18 nt, Human
aauuauaacuggaaagaa

SEQ ID NO: 3478824 - RNA, 19 nt, Human
aauuauaacuggaaagaag

SEQ ID NO: 3478825 - RNA, 17 nt, Human
aauuauaacuuaaaaua

SEQ ID NO: 3478826 - RNA, 17 nt, Human
aauuauaaggacugcau

SEQ ID NO: 3478827 - RNA, 12 nt, Human
aauuauaaugua

SEQ ID NO: 3478828 - RNA, 13 nt, Human
aauuauaauguau

SEQ ID NO: 3478829 - RNA, 18 nt, Human
aauuauaauguauucaua

SEQ ID NO: 3478830 - RNA, 20 nt, Human
aauuauacaaauuaaaaaga

SEQ ID NO: 3478831 - RNA, 20 nt, Human
aauuauacuggagaagucuu

SEQ ID NO: 3478832 - RNA, 19 nt, Human
aauuauagaugggaaugaa

SEQ ID NO: 3478833 - RNA, 17 nt, Human
aauuauagcucuaaugu

SEQ ID NO: 3478834 - RNA, 18 nt, Human
aauuauagcucuaauguu

SEQ ID NO: 3478835 - RNA, 13 nt, Human
aauuauaguuucu

SEQ ID NO: 3478836 - RNA, 20 nt, Human
aauuauauagguugugcaaa

SEQ ID NO: 3478837 - RNA, 19 nt, Human
aauuauaugcuauuucuau

SEQ ID NO: 3478838 - RNA, 11 nt, Human
aauuauauucc

SEQ ID NO: 3478839 - RNA, 23 nt, Human
aauuauauuccucuugcauuuca

SEQ ID NO: 3478840 - RNA, 20 nt, Human
aauuauauuugugcuauagu

SEQ ID NO: 3478841 - RNA, 22 nt, Human
aauuauauuugugcuauaguau

SEQ ID NO: 3478842 - RNA, 16 nt, Human
aauuaucaagcuaaua

SEQ ID NO: 3478843 - RNA, 13 nt, Human
aauuauccaggaa

SEQ ID NO: 3478844 - RNA, 15 nt, Human
aauuaucccuuuucu

SEQ ID NO: 3478845 - RNA, 14 nt, Human
aauuauccuauuuc

SEQ ID NO: 3478846 - RNA, 17 nt, Human
aauuaucggaagcagug

SEQ ID NO: 3478847 - RNA, 20 nt, Human
aauuaucggaagcagugccu

SEQ ID NO: 3478848 - RNA, 20 nt, Human
aauuaucgggaacaguguuu

SEQ ID NO: 3478849 - RNA, 22 nt, Human
aauuaucuauacauaucuuuau

SEQ ID NO: 3478850 - RNA, 12 nt, Human
aauuaucuauuu

SEQ ID NO: 3478851 - RNA, 16 nt, Human
aauuaucuauuuguau

SEQ ID NO: 3478852 - RNA, 19 nt, Human
aauuaucuauuuguauaua

SEQ ID NO: 3478853 - RNA, 21 nt, Human
aauuaucuugauacauucaaa

SEQ ID NO: 3478854 - RNA, 12 nt, Human
aauuaugacagu

SEQ ID NO: 3478855 - RNA, 23 nt, Human
aauuaugagauugguuuuccugu

SEQ ID NO: 3478856 - RNA, 19 nt, Human
aauuaugaguuauuuuuau

SEQ ID NO: 3478857 - RNA, 20 nt, Human
aauuaugguuaguagaggua

SEQ ID NO: 3478858 - RNA, 15 nt, Human
aauuauguaaauuau

SEQ ID NO: 3478859 - RNA, 17 nt, Human
aauuauguaaauuauca

SEQ ID NO: 3478860 - RNA, 17 nt, Human
aauuauguaaauuaugu

SEQ ID NO: 3478861 - RNA, 22 nt, Human
aauuaugucugcugaauaauaa

SEQ ID NO: 3478862 - RNA, 17 nt, Human
aauuaugugacauuuua

SEQ ID NO: 3478863 - RNA, 13 nt, Human
aauuauguuaaac

SEQ ID NO: 3478864 - RNA, 19 nt, Human
aauuauguuaaacuagcau

SEQ ID NO: 3478865 - RNA, 18 nt, Human
aauuauguuauugaaaaa

SEQ ID NO: 3478866 - RNA, 19 nt, Human
aauuauguugaaaagagua

SEQ ID NO: 3478867 - RNA, 16 nt, Human
aauuauuaacuacauu

SEQ ID NO: 3478868 - RNA, 23 nt, Human
aauuauuaacuacauuuaugagu

SEQ ID NO: 3478869 - RNA, 16 nt, Human
aauuauuaaugaaaau

SEQ ID NO: 3478870 - RNA, 17 nt, Human
aauuauuaaugaaaaua

SEQ ID NO: 3478871 - RNA, 11 nt, Human
aauuauuauuu

SEQ ID NO: 3478872 - RNA, 13 nt, Human
aauuauuauuuau

SEQ ID NO: 3478873 - RNA, 16 nt, Human
aauuauuauuuauaua

SEQ ID NO: 3478874 - RNA, 18 nt, Human
aauuauucaguuaagaaa

SEQ ID NO: 3478875 - RNA, 14 nt, Human
aauuauugacacug

SEQ ID NO: 3478876 - RNA, 20 nt, Human
aauuauugauauauauuaua

SEQ ID NO: 3478877 - RNA, 17 nt, Human
aauuauugauguuuuca

SEQ ID NO: 3478878 - RNA, 17 nt, Human
aauuauugauugcuuuu

SEQ ID NO: 3478879 - RNA, 12 nt, Human
aauuauuguaua

SEQ ID NO: 3478880 - RNA, 13 nt, Human
aauuauugugauu

SEQ ID NO: 3478881 - RNA, 19 nt, Human
aauuauuguuuauauuuuc

SEQ ID NO: 3478882 - RNA, 20 nt, Human
aauuauuguuuauauuuuca

SEQ ID NO: 3478883 - RNA, 22 nt, Human
aauuauuguuuauauuuucaau

SEQ ID NO: 3478884 - RNA, 22 nt, Human
aauuauuuaaaccgcuaaaaga

SEQ ID NO: 3478885 - RNA, 14 nt, Human
aauuauuuaauaaa

SEQ ID NO: 3478886 - RNA, 19 nt, Human
aauuauuuauuuaauaaca

SEQ ID NO: 3478887 - RNA, 22 nt, Human
aauuauuucugucacaguaaaa

SEQ ID NO: 3478888 - RNA, 14 nt, Human
aauuauuugaauga

SEQ ID NO: 3478889 - RNA, 19 nt, Human
aauuauuugcaggucuuua

SEQ ID NO: 3478890 - RNA, 14 nt, Human
aauuauuuguguaa

SEQ ID NO: 3478891 - RNA, 15 nt, Human
aauuauuuuaaaaga

SEQ ID NO: 3478892 - RNA, 15 nt, Human
aauuauuuuaaauua

SEQ ID NO: 3478893 - RNA, 20 nt, Human
aauuauuuuaaauuauaagg

SEQ ID NO: 3478894 - RNA, 17 nt, Human
aauuauuuuaauuaggu

SEQ ID NO: 3478895 - RNA, 11 nt, Human
aauuauuuugu

SEQ ID NO: 3478896 - RNA, 16 nt, Human
aauuauuuuguucaua

SEQ ID NO: 3478897 - RNA, 22 nt, Human
aauuauuuuguucauacauauu

SEQ ID NO: 3478898 - RNA, 15 nt, Human
aauuauuuuuaagug

SEQ ID NO: 3478899 - RNA, 13 nt, Human
aauucaaaaaugu

SEQ ID NO: 3478900 - RNA, 22 nt, Human
aauucaaaaauguacaaaauaa

SEQ ID NO: 3478901 - RNA, 18 nt, Human
aauucaaagcucuauuaa

SEQ ID NO: 3478902 - RNA, 17 nt, Human
aauucaaauaaaaaucc

SEQ ID NO: 3478903 - RNA, 21 nt, Human
aauucaaccacuguaaaauga

SEQ ID NO: 3478904 - RNA, 20 nt, Human
aauucaagaaaacaacuuca

SEQ ID NO: 3478905 - RNA, 16 nt, Human
aauucaaggaauuucu

SEQ ID NO: 3478906 - RNA, 15 nt, Human
aauucaauaguaaua

SEQ ID NO: 3478907 - RNA, 20 nt, Human
aauucaauaguaauauaaua

SEQ ID NO: 3478908 - RNA, 15 nt, Human
aauucaauucaaagc

SEQ ID NO: 3478909 - RNA, 13 nt, Human
aauucacaaagua

SEQ ID NO: 3478910 - RNA, 17 nt, Human
aauucaccaaaguauuu

SEQ ID NO: 3478911 - RNA, 21 nt, Human
aauucacuguacuaucagguu

SEQ ID NO: 3478912 - RNA, 21 nt, Human
aauucacuuucauuuuugaua

SEQ ID NO: 3478913 - RNA, 15 nt, Human
aauucagaaggaucu

SEQ ID NO: 3478914 - RNA, 21 nt, Human
aauucagacaucugagguuuu

SEQ ID NO: 3478915 - RNA, 16 nt, Human
aauucagcaaaccauu

SEQ ID NO: 3478916 - RNA, 20 nt, Human
aauucagcacugauuucaca

SEQ ID NO: 3478917 - RNA, 14 nt, Human
aauucagcauuuga

SEQ ID NO: 3478918 - RNA, 21 nt, Human
aauucaggugaaaauguucau

SEQ ID NO: 3478919 - RNA, 15 nt, Human
aauucagguuuuucc

SEQ ID NO: 3478920 - RNA, 19 nt, Human
aauucagguuuuuccuuuu

SEQ ID NO: 3478921 - RNA, 19 nt, Human
aauucaguguauuucaguu

SEQ ID NO: 3478922 - RNA, 11 nt, Human
aauucaguugu

SEQ ID NO: 3478923 - RNA, 22 nt, Human
aauucaguuguuagugugucuu

SEQ ID NO: 3478924 - RNA, 13 nt, Human
aauucaguuucau

SEQ ID NO: 3478925 - RNA, 13 nt, Human
aauucauauucug

SEQ ID NO: 3478926 - RNA, 23 nt, Human
aauucaucaaauggaagacacau

SEQ ID NO: 3478927 - RNA, 16 nt, Human
aauucaucugucuaua

SEQ ID NO: 3478928 - RNA, 19 nt, Human
aauucauucauacuuaaaa

SEQ ID NO: 3478929 - RNA, 13 nt, Human
aauucauuucuaa

SEQ ID NO: 3478930 - RNA, 16 nt, Human
aauucauuuucucuuu

SEQ ID NO: 3478931 - RNA, 15 nt, Human
aauucauuuuuuuca

SEQ ID NO: 3478932 - RNA, 17 nt, Human
aauuccaaacaugguuu

SEQ ID NO: 3478933 - RNA, 18 nt, Human
aauuccaaagucucuaau

SEQ ID NO: 3478934 - RNA, 16 nt, Human
aauuccacacccucac

SEQ ID NO: 3478935 - RNA, 20 nt, Human
aauuccacacccucacugcu

SEQ ID NO: 3478936 - RNA, 12 nt, Human
aauuccacagcu

SEQ ID NO: 3478937 - RNA, 14 nt, Human
aauuccacuggacu

SEQ ID NO: 3478938 - RNA, 11 nt, Human
aauuccaugaa

SEQ ID NO: 3478939 - RNA, 16 nt, Human
aauuccaugaaucgcu

SEQ ID NO: 3478940 - RNA, 13 nt, Human
aauucucauguga

SEQ ID NO: 3478941 - RNA, 16 nt, Human
aauucucaugugaucc

SEQ ID NO: 3478942 - RNA, 16 nt, Human
aauucuccugccucag

SEQ ID NO: 3478943 - RNA, 16 nt, Human
aauucuccugccuuug

SEQ ID NO: 3478944 - RNA, 12 nt, Human
aauucuccugga

SEQ ID NO: 3478945 - RNA, 11 nt, Human
aauucuccuuu

SEQ ID NO: 3478946 - RNA, 20 nt, Human
aauucucuguggaaugaaua

SEQ ID NO: 3478947 - RNA, 15 nt, Human
aauucucuuauccaa

SEQ ID NO: 3478948 - RNA, 18 nt, Human
aauucugaaguuauauuu

SEQ ID NO: 3478949 - RNA, 19 nt, Human
aauucugaaguuauauuuc

SEQ ID NO: 3478950 - RNA, 14 nt, Human
aauucugaauuugc

SEQ ID NO: 3478951 - RNA, 15 nt, Human
aauucugaauuugca

SEQ ID NO: 3478952 - RNA, 21 nt, Human
aauucugagaaaacuucuuuu

SEQ ID NO: 3478953 - RNA, 23 nt, Human
aauucugauucuggcuuuaagcc

SEQ ID NO: 3478954 - RNA, 21 nt, Human
aauucuggcugguagagcagg

SEQ ID NO: 3478955 - RNA, 12 nt, Human
aauucuguauag

SEQ ID NO: 3478956 - RNA, 20 nt, Human
aauucuguucugauauuaau

SEQ ID NO: 3478957 - RNA, 16 nt, Human
aauucuguuucuugag

SEQ ID NO: 3478958 - RNA, 12 nt, Human
aauucuguuuua

SEQ ID NO: 3478959 - RNA, 22 nt, Human
aauucuguuuuuaaugcuauuu

SEQ ID NO: 3478960 - RNA, 18 nt, Human
aauucuguuuuucuaggc

SEQ ID NO: 3478961 - RNA, 11 nt, Human
aauucuuaaaa

SEQ ID NO: 3478962 - RNA, 23 nt, Human
aauucuuaaaaggcccauagcag

SEQ ID NO: 3478963 - RNA, 13 nt, Human
aauucuuaaauau

SEQ ID NO: 3478964 - RNA, 16 nt, Human
aauucuuaaguauguu

SEQ ID NO: 3478965 - RNA, 17 nt, Human
aauucuuacaaacaugu

SEQ ID NO: 3478966 - RNA, 15 nt, Human
aauucuuacauguuu

SEQ ID NO: 3478967 - RNA, 21 nt, Human
aauucuuauuacuagacugcc

SEQ ID NO: 3478968 - RNA, 18 nt, Human
aauucuuauuccauauua

SEQ ID NO: 3478969 - RNA, 23 nt, Human
aauucuuauuuuuuaaaaagcua

SEQ ID NO: 3478970 - RNA, 20 nt, Human
aauucuucagcguaaaaugg

SEQ ID NO: 3478971 - RNA, 11 nt, Human
aauucuucccu

SEQ ID NO: 3478972 - RNA, 21 nt, Human
aauucuucccuaucuuugcca

SEQ ID NO: 3478973 - RNA, 21 nt, Human
aauucuugaaagaauuuuccu

SEQ ID NO: 3478974 - RNA, 15 nt, Human
aauucuugaaggaaa

SEQ ID NO: 3478975 - RNA, 18 nt, Human
aauucuuguaauuuuuau

SEQ ID NO: 3478976 - RNA, 20 nt, Human
aauucuuguauauuauggaa

SEQ ID NO: 3478977 - RNA, 13 nt, Human
aauucuuuaauga

SEQ ID NO: 3478978 - RNA, 21 nt, Human
aauucuuuauacaacagugcu

SEQ ID NO: 3478979 - RNA, 19 nt, Human
aauucuuucaauacagaua

SEQ ID NO: 3478980 - RNA, 20 nt, Human
aauucuuucaauacagauau

SEQ ID NO: 3478981 - RNA, 22 nt, Human
aauucuuucaauacagauauau

SEQ ID NO: 3478982 - RNA, 17 nt, Human
aauucuuugcaaaaauc

SEQ ID NO: 3478983 - RNA, 14 nt, Human
aauucuuuugaauu

SEQ ID NO: 3478984 - RNA, 18 nt, Human
aauucuuuuuuauuaauc

SEQ ID NO: 3478985 - RNA, 21 nt, Human
aauucuuuuuuauuaaucacu

SEQ ID NO: 3478986 - RNA, 17 nt, Human
aauugaaaaacucuuua

SEQ ID NO: 3478987 - RNA, 14 nt, Human
aauugaaaaguaca

SEQ ID NO: 3478988 - RNA, 13 nt, Human
aauugaaacacuu

SEQ ID NO: 3478989 - RNA, 15 nt, Human
aauugaaacacuuuu

SEQ ID NO: 3478990 - RNA, 17 nt, Human
aauugaaaggcauucuc

SEQ ID NO: 3478991 - RNA, 21 nt, Human
aauugaaaggcauucucugaa

SEQ ID NO: 3478992 - RNA, 12 nt, Human
aauugaaauaua

SEQ ID NO: 3478993 - RNA, 12 nt, Human
aauugaaaugua

SEQ ID NO: 3478994 - RNA, 13 nt, Human
aauugaaccuuug

SEQ ID NO: 3478995 - RNA, 21 nt, Human
aauugaacuuaaauaaauguc

SEQ ID NO: 3478996 - RNA, 14 nt, Human
aauugaaggaaaga

SEQ ID NO: 3478997 - RNA, 18 nt, Human
aauugaagguuuuugaua

SEQ ID NO: 3478998 - RNA, 19 nt, Human
aauugaagguuuuugauag

SEQ ID NO: 3478999 - RNA, 21 nt, Human
aauugaagguuuuugauagca

SEQ ID NO: 3479000 - RNA, 18 nt, Human
aauugaaguaaacuuuuu

SEQ ID NO: 3479001 - RNA, 20 nt, Human
aauugaaguguauaauauaa

SEQ ID NO: 3479002 - RNA, 21 nt, Human
aauugaaguguauaauauaaa

SEQ ID NO: 3479003 - RNA, 18 nt, Human
aauugaauacuuugaaug

SEQ ID NO: 3479004 - RNA, 21 nt, Human
aauugaaucaguauaaacaaa

SEQ ID NO: 3479005 - RNA, 14 nt, Human
aauugaauuuaaca

SEQ ID NO: 3479006 - RNA, 16 nt, Human
aauugaauuuaacaau

SEQ ID NO: 3479007 - RNA, 20 nt, Human
aauugaauuuucaagcaucu

SEQ ID NO: 3479008 - RNA, 21 nt, Human
aauugaauuuucaagcaucuc

SEQ ID NO: 3479009 - RNA, 18 nt, Human
aauugacaggcgaaagaa

SEQ ID NO: 3479010 - RNA, 19 nt, Human
aauugaccaucugcuuuua

SEQ ID NO: 3479011 - RNA, 16 nt, Human
aauugacccacaagaa

SEQ ID NO: 3479012 - RNA, 19 nt, Human
aauugacccacaagaaaug

SEQ ID NO: 3479013 - RNA, 21 nt, Human
aauugacccacaagaaaugaa

SEQ ID NO: 3479014 - RNA, 23 nt, Human
aauugaccgacagcuuuccagua

SEQ ID NO: 3479015 - RNA, 15 nt, Human
aauugacucaaaucu

SEQ ID NO: 3479016 - RNA, 21 nt, Human
aauugacuuauuuauauaaau

SEQ ID NO: 3479017 - RNA, 18 nt, Human
aauugacuucgacuguga

SEQ ID NO: 3479018 - RNA, 20 nt, Human
aauugagaagcguauguuuu

SEQ ID NO: 3479019 - RNA, 23 nt, Human
aauugagcugcuuuuuuugaaac

SEQ ID NO: 3479020 - RNA, 14 nt, Human
aauugaggucugcu

SEQ ID NO: 3479021 - RNA, 19 nt, Human
aauugaggucugcucggcc

SEQ ID NO: 3479022 - RNA, 18 nt, Human
aauugaguguuuaaaguu

SEQ ID NO: 3479023 - RNA, 15 nt, Human
aauugauaauaaacu

SEQ ID NO: 3479024 - RNA, 22 nt, Human
aauugauaauaaacuguccucu

SEQ ID NO: 3479025 - RNA, 22 nt, Human
aauugaucauagguauuucaaa

SEQ ID NO: 3479026 - RNA, 19 nt, Human
aauugaugggauuugguca

SEQ ID NO: 3479027 - RNA, 12 nt, Human
aauugauguuga

SEQ ID NO: 3479028 - RNA, 13 nt, Human
aauugauguugau

SEQ ID NO: 3479029 - RNA, 17 nt, Human
aauugauguugaugcaa

SEQ ID NO: 3479030 - RNA, 20 nt, Human
aauugauugggcacaucauu

SEQ ID NO: 3479031 - RNA, 13 nt, Human
aauugauuugcau

SEQ ID NO: 3479032 - RNA, 13 nt, Human
aauugauuuugaa

SEQ ID NO: 3479033 - RNA, 20 nt, Human
aauugcaaaaacauagaaau

SEQ ID NO: 3479034 - RNA, 14 nt, Human
aauugcaaaucuug

SEQ ID NO: 3479035 - RNA, 15 nt, Human
aauugcaaucuauaa

SEQ ID NO: 3479036 - RNA, 20 nt, Human
aauugcacaccuuggaauuc

SEQ ID NO: 3479037 - RNA, 22 nt, Human
aauugcacagaaguccuguaug

SEQ ID NO: 3479038 - RNA, 18 nt, Human
aauugcacuuuuaaaccu

SEQ ID NO: 3479039 - RNA, 16 nt, Human
aauugcauaaagcaua

SEQ ID NO: 3479040 - RNA, 22 nt, Human
aauugcaugcugcuuuaauugu

SEQ ID NO: 3479041 - RNA, 12 nt, Human
aauugcauuucc

SEQ ID NO: 3479042 - RNA, 13 nt, Human
aauugcauuuuuu

SEQ ID NO: 3479043 - RNA, 21 nt, Human
aauugcauuuuuuaaaacaag

SEQ ID NO: 3479044 - RNA, 23 nt, Human
aauugccaccucuaacagcacca

SEQ ID NO: 3479045 - RNA, 13 nt, Human
aauugccauauug

SEQ ID NO: 3479046 - RNA, 15 nt, Human
aauugccauauugca

SEQ ID NO: 3479047 - RNA, 17 nt, Human
aauugccauauugcaca

SEQ ID NO: 3479048 - RNA, 20 nt, Human
aauugccauguacaguaugu

SEQ ID NO: 3479049 - RNA, 14 nt, Human
aauugccuuucugu

SEQ ID NO: 3479050 - RNA, 22 nt, Human
aauugcguuggucucugcauuu

SEQ ID NO: 3479051 - RNA, 13 nt, Human
aauugcuauguua

SEQ ID NO: 3479052 - RNA, 14 nt, Human
aauugcuauguuac

SEQ ID NO: 3479053 - RNA, 19 nt, Human
aauugcuauguuacuauuu

SEQ ID NO: 3479054 - RNA, 21 nt, Human
aauugcuauguuacuauuuuc

SEQ ID NO: 3479055 - RNA, 17 nt, Human
aauugcucacaguuauu

SEQ ID NO: 3479056 - RNA, 18 nt, Human
aauugcugacuguagcuu

SEQ ID NO: 3479057 - RNA, 18 nt, Human
aauugcuguguaucugau

SEQ ID NO: 3479058 - RNA, 19 nt, Human
aauugcuguugaaagcaaa

SEQ ID NO: 3479059 - RNA, 21 nt, Human
aauugcuguugaaagcaaaaa

SEQ ID NO: 3479060 - RNA, 13 nt, Human
aauugcuuauuua

SEQ ID NO: 3479061 - RNA, 19 nt, Human
aauugcuuauuuauuguau

SEQ ID NO: 3479062 - RNA, 15 nt, Human
aauuggaaagcaggu

SEQ ID NO: 3479063 - RNA, 16 nt, Human
aauuggaggaaagcaa

SEQ ID NO: 3479064 - RNA, 15 nt, Human
aauuggauuuccuaa

SEQ ID NO: 3479065 - RNA, 17 nt, Human
aauuggauuuccuaaua

SEQ ID NO: 3479066 - RNA, 13 nt, Human
aauuggcauuaaa

SEQ ID NO: 3479067 - RNA, 19 nt, Human
aauugggaguccaggcaca

SEQ ID NO: 3479068 - RNA, 18 nt, Human
aauugggcacuauuuauu

SEQ ID NO: 3479069 - RNA, 16 nt, Human
aauugggccagcuuuu

SEQ ID NO: 3479070 - RNA, 15 nt, Human
acaaggccccagaga

SEQ ID NO: 3479071 - RNA, 20 nt, Human
acaaggcugaccaagagaga

SEQ ID NO: 3479072 - RNA, 22 nt, Human
acaaggcugaccaagagagaaa

SEQ ID NO: 3479073 - RNA, 18 nt, Human
acaagggaagauuuaugu

SEQ ID NO: 3479074 - RNA, 18 nt, Human
acaaggggcuguuacaua

SEQ ID NO: 3479075 - RNA, 21 nt, Human
acaaggggcuguuacauaaca

SEQ ID NO: 3479076 - RNA, 17 nt, Human
acaagggucuagggaga

SEQ ID NO: 3479077 - RNA, 13 nt, Human
acaaggguggcau

SEQ ID NO: 3479078 - RNA, 16 nt, Human
acaaggucuuuaaagu

SEQ ID NO: 3479079 - RNA, 15 nt, Human
acaaggugcaggcag

SEQ ID NO: 3479080 - RNA, 19 nt, Human
acaagguuauaugaauaua

SEQ ID NO: 3479081 - RNA, 14 nt, Human
acaaguaacaaaaa

SEQ ID NO: 3479082 - RNA, 15 nt, Human
acaaguaacaaaaau

SEQ ID NO: 3479083 - RNA, 15 nt, Human
acaaguaauuucagu

SEQ ID NO: 3479084 - RNA, 16 nt, Human
acaaguaauuucagug

SEQ ID NO: 3479085 - RNA, 11 nt, Human
acaaguacugg

SEQ ID NO: 3479086 - RNA, 18 nt, Human
acaaguacugguaagauu

SEQ ID NO: 3479087 - RNA, 20 nt, Human
acaaguagaugccugaacuu

SEQ ID NO: 3479088 - RNA, 20 nt, Human
acaaguaguucuguauuuga

SEQ ID NO: 3479089 - RNA, 21 nt, Human
acaaguaguucuguauuugaa

SEQ ID NO: 3479090 - RNA, 23 nt, Human
acaaguaguucuguauuugaaag

SEQ ID NO: 3479091 - RNA, 23 nt, Human
acaaguaugaauaaagacaccua

SEQ ID NO: 3479092 - RNA, 22 nt, Human
acaagucagcuccagcuuucug

SEQ ID NO: 3479093 - RNA, 23 nt, Human
acaagucauuuuaacuuuaucac

SEQ ID NO: 3479094 - RNA, 16 nt, Human
acaagucccuguaauu

SEQ ID NO: 3479095 - RNA, 20 nt, Human
acaaguccuggauguugugu

SEQ ID NO: 3479096 - RNA, 19 nt, Human
acaagugacuguaucugug

SEQ ID NO: 3479097 - RNA, 22 nt, Human
acaagugacuguaucuguguag

SEQ ID NO: 3479098 - RNA, 17 nt, Human
acaagugagacaaaaag

SEQ ID NO: 3479099 - RNA, 19 nt, Human
acaagugcccuccaggcuu

SEQ ID NO: 3479100 - RNA, 13 nt, Human
acaagugcuggca

SEQ ID NO: 3479101 - RNA, 13 nt, Human
acaagugguggua

SEQ ID NO: 3479102 - RNA, 20 nt, Human
acaaguguauaucagaaaag

SEQ ID NO: 3479103 - RNA, 15 nt, Human
acaaguuaaauaaau

SEQ ID NO: 3479104 - RNA, 22 nt, Human
acaaguuauuuaaaucuguuuu

SEQ ID NO: 3479105 - RNA, 13 nt, Human
acaaguuccaugg

SEQ ID NO: 3479106 - RNA, 22 nt, Human
acaaguugcgacggagagaaaa

SEQ ID NO: 3479107 - RNA, 14 nt, Human
acaaguuguguuug

SEQ ID NO: 3479108 - RNA, 16 nt, Human
acaaguuuauauauau

SEQ ID NO: 3479109 - RNA, 16 nt, Human
acaaguuuuucuguca

SEQ ID NO: 3479110 - RNA, 16 nt, Human
acaauaaaaauguuua

SEQ ID NO: 3479111 - RNA, 12 nt, Human
acaauaaaacau

SEQ ID NO: 3479112 - RNA, 22 nt, Human
acaauaaaaguguccauugaaa

SEQ ID NO: 3479113 - RNA, 15 nt, Human
acaauaaaauauuau

SEQ ID NO: 3479114 - RNA, 12 nt, Human
acaauaaaccuc

SEQ ID NO: 3479115 - RNA, 14 nt, Human
acaauaaauaaucu

SEQ ID NO: 3479116 - RNA, 13 nt, Human
acaauaaauagac

SEQ ID NO: 3479117 - RNA, 16 nt, Human
acaauaaauguauuca

SEQ ID NO: 3479118 - RNA, 20 nt, Human
acaauaaauguauucaaaua

SEQ ID NO: 3479119 - RNA, 23 nt, Human
acaauaaauugcuaauguugcug

SEQ ID NO: 3479120 - RNA, 22 nt, Human
acaauaacuacuguguuccugg

SEQ ID NO: 3479121 - RNA, 15 nt, Human
acaauaagcaaaaac

SEQ ID NO: 3479122 - RNA, 21 nt, Human
acaauaauauuguuguauaau

SEQ ID NO: 3479123 - RNA, 13 nt, Human
acaauaauggaaa

SEQ ID NO: 3479124 - RNA, 13 nt, Human
acaauaauuucag

SEQ ID NO: 3479125 - RNA, 13 nt, Human
acaauacaaaugg

SEQ ID NO: 3479126 - RNA, 13 nt, Human
acaauacccccag

SEQ ID NO: 3479127 - RNA, 21 nt, Human
acaauacucauaaugugaagu

SEQ ID NO: 3479128 - RNA, 22 nt, Human
acaauagccgauaucagaauuu

SEQ ID NO: 3479129 - RNA, 22 nt, Human
acaauaggaguggugauuugaa

SEQ ID NO: 3479130 - RNA, 10 nt, Human
acaauauaua

SEQ ID NO: 3479131 - RNA, 18 nt, Human
acaauauauaaaaauaua

SEQ ID NO: 3479132 - RNA, 12 nt, Human
acaauaucauau

SEQ ID NO: 3479133 - RNA, 15 nt, Human
acaauaugaauacag

SEQ ID NO: 3479134 - RNA, 21 nt, Human
acaauaugaauacagggcaug

SEQ ID NO: 3479135 - RNA, 18 nt, Human
acaauauguacauuucua

SEQ ID NO: 3479136 - RNA, 14 nt, Human
acaauaugugagug

SEQ ID NO: 3479137 - RNA, 22 nt, Human
acaauaugugccaaucaauagc

SEQ ID NO: 3479138 - RNA, 14 nt, Human
acaauauugaacuu

SEQ ID NO: 3479139 - RNA, 18 nt, Human
acaauauugacuuugucu

SEQ ID NO: 3479140 - RNA, 14 nt, Human
acaauauuuauugu

SEQ ID NO: 3479141 - RNA, 15 nt, Human
acaauauuuauugua

SEQ ID NO: 3479142 - RNA, 19 nt, Human
acaauauuuauuguauuuu

SEQ ID NO: 3479143 - RNA, 14 nt, Human
acaauauuucugau

SEQ ID NO: 3479144 - RNA, 12 nt, Human
acaauauuugug

SEQ ID NO: 3479145 - RNA, 18 nt, Human
acaauauuuuaagcauua

SEQ ID NO: 3479146 - RNA, 23 nt, Human
acaauauuuuaagcauuacucuu

SEQ ID NO: 3479147 - RNA, 15 nt, Human
acaauauuuuauggu

SEQ ID NO: 3479148 - RNA, 23 nt, Human
acaaucaacucuaauagugcuua

SEQ ID NO: 3479149 - RNA, 12 nt, Human
acaaucacacuc

SEQ ID NO: 3479150 - RNA, 12 nt, Human
acaaucagcugc

SEQ ID NO: 3479151 - RNA, 13 nt, Human
acaaucagcugcu

SEQ ID NO: 3479152 - RNA, 17 nt, Human
acaaucaguccccuccc

SEQ ID NO: 3479153 - RNA, 18 nt, Human
acaaucaugaaauaugca

SEQ ID NO: 3479154 - RNA, 14 nt, Human
acaaucaugugugu

SEQ ID NO: 3479155 - RNA, 21 nt, Human
acaaucauguguguuaaccca

SEQ ID NO: 3479156 - RNA, 22 nt, Human
acaaucauugcugaaaauggua

SEQ ID NO: 3479157 - RNA, 20 nt, Human
acaaucauuguuuugaauau

SEQ ID NO: 3479158 - RNA, 22 nt, Human
acaauccuagugcuuuccuuuu

SEQ ID NO: 3479159 - RNA, 17 nt, Human
acaaucgauggccuugc

SEQ ID NO: 3479160 - RNA, 20 nt, Human
acaaucuauuuauuggacau

SEQ ID NO: 3479161 - RNA, 12 nt, Human
acaaucucaaau

SEQ ID NO: 3479162 - RNA, 13 nt, Human
acaaucucuuaaa

SEQ ID NO: 3479163 - RNA, 14 nt, Human
acaaucucuuaaau

SEQ ID NO: 3479164 - RNA, 21 nt, Human
acaaugaaaacucuuugcugc

SEQ ID NO: 3479165 - RNA, 12 nt, Human
acaaugaaauua

SEQ ID NO: 3479166 - RNA, 18 nt, Human
acaaugaagauaaaaaga

SEQ ID NO: 3479167 - RNA, 16 nt, Human
acaaugacaaagcaga

SEQ ID NO: 3479168 - RNA, 12 nt, Human
acaaugacuuac

SEQ ID NO: 3479169 - RNA, 14 nt, Human
acaaugacuuuauu

SEQ ID NO: 3479170 - RNA, 22 nt, Human
acaaugauccuguauucagaca

SEQ ID NO: 3479171 - RNA, 17 nt, Human
acaaugaugaugauaau

SEQ ID NO: 3479172 - RNA, 18 nt, Human
acaaugaugcuauuugca

SEQ ID NO: 3479173 - RNA, 20 nt, Human
acaaugaugcuauuugcaau

SEQ ID NO: 3479174 - RNA, 12 nt, Human
acaaugcaaaac

SEQ ID NO: 3479175 - RNA, 23 nt, Human
acaaugcaaaccaucauugaaau

SEQ ID NO: 3479176 - RNA, 19 nt, Human
acaaugcaccuagcugugc

SEQ ID NO: 3479177 - RNA, 15 nt, Human
acaaugcagaugcca

SEQ ID NO: 3479178 - RNA, 22 nt, Human
acaaugcagcaaggcccugcug

SEQ ID NO: 3479179 - RNA, 16 nt, Human
acaaugcgaaugguag

SEQ ID NO: 3479180 - RNA, 17 nt, Human
acaaugcugauuuggug

SEQ ID NO: 3479181 - RNA, 21 nt, Human
acaaugcugugcccuaaagug

SEQ ID NO: 3479182 - RNA, 19 nt, Human
acaauggaaacugaaugcu

SEQ ID NO: 3479183 - RNA, 16 nt, Human
acaaugguuuuuaaau

SEQ ID NO: 3479184 - RNA, 20 nt, Human
acaauguagauaaguguucu

SEQ ID NO: 3479185 - RNA, 23 nt, Human
acaauguagauggccucuuacua

SEQ ID NO: 3479186 - RNA, 19 nt, Human
acaauguauuuauuuaaaa

SEQ ID NO: 3479187 - RNA, 21 nt, Human
acaauguauuuauuuaaaaga

SEQ ID NO: 3479188 - RNA, 15 nt, Human
acaauguauuuucuu

SEQ ID NO: 3479189 - RNA, 22 nt, Human
acaaugucaaggugcuguuguc

SEQ ID NO: 3479190 - RNA, 22 nt, Human
acaaugucauauacugccaugu

SEQ ID NO: 3479191 - RNA, 22 nt, Human
acaauguccuaacugaaagaug

SEQ ID NO: 3479192 - RNA, 16 nt, Human
acaaugucugcagccc

SEQ ID NO: 3479193 - RNA, 19 nt, Human
acaaugucugcagcccuga

SEQ ID NO: 3479194 - RNA, 19 nt, Human
acaaugugaaaagaaaaau

SEQ ID NO: 3479195 - RNA, 21 nt, Human
acaauguggccgaggacuuug

SEQ ID NO: 3479196 - RNA, 15 nt, Human
acaauguguuuuucu

SEQ ID NO: 3479197 - RNA, 18 nt, Human
acaauguguuuuucucca

SEQ ID NO: 3479198 - RNA, 17 nt, Human
acaauguuaacauuuuu

SEQ ID NO: 3479199 - RNA, 11 nt, Human
acaauguuaag

SEQ ID NO: 3479200 - RNA, 21 nt, Human
acaauguucaucccaugaugu

SEQ ID NO: 3479201 - RNA, 17 nt, Human
acaauguuuaaaccuuu

SEQ ID NO: 3479202 - RNA, 13 nt, Human
acaauguuuacaa

SEQ ID NO: 3479203 - RNA, 21 nt, Human
acaauuaaaaaccugauggaa

SEQ ID NO: 3479204 - RNA, 19 nt, Human
acaauuaaagcuguuauuu

SEQ ID NO: 3479205 - RNA, 17 nt, Human
acaauuaauaguuuguc

SEQ ID NO: 3479206 - RNA, 13 nt, Human
acaauuagauuuc

SEQ ID NO: 3479207 - RNA, 12 nt, Human
acaauuauaaac

SEQ ID NO: 3479208 - RNA, 21 nt, Human
acaauuauuccaaaccaaauu

SEQ ID NO: 3479209 - RNA, 22 nt, Human
acaauuauuccaaaccaaauuu

SEQ ID NO: 3479210 - RNA, 15 nt, Human
acaauucuacauugu

SEQ ID NO: 3479211 - RNA, 21 nt, Human
acaauucucccgggacucugc

SEQ ID NO: 3479212 - RNA, 14 nt, Human
acaauucuuuauac

SEQ ID NO: 3479213 - RNA, 18 nt, Human
acaauucuuuauacaaca

SEQ ID NO: 3479214 - RNA, 19 nt, Human
acaauugaacuuaaauaaa

SEQ ID NO: 3479215 - RNA, 13 nt, Human
acaauugaaguaa

SEQ ID NO: 3479216 - RNA, 16 nt, Human
acaauugaaguaaacu

SEQ ID NO: 3479217 - RNA, 15 nt, Human
acaauugguaaaacu

SEQ ID NO: 3479218 - RNA, 23 nt, Human
acaauugguaaaacucacuguga

SEQ ID NO: 3479219 - RNA, 19 nt, Human
acaauuguccauggucuca

SEQ ID NO: 3479220 - RNA, 21 nt, Human
acaauuguuugggguugaaaa

SEQ ID NO: 3479221 - RNA, 22 nt, Human
acaauuguuuuaaucugaaauu

SEQ ID NO: 3479222 - RNA, 23 nt, Human
acaauuguuuuaaucugaaauuc

SEQ ID NO: 3479223 - RNA, 17 nt, Human
acaauuuacaaagugug

SEQ ID NO: 3479224 - RNA, 12 nt, Human
acaauuuauuuu

SEQ ID NO: 3479225 - RNA, 14 nt, Human
acaauuuauuuuau

SEQ ID NO: 3479226 - RNA, 16 nt, Human
acaauuuccuuuauau

SEQ ID NO: 3479227 - RNA, 13 nt, Human
acaauuucugugu

SEQ ID NO: 3479228 - RNA, 16 nt, Human
acaauuugauacauaa

SEQ ID NO: 3479229 - RNA, 21 nt, Human
acaauuugauacauaauaaaa

SEQ ID NO: 3479230 - RNA, 20 nt, Human
acaauuuggcaauuuugugg

SEQ ID NO: 3479231 - RNA, 12 nt, Human
acaauuuuaaga

SEQ ID NO: 3479232 - RNA, 13 nt, Human
acaauuuucagau

SEQ ID NO: 3479233 - RNA, 14 nt, Human
acaauuuucagauu

SEQ ID NO: 3479234 - RNA, 21 nt, Human
acaauuuucagauuugcacaa

SEQ ID NO: 3479235 - RNA, 13 nt, Human
acaauuuucuugu

SEQ ID NO: 3479236 - RNA, 18 nt, Human
acaauuuucuugugacag

SEQ ID NO: 3479237 - RNA, 14 nt, Human
acaauuuuguuucu

SEQ ID NO: 3479238 - RNA, 15 nt, Human
acaauuuuguuucug

SEQ ID NO: 3479239 - RNA, 18 nt, Human
acaauuuuguuucuguac

SEQ ID NO: 3479240 - RNA, 19 nt, Human
acaauuuuuauuucuuuua

SEQ ID NO: 3479241 - RNA, 14 nt, Human
acaauuuuuuuaau

SEQ ID NO: 3479242 - RNA, 19 nt, Human
acaauuuuuuuaauuuugu

SEQ ID NO: 3479243 - RNA, 19 nt, Human
acacaaaacuccgccccca

SEQ ID NO: 3479244 - RNA, 17 nt, Human
acacaaacacauuguua

SEQ ID NO: 3479245 - RNA, 16 nt, Human
acacaaacuguaaaua

SEQ ID NO: 3479246 - RNA, 18 nt, Human
acacaaagcuuuugcaua

SEQ ID NO: 3479247 - RNA, 20 nt, Human
acacaaagcuuuugcauauu

SEQ ID NO: 3479248 - RNA, 21 nt, Human
acacaaaggaagugcccccuc

SEQ ID NO: 3479249 - RNA, 18 nt, Human
acacaaauacuuauucau

SEQ ID NO: 3479250 - RNA, 12 nt, Human
acacaaaugaua

SEQ ID NO: 3479251 - RNA, 18 nt, Human
acacaaauuaucuuaaaa

SEQ ID NO: 3479252 - RNA, 18 nt, Human
acacaacagccaacagcu

SEQ ID NO: 3479253 - RNA, 19 nt, Human
acacaacagccaacagcua

SEQ ID NO: 3479254 - RNA, 16 nt, Human
acacaagauugguguu

SEQ ID NO: 3479255 - RNA, 17 nt, Human
acacaagauugguguuu

SEQ ID NO: 3479256 - RNA, 14 nt, Human
acacaagccacaga

SEQ ID NO: 3479257 - RNA, 16 nt, Human
acacaagccacagaag

SEQ ID NO: 3479258 - RNA, 17 nt, Human
acacaagcccacagcac

SEQ ID NO: 3479259 - RNA, 14 nt, Human
acacaagcuggaag

SEQ ID NO: 3479260 - RNA, 15 nt, Human
acacaagcuggaagc

SEQ ID NO: 3479261 - RNA, 22 nt, Human
acacaagcuuuuuuacacaaau

SEQ ID NO: 3479262 - RNA, 19 nt, Human
acacaaggauagaugcugg

SEQ ID NO: 3479263 - RNA, 14 nt, Human
acacaaguaaacau

SEQ ID NO: 3479264 - RNA, 19 nt, Human
acacaaguaagagacucag

SEQ ID NO: 3479265 - RNA, 23 nt, Human
acacaaguaagagacucagccug

SEQ ID NO: 3479266 - RNA, 16 nt, Human
acacaaguccugugaa

SEQ ID NO: 3479267 - RNA, 22 nt, Human
acacaaugguuuuuaaauuuug

SEQ ID NO: 3479268 - RNA, 14 nt, Human
acacaaugugucug

SEQ ID NO: 3479269 - RNA, 13 nt, Human
acacaauguuauu

SEQ ID NO: 3479270 - RNA, 22 nt, Human
acacacaaauuaucuuaaaacu

SEQ ID NO: 3479271 - RNA, 15 nt, Human
acacacaacagccaa

SEQ ID NO: 3479272 - RNA, 13 nt, Human
acacacacaaacc

SEQ ID NO: 3479273 - RNA, 14 nt, Human
acacacacaaagag

SEQ ID NO: 3479274 - RNA, 10 nt, Human
acacacacac

SEQ ID NO: 3479275 - RNA, 12 nt, Human
acacacacacac

SEQ ID NO: 3479276 - RNA, 15 nt, Human
acacacacacacaaa

SEQ ID NO: 3479277 - RNA, 14 nt, Human
acacacacacacac

SEQ ID NO: 3479278 - RNA, 16 nt, Human
acacacacacacacac

SEQ ID NO: 3479279 - RNA, 16 nt, Human
acacacacacacacag

SEQ ID NO: 3479280 - RNA, 15 nt, Human
acacacacacacauc

SEQ ID NO: 3479281 - RNA, 15 nt, Human
acacacacacacaug

SEQ ID NO: 3479282 - RNA, 17 nt, Human
acacacacacacaugca

SEQ ID NO: 3479283 - RNA, 13 nt, Human
acacacacacagc

SEQ ID NO: 3479284 - RNA, 13 nt, Human
acacacacacagg

SEQ ID NO: 3479285 - RNA, 14 nt, Human
acacacacacagga

SEQ ID NO: 3479286 - RNA, 13 nt, Human
acacacacacaua

SEQ ID NO: 3479287 - RNA, 14 nt, Human
acacacacacauac

SEQ ID NO: 3479288 - RNA, 17 nt, Human
acacacacacaugcaua

SEQ ID NO: 3479289 - RNA, 12 nt, Human
acacacacagaa

SEQ ID NO: 3479290 - RNA, 13 nt, Human
acacacacagaaa

SEQ ID NO: 3479291 - RNA, 15 nt, Human
acacacacagccaca

SEQ ID NO: 3479292 - RNA, 16 nt, Human
acacacacagccacac

SEQ ID NO: 3479293 - RNA, 12 nt, Human
acacacacagcu

SEQ ID NO: 3479294 - RNA, 13 nt, Human
acacacacagcuu

SEQ ID NO: 3479295 - RNA, 11 nt, Human
acacacacagg

SEQ ID NO: 3479296 - RNA, 13 nt, Human
acacacacauaca

SEQ ID NO: 3479297 - RNA, 13 nt, Human
acacacacaugca

SEQ ID NO: 3479298 - RNA, 15 nt, Human
acacacacaugcaca

SEQ ID NO: 3479299 - RNA, 16 nt, Human
acacacagaaaagcau

SEQ ID NO: 3479300 - RNA, 14 nt, Human
acacacagaaaaua

SEQ ID NO: 3479301 - RNA, 20 nt, Human
acacacagaaaauauacugu

SEQ ID NO: 3479302 - RNA, 13 nt, Human
acacacagacaca

SEQ ID NO: 3479303 - RNA, 11 nt, Human
acacacagcca

SEQ ID NO: 3479304 - RNA, 15 nt, Human
acacacagccacaca

SEQ ID NO: 3479305 - RNA, 20 nt, Human
acacacagcuaacacacagc

SEQ ID NO: 3479306 - RNA, 12 nt, Human
acacacagcucu

SEQ ID NO: 3479307 - RNA, 19 nt, Human
acacacagcucuguccugg

SEQ ID NO: 3479308 - RNA, 13 nt, Human
acacacaggagga

SEQ ID NO: 3479309 - RNA, 23 nt, Human
acacacagguggugucacugucc

SEQ ID NO: 3479310 - RNA, 12 nt, Human
acacacaguacg

SEQ ID NO: 3479311 - RNA, 12 nt, Human
acacacauaaag

SEQ ID NO: 3479312 - RNA, 21 nt, Human
acacacauauaaacaucacac

SEQ ID NO: 3479313 - RNA, 18 nt, Human
acacacauauauuauuug

SEQ ID NO: 3479314 - RNA, 12 nt, Human
acacacaugcac

SEQ ID NO: 3479315 - RNA, 15 nt, Human
acacacaugcauaca

SEQ ID NO: 3479316 - RNA, 17 nt, Human
acacaccaccacgccug

SEQ ID NO: 3479317 - RNA, 20 nt, Human
acacaccaccacgccuggcu

SEQ ID NO: 3479318 - RNA, 15 nt, Human
acacaccagagccca

SEQ ID NO: 3479319 - RNA, 14 nt, Human
acacaccuaacuua

SEQ ID NO: 3479320 - RNA, 17 nt, Human
acacaccuaagggacau

SEQ ID NO: 3479321 - RNA, 15 nt, Human
acacaccucaccaga

SEQ ID NO: 3479322 - RNA, 11 nt, Human
acacaccugua

SEQ ID NO: 3479323 - RNA, 17 nt, Human
acacaccuuuaaguaga

SEQ ID NO: 3479324 - RNA, 14 nt, Human
acacacgcacgcac

SEQ ID NO: 3479325 - RNA, 18 nt, Human
acacacgcacgcacacac

SEQ ID NO: 3479326 - RNA, 16 nt, Human
acacacgcaggaacuc

SEQ ID NO: 3479327 - RNA, 15 nt, Human
acacacgcgcgcaca

SEQ ID NO: 3479328 - RNA, 21 nt, Human
acacacgcgugcacacaccag

SEQ ID NO: 3479329 - RNA, 13 nt, Human
acacacgcugccu

SEQ ID NO: 3479330 - RNA, 16 nt, Human
acacacggugccuuua

SEQ ID NO: 3479331 - RNA, 13 nt, Human
acacacuacacca

SEQ ID NO: 3479332 - RNA, 20 nt, Human
acacacuaccgaaugugucu

SEQ ID NO: 3479333 - RNA, 13 nt, Human
acacacugaagaa

SEQ ID NO: 3479334 - RNA, 18 nt, Human
acacacugaggcagggaa

SEQ ID NO: 3479335 - RNA, 15 nt, Human
acacacugaugcuua

SEQ ID NO: 3479336 - RNA, 17 nt, Human
acacacuguacacauaa

SEQ ID NO: 3479337 - RNA, 16 nt, Human
acacacugugcuuucu

SEQ ID NO: 3479338 - RNA, 17 nt, Human
acacacugugcuuucua

SEQ ID NO: 3479339 - RNA, 22 nt, Human
acacacugugcuuucuauugua

SEQ ID NO: 3479340 - RNA, 14 nt, Human
acacacuuuuuaag

SEQ ID NO: 3479341 - RNA, 15 nt, Human
acacagaaaauauac

SEQ ID NO: 3479342 - RNA, 16 nt, Human
acacagaaaauauacu

SEQ ID NO: 3479343 - RNA, 19 nt, Human
acacagaaaauauacugua

SEQ ID NO: 3479344 - RNA, 20 nt, Human
acacagaaaauauacuguaa

SEQ ID NO: 3479345 - RNA, 21 nt, Human
acacagaaaauauacuguaaa

SEQ ID NO: 3479346 - RNA, 22 nt, Human
acacagaaaauauacuguaaag

SEQ ID NO: 3479347 - RNA, 12 nt, Human
acacagaaacac

SEQ ID NO: 3479348 - RNA, 19 nt, Human
acacagaaaccuuuuuaaa

SEQ ID NO: 3479349 - RNA, 14 nt, Human
acacagaaauauau

SEQ ID NO: 3479350 - RNA, 14 nt, Human
acacagaaaugcug

SEQ ID NO: 3479351 - RNA, 17 nt, Human
acacagaaaugcugcug

SEQ ID NO: 3479352 - RNA, 18 nt, Human
acacagaaaugcugcugg

SEQ ID NO: 3479353 - RNA, 16 nt, Human
acacagaaugcaacca

SEQ ID NO: 3479354 - RNA, 21 nt, Human
acacagacacuaacgaaauau

SEQ ID NO: 3479355 - RNA, 11 nt, Human
acacagaccac

SEQ ID NO: 3479356 - RNA, 16 nt, Human
acacagacuauugaca

SEQ ID NO: 3479357 - RNA, 16 nt, Human
acacagacucauauua

SEQ ID NO: 3479358 - RNA, 23 nt, Human
acacagacugcgauuugucccag

SEQ ID NO: 3479359 - RNA, 22 nt, Human
acacagagaagcggauuuccag

SEQ ID NO: 3479360 - RNA, 19 nt, Human
acacagaguggucuuucug

SEQ ID NO: 3479361 - RNA, 14 nt, Human
acaggcacccacca

SEQ ID NO: 3479362 - RNA, 17 nt, Human
acaggcaccgagaaugu

SEQ ID NO: 3479363 - RNA, 20 nt, Human
acaggcaccgagaauguugu

SEQ ID NO: 3479364 - RNA, 16 nt, Human
acaggcacuuggcagc

SEQ ID NO: 3479365 - RNA, 20 nt, Human
acaggcacuuggcagccuug

SEQ ID NO: 3479366 - RNA, 14 nt, Human
acaggcagaaagag

SEQ ID NO: 3479367 - RNA, 14 nt, Human
acaggcagcagaga

SEQ ID NO: 3479368 - RNA, 22 nt, Human
acaggcagccuggacauagaga

SEQ ID NO: 3479369 - RNA, 18 nt, Human
acaggcagcuuucuagaa

SEQ ID NO: 3479370 - RNA, 19 nt, Human
acaggcagcuuucuagaag

SEQ ID NO: 3479371 - RNA, 18 nt, Human
acaggcagggcaggacca

SEQ ID NO: 3479372 - RNA, 21 nt, Human
acaggcagggcaggaccagcc

SEQ ID NO: 3479373 - RNA, 13 nt, Human
acaggcaggucca

SEQ ID NO: 3479374 - RNA, 21 nt, Human
acaggcaugggugcaaggaaa

SEQ ID NO: 3479375 - RNA, 20 nt, Human
acaggcauguucucugagga

SEQ ID NO: 3479376 - RNA, 17 nt, Human
acaggcauuuccugggu

SEQ ID NO: 3479377 - RNA, 17 nt, Human
acaggcauuuguucacu

SEQ ID NO: 3479378 - RNA, 16 nt, Human
acaggccacccugugc

SEQ ID NO: 3479379 - RNA, 18 nt, Human
acaggcccaagagaugaa

SEQ ID NO: 3479380 - RNA, 13 nt, Human
acaggcccagcau

SEQ ID NO: 3479381 - RNA, 20 nt, Human
acaggcccagcauugcuggu

SEQ ID NO: 3479382 - RNA, 22 nt, Human
acaggcccggcgcgguggcuca

SEQ ID NO: 3479383 - RNA, 16 nt, Human
acaggcccggcuccag

SEQ ID NO: 3479384 - RNA, 20 nt, Human
acaggcccggcuccaggcuc

SEQ ID NO: 3479385 - RNA, 21 nt, Human
acaggcccucccuguucccca

SEQ ID NO: 3479386 - RNA, 23 nt, Human
acaggcccucccuguuccccaga

SEQ ID NO: 3479387 - RNA, 23 nt, Human
acaggcccuccucccucccagcu

SEQ ID NO: 3479388 - RNA, 17 nt, Human
acaggcccuggcugagg

SEQ ID NO: 3479389 - RNA, 15 nt, Human
acaggcccuuccucu

SEQ ID NO: 3479390 - RNA, 13 nt, Human
acaggccucaccu

SEQ ID NO: 3479391 - RNA, 15 nt, Human
acaggccucagggcu

SEQ ID NO: 3479392 - RNA, 13 nt, Human
acaggccucccug

SEQ ID NO: 3479393 - RNA, 23 nt, Human
acaggccucuccauuugcucuuc

SEQ ID NO: 3479394 - RNA, 14 nt, Human
acaggccugaagau

SEQ ID NO: 3479395 - RNA, 15 nt, Human
acaggccugaagaua

SEQ ID NO: 3479396 - RNA, 20 nt, Human
acaggccugaagauauuacu

SEQ ID NO: 3479397 - RNA, 17 nt, Human
acaggccugagauuuca

SEQ ID NO: 3479398 - RNA, 23 nt, Human
acaggccuguguagcugugaccu

SEQ ID NO: 3479399 - RNA, 16 nt, Human
acaggcgaaagaaaac

SEQ ID NO: 3479400 - RNA, 14 nt, Human
acaggcgaggccug

SEQ ID NO: 3479401 - RNA, 18 nt, Human
acaggcuacucuccucgg

SEQ ID NO: 3479402 - RNA, 14 nt, Human
acaggcucaauauu

SEQ ID NO: 3479403 - RNA, 15 nt, Human
acaggcuccugccac

SEQ ID NO: 3479404 - RNA, 13 nt, Human
acaggcucuuagc

SEQ ID NO: 3479405 - RNA, 20 nt, Human
acaggcugacguuccgggca

SEQ ID NO: 3479406 - RNA, 17 nt, Human
acaggcugagugcaggc

SEQ ID NO: 3479407 - RNA, 21 nt, Human
acaggcugcggccccuccccc

SEQ ID NO: 3479408 - RNA, 20 nt, Human
acaggcuggaagauagcugu

SEQ ID NO: 3479409 - RNA, 17 nt, Human
acaggcugggcugggca

SEQ ID NO: 3479410 - RNA, 21 nt, Human
acaggcugggcugggcacugc

SEQ ID NO: 3479411 - RNA, 23 nt, Human
acaggcugggcuucaguggcagc

SEQ ID NO: 3479412 - RNA, 14 nt, Human
acaggcuuagugau

SEQ ID NO: 3479413 - RNA, 17 nt, Human
acaggcuucugagcagc

SEQ ID NO: 3479414 - RNA, 18 nt, Human
acaggcuucugagcagcg

SEQ ID NO: 3479415 - RNA, 23 nt, Human
acaggcuucugagcagcgagccu

SEQ ID NO: 3479416 - RNA, 22 nt, Human
acagggaacccugcuugcacuu

SEQ ID NO: 3479417 - RNA, 13 nt, Human
acagggaagcuac

SEQ ID NO: 3479418 - RNA, 14 nt, Human
acagggaagcuaca

SEQ ID NO: 3479419 - RNA, 18 nt, Human
acagggaagcuacagguu

SEQ ID NO: 3479420 - RNA, 12 nt, Human
acagggaaggca

SEQ ID NO: 3479421 - RNA, 17 nt, Human
acagggaaggcaggcag

SEQ ID NO: 3479422 - RNA, 19 nt, Human
acagggaaggcaggcaggg

SEQ ID NO: 3479423 - RNA, 20 nt, Human
acagggaaggcaggcagggc

SEQ ID NO: 3479424 - RNA, 22 nt, Human
acagggaaggcaggcagggcuc

SEQ ID NO: 3479425 - RNA, 14 nt, Human
acagggagccuccu

SEQ ID NO: 3479426 - RNA, 21 nt, Human
acagggaggacgcucucuggc

SEQ ID NO: 3479427 - RNA, 14 nt, Human
acagggaugagcau

SEQ ID NO: 3479428 - RNA, 15 nt, Human
acagggauucucaca

SEQ ID NO: 3479429 - RNA, 16 nt, Human
acagggauugauuuua

SEQ ID NO: 3479430 - RNA, 20 nt, Human
acagggcacaccgggcacuc

SEQ ID NO: 3479431 - RNA, 13 nt, Human
acagggcacaggc

SEQ ID NO: 3479432 - RNA, 17 nt, Human
acagggcaccugccacc

SEQ ID NO: 3479433 - RNA, 17 nt, Human
acagggcagcugggccc

SEQ ID NO: 3479434 - RNA, 21 nt, Human
acagggcaucuccaggaaggc

SEQ ID NO: 3479435 - RNA, 22 nt, Human
acagggcaugccccggccaccu

SEQ ID NO: 3479436 - RNA, 23 nt, Human
acagggccaguggggccugugga

SEQ ID NO: 3479437 - RNA, 13 nt, Human
acagggccucugc

SEQ ID NO: 3479438 - RNA, 17 nt, Human
acagggccucugcggag

SEQ ID NO: 3479439 - RNA, 12 nt, Human
acagggccuggc

SEQ ID NO: 3479440 - RNA, 13 nt, Human
acagggccuggcc

SEQ ID NO: 3479441 - RNA, 14 nt, Human
acagggccuggccc

SEQ ID NO: 3479442 - RNA, 15 nt, Human
acagggccuggccca

SEQ ID NO: 3479443 - RNA, 16 nt, Human
acagggccuggcccau

SEQ ID NO: 3479444 - RNA, 17 nt, Human
acagggccuggcccaug

SEQ ID NO: 3479445 - RNA, 16 nt, Human
acagggcuggcccagc

SEQ ID NO: 3479446 - RNA, 17 nt, Human
acagggcuggcccagcc

SEQ ID NO: 3479447 - RNA, 19 nt, Human
acagggcuggcccagcccu

SEQ ID NO: 3479448 - RNA, 21 nt, Human
acagggcuggcccagcccugc

SEQ ID NO: 3479449 - RNA, 20 nt, Human
acaggggaagguggccucug

SEQ ID NO: 3479450 - RNA, 19 nt, Human
acaggggaauauuuuauuc

SEQ ID NO: 3479451 - RNA, 16 nt, Human
acaggggaggugauag

SEQ ID NO: 3479452 - RNA, 12 nt, Human
acaggggccaga

SEQ ID NO: 3479453 - RNA, 12 nt, Human
acaggggcuggu

SEQ ID NO: 3479454 - RNA, 16 nt, Human
acagggggucuggcug

SEQ ID NO: 3479455 - RNA, 18 nt, Human
acagggggucuggcuggu

SEQ ID NO: 3479456 - RNA, 12 nt, Human
acagggguuccu

SEQ ID NO: 3479457 - RNA, 13 nt, Human
acagggguuccuu

SEQ ID NO: 3479458 - RNA, 17 nt, Human
acaggguaaauuauuca

SEQ ID NO: 3479459 - RNA, 18 nt, Human
acaggguaacugugcuga

SEQ ID NO: 3479460 - RNA, 14 nt, Human
acaggguccugcua

SEQ ID NO: 3479461 - RNA, 21 nt, Human
acagggucucuagugcuguga

SEQ ID NO: 3479462 - RNA, 23 nt, Human
acagggucucuagugcugugaaa

SEQ ID NO: 3479463 - RNA, 14 nt, Human
acagggucugcucu

SEQ ID NO: 3479464 - RNA, 14 nt, Human
acaggguugggccc

SEQ ID NO: 3479465 - RNA, 22 nt, Human
acaggguuuggcugugucuaaa

SEQ ID NO: 3479466 - RNA, 23 nt, Human
acaggguuuggcugugucuaaac

SEQ ID NO: 3479467 - RNA, 14 nt, Human
acaggguuuuuacc

SEQ ID NO: 3479468 - RNA, 20 nt, Human
acaggguuuuuaccugucac

SEQ ID NO: 3479469 - RNA, 15 nt, Human
acagguaaaacaggg

SEQ ID NO: 3479470 - RNA, 17 nt, Human
acagguaccaguucuuu

SEQ ID NO: 3479471 - RNA, 15 nt, Human
acagguacuuugucu

SEQ ID NO: 3479472 - RNA, 16 nt, Human
acagguauauacuuug

SEQ ID NO: 3479473 - RNA, 18 nt, Human
acagguauuuuguuucuu

SEQ ID NO: 3479474 - RNA, 13 nt, Human
acaggucccaccu

SEQ ID NO: 3479475 - RNA, 21 nt, Human
acaggucccaccuccagcccg

SEQ ID NO: 3479476 - RNA, 15 nt, Human
acaggucccuccccu

SEQ ID NO: 3479477 - RNA, 18 nt, Human
acagguggacacacaagg

SEQ ID NO: 3479478 - RNA, 15 nt, Human
acagguggcaggacc

SEQ ID NO: 3479479 - RNA, 18 nt, Human
acaggugugguguaauuu

SEQ ID NO: 3479480 - RNA, 21 nt, Human
acaggugugguguaauuuaua

SEQ ID NO: 3479481 - RNA, 17 nt, Human
acagguguuggugacaa

SEQ ID NO: 3479482 - RNA, 12 nt, Human
acagguuacaac

SEQ ID NO: 3479483 - RNA, 14 nt, Human
acagguuacaacag

SEQ ID NO: 3479484 - RNA, 15 nt, Human
acagguuacaacaga

SEQ ID NO: 3479485 - RNA, 17 nt, Human
acagguuacaacagauu

SEQ ID NO: 3479486 - RNA, 20 nt, Human
acagguuacaacagauuugu

SEQ ID NO: 3479487 - RNA, 23 nt, Human
acagguuauuuuaguuucuguuc

SEQ ID NO: 3479488 - RNA, 15 nt, Human
acagguuggaagaga

SEQ ID NO: 3479489 - RNA, 15 nt, Human
acagguuugggaccc

SEQ ID NO: 3479490 - RNA, 12 nt, Human
acaguaaacauu

SEQ ID NO: 3479491 - RNA, 15 nt, Human
acaguaaaccacuga

SEQ ID NO: 3479492 - RNA, 17 nt, Human
acaguaaaccacugaaa

SEQ ID NO: 3479493 - RNA, 14 nt, Human
acaguaaauaaauu

SEQ ID NO: 3479494 - RNA, 17 nt, Human
acaguaaauaaauuguu

SEQ ID NO: 3479495 - RNA, 23 nt, Human
acaguaaauaaauuguuugacca

SEQ ID NO: 3479496 - RNA, 21 nt, Human
acaguaaauaucccaaacugu

SEQ ID NO: 3479497 - RNA, 15 nt, Human
acaguaacuuuaugu

SEQ ID NO: 3479498 - RNA, 21 nt, Human
acaguaacuuuauguguaaau

SEQ ID NO: 3479499 - RNA, 15 nt, Human
acaguaagauaucuc

SEQ ID NO: 3479500 - RNA, 14 nt, Human
acaguaaguuccua

SEQ ID NO: 3479501 - RNA, 13 nt, Human
acaguaauaaaug

SEQ ID NO: 3479502 - RNA, 13 nt, Human
acaguaaucaguu

SEQ ID NO: 3479503 - RNA, 14 nt, Human
acaguacacuguca

SEQ ID NO: 3479504 - RNA, 12 nt, Human
acaguacaggca

SEQ ID NO: 3479505 - RNA, 14 nt, Human
acaguacaggcagc

SEQ ID NO: 3479506 - RNA, 18 nt, Human
acaguacaggcagcacag

SEQ ID NO: 3479507 - RNA, 20 nt, Human
acaguacccugguugugugu

SEQ ID NO: 3479508 - RNA, 13 nt, Human
acaguagagccag

SEQ ID NO: 3479509 - RNA, 14 nt, Human
acaguaggagccca

SEQ ID NO: 3479510 - RNA, 14 nt, Human
acaguagucuugau

SEQ ID NO: 3479511 - RNA, 16 nt, Human
acaguauagauuuuug

SEQ ID NO: 3479512 - RNA, 13 nt, Human
acaguauauuuua

SEQ ID NO: 3479513 - RNA, 20 nt, Human
acaguaucucaaacaauuga

SEQ ID NO: 3479514 - RNA, 18 nt, Human
acaguaugcuugcucuaa

SEQ ID NO: 3479515 - RNA, 20 nt, Human
acaguauggggguuguaaau

SEQ ID NO: 3479516 - RNA, 21 nt, Human
acaguauggggguuguaaauu

SEQ ID NO: 3479517 - RNA, 15 nt, Human
acaguauuacuucug

SEQ ID NO: 3479518 - RNA, 17 nt, Human
acaguauucuguaccau

SEQ ID NO: 3479519 - RNA, 17 nt, Human
acaguauuuguaauuaa

SEQ ID NO: 3479520 - RNA, 17 nt, Human
acaguauuuugguucuu

SEQ ID NO: 3479521 - RNA, 18 nt, Human
acagucaaaacagagaug

SEQ ID NO: 3479522 - RNA, 13 nt, Human
acagucaaaauaa

SEQ ID NO: 3479523 - RNA, 14 nt, Human
acagucaaaauaau

SEQ ID NO: 3479524 - RNA, 18 nt, Human
acagucaccucauggaau

SEQ ID NO: 3479525 - RNA, 23 nt, Human
acagucacugccacuuugcacau

SEQ ID NO: 3479526 - RNA, 14 nt, Human
acagucacugcucu

SEQ ID NO: 3479527 - RNA, 15 nt, Human
acagucagauuucca

SEQ ID NO: 3479528 - RNA, 20 nt, Human
acagucagauuuccagucuc

SEQ ID NO: 3479529 - RNA, 15 nt, Human
acagucagcucuuca

SEQ ID NO: 3479530 - RNA, 16 nt, Human
acagucagcucuucau

SEQ ID NO: 3479531 - RNA, 17 nt, Human
acagucaucaucagggc

SEQ ID NO: 3479532 - RNA, 20 nt, Human
acagucaucaucagggccug

SEQ ID NO: 3479533 - RNA, 13 nt, Human
acagucauuuaaa

SEQ ID NO: 3479534 - RNA, 17 nt, Human
acagucauuugcgcaca

SEQ ID NO: 3479535 - RNA, 21 nt, Human
acagucauuugcgcacaacuu

SEQ ID NO: 3479536 - RNA, 14 nt, Human
acaguccagccugg

SEQ ID NO: 3479537 - RNA, 18 nt, Human
acaguccaggaacaagcu

SEQ ID NO: 3479538 - RNA, 13 nt, Human
acagucccugcca

SEQ ID NO: 3479539 - RNA, 22 nt, Human
acaguccuauuuagacauguaa

SEQ ID NO: 3479540 - RNA, 17 nt, Human
acaguccucccaucuca

SEQ ID NO: 3479541 - RNA, 23 nt, Human
acaguccucuccaccuaguggcu

SEQ ID NO: 3479542 - RNA, 23 nt, Human
acaguccuucaaaauccuuccaa

SEQ ID NO: 3479543 - RNA, 15 nt, Human
acagucuaaagcugg

SEQ ID NO: 3479544 - RNA, 21 nt, Human
acagucuaauuuuuauucaua

SEQ ID NO: 3479545 - RNA, 22 nt, Human
acagucuaauuuuuauucauaa

SEQ ID NO: 3479546 - RNA, 22 nt, Human
acagucucaccauuuccccagg

SEQ ID NO: 3479547 - RNA, 14 nt, Human
acagucucaggaaa

SEQ ID NO: 3479548 - RNA, 16 nt, Human
acagucucaggaaauc

SEQ ID NO: 3479549 - RNA, 18 nt, Human
acagucucugagaacugg

SEQ ID NO: 3479550 - RNA, 20 nt, Human
acagucucuuuaaucuucag

SEQ ID NO: 3479551 - RNA, 13 nt, Human
acagucugucaug

SEQ ID NO: 3479552 - RNA, 17 nt, Human
acagucugucuucugua

SEQ ID NO: 3479553 - RNA, 18 nt, Human
acagucuuguauuaaguu

SEQ ID NO: 3479554 - RNA, 13 nt, Human
acagugaagacag

SEQ ID NO: 3479555 - RNA, 16 nt, Human
acagugaaguuuuacu

SEQ ID NO: 3479556 - RNA, 23 nt, Human
acagugacucgggcuccugugcc

SEQ ID NO: 3479557 - RNA, 14 nt, Human
acagugagacucug

SEQ ID NO: 3479558 - RNA, 12 nt, Human
acagugagagac

SEQ ID NO: 3479559 - RNA, 17 nt, Human
acagugagccugaauuu

SEQ ID NO: 3479560 - RNA, 21 nt, Human
acagugagccugaauuuuguu

SEQ ID NO: 3479561 - RNA, 15 nt, Human
acagugagguccugg

SEQ ID NO: 3479562 - RNA, 18 nt, Human
acagugagguccuggggg

SEQ ID NO: 3479563 - RNA, 18 nt, Human
acagugauauuggaacuu

SEQ ID NO: 3479564 - RNA, 15 nt, Human
acagugaucuccaua

SEQ ID NO: 3479565 - RNA, 19 nt, Human
acagugauuaccagggacu

SEQ ID NO: 3479566 - RNA, 20 nt, Human
acagugauuaccagggacug

SEQ ID NO: 3479567 - RNA, 13 nt, Human
acagugauuuuuu

SEQ ID NO: 3479568 - RNA, 21 nt, Human
acagugcaccugggacaggga

SEQ ID NO: 3479569 - RNA, 14 nt, Human
acagugcagggcaa

SEQ ID NO: 3479570 - RNA, 19 nt, Human
acagugcagggcaaaauau

SEQ ID NO: 3479571 - RNA, 14 nt, Human
acagugcagugcgc

SEQ ID NO: 3479572 - RNA, 13 nt, Human
acagugcaucuca

SEQ ID NO: 3479573 - RNA, 18 nt, Human
acagugccaacuccucac

SEQ ID NO: 3479574 - RNA, 15 nt, Human
acagugccauugucu

SEQ ID NO: 3479575 - RNA, 17 nt, Human
acagugccauugucuuu

SEQ ID NO: 3479576 - RNA, 14 nt, Human
acagugccugcuga

SEQ ID NO: 3479577 - RNA, 14 nt, Human
acagugccugggaa

SEQ ID NO: 3479578 - RNA, 16 nt, Human
acagugcuaaaaaugg

SEQ ID NO: 3479579 - RNA, 15 nt, Human
acagugcuucagccu

SEQ ID NO: 3479580 - RNA, 20 nt, Human
acagugcuucagccugaggc

SEQ ID NO: 3479581 - RNA, 21 nt, Human
acagugcuucagccugaggcu

SEQ ID NO: 3479582 - RNA, 20 nt, Human
acagugcuugccacagagcg

SEQ ID NO: 3479583 - RNA, 16 nt, Human
acaguggaacuacauu

SEQ ID NO: 3479584 - RNA, 15 nt, Human
acaguggaucacaaa

SEQ ID NO: 3479585 - RNA, 18 nt, Human
acaguggaucacaaagug

SEQ ID NO: 3479586 - RNA, 19 nt, Human
acaguggauuguuuauacu

SEQ ID NO: 3479587 - RNA, 16 nt, Human
acagugggaacucuga

SEQ ID NO: 3479588 - RNA, 19 nt, Human
acagugggaacucugacaa

SEQ ID NO: 3479589 - RNA, 21 nt, Human
acagugggaacucugacaagg

SEQ ID NO: 3479590 - RNA, 15 nt, Human
acaguggggaagagu

SEQ ID NO: 3479591 - RNA, 23 nt, Human
acagugguggcaacauucauugc

SEQ ID NO: 3479592 - RNA, 17 nt, Human
acagugguggcagggcc

SEQ ID NO: 3479593 - RNA, 20 nt, Human
acagugguuuuauacugaag

SEQ ID NO: 3479594 - RNA, 12 nt, Human
acaguguacagu

SEQ ID NO: 3479595 - RNA, 17 nt, Human
acaguguacagucuugu

SEQ ID NO: 3479596 - RNA, 18 nt, Human
acaguguaccauuaaaau

SEQ ID NO: 3479597 - RNA, 23 nt, Human
acaguguaccauuaaaauaugca

SEQ ID NO: 3479598 - RNA, 18 nt, Human
acaguguauauugaaauu

SEQ ID NO: 3479599 - RNA, 15 nt, Human
acagugucccccagg

SEQ ID NO: 3479600 - RNA, 16 nt, Human
acagugucccccaggu

SEQ ID NO: 3479601 - RNA, 21 nt, Human
acagugucugggcugacuggg

SEQ ID NO: 3479602 - RNA, 11 nt, Human
acagugucuuu

SEQ ID NO: 3479603 - RNA, 19 nt, Human
acagugucuuuuuuuguau

SEQ ID NO: 3479604 - RNA, 12 nt, Human
acagugugaagu

SEQ ID NO: 3479605 - RNA, 13 nt, Human
acagugugaaguu

SEQ ID NO: 3479606 - RNA, 14 nt, Human
acagugugauuuug

SEQ ID NO: 3479607 - RNA, 13 nt, Human
acaguguguaaac

SEQ ID NO: 3479608 - RNA, 14 nt, Human
acaguguuaaauga

SEQ ID NO: 3479609 - RNA, 21 nt, Human
acaguguuaggccuggcacag

SEQ ID NO: 3479610 - RNA, 23 nt, Human
acaguguuaggccuggcacagug

SEQ ID NO: 3479611 - RNA, 16 nt, Human
acaguguuauuuucuu

SEQ ID NO: 3479612 - RNA, 14 nt, Human
acaguguucuguuu

SEQ ID NO: 3479613 - RNA, 17 nt, Human
acaguguucuguuuaau

SEQ ID NO: 3479614 - RNA, 22 nt, Human
acaguguucuguuuaauacuca

SEQ ID NO: 3479615 - RNA, 9 nt, Human
acaguguuu

SEQ ID NO: 3479616 - RNA, 21 nt, Human
acaguguuuauccuuucauau

SEQ ID NO: 3479617 - RNA, 22 nt, Human
acaguguuucccauaauuuucu

SEQ ID NO: 3479618 - RNA, 17 nt, Human
acaguguuugcaauggu

SEQ ID NO: 3479619 - RNA, 13 nt, Human
acaguuaacuuuc

SEQ ID NO: 3479620 - RNA, 19 nt, Human
acaguuacauaauucacuc

SEQ ID NO: 3479621 - RNA, 16 nt, Human
acaguuacuuuuccuu

SEQ ID NO: 3479622 - RNA, 22 nt, Human
acaguuaggguugaguuacuuc

SEQ ID NO: 3479623 - RNA, 16 nt, Human
acaguuaucuaaguua

SEQ ID NO: 3479624 - RNA, 13 nt, Human
acaguuauuacau

SEQ ID NO: 3479625 - RNA, 15 nt, Human
acaguuauuuugaua

SEQ ID NO: 3479626 - RNA, 21 nt, Human
acaguucaaaauucuaaaugu

SEQ ID NO: 3479627 - RNA, 21 nt, Human
acaguucaauaaacuuaacuu

SEQ ID NO: 3479628 - RNA, 20 nt, Human
acaguucaauucucauuugu

SEQ ID NO: 3479629 - RNA, 14 nt, Human
acaguucacacccu

SEQ ID NO: 3479630 - RNA, 20 nt, Human
acaguucaguggcagggcuc

SEQ ID NO: 3479631 - RNA, 23 nt, Human
acaguucaguggcagggcucagg

SEQ ID NO: 3479632 - RNA, 19 nt, Human
acaguuccaaucaguagcu

SEQ ID NO: 3479633 - RNA, 12 nt, Human
acaguuccucgc

SEQ ID NO: 3479634 - RNA, 15 nt, Human
acaguuccucgcccu

SEQ ID NO: 3479635 - RNA, 16 nt, Human
acaguuccucgcccug

SEQ ID NO: 3479636 - RNA, 21 nt, Human
acaguuccugggaacaucaca

SEQ ID NO: 3479637 - RNA, 13 nt, Human
acaguuccuucag

SEQ ID NO: 3479638 - RNA, 21 nt, Human
acaguucugcucugguuguuu

SEQ ID NO: 3479639 - RNA, 20 nt, Human
acaguucuucgggaagagag

SEQ ID NO: 3479640 - RNA, 23 nt, Human
acaguucuugugugguuuggccc

SEQ ID NO: 3479641 - RNA, 18 nt, Human
acaguucuuugggccaga

SEQ ID NO: 3479642 - RNA, 20 nt, Human
acaguucuuugggccagaca

SEQ ID NO: 3479643 - RNA, 22 nt, Human
acaguucuuuuguuguaaagag

SEQ ID NO: 3479644 - RNA, 15 nt, Human
acaguugaaaaacag

SEQ ID NO: 3479645 - RNA, 13 nt, Human
acaguugcacagc

SEQ ID NO: 3479646 - RNA, 15 nt, Human
acaguugcacagcau

SEQ ID NO: 3479647 - RNA, 23 nt, Human
acaguugcauguaguaacacuaa

SEQ ID NO: 3479648 - RNA, 19 nt, Human
acaguugccaccaccucug

SEQ ID NO: 3479649 - RNA, 21 nt, Human
acaguugccaccaccucugug

SEQ ID NO: 3479650 - RNA, 15 nt, Human
acaguugcugucaua

SEQ ID NO: 3479651 - RNA, 18 nt, Human
acaguugcuguuguguga

SEQ ID NO: 3479652 - RNA, 20 nt, Human
acaguugggaaaauaugucc

SEQ ID NO: 3479653 - RNA, 18 nt, Human
acaguuguauuuaacaga

SEQ ID NO: 3479654 - RNA, 12 nt, Human
acaguuguuuga

SEQ ID NO: 3479655 - RNA, 20 nt, Human
acaguuuaauaccacagcuu

SEQ ID NO: 3479656 - RNA, 19 nt, Human
acaguuuaaugaagaucua

SEQ ID NO: 3479657 - RNA, 17 nt, Human
acaguuuaugcagugcu

SEQ ID NO: 3479658 - RNA, 19 nt, Human
acaguuuaugcagugcugc

SEQ ID NO: 3479659 - RNA, 14 nt, Human
acaguuucuuagcu

SEQ ID NO: 3479660 - RNA, 16 nt, Human
acaguuucuuagcuuu

SEQ ID NO: 3479661 - RNA, 17 nt, Human
acaguuucuuagcuuuu

SEQ ID NO: 3479662 - RNA, 22 nt, Human
acaguuucuuagcuuuuuaauu

SEQ ID NO: 3479663 - RNA, 19 nt, Human
acaguuucuuuuuucuuac

SEQ ID NO: 3479664 - RNA, 20 nt, Human
acaguuugaaauaagcuauu

SEQ ID NO: 3479665 - RNA, 22 nt, Human
acaguuugaaauaagcuauuug

SEQ ID NO: 3479666 - RNA, 18 nt, Human
acaguuuguaaauguuau

SEQ ID NO: 3479667 - RNA, 16 nt, Human
acaguuuguuaguaug

SEQ ID NO: 3479668 - RNA, 17 nt, Human
acaguuuuaacugugga

SEQ ID NO: 3479669 - RNA, 13 nt, Human
acaguuuuaugcu

SEQ ID NO: 3479670 - RNA, 16 nt, Human
acaguuuuaugcucuu

SEQ ID NO: 3479671 - RNA, 20 nt, Human
acaguuuuaugcucuuuuuu

SEQ ID NO: 3479672 - RNA, 17 nt, Human
acaguuuuccaugaaaa

SEQ ID NO: 3479673 - RNA, 21 nt, Human
acaguuuuccaugaaaacguu

SEQ ID NO: 3479674 - RNA, 19 nt, Human
acaguuuucugagaaagac

SEQ ID NO: 3479675 - RNA, 20 nt, Human
acaguuuugagaacguaaag

SEQ ID NO: 3479676 - RNA, 19 nt, Human
acaguuuugguugcuuuaa

SEQ ID NO: 3479677 - RNA, 13 nt, Human
acaguuuugugaa

SEQ ID NO: 3479678 - RNA, 14 nt, Human
acaguuuuuaaacu

SEQ ID NO: 3479679 - RNA, 12 nt, Human
acauaaaaaguu

SEQ ID NO: 3479680 - RNA, 22 nt, Human
acauaaaaaguuaaaaaaaaua

SEQ ID NO: 3479681 - RNA, 11 nt, Human
acauaaacauc

SEQ ID NO: 3479682 - RNA, 21 nt, Human
acauaaaccauuuuuguuacu

SEQ ID NO: 3479683 - RNA, 13 nt, Human
acauaaacugacu

SEQ ID NO: 3479684 - RNA, 22 nt, Human
acauaaaggaaaagacacauuu

SEQ ID NO: 3479685 - RNA, 14 nt, Human
acauaaaucuguga

SEQ ID NO: 3479686 - RNA, 20 nt, Human
acauaaauugcauaaagcau

SEQ ID NO: 3479687 - RNA, 14 nt, Human
acauaacaaaauca

SEQ ID NO: 3479688 - RNA, 17 nt, Human
acauaacaaaaucacuu

SEQ ID NO: 3479689 - RNA, 15 nt, Human
acauaacagaaugca

SEQ ID NO: 3479690 - RNA, 16 nt, Human
acauaaccacugcuuc

SEQ ID NO: 3479691 - RNA, 12 nt, Human
acauaacuaaau

SEQ ID NO: 3479692 - RNA, 13 nt, Human
acauaacuaaauu

SEQ ID NO: 3479693 - RNA, 23 nt, Human
acauaacuaaauuugauacuuau

SEQ ID NO: 3479694 - RNA, 18 nt, Human
acauaacugacuuaguuc

SEQ ID NO: 3479695 - RNA, 17 nt, Human
acauaagaucacugcca

SEQ ID NO: 3479696 - RNA, 18 nt, Human
acauaagccauuauucac

SEQ ID NO: 3479697 - RNA, 12 nt, Human
acauaagcuauu

SEQ ID NO: 3479698 - RNA, 13 nt, Human
acauaagcuauuu

SEQ ID NO: 3479699 - RNA, 18 nt, Human
acauaagcuauuuuucua

SEQ ID NO: 3479700 - RNA, 15 nt, Human
acauaagcuuccauu

SEQ ID NO: 3479701 - RNA, 17 nt, Human
acauaagcuuccauuuu

SEQ ID NO: 3479702 - RNA, 18 nt, Human
acauaagcuuccauuuua

SEQ ID NO: 3479703 - RNA, 21 nt, Human
acauaagggguuugccauuug

SEQ ID NO: 3479704 - RNA, 22 nt, Human
acauaauacacuugcccugcuc

SEQ ID NO: 3479705 - RNA, 14 nt, Human
acauaauacugaac

SEQ ID NO: 3479706 - RNA, 13 nt, Human
acauaaugaaaau

SEQ ID NO: 3479707 - RNA, 23 nt, Human
acauaaugcgugcauaccacuuu

SEQ ID NO: 3479708 - RNA, 20 nt, Human
acauaauguauuguugguaa

SEQ ID NO: 3479709 - RNA, 15 nt, Human
acauaauuaaagugu

SEQ ID NO: 3479710 - RNA, 20 nt, Human
acauaauuaaaguguccauu

SEQ ID NO: 3479711 - RNA, 17 nt, Human
acauaauuauccaggaa

SEQ ID NO: 3479712 - RNA, 16 nt, Human
acauaauucacucuga

SEQ ID NO: 3479713 - RNA, 17 nt, Human
acauaauucacucugag

SEQ ID NO: 3479714 - RNA, 20 nt, Human
acauaauucacucugagugu

SEQ ID NO: 3479715 - RNA, 18 nt, Human
acauacacgaaagagaga

SEQ ID NO: 3479716 - RNA, 21 nt, Human
acauacacuuguauaaaugua

SEQ ID NO: 3479717 - RNA, 18 nt, Human
acauacagaauuacugua

SEQ ID NO: 3479718 - RNA, 20 nt, Human
acauacagaauuacuguaac

SEQ ID NO: 3479719 - RNA, 20 nt, Human
acauacaggaagguagaaau

SEQ ID NO: 3479720 - RNA, 14 nt, Human
acauacauuuugua

SEQ ID NO: 3479721 - RNA, 18 nt, Human
acauaccccuuacaaaug

SEQ ID NO: 3479722 - RNA, 21 nt, Human
acauacccgccuagcugcugu

SEQ ID NO: 3479723 - RNA, 14 nt, Human
acauacgaaacaca

SEQ ID NO: 3479724 - RNA, 20 nt, Human
acauacggucagguuuaaca

SEQ ID NO: 3479725 - RNA, 22 nt, Human
acauacuaaccagcagaaaugc

SEQ ID NO: 3479726 - RNA, 14 nt, Human
acauacuaugaaau

SEQ ID NO: 3479727 - RNA, 24 nt, Human
acauacuccuuccaucaaauagaa

SEQ ID NO: 3479728 - RNA, 16 nt, Human
acauacuggcugguga

SEQ ID NO: 3479729 - RNA, 14 nt, Human
acauacuguucacu

SEQ ID NO: 3479730 - RNA, 12 nt, Human
acauacuucagc

SEQ ID NO: 3479731 - RNA, 17 nt, Human
acauagaaaguucaugg

SEQ ID NO: 3479732 - RNA, 20 nt, Human
acauagaaauggaaauuuug

SEQ ID NO: 3479733 - RNA, 18 nt, Human
acauagaauuaacacaug

SEQ ID NO: 3479734 - RNA, 17 nt, Human
acauagacagaagaaac

SEQ ID NO: 3479735 - RNA, 17 nt, Human
acauagacuagagaaac

SEQ ID NO: 3479736 - RNA, 23 nt, Human
acauagagagggagaagaaguca

SEQ ID NO: 3479737 - RNA, 19 nt, Human
acauagagccggguguccc

SEQ ID NO: 3479738 - RNA, 21 nt, Human
acauagagccgggugucccca

SEQ ID NO: 3479739 - RNA, 21 nt, Human
acauagagguauauuggaaga

SEQ ID NO: 3479740 - RNA, 16 nt, Human
acauagauaaaacauc

SEQ ID NO: 3479741 - RNA, 14 nt, Human
acauagauuaaugg

SEQ ID NO: 3479742 - RNA, 18 nt, Human
acauagauuaauggcacu

SEQ ID NO: 3479743 - RNA, 19 nt, Human
acauagauuaauggcacug

SEQ ID NO: 3479744 - RNA, 20 nt, Human
acauagauuaauggcacuga

SEQ ID NO: 3479745 - RNA, 19 nt, Human
acauagauucaccuguaaa

SEQ ID NO: 3479746 - RNA, 19 nt, Human
acauagcaugacauuucuu

SEQ ID NO: 3479747 - RNA, 19 nt, Human
acauagccaaaaugugagu

SEQ ID NO: 3479748 - RNA, 14 nt, Human
acauagcccauccc

SEQ ID NO: 3479749 - RNA, 16 nt, Human
acauagccuauauuua

SEQ ID NO: 3479750 - RNA, 17 nt, Human
acauagccuauauuuac

SEQ ID NO: 3479751 - RNA, 22 nt, Human
acauagcuugauaaagggccaa

SEQ ID NO: 3479752 - RNA, 21 nt, Human
acauaggaaguuaaaagcaca

SEQ ID NO: 3479753 - RNA, 16 nt, Human
acauaggguucccacg

SEQ ID NO: 3479754 - RNA, 20 nt, Human
acauagucuggcuguaccca

SEQ ID NO: 3479755 - RNA, 18 nt, Human
acauagugaaaauuguuu

SEQ ID NO: 3479756 - RNA, 23 nt, Human
acauagugaaaauuguuuaguga

SEQ ID NO: 3479757 - RNA, 16 nt, Human
acauagugaaaguuua

SEQ ID NO: 3479758 - RNA, 20 nt, Human
acauagugcuaacaugaaga

SEQ ID NO: 3479759 - RNA, 17 nt, Human
acauaguguaggcuuua

SEQ ID NO: 3479760 - RNA, 19 nt, Human
acauaguuuuaaacucauu

SEQ ID NO: 3479761 - RNA, 20 nt, Human
acauauaaacaucacacaca

SEQ ID NO: 3479762 - RNA, 16 nt, Human
acauauauuauuuauu

SEQ ID NO: 3479763 - RNA, 22 nt, Human
acauauauuuuuaaaaaaugaa

SEQ ID NO: 3479764 - RNA, 18 nt, Human
acauauauuuuuuaaaau

SEQ ID NO: 3479765 - RNA, 15 nt, Human
acauaucccuuccag

SEQ ID NO: 3479766 - RNA, 16 nt, Human
acauaucccuuccaga

SEQ ID NO: 3479767 - RNA, 22 nt, Human
acauaucuaguaugaaauuaua

SEQ ID NO: 3479768 - RNA, 13 nt, Human
acauaugaaaaua

SEQ ID NO: 3479769 - RNA, 18 nt, Human
acauaugaaauuuaauau

SEQ ID NO: 3479770 - RNA, 16 nt, Human
acauaugaucugucug

SEQ ID NO: 3479771 - RNA, 17 nt, Human
acauaugaucugucugu

SEQ ID NO: 3479772 - RNA, 19 nt, Human
acauaugaucugucugugg

SEQ ID NO: 3479773 - RNA, 15 nt, Human
acauaugcaccuugu

SEQ ID NO: 3479774 - RNA, 19 nt, Human
acauaugcaccuugugucu

SEQ ID NO: 3479775 - RNA, 20 nt, Human
acauaugcuuuaagaaucga

SEQ ID NO: 3479776 - RNA, 20 nt, Human
acauauggaauuuugcaaag

SEQ ID NO: 3479777 - RNA, 14 nt, Human
acauauggauguua

SEQ ID NO: 3479778 - RNA, 18 nt, Human
acauauggauguuacucu

SEQ ID NO: 3479779 - RNA, 19 nt, Human
acauauggucuccauuuua

SEQ ID NO: 3479780 - RNA, 13 nt, Human
acauaugugaaua

SEQ ID NO: 3479781 - RNA, 20 nt, Human
acauauuagcgacaacagau

SEQ ID NO: 3479782 - RNA, 20 nt, Human
acauauuagugcagccaagu

SEQ ID NO: 3479783 - RNA, 12 nt, Human
acauauucauuu

SEQ ID NO: 3479784 - RNA, 23 nt, Human
acauauugauuuccguuaaaaua

SEQ ID NO: 3479785 - RNA, 13 nt, Human
acauauuuaacug

SEQ ID NO: 3479786 - RNA, 20 nt, Human
acauauuuaacuggugcacu

SEQ ID NO: 3479787 - RNA, 18 nt, Human
acauauuuccaagaaguu

SEQ ID NO: 3479788 - RNA, 15 nt, Human
acauauuuguggaau

SEQ ID NO: 3479789 - RNA, 16 nt, Human
acauauuuguggaaua

SEQ ID NO: 3479790 - RNA, 14 nt, Human
acauauuuguuaaa

SEQ ID NO: 3479791 - RNA, 17 nt, Human
acauauuuuauuaagaa

SEQ ID NO: 3479792 - RNA, 13 nt, Human
acauauuuucugu

SEQ ID NO: 3479793 - RNA, 15 nt, Human
acauauuuuuuauau

SEQ ID NO: 3479794 - RNA, 19 nt, Human
acauauuuuuuauaucugg

SEQ ID NO: 3479795 - RNA, 13 nt, Human
acaucaaaccuuu

SEQ ID NO: 3479796 - RNA, 19 nt, Human
acaucaaacucaaugcuuu

SEQ ID NO: 3479797 - RNA, 13 nt, Human
acaucaaauaaga

SEQ ID NO: 3479798 - RNA, 14 nt, Human
acaucaaauaagaa

SEQ ID NO: 3479799 - RNA, 18 nt, Human
acaucaacaucuugguca

SEQ ID NO: 3479800 - RNA, 18 nt, Human
acaucaauauugucauuc

SEQ ID NO: 3479801 - RNA, 20 nt, Human
acaucaauauugucauuccu

SEQ ID NO: 3479802 - RNA, 13 nt, Human
acaucaauguuca

SEQ ID NO: 3479803 - RNA, 17 nt, Human
acaucaauguucauugu

SEQ ID NO: 3479804 - RNA, 18 nt, Human
acaucaauguucauugua

SEQ ID NO: 3479805 - RNA, 20 nt, Human
acaucaauguucauuguaau

SEQ ID NO: 3479806 - RNA, 14 nt, Human
acaucacaagacua

SEQ ID NO: 3479807 - RNA, 16 nt, Human
acaucacaccugcccu

SEQ ID NO: 3479808 - RNA, 13 nt, Human
acaucacagauga

SEQ ID NO: 3479809 - RNA, 13 nt, Human
acaucacagcagc

SEQ ID NO: 3479810 - RNA, 19 nt, Human
acaucacagggugggccuc

SEQ ID NO: 3479811 - RNA, 16 nt, Human
acaucaccacaguuua

SEQ ID NO: 3479812 - RNA, 22 nt, Human
acaucacccuuaccaugugccu

SEQ ID NO: 3479813 - RNA, 20 nt, Human
acaucaccgacgcgucuccu

SEQ ID NO: 3479814 - RNA, 13 nt, Human
acaucagaaagga

SEQ ID NO: 3479815 - RNA, 18 nt, Human
acaucagcacgauuucug

SEQ ID NO: 3479816 - RNA, 15 nt, Human
acaucagccagcugc

SEQ ID NO: 3479817 - RNA, 12 nt, Human
acaucagcccuu

SEQ ID NO: 3479818 - RNA, 22 nt, Human
acaucagcuggucaaacaaacu

SEQ ID NO: 3479819 - RNA, 23 nt, Human
acaucaguggcauggcuccaguc

SEQ ID NO: 3479820 - RNA, 18 nt, Human
acaucaucuguaagcugu

SEQ ID NO: 3479821 - RNA, 17 nt, Human
acaucaugaauuuuaca

SEQ ID NO: 3479822 - RNA, 16 nt, Human
acaucauuccuuuuua

SEQ ID NO: 3479823 - RNA, 17 nt, Human
acaucauuccuuuuuau

SEQ ID NO: 3479824 - RNA, 21 nt, Human
acaucauuccuuuuuauuuau

SEQ ID NO: 3479825 - RNA, 22 nt, Human
acaucauuccuuuuuauuuaua

SEQ ID NO: 3479826 - RNA, 14 nt, Human
acaucauuucaaga

SEQ ID NO: 3479827 - RNA, 11 nt, Human
acaucauuucu

SEQ ID NO: 3479828 - RNA, 12 nt, Human
acaucauuucuu

SEQ ID NO: 3479829 - RNA, 15 nt, Human
acauccaaagcagac

SEQ ID NO: 3479830 - RNA, 19 nt, Human
acauccaaagcagacagcu

SEQ ID NO: 3479831 - RNA, 16 nt, Human
acauccaacuccagca

SEQ ID NO: 3479832 - RNA, 18 nt, Human
acauccaacuccagcaac

SEQ ID NO: 3479833 - RNA, 13 nt, Human
acauccaagcuuc

SEQ ID NO: 3479834 - RNA, 16 nt, Human
acauccaagcuuccuu

SEQ ID NO: 3479835 - RNA, 20 nt, Human
acauccaauauuuucuuuaa

SEQ ID NO: 3479836 - RNA, 15 nt, Human
acauccacagucucc

SEQ ID NO: 3479837 - RNA, 12 nt, Human
acauccagcaga

SEQ ID NO: 3479838 - RNA, 21 nt, Human
acauccauguccuauguguga

SEQ ID NO: 3479839 - RNA, 20 nt, Human
acauccauguuuguaaaacu

SEQ ID NO: 3479840 - RNA, 21 nt, Human
acauccauucccaagaaaugc

SEQ ID NO: 3479841 - RNA, 20 nt, Human
acauccauuucaucuauuuc

SEQ ID NO: 3479842 - RNA, 20 nt, Human
acaucccaccccauccucca

SEQ ID NO: 3479843 - RNA, 23 nt, Human
acaucccagcccaauccagguac

SEQ ID NO: 3479844 - RNA, 16 nt, Human
acaucccauugcccug

SEQ ID NO: 3479845 - RNA, 18 nt, Human
acaucccauugcccuggu

SEQ ID NO: 3479846 - RNA, 19 nt, Human
acauccccgcuggcugggg

SEQ ID NO: 3479847 - RNA, 17 nt, Human
acaucccugagcaggaa

SEQ ID NO: 3479848 - RNA, 16 nt, Human
acaucccugccagcuc

SEQ ID NO: 3479849 - RNA, 17 nt, Human
acaucccugccagcucu

SEQ ID NO: 3479850 - RNA, 16 nt, Human
acaucccugggccugc

SEQ ID NO: 3479851 - RNA, 20 nt, Human
acaucccugggccugcugcu

SEQ ID NO: 3479852 - RNA, 16 nt, Human
acauccggaggagaag

SEQ ID NO: 3479853 - RNA, 19 nt, Human
acauccggggccagcuccg

SEQ ID NO: 3479854 - RNA, 15 nt, Human
acauccuacaagaca

SEQ ID NO: 3479855 - RNA, 16 nt, Human
acauccucuuccauau

SEQ ID NO: 3479856 - RNA, 15 nt, Human
acauccucuucugcu

SEQ ID NO: 3479857 - RNA, 20 nt, Human
acauccugucaucugagaau

SEQ ID NO: 3479858 - RNA, 16 nt, Human
acauccugugccucca

SEQ ID NO: 3479859 - RNA, 13 nt, Human
acauccuuccuuc

SEQ ID NO: 3479860 - RNA, 18 nt, Human
acauccuuguggcacauu

SEQ ID NO: 3479861 - RNA, 13 nt, Human
acauccuuucuaa

SEQ ID NO: 3479862 - RNA, 18 nt, Human
acauccuuucuaaacaag

SEQ ID NO: 3479863 - RNA, 21 nt, Human
acauccuuucuauugaaaaau

SEQ ID NO: 3479864 - RNA, 20 nt, Human
acauccuuugcagggcagcc

SEQ ID NO: 3479865 - RNA, 14 nt, Human
acaucggaaaaaua

SEQ ID NO: 3479866 - RNA, 17 nt, Human
acaucgugaaacccugu

SEQ ID NO: 3479867 - RNA, 20 nt, Human
acaucgugaaacccugucuc

SEQ ID NO: 3479868 - RNA, 17 nt, Human
acaucucaacaggccuc

SEQ ID NO: 3479869 - RNA, 23 nt, Human
acaucucccuuuuccaugacugu

SEQ ID NO: 3479870 - RNA, 21 nt, Human
acaucucuauuccccacccuc

SEQ ID NO: 3479871 - RNA, 19 nt, Human
accaaccugaagacaccgu

SEQ ID NO: 3479872 - RNA, 23 nt, Human
accaacgcgaaaccaauuccuca

SEQ ID NO: 3479873 - RNA, 14 nt, Human
accaacgucugugc

SEQ ID NO: 3479874 - RNA, 17 nt, Human
accaacgucugugccau

SEQ ID NO: 3479875 - RNA, 21 nt, Human
accaacgucugugccauuuug

SEQ ID NO: 3479876 - RNA, 17 nt, Human
accaacguuacucaggg

SEQ ID NO: 3479877 - RNA, 21 nt, Human
accaacguuacucagggcucc

SEQ ID NO: 3479878 - RNA, 16 nt, Human
accaacuacaaccaag

SEQ ID NO: 3479879 - RNA, 14 nt, Human
accaacucuugcag

SEQ ID NO: 3479880 - RNA, 14 nt, Human
accaacugggccca

SEQ ID NO: 3479881 - RNA, 10 nt, Human
accaacugug

SEQ ID NO: 3479882 - RNA, 16 nt, Human
accaacuguguuguau

SEQ ID NO: 3479883 - RNA, 18 nt, Human
accaacuguguuguauua

SEQ ID NO: 3479884 - RNA, 22 nt, Human
accaacuguguuguauuaacaa

SEQ ID NO: 3479885 - RNA, 23 nt, Human
accaacuguguuguauuaacaaa

SEQ ID NO: 3479886 - RNA, 20 nt, Human
accaacuugguucugcuuca

SEQ ID NO: 3479887 - RNA, 13 nt, Human
accaacuuucaag

SEQ ID NO: 3479888 - RNA, 15 nt, Human
accaacuuucaagaa

SEQ ID NO: 3479889 - RNA, 13 nt, Human
accaacuuucugu

SEQ ID NO: 3479890 - RNA, 14 nt, Human
accaagaaagcagg

SEQ ID NO: 3479891 - RNA, 18 nt, Human
accaagaaaggaaccugu

SEQ ID NO: 3479892 - RNA, 15 nt, Human
accaagaacugcaug

SEQ ID NO: 3479893 - RNA, 16 nt, Human
accaagaagaugucuu

SEQ ID NO: 3479894 - RNA, 21 nt, Human
accaagaauucuccaaaacaa

SEQ ID NO: 3479895 - RNA, 14 nt, Human
accaagacaaauuc

SEQ ID NO: 3479896 - RNA, 15 nt, Human
accaagagagaaaga

SEQ ID NO: 3479897 - RNA, 17 nt, Human
accaagagauugcuaau

SEQ ID NO: 3479898 - RNA, 13 nt, Human
accaagaggcugg

SEQ ID NO: 3479899 - RNA, 14 nt, Human
accaagaggcuggu

SEQ ID NO: 3479900 - RNA, 15 nt, Human
accaagcaggaagcu

SEQ ID NO: 3479901 - RNA, 14 nt, Human
accaagcaucuugg

SEQ ID NO: 3479902 - RNA, 20 nt, Human
accaagccaagggaaccugu

SEQ ID NO: 3479903 - RNA, 23 nt, Human
accaagccaagggaaccuguguc

SEQ ID NO: 3479904 - RNA, 12 nt, Human
accaagcccagu

SEQ ID NO: 3479905 - RNA, 18 nt, Human
accaagccguggcuuccc

SEQ ID NO: 3479906 - RNA, 12 nt, Human
accaagccuuga

SEQ ID NO: 3479907 - RNA, 19 nt, Human
accaagcuauuccuuuccc

SEQ ID NO: 3479908 - RNA, 22 nt, Human
accaagcuauuccuuucccuuc

SEQ ID NO: 3479909 - RNA, 19 nt, Human
accaagcugaguuuccuau

SEQ ID NO: 3479910 - RNA, 20 nt, Human
accaagcugugacccucaau

SEQ ID NO: 3479911 - RNA, 15 nt, Human
accaaggacugagca

SEQ ID NO: 3479912 - RNA, 20 nt, Human
accaaggcaaggcaggugcc

SEQ ID NO: 3479913 - RNA, 21 nt, Human
accaaggcugagacagugaau

SEQ ID NO: 3479914 - RNA, 23 nt, Human
accaaggcuuucucuacugauuc

SEQ ID NO: 3479915 - RNA, 12 nt, Human
accaagucacac

SEQ ID NO: 3479916 - RNA, 19 nt, Human
accaagucggaacagcaga

SEQ ID NO: 3479917 - RNA, 15 nt, Human
accaaguuauauaaa

SEQ ID NO: 3479918 - RNA, 21 nt, Human
accaaguuauauaaagagaaa

SEQ ID NO: 3479919 - RNA, 11 nt, Human
accaauaaagu

SEQ ID NO: 3479920 - RNA, 12 nt, Human
accaauaaagug

SEQ ID NO: 3479921 - RNA, 16 nt, Human
accaauagcccacagc

SEQ ID NO: 3479922 - RNA, 18 nt, Human
accaauauuguacaguuu

SEQ ID NO: 3479923 - RNA, 17 nt, Human
accaauccuaugcaugg

SEQ ID NO: 3479924 - RNA, 15 nt, Human
accaaucuuacuuug

SEQ ID NO: 3479925 - RNA, 16 nt, Human
accaaucuuacuuugu

SEQ ID NO: 3479926 - RNA, 21 nt, Human
accaaucuuacuuuguaaauu

SEQ ID NO: 3479927 - RNA, 17 nt, Human
accaaugcaugcagcca

SEQ ID NO: 3479928 - RNA, 20 nt, Human
accaaugcaugcagccacug

SEQ ID NO: 3479929 - RNA, 22 nt, Human
accaaugccaagauaauucacu

SEQ ID NO: 3479930 - RNA, 14 nt, Human
accaauguacccac

SEQ ID NO: 3479931 - RNA, 12 nt, Human
accaaugucuug

SEQ ID NO: 3479932 - RNA, 16 nt, Human
accaauguuuaaaaaa

SEQ ID NO: 3479933 - RNA, 14 nt, Human
accaauuauugaua

SEQ ID NO: 3479934 - RNA, 16 nt, Human
accaauucaacccuuu

SEQ ID NO: 3479935 - RNA, 15 nt, Human
accaauugcuuuguc

SEQ ID NO: 3479936 - RNA, 15 nt, Human
accaauugugcugcc

SEQ ID NO: 3479937 - RNA, 16 nt, Human
accaauugugcugcca

SEQ ID NO: 3479938 - RNA, 21 nt, Human
accaauuuuuugugugugaag

SEQ ID NO: 3479939 - RNA, 16 nt, Human
accaauuuuuuguucu

SEQ ID NO: 3479940 - RNA, 14 nt, Human
accacaaaauauac

SEQ ID NO: 3479941 - RNA, 18 nt, Human
accacaaacuguaauaca

SEQ ID NO: 3479942 - RNA, 20 nt, Human
accacaaagcacaguuugaa

SEQ ID NO: 3479943 - RNA, 20 nt, Human
accacaaaggccaaacugcu

SEQ ID NO: 3479944 - RNA, 21 nt, Human
accacaaaggccaaacugcug

SEQ ID NO: 3479945 - RNA, 17 nt, Human
accacaacaugaggcca

SEQ ID NO: 3479946 - RNA, 20 nt, Human
accacaacuauuuucagaug

SEQ ID NO: 3479947 - RNA, 13 nt, Human
accacaacugaca

SEQ ID NO: 3479948 - RNA, 11 nt, Human
accacacaaag

SEQ ID NO: 3479949 - RNA, 18 nt, Human
accacacacaacagccaa

SEQ ID NO: 3479950 - RNA, 17 nt, Human
accacacagaggcugcc

SEQ ID NO: 3479951 - RNA, 15 nt, Human
accacacagccuaca

SEQ ID NO: 3479952 - RNA, 13 nt, Human
accacacauccca

SEQ ID NO: 3479953 - RNA, 14 nt, Human
accacacaucccag

SEQ ID NO: 3479954 - RNA, 13 nt, Human
accacacccaacu

SEQ ID NO: 3479955 - RNA, 17 nt, Human
accacacccacacucag

SEQ ID NO: 3479956 - RNA, 12 nt, Human
accacacccagc

SEQ ID NO: 3479957 - RNA, 21 nt, Human
accacacccagcccacuucug

SEQ ID NO: 3479958 - RNA, 24 nt, Human
accacacccagccucaguccuccc

SEQ ID NO: 3479959 - RNA, 17 nt, Human
accacacccuguacugu

SEQ ID NO: 3479960 - RNA, 14 nt, Human
accacaccuggcua

SEQ ID NO: 3479961 - RNA, 13 nt, Human
accacacuuccug

SEQ ID NO: 3479962 - RNA, 17 nt, Human
accacacuuccugucca

SEQ ID NO: 3479963 - RNA, 17 nt, Human
accacacuugaaaccuu

SEQ ID NO: 3479964 - RNA, 20 nt, Human
accacacuugucggcuccag

SEQ ID NO: 3479965 - RNA, 14 nt, Human
accacagacacaca

SEQ ID NO: 3479966 - RNA, 15 nt, Human
accacagagcuguca

SEQ ID NO: 3479967 - RNA, 23 nt, Human
accacagcaacgaucacaaauga

SEQ ID NO: 3479968 - RNA, 19 nt, Human
accacagcaaggcaccugc

SEQ ID NO: 3479969 - RNA, 16 nt, Human
accacagcagcugaac

SEQ ID NO: 3479970 - RNA, 21 nt, Human
accacagcagcugaacagcca

SEQ ID NO: 3479971 - RNA, 19 nt, Human
accacagcaggugucauau

SEQ ID NO: 3479972 - RNA, 20 nt, Human
accacagccagcaccuggca

SEQ ID NO: 3479973 - RNA, 15 nt, Human
accacagcuccuuuu

SEQ ID NO: 3479974 - RNA, 16 nt, Human
accacagcugcuggag

SEQ ID NO: 3479975 - RNA, 22 nt, Human
accacaggcccuuuccucaggc

SEQ ID NO: 3479976 - RNA, 22 nt, Human
accacaggguucaaaaugucug

SEQ ID NO: 3479977 - RNA, 15 nt, Human
accacaggugcccgc

SEQ ID NO: 3479978 - RNA, 21 nt, Human
accacaguguaccauuaaaau

SEQ ID NO: 3479979 - RNA, 17 nt, Human
accacaucaaauaagaa

SEQ ID NO: 3479980 - RNA, 20 nt, Human
accacauccuccguccagcc

SEQ ID NO: 3479981 - RNA, 21 nt, Human
accacauccuccguccagccg

SEQ ID NO: 3479982 - RNA, 20 nt, Human
accacaucuaagccugaagg

SEQ ID NO: 3479983 - RNA, 19 nt, Human
accacaucuugcucugcug

SEQ ID NO: 3479984 - RNA, 21 nt, Human
accacaucuugcucugcugac

SEQ ID NO: 3479985 - RNA, 22 nt, Human
accacaugccaagcacugugcu

SEQ ID NO: 3479986 - RNA, 14 nt, Human
accaccaaaaacaa

SEQ ID NO: 3479987 - RNA, 12 nt, Human
accaccaagccu

SEQ ID NO: 3479988 - RNA, 15 nt, Human
accaccacuggccac

SEQ ID NO: 3479989 - RNA, 21 nt, Human
accaccacuggccaccaggcu

SEQ ID NO: 3479990 - RNA, 16 nt, Human
accaccagaagcccag

SEQ ID NO: 3479991 - RNA, 17 nt, Human
accaccagaagcccaga

SEQ ID NO: 3479992 - RNA, 17 nt, Human
accaccagggcaucucu

SEQ ID NO: 3479993 - RNA, 22 nt, Human
accaccagggcaucucugggcu

SEQ ID NO: 3479994 - RNA, 14 nt, Human
accaccaggucucc

SEQ ID NO: 3479995 - RNA, 20 nt, Human
accaccauccaccgcugcuc

SEQ ID NO: 3479996 - RNA, 21 nt, Human
accaccauccaccgcugcucc

SEQ ID NO: 3479997 - RNA, 20 nt, Human
accaccccagcugcuccccu

SEQ ID NO: 3479998 - RNA, 18 nt, Human
accaccccggcccccugc

SEQ ID NO: 3479999 - RNA, 20 nt, Human
accaccccggcccccugccc

SEQ ID NO: 3480000 - RNA, 13 nt, Human
accaccccuacca

SEQ ID NO: 3480001 - RNA, 15 nt, Human
accaccccugccucc

SEQ ID NO: 3480002 - RNA, 22 nt, Human
accaccccugccuccacccucu

SEQ ID NO: 3480003 - RNA, 14 nt, Human
accaccccuuccug

SEQ ID NO: 3480004 - RNA, 20 nt, Human
accacccuagucccuucccc

SEQ ID NO: 3480005 - RNA, 20 nt, Human
accacccucacuggcucucc

SEQ ID NO: 3480006 - RNA, 17 nt, Human
accacccuccccucucu

SEQ ID NO: 3480007 - RNA, 23 nt, Human
accacccuccccucucuugcacc

SEQ ID NO: 3480008 - RNA, 12 nt, Human
accacccugagc

SEQ ID NO: 3480009 - RNA, 14 nt, Human
accacccugagccg

SEQ ID NO: 3480010 - RNA, 18 nt, Human
accaccgcccgucugugu

SEQ ID NO: 3480011 - RNA, 21 nt, Human
accaccgcgcccagccuuuuu

SEQ ID NO: 3480012 - RNA, 14 nt, Human
accaccgcucccca

SEQ ID NO: 3480013 - RNA, 23 nt, Human
accaccgcuccccagcccagggu

SEQ ID NO: 3480014 - RNA, 18 nt, Human
accaccuaggccacuccu

SEQ ID NO: 3480015 - RNA, 15 nt, Human
accaccucacuccug

SEQ ID NO: 3480016 - RNA, 14 nt, Human
accaccucccucac

SEQ ID NO: 3480017 - RNA, 15 nt, Human
accaccucucaauau

SEQ ID NO: 3480018 - RNA, 13 nt, Human
accaccuucccag

SEQ ID NO: 3480019 - RNA, 14 nt, Human
accaccuucccagc

SEQ ID NO: 3480020 - RNA, 20 nt, Human
accaccuucccagcucuccc

SEQ ID NO: 3480021 - RNA, 20 nt, Human
accccucaacaccucugcac

SEQ ID NO: 3480022 - RNA, 15 nt, Human
accccucacucuggc

SEQ ID NO: 3480023 - RNA, 17 nt, Human
accccucauagcccuca

SEQ ID NO: 3480024 - RNA, 13 nt, Human
accccuccacucu

SEQ ID NO: 3480025 - RNA, 12 nt, Human
accccuccagga

SEQ ID NO: 3480026 - RNA, 16 nt, Human
accccucccagcugac

SEQ ID NO: 3480027 - RNA, 19 nt, Human
accccucccauuaggacaa

SEQ ID NO: 3480028 - RNA, 18 nt, Human
accccuccccuaaugccu

SEQ ID NO: 3480029 - RNA, 13 nt, Human
accccuccccucc

SEQ ID NO: 3480030 - RNA, 14 nt, Human
accccuccccucca

SEQ ID NO: 3480031 - RNA, 19 nt, Human
accccucccggcccugccu

SEQ ID NO: 3480032 - RNA, 21 nt, Human
accccucccggcccugccugc

SEQ ID NO: 3480033 - RNA, 22 nt, Human
accccucccucacucccaccug

SEQ ID NO: 3480034 - RNA, 17 nt, Human
accccucccucugucca

SEQ ID NO: 3480035 - RNA, 14 nt, Human
accccucccuuucu

SEQ ID NO: 3480036 - RNA, 19 nt, Human
accccuccucacuggccau

SEQ ID NO: 3480037 - RNA, 21 nt, Human
accccuccucacuggccaucc

SEQ ID NO: 3480038 - RNA, 14 nt, Human
accccuccuggggc

SEQ ID NO: 3480039 - RNA, 12 nt, Human
accccuccuucc

SEQ ID NO: 3480040 - RNA, 17 nt, Human
agcauguauaguugcuu

SEQ ID NO: 3480041 - RNA, 22 nt, Human
agcauguauugugucuuuugca

SEQ ID NO: 3480042 - RNA, 23 nt, Human
agcauguauugugucuuuugcau

SEQ ID NO: 3480043 - RNA, 20 nt, Human
agcauguauuuuugucaauu

SEQ ID NO: 3480044 - RNA, 23 nt, Human
agcauguccuaaugcuugcugcu

SEQ ID NO: 3480045 - RNA, 17 nt, Human
agcaugucgucaaagcu

SEQ ID NO: 3480046 - RNA, 17 nt, Human
agcaugucuauucagcu

SEQ ID NO: 3480047 - RNA, 15 nt, Human
agcaugugcccuccu

SEQ ID NO: 3480048 - RNA, 16 nt, Human
agcaugugccuuaaug

SEQ ID NO: 3480049 - RNA, 17 nt, Human
agcauguggcauguuca

SEQ ID NO: 3480050 - RNA, 19 nt, Human
agcauguguauuuccagug

SEQ ID NO: 3480051 - RNA, 12 nt, Human
agcauguuacug

SEQ ID NO: 3480052 - RNA, 20 nt, Human
agcauguugagccaggccug

SEQ ID NO: 3480053 - RNA, 18 nt, Human
agcauguugcugaggagu

SEQ ID NO: 3480054 - RNA, 21 nt, Human
agcauguuuagacuuuaacau

SEQ ID NO: 3480055 - RNA, 22 nt, Human
agcauguuuagacuuuaacaua

SEQ ID NO: 3480056 - RNA, 23 nt, Human
agcauguuuagacuuuaacauaa

SEQ ID NO: 3480057 - RNA, 14 nt, Human
agcauguuucaugu

SEQ ID NO: 3480058 - RNA, 14 nt, Human
agcauguuugcuga

SEQ ID NO: 3480059 - RNA, 14 nt, Human
agcauguuuugcau

SEQ ID NO: 3480060 - RNA, 17 nt, Human
agcauguuuuguauaca

SEQ ID NO: 3480061 - RNA, 17 nt, Human
agcauuacaaauugcuu

SEQ ID NO: 3480062 - RNA, 14 nt, Human
agcauuacaggcaa

SEQ ID NO: 3480063 - RNA, 17 nt, Human
agcauuaccucuuugga

SEQ ID NO: 3480064 - RNA, 18 nt, Human
agcauuacucuuguaaga

SEQ ID NO: 3480065 - RNA, 20 nt, Human
agcauuacucuuguaagauu

SEQ ID NO: 3480066 - RNA, 17 nt, Human
agcauuagauuucucau

SEQ ID NO: 3480067 - RNA, 23 nt, Human
agcauucaauuuauucaagaaaa

SEQ ID NO: 3480068 - RNA, 18 nt, Human
agcauucacaacuuguuu

SEQ ID NO: 3480069 - RNA, 17 nt, Human
agcauucagaagaaaaa

SEQ ID NO: 3480070 - RNA, 16 nt, Human
agcauucagagagcag

SEQ ID NO: 3480071 - RNA, 19 nt, Human
agcauuccaacaaaggguu

SEQ ID NO: 3480072 - RNA, 16 nt, Human
agcauuccagccccuc

SEQ ID NO: 3480073 - RNA, 19 nt, Human
agcauuccagccccucugg

SEQ ID NO: 3480074 - RNA, 12 nt, Human
agcauucccagg

SEQ ID NO: 3480075 - RNA, 13 nt, Human
agcauucccaggu

SEQ ID NO: 3480076 - RNA, 14 nt, Human
agcauucccuccca

SEQ ID NO: 3480077 - RNA, 17 nt, Human
agcauuccuucuuugau

SEQ ID NO: 3480078 - RNA, 18 nt, Human
agcauuccuucuuugaua

SEQ ID NO: 3480079 - RNA, 24 nt, Human
agcauuccuucuuugauaauguua

SEQ ID NO: 3480080 - RNA, 19 nt, Human
agcauucgagacagaaccu

SEQ ID NO: 3480081 - RNA, 18 nt, Human
agcauucucacuccuacc

SEQ ID NO: 3480082 - RNA, 20 nt, Human
agcauucucacuccuaccug

SEQ ID NO: 3480083 - RNA, 13 nt, Human
agcauucucccca

SEQ ID NO: 3480084 - RNA, 18 nt, Human
agcauucuuagccugugg

SEQ ID NO: 3480085 - RNA, 20 nt, Human
agcauucuuagccuguggca

SEQ ID NO: 3480086 - RNA, 23 nt, Human
agcauucuuagccuguggcagua

SEQ ID NO: 3480087 - RNA, 19 nt, Human
agcauucuugucacaauaa

SEQ ID NO: 3480088 - RNA, 20 nt, Human
agcauucuugucacaauaaa

SEQ ID NO: 3480089 - RNA, 15 nt, Human
agcauugaauggcua

SEQ ID NO: 3480090 - RNA, 18 nt, Human
agcauugauauuugugca

SEQ ID NO: 3480091 - RNA, 16 nt, Human
agcauugcugguucua

SEQ ID NO: 3480092 - RNA, 23 nt, Human
agcauugcugguucuauuuaaug

SEQ ID NO: 3480093 - RNA, 15 nt, Human
agcauugcuguuaug

SEQ ID NO: 3480094 - RNA, 11 nt, Human
agcauugcuuu

SEQ ID NO: 3480095 - RNA, 12 nt, Human
agcauugcuuuc

SEQ ID NO: 3480096 - RNA, 14 nt, Human
agcauugcuuucug

SEQ ID NO: 3480097 - RNA, 17 nt, Human
agcauuggauacagcag

SEQ ID NO: 3480098 - RNA, 15 nt, Human
agcauuguaaaagca

SEQ ID NO: 3480099 - RNA, 20 nt, Human
agcauuguaaaauaauucug

SEQ ID NO: 3480100 - RNA, 21 nt, Human
agcauugugaacugacaggca

SEQ ID NO: 3480101 - RNA, 21 nt, Human
agcauuguggcugucagcagg

SEQ ID NO: 3480102 - RNA, 15 nt, Human
agcauuguuugcuua

SEQ ID NO: 3480103 - RNA, 23 nt, Human
agcauuguuugcuuauuguucca

SEQ ID NO: 3480104 - RNA, 21 nt, Human
agcauuuaaccccccuguaca

SEQ ID NO: 3480105 - RNA, 17 nt, Human
agcauuuaauguagcca

SEQ ID NO: 3480106 - RNA, 20 nt, Human
agcauuuaauguagccaugg

SEQ ID NO: 3480107 - RNA, 17 nt, Human
agcauuuacuuugaauu

SEQ ID NO: 3480108 - RNA, 15 nt, Human
agcauuuagaaaacu

SEQ ID NO: 3480109 - RNA, 21 nt, Human
agcauuuaguccaaugucuuu

SEQ ID NO: 3480110 - RNA, 18 nt, Human
agcauuuagucuugccag

SEQ ID NO: 3480111 - RNA, 14 nt, Human
agcauuuauaaauu

SEQ ID NO: 3480112 - RNA, 17 nt, Human
agcauuucacuuauuua

SEQ ID NO: 3480113 - RNA, 17 nt, Human
agcauuuccaacaccac

SEQ ID NO: 3480114 - RNA, 19 nt, Human
agcauuuccaacaccacag

SEQ ID NO: 3480115 - RNA, 17 nt, Human
agcauuucccuuccuuc

SEQ ID NO: 3480116 - RNA, 18 nt, Human
agcauuucucaucaguag

SEQ ID NO: 3480117 - RNA, 12 nt, Human
agcauuugaaug

SEQ ID NO: 3480118 - RNA, 13 nt, Human
agcauuugaaugc

SEQ ID NO: 3480119 - RNA, 15 nt, Human
agcauuugaaugcau

SEQ ID NO: 3480120 - RNA, 16 nt, Human
agcauuugaaugcauu

SEQ ID NO: 3480121 - RNA, 17 nt, Human
agcauuugauaaugaua

SEQ ID NO: 3480122 - RNA, 22 nt, Human
agcauuugauaaugauaaaaca

SEQ ID NO: 3480123 - RNA, 23 nt, Human
agcauuuggaccaauagcccaca

SEQ ID NO: 3480124 - RNA, 14 nt, Human
agcauuuguauuuu

SEQ ID NO: 3480125 - RNA, 17 nt, Human
agauugagcucucugcc

SEQ ID NO: 3480126 - RNA, 18 nt, Human
agauugagcucucugccc

SEQ ID NO: 3480127 - RNA, 17 nt, Human
agauugauaucuauaaa

SEQ ID NO: 3480128 - RNA, 21 nt, Human
agauugauaucuauaaaauag

SEQ ID NO: 3480129 - RNA, 20 nt, Human
agauugcagaaaauucugug

SEQ ID NO: 3480130 - RNA, 21 nt, Human
agauugcagaaaauucugugc

SEQ ID NO: 3480131 - RNA, 16 nt, Human
agauugccccaggucu

SEQ ID NO: 3480132 - RNA, 14 nt, Human
agauugcucaaauc

SEQ ID NO: 3480133 - RNA, 16 nt, Human
agauugcucaaaucag

SEQ ID NO: 3480134 - RNA, 19 nt, Human
agauugcugaaaaaguaga

SEQ ID NO: 3480135 - RNA, 22 nt, Human
agauugcugaaauuuuauaugc

SEQ ID NO: 3480136 - RNA, 15 nt, Human
agauugcugcuucug

SEQ ID NO: 3480137 - RNA, 15 nt, Human
agauugcuucuguag

SEQ ID NO: 3480138 - RNA, 17 nt, Human
agauugcuucuguagua

SEQ ID NO: 3480139 - RNA, 13 nt, Human
agauuggaaggaa

SEQ ID NO: 3480140 - RNA, 23 nt, Human
agauuggacauaacugacuuagu

SEQ ID NO: 3480141 - RNA, 20 nt, Human
agauuggaguggggaagugu

SEQ ID NO: 3480142 - RNA, 15 nt, Human
agauuggaucaagua

SEQ ID NO: 3480143 - RNA, 22 nt, Human
agauuggauuuuauguugacau

SEQ ID NO: 3480144 - RNA, 19 nt, Human
agauugguguuuuuuucua

SEQ ID NO: 3480145 - RNA, 11 nt, Human
agauuguaaac

SEQ ID NO: 3480146 - RNA, 23 nt, Human
agauuguaaaccgcuuuggccug

SEQ ID NO: 3480147 - RNA, 21 nt, Human
agauuguccagugcaaccaca

SEQ ID NO: 3480148 - RNA, 20 nt, Human
agauuguccuuuugcaaaga

SEQ ID NO: 3480149 - RNA, 17 nt, Human
agauugucuuaauuucu

SEQ ID NO: 3480150 - RNA, 13 nt, Human
agauugugaauaa

SEQ ID NO: 3480151 - RNA, 18 nt, Human
agauugugaauauuucca

SEQ ID NO: 3480152 - RNA, 16 nt, Human
agauugugccccugca

SEQ ID NO: 3480153 - RNA, 21 nt, Human
agauuguggaauguuggauaa

SEQ ID NO: 3480154 - RNA, 22 nt, Human
agauuguggaauguuggauaag

SEQ ID NO: 3480155 - RNA, 20 nt, Human
agauugugggggaaaaauaa

SEQ ID NO: 3480156 - RNA, 13 nt, Human
agauuguguaaca

SEQ ID NO: 3480157 - RNA, 17 nt, Human
agauuguuauuaaaugu

SEQ ID NO: 3480158 - RNA, 15 nt, Human
agauuguuguuugcc

SEQ ID NO: 3480159 - RNA, 14 nt, Human
agauuguuucuaua

SEQ ID NO: 3480160 - RNA, 22 nt, Human
agauuguuuuaucaugacaugu

SEQ ID NO: 3480161 - RNA, 23 nt, Human
agauuguuuuaucaugacauguu

SEQ ID NO: 3480162 - RNA, 21 nt, Human
agauuuaaacucugaauuuau

SEQ ID NO: 3480163 - RNA, 20 nt, Human
agauuuaagcacaaacuuua

SEQ ID NO: 3480164 - RNA, 18 nt, Human
agauuuaauauuacagau

SEQ ID NO: 3480165 - RNA, 21 nt, Human
agauuuaauuugccaaaauaa

SEQ ID NO: 3480166 - RNA, 15 nt, Human
agauuuacacuggga

SEQ ID NO: 3480167 - RNA, 20 nt, Human
agauuuaccagggauguaga

SEQ ID NO: 3480168 - RNA, 21 nt, Human
agauuuacccagaaugucaga

SEQ ID NO: 3480169 - RNA, 12 nt, Human
agauuuagugua

SEQ ID NO: 3480170 - RNA, 17 nt, Human
agauuuaucaaaucagu

SEQ ID NO: 3480171 - RNA, 16 nt, Human
agauuuauuccuuugu

SEQ ID NO: 3480172 - RNA, 18 nt, Human
agauuuauuuuucaguuc

SEQ ID NO: 3480173 - RNA, 18 nt, Human
agauuucaagaaaaaaua

SEQ ID NO: 3480174 - RNA, 13 nt, Human
agauuucaagaga

SEQ ID NO: 3480175 - RNA, 14 nt, Human
agauuucaagagau

SEQ ID NO: 3480176 - RNA, 12 nt, Human
agauuucaagau

SEQ ID NO: 3480177 - RNA, 19 nt, Human
agauuucacucuccuuggu

SEQ ID NO: 3480178 - RNA, 20 nt, Human
agauuucauaguucagaauu

SEQ ID NO: 3480179 - RNA, 13 nt, Human
agauuuccuccug

SEQ ID NO: 3480180 - RNA, 21 nt, Human
agauuuccuucuuuuuuucuu

SEQ ID NO: 3480181 - RNA, 18 nt, Human
agauuucucauugacuuu

SEQ ID NO: 3480182 - RNA, 14 nt, Human
agauuucucuuuga

SEQ ID NO: 3480183 - RNA, 15 nt, Human
agauuucugaggaaa

SEQ ID NO: 3480184 - RNA, 12 nt, Human
agauuucuguuc

SEQ ID NO: 3480185 - RNA, 13 nt, Human
agauuugaccucc

SEQ ID NO: 3480186 - RNA, 22 nt, Human
agauuugcccauuuacacuuuu

SEQ ID NO: 3480187 - RNA, 22 nt, Human
agauuuggaauaggaauaagcu

SEQ ID NO: 3480188 - RNA, 16 nt, Human
agauuuggagcacucu

SEQ ID NO: 3480189 - RNA, 12 nt, Human
agauuugggaga

SEQ ID NO: 3480190 - RNA, 13 nt, Human
agauuugggcugg

SEQ ID NO: 3480191 - RNA, 17 nt, Human
agauuugggcuggaaca

SEQ ID NO: 3480192 - RNA, 16 nt, Human
agauuugugaacucag

SEQ ID NO: 3480193 - RNA, 20 nt, Human
agauuuguuuuuaaacugua

SEQ ID NO: 3480194 - RNA, 22 nt, Human
agauuuuaaauucacaauagaa

SEQ ID NO: 3480195 - RNA, 15 nt, Human
agauuuuaaucaaau

SEQ ID NO: 3480196 - RNA, 18 nt, Human
agauuuuaaucaaauuug

SEQ ID NO: 3480197 - RNA, 14 nt, Human
agauuuuaauuguc

SEQ ID NO: 3480198 - RNA, 17 nt, Human
agauuuuaauugucaug

SEQ ID NO: 3480199 - RNA, 17 nt, Human
agauuuuaauuuugaau

SEQ ID NO: 3480200 - RNA, 21 nt, Human
agauuuuaauuuugaauaaau

SEQ ID NO: 3480201 - RNA, 15 nt, Human
agauuuuagguguug

SEQ ID NO: 3480202 - RNA, 22 nt, Human
agauuuuaguuuuauuuucuaa

SEQ ID NO: 3480203 - RNA, 17 nt, Human
agauuuuauuauguaaa

SEQ ID NO: 3480204 - RNA, 21 nt, Human
agauuuuauuauguaaauccc

SEQ ID NO: 3480205 - RNA, 17 nt, Human
agauuuucagaaaauau

SEQ ID NO: 3480206 - RNA, 19 nt, Human
agauuuucagcaaacucuu

SEQ ID NO: 3480207 - RNA, 11 nt, Human
agauuuuccuu

SEQ ID NO: 3480208 - RNA, 19 nt, Human
agauuuuccuuuuuuauac

SEQ ID NO: 3480209 - RNA, 20 nt, Human
agauuuuccuuuuuuauaca

SEQ ID NO: 3480210 - RNA, 12 nt, Human
agauuuucuggu

SEQ ID NO: 3480211 - RNA, 18 nt, Human
agauuuucugguucuaac

SEQ ID NO: 3480212 - RNA, 19 nt, Human
agauuuucugguucuaaca

SEQ ID NO: 3480213 - RNA, 14 nt, Human
agauuuugaaugcu

SEQ ID NO: 3480214 - RNA, 16 nt, Human
agauuuugauaacugu

SEQ ID NO: 3480215 - RNA, 15 nt, Human
agauuuugauagcaa

SEQ ID NO: 3480216 - RNA, 18 nt, Human
agauuuugauagcaaagc

SEQ ID NO: 3480217 - RNA, 22 nt, Human
agauuuugggguuguguuguca

SEQ ID NO: 3480218 - RNA, 14 nt, Human
agauuuuguuuugc

SEQ ID NO: 3480219 - RNA, 21 nt, Human
agauuuuguuuugcuuuuucu

SEQ ID NO: 3480220 - RNA, 13 nt, Human
agauuuuuacaaa

SEQ ID NO: 3480221 - RNA, 22 nt, Human
agauuuuuauauuaguugcuuu

SEQ ID NO: 3480222 - RNA, 23 nt, Human
agauuuuuuauugcuaguauuug

SEQ ID NO: 3480223 - RNA, 21 nt, Human
agauuuuuucagacuugucaa

SEQ ID NO: 3480224 - RNA, 15 nt, Human
agauuuuuuuguugu

SEQ ID NO: 3480225 - RNA, 16 nt, Human
agauuuuuuuguuguu

SEQ ID NO: 3480226 - RNA, 19 nt, Human
agcaaaaaaaacccaugug

SEQ ID NO: 3480227 - RNA, 13 nt, Human
agcaaaaaaugaa

SEQ ID NO: 3480228 - RNA, 20 nt, Human
agcaaaaaaugaaugucuaa

SEQ ID NO: 3480229 - RNA, 13 nt, Human
agcaaaaaugcua

SEQ ID NO: 3480230 - RNA, 21 nt, Human
agcaaaaaugcuaauauuaaa

SEQ ID NO: 3480231 - RNA, 16 nt, Human
agcaaaaccauugcuu

SEQ ID NO: 3480232 - RNA, 14 nt, Human
agcaaaacuuuuaa

SEQ ID NO: 3480233 - RNA, 14 nt, Human
agcaaaagaagaag

SEQ ID NO: 3480234 - RNA, 17 nt, Human
agcaaaagaauggcaga

SEQ ID NO: 3480235 - RNA, 18 nt, Human
agcaaaagggugucugag

SEQ ID NO: 3480236 - RNA, 13 nt, Human
agcaaaaucaaga

SEQ ID NO: 3480237 - RNA, 15 nt, Human
agcaaaaucauuuua

SEQ ID NO: 3480238 - RNA, 15 nt, Human
agcaaaaugcaugua

SEQ ID NO: 3480239 - RNA, 23 nt, Human
agcaaaauuuuuucucuaggaaa

SEQ ID NO: 3480240 - RNA, 24 nt, Human
agcaaaauuuuuucucuaggaaau

SEQ ID NO: 3480241 - RNA, 13 nt, Human
agcaaacacauua

SEQ ID NO: 3480242 - RNA, 13 nt, Human
agcaaaccaagag

SEQ ID NO: 3480243 - RNA, 16 nt, Human
agcaaacccugucaaa

SEQ ID NO: 3480244 - RNA, 15 nt, Human
agcaaaccugcccca

SEQ ID NO: 3480245 - RNA, 19 nt, Human
agcaaacugcaugcccaga

SEQ ID NO: 3480246 - RNA, 19 nt, Human
agcaaacuuguugaauuua

SEQ ID NO: 3480247 - RNA, 23 nt, Human
agcaaagaggacucgcuuguaaa

SEQ ID NO: 3480248 - RNA, 16 nt, Human
agcaaagagugggcug

SEQ ID NO: 3480249 - RNA, 22 nt, Human
agcaaagagugggcugcaucug

SEQ ID NO: 3480250 - RNA, 12 nt, Human
agcaaagaucaa

SEQ ID NO: 3480251 - RNA, 14 nt, Human
agcaaagcacagag

SEQ ID NO: 3480252 - RNA, 15 nt, Human
agcaaagcacagaga

SEQ ID NO: 3480253 - RNA, 22 nt, Human
agcaaagcacccauuucaaugu

SEQ ID NO: 3480254 - RNA, 15 nt, Human
agcaaagcccccaga

SEQ ID NO: 3480255 - RNA, 17 nt, Human
agcaaagcccccagagc

SEQ ID NO: 3480256 - RNA, 23 nt, Human
agcaaagcugaugacaacuuccc

SEQ ID NO: 3480257 - RNA, 21 nt, Human
acucuuguugaguucuguaga

SEQ ID NO: 3480258 - RNA, 15 nt, Human
acucuuuaacuugua

SEQ ID NO: 3480259 - RNA, 19 nt, Human
acucuuuaacuuguaauaa

SEQ ID NO: 3480260 - RNA, 14 nt, Human
acucuuuaugcuug

SEQ ID NO: 3480261 - RNA, 18 nt, Human
acucuuuaugcuugcaaa

SEQ ID NO: 3480262 - RNA, 19 nt, Human
acucuuuauugucuguaaa

SEQ ID NO: 3480263 - RNA, 16 nt, Human
acucuuucuaaugcug

SEQ ID NO: 3480264 - RNA, 18 nt, Human
acucuuucugagugccuu

SEQ ID NO: 3480265 - RNA, 22 nt, Human
acucuuucuguauauacuuuuu

SEQ ID NO: 3480266 - RNA, 22 nt, Human
acucuuuggauagcaugucuuu

SEQ ID NO: 3480267 - RNA, 14 nt, Human
acucuuuguaagag

SEQ ID NO: 3480268 - RNA, 15 nt, Human
acuucuaaaacugua

SEQ ID NO: 3480269 - RNA, 23 nt, Human
acuucuaaaacuguacuuugauu

SEQ ID NO: 3480270 - RNA, 15 nt, Human
acuucuaaaugaagu

SEQ ID NO: 3480271 - RNA, 16 nt, Human
acuucuaaaugaagug

SEQ ID NO: 3480272 - RNA, 13 nt, Human
acuucuaaguaaa

SEQ ID NO: 3480273 - RNA, 18 nt, Human
acuucuaaguaaaaccac

SEQ ID NO: 3480274 - RNA, 19 nt, Human
acuucuaaguaaaaccaca

SEQ ID NO: 3480275 - RNA, 19 nt, Human
acuucuaaguugaguauau

SEQ ID NO: 3480276 - RNA, 15 nt, Human
acuucuaauaucauu

SEQ ID NO: 3480277 - RNA, 16 nt, Human
acuucuaauaucauuc

SEQ ID NO: 3480278 - RNA, 14 nt, Human
acuucuaauugcca

SEQ ID NO: 3480279 - RNA, 21 nt, Human
acuucuauuuuaaagacaaug

SEQ ID NO: 3480280 - RNA, 18 nt, Human
acuucucaggacacaggc

SEQ ID NO: 3480281 - RNA, 19 nt, Human
acuucucauuuuuuaaaaa

SEQ ID NO: 3480282 - RNA, 14 nt, Human
acuucuccacccug

SEQ ID NO: 3480283 - RNA, 22 nt, Human
acuucuccagacccaccacacc

SEQ ID NO: 3480284 - RNA, 16 nt, Human
acuucuccaggucuca

SEQ ID NO: 3480285 - RNA, 19 nt, Human
acuucucuauaaaaaauau

SEQ ID NO: 3480286 - RNA, 21 nt, Human
acuucucuauaaaaaauaugu

SEQ ID NO: 3480287 - RNA, 14 nt, Human
acuucugacagccu

SEQ ID NO: 3480288 - RNA, 15 nt, Human
acuucugacagccuc

SEQ ID NO: 3480289 - RNA, 15 nt, Human
acuucugaccacacu

SEQ ID NO: 3480290 - RNA, 16 nt, Human
acuucugaccacacuu

SEQ ID NO: 3480291 - RNA, 16 nt, Human
acuucugacucuuccc

SEQ ID NO: 3480292 - RNA, 18 nt, Human
acuucugcaacaagcaug

SEQ ID NO: 3480293 - RNA, 19 nt, Human
acuucugcaacaagcaugc

SEQ ID NO: 3480294 - RNA, 12 nt, Human
acuucugccaga

SEQ ID NO: 3480295 - RNA, 19 nt, Human
acuucugccagauguccua

SEQ ID NO: 3480296 - RNA, 22 nt, Human
acuucugccagcauaauacuug

SEQ ID NO: 3480297 - RNA, 18 nt, Human
acuucugccauauucugu

SEQ ID NO: 3480298 - RNA, 19 nt, Human
acuucugccauauucuguu

SEQ ID NO: 3480299 - RNA, 23 nt, Human
acuucugccugaggggcagccug

SEQ ID NO: 3480300 - RNA, 12 nt, Human
acuucugccugg

SEQ ID NO: 3480301 - RNA, 13 nt, Human
acuucugccugga

SEQ ID NO: 3480302 - RNA, 14 nt, Human
acuucuguccugug

SEQ ID NO: 3480303 - RNA, 19 nt, Human
acuucugugagacccccac

SEQ ID NO: 3480304 - RNA, 15 nt, Human
acuucuguuuagucu

SEQ ID NO: 3480305 - RNA, 12 nt, Human
acuucuguuuca

SEQ ID NO: 3480306 - RNA, 15 nt, Human
acuucuguuuuacca

SEQ ID NO: 3480307 - RNA, 16 nt, Human
acuucuguuuucaauc

SEQ ID NO: 3480308 - RNA, 17 nt, Human
acuucuuacgcaaugcu

SEQ ID NO: 3480309 - RNA, 21 nt, Human
acuucuuauggaauugauuug

SEQ ID NO: 3480310 - RNA, 16 nt, Human
acuucuucucuuagau

SEQ ID NO: 3480311 - RNA, 11 nt, Human
acuucuucugu

SEQ ID NO: 3480312 - RNA, 16 nt, Human
acuucuucuguaauau

SEQ ID NO: 3480313 - RNA, 20 nt, Human
acuucuucuguccaagcaga

SEQ ID NO: 3480314 - RNA, 19 nt, Human
acuucuugcuggucuaguc

SEQ ID NO: 3480315 - RNA, 11 nt, Human
acuucuugcuu

SEQ ID NO: 3480316 - RNA, 22 nt, Human
acuucuuggcuuggugaggaaa

SEQ ID NO: 3480317 - RNA, 12 nt, Human
acuucuugucag

SEQ ID NO: 3480318 - RNA, 16 nt, Human
acuucuugucagacau

SEQ ID NO: 3480319 - RNA, 20 nt, Human
acuucuugucagacauaaag

SEQ ID NO: 3480320 - RNA, 23 nt, Human
acuucuugucagacauaaagcca

SEQ ID NO: 3480321 - RNA, 18 nt, Human
acuucuuuaauuuuggaa

SEQ ID NO: 3480322 - RNA, 19 nt, Human
acuucuuuaauuuuggaau

SEQ ID NO: 3480323 - RNA, 20 nt, Human
acuucuuuaauuuuggaauu

SEQ ID NO: 3480324 - RNA, 19 nt, Human
acuucuuucccuuccucca

SEQ ID NO: 3480325 - RNA, 21 nt, Human
acuucuuugcaguucccaucu

SEQ ID NO: 3480326 - RNA, 20 nt, Human
acuucuuugcuuugcccagc

SEQ ID NO: 3480327 - RNA, 21 nt, Human
acuucuuugcuuugcccagca

SEQ ID NO: 3480328 - RNA, 22 nt, Human
acuucuuuuauaacuaguccuu

SEQ ID NO: 3480329 - RNA, 11 nt, Human
acuucuuuuca

SEQ ID NO: 3480330 - RNA, 12 nt, Human
acuucuuuucac

SEQ ID NO: 3480331 - RNA, 15 nt, Human
acuucuuuucacauu

SEQ ID NO: 3480332 - RNA, 19 nt, Human
acuucuuuucacauucuua

SEQ ID NO: 3480333 - RNA, 20 nt, Human
acuugaaaagagacaggcag

SEQ ID NO: 3480334 - RNA, 21 nt, Human
acuugaaaagagacaggcagg

SEQ ID NO: 3480335 - RNA, 12 nt, Human
acuugaaaauua

SEQ ID NO: 3480336 - RNA, 16 nt, Human
acuugaaauuauaucu

SEQ ID NO: 3480337 - RNA, 16 nt, Human
acuugaaauuugaauu

SEQ ID NO: 3480338 - RNA, 16 nt, Human
acuugaacaaaagggu

SEQ ID NO: 3480339 - RNA, 21 nt, Human
acuugaacccauauuuguaca

SEQ ID NO: 3480340 - RNA, 17 nt, Human
acuugaacguuuucuaa

SEQ ID NO: 3480341 - RNA, 18 nt, Human
acuugaacguuuucuaau

SEQ ID NO: 3480342 - RNA, 19 nt, Human
acuugaacguuuucuaauu

SEQ ID NO: 3480343 - RNA, 21 nt, Human
acuugaacugauucacaucuc

SEQ ID NO: 3480344 - RNA, 14 nt, Human
acuugaacuugccu

SEQ ID NO: 3480345 - RNA, 15 nt, Human
acuugaacuugccuc

SEQ ID NO: 3480346 - RNA, 16 nt, Human
acuugaacuugccucu

SEQ ID NO: 3480347 - RNA, 19 nt, Human
acuugaagccugcuccuuc

SEQ ID NO: 3480348 - RNA, 20 nt, Human
acuugaagccugcuccuucc

SEQ ID NO: 3480349 - RNA, 14 nt, Human
acuugaagggccag

SEQ ID NO: 3480350 - RNA, 17 nt, Human
acuugaagggccagagc

SEQ ID NO: 3480351 - RNA, 19 nt, Human
acuugaagggccagagcca

SEQ ID NO: 3480352 - RNA, 22 nt, Human
acuugaagggccagagccaggg

SEQ ID NO: 3480353 - RNA, 15 nt, Human
acuugaauaguauug

SEQ ID NO: 3480354 - RNA, 18 nt, Human
acuugaauaguauugugu

SEQ ID NO: 3480355 - RNA, 19 nt, Human
acuugaauccuagggccug

SEQ ID NO: 3480356 - RNA, 16 nt, Human
acuugaaugugucacu

SEQ ID NO: 3480357 - RNA, 18 nt, Human
acuugaauuuucccacug

SEQ ID NO: 3480358 - RNA, 14 nt, Human
acuugacccugagc

SEQ ID NO: 3480359 - RNA, 18 nt, Human
acuugacuccauuucauc

SEQ ID NO: 3480360 - RNA, 23 nt, Human
acuugagaacuugacaaguugcg

SEQ ID NO: 3480361 - RNA, 12 nt, Human
acuugagaggau

SEQ ID NO: 3480362 - RNA, 12 nt, Human
acuugagcaugu

SEQ ID NO: 3480363 - RNA, 15 nt, Human
acuugagcuuuaaaa

SEQ ID NO: 3480364 - RNA, 12 nt, Human
acuugaggacac

SEQ ID NO: 3480365 - RNA, 14 nt, Human
acuugaggacacau

SEQ ID NO: 3480366 - RNA, 17 nt, Human
acuugaggacacauguc

SEQ ID NO: 3480367 - RNA, 18 nt, Human
acuugaggauuuugagua

SEQ ID NO: 3480368 - RNA, 21 nt, Human
acuugagggcccagagcagga

SEQ ID NO: 3480369 - RNA, 21 nt, Human
acuugagguggccuccuugcu

SEQ ID NO: 3480370 - RNA, 18 nt, Human
acuugaguuacaccagac

SEQ ID NO: 3480371 - RNA, 17 nt, Human
acuugauacuuguuuuc

SEQ ID NO: 3480372 - RNA, 19 nt, Human
acuugauagcaaacacugg

SEQ ID NO: 3480373 - RNA, 20 nt, Human
acuugauccauuucuaauua

SEQ ID NO: 3480374 - RNA, 19 nt, Human
acuugauggcuaacuuaca

SEQ ID NO: 3480375 - RNA, 18 nt, Human
acuugcaaaaucaguuuu

SEQ ID NO: 3480376 - RNA, 21 nt, Human
acuugcacagggauucucaca

SEQ ID NO: 3480377 - RNA, 15 nt, Human
acuugcacucuucua

SEQ ID NO: 3480378 - RNA, 16 nt, Human
acuugcacucuucuac

SEQ ID NO: 3480379 - RNA, 19 nt, Human
acuugcagacucuacagag

SEQ ID NO: 3480380 - RNA, 23 nt, Human
acuugcagcugauguuggaagag

SEQ ID NO: 3480381 - RNA, 19 nt, Human
acuugcauccaacuccagg

SEQ ID NO: 3480382 - RNA, 14 nt, Human
acuugcaugaagag

SEQ ID NO: 3480383 - RNA, 15 nt, Human
acuugcauggagcag

SEQ ID NO: 3480384 - RNA, 11 nt, Human
acuugcauuuc

SEQ ID NO: 3480385 - RNA, 18 nt, Human
acuugcauuuuugcagga

SEQ ID NO: 3480386 - RNA, 13 nt, Human
acuugcccugcuc

SEQ ID NO: 3480387 - RNA, 18 nt, Human
acuugccuccgugucacc

SEQ ID NO: 3480388 - RNA, 13 nt, Human
acuugccucuucc

SEQ ID NO: 3480389 - RNA, 17 nt, Human
acuugccucuuccuuga

SEQ ID NO: 3480390 - RNA, 23 nt, Human
acuugccucuuuuaccugcugcu

SEQ ID NO: 3480391 - RNA, 21 nt, Human
acuugccugccuuuccaucca

SEQ ID NO: 3480392 - RNA, 13 nt, Human
acuugccuggguc

SEQ ID NO: 3480393 - RNA, 22 nt, Human
acuugcgagaaauucguguguu

SEQ ID NO: 3480394 - RNA, 14 nt, Human
acuugcgcagaaaa

SEQ ID NO: 3480395 - RNA, 22 nt, Human
acuugcucagguacuuguaaau

SEQ ID NO: 3480396 - RNA, 23 nt, Human
acuugcucucuggccuuuuccua

SEQ ID NO: 3480397 - RNA, 12 nt, Human
acuugcucugga

SEQ ID NO: 3480398 - RNA, 14 nt, Human
acuugcucuggacc

SEQ ID NO: 3480399 - RNA, 20 nt, Human
acuugcucuugaugccuggc

SEQ ID NO: 3480400 - RNA, 21 nt, Human
acuugcugcaguaugaaaaua

SEQ ID NO: 3480401 - RNA, 11 nt, Human
acuugcugccu

SEQ ID NO: 3480402 - RNA, 13 nt, Human
acuugcugccucg

SEQ ID NO: 3480403 - RNA, 17 nt, Human
acuugcugccugaagaa

SEQ ID NO: 3480404 - RNA, 23 nt, Human
acuugcugccugaagaacaguaa

SEQ ID NO: 3480405 - RNA, 14 nt, Human
acuugcugcuauuu

SEQ ID NO: 3480406 - RNA, 17 nt, Human
acuugcugcuauuuuac

SEQ ID NO: 3480407 - RNA, 15 nt, Human
acuugcugcugucuu

SEQ ID NO: 3480408 - RNA, 17 nt, Human
acuugcuuaaaugugaa

SEQ ID NO: 3480409 - RNA, 19 nt, Human
acuugcuuaaauuucuuau

SEQ ID NO: 3480410 - RNA, 16 nt, Human
acuugcuucucuagcu

SEQ ID NO: 3480411 - RNA, 19 nt, Human
acuugcuuuggucacuuuu

SEQ ID NO: 3480412 - RNA, 23 nt, Human
acuugcuuuggucacuuuuagau

SEQ ID NO: 3480413 - RNA, 14 nt, Human
acuuggaagcuccg

SEQ ID NO: 3480414 - RNA, 22 nt, Human
acuuggaauuuguaaccucagc

SEQ ID NO: 3480415 - RNA, 23 nt, Human
acuuggaauuuguaaccucagcu

SEQ ID NO: 3480416 - RNA, 18 nt, Human
acuuggacucuugcucuu

SEQ ID NO: 3480417 - RNA, 21 nt, Human
acuuggacuuguccucagcag

SEQ ID NO: 3480418 - RNA, 14 nt, Human
acuuuauaaauuuc

SEQ ID NO: 3480419 - RNA, 18 nt, Human
acuuuauaacuaacaugu

SEQ ID NO: 3480420 - RNA, 16 nt, Human
acuuuauacauuagua

SEQ ID NO: 3480421 - RNA, 19 nt, Human
acuuuauacauuaguaaau

SEQ ID NO: 3480422 - RNA, 20 nt, Human
acuuuauacccagaaaguua

SEQ ID NO: 3480423 - RNA, 22 nt, Human
acuuuauacccagaaaguuauu

SEQ ID NO: 3480424 - RNA, 13 nt, Human
acuuuaucacuua

SEQ ID NO: 3480425 - RNA, 13 nt, Human
acuuuaucacuuu

SEQ ID NO: 3480426 - RNA, 17 nt, Human
acuuuaucacuuuuuga

SEQ ID NO: 3480427 - RNA, 12 nt, Human
acuuuaugcuaa

SEQ ID NO: 3480428 - RNA, 12 nt, Human
acuuuauuaaau

SEQ ID NO: 3480429 - RNA, 20 nt, Human
acuuuauuaaauacaaaacu

SEQ ID NO: 3480430 - RNA, 13 nt, Human
acuuuauugcauc

SEQ ID NO: 3480431 - RNA, 12 nt, Human
acuuuauuucca

SEQ ID NO: 3480432 - RNA, 20 nt, Human
acuuuauuuuauauaauaaa

SEQ ID NO: 3480433 - RNA, 13 nt, Human
acuuucaaaauua

SEQ ID NO: 3480434 - RNA, 21 nt, Human
acuuucaaaguggaugcaauu

SEQ ID NO: 3480435 - RNA, 19 nt, Human
acuuucaagaacuuguuua

SEQ ID NO: 3480436 - RNA, 21 nt, Human
acuuucagguacuaaauaccu

SEQ ID NO: 3480437 - RNA, 18 nt, Human
acuuucagugaaagcauc

SEQ ID NO: 3480438 - RNA, 15 nt, Human
acuuucauuccuuca

SEQ ID NO: 3480439 - RNA, 20 nt, Human
acuuucauuccuucagauuu

SEQ ID NO: 3480440 - RNA, 17 nt, Human
acuuucauugccagugu

SEQ ID NO: 3480441 - RNA, 14 nt, Human
acuuucauuggaaa

SEQ ID NO: 3480442 - RNA, 20 nt, Human
acuuucauuuuuuuccaggc

SEQ ID NO: 3480443 - RNA, 21 nt, Human
acuuucauuuuuuuccaggcu

SEQ ID NO: 3480444 - RNA, 19 nt, Human
acuuuccaauaaagaguuc

SEQ ID NO: 3480445 - RNA, 17 nt, Human
acuuuccaauucuccuu

SEQ ID NO: 3480446 - RNA, 19 nt, Human
acuuuccacccccucccug

SEQ ID NO: 3480447 - RNA, 20 nt, Human
acuuuccacccccucccugg

SEQ ID NO: 3480448 - RNA, 18 nt, Human
acuuuccacuucuuccuu

SEQ ID NO: 3480449 - RNA, 13 nt, Human
acuuuccauuaca

SEQ ID NO: 3480450 - RNA, 14 nt, Human
acuuuccauuacaa

SEQ ID NO: 3480451 - RNA, 21 nt, Human
acuuuccccaccagaugcuga

SEQ ID NO: 3480452 - RNA, 22 nt, Human
acuuuccccgugggccauggca

SEQ ID NO: 3480453 - RNA, 11 nt, Human
acuuucccuug

SEQ ID NO: 3480454 - RNA, 13 nt, Human
acuuucccuugcu

SEQ ID NO: 3480455 - RNA, 18 nt, Human
acuuuccucuuccugccu

SEQ ID NO: 3480456 - RNA, 23 nt, Human
acuuuccuucauucaacccaccu

SEQ ID NO: 3480457 - RNA, 16 nt, Human
acuuucguacauuggc

SEQ ID NO: 3480458 - RNA, 15 nt, Human
acuuucuaauguuuc

SEQ ID NO: 3480459 - RNA, 19 nt, Human
acuuucuacaaugugaacu

SEQ ID NO: 3480460 - RNA, 15 nt, Human
acuuucuagauuaag

SEQ ID NO: 3480461 - RNA, 19 nt, Human
acuuucuauuuuaaucuug

SEQ ID NO: 3480462 - RNA, 12 nt, Human
acuuucucuaau

SEQ ID NO: 3480463 - RNA, 13 nt, Human
acuuucugccugg

SEQ ID NO: 3480464 - RNA, 18 nt, Human
acuuucuguaaacucaaa

SEQ ID NO: 3480465 - RNA, 19 nt, Human
acuuucuguaaacucaaaa

SEQ ID NO: 3480466 - RNA, 17 nt, Human
acuuucuguuaaaaugc

SEQ ID NO: 3480467 - RNA, 23 nt, Human
acuuucuguuaaaaugcaugauu

SEQ ID NO: 3480468 - RNA, 19 nt, Human
acuuucuguugccacaacc

SEQ ID NO: 3480469 - RNA, 14 nt, Human
acuuucuucaaaau

SEQ ID NO: 3480470 - RNA, 14 nt, Human
acuuucuucugaau

SEQ ID NO: 3480471 - RNA, 20 nt, Human
acuuucuucugaauauuuua

SEQ ID NO: 3480472 - RNA, 21 nt, Human
acuuucuuuucgccguggcug

SEQ ID NO: 3480473 - RNA, 15 nt, Human
acuuucuuuucugga

SEQ ID NO: 3480474 - RNA, 15 nt, Human
acuuugaaauaccuc

SEQ ID NO: 3480475 - RNA, 19 nt, Human
acuuugaaauguguuucug

SEQ ID NO: 3480476 - RNA, 23 nt, Human
acuuugaaauguguuucuguaua

SEQ ID NO: 3480477 - RNA, 14 nt, Human
acuuugaaguuagc

SEQ ID NO: 3480478 - RNA, 12 nt, Human
acuuugaauaaa

SEQ ID NO: 3480479 - RNA, 12 nt, Human
acuuugaaugug

SEQ ID NO: 3480480 - RNA, 14 nt, Human
acuuugaauguguu

SEQ ID NO: 3480481 - RNA, 16 nt, Human
acuuugacaaccauga

SEQ ID NO: 3480482 - RNA, 22 nt, Human
acuuugacacuuuucauaucau

SEQ ID NO: 3480483 - RNA, 23 nt, Human
acuuugacacuuuucauaucauu

SEQ ID NO: 3480484 - RNA, 22 nt, Human
acuuugaccuaaauuauuuacu

SEQ ID NO: 3480485 - RNA, 15 nt, Human
acuuugaccucugca

SEQ ID NO: 3480486 - RNA, 23 nt, Human
acuuugacgagucaccuuccagg

SEQ ID NO: 3480487 - RNA, 18 nt, Human
acuuugagaucuaaaaau

SEQ ID NO: 3480488 - RNA, 19 nt, Human
acuuugagaucuaaaaaua

SEQ ID NO: 3480489 - RNA, 10 nt, Human
acuuugaugu

SEQ ID NO: 3480490 - RNA, 16 nt, Human
acuuugaugucagcag

SEQ ID NO: 3480491 - RNA, 22 nt, Human
acuuugaugucagcaguugcug

SEQ ID NO: 3480492 - RNA, 22 nt, Human
acuuugaugucauguguucccu

SEQ ID NO: 3480493 - RNA, 13 nt, Human
acuuugauucaca

SEQ ID NO: 3480494 - RNA, 19 nt, Human
acuuugauucacauguuuu

SEQ ID NO: 3480495 - RNA, 23 nt, Human
acuuugauucacauguuuucaaa

SEQ ID NO: 3480496 - RNA, 19 nt, Human
acuuugcacgacgcccucu

SEQ ID NO: 3480497 - RNA, 20 nt, Human
acuuugcacgacgcccucuc

SEQ ID NO: 3480498 - RNA, 22 nt, Human
acuuugcagcacagcugagagg

SEQ ID NO: 3480499 - RNA, 23 nt, Human
acuuugccuccuguguacugugu

SEQ ID NO: 3480500 - RNA, 21 nt, Human
acuuugcuaaagacaugaagc

SEQ ID NO: 3480501 - RNA, 20 nt, Human
acuuugcuugcaguagauuu

SEQ ID NO: 3480502 - RNA, 13 nt, Human
acuuugcuugcuu

SEQ ID NO: 3480503 - RNA, 16 nt, Human
acuuugcuuuaauaua

SEQ ID NO: 3480504 - RNA, 19 nt, Human
acuuugcuuuaauauaaau

SEQ ID NO: 3480505 - RNA, 22 nt, Human
acuuugcuuuaauauaaaugca

SEQ ID NO: 3480506 - RNA, 13 nt, Human
acuuuggaaagac

SEQ ID NO: 3480507 - RNA, 16 nt, Human
acuuuggaaccagacu

SEQ ID NO: 3480508 - RNA, 17 nt, Human
acuuuggaaccagacuc

SEQ ID NO: 3480509 - RNA, 23 nt, Human
acuuuggaaccagacucuugccu

SEQ ID NO: 3480510 - RNA, 23 nt, Human
acuuuggagagugagcuacagag

SEQ ID NO: 3480511 - RNA, 22 nt, Human
acuuuggaguccccucaccucc

SEQ ID NO: 3480512 - RNA, 14 nt, Human
acuuuggcugcaug

SEQ ID NO: 3480513 - RNA, 12 nt, Human
acuuugggaggc

SEQ ID NO: 3480514 - RNA, 16 nt, Human
acuuugggaggccaag

SEQ ID NO: 3480515 - RNA, 16 nt, Human
acuuugggaggccgag

SEQ ID NO: 3480516 - RNA, 19 nt, Human
acuuugggaggcugaggug

SEQ ID NO: 3480517 - RNA, 15 nt, Human
acuuuggggaaggga

SEQ ID NO: 3480518 - RNA, 17 nt, Human
acuuuggggcuaauuua

SEQ ID NO: 3480519 - RNA, 16 nt, Human
acuuugguaccagaua

SEQ ID NO: 3480520 - RNA, 23 nt, Human
acuuuggugcgggcacaauaaau

SEQ ID NO: 3480521 - RNA, 10 nt, Human
acuuugguua

SEQ ID NO: 3480522 - RNA, 23 nt, Human
acuuugguuauuuuacuuuuugg

SEQ ID NO: 3480523 - RNA, 17 nt, Human
acuuuguaaauucugau

SEQ ID NO: 3480524 - RNA, 15 nt, Human
acuuuguaguguuug

SEQ ID NO: 3480525 - RNA, 20 nt, Human
acuuuguaguguuuggugcu

SEQ ID NO: 3480526 - RNA, 18 nt, Human
acuuuguauacuuuaaau

SEQ ID NO: 3480527 - RNA, 17 nt, Human
acuuuguauaguuaugu

SEQ ID NO: 3480528 - RNA, 24 nt, Human
acuuuguauuguccuauuaguguu

SEQ ID NO: 3480529 - RNA, 20 nt, Human
acuuugucgcccaggcugga

SEQ ID NO: 3480530 - RNA, 17 nt, Human
acuuugucugaaaaauu

SEQ ID NO: 3480531 - RNA, 10 nt, Human
acuuugugcu

SEQ ID NO: 3480532 - RNA, 22 nt, Human
acuuugugcugggguuaucuga

SEQ ID NO: 3480533 - RNA, 17 nt, Human
acuuuguggaccaauua

SEQ ID NO: 3480534 - RNA, 20 nt, Human
acuuuguggaccaauuauug

SEQ ID NO: 3480535 - RNA, 17 nt, Human
acuuuguggaugucuuc

SEQ ID NO: 3480536 - RNA, 20 nt, Human
acuuuguuaggauuuucaca

SEQ ID NO: 3480537 - RNA, 20 nt, Human
acuuuguuucguggggaggu

SEQ ID NO: 3480538 - RNA, 12 nt, Human
acuuuuaaacag

SEQ ID NO: 3480539 - RNA, 21 nt, Human
acuuuuaaagaauuucuuuau

SEQ ID NO: 3480540 - RNA, 12 nt, Human
acuuuuaagacu

SEQ ID NO: 3480541 - RNA, 14 nt, Human
acuuuuaaggcagu

SEQ ID NO: 3480542 - RNA, 18 nt, Human
acuuuuaaugaacaaaug

SEQ ID NO: 3480543 - RNA, 19 nt, Human
acuuuuacucugccuacag

SEQ ID NO: 3480544 - RNA, 17 nt, Human
acuuuuauaaagcaugu

SEQ ID NO: 3480545 - RNA, 12 nt, Human
acuuuuaugaua

SEQ ID NO: 3480546 - RNA, 23 nt, Human
acuuuuauuuccagugaaaucag

SEQ ID NO: 3480547 - RNA, 14 nt, Human
acuuuuauuugcaa

SEQ ID NO: 3480548 - RNA, 14 nt, Human
acuuuucauucucu

SEQ ID NO: 3480549 - RNA, 18 nt, Human
acuuuucauucucuuuua

SEQ ID NO: 3480550 - RNA, 11 nt, Human
acuuuuccagu

SEQ ID NO: 3480551 - RNA, 17 nt, Human
acuuuuccauguaucua

SEQ ID NO: 3480552 - RNA, 12 nt, Human
acuuuuccuucc

SEQ ID NO: 3480553 - RNA, 23 nt, Human
acuuuuccuucccucaaagcuuc

SEQ ID NO: 3480554 - RNA, 14 nt, Human
acuuuuccuugcau

SEQ ID NO: 3480555 - RNA, 15 nt, Human
acuuuuccuugcaua

SEQ ID NO: 3480556 - RNA, 21 nt, Human
acuuuuccuugcauacaaaca

SEQ ID NO: 3480557 - RNA, 19 nt, Human
acuuuuccuuugaauccuc

SEQ ID NO: 3480558 - RNA, 17 nt, Human
acuuuucguuaacauug

SEQ ID NO: 3480559 - RNA, 18 nt, Human
acuuuucuagaauuauuu

SEQ ID NO: 3480560 - RNA, 17 nt, Human
acuuuucuauuaaaagu

SEQ ID NO: 3480561 - RNA, 15 nt, Human
acuuuucuccaugag

SEQ ID NO: 3480562 - RNA, 17 nt, Human
acuuuucuuaaaaaguu

SEQ ID NO: 3480563 - RNA, 24 nt, Human
acuuuucuuaaaccuucaguuaug

SEQ ID NO: 3480564 - RNA, 16 nt, Human
acuuuugagacuuuuu

SEQ ID NO: 3480565 - RNA, 12 nt, Human
acuuuugagugu

SEQ ID NO: 3480566 - RNA, 16 nt, Human
acuuuugagugugugu

SEQ ID NO: 3480567 - RNA, 11 nt, Human
acuuuugcaag

SEQ ID NO: 3480568 - RNA, 15 nt, Human
acugccuauuuuaau

SEQ ID NO: 3480569 - RNA, 21 nt, Human
acugccuauuuuaauaaacac

SEQ ID NO: 3480570 - RNA, 16 nt, Human
acugccucucccucug

SEQ ID NO: 3480571 - RNA, 18 nt, Human
acugccucucccuggccc

SEQ ID NO: 3480572 - RNA, 19 nt, Human
acugccucucccuggcccu

SEQ ID NO: 3480573 - RNA, 13 nt, Human
acugccucugcca

SEQ ID NO: 3480574 - RNA, 15 nt, Human
acugccucugccaca

SEQ ID NO: 3480575 - RNA, 13 nt, Human
acugccucugccu

SEQ ID NO: 3480576 - RNA, 15 nt, Human
acugccucugccuua

SEQ ID NO: 3480577 - RNA, 22 nt, Human
acugccucugccuuagaggagc

SEQ ID NO: 3480578 - RNA, 15 nt, Human
acugccucuuccucc

SEQ ID NO: 3480579 - RNA, 17 nt, Human
acugccugauggaccug

SEQ ID NO: 3480580 - RNA, 20 nt, Human
acugccugauggaccuguca

SEQ ID NO: 3480581 - RNA, 18 nt, Human
acugccugccuuaaguga

SEQ ID NO: 3480582 - RNA, 11 nt, Human
acugccugcuc

SEQ ID NO: 3480583 - RNA, 13 nt, Human
acugccugcuccc

SEQ ID NO: 3480584 - RNA, 19 nt, Human
acugccugcucccauccug

SEQ ID NO: 3480585 - RNA, 11 nt, Human
acugccugggc

SEQ ID NO: 3480586 - RNA, 12 nt, Human
acugccugggcu

SEQ ID NO: 3480587 - RNA, 14 nt, Human
acugccugggcucc

SEQ ID NO: 3480588 - RNA, 15 nt, Human
acugccuguauacuu

SEQ ID NO: 3480589 - RNA, 16 nt, Human
acugccuguauacuuu

SEQ ID NO: 3480590 - RNA, 20 nt, Human
acugccuguauacuuuagua

SEQ ID NO: 3480591 - RNA, 11 nt, Human
acugccuuaau

SEQ ID NO: 3480592 - RNA, 15 nt, Human
acugccuucgcuucu

SEQ ID NO: 3480593 - RNA, 21 nt, Human
acugccuucgcuucuugccuc

SEQ ID NO: 3480594 - RNA, 13 nt, Human
acugccuuuagaa

SEQ ID NO: 3480595 - RNA, 16 nt, Human
acugccuuuggcagag

SEQ ID NO: 3480596 - RNA, 20 nt, Human
acugccuuuuuauuuauaug

SEQ ID NO: 3480597 - RNA, 15 nt, Human
acugcgacuuucugc

SEQ ID NO: 3480598 - RNA, 17 nt, Human
acugcgacuuucugccu

SEQ ID NO: 3480599 - RNA, 19 nt, Human
acugcgacuuucugccugg

SEQ ID NO: 3480600 - RNA, 22 nt, Human
acugcgacuuucugccuggagu

SEQ ID NO: 3480601 - RNA, 23 nt, Human
acugcgcccuuaacugcauccag

SEQ ID NO: 3480602 - RNA, 18 nt, Human
acugcgcuuuauuuucuu

SEQ ID NO: 3480603 - RNA, 22 nt, Human
acugcgggaugguccuggggcu

SEQ ID NO: 3480604 - RNA, 16 nt, Human
acugcggggcuuggcu

SEQ ID NO: 3480605 - RNA, 14 nt, Human
acugcguucugcaa

SEQ ID NO: 3480606 - RNA, 14 nt, Human
acugcuaaauaaaa

SEQ ID NO: 3480607 - RNA, 15 nt, Human
acugcuaaauaaaau

SEQ ID NO: 3480608 - RNA, 19 nt, Human
acugcuaaauaaaauuugu

SEQ ID NO: 3480609 - RNA, 17 nt, Human
acugcuaaguauuuccc

SEQ ID NO: 3480610 - RNA, 18 nt, Human
acugcuaaguauuuccca

SEQ ID NO: 3480611 - RNA, 18 nt, Human
acugcuacuguaauuuua

SEQ ID NO: 3480612 - RNA, 16 nt, Human
acugcuaggugggcca

SEQ ID NO: 3480613 - RNA, 17 nt, Human
acugcuaggugggccag

SEQ ID NO: 3480614 - RNA, 13 nt, Human
acugcuaguguuc

SEQ ID NO: 3480615 - RNA, 19 nt, Human
acugcuauuuuccuguucu

SEQ ID NO: 3480616 - RNA, 15 nt, Human
acugcucaggcugca

SEQ ID NO: 3480617 - RNA, 21 nt, Human
acugcuccccagcccuggcuc

SEQ ID NO: 3480618 - RNA, 23 nt, Human
acugcucccuaagccagccuggu

SEQ ID NO: 3480619 - RNA, 17 nt, Human
acugcucccugaagcca

SEQ ID NO: 3480620 - RNA, 21 nt, Human
acugcucccugaagccagccu

SEQ ID NO: 3480621 - RNA, 23 nt, Human
acugcucccugaagccagccuuc

SEQ ID NO: 3480622 - RNA, 13 nt, Human
acugcuccgugga

SEQ ID NO: 3480623 - RNA, 21 nt, Human
acugcuccugagcccccagcu

SEQ ID NO: 3480624 - RNA, 22 nt, Human
acugcuccugagcccccagcuu

SEQ ID NO: 3480625 - RNA, 18 nt, Human
acugcucuaacagcccuc

SEQ ID NO: 3480626 - RNA, 12 nt, Human
acugcucugaga

SEQ ID NO: 3480627 - RNA, 13 nt, Human
acugcucugagaa

SEQ ID NO: 3480628 - RNA, 18 nt, Human
acugcucuuguuucuuuu

SEQ ID NO: 3480629 - RNA, 11 nt, Human
acugcugcaag

SEQ ID NO: 3480630 - RNA, 15 nt, Human
acugcugcaaggccu

SEQ ID NO: 3480631 - RNA, 13 nt, Human
acugcugccacug

SEQ ID NO: 3480632 - RNA, 14 nt, Human
acugcugccacuga

SEQ ID NO: 3480633 - RNA, 17 nt, Human
acugcugccacugaggg

SEQ ID NO: 3480634 - RNA, 16 nt, Human
acugcugcccagccuc

SEQ ID NO: 3480635 - RNA, 18 nt, Human
acugcugcccagccucca

SEQ ID NO: 3480636 - RNA, 22 nt, Human
acugcugccccaaaggaagcuu

SEQ ID NO: 3480637 - RNA, 22 nt, Human
acugcugcgucauuacagggca

SEQ ID NO: 3480638 - RNA, 17 nt, Human
acugcugcuagagccag

SEQ ID NO: 3480639 - RNA, 15 nt, Human
acugcugcugccugg

SEQ ID NO: 3480640 - RNA, 19 nt, Human
acugcugcugccuggccac

SEQ ID NO: 3480641 - RNA, 21 nt, Human
acugcugcuuuuugagguggc

SEQ ID NO: 3480642 - RNA, 16 nt, Human
acugcuggagaggccc

SEQ ID NO: 3480643 - RNA, 12 nt, Human
acugcuggcugc

SEQ ID NO: 3480644 - RNA, 18 nt, Human
acugcugggacuggccag

SEQ ID NO: 3480645 - RNA, 13 nt, Human
acugcuggguggc

SEQ ID NO: 3480646 - RNA, 17 nt, Human
acugcuggguggcccau

SEQ ID NO: 3480647 - RNA, 18 nt, Human
acugcuggguggcccauc

SEQ ID NO: 3480648 - RNA, 22 nt, Human
acugcugugaacccuggggccu

SEQ ID NO: 3480649 - RNA, 18 nt, Human
acugcuguggccaggagg

SEQ ID NO: 3480650 - RNA, 19 nt, Human
acugcuucccauccuaccc

SEQ ID NO: 3480651 - RNA, 20 nt, Human
acugcuucccauccuacccu

SEQ ID NO: 3480652 - RNA, 18 nt, Human
acugcuuccuauaauuuu

SEQ ID NO: 3480653 - RNA, 13 nt, Human
acugcuugaauaa

SEQ ID NO: 3480654 - RNA, 15 nt, Human
acugcuugaggaaaa

SEQ ID NO: 3480655 - RNA, 18 nt, Human
acugcuugaugaagcaag

SEQ ID NO: 3480656 - RNA, 23 nt, Human
acugcuugaugaagcaaggaaga

SEQ ID NO: 3480657 - RNA, 16 nt, Human
acugcuugcccuaagc

SEQ ID NO: 3480658 - RNA, 18 nt, Human
acugcuuggagcugagca

SEQ ID NO: 3480659 - RNA, 12 nt, Human
acugcuuucugu

SEQ ID NO: 3480660 - RNA, 14 nt, Human
acugcuuucuguuc

SEQ ID NO: 3480661 - RNA, 18 nt, Human
acugcuuucuguuccaaa

SEQ ID NO: 3480662 - RNA, 15 nt, Human
acugcuuuuggccug

SEQ ID NO: 3480663 - RNA, 20 nt, Human
acugcuuuuggucuguguga

SEQ ID NO: 3480664 - RNA, 19 nt, Human
acugcuuuuuuuuuuccag

SEQ ID NO: 3480665 - RNA, 16 nt, Human
acuggaaaacagaaca

SEQ ID NO: 3480666 - RNA, 23 nt, Human
acuggaaaacagaacacuuaugu

SEQ ID NO: 3480667 - RNA, 12 nt, Human
acuggaaagaag

SEQ ID NO: 3480668 - RNA, 23 nt, Human
acuggaaagcuuuucuauuuuaa

SEQ ID NO: 3480669 - RNA, 15 nt, Human
acuggaaaggggaga

SEQ ID NO: 3480670 - RNA, 22 nt, Human
acuggaacacuagacaagccag

SEQ ID NO: 3480671 - RNA, 15 nt, Human
acuggaaccagggag

SEQ ID NO: 3480672 - RNA, 12 nt, Human
acuggaagcaca

SEQ ID NO: 3480673 - RNA, 14 nt, Human
acuggaagcacaga

SEQ ID NO: 3480674 - RNA, 15 nt, Human
acuggaagcacagcu

SEQ ID NO: 3480675 - RNA, 20 nt, Human
acuggaagcauguaggagaa

SEQ ID NO: 3480676 - RNA, 16 nt, Human
acuggaagcuaauuug

SEQ ID NO: 3480677 - RNA, 19 nt, Human
acuggaagcuaauuugcau

SEQ ID NO: 3480678 - RNA, 18 nt, Human
acuggaagguggggacag

SEQ ID NO: 3480679 - RNA, 12 nt, Human
acuggaaguuca

SEQ ID NO: 3480680 - RNA, 19 nt, Human
acuggaaguucauaccuaa

SEQ ID NO: 3480681 - RNA, 13 nt, Human
acuggaauuaaaa

SEQ ID NO: 3480682 - RNA, 13 nt, Human
acuggaauuuuua

SEQ ID NO: 3480683 - RNA, 24 nt, Human
acuggaauuuuuauuaugcauaac

SEQ ID NO: 3480684 - RNA, 13 nt, Human
acuggacagcuug

SEQ ID NO: 3480685 - RNA, 15 nt, Human
acuggacagcuugug

SEQ ID NO: 3480686 - RNA, 18 nt, Human
acuggacccuguugcuaa

SEQ ID NO: 3480687 - RNA, 18 nt, Human
acuggacuccggcccucc

SEQ ID NO: 3480688 - RNA, 14 nt, Human
acuggacucuucaa

SEQ ID NO: 3480689 - RNA, 22 nt, Human
acuggacuugagcuuggcagcu

SEQ ID NO: 3480690 - RNA, 21 nt, Human
acuggagacaaugcagaugcc

SEQ ID NO: 3480691 - RNA, 21 nt, Human
acuggagacugugugugcccu

SEQ ID NO: 3480692 - RNA, 19 nt, Human
acuggagcaccaggcacga

SEQ ID NO: 3480693 - RNA, 13 nt, Human
acuggagcaucug

SEQ ID NO: 3480694 - RNA, 14 nt, Human
acuggagcaucuga

SEQ ID NO: 3480695 - RNA, 16 nt, Human
acuggagcaucugacu

SEQ ID NO: 3480696 - RNA, 15 nt, Human
acuggaggccccugg

SEQ ID NO: 3480697 - RNA, 21 nt, Human
acuggaggucacauucaggaa

SEQ ID NO: 3480698 - RNA, 23 nt, Human
acuggaggucacauucaggaaga

SEQ ID NO: 3480699 - RNA, 12 nt, Human
acuggaguccag

SEQ ID NO: 3480700 - RNA, 13 nt, Human
acuggagucugga

SEQ ID NO: 3480701 - RNA, 15 nt, Human
acuggagucuggagu

SEQ ID NO: 3480702 - RNA, 17 nt, Human
acuggagugcagggagg

SEQ ID NO: 3480703 - RNA, 21 nt, Human
acuggaguggcucgccaggcc

SEQ ID NO: 3480704 - RNA, 14 nt, Human
acuggaguuacauu

SEQ ID NO: 3480705 - RNA, 13 nt, Human
acuggauaaauug

SEQ ID NO: 3480706 - RNA, 10 nt, Human
acuggaugaa

SEQ ID NO: 3480707 - RNA, 11 nt, Human
acuggaugaaa

SEQ ID NO: 3480708 - RNA, 22 nt, Human
acuggauuaaacuuaaucuaaa

SEQ ID NO: 3480709 - RNA, 21 nt, Human
acuggcaaacagggccucugc

SEQ ID NO: 3480710 - RNA, 18 nt, Human
acuggcaacauuccaaga

SEQ ID NO: 3480711 - RNA, 16 nt, Human
acuggcaaugguaguu

SEQ ID NO: 3480712 - RNA, 21 nt, Human
acuggcaaugguaguuucugu

SEQ ID NO: 3480713 - RNA, 12 nt, Human
acuggcacagag

SEQ ID NO: 3480714 - RNA, 22 nt, Human
acuggcacaguuuucugagaaa

SEQ ID NO: 3480715 - RNA, 20 nt, Human
acuggcacugaauuaaucau

SEQ ID NO: 3480716 - RNA, 21 nt, Human
acuggcaggcaggcucccagg

SEQ ID NO: 3480717 - RNA, 16 nt, Human
acuggcaguuuuccau

SEQ ID NO: 3480718 - RNA, 20 nt, Human
acuggcaucugacacaaaaa

SEQ ID NO: 3480719 - RNA, 15 nt, Human
acuucauugucccuc

SEQ ID NO: 3480720 - RNA, 20 nt, Human
acuucauuuaaaaaaaucac

SEQ ID NO: 3480721 - RNA, 16 nt, Human
acuuccaaacuaauuu

SEQ ID NO: 3480722 - RNA, 19 nt, Human
acuuccaaacuaauuuuua

SEQ ID NO: 3480723 - RNA, 21 nt, Human
acuuccaaauccccuaagcag

SEQ ID NO: 3480724 - RNA, 18 nt, Human
acuuccaauuuacauacu

SEQ ID NO: 3480725 - RNA, 20 nt, Human
acuuccacagggucccacag

SEQ ID NO: 3480726 - RNA, 21 nt, Human
acuuccacagggucccacagc

SEQ ID NO: 3480727 - RNA, 14 nt, Human
acuuccaccagccu

SEQ ID NO: 3480728 - RNA, 15 nt, Human
acuuccaccagccug

SEQ ID NO: 3480729 - RNA, 18 nt, Human
acuuccaccagccugcac

SEQ ID NO: 3480730 - RNA, 21 nt, Human
acuuccaccucgggcacauuu

SEQ ID NO: 3480731 - RNA, 20 nt, Human
acuuccagauccuggaaauc

SEQ ID NO: 3480732 - RNA, 21 nt, Human
acuuccaggggaaccugccau

SEQ ID NO: 3480733 - RNA, 20 nt, Human
acuuccagugcaacacugaa

SEQ ID NO: 3480734 - RNA, 13 nt, Human
acuuccaugaauu

SEQ ID NO: 3480735 - RNA, 18 nt, Human
acuuccauggcccucauu

SEQ ID NO: 3480736 - RNA, 22 nt, Human
acuuccaugugaggguuuucag

SEQ ID NO: 3480737 - RNA, 13 nt, Human
acuucccacccug

SEQ ID NO: 3480738 - RNA, 18 nt, Human
acuuccccauacaaauaa

SEQ ID NO: 3480739 - RNA, 11 nt, Human
acuucccccaa

SEQ ID NO: 3480740 - RNA, 14 nt, Human
acuuccccuaugga

SEQ ID NO: 3480741 - RNA, 17 nt, Human
acuuccccuccuacccc

SEQ ID NO: 3480742 - RNA, 23 nt, Human
acuucccgucccauauccugccu

SEQ ID NO: 3480743 - RNA, 14 nt, Human
acuucccucuguuu

SEQ ID NO: 3480744 - RNA, 21 nt, Human
acuucccugauugaccugcuc

SEQ ID NO: 3480745 - RNA, 11 nt, Human
acuucccugcu

SEQ ID NO: 3480746 - RNA, 16 nt, Human
acuucccugcugccug

SEQ ID NO: 3480747 - RNA, 14 nt, Human
acuucccugggcaa

SEQ ID NO: 3480748 - RNA, 22 nt, Human
acuucccuuucugcuuguguua

SEQ ID NO: 3480749 - RNA, 18 nt, Human
acuuccucucgcggcccu

SEQ ID NO: 3480750 - RNA, 20 nt, Human
acuuccugagggaucuauac

SEQ ID NO: 3480751 - RNA, 22 nt, Human
acuuccugauugguuucucuuc

SEQ ID NO: 3480752 - RNA, 23 nt, Human
acuuccugauugguuucucuucu

SEQ ID NO: 3480753 - RNA, 14 nt, Human
acuuccugccuggu

SEQ ID NO: 3480754 - RNA, 16 nt, Human
acuuccugccuggucu

SEQ ID NO: 3480755 - RNA, 18 nt, Human
acuuccugccuggucucc

SEQ ID NO: 3480756 - RNA, 12 nt, Human
acuuccugucca

SEQ ID NO: 3480757 - RNA, 13 nt, Human
acuuccuguccag

SEQ ID NO: 3480758 - RNA, 23 nt, Human
acuuccuguccagcuccaaccug

SEQ ID NO: 3480759 - RNA, 22 nt, Human
acuuccuugagacacggagccc

SEQ ID NO: 3480760 - RNA, 14 nt, Human
acuuccuugccagu

SEQ ID NO: 3480761 - RNA, 16 nt, Human
acuuccuugcucuccc

SEQ ID NO: 3480762 - RNA, 20 nt, Human
acuuccuuuaaagaugaacu

SEQ ID NO: 3480763 - RNA, 14 nt, Human
acuucgacacuguu

SEQ ID NO: 3480764 - RNA, 21 nt, Human
acuucgacacuguucuuagcu

SEQ ID NO: 3480765 - RNA, 22 nt, Human
acuucgcaucaaaagacaauuc

SEQ ID NO: 3480766 - RNA, 24 nt, Human
acuucgcaucaaaagacaauucuu

SEQ ID NO: 3480767 - RNA, 22 nt, Human
acuucggcagauacugucucuu

SEQ ID NO: 3480768 - RNA, 22 nt, Human
acuucgggaggucgaggcagga

SEQ ID NO: 3480769 - RNA, 15 nt, Human
acuucgucuucuaau

SEQ ID NO: 3480770 - RNA, 17 nt, Human
acuucguuuaaugaaug

SEQ ID NO: 3480771 - RNA, 15 nt, Human
acccaaaagaaacug

SEQ ID NO: 3480772 - RNA, 15 nt, Human
acccaaaagagaaaa

SEQ ID NO: 3480773 - RNA, 21 nt, Human
acccaaaagcucagccagccc

SEQ ID NO: 3480774 - RNA, 18 nt, Human
acccaaaaggcagaagca

SEQ ID NO: 3480775 - RNA, 23 nt, Human
acccaaaagucaaaaggugccug

SEQ ID NO: 3480776 - RNA, 11 nt, Human
acccaaagcag

SEQ ID NO: 3480777 - RNA, 17 nt, Human
acccaaagcugagccug

SEQ ID NO: 3480778 - RNA, 22 nt, Human
acccaaagcugagccugcaggg

SEQ ID NO: 3480779 - RNA, 14 nt, Human
acccaaauccucuc

SEQ ID NO: 3480780 - RNA, 15 nt, Human
acccaaauccucucc

SEQ ID NO: 3480781 - RNA, 16 nt, Human
acccaaauguucauca

SEQ ID NO: 3480782 - RNA, 23 nt, Human
acccaaccacaucccacucacaa

SEQ ID NO: 3480783 - RNA, 19 nt, Human
acccaaccccaagccagcc

SEQ ID NO: 3480784 - RNA, 17 nt, Human
acccaacccuaucuccu

SEQ ID NO: 3480785 - RNA, 13 nt, Human
acccaacgcucca

SEQ ID NO: 3480786 - RNA, 19 nt, Human
acccaacuagcucuauguu

SEQ ID NO: 3480787 - RNA, 13 nt, Human
acccaacucuccu

SEQ ID NO: 3480788 - RNA, 15 nt, Human
acccaacucuccugg

SEQ ID NO: 3480789 - RNA, 16 nt, Human
acccaacucuccugga

SEQ ID NO: 3480790 - RNA, 19 nt, Human
acccaagaccucagggcac

SEQ ID NO: 3480791 - RNA, 20 nt, Human
acccaagaugcaagaaggag

SEQ ID NO: 3480792 - RNA, 22 nt, Human
acccaagaugggcaucuuuugu

SEQ ID NO: 3480793 - RNA, 15 nt, Human
acccaagcaggaggc

SEQ ID NO: 3480794 - RNA, 15 nt, Human
acccaagcuccuccu

SEQ ID NO: 3480795 - RNA, 19 nt, Human
acccaaggagcacaggucc

SEQ ID NO: 3480796 - RNA, 17 nt, Human
acccaagggcagaaagu

SEQ ID NO: 3480797 - RNA, 20 nt, Human
acccaagggcagaaaguaga

SEQ ID NO: 3480798 - RNA, 21 nt, Human
acccaauagcugcccauuucg

SEQ ID NO: 3480799 - RNA, 13 nt, Human
acccacaagugcc

SEQ ID NO: 3480800 - RNA, 19 nt, Human
acccacagccucugccugu

SEQ ID NO: 3480801 - RNA, 13 nt, Human
acccacagggcua

SEQ ID NO: 3480802 - RNA, 12 nt, Human
acccaccacaca

SEQ ID NO: 3480803 - RNA, 16 nt, Human
acccaccccaccugca

SEQ ID NO: 3480804 - RNA, 15 nt, Human
acccacccccaccca

SEQ ID NO: 3480805 - RNA, 12 nt, Human
acccaccccugc

SEQ ID NO: 3480806 - RNA, 14 nt, Human
acccaccccugugc

SEQ ID NO: 3480807 - RNA, 20 nt, Human
acccaccgccacaauaaaga

SEQ ID NO: 3480808 - RNA, 14 nt, Human
acccaccgggccac

SEQ ID NO: 3480809 - RNA, 19 nt, Human
acccaccguccgcccugcu

SEQ ID NO: 3480810 - RNA, 15 nt, Human
acccaccguggagga

SEQ ID NO: 3480811 - RNA, 14 nt, Human
acccaccucagccu

SEQ ID NO: 3480812 - RNA, 15 nt, Human
acccaccucagccuc

SEQ ID NO: 3480813 - RNA, 14 nt, Human
acccaccucccugc

SEQ ID NO: 3480814 - RNA, 16 nt, Human
acccaccugagcuuug

SEQ ID NO: 3480815 - RNA, 21 nt, Human
acccaccuuguuggagccugc

SEQ ID NO: 3480816 - RNA, 19 nt, Human
acccacgauuuucuccagc

SEQ ID NO: 3480817 - RNA, 20 nt, Human
acccacgauuuucuccagcu

SEQ ID NO: 3480818 - RNA, 14 nt, Human
acccacguggcugc

SEQ ID NO: 3480819 - RNA, 18 nt, Human
acccacucuccucugccu

SEQ ID NO: 3480820 - RNA, 22 nt, Human
acccacuucucaucacacacau

SEQ ID NO: 3480821 - RNA, 21 nt, Human
acccagaaacgccacaucccc

SEQ ID NO: 3480822 - RNA, 21 nt, Human
acccagacagcucccucugcc

SEQ ID NO: 3480823 - RNA, 22 nt, Human
acccagacagcucccucugccu

SEQ ID NO: 3480824 - RNA, 19 nt, Human
acccagacauaaaggaaaa

SEQ ID NO: 3480825 - RNA, 17 nt, Human
acccagaccccaggcug

SEQ ID NO: 3480826 - RNA, 15 nt, Human
acccagacucagaca

SEQ ID NO: 3480827 - RNA, 17 nt, Human
acccagagaagccccuu

SEQ ID NO: 3480828 - RNA, 19 nt, Human
acccagagaagccccuucc

SEQ ID NO: 3480829 - RNA, 22 nt, Human
acccagagaagccccuucccca

SEQ ID NO: 3480830 - RNA, 21 nt, Human
acccagauaaagguucaugca

SEQ ID NO: 3480831 - RNA, 22 nt, Human
acccagaugggggaaagcacag

SEQ ID NO: 3480832 - RNA, 19 nt, Human
acccagauuuugcuguaua

SEQ ID NO: 3480833 - RNA, 14 nt, Human
acccagcaguucug

SEQ ID NO: 3480834 - RNA, 17 nt, Human
acccagccaggcccagc

SEQ ID NO: 3480835 - RNA, 14 nt, Human
acccagcccacccc

SEQ ID NO: 3480836 - RNA, 15 nt, Human
acccagcccaccccc

SEQ ID NO: 3480837 - RNA, 16 nt, Human
acccagcccacccccg

SEQ ID NO: 3480838 - RNA, 16 nt, Human
acccagcccacuucug

SEQ ID NO: 3480839 - RNA, 11 nt, Human
acccagcccau

SEQ ID NO: 3480840 - RNA, 19 nt, Human
acccagcccauucucucuc

SEQ ID NO: 3480841 - RNA, 22 nt, Human
acccagcccauucucucuccug

SEQ ID NO: 3480842 - RNA, 16 nt, Human
acccagcccucauccc

SEQ ID NO: 3480843 - RNA, 21 nt, Human
acccagcccuggucucagcag

SEQ ID NO: 3480844 - RNA, 14 nt, Human
acccagccgcugcc

SEQ ID NO: 3480845 - RNA, 16 nt, Human
acccagccgcugcccg

SEQ ID NO: 3480846 - RNA, 13 nt, Human
acccagccucagu

SEQ ID NO: 3480847 - RNA, 16 nt, Human
acccagcgagcccugg

SEQ ID NO: 3480848 - RNA, 19 nt, Human
acccagcgagcccuggugg

SEQ ID NO: 3480849 - RNA, 15 nt, Human
acccagcggacacac

SEQ ID NO: 3480850 - RNA, 13 nt, Human
acccagcugcacc

SEQ ID NO: 3480851 - RNA, 14 nt, Human
acccaggacaagca

SEQ ID NO: 3480852 - RNA, 17 nt, Human
acccaggacaagcaugg

SEQ ID NO: 3480853 - RNA, 11 nt, Human
acccaggacag

SEQ ID NO: 3480854 - RNA, 14 nt, Human
acccaggaccaagc

SEQ ID NO: 3480855 - RNA, 19 nt, Human
acccaggagccccgaggcc

SEQ ID NO: 3480856 - RNA, 19 nt, Human
acccaggaggggaacacug

SEQ ID NO: 3480857 - RNA, 20 nt, Human
acccaggaggggaacacugc

SEQ ID NO: 3480858 - RNA, 14 nt, Human
acccaggaggugga

SEQ ID NO: 3480859 - RNA, 20 nt, Human
acccaggagguggagguugc

SEQ ID NO: 3480860 - RNA, 22 nt, Human
acccaggccgcagcucuugccc

SEQ ID NO: 3480861 - RNA, 23 nt, Human
acccaggccgcagcucuugcccu

SEQ ID NO: 3480862 - RNA, 11 nt, Human
acccaggcucc

SEQ ID NO: 3480863 - RNA, 13 nt, Human
acccaggcugggc

SEQ ID NO: 3480864 - RNA, 14 nt, Human
acccaggcugggca

SEQ ID NO: 3480865 - RNA, 20 nt, Human
acccaggcugggcaaggagg

SEQ ID NO: 3480866 - RNA, 13 nt, Human
acccagggccugc

SEQ ID NO: 3480867 - RNA, 14 nt, Human
acccagggccugca

SEQ ID NO: 3480868 - RNA, 17 nt, Human
acccagggccugcagga

SEQ ID NO: 3480869 - RNA, 16 nt, Human
acccagggcucugccc

SEQ ID NO: 3480870 - RNA, 19 nt, Human
acccagggcucugccccag

SEQ ID NO: 3480871 - RNA, 19 nt, Human
acccaggguggagugcagu

SEQ ID NO: 3480872 - RNA, 20 nt, Human
acccaggguggagugcagug

SEQ ID NO: 3480873 - RNA, 21 nt, Human
acccaggguggagugcagugg

SEQ ID NO: 3480874 - RNA, 22 nt, Human
acccaggguucccgcggggcug

SEQ ID NO: 3480875 - RNA, 14 nt, Human
acccaggucucccu

SEQ ID NO: 3480876 - RNA, 21 nt, Human
acccaggugauguuaguguuu

SEQ ID NO: 3480877 - RNA, 16 nt, Human
acccaggugggucccg

SEQ ID NO: 3480878 - RNA, 21 nt, Human
acccaguccccgugccccgcc

SEQ ID NO: 3480879 - RNA, 14 nt, Human
acccagucgcccuu

SEQ ID NO: 3480880 - RNA, 19 nt, Human
acccagucgcccuuacuuc

SEQ ID NO: 3480881 - RNA, 18 nt, Human
acccagucucugcuccac

SEQ ID NO: 3480882 - RNA, 18 nt, Human
acccagugcccccacuga

SEQ ID NO: 3480883 - RNA, 22 nt, Human
acccagugcccccacugaccag

SEQ ID NO: 3480884 - RNA, 18 nt, Human
acccaguggcagggcaca

SEQ ID NO: 3480885 - RNA, 20 nt, Human
acccaguggcagggcacagg

SEQ ID NO: 3480886 - RNA, 19 nt, Human
acccaguguuuuaggagca

SEQ ID NO: 3480887 - RNA, 17 nt, Human
acccaguuuccuuggga

SEQ ID NO: 3480888 - RNA, 20 nt, Human
acccaguuucuaaacuggag

SEQ ID NO: 3480889 - RNA, 21 nt, Human
acccaguuucuaaacuggaga

SEQ ID NO: 3480890 - RNA, 17 nt, Human
acccauaauccuuucug

SEQ ID NO: 3480891 - RNA, 21 nt, Human
acccauagaucuucugaaaug

SEQ ID NO: 3480892 - RNA, 22 nt, Human
acccauaggcccacacacaggu

SEQ ID NO: 3480893 - RNA, 14 nt, Human
acccauauccccuc

SEQ ID NO: 3480894 - RNA, 23 nt, Human
acccauauccuuacccuccuugg

SEQ ID NO: 3480895 - RNA, 20 nt, Human
acccauauuguaaaacaggu

SEQ ID NO: 3480896 - RNA, 15 nt, Human
acccaucaacaaaaa

SEQ ID NO: 3480897 - RNA, 15 nt, Human
acccaucgcugugug

SEQ ID NO: 3480898 - RNA, 16 nt, Human
acccaucuaccccugg

SEQ ID NO: 3480899 - RNA, 20 nt, Human
acccaucugcaccccccugg

SEQ ID NO: 3480900 - RNA, 21 nt, Human
acccaucugcaccccccuggg

SEQ ID NO: 3480901 - RNA, 17 nt, Human
acccaucuguuuuuugu

SEQ ID NO: 3480902 - RNA, 11 nt, Human
acccaugaaaa

SEQ ID NO: 3480903 - RNA, 12 nt, Human
acccaugaagau

SEQ ID NO: 3480904 - RNA, 23 nt, Human
acccaugacuuuauauggaugau

SEQ ID NO: 3480905 - RNA, 20 nt, Human
acccaugaguuggggucugg

SEQ ID NO: 3480906 - RNA, 18 nt, Human
acccaugaugagcuccuc

SEQ ID NO: 3480907 - RNA, 14 nt, Human
acccaugcugcccu

SEQ ID NO: 3480908 - RNA, 18 nt, Human
acccaugcugcccuguga

SEQ ID NO: 3480909 - RNA, 19 nt, Human
acccaugcugcccugugag

SEQ ID NO: 3480910 - RNA, 13 nt, Human
acccaugggcagg

SEQ ID NO: 3480911 - RNA, 18 nt, Human
acccaugggcaggagacu

SEQ ID NO: 3480912 - RNA, 16 nt, Human
acccauguuucucugg

SEQ ID NO: 3480913 - RNA, 21 nt, Human
accaccuucccagcucucccu

SEQ ID NO: 3480914 - RNA, 14 nt, Human
accaccuuucagau

SEQ ID NO: 3480915 - RNA, 13 nt, Human
accacgacuggcc

SEQ ID NO: 3480916 - RNA, 16 nt, Human
accacgacuggccagg

SEQ ID NO: 3480917 - RNA, 16 nt, Human
accacgauguggcccu

SEQ ID NO: 3480918 - RNA, 19 nt, Human
accacgauguggcccuggc

SEQ ID NO: 3480919 - RNA, 20 nt, Human
accacgcccggcuaauuuuu

SEQ ID NO: 3480920 - RNA, 20 nt, Human
accacgcccguccugccugu

SEQ ID NO: 3480921 - RNA, 23 nt, Human
accacgcccguccugccuguggc

SEQ ID NO: 3480922 - RNA, 22 nt, Human
accacgccucuugaccaggcug

SEQ ID NO: 3480923 - RNA, 20 nt, Human
accacgcuugacaggacagc

SEQ ID NO: 3480924 - RNA, 18 nt, Human
accacggaaaagagcgca

SEQ ID NO: 3480925 - RNA, 20 nt, Human
accacguugggacagggagg

SEQ ID NO: 3480926 - RNA, 16 nt, Human
accacuacauucuguu

SEQ ID NO: 3480927 - RNA, 14 nt, Human
accacuauaaaaug

SEQ ID NO: 3480928 - RNA, 15 nt, Human
accacucaaaggcca

SEQ ID NO: 3480929 - RNA, 14 nt, Human
accacucagagaca

SEQ ID NO: 3480930 - RNA, 12 nt, Human
accacucagccc

SEQ ID NO: 3480931 - RNA, 13 nt, Human
accacucagcccc

SEQ ID NO: 3480932 - RNA, 14 nt, Human
accacucagccccu

SEQ ID NO: 3480933 - RNA, 15 nt, Human
accacucagccccua

SEQ ID NO: 3480934 - RNA, 17 nt, Human
accacucagccccuagg

SEQ ID NO: 3480935 - RNA, 20 nt, Human
accacucuggcagccacacu

SEQ ID NO: 3480936 - RNA, 16 nt, Human
accacugaaaaaauau

SEQ ID NO: 3480937 - RNA, 19 nt, Human
accacugaaaaaauauaug

SEQ ID NO: 3480938 - RNA, 18 nt, Human
accacugcacuccagccu

SEQ ID NO: 3480939 - RNA, 21 nt, Human
accacugcacuccagccuggg

SEQ ID NO: 3480940 - RNA, 21 nt, Human
accacugcugauauuuucucu

SEQ ID NO: 3480941 - RNA, 19 nt, Human
accacugcugugaacaagu

SEQ ID NO: 3480942 - RNA, 12 nt, Human
accacuggccac

SEQ ID NO: 3480943 - RNA, 15 nt, Human
accacuggccaccag

SEQ ID NO: 3480944 - RNA, 13 nt, Human
accacugucuucu

SEQ ID NO: 3480945 - RNA, 13 nt, Human
accacuguuucuu

SEQ ID NO: 3480946 - RNA, 16 nt, Human
accacuguuucuugcu

SEQ ID NO: 3480947 - RNA, 20 nt, Human
accacuguuucuugcuugua

SEQ ID NO: 3480948 - RNA, 22 nt, Human
accacuguuucuugcuuguacc

SEQ ID NO: 3480949 - RNA, 14 nt, Human
accacuucagcuga

SEQ ID NO: 3480950 - RNA, 15 nt, Human
accacuucagcugac

SEQ ID NO: 3480951 - RNA, 14 nt, Human
accacuucauucug

SEQ ID NO: 3480952 - RNA, 20 nt, Human
accacuuccaggggaaccug

SEQ ID NO: 3480953 - RNA, 15 nt, Human
accacuuccuuuaaa

SEQ ID NO: 3480954 - RNA, 15 nt, Human
accacuucuuuuaua

SEQ ID NO: 3480955 - RNA, 20 nt, Human
accacuugaggccugaucug

SEQ ID NO: 3480956 - RNA, 23 nt, Human
accacuuguguuuugcaagccag

SEQ ID NO: 3480957 - RNA, 16 nt, Human
accacuuuuguucuug

SEQ ID NO: 3480958 - RNA, 12 nt, Human
accacuuuuuag

SEQ ID NO: 3480959 - RNA, 17 nt, Human
accacuuuuugcagcuu

SEQ ID NO: 3480960 - RNA, 18 nt, Human
accacuuuuugcagcuuu

SEQ ID NO: 3480961 - RNA, 23 nt, Human
accagaaagcaguugagacaaga

SEQ ID NO: 3480962 - RNA, 19 nt, Human
accagaaccaauuauuuuc

SEQ ID NO: 3480963 - RNA, 21 nt, Human
accagaaccaauuauuuucau

SEQ ID NO: 3480964 - RNA, 19 nt, Human
accagaagcucccccagca

SEQ ID NO: 3480965 - RNA, 14 nt, Human
accagaagggaaac

SEQ ID NO: 3480966 - RNA, 13 nt, Human
accagacacaaac

SEQ ID NO: 3480967 - RNA, 14 nt, Human
accagacggggcug

SEQ ID NO: 3480968 - RNA, 20 nt, Human
accagacgguucaccagccu

SEQ ID NO: 3480969 - RNA, 14 nt, Human
accagacugcaggu

SEQ ID NO: 3480970 - RNA, 18 nt, Human
accagacuguggagaaau

SEQ ID NO: 3480971 - RNA, 20 nt, Human
accagacuguggagaaauaa

SEQ ID NO: 3480972 - RNA, 20 nt, Human
accagagauaauaugagaau

SEQ ID NO: 3480973 - RNA, 19 nt, Human
accagagcaaccucucacu

SEQ ID NO: 3480974 - RNA, 13 nt, Human
accagagcacugu

SEQ ID NO: 3480975 - RNA, 14 nt, Human
accagagcacugua

SEQ ID NO: 3480976 - RNA, 16 nt, Human
accagagcacuguaua

SEQ ID NO: 3480977 - RNA, 14 nt, Human
accagagccaugga

SEQ ID NO: 3480978 - RNA, 17 nt, Human
accagagccauggacuc

SEQ ID NO: 3480979 - RNA, 23 nt, Human
accagagccauggacucuacacu

SEQ ID NO: 3480980 - RNA, 17 nt, Human
accagagcccaccuugg

SEQ ID NO: 3480981 - RNA, 19 nt, Human
accagagcccaccuuggcu

SEQ ID NO: 3480982 - RNA, 22 nt, Human
accagagcccaccuuggcucaa

SEQ ID NO: 3480983 - RNA, 20 nt, Human
accagagccccacacggagg

SEQ ID NO: 3480984 - RNA, 14 nt, Human
accagagcucugga

SEQ ID NO: 3480985 - RNA, 16 nt, Human
accagagcugccaccu

SEQ ID NO: 3480986 - RNA, 19 nt, Human
accagagcugccaccugcc

SEQ ID NO: 3480987 - RNA, 17 nt, Human
accagagcuguggagag

SEQ ID NO: 3480988 - RNA, 15 nt, Human
accagaggaaucacu

SEQ ID NO: 3480989 - RNA, 20 nt, Human
accagauaaaauuauagaug

SEQ ID NO: 3480990 - RNA, 13 nt, Human
accagauaacuuu

SEQ ID NO: 3480991 - RNA, 13 nt, Human
accagaucauugu

SEQ ID NO: 3480992 - RNA, 16 nt, Human
accagaugagaauuag

SEQ ID NO: 3480993 - RNA, 17 nt, Human
accagaugaugggggag

SEQ ID NO: 3480994 - RNA, 18 nt, Human
accagaugaugggggagg

SEQ ID NO: 3480995 - RNA, 17 nt, Human
accagcacacucccgag

SEQ ID NO: 3480996 - RNA, 19 nt, Human
accagcagacagagccagg

SEQ ID NO: 3480997 - RNA, 12 nt, Human
accagcagagca

SEQ ID NO: 3480998 - RNA, 21 nt, Human
accagcagaucccagcucacg

SEQ ID NO: 3480999 - RNA, 17 nt, Human
accagcagccuggaccc

SEQ ID NO: 3481000 - RNA, 17 nt, Human
accagcagcgccuuucc

SEQ ID NO: 3481001 - RNA, 18 nt, Human
accagcagcgccuuuccc

SEQ ID NO: 3481002 - RNA, 22 nt, Human
accagcaucccuugaccaggcc

SEQ ID NO: 3481003 - RNA, 15 nt, Human
accagcauuccuuuu

SEQ ID NO: 3481004 - RNA, 11 nt, Human
accagccagcg

SEQ ID NO: 3481005 - RNA, 17 nt, Human
accagccaggcucugug

SEQ ID NO: 3481006 - RNA, 23 nt, Human
accagccaggcucugugcugacc

SEQ ID NO: 3481007 - RNA, 15 nt, Human
accagcccagacccu

SEQ ID NO: 3481008 - RNA, 14 nt, Human
accagcccagaugu

SEQ ID NO: 3481009 - RNA, 20 nt, Human
accagccccacugccagcag

SEQ ID NO: 3481010 - RNA, 21 nt, Human
accagccccacugccagcagc

SEQ ID NO: 3481011 - RNA, 12 nt, Human
accagccccugc

SEQ ID NO: 3481012 - RNA, 16 nt, Human
accagccccugcccca

SEQ ID NO: 3481013 - RNA, 12 nt, Human
accagcccuggg

SEQ ID NO: 3481014 - RNA, 21 nt, Human
accagccuccaugcugccucc

SEQ ID NO: 3481015 - RNA, 17 nt, Human
accagccucgucuucau

SEQ ID NO: 3481016 - RNA, 12 nt, Human
accagccuggcc

SEQ ID NO: 3481017 - RNA, 15 nt, Human
accagccuggccaac

SEQ ID NO: 3481018 - RNA, 20 nt, Human
accagccuggccaacauggu

SEQ ID NO: 3481019 - RNA, 13 nt, Human
accagccuggccc

SEQ ID NO: 3481020 - RNA, 20 nt, Human
accagccuggucaacauggu

SEQ ID NO: 3481021 - RNA, 16 nt, Human
accagccuuucuccca

SEQ ID NO: 3481022 - RNA, 23 nt, Human
accagcgaggaggcuccagaggg

SEQ ID NO: 3481023 - RNA, 23 nt, Human
accagcgcacugauggucacugg

SEQ ID NO: 3481024 - RNA, 14 nt, Human
accagcgcccgcug

SEQ ID NO: 3481025 - RNA, 18 nt, Human
accagcgcccgcugggcu

SEQ ID NO: 3481026 - RNA, 13 nt, Human
accagcucaggac

SEQ ID NO: 3481027 - RNA, 20 nt, Human
accagcugaaaguugggacu

SEQ ID NO: 3481028 - RNA, 12 nt, Human
accagcugcaaa

SEQ ID NO: 3481029 - RNA, 14 nt, Human
accagcugcaaagu

SEQ ID NO: 3481030 - RNA, 15 nt, Human
accagcugcaaagug

SEQ ID NO: 3481031 - RNA, 17 nt, Human
accagcugcaaaguguu

SEQ ID NO: 3481032 - RNA, 15 nt, Human
accagcugccucuuc

SEQ ID NO: 3481033 - RNA, 23 nt, Human
accagcuggggcguggggagggc

SEQ ID NO: 3481034 - RNA, 17 nt, Human
accagcuuaaaggcagu

SEQ ID NO: 3481035 - RNA, 15 nt, Human
accagcuuccuucag

SEQ ID NO: 3481036 - RNA, 17 nt, Human
accagcuuccuucagag

SEQ ID NO: 3481037 - RNA, 20 nt, Human
accagcuuccuucagagagc

SEQ ID NO: 3481038 - RNA, 21 nt, Human
accagcuuccuucagagagca

SEQ ID NO: 3481039 - RNA, 23 nt, Human
accagcuuccuucagagagcagu

SEQ ID NO: 3481040 - RNA, 15 nt, Human
accagcuucuccagg

SEQ ID NO: 3481041 - RNA, 16 nt, Human
accagcuucuccaggc

SEQ ID NO: 3481042 - RNA, 13 nt, Human
accagcuuuuaac

SEQ ID NO: 3481043 - RNA, 20 nt, Human
accaggaauguuaaagucag

SEQ ID NO: 3481044 - RNA, 22 nt, Human
accaggacuagggcuggaguga

SEQ ID NO: 3481045 - RNA, 21 nt, Human
accaggacuauagcccagguc

SEQ ID NO: 3481046 - RNA, 14 nt, Human
accaggagaaccac

SEQ ID NO: 3481047 - RNA, 20 nt, Human
accaggagaaccacuacaug

SEQ ID NO: 3481048 - RNA, 15 nt, Human
accaggagcugcuca

SEQ ID NO: 3481049 - RNA, 18 nt, Human
accaggagggcacuggag

SEQ ID NO: 3481050 - RNA, 22 nt, Human
accaggagucccugguaauaag

SEQ ID NO: 3481051 - RNA, 16 nt, Human
accaggauagagacug

SEQ ID NO: 3481052 - RNA, 19 nt, Human
accaggauagagacuggaa

SEQ ID NO: 3481053 - RNA, 19 nt, Human
accaggauccagccucacu

SEQ ID NO: 3481054 - RNA, 15 nt, Human
accaggauuucuaau

SEQ ID NO: 3481055 - RNA, 17 nt, Human
accaggcaccucuuccu

SEQ ID NO: 3481056 - RNA, 17 nt, Human
accaggcagccucuggg

SEQ ID NO: 3481057 - RNA, 12 nt, Human
accaggccaccu

SEQ ID NO: 3481058 - RNA, 16 nt, Human
accaggccgccccagc

SEQ ID NO: 3481059 - RNA, 23 nt, Human
accaggcuggcgcagccaaggcc

SEQ ID NO: 3481060 - RNA, 23 nt, Human
accagggaagaagaucaacgccu

SEQ ID NO: 3481061 - RNA, 15 nt, Human
accagggccagaagu

SEQ ID NO: 3481062 - RNA, 16 nt, Human
accagggccagccucu

SEQ ID NO: 3481063 - RNA, 17 nt, Human
acccugaguuuuguuuu

SEQ ID NO: 3481064 - RNA, 23 nt, Human
acccugcaaacagaacaggguca

SEQ ID NO: 3481065 - RNA, 15 nt, Human
acccugccaggcaca

SEQ ID NO: 3481066 - RNA, 16 nt, Human
acccugccaggcacag

SEQ ID NO: 3481067 - RNA, 18 nt, Human
acccugccaggcacaggc

SEQ ID NO: 3481068 - RNA, 19 nt, Human
acccugccaggcacaggca

SEQ ID NO: 3481069 - RNA, 14 nt, Human
acccugccauggaa

SEQ ID NO: 3481070 - RNA, 17 nt, Human
acccugccccucagaga

SEQ ID NO: 3481071 - RNA, 14 nt, Human
acccugccccugcc

SEQ ID NO: 3481072 - RNA, 22 nt, Human
acccugcccugugggcccccaa

SEQ ID NO: 3481073 - RNA, 17 nt, Human
acccugccgucaccacc

SEQ ID NO: 3481074 - RNA, 19 nt, Human
acccugccgucaccaccac

SEQ ID NO: 3481075 - RNA, 22 nt, Human
acccugccgucaccaccacccc

SEQ ID NO: 3481076 - RNA, 14 nt, Human
acccugccucccuu

SEQ ID NO: 3481077 - RNA, 20 nt, Human
acccugccucccuugacuuu

SEQ ID NO: 3481078 - RNA, 16 nt, Human
acccugccucucccag

SEQ ID NO: 3481079 - RNA, 20 nt, Human
acccugccucucccaggcag

SEQ ID NO: 3481080 - RNA, 18 nt, Human
acccugccuuaucuugca

SEQ ID NO: 3481081 - RNA, 19 nt, Human
acccugcgaaggggcccug

SEQ ID NO: 3481082 - RNA, 16 nt, Human
acccugcugcuggugc

SEQ ID NO: 3481083 - RNA, 14 nt, Human
acccuggacccagc

SEQ ID NO: 3481084 - RNA, 16 nt, Human
acccuggaucaguccu

SEQ ID NO: 3481085 - RNA, 22 nt, Human
acccuggcaaagcagcaacaca

SEQ ID NO: 3481086 - RNA, 14 nt, Human
acuggcauuuuaua

SEQ ID NO: 3481087 - RNA, 18 nt, Human
acuggcauuuuauagaca

SEQ ID NO: 3481088 - RNA, 16 nt, Human
acuggccaagcugagg

SEQ ID NO: 3481089 - RNA, 19 nt, Human
acuggccaagcugaggugc

SEQ ID NO: 3481090 - RNA, 21 nt, Human
acuggccaagcugaggugccc

SEQ ID NO: 3481091 - RNA, 14 nt, Human
acuggccaccaggc

SEQ ID NO: 3481092 - RNA, 18 nt, Human
acuggccaccaggcuggc

SEQ ID NO: 3481093 - RNA, 21 nt, Human
acuggccaccaggcuggcgca

SEQ ID NO: 3481094 - RNA, 12 nt, Human
acuggccccacc

SEQ ID NO: 3481095 - RNA, 13 nt, Human
acuggccccaccc

SEQ ID NO: 3481096 - RNA, 21 nt, Human
acuggccccggaucagagcag

SEQ ID NO: 3481097 - RNA, 13 nt, Human
acuggccccuggg

SEQ ID NO: 3481098 - RNA, 17 nt, Human
acuggccgcgggggcag

SEQ ID NO: 3481099 - RNA, 19 nt, Human
acuggccggagucagugcc

SEQ ID NO: 3481100 - RNA, 18 nt, Human
acuggccucgccuggccu

SEQ ID NO: 3481101 - RNA, 19 nt, Human
acuggccucgccuggccug

SEQ ID NO: 3481102 - RNA, 14 nt, Human
acuggccucugcug

SEQ ID NO: 3481103 - RNA, 23 nt, Human
acuggccuucugaugaaauguua

SEQ ID NO: 3481104 - RNA, 18 nt, Human
acuggccuuuuucauuua

SEQ ID NO: 3481105 - RNA, 15 nt, Human
acuggcgccuccgag

SEQ ID NO: 3481106 - RNA, 12 nt, Human
acuggcucaccc

SEQ ID NO: 3481107 - RNA, 15 nt, Human
acuggcucacccagu

SEQ ID NO: 3481108 - RNA, 14 nt, Human
acuggcucuccaag

SEQ ID NO: 3481109 - RNA, 16 nt, Human
acuggcucuccaagug

SEQ ID NO: 3481110 - RNA, 20 nt, Human
acuggcucuccaagugccag

SEQ ID NO: 3481111 - RNA, 22 nt, Human
acuggcucuccaagugccagag

SEQ ID NO: 3481112 - RNA, 16 nt, Human
acuggcucucuccagg

SEQ ID NO: 3481113 - RNA, 17 nt, Human
acuggcucucuccagga

SEQ ID NO: 3481114 - RNA, 19 nt, Human
acuggcugccagcuauuuu

SEQ ID NO: 3481115 - RNA, 17 nt, Human
acuggcugccuccacuc

SEQ ID NO: 3481116 - RNA, 21 nt, Human
acuggcugccuccacucccac

SEQ ID NO: 3481117 - RNA, 16 nt, Human
acuggcugugggcucc

SEQ ID NO: 3481118 - RNA, 19 nt, Human
acuggcugugggcucccuu

SEQ ID NO: 3481119 - RNA, 20 nt, Human
acuggcugugggcucccuuc

SEQ ID NO: 3481120 - RNA, 16 nt, Human
acuggcugugugaccu

SEQ ID NO: 3481121 - RNA, 21 nt, Human
acuggcugugugaccuuaggc

SEQ ID NO: 3481122 - RNA, 13 nt, Human
acuggcuucagca

SEQ ID NO: 3481123 - RNA, 23 nt, Human
acuggcuugaauuggugacauuu

SEQ ID NO: 3481124 - RNA, 20 nt, Human
acuggcuuuuauuaaugcac

SEQ ID NO: 3481125 - RNA, 18 nt, Human
acugggacaggggagaac

SEQ ID NO: 3481126 - RNA, 23 nt, Human
acugggaccaacccuggggaagg

SEQ ID NO: 3481127 - RNA, 16 nt, Human
acugggagaaaugaaa

SEQ ID NO: 3481128 - RNA, 19 nt, Human
acugggagaggugccagca

SEQ ID NO: 3481129 - RNA, 18 nt, Human
acugggagcccccagccu

SEQ ID NO: 3481130 - RNA, 19 nt, Human
acugggagcccccagccug

SEQ ID NO: 3481131 - RNA, 20 nt, Human
acugggagcccccagccugu

SEQ ID NO: 3481132 - RNA, 12 nt, Human
acugggaggcuc

SEQ ID NO: 3481133 - RNA, 17 nt, Human
acugggaggcuccccuu

SEQ ID NO: 3481134 - RNA, 22 nt, Human
acugggaugggaggagaggaca

SEQ ID NO: 3481135 - RNA, 18 nt, Human
acugggcaaugauggcaa

SEQ ID NO: 3481136 - RNA, 15 nt, Human
acugggccaggggag

SEQ ID NO: 3481137 - RNA, 12 nt, Human
acugggcccuga

SEQ ID NO: 3481138 - RNA, 14 nt, Human
acugggcccugagu

SEQ ID NO: 3481139 - RNA, 17 nt, Human
acugggccuguagcuca

SEQ ID NO: 3481140 - RNA, 16 nt, Human
acugggcucccgggcc

SEQ ID NO: 3481141 - RNA, 16 nt, Human
acugggcugaacacuc

SEQ ID NO: 3481142 - RNA, 17 nt, Human
acugggcugagggagcc

SEQ ID NO: 3481143 - RNA, 19 nt, Human
acuggggacuuggccucuc

SEQ ID NO: 3481144 - RNA, 17 nt, Human
acuggggaugugggagg

SEQ ID NO: 3481145 - RNA, 18 nt, Human
acuggggaugugggaggg

SEQ ID NO: 3481146 - RNA, 17 nt, Human
acuggggauuggguggg

SEQ ID NO: 3481147 - RNA, 16 nt, Human
acuggggcagacaaua

SEQ ID NO: 3481148 - RNA, 14 nt, Human
acuggggcaggggc

SEQ ID NO: 3481149 - RNA, 16 nt, Human
acuggggcaggggccg

SEQ ID NO: 3481150 - RNA, 16 nt, Human
acuggggccuccagaa

SEQ ID NO: 3481151 - RNA, 17 nt, Human
acuggggccuccagaac

SEQ ID NO: 3481152 - RNA, 18 nt, Human
acuggggcucagagccgg

SEQ ID NO: 3481153 - RNA, 18 nt, Human
acugggguccuggggccu

SEQ ID NO: 3481154 - RNA, 19 nt, Human
acuggggugccgccugccc

SEQ ID NO: 3481155 - RNA, 22 nt, Human
acuggggugggaggucuugcua

SEQ ID NO: 3481156 - RNA, 14 nt, Human
acuggguaaugaaa

SEQ ID NO: 3481157 - RNA, 17 nt, Human
acuggguacuuguggac

SEQ ID NO: 3481158 - RNA, 15 nt, Human
acuggguaggaaaga

SEQ ID NO: 3481159 - RNA, 21 nt, Human
acugggugcccaagcucagaa

SEQ ID NO: 3481160 - RNA, 18 nt, Human
acuggguggggugaggac

SEQ ID NO: 3481161 - RNA, 18 nt, Human
acugggugguggccuggu

SEQ ID NO: 3481162 - RNA, 16 nt, Human
acuggguucccaugcu

SEQ ID NO: 3481163 - RNA, 13 nt, Human
acuggguugacuu

SEQ ID NO: 3481164 - RNA, 20 nt, Human
acuggguugacuuucaggua

SEQ ID NO: 3481165 - RNA, 15 nt, Human
acuggguugcgggac

SEQ ID NO: 3481166 - RNA, 17 nt, Human
acugguacuuagaguuu

SEQ ID NO: 3481167 - RNA, 23 nt, Human
acugguacuuagaguuucuguuu

SEQ ID NO: 3481168 - RNA, 15 nt, Human
acugguaggaccaag

SEQ ID NO: 3481169 - RNA, 18 nt, Human
acugguauguaaaagaaa

SEQ ID NO: 3481170 - RNA, 16 nt, Human
acugguauucuguucu

SEQ ID NO: 3481171 - RNA, 14 nt, Human
acugguauuuuauc

SEQ ID NO: 3481172 - RNA, 21 nt, Human
acugguccaaaagauugcuga

SEQ ID NO: 3481173 - RNA, 15 nt, Human
acugguccugugugc

SEQ ID NO: 3481174 - RNA, 15 nt, Human
acuggucuguaggga

SEQ ID NO: 3481175 - RNA, 16 nt, Human
acuggugacugauucu

SEQ ID NO: 3481176 - RNA, 15 nt, Human
acuggugauauaucu

SEQ ID NO: 3481177 - RNA, 23 nt, Human
acuggugcuauaggcuggagaag

SEQ ID NO: 3481178 - RNA, 12 nt, Human
acugguggcccg

SEQ ID NO: 3481179 - RNA, 14 nt, Human
acuggugugaccug

SEQ ID NO: 3481180 - RNA, 17 nt, Human
acuggugugaccugagg

SEQ ID NO: 3481181 - RNA, 19 nt, Human
acugguguuugaaaguagg

SEQ ID NO: 3481182 - RNA, 18 nt, Human
acugguuaucacaccauc

SEQ ID NO: 3481183 - RNA, 17 nt, Human
acugguucucaaugaaa

SEQ ID NO: 3481184 - RNA, 18 nt, Human
acugguucucaaugaaaa

SEQ ID NO: 3481185 - RNA, 18 nt, Human
acugguugcauggaaauc

SEQ ID NO: 3481186 - RNA, 18 nt, Human
acugguuuacaggcccug

SEQ ID NO: 3481187 - RNA, 17 nt, Human
acugguuugaagaaugu

SEQ ID NO: 3481188 - RNA, 20 nt, Human
acugguuugaagaauguuaa

SEQ ID NO: 3481189 - RNA, 14 nt, Human
acugguuuuaaaua

SEQ ID NO: 3481190 - RNA, 13 nt, Human
acugguuuucugc

SEQ ID NO: 3481191 - RNA, 17 nt, Human
acuguaaaauaauaacu

SEQ ID NO: 3481192 - RNA, 17 nt, Human
acuguaaaauacuucuu

SEQ ID NO: 3481193 - RNA, 16 nt, Human
acuguaaaaugaaauu

SEQ ID NO: 3481194 - RNA, 24 nt, Human
acuguaaaaugcaaaaaaucuuaa

SEQ ID NO: 3481195 - RNA, 21 nt, Human
acuguaaaaugugggauuaug

SEQ ID NO: 3481196 - RNA, 17 nt, Human
acuguaaaccaauuuuu

SEQ ID NO: 3481197 - RNA, 17 nt, Human
acuguaaacuucugcaa

SEQ ID NO: 3481198 - RNA, 15 nt, Human
acuguaaagaaagag

SEQ ID NO: 3481199 - RNA, 22 nt, Human
acuguaaagaaagagagaaaau

SEQ ID NO: 3481200 - RNA, 23 nt, Human
acuguaaagaaagagagaaaaua

SEQ ID NO: 3481201 - RNA, 16 nt, Human
acuguaaauaugaauc

SEQ ID NO: 3481202 - RNA, 17 nt, Human
acuguaaauaugaaucu

SEQ ID NO: 3481203 - RNA, 15 nt, Human
acuguaacauucagg

SEQ ID NO: 3481204 - RNA, 20 nt, Human
acuguaacuuccaaauaaau

SEQ ID NO: 3481205 - RNA, 13 nt, Human
acuguaagaaaau

SEQ ID NO: 3481206 - RNA, 19 nt, Human
acuguaagaaaauaucacu

SEQ ID NO: 3481207 - RNA, 14 nt, Human
acuguaagaauaau

SEQ ID NO: 3481208 - RNA, 15 nt, Human
acuguaagaauaauu

SEQ ID NO: 3481209 - RNA, 13 nt, Human
acuguaagggauu

SEQ ID NO: 3481210 - RNA, 22 nt, Human
acuguaaugaaccgcugaauau

SEQ ID NO: 3481211 - RNA, 12 nt, Human
acuguaauuuag

SEQ ID NO: 3481212 - RNA, 19 nt, Human
acuguacaaaaaaaucuuc

SEQ ID NO: 3481213 - RNA, 14 nt, Human
acuguacacacuuu

SEQ ID NO: 3481214 - RNA, 22 nt, Human
acuguacagauugcugcuucug

SEQ ID NO: 3481215 - RNA, 13 nt, Human
acuguacagcugg

SEQ ID NO: 3481216 - RNA, 12 nt, Human
acuguacagggg

SEQ ID NO: 3481217 - RNA, 17 nt, Human
acuguacagugucuuuu

SEQ ID NO: 3481218 - RNA, 21 nt, Human
acuguacagugucuuuuuuug

SEQ ID NO: 3481219 - RNA, 13 nt, Human
acuguacaugaaa

SEQ ID NO: 3481220 - RNA, 14 nt, Human
acuguacaugaaaa

SEQ ID NO: 3481221 - RNA, 19 nt, Human
acuguacaugaaaacacau

SEQ ID NO: 3481222 - RNA, 21 nt, Human
acuguacaugggacuaugcuu

SEQ ID NO: 3481223 - RNA, 21 nt, Human
acuguaccaugugcuacaggg

SEQ ID NO: 3481224 - RNA, 14 nt, Human
acuguacuccuccc

SEQ ID NO: 3481225 - RNA, 17 nt, Human
acuguacugacuugagg

SEQ ID NO: 3481226 - RNA, 15 nt, Human
acuguacugggccau

SEQ ID NO: 3481227 - RNA, 23 nt, Human
acuguagaaaagggaacugaaca

SEQ ID NO: 3481228 - RNA, 20 nt, Human
acuguagauauguauucuuu

SEQ ID NO: 3481229 - RNA, 15 nt, Human
acuguagaugaugua

SEQ ID NO: 3481230 - RNA, 21 nt, Human
acuguagauugcuucuguagu

SEQ ID NO: 3481231 - RNA, 22 nt, Human
acuguagauugcuucuguagua

SEQ ID NO: 3481232 - RNA, 17 nt, Human
acuguagccuggauauu

SEQ ID NO: 3481233 - RNA, 20 nt, Human
acuguaggaagaguagcauu

SEQ ID NO: 3481234 - RNA, 13 nt, Human
acuguagggaggg

SEQ ID NO: 3481235 - RNA, 16 nt, Human
acuguaguaaauaaug

SEQ ID NO: 3481236 - RNA, 13 nt, Human
agaaacaugacac

SEQ ID NO: 3481237 - RNA, 14 nt, Human
agaaacaugguuuu

SEQ ID NO: 3481238 - RNA, 14 nt, Human
agaaacauuggaag

SEQ ID NO: 3481239 - RNA, 16 nt, Human
agaaacauuggaagca

SEQ ID NO: 3481240 - RNA, 15 nt, Human
agaaacauuugguaa

SEQ ID NO: 3481241 - RNA, 18 nt, Human
agaaaccacuucugguca

SEQ ID NO: 3481242 - RNA, 13 nt, Human
agaaaccagcuuc

SEQ ID NO: 3481243 - RNA, 19 nt, Human
agaaaccaggaguaaaaga

SEQ ID NO: 3481244 - RNA, 21 nt, Human
agaaaccaguuaugugaauga

SEQ ID NO: 3481245 - RNA, 15 nt, Human
agaaacccaagcucc

SEQ ID NO: 3481246 - RNA, 19 nt, Human
agaaacccaagcuccuccu

SEQ ID NO: 3481247 - RNA, 18 nt, Human
agaaacccgacagaggga

SEQ ID NO: 3481248 - RNA, 21 nt, Human
agaaacccgacagagggaaga

SEQ ID NO: 3481249 - RNA, 21 nt, Human
agaaacccucauuguguuucu

SEQ ID NO: 3481250 - RNA, 13 nt, Human
agaaacccugcac

SEQ ID NO: 3481251 - RNA, 16 nt, Human
agaaaccguccucuuu

SEQ ID NO: 3481252 - RNA, 23 nt, Human
agaaaccuacugcccaggcacug

SEQ ID NO: 3481253 - RNA, 14 nt, Human
agaaaccuguaucu

SEQ ID NO: 3481254 - RNA, 17 nt, Human
agaaaccuguaucuuuc

SEQ ID NO: 3481255 - RNA, 19 nt, Human
agaaacgcaacaagaaacu

SEQ ID NO: 3481256 - RNA, 15 nt, Human
agaaacgucuucuaa

SEQ ID NO: 3481257 - RNA, 19 nt, Human
agaaacguuuggaacaauc

SEQ ID NO: 3481258 - RNA, 19 nt, Human
agaaacucuauggucuuau

SEQ ID NO: 3481259 - RNA, 20 nt, Human
agaaacugacaugcccuccc

SEQ ID NO: 3481260 - RNA, 21 nt, Human
agaaacugacaugcccucccu

SEQ ID NO: 3481261 - RNA, 22 nt, Human
agaaacugacaugcccucccuu

SEQ ID NO: 3481262 - RNA, 18 nt, Human
agaaacugaggaauuuuc

SEQ ID NO: 3481263 - RNA, 15 nt, Human
agaaacuggaacucu

SEQ ID NO: 3481264 - RNA, 17 nt, Human
agaaacuggcaaagcag

SEQ ID NO: 3481265 - RNA, 17 nt, Human
agaaacugucuagcacu

SEQ ID NO: 3481266 - RNA, 23 nt, Human
agaaacugucuagcacuuccuug

SEQ ID NO: 3481267 - RNA, 18 nt, Human
agaaacuuaaauguuauu

SEQ ID NO: 3481268 - RNA, 13 nt, Human
agaaacuugugaa

SEQ ID NO: 3481269 - RNA, 23 nt, Human
agaaacuugugaaguggaaaugu

SEQ ID NO: 3481270 - RNA, 13 nt, Human
agaaacuuguucu

SEQ ID NO: 3481271 - RNA, 16 nt, Human
agaaacuuuauacauu

SEQ ID NO: 3481272 - RNA, 22 nt, Human
agaaacuuuauacauuaguaaa

SEQ ID NO: 3481273 - RNA, 15 nt, Human
agaaacuuucuuucu

SEQ ID NO: 3481274 - RNA, 17 nt, Human
agaaacuuuuguaaaga

SEQ ID NO: 3481275 - RNA, 15 nt, Human
agaaacuuuuuuauu

SEQ ID NO: 3481276 - RNA, 19 nt, Human
agaaacuuuuuuauuuaaa

SEQ ID NO: 3481277 - RNA, 12 nt, Human
agaaagaaagaa

SEQ ID NO: 3481278 - RNA, 12 nt, Human
agaaagaagccc

SEQ ID NO: 3481279 - RNA, 22 nt, Human
agaaagacuaucuaaauguuga

SEQ ID NO: 3481280 - RNA, 18 nt, Human
agaaagacuauucaaaca

SEQ ID NO: 3481281 - RNA, 19 nt, Human
agaaagacuauucaaacag

SEQ ID NO: 3481282 - RNA, 17 nt, Human
agaaagagaaacaguug

SEQ ID NO: 3481283 - RNA, 13 nt, Human
agaaagagagaaa

SEQ ID NO: 3481284 - RNA, 23 nt, Human
agaaagagagagaauucuuucaa

SEQ ID NO: 3481285 - RNA, 11 nt, Human
agaaagagagc

SEQ ID NO: 3481286 - RNA, 13 nt, Human
agaaagagcacuu

SEQ ID NO: 3481287 - RNA, 19 nt, Human
agaaagaggugaccccagg

SEQ ID NO: 3481288 - RNA, 17 nt, Human
agaaagaucauugaaau

SEQ ID NO: 3481289 - RNA, 12 nt, Human
agaaagauguau

SEQ ID NO: 3481290 - RNA, 15 nt, Human
agaaagcaaaauuau

SEQ ID NO: 3481291 - RNA, 14 nt, Human
agaaagcaacuuau

SEQ ID NO: 3481292 - RNA, 15 nt, Human
agaaagcaagaugua

SEQ ID NO: 3481293 - RNA, 20 nt, Human
agaaagcagaacagugauua

SEQ ID NO: 3481294 - RNA, 15 nt, Human
agaaagcagaggcug

SEQ ID NO: 3481295 - RNA, 16 nt, Human
agaaagcagaggcugg

SEQ ID NO: 3481296 - RNA, 23 nt, Human
agaaagcagaggcuggccucaga

SEQ ID NO: 3481297 - RNA, 21 nt, Human
agaaagcagauaccucacccu

SEQ ID NO: 3481298 - RNA, 17 nt, Human
agaaagcaucccucacc

SEQ ID NO: 3481299 - RNA, 16 nt, Human
agaaagcauuacauuu

SEQ ID NO: 3481300 - RNA, 18 nt, Human
agaaagcauuugaaugca

SEQ ID NO: 3481301 - RNA, 20 nt, Human
agaaagcauuugaaugcauu

SEQ ID NO: 3481302 - RNA, 20 nt, Human
agaaagccagucuuaacauu

SEQ ID NO: 3481303 - RNA, 22 nt, Human
agaaagcccuuaggaagaauuu

SEQ ID NO: 3481304 - RNA, 15 nt, Human
agaaagccucagaga

SEQ ID NO: 3481305 - RNA, 20 nt, Human
agaaagccugggugacauuu

SEQ ID NO: 3481306 - RNA, 22 nt, Human
agaaagccuuucauuuugcuuu

SEQ ID NO: 3481307 - RNA, 11 nt, Human
agaaagcucaa

SEQ ID NO: 3481308 - RNA, 14 nt, Human
agaaagcugacauu

SEQ ID NO: 3481309 - RNA, 16 nt, Human
agaaagcugacuuggc

SEQ ID NO: 3481310 - RNA, 20 nt, Human
agaaagcugacuuggcuggu

SEQ ID NO: 3481311 - RNA, 19 nt, Human
agaaagcugguaaacuauu

SEQ ID NO: 3481312 - RNA, 16 nt, Human
agaaagcugugaacag

SEQ ID NO: 3481313 - RNA, 16 nt, Human
agaaaggaaaaccuga

SEQ ID NO: 3481314 - RNA, 14 nt, Human
agaaaggaaaccuu

SEQ ID NO: 3481315 - RNA, 15 nt, Human
agaaaggaagcauug

SEQ ID NO: 3481316 - RNA, 17 nt, Human
agaaaggaagcauugua

SEQ ID NO: 3481317 - RNA, 21 nt, Human
agaaaggaagcauuguaaaau

SEQ ID NO: 3481318 - RNA, 16 nt, Human
agaaaggaccugcaaa

SEQ ID NO: 3481319 - RNA, 19 nt, Human
agaaaggacuccugaaaaa

SEQ ID NO: 3481320 - RNA, 11 nt, Human
agaaaggagac

SEQ ID NO: 3481321 - RNA, 18 nt, Human
agaaaggagagucuugca

SEQ ID NO: 3481322 - RNA, 17 nt, Human
agaaaggagucugcaca

SEQ ID NO: 3481323 - RNA, 19 nt, Human
agaaaggauauuuaagaaa

SEQ ID NO: 3481324 - RNA, 15 nt, Human
agaaaggccugcaca

SEQ ID NO: 3481325 - RNA, 15 nt, Human
agaaaggccuuuaaa

SEQ ID NO: 3481326 - RNA, 15 nt, Human
agaaaggcugcugua

SEQ ID NO: 3481327 - RNA, 15 nt, Human
agaaaggcuguuaaa

SEQ ID NO: 3481328 - RNA, 16 nt, Human
agaaaggcuguuaaau

SEQ ID NO: 3481329 - RNA, 21 nt, Human
agaaaggcuguuaaauacagg

SEQ ID NO: 3481330 - RNA, 14 nt, Human
agaaagggagggcu

SEQ ID NO: 3481331 - RNA, 16 nt, Human
agaaagggagggcucu

SEQ ID NO: 3481332 - RNA, 18 nt, Human
agaaagggagggcucuga

SEQ ID NO: 3481333 - RNA, 19 nt, Human
agaaagggagggcucugag

SEQ ID NO: 3481334 - RNA, 21 nt, Human
agaaagggagggcucugaggc

SEQ ID NO: 3481335 - RNA, 20 nt, Human
agaaagggcaacaauaaaau

SEQ ID NO: 3481336 - RNA, 15 nt, Human
agaaaggggagccca

SEQ ID NO: 3481337 - RNA, 17 nt, Human
agaaaggggcaggagcu

SEQ ID NO: 3481338 - RNA, 21 nt, Human
agaaaggggcaggagcucaga

SEQ ID NO: 3481339 - RNA, 22 nt, Human
agaaaggggcaggagcucagau

SEQ ID NO: 3481340 - RNA, 14 nt, Human
agaaaggguguuuu

SEQ ID NO: 3481341 - RNA, 22 nt, Human
agaaaggugaguuugagcugcc

SEQ ID NO: 3481342 - RNA, 23 nt, Human
agaaaggugaguuugagcugccu

SEQ ID NO: 3481343 - RNA, 19 nt, Human
agaaagguuuugagcaugg

SEQ ID NO: 3481344 - RNA, 15 nt, Human
agaaaguaauuucuu

SEQ ID NO: 3481345 - RNA, 17 nt, Human
agaaagucauuccuucu

SEQ ID NO: 3481346 - RNA, 21 nt, Human
agaaagucgaauuaauagcuu

SEQ ID NO: 3481347 - RNA, 19 nt, Human
agaaagucuuauuuauuca

SEQ ID NO: 3481348 - RNA, 22 nt, Human
agaaagucuuauuuauucauau

SEQ ID NO: 3481349 - RNA, 15 nt, Human
agaaagugccugaca

SEQ ID NO: 3481350 - RNA, 18 nt, Human
agaaagugccuuucagga

SEQ ID NO: 3481351 - RNA, 19 nt, Human
agaaagugggaggucagga

SEQ ID NO: 3481352 - RNA, 22 nt, Human
agaaagugggcuuaauggaguu

SEQ ID NO: 3481353 - RNA, 17 nt, Human
agaaaguggugcucagu

SEQ ID NO: 3481354 - RNA, 11 nt, Human
agaaaguguau

SEQ ID NO: 3481355 - RNA, 17 nt, Human
agaaagugugagcaaac

SEQ ID NO: 3481356 - RNA, 22 nt, Human
agaaagugugcuuuaugcugaa

SEQ ID NO: 3481357 - RNA, 16 nt, Human
agaaaguguucuguua

SEQ ID NO: 3481358 - RNA, 19 nt, Human
agaaaguguucuguuacaa

SEQ ID NO: 3481359 - RNA, 13 nt, Human
agaaaguuuagaa

SEQ ID NO: 3481360 - RNA, 18 nt, Human
agaaauaaaaggaagcca

SEQ ID NO: 3481361 - RNA, 23 nt, Human
agaaauaaaagugaaugaaagau

SEQ ID NO: 3481362 - RNA, 14 nt, Human
agaaauaaaccaaa

SEQ ID NO: 3481363 - RNA, 23 nt, Human
agaaauaaaccaaaggaaaaugu

SEQ ID NO: 3481364 - RNA, 16 nt, Human
agaaauaaaccuuaau

SEQ ID NO: 3481365 - RNA, 19 nt, Human
agaaauaaaguuggugaca

SEQ ID NO: 3481366 - RNA, 21 nt, Human
agaaauaaaguuggugacaga

SEQ ID NO: 3481367 - RNA, 18 nt, Human
agaaauaaaguuucuguu

SEQ ID NO: 3481368 - RNA, 21 nt, Human
agaaauaaaguuugcuuagaa

SEQ ID NO: 3481369 - RNA, 18 nt, Human
agaaauaaauagcuauau

SEQ ID NO: 3481370 - RNA, 13 nt, Human
agaaauaacagaa

SEQ ID NO: 3481371 - RNA, 21 nt, Human
agaaauaacagaagaaaauag

SEQ ID NO: 3481372 - RNA, 22 nt, Human
agaaauaacagaagaaaauaga

SEQ ID NO: 3481373 - RNA, 14 nt, Human
agaaauaauaugca

SEQ ID NO: 3481374 - RNA, 17 nt, Human
agaaauaaugcuacaau

SEQ ID NO: 3481375 - RNA, 19 nt, Human
agaaauaaugcuacaauuu

SEQ ID NO: 3481376 - RNA, 22 nt, Human
agaaauaaugcuacaauuuuaa

SEQ ID NO: 3481377 - RNA, 14 nt, Human
agaaauacaaaaau

SEQ ID NO: 3481378 - RNA, 19 nt, Human
agaaauacaauucuacauu

SEQ ID NO: 3481379 - RNA, 12 nt, Human
agaaauacaguc

SEQ ID NO: 3481380 - RNA, 23 nt, Human
agaaauaccaaaauuauuucaga

SEQ ID NO: 3481381 - RNA, 21 nt, Human
agaaauacuauaacauaugua

SEQ ID NO: 3481382 - RNA, 14 nt, Human
agaaauacuguaca

SEQ ID NO: 3481383 - RNA, 13 nt, Human
agaaauagaacaa

SEQ ID NO: 3481384 - RNA, 16 nt, Human
agaaauagaauuauaa

SEQ ID NO: 3481385 - RNA, 19 nt, Human
agaaauagcuuaugaaaag

SEQ ID NO: 3481386 - RNA, 15 nt, Human
agaaauaguucugug

SEQ ID NO: 3481387 - RNA, 16 nt, Human
agaaauauaacacauu

SEQ ID NO: 3481388 - RNA, 17 nt, Human
agaaauauaacacauuu

SEQ ID NO: 3481389 - RNA, 19 nt, Human
agaaauauaacacauuuuu

SEQ ID NO: 3481390 - RNA, 14 nt, Human
agaaauauaauuga

SEQ ID NO: 3481391 - RNA, 13 nt, Human
agaaauauauaua

SEQ ID NO: 3481392 - RNA, 20 nt, Human
agaaauaucugaaaauguau

SEQ ID NO: 3481393 - RNA, 13 nt, Human
agaaauaugauuu

SEQ ID NO: 3481394 - RNA, 22 nt, Human
agaaauaugauuuuauuugaca

SEQ ID NO: 3481395 - RNA, 17 nt, Human
agaaauauggaacuuac

SEQ ID NO: 3481396 - RNA, 20 nt, Human
agaaauauggaacuuacauu

SEQ ID NO: 3481397 - RNA, 17 nt, Human
agaaauauggacacuua

SEQ ID NO: 3481398 - RNA, 17 nt, Human
agaaauauguauucugu

SEQ ID NO: 3481399 - RNA, 13 nt, Human
agaaauaugugag

SEQ ID NO: 3481400 - RNA, 14 nt, Human
agaaauaugugaga

SEQ ID NO: 3481401 - RNA, 18 nt, Human
agaaauauuccaaauguc

SEQ ID NO: 3481402 - RNA, 17 nt, Human
agaaauauuuuaaaauc

SEQ ID NO: 3481403 - RNA, 17 nt, Human
agaaaucacagaaucau

SEQ ID NO: 3481404 - RNA, 18 nt, Human
agaaaucaguaauauuua

SEQ ID NO: 3481405 - RNA, 12 nt, Human
agaaaucauguu

SEQ ID NO: 3481406 - RNA, 23 nt, Human
agaaaucuaguauuucaugcugg

SEQ ID NO: 3481407 - RNA, 20 nt, Human
agaaaucuauagaaaguguu

SEQ ID NO: 3481408 - RNA, 22 nt, Human
agaaaucuauagaacugaauga

SEQ ID NO: 3481409 - RNA, 20 nt, Human
agaaaucucccaugugcaua

SEQ ID NO: 3481410 - RNA, 16 nt, Human
agaaaugaaaacagug

SEQ ID NO: 3481411 - RNA, 14 nt, Human
agaaaugaaauuuu

SEQ ID NO: 3481412 - RNA, 15 nt, Human
agaaaugaacauucc

SEQ ID NO: 3481413 - RNA, 19 nt, Human
agaaaugaauaauuuccca

SEQ ID NO: 3481414 - RNA, 19 nt, Human
agaaaugagaucaggcucu

SEQ ID NO: 3481415 - RNA, 23 nt, Human
agaaaugaugauguggaagaacu

SEQ ID NO: 3481416 - RNA, 18 nt, Human
agaaaugauguuggagaa

SEQ ID NO: 3481417 - RNA, 18 nt, Human
agaaaugcauauuguauu

SEQ ID NO: 3481418 - RNA, 22 nt, Human
agaaaugcauccauuccucagg

SEQ ID NO: 3481419 - RNA, 15 nt, Human
agaaaugcugccugc

SEQ ID NO: 3481420 - RNA, 15 nt, Human
agaaaugcugcuggc

SEQ ID NO: 3481421 - RNA, 16 nt, Human
agaaauggaaagcaga

SEQ ID NO: 3481422 - RNA, 20 nt, Human
agaaaugggacuuaacuccu

SEQ ID NO: 3481423 - RNA, 16 nt, Human
agaaauggggaauucu

SEQ ID NO: 3481424 - RNA, 21 nt, Human
agaaauggggaauucucuaau

SEQ ID NO: 3481425 - RNA, 15 nt, Human
agaaaugguuguauu

SEQ ID NO: 3481426 - RNA, 16 nt, Human
agaaaugguuguauua

SEQ ID NO: 3481427 - RNA, 13 nt, Human
agaaauguaaacu

SEQ ID NO: 3481428 - RNA, 15 nt, Human
agaaauguaaacugc

SEQ ID NO: 3481429 - RNA, 16 nt, Human
agaaauguaaacugcc

SEQ ID NO: 3481430 - RNA, 17 nt, Human
agaaauguaaacugcca

SEQ ID NO: 3481431 - RNA, 12 nt, Human
agaaauguaaug

SEQ ID NO: 3481432 - RNA, 14 nt, Human
agaaauguacagca

SEQ ID NO: 3481433 - RNA, 16 nt, Human
agaaauguacagcaag

SEQ ID NO: 3481434 - RNA, 15 nt, Human
agaaauguaguugau

SEQ ID NO: 3481435 - RNA, 16 nt, Human
agaaauguauaaacuu

SEQ ID NO: 3481436 - RNA, 19 nt, Human
agaaaugucccuuucuucu

SEQ ID NO: 3481437 - RNA, 15 nt, Human
agaaaugucuggaga

SEQ ID NO: 3481438 - RNA, 11 nt, Human
agaaauguguu

SEQ ID NO: 3481439 - RNA, 16 nt, Human
agaaauguuguucauu

SEQ ID NO: 3481440 - RNA, 19 nt, Human
agaaauuaccuguggauau

SEQ ID NO: 3481441 - RNA, 20 nt, Human
agaaauuaccuguggauauu

SEQ ID NO: 3481442 - RNA, 17 nt, Human
agaaauuagaaaccuua

SEQ ID NO: 3481443 - RNA, 17 nt, Human
agaaauuagcuguguga

SEQ ID NO: 3481444 - RNA, 21 nt, Human
agaaauuagggcucuaauuuc

SEQ ID NO: 3481445 - RNA, 12 nt, Human
agaaauuaugug

SEQ ID NO: 3481446 - RNA, 13 nt, Human
agaaauuaugugc

SEQ ID NO: 3481447 - RNA, 17 nt, Human
agaaauuauuuaauaaa

SEQ ID NO: 3481448 - RNA, 22 nt, Human
agaaauucaauuuggauuuaaa

SEQ ID NO: 3481449 - RNA, 14 nt, Human
agaaauucccugga

SEQ ID NO: 3481450 - RNA, 18 nt, Human
agaaauucccuggaccag

SEQ ID NO: 3481451 - RNA, 22 nt, Human
agaaauucccuggaccagaugc

SEQ ID NO: 3481452 - RNA, 16 nt, Human
agaaauuccuguagca

SEQ ID NO: 3481453 - RNA, 23 nt, Human
agaaauuccuguagcaucuucug

SEQ ID NO: 3481454 - RNA, 23 nt, Human
agaaauuccuugauucacaauga

SEQ ID NO: 3481455 - RNA, 18 nt, Human
agaaauucguguguuuuu

SEQ ID NO: 3481456 - RNA, 13 nt, Human
agaaauucuguua

SEQ ID NO: 3481457 - RNA, 15 nt, Human
agaaauucuguuaaa

SEQ ID NO: 3481458 - RNA, 19 nt, Human
agaaauucuguuaaaaucu

SEQ ID NO: 3481459 - RNA, 20 nt, Human
agaaauucuguuaaaaucua

SEQ ID NO: 3481460 - RNA, 16 nt, Human
agaaauucuguuuuua

SEQ ID NO: 3481461 - RNA, 19 nt, Human
agaaauucuguuuuuaaaa

SEQ ID NO: 3481462 - RNA, 18 nt, Human
agaaauucuuguuauggu

SEQ ID NO: 3481463 - RNA, 21 nt, Human
agaaauugaauacuuugaaug

SEQ ID NO: 3481464 - RNA, 22 nt, Human
agaaauugaauacuuugaaugu

SEQ ID NO: 3481465 - RNA, 20 nt, Human
agaaauugcauuuccugaca

SEQ ID NO: 3481466 - RNA, 19 nt, Human
agaaauuggaacagaaugu

SEQ ID NO: 3481467 - RNA, 22 nt, Human
agaaauugguaccuugcacaca

SEQ ID NO: 3481468 - RNA, 23 nt, Human
agaaauugguaccuugcacacau

SEQ ID NO: 3481469 - RNA, 16 nt, Human
agaaauuguauauugu

SEQ ID NO: 3481470 - RNA, 20 nt, Human
agaaauuuaaacuauaagca

SEQ ID NO: 3481471 - RNA, 14 nt, Human
agaaauuuacuaua

SEQ ID NO: 3481472 - RNA, 15 nt, Human
agaaauuuacuauau

SEQ ID NO: 3481473 - RNA, 19 nt, Human
agaaauuuacuauauauau

SEQ ID NO: 3481474 - RNA, 13 nt, Human
agaaauuuauuuc

SEQ ID NO: 3481475 - RNA, 16 nt, Human
agaaauuuccacucag

SEQ ID NO: 3481476 - RNA, 22 nt, Human
agaaauuuccacucaggucugu

SEQ ID NO: 3481477 - RNA, 16 nt, Human
agaaauuugauuucua

SEQ ID NO: 3481478 - RNA, 20 nt, Human
agaaauuugauuucuauuca

SEQ ID NO: 3481479 - RNA, 13 nt, Human
agaaauuuuguaa

SEQ ID NO: 3481480 - RNA, 14 nt, Human
agaaauuuuguaag

SEQ ID NO: 3481481 - RNA, 17 nt, Human
agaaauuuuguaagaag

SEQ ID NO: 3481482 - RNA, 21 nt, Human
agaaauuuuguaagaaggcaa

SEQ ID NO: 3481483 - RNA, 22 nt, Human
agaaauuuuguaagaaggcaau

SEQ ID NO: 3481484 - RNA, 22 nt, Human
agaaauuuuuauuuuucuaagg

SEQ ID NO: 3481485 - RNA, 21 nt, Human
agaaauuuuucagaugcuucu

SEQ ID NO: 3481486 - RNA, 19 nt, Human
agaacaaaaaaaucugcag

SEQ ID NO: 3481487 - RNA, 14 nt, Human
agaacaaagcuguu

SEQ ID NO: 3481488 - RNA, 18 nt, Human
agaacaaagcuguuaaac

SEQ ID NO: 3481489 - RNA, 21 nt, Human
agaacaaagcuguuaaacugu

SEQ ID NO: 3481490 - RNA, 20 nt, Human
agaacaaagugagacagucc

SEQ ID NO: 3481491 - RNA, 18 nt, Human
agaacaaauauucagaau

SEQ ID NO: 3481492 - RNA, 17 nt, Human
agaacaaccaaaaucuu

SEQ ID NO: 3481493 - RNA, 22 nt, Human
agaacaagaaagggccaggaga

SEQ ID NO: 3481494 - RNA, 19 nt, Human
agaacaauauugacuuugu

SEQ ID NO: 3481495 - RNA, 12 nt, Human
agaacacacaca

SEQ ID NO: 3481496 - RNA, 15 nt, Human
agaacacacacacuu

SEQ ID NO: 3481497 - RNA, 19 nt, Human
agaacacagaaagccuauc

SEQ ID NO: 3481498 - RNA, 21 nt, Human
agaacacagccgauucaccug

SEQ ID NO: 3481499 - RNA, 14 nt, Human
agaacacuaauuca

SEQ ID NO: 3481500 - RNA, 16 nt, Human
agaacacuauuuucag

SEQ ID NO: 3481501 - RNA, 18 nt, Human
agaacacuauuuucagaa

SEQ ID NO: 3481502 - RNA, 19 nt, Human
agaacacuauuuucagaau

SEQ ID NO: 3481503 - RNA, 21 nt, Human
agaacacuauuuucagaaucu

SEQ ID NO: 3481504 - RNA, 23 nt, Human
agaacacuauuuucagaaucuga

SEQ ID NO: 3481505 - RNA, 11 nt, Human
agaacagaaaa

SEQ ID NO: 3481506 - RNA, 13 nt, Human
agaacagaaaaca

SEQ ID NO: 3481507 - RNA, 14 nt, Human
agaacagaaaacaa

SEQ ID NO: 3481508 - RNA, 20 nt, Human
agaacagaucuccaaagcuu

SEQ ID NO: 3481509 - RNA, 13 nt, Human
agaacagcaggcc

SEQ ID NO: 3481510 - RNA, 16 nt, Human
agaacagcuucagguu

SEQ ID NO: 3481511 - RNA, 16 nt, Human
agaacaggcaagugaa

SEQ ID NO: 3481512 - RNA, 11 nt, Human
agaacaggguc

SEQ ID NO: 3481513 - RNA, 17 nt, Human
agaacaguaucuuugca

SEQ ID NO: 3481514 - RNA, 21 nt, Human
agaacagugcuugccacagag

SEQ ID NO: 3481515 - RNA, 16 nt, Human
agaacauaaagcaaau

SEQ ID NO: 3481516 - RNA, 20 nt, Human
agaacauaaagguaaaacaa

SEQ ID NO: 3481517 - RNA, 16 nt, Human
agaacaucccugccag

SEQ ID NO: 3481518 - RNA, 18 nt, Human
agaacaucuguccuguga

SEQ ID NO: 3481519 - RNA, 14 nt, Human
agaacaugcaguuu

SEQ ID NO: 3481520 - RNA, 16 nt, Human
agaacaugcaguuuga

SEQ ID NO: 3481521 - RNA, 21 nt, Human
agaacaugcaguuugaaauuc

SEQ ID NO: 3481522 - RNA, 14 nt, Human
agaacauggacuug

SEQ ID NO: 3481523 - RNA, 18 nt, Human
agaacauggccuaagggc

SEQ ID NO: 3481524 - RNA, 18 nt, Human
agaacauguagaaaacaa

SEQ ID NO: 3481525 - RNA, 21 nt, Human
agaacauguugguauuuaucu

SEQ ID NO: 3481526 - RNA, 19 nt, Human
agaacauugauugcugugu

SEQ ID NO: 3481527 - RNA, 18 nt, Human
agaaccaaaaagaggcua

SEQ ID NO: 3481528 - RNA, 17 nt, Human
agaaccaaagcucaaau

SEQ ID NO: 3481529 - RNA, 13 nt, Human
agaaccaaaucug

SEQ ID NO: 3481530 - RNA, 18 nt, Human
agaaccaaaucuggaagc

SEQ ID NO: 3481531 - RNA, 16 nt, Human
agaaccaagaagggcu

SEQ ID NO: 3481532 - RNA, 13 nt, Human
agaaccacuauga

SEQ ID NO: 3481533 - RNA, 14 nt, Human
agaaccagccauau

SEQ ID NO: 3481534 - RNA, 17 nt, Human
agaaccagucuuucaac

SEQ ID NO: 3481535 - RNA, 11 nt, Human
acuuggagcca

SEQ ID NO: 3481536 - RNA, 17 nt, Human
acuuggaguggagagga

SEQ ID NO: 3481537 - RNA, 18 nt, Human
acuuggauacuuggauuu

SEQ ID NO: 3481538 - RNA, 17 nt, Human
acuuggauucuuuccau

SEQ ID NO: 3481539 - RNA, 22 nt, Human
acuuggauucuuuccauuugca

SEQ ID NO: 3481540 - RNA, 15 nt, Human
acuuggcagccuugu

SEQ ID NO: 3481541 - RNA, 17 nt, Human
acuuggcagccuuguga

SEQ ID NO: 3481542 - RNA, 15 nt, Human
acuuggccucucucu

SEQ ID NO: 3481543 - RNA, 14 nt, Human
acuuggccucugga

SEQ ID NO: 3481544 - RNA, 19 nt, Human
acuuggcucgaaucucugu

SEQ ID NO: 3481545 - RNA, 14 nt, Human
acuuggcucugagg

SEQ ID NO: 3481546 - RNA, 14 nt, Human
acuuggcuggugug

SEQ ID NO: 3481547 - RNA, 19 nt, Human
acuuggcuggugugguaca

SEQ ID NO: 3481548 - RNA, 22 nt, Human
acuuggcuggugugguacagag

SEQ ID NO: 3481549 - RNA, 11 nt, Human
acuuggcuuuc

SEQ ID NO: 3481550 - RNA, 13 nt, Human
acuugggaauaua

SEQ ID NO: 3481551 - RNA, 13 nt, Human
acuugggacauug

SEQ ID NO: 3481552 - RNA, 22 nt, Human
acuugggaggcugagaugggag

SEQ ID NO: 3481553 - RNA, 22 nt, Human
acuugggaggcugaggcaggag

SEQ ID NO: 3481554 - RNA, 22 nt, Human
acuugggcacccccagccuggg

SEQ ID NO: 3481555 - RNA, 14 nt, Human
acuugggccacugu

SEQ ID NO: 3481556 - RNA, 15 nt, Human
acuugggccacugug

SEQ ID NO: 3481557 - RNA, 18 nt, Human
acuuggggagauuugcca

SEQ ID NO: 3481558 - RNA, 23 nt, Human
acuuggggaguuaagaccuggca

SEQ ID NO: 3481559 - RNA, 17 nt, Human
acuuggggcacagggag

SEQ ID NO: 3481560 - RNA, 22 nt, Human
acuugggggaacgaugugucug

SEQ ID NO: 3481561 - RNA, 17 nt, Human
acuugggggcucagcaa

SEQ ID NO: 3481562 - RNA, 22 nt, Human
acuugggggcucagcaaggcca

SEQ ID NO: 3481563 - RNA, 20 nt, Human
acuuggggguucaggcccgg

SEQ ID NO: 3481564 - RNA, 21 nt, Human
acuuggguccaggccuacucc

SEQ ID NO: 3481565 - RNA, 15 nt, Human
acuugggucuucccu

SEQ ID NO: 3481566 - RNA, 20 nt, Human
acuuggucacagccaggcgc

SEQ ID NO: 3481567 - RNA, 14 nt, Human
acuuggucaccagc

SEQ ID NO: 3481568 - RNA, 20 nt, Human
acuugguccaacugcaacuc

SEQ ID NO: 3481569 - RNA, 14 nt, Human
acuuggucugugag

SEQ ID NO: 3481570 - RNA, 22 nt, Human
acuuggugcuuauugauauucu

SEQ ID NO: 3481571 - RNA, 22 nt, Human
acuugguguccuuucccuccac

SEQ ID NO: 3481572 - RNA, 13 nt, Human
acuugguuauaca

SEQ ID NO: 3481573 - RNA, 13 nt, Human
acuugguuuuaug

SEQ ID NO: 3481574 - RNA, 14 nt, Human
acuugguuuugcua

SEQ ID NO: 3481575 - RNA, 19 nt, Human
acuuguaaaggaauuuaaa

SEQ ID NO: 3481576 - RNA, 13 nt, Human
acuuguaaauaca

SEQ ID NO: 3481577 - RNA, 18 nt, Human
acuuguaaauauaaagac

SEQ ID NO: 3481578 - RNA, 19 nt, Human
acuuguaaauauaaagacg

SEQ ID NO: 3481579 - RNA, 20 nt, Human
acuuguaaaugugguaaaga

SEQ ID NO: 3481580 - RNA, 14 nt, Human
acuuguacaaaaua

SEQ ID NO: 3481581 - RNA, 20 nt, Human
acuuguacaaaauaaacaaa

SEQ ID NO: 3481582 - RNA, 12 nt, Human
acuuguagauuu

SEQ ID NO: 3481583 - RNA, 13 nt, Human
acuuguagauuug

SEQ ID NO: 3481584 - RNA, 14 nt, Human
acuuguagauuuga

SEQ ID NO: 3481585 - RNA, 16 nt, Human
acuuguagauuugauu

SEQ ID NO: 3481586 - RNA, 17 nt, Human
acuuguagauuugauuu

SEQ ID NO: 3481587 - RNA, 18 nt, Human
acuuguagauuugauuuu

SEQ ID NO: 3481588 - RNA, 11 nt, Human
acuuguagcug

SEQ ID NO: 3481589 - RNA, 17 nt, Human
acuuguagggaugccuu

SEQ ID NO: 3481590 - RNA, 15 nt, Human
acuuguauaaaugua

SEQ ID NO: 3481591 - RNA, 21 nt, Human
acuuguauaaauguauauaca

SEQ ID NO: 3481592 - RNA, 20 nt, Human
acuuguauauucuauuuuac

SEQ ID NO: 3481593 - RNA, 20 nt, Human
acuuguauccaggccuggga

SEQ ID NO: 3481594 - RNA, 14 nt, Human
acuugucaaagaag

SEQ ID NO: 3481595 - RNA, 16 nt, Human
acuugucaaagaaggu

SEQ ID NO: 3481596 - RNA, 18 nt, Human
acuugucaagccugugca

SEQ ID NO: 3481597 - RNA, 15 nt, Human
acuugucaauaaaau

SEQ ID NO: 3481598 - RNA, 16 nt, Human
acuugucaauauuuaa

SEQ ID NO: 3481599 - RNA, 17 nt, Human
acuugucaauauuuaaa

SEQ ID NO: 3481600 - RNA, 20 nt, Human
acuugucaauauuuaaacau

SEQ ID NO: 3481601 - RNA, 20 nt, Human
acuugucacugacacaaagg

SEQ ID NO: 3481602 - RNA, 22 nt, Human
acuugucacugacacaaaggaa

SEQ ID NO: 3481603 - RNA, 15 nt, Human
acuugucacuugcau

SEQ ID NO: 3481604 - RNA, 18 nt, Human
acuugucacuugcauguc

SEQ ID NO: 3481605 - RNA, 23 nt, Human
acuugucccgggacaccuaggcu

SEQ ID NO: 3481606 - RNA, 23 nt, Human
acuuguccuuuuguaccauggug

SEQ ID NO: 3481607 - RNA, 16 nt, Human
acuugucucauuuuaa

SEQ ID NO: 3481608 - RNA, 20 nt, Human
acuugucucauuuuaaugua

SEQ ID NO: 3481609 - RNA, 12 nt, Human
acuugucuguuu

SEQ ID NO: 3481610 - RNA, 13 nt, Human
acuugucuguuuu

SEQ ID NO: 3481611 - RNA, 19 nt, Human
acuugucuuaaauaaaaga

SEQ ID NO: 3481612 - RNA, 23 nt, Human
acuugucuuaaauaaaagaaaug

SEQ ID NO: 3481613 - RNA, 16 nt, Human
acuugucuuucugggg

SEQ ID NO: 3481614 - RNA, 14 nt, Human
acuugucuuuggac

SEQ ID NO: 3481615 - RNA, 18 nt, Human
acuugucuuuggacccug

SEQ ID NO: 3481616 - RNA, 16 nt, Human
acuugucuuuuucugg

SEQ ID NO: 3481617 - RNA, 17 nt, Human
acuugucuuuuucugga

SEQ ID NO: 3481618 - RNA, 19 nt, Human
acuugugaaacacagcugu

SEQ ID NO: 3481619 - RNA, 11 nt, Human
acuugugaaug

SEQ ID NO: 3481620 - RNA, 13 nt, Human
acuugugaaugcu

SEQ ID NO: 3481621 - RNA, 18 nt, Human
acuugugaaugcuucuca

SEQ ID NO: 3481622 - RNA, 17 nt, Human
acuugugauuauuuauu

SEQ ID NO: 3481623 - RNA, 18 nt, Human
acuugugccaacacucaa

SEQ ID NO: 3481624 - RNA, 21 nt, Human
acuugugcuuucaguuagccu

SEQ ID NO: 3481625 - RNA, 15 nt, Human
acuuguggacacagc

SEQ ID NO: 3481626 - RNA, 20 nt, Human
acuuguggacuaaaagauau

SEQ ID NO: 3481627 - RNA, 16 nt, Human
acuugugguugaauua

SEQ ID NO: 3481628 - RNA, 13 nt, Human
acuuguguaaaua

SEQ ID NO: 3481629 - RNA, 23 nt, Human
acuuguguaaauacaauuuuguu

SEQ ID NO: 3481630 - RNA, 21 nt, Human
acuugugucucugugcuuuua

SEQ ID NO: 3481631 - RNA, 20 nt, Human
acuugugugugggcugugag

SEQ ID NO: 3481632 - RNA, 21 nt, Human
acuugugugugggcugugagu

SEQ ID NO: 3481633 - RNA, 17 nt, Human
acuuguguuuuaaaaua

SEQ ID NO: 3481634 - RNA, 13 nt, Human
acuuguuauugug

SEQ ID NO: 3481635 - RNA, 20 nt, Human
acuuguuauugugaaugauu

SEQ ID NO: 3481636 - RNA, 17 nt, Human
acuuguuccagcucuuu

SEQ ID NO: 3481637 - RNA, 12 nt, Human
acuuguucuucc

SEQ ID NO: 3481638 - RNA, 13 nt, Human
acuuguucuucca

SEQ ID NO: 3481639 - RNA, 15 nt, Human
acuuguugccuauaa

SEQ ID NO: 3481640 - RNA, 22 nt, Human
acuuguuggcguaggcuacaga

SEQ ID NO: 3481641 - RNA, 21 nt, Human
acuuguuguuuuacuaaagaa

SEQ ID NO: 3481642 - RNA, 22 nt, Human
acuuguuuuauuuaaccucuaa

SEQ ID NO: 3481643 - RNA, 18 nt, Human
acuuguuuuggauggcuu

SEQ ID NO: 3481644 - RNA, 16 nt, Human
acuuguuuuuguaaag

SEQ ID NO: 3481645 - RNA, 21 nt, Human
acuuguuuuuguaaagaaaaa

SEQ ID NO: 3481646 - RNA, 16 nt, Human
acuuuaaaaauuuacu

SEQ ID NO: 3481647 - RNA, 12 nt, Human
acuuuaaaagca

SEQ ID NO: 3481648 - RNA, 14 nt, Human
acuuuaaaagcauu

SEQ ID NO: 3481649 - RNA, 20 nt, Human
acuuuaaaggaaaaaauguu

SEQ ID NO: 3481650 - RNA, 21 nt, Human
acuuuaaaggaaaaaauguug

SEQ ID NO: 3481651 - RNA, 13 nt, Human
acuuuaaauugug

SEQ ID NO: 3481652 - RNA, 14 nt, Human
acuuuaacauaagc

SEQ ID NO: 3481653 - RNA, 18 nt, Human
acuuuaacauaagcuauu

SEQ ID NO: 3481654 - RNA, 19 nt, Human
acuuuaacauaagcuauuu

SEQ ID NO: 3481655 - RNA, 20 nt, Human
acuuuaacuuaguuuugcau

SEQ ID NO: 3481656 - RNA, 16 nt, Human
acuuuaacuucuguuu

SEQ ID NO: 3481657 - RNA, 13 nt, Human
acuuuaagcacua

SEQ ID NO: 3481658 - RNA, 15 nt, Human
acuuuaaguuucagg

SEQ ID NO: 3481659 - RNA, 19 nt, Human
acuuuaauuaccaaccugu

SEQ ID NO: 3481660 - RNA, 23 nt, Human
acuuuaauucucaugugauccuu

SEQ ID NO: 3481661 - RNA, 10 nt, Human
acuuuaauuu

SEQ ID NO: 3481662 - RNA, 18 nt, Human
acuuuacacaauagaauu

SEQ ID NO: 3481663 - RNA, 18 nt, Human
acuuuacagaaauggacu

SEQ ID NO: 3481664 - RNA, 17 nt, Human
acuuuacaugacacagc

SEQ ID NO: 3481665 - RNA, 17 nt, Human
acuuuacccaccuagaa

SEQ ID NO: 3481666 - RNA, 16 nt, Human
acuuuacuaagaugac

SEQ ID NO: 3481667 - RNA, 18 nt, Human
acuuuacuaagaugacau

SEQ ID NO: 3481668 - RNA, 22 nt, Human
acuuuacuaagaugacauugcu

SEQ ID NO: 3481669 - RNA, 17 nt, Human
acuuuagaaagcugaca

SEQ ID NO: 3481670 - RNA, 12 nt, Human
acuuuagaaaua

SEQ ID NO: 3481671 - RNA, 14 nt, Human
acuuuagaaauaaa

SEQ ID NO: 3481672 - RNA, 21 nt, Human
acuuuagaagcacaguaaaua

SEQ ID NO: 3481673 - RNA, 19 nt, Human
acuuuagaagugcauuucu

SEQ ID NO: 3481674 - RNA, 15 nt, Human
acuuuagaguagcau

SEQ ID NO: 3481675 - RNA, 15 nt, Human
acuuuagaugcugau

SEQ ID NO: 3481676 - RNA, 19 nt, Human
acuuuaggcuuucagcuua

SEQ ID NO: 3481677 - RNA, 22 nt, Human
acuuuagggcuguaaaaugcau

SEQ ID NO: 3481678 - RNA, 19 nt, Human
acuuuagggggugggauuc

SEQ ID NO: 3481679 - RNA, 19 nt, Human
acuuuaggguaaaaauugc

SEQ ID NO: 3481680 - RNA, 13 nt, Human
acuuuaguaugac

SEQ ID NO: 3481681 - RNA, 15 nt, Human
acuuuagucugcaaa

SEQ ID NO: 3481682 - RNA, 17 nt, Human
acuuuagucugcaaaau

SEQ ID NO: 3481683 - RNA, 12 nt, Human
acuuuauaaauu

SEQ ID NO: 3481684 - RNA, 13 nt, Human
acuuuauaaauuu

SEQ ID NO: 3481685 - RNA, 13 nt, Human
agaagcauuugua

SEQ ID NO: 3481686 - RNA, 23 nt, Human
agaagccaacuaugauuauuaac

SEQ ID NO: 3481687 - RNA, 15 nt, Human
agaagccaagggaaa

SEQ ID NO: 3481688 - RNA, 21 nt, Human
agaagccaagggaaaggggug

SEQ ID NO: 3481689 - RNA, 17 nt, Human
agaagccacccaaagca

SEQ ID NO: 3481690 - RNA, 12 nt, Human
agaagccaggaa

SEQ ID NO: 3481691 - RNA, 13 nt, Human
agaagccaggaau

SEQ ID NO: 3481692 - RNA, 18 nt, Human
agaagccaucaccucaga

SEQ ID NO: 3481693 - RNA, 22 nt, Human
agaagccauggaaaaacuuccu

SEQ ID NO: 3481694 - RNA, 12 nt, Human
agaagccauugu

SEQ ID NO: 3481695 - RNA, 15 nt, Human
agaagccauugucuu

SEQ ID NO: 3481696 - RNA, 20 nt, Human
agaagccauugucuucggaa

SEQ ID NO: 3481697 - RNA, 21 nt, Human
agaagcccaauauuauaauuu

SEQ ID NO: 3481698 - RNA, 11 nt, Human
agaagcccaga

SEQ ID NO: 3481699 - RNA, 18 nt, Human
agaagcccaggaaaggcu

SEQ ID NO: 3481700 - RNA, 20 nt, Human
agaagcccaggaaaggcucc

SEQ ID NO: 3481701 - RNA, 21 nt, Human
agaagcccaggaaaggcucca

SEQ ID NO: 3481702 - RNA, 23 nt, Human
agaagcccaggaaaggcuccagg

SEQ ID NO: 3481703 - RNA, 17 nt, Human
agaagcccccagcuaag

SEQ ID NO: 3481704 - RNA, 21 nt, Human
agaagccccuuccccauggga

SEQ ID NO: 3481705 - RNA, 20 nt, Human
agaagcccggcuccugguca

SEQ ID NO: 3481706 - RNA, 21 nt, Human
agaagccgagagccuuuugug

SEQ ID NO: 3481707 - RNA, 20 nt, Human
agaagccucguuuugaugcc

SEQ ID NO: 3481708 - RNA, 12 nt, Human
agaagccucugg

SEQ ID NO: 3481709 - RNA, 21 nt, Human
agaagccugaugcugacauuc

SEQ ID NO: 3481710 - RNA, 21 nt, Human
agaagccugcauaauguuucu

SEQ ID NO: 3481711 - RNA, 11 nt, Human
agaagccuggg

SEQ ID NO: 3481712 - RNA, 13 nt, Human
agaagccuggggg

SEQ ID NO: 3481713 - RNA, 22 nt, Human
agaagccuguaacacuccucug

SEQ ID NO: 3481714 - RNA, 12 nt, Human
agaagccuucag

SEQ ID NO: 3481715 - RNA, 13 nt, Human
agaagccuucagc

SEQ ID NO: 3481716 - RNA, 14 nt, Human
agaagccuugguac

SEQ ID NO: 3481717 - RNA, 14 nt, Human
agaagcgagcacug

SEQ ID NO: 3481718 - RNA, 22 nt, Human
agaagcgauuaugaaagcaaca

SEQ ID NO: 3481719 - RNA, 13 nt, Human
agaagcuaagcug

SEQ ID NO: 3481720 - RNA, 21 nt, Human
agaagcuaugucaagaggcug

SEQ ID NO: 3481721 - RNA, 13 nt, Human
agaagcucagcug

SEQ ID NO: 3481722 - RNA, 17 nt, Human
agaagcucccaggaaca

SEQ ID NO: 3481723 - RNA, 14 nt, Human
agaagcuccucucc

SEQ ID NO: 3481724 - RNA, 18 nt, Human
agaagcuccucuccccag

SEQ ID NO: 3481725 - RNA, 22 nt, Human
agaagcuccucuccccagccca

SEQ ID NO: 3481726 - RNA, 15 nt, Human
agaagcugagcacca

SEQ ID NO: 3481727 - RNA, 20 nt, Human
agaagcugagcaccagggga

SEQ ID NO: 3481728 - RNA, 12 nt, Human
agaagcugcagg

SEQ ID NO: 3481729 - RNA, 19 nt, Human
agaagcugcuccaggccug

SEQ ID NO: 3481730 - RNA, 16 nt, Human
agaagcugcugaccaa

SEQ ID NO: 3481731 - RNA, 16 nt, Human
agaagcuguuguacau

SEQ ID NO: 3481732 - RNA, 20 nt, Human
agaagcuguuguacauuuau

SEQ ID NO: 3481733 - RNA, 21 nt, Human
agaagcuguuguacauuuaug

SEQ ID NO: 3481734 - RNA, 15 nt, Human
agaagcuuaggcagg

SEQ ID NO: 3481735 - RNA, 18 nt, Human
agaagcuucuaauaaauu

SEQ ID NO: 3481736 - RNA, 15 nt, Human
agaagcuuuauuucu

SEQ ID NO: 3481737 - RNA, 16 nt, Human
agaaggaaaaaugugu

SEQ ID NO: 3481738 - RNA, 19 nt, Human
agaaggaaaaugaucugag

SEQ ID NO: 3481739 - RNA, 23 nt, Human
agaaggaaagcuuuggcaguguu

SEQ ID NO: 3481740 - RNA, 14 nt, Human
agaaggaagcaggu

SEQ ID NO: 3481741 - RNA, 11 nt, Human
agaaggaaggc

SEQ ID NO: 3481742 - RNA, 17 nt, Human
agaaggaaggcagggag

SEQ ID NO: 3481743 - RNA, 19 nt, Human
agaaggaaggcagggagga

SEQ ID NO: 3481744 - RNA, 15 nt, Human
agaaggaauuugagu

SEQ ID NO: 3481745 - RNA, 18 nt, Human
agaaggagagaaaguggg

SEQ ID NO: 3481746 - RNA, 19 nt, Human
agaaggagagaaagugggu

SEQ ID NO: 3481747 - RNA, 22 nt, Human
agaaggaggaaugcuggacugg

SEQ ID NO: 3481748 - RNA, 16 nt, Human
agaaggcaaaaauagu

SEQ ID NO: 3481749 - RNA, 15 nt, Human
agaaggcaaaaaugu

SEQ ID NO: 3481750 - RNA, 14 nt, Human
agaaggcaaaugac

SEQ ID NO: 3481751 - RNA, 15 nt, Human
agaaggcaaaugacu

SEQ ID NO: 3481752 - RNA, 13 nt, Human
agaaggcagccac

SEQ ID NO: 3481753 - RNA, 22 nt, Human
agaaggcauaucagucucugag

SEQ ID NO: 3481754 - RNA, 23 nt, Human
agaaggccuucauggccccagca

SEQ ID NO: 3481755 - RNA, 16 nt, Human
agaaggcuggggcuau

SEQ ID NO: 3481756 - RNA, 15 nt, Human
agaagggaaagccca

SEQ ID NO: 3481757 - RNA, 18 nt, Human
agaagggaaggggagagg

SEQ ID NO: 3481758 - RNA, 16 nt, Human
agaagggaauccuccu

SEQ ID NO: 3481759 - RNA, 18 nt, Human
agaagggagcuagccaga

SEQ ID NO: 3481760 - RNA, 18 nt, Human
agaagggagcuggcucca

SEQ ID NO: 3481761 - RNA, 19 nt, Human
agaagggagggcagagcug

SEQ ID NO: 3481762 - RNA, 21 nt, Human
agaagggagggcagagcuggu

SEQ ID NO: 3481763 - RNA, 22 nt, Human
agaagggagggcagagcuggug

SEQ ID NO: 3481764 - RNA, 19 nt, Human
agaagggccaguccugccu

SEQ ID NO: 3481765 - RNA, 17 nt, Human
agaagggcuccugcagg

SEQ ID NO: 3481766 - RNA, 20 nt, Human
agaagggcugcaugauguuu

SEQ ID NO: 3481767 - RNA, 15 nt, Human
agaaggggagaugga

SEQ ID NO: 3481768 - RNA, 18 nt, Human
agaagggggucaaagcaa

SEQ ID NO: 3481769 - RNA, 20 nt, Human
agaaggguuuuccacccugg

SEQ ID NO: 3481770 - RNA, 22 nt, Human
agaaggguuuuccacccuggaa

SEQ ID NO: 3481771 - RNA, 21 nt, Human
agaagguauuccuuuugugua

SEQ ID NO: 3481772 - RNA, 20 nt, Human
agaagguccuuaaugauccg

SEQ ID NO: 3481773 - RNA, 21 nt, Human
agaagguccuuaaugauccgu

SEQ ID NO: 3481774 - RNA, 20 nt, Human
agaaggucggaggcuuggga

SEQ ID NO: 3481775 - RNA, 21 nt, Human
agaagguggaccuuuuaaagu

SEQ ID NO: 3481776 - RNA, 19 nt, Human
agaagguggggguuggcug

SEQ ID NO: 3481777 - RNA, 20 nt, Human
agaagguuaccaagaagccu

SEQ ID NO: 3481778 - RNA, 17 nt, Human
agaagguugacacaguu

SEQ ID NO: 3481779 - RNA, 21 nt, Human
agaagguuuacuuuuuggugu

SEQ ID NO: 3481780 - RNA, 18 nt, Human
agaagguuuauuguuaau

SEQ ID NO: 3481781 - RNA, 22 nt, Human
agaagguuugguccagccuggu

SEQ ID NO: 3481782 - RNA, 13 nt, Human
agaaguaacaaga

SEQ ID NO: 3481783 - RNA, 21 nt, Human
agaaguaacaagagugauucu

SEQ ID NO: 3481784 - RNA, 20 nt, Human
agaaguaagaggcuaccucu

SEQ ID NO: 3481785 - RNA, 14 nt, Human
agaaguaccagacu

SEQ ID NO: 3481786 - RNA, 21 nt, Human
agaaguacugcccuuuugugu

SEQ ID NO: 3481787 - RNA, 18 nt, Human
agaaguaggggaagacau

SEQ ID NO: 3481788 - RNA, 19 nt, Human
agaaguaggggaagacaug

SEQ ID NO: 3481789 - RNA, 19 nt, Human
agaaguauaaagaauugug

SEQ ID NO: 3481790 - RNA, 16 nt, Human
agaaguauuauaaauu

SEQ ID NO: 3481791 - RNA, 16 nt, Human
agaagucaaggcuuag

SEQ ID NO: 3481792 - RNA, 18 nt, Human
agaagucaaggcuuagac

SEQ ID NO: 3481793 - RNA, 19 nt, Human
agaagucaaggcuuagacc

SEQ ID NO: 3481794 - RNA, 15 nt, Human
agaagucacagggca

SEQ ID NO: 3481795 - RNA, 17 nt, Human
agaagucacagggcagu

SEQ ID NO: 3481796 - RNA, 21 nt, Human
agaagucacauuccugaacag

SEQ ID NO: 3481797 - RNA, 22 nt, Human
agaagucagagagggugacaag

SEQ ID NO: 3481798 - RNA, 15 nt, Human
agaagucaucuugcu

SEQ ID NO: 3481799 - RNA, 13 nt, Human
agaaguccagagu

SEQ ID NO: 3481800 - RNA, 21 nt, Human
agaaguccuguaugucuguca

SEQ ID NO: 3481801 - RNA, 21 nt, Human
agaagucuucuauuuauuuau

SEQ ID NO: 3481802 - RNA, 21 nt, Human
agaagugaaaaucuacacucc

SEQ ID NO: 3481803 - RNA, 18 nt, Human
agaagugaauaacugcaa

SEQ ID NO: 3481804 - RNA, 13 nt, Human
agaagugacaggg

SEQ ID NO: 3481805 - RNA, 16 nt, Human
agaagugacagggaag

SEQ ID NO: 3481806 - RNA, 19 nt, Human
agaagugacagggaagcua

SEQ ID NO: 3481807 - RNA, 17 nt, Human
agaagugaccaaggagg

SEQ ID NO: 3481808 - RNA, 16 nt, Human
agaagugacgguuccu

SEQ ID NO: 3481809 - RNA, 17 nt, Human
agaagugacgguuccua

SEQ ID NO: 3481810 - RNA, 18 nt, Human
agaagugagcaaaaaaga

SEQ ID NO: 3481811 - RNA, 19 nt, Human
agaagugagcuuugcugcu

SEQ ID NO: 3481812 - RNA, 23 nt, Human
agaagugcaucuggagagaacag

SEQ ID NO: 3481813 - RNA, 14 nt, Human
agaagugcauuucu

SEQ ID NO: 3481814 - RNA, 16 nt, Human
agaagugcauuucuga

SEQ ID NO: 3481815 - RNA, 19 nt, Human
agaagugcauuucugaaua

SEQ ID NO: 3481816 - RNA, 13 nt, Human
agaagugccccug

SEQ ID NO: 3481817 - RNA, 22 nt, Human
agaagugccccugcugccuccc

SEQ ID NO: 3481818 - RNA, 17 nt, Human
agaaguggacuggagga

SEQ ID NO: 3481819 - RNA, 14 nt, Human
agaagugucauguu

SEQ ID NO: 3481820 - RNA, 14 nt, Human
agaagugugauugg

SEQ ID NO: 3481821 - RNA, 22 nt, Human
agaagugugauugggaauaaau

SEQ ID NO: 3481822 - RNA, 22 nt, Human
agaaugacggaauaagagaccu

SEQ ID NO: 3481823 - RNA, 12 nt, Human
agaaugagccuc

SEQ ID NO: 3481824 - RNA, 20 nt, Human
agaaugaguccuugauuuca

SEQ ID NO: 3481825 - RNA, 16 nt, Human
agacauuucuuuucuu

SEQ ID NO: 3481826 - RNA, 20 nt, Human
agacauuucuuuucuuuuua

SEQ ID NO: 3481827 - RNA, 21 nt, Human
agacauuugcuaugagcuggg

SEQ ID NO: 3481828 - RNA, 19 nt, Human
agacauuuuaaaaaauggu

SEQ ID NO: 3481829 - RNA, 20 nt, Human
agacauuuuaaaaaaugguc

SEQ ID NO: 3481830 - RNA, 22 nt, Human
agacauuuuaaaaaauggucac

SEQ ID NO: 3481831 - RNA, 15 nt, Human
agacauuuuaacaag

SEQ ID NO: 3481832 - RNA, 17 nt, Human
agacauuuuaacaagaa

SEQ ID NO: 3481833 - RNA, 22 nt, Human
agacauuuuaacaagaagauga

SEQ ID NO: 3481834 - RNA, 23 nt, Human
agacauuuuaacaagaagaugaa

SEQ ID NO: 3481835 - RNA, 24 nt, Human
agaccaaacuucacucugggcaca

SEQ ID NO: 3481836 - RNA, 17 nt, Human
agaccaaauggaaacag

SEQ ID NO: 3481837 - RNA, 14 nt, Human
agaccaaccugacc

SEQ ID NO: 3481838 - RNA, 13 nt, Human
agaccaagcuugu

SEQ ID NO: 3481839 - RNA, 19 nt, Human
agaccaaggcuuucucuac

SEQ ID NO: 3481840 - RNA, 16 nt, Human
agaccacaaaaauuga

SEQ ID NO: 3481841 - RNA, 17 nt, Human
agaccacagagcuguca

SEQ ID NO: 3481842 - RNA, 20 nt, Human
agaccacaggguucaaaaug

SEQ ID NO: 3481843 - RNA, 21 nt, Human
agaccacaggguucaaaaugu

SEQ ID NO: 3481844 - RNA, 14 nt, Human
agaccacaugcccc

SEQ ID NO: 3481845 - RNA, 14 nt, Human
agaccaccaagccu

SEQ ID NO: 3481846 - RNA, 11 nt, Human
agaccaccagg

SEQ ID NO: 3481847 - RNA, 14 nt, Human
agaccaccagggca

SEQ ID NO: 3481848 - RNA, 17 nt, Human
agaccaccauccaccgc

SEQ ID NO: 3481849 - RNA, 20 nt, Human
agaccacgcccguccugccu

SEQ ID NO: 3481850 - RNA, 14 nt, Human
agaccagaaauucc

SEQ ID NO: 3481851 - RNA, 15 nt, Human
agaccagagcucugg

SEQ ID NO: 3481852 - RNA, 20 nt, Human
agaccagagcucuggagcca

SEQ ID NO: 3481853 - RNA, 15 nt, Human
agaccagauuaaacu

SEQ ID NO: 3481854 - RNA, 18 nt, Human
agaccagauuaaacuuca

SEQ ID NO: 3481855 - RNA, 16 nt, Human
agaccagcagacagag

SEQ ID NO: 3481856 - RNA, 20 nt, Human
agaccagcagacagagccag

SEQ ID NO: 3481857 - RNA, 12 nt, Human
agaccagccugg

SEQ ID NO: 3481858 - RNA, 16 nt, Human
agaccagggcuccagc

SEQ ID NO: 3481859 - RNA, 18 nt, Human
agaccagggcuccagccc

SEQ ID NO: 3481860 - RNA, 20 nt, Human
agaccaguugggagcacugg

SEQ ID NO: 3481861 - RNA, 22 nt, Human
agaccaguugggagcacuggag

SEQ ID NO: 3481862 - RNA, 23 nt, Human
agaccaguugggagcacuggagu

SEQ ID NO: 3481863 - RNA, 15 nt, Human
agaccauagugacca

SEQ ID NO: 3481864 - RNA, 13 nt, Human
agaccaucccuga

SEQ ID NO: 3481865 - RNA, 17 nt, Human
agaccaucccugaaggc

SEQ ID NO: 3481866 - RNA, 15 nt, Human
agaccauccuggcua

SEQ ID NO: 3481867 - RNA, 16 nt, Human
agaccaugcagagcgc

SEQ ID NO: 3481868 - RNA, 21 nt, Human
agaccauggacacuacaccca

SEQ ID NO: 3481869 - RNA, 20 nt, Human
agaccauuggggcucccagc

SEQ ID NO: 3481870 - RNA, 22 nt, Human
agaccauuggggcucccagcca

SEQ ID NO: 3481871 - RNA, 14 nt, Human
agacccaaggagga

SEQ ID NO: 3481872 - RNA, 18 nt, Human
agacccagcccucauccc

SEQ ID NO: 3481873 - RNA, 19 nt, Human
agacccagcccucaucccg

SEQ ID NO: 3481874 - RNA, 17 nt, Human
agacccauuccuuccca

SEQ ID NO: 3481875 - RNA, 22 nt, Human
agacccauuccuucccagaggg

SEQ ID NO: 3481876 - RNA, 15 nt, Human
agaccccacccaagc

SEQ ID NO: 3481877 - RNA, 13 nt, Human
agacccccacacc

SEQ ID NO: 3481878 - RNA, 12 nt, Human
agacccccaccc

SEQ ID NO: 3481879 - RNA, 21 nt, Human
agacccccaccccuuccccac

SEQ ID NO: 3481880 - RNA, 12 nt, Human
agacccccacuc

SEQ ID NO: 3481881 - RNA, 13 nt, Human
agacccccacucu

SEQ ID NO: 3481882 - RNA, 20 nt, Human
agacccccagcaacccuccu

SEQ ID NO: 3481883 - RNA, 14 nt, Human
agacccccagcacu

SEQ ID NO: 3481884 - RNA, 19 nt, Human
agacccccuggagacuaac

SEQ ID NO: 3481885 - RNA, 14 nt, Human
agaccccucuggcc

SEQ ID NO: 3481886 - RNA, 13 nt, Human
agaccccuggccu

SEQ ID NO: 3481887 - RNA, 16 nt, Human
agaccccuggccuccg

SEQ ID NO: 3481888 - RNA, 13 nt, Human
agaccccugucuc

SEQ ID NO: 3481889 - RNA, 18 nt, Human
agacccuaccccaccacg

SEQ ID NO: 3481890 - RNA, 17 nt, Human
agacccucaugcugcca

SEQ ID NO: 3481891 - RNA, 18 nt, Human
agacccucaugcugccaa

SEQ ID NO: 3481892 - RNA, 21 nt, Human
agacccucugccaccagagac

SEQ ID NO: 3481893 - RNA, 15 nt, Human
agacccucuugccca

SEQ ID NO: 3481894 - RNA, 18 nt, Human
agacccucuugcccaucc

SEQ ID NO: 3481895 - RNA, 19 nt, Human
agacccucuugcccauccu

SEQ ID NO: 3481896 - RNA, 13 nt, Human
agacccugcccug

SEQ ID NO: 3481897 - RNA, 23 nt, Human
agacccugcccugugggccccca

SEQ ID NO: 3481898 - RNA, 20 nt, Human
agacccugggugggcucugu

SEQ ID NO: 3481899 - RNA, 14 nt, Human
agacccuggugccu

SEQ ID NO: 3481900 - RNA, 19 nt, Human
agacccuuguggucccacc

SEQ ID NO: 3481901 - RNA, 20 nt, Human
agacccuuguggucccaccc

SEQ ID NO: 3481902 - RNA, 23 nt, Human
agacccuuguggucccaccccac

SEQ ID NO: 3481903 - RNA, 20 nt, Human
agaccgaacuguuguauaaa

SEQ ID NO: 3481904 - RNA, 17 nt, Human
agaccggccugccagga

SEQ ID NO: 3481905 - RNA, 13 nt, Human
agaccguccucac

SEQ ID NO: 3481906 - RNA, 16 nt, Human
agaccguccucacccc

SEQ ID NO: 3481907 - RNA, 20 nt, Human
agaccgugaagauacuuugu

SEQ ID NO: 3481908 - RNA, 18 nt, Human
agaccguuuaccuagaag

SEQ ID NO: 3481909 - RNA, 16 nt, Human
agaccuaaccagggcc

SEQ ID NO: 3481910 - RNA, 17 nt, Human
agaccuaaccagggcca

SEQ ID NO: 3481911 - RNA, 21 nt, Human
agaccuaaucucuguaaagcu

SEQ ID NO: 3481912 - RNA, 15 nt, Human
agaccuaaugcuccu

SEQ ID NO: 3481913 - RNA, 14 nt, Human
agaccuacaggggg

SEQ ID NO: 3481914 - RNA, 19 nt, Human
agaccuaccucagguugcu

SEQ ID NO: 3481915 - RNA, 19 nt, Human
agaccuacuguucuaaagc

SEQ ID NO: 3481916 - RNA, 16 nt, Human
agaccuauuccuccug

SEQ ID NO: 3481917 - RNA, 14 nt, Human
agaccucagaagua

SEQ ID NO: 3481918 - RNA, 15 nt, Human
agaccucagaaguaa

SEQ ID NO: 3481919 - RNA, 11 nt, Human
agaccucagcc

SEQ ID NO: 3481920 - RNA, 14 nt, Human
agaccucagccugu

SEQ ID NO: 3481921 - RNA, 16 nt, Human
agaccucagccugugc

SEQ ID NO: 3481922 - RNA, 15 nt, Human
agaccucagggcaca

SEQ ID NO: 3481923 - RNA, 16 nt, Human
agaccucaucaggaug

SEQ ID NO: 3481924 - RNA, 11 nt, Human
agaccucugga

SEQ ID NO: 3481925 - RNA, 23 nt, Human
agaccucugugaggaaagcacac

SEQ ID NO: 3481926 - RNA, 18 nt, Human
agaccucugugcacuuau

SEQ ID NO: 3481927 - RNA, 23 nt, Human
agagcccacuccaucugguagaa

SEQ ID NO: 3481928 - RNA, 14 nt, Human
agagcccagaggua

SEQ ID NO: 3481929 - RNA, 20 nt, Human
agagcccagagguaacagaa

SEQ ID NO: 3481930 - RNA, 24 nt, Human
agagcccagagguaacagaacagc

SEQ ID NO: 3481931 - RNA, 18 nt, Human
agagcccagagucccccc

SEQ ID NO: 3481932 - RNA, 21 nt, Human
agagcccagcagggccucaaa

SEQ ID NO: 3481933 - RNA, 13 nt, Human
agagcccagcucc

SEQ ID NO: 3481934 - RNA, 15 nt, Human
agagcccaggagcuc

SEQ ID NO: 3481935 - RNA, 16 nt, Human
agagcccaggagcucc

SEQ ID NO: 3481936 - RNA, 13 nt, Human
agagcccaggccu

SEQ ID NO: 3481937 - RNA, 14 nt, Human
agagcccaggccuc

SEQ ID NO: 3481938 - RNA, 13 nt, Human
agagccccacagc

SEQ ID NO: 3481939 - RNA, 15 nt, Human
agagccccacucuca

SEQ ID NO: 3481940 - RNA, 16 nt, Human
agagccccacucucag

SEQ ID NO: 3481941 - RNA, 17 nt, Human
agagccccacucucaga

SEQ ID NO: 3481942 - RNA, 20 nt, Human
agagccccacucucagaggc

SEQ ID NO: 3481943 - RNA, 23 nt, Human
agagccccacucucagaggcccc

SEQ ID NO: 3481944 - RNA, 21 nt, Human
agagccccgcaaaacccacug

SEQ ID NO: 3481945 - RNA, 20 nt, Human
agagccccuccuccagcccc

SEQ ID NO: 3481946 - RNA, 22 nt, Human
agagccccuccuccagccccug

SEQ ID NO: 3481947 - RNA, 16 nt, Human
agagccccuggggccu

SEQ ID NO: 3481948 - RNA, 21 nt, Human
agagcccgaggaggugucuca

SEQ ID NO: 3481949 - RNA, 13 nt, Human
agagcccugcucc

SEQ ID NO: 3481950 - RNA, 13 nt, Human
agagcccugggac

SEQ ID NO: 3481951 - RNA, 21 nt, Human
agagcccuguaucaacccaga

SEQ ID NO: 3481952 - RNA, 19 nt, Human
agagcccuugccuccccau

SEQ ID NO: 3481953 - RNA, 22 nt, Human
agagccgggcacauugagcugu

SEQ ID NO: 3481954 - RNA, 17 nt, Human
agagccguaaaaacuga

SEQ ID NO: 3481955 - RNA, 21 nt, Human
agagccguggucccugaggau

SEQ ID NO: 3481956 - RNA, 14 nt, Human
agagccucaaauga

SEQ ID NO: 3481957 - RNA, 22 nt, Human
agagccucccaaggagaacaaa

SEQ ID NO: 3481958 - RNA, 23 nt, Human
agagccucccaaggagaacaaau

SEQ ID NO: 3481959 - RNA, 16 nt, Human
agagccugaucucuuc

SEQ ID NO: 3481960 - RNA, 18 nt, Human
agagccugaucucuuccu

SEQ ID NO: 3481961 - RNA, 20 nt, Human
agagccugaucucuuccugu

SEQ ID NO: 3481962 - RNA, 15 nt, Human
agagccugcuccccc

SEQ ID NO: 3481963 - RNA, 20 nt, Human
agagccugcucccccacccc

SEQ ID NO: 3481964 - RNA, 11 nt, Human
agagccugcug

SEQ ID NO: 3481965 - RNA, 13 nt, Human
agagccugcuggc

SEQ ID NO: 3481966 - RNA, 13 nt, Human
agagccuggagaa

SEQ ID NO: 3481967 - RNA, 15 nt, Human
agagccuggagaagc

SEQ ID NO: 3481968 - RNA, 17 nt, Human
agagccuggagaagcug

SEQ ID NO: 3481969 - RNA, 10 nt, Human
agagccuggu

SEQ ID NO: 3481970 - RNA, 16 nt, Human
agagccuggugcugcu

SEQ ID NO: 3481971 - RNA, 20 nt, Human
agagccugguugcccaggga

SEQ ID NO: 3481972 - RNA, 14 nt, Human
agagccuuaaaaca

SEQ ID NO: 3481973 - RNA, 13 nt, Human
agagccuucucag

SEQ ID NO: 3481974 - RNA, 18 nt, Human
agagccuucucagaagca

SEQ ID NO: 3481975 - RNA, 21 nt, Human
agagccuucugaugucucuaa

SEQ ID NO: 3481976 - RNA, 21 nt, Human
agagccuugcggaagguucua

SEQ ID NO: 3481977 - RNA, 23 nt, Human
agagccuugguguccaccuggcc

SEQ ID NO: 3481978 - RNA, 19 nt, Human
agagccuuuccucaaaacu

SEQ ID NO: 3481979 - RNA, 23 nt, Human
agagccuuuggaugaccagaaca

SEQ ID NO: 3481980 - RNA, 18 nt, Human
agagccuuuuucuaggcc

SEQ ID NO: 3481981 - RNA, 17 nt, Human
agagcgagagucugucu

SEQ ID NO: 3481982 - RNA, 14 nt, Human
agagcgaggcugag

SEQ ID NO: 3481983 - RNA, 14 nt, Human
agagcgcagcaucc

SEQ ID NO: 3481984 - RNA, 20 nt, Human
agagcgccgugaguucucag

SEQ ID NO: 3481985 - RNA, 23 nt, Human
agagcgccugccccucccagaac

SEQ ID NO: 3481986 - RNA, 13 nt, Human
agagcgcgucugg

SEQ ID NO: 3481987 - RNA, 23 nt, Human
agagcggucucaggcugguggga

SEQ ID NO: 3481988 - RNA, 16 nt, Human
agagcgugagcugagc

SEQ ID NO: 3481989 - RNA, 20 nt, Human
agagcgugagcugagcaggc

SEQ ID NO: 3481990 - RNA, 20 nt, Human
agagcuaaacuccuuccugg

SEQ ID NO: 3481991 - RNA, 21 nt, Human
agagcuaacccuuaucuguaa

SEQ ID NO: 3481992 - RNA, 17 nt, Human
agagcuaagggugggug

SEQ ID NO: 3481993 - RNA, 22 nt, Human
agagcuaagggugggugcucag

SEQ ID NO: 3481994 - RNA, 11 nt, Human
agagcuacaua

SEQ ID NO: 3481995 - RNA, 14 nt, Human
agagcuacauaauu

SEQ ID NO: 3481996 - RNA, 16 nt, Human
agagcuacauaauuua

SEQ ID NO: 3481997 - RNA, 18 nt, Human
agagcuacauaauuuagu

SEQ ID NO: 3481998 - RNA, 22 nt, Human
agagcuagaacauggagagcua

SEQ ID NO: 3481999 - RNA, 23 nt, Human
agagcuagaacccggcaggcuag

SEQ ID NO: 3482000 - RNA, 13 nt, Human
agagcuagcgcug

SEQ ID NO: 3482001 - RNA, 14 nt, Human
agagcuaggcaggg

SEQ ID NO: 3482002 - RNA, 23 nt, Human
agagcuauggacagcauugccag

SEQ ID NO: 3482003 - RNA, 13 nt, Human
agagcucaggaug

SEQ ID NO: 3482004 - RNA, 13 nt, Human
agagcuccucccu

SEQ ID NO: 3482005 - RNA, 14 nt, Human
agagcucuccagcu

SEQ ID NO: 3482006 - RNA, 15 nt, Human
agagcucuccagcuc

SEQ ID NO: 3482007 - RNA, 18 nt, Human
agagcucuggagccaccu

SEQ ID NO: 3482008 - RNA, 19 nt, Human
agagcucuggagccaccug

SEQ ID NO: 3482009 - RNA, 20 nt, Human
agagcucuggagccaccugu

SEQ ID NO: 3482010 - RNA, 21 nt, Human
agagcucuggugauaaggaca

SEQ ID NO: 3482011 - RNA, 19 nt, Human
agagcugaagguuguggcc

SEQ ID NO: 3482012 - RNA, 18 nt, Human
agagcugacacaaaccug

SEQ ID NO: 3482013 - RNA, 19 nt, Human
agagcugauccagagcaca

SEQ ID NO: 3482014 - RNA, 16 nt, Human
agagcugauggagaag

SEQ ID NO: 3482015 - RNA, 21 nt, Human
agagcugauggagaaggaagg

SEQ ID NO: 3482016 - RNA, 13 nt, Human
agagcugccagug

SEQ ID NO: 3482017 - RNA, 14 nt, Human
agagcugcccucuc

SEQ ID NO: 3482018 - RNA, 17 nt, Human
agagcugcccucuccug

SEQ ID NO: 3482019 - RNA, 15 nt, Human
agagcugcucuggaa

SEQ ID NO: 3482020 - RNA, 16 nt, Human
agagcugcucuggaaa

SEQ ID NO: 3482021 - RNA, 21 nt, Human
agagcuggagaugaggccaga

SEQ ID NO: 3482022 - RNA, 12 nt, Human
agagcuggcucu

SEQ ID NO: 3482023 - RNA, 13 nt, Human
agagcuggcucug

SEQ ID NO: 3482024 - RNA, 13 nt, Human
agagcugggaggg

SEQ ID NO: 3482025 - RNA, 23 nt, Human
agagcugguaguuaguagcaugu

SEQ ID NO: 3482026 - RNA, 13 nt, Human
agagcuggugccc

SEQ ID NO: 3482027 - RNA, 18 nt, Human
agagcuggugcggcuggc

SEQ ID NO: 3482028 - RNA, 19 nt, Human
agagcuggugcggcuggcc

SEQ ID NO: 3482029 - RNA, 22 nt, Human
agagcuggugcggcuggccaug

SEQ ID NO: 3482030 - RNA, 11 nt, Human
agagcuggugu

SEQ ID NO: 3482031 - RNA, 16 nt, Human
agagcuguggagaggg

SEQ ID NO: 3482032 - RNA, 20 nt, Human
agagcuguggaggauugcua

SEQ ID NO: 3482033 - RNA, 18 nt, Human
agagcuguugaugggaug

SEQ ID NO: 3482034 - RNA, 14 nt, Human
agagcuuagaaacu

SEQ ID NO: 3482035 - RNA, 20 nt, Human
agagcuucccugacucauuc

SEQ ID NO: 3482036 - RNA, 23 nt, Human
agagcuucuuccaggugcccagc

SEQ ID NO: 3482037 - RNA, 14 nt, Human
agagcuuggacugg

SEQ ID NO: 3482038 - RNA, 16 nt, Human
agagcuuuacaaaaag

SEQ ID NO: 3482039 - RNA, 23 nt, Human
agagcuuucuguccuuuuggcac

SEQ ID NO: 3482040 - RNA, 20 nt, Human
agagcuuucuucccgaaccc

SEQ ID NO: 3482041 - RNA, 17 nt, Human
agagcuuugucguauuu

SEQ ID NO: 3482042 - RNA, 13 nt, Human
agagcuuuucaga

SEQ ID NO: 3482043 - RNA, 20 nt, Human
agagcuuuucagauugugga

SEQ ID NO: 3482044 - RNA, 16 nt, Human
agaggaaaaaaaugac

SEQ ID NO: 3482045 - RNA, 17 nt, Human
agaggaaaaaaaugacu

SEQ ID NO: 3482046 - RNA, 12 nt, Human
agaggaaaagaa

SEQ ID NO: 3482047 - RNA, 19 nt, Human
agaggaaaaguaaggugca

SEQ ID NO: 3482048 - RNA, 16 nt, Human
agaggaaaaugaauaa

SEQ ID NO: 3482049 - RNA, 12 nt, Human
agaggaaagcaa

SEQ ID NO: 3482050 - RNA, 18 nt, Human
agaggaaagcaaaggaga

SEQ ID NO: 3482051 - RNA, 19 nt, Human
agaggaaagcaaaggagau

SEQ ID NO: 3482052 - RNA, 23 nt, Human
agaggaaauaagaaaaaucaugu

SEQ ID NO: 3482053 - RNA, 21 nt, Human
agaggaaaucaccgaaaacgu

SEQ ID NO: 3482054 - RNA, 14 nt, Human
agaggaaccaaccc

SEQ ID NO: 3482055 - RNA, 20 nt, Human
agaggaaccucugauuuauu

SEQ ID NO: 3482056 - RNA, 17 nt, Human
agaggaacuccuuggcc

SEQ ID NO: 3482057 - RNA, 12 nt, Human
agaggaacuguc

SEQ ID NO: 3482058 - RNA, 19 nt, Human
agaggaacuguccagagag

SEQ ID NO: 3482059 - RNA, 20 nt, Human
agaggaacuguccagagagc

SEQ ID NO: 3482060 - RNA, 21 nt, Human
agaggaacuguccagagagca

SEQ ID NO: 3482061 - RNA, 16 nt, Human
agaggaagagacacuc

SEQ ID NO: 3482062 - RNA, 13 nt, Human
agaggaagagcag

SEQ ID NO: 3482063 - RNA, 16 nt, Human
agaggaaggggccaga

SEQ ID NO: 3482064 - RNA, 23 nt, Human
agaggaaucagacuucacacugc

SEQ ID NO: 3482065 - RNA, 13 nt, Human
agaggaaugaagu

SEQ ID NO: 3482066 - RNA, 23 nt, Human
agaggacaccuguacuggagagc

SEQ ID NO: 3482067 - RNA, 17 nt, Human
agaggaccagggccuuu

SEQ ID NO: 3482068 - RNA, 19 nt, Human
agaggaccuguauuuaagc

SEQ ID NO: 3482069 - RNA, 19 nt, Human
agaggacucacuugcccac

SEQ ID NO: 3482070 - RNA, 18 nt, Human
agaggacucccaacccug

SEQ ID NO: 3482071 - RNA, 21 nt, Human
agaggacucccaacccuggcu

SEQ ID NO: 3482072 - RNA, 17 nt, Human
agaggacucgcuuguaa

SEQ ID NO: 3482073 - RNA, 19 nt, Human
agaggacucgcuuguaaau

SEQ ID NO: 3482074 - RNA, 22 nt, Human
agaggacuuuucuuuguggcuu

SEQ ID NO: 3482075 - RNA, 20 nt, Human
agaggagaacuugcugccuc

SEQ ID NO: 3482076 - RNA, 14 nt, Human
agccccugguccug

SEQ ID NO: 3482077 - RNA, 15 nt, Human
agccccugucauggu

SEQ ID NO: 3482078 - RNA, 22 nt, Human
agccccugucuagagagggagg

SEQ ID NO: 3482079 - RNA, 17 nt, Human
agccccuuccuugcucu

SEQ ID NO: 3482080 - RNA, 24 nt, Human
agccccuucugacccaugcugccc

SEQ ID NO: 3482081 - RNA, 19 nt, Human
agccccuucugcucagcuc

SEQ ID NO: 3482082 - RNA, 20 nt, Human
agccccuugcucuccccugc

SEQ ID NO: 3482083 - RNA, 14 nt, Human
agcccgaggaggug

SEQ ID NO: 3482084 - RNA, 19 nt, Human
agcccgaggcaccaguguc

SEQ ID NO: 3482085 - RNA, 15 nt, Human
agcccgcacaccugc

SEQ ID NO: 3482086 - RNA, 17 nt, Human
agcccgcacccccaccc

SEQ ID NO: 3482087 - RNA, 15 nt, Human
agcccgcaucagcug

SEQ ID NO: 3482088 - RNA, 14 nt, Human
agcccgcaugcagc

SEQ ID NO: 3482089 - RNA, 18 nt, Human
agcccgcaugcagcagcu

SEQ ID NO: 3482090 - RNA, 13 nt, Human
agcccgccugcca

SEQ ID NO: 3482091 - RNA, 22 nt, Human
agcccgccugccaguccuagcu

SEQ ID NO: 3482092 - RNA, 15 nt, Human
agcccgcggggacau

SEQ ID NO: 3482093 - RNA, 14 nt, Human
agcccggaugcuuc

SEQ ID NO: 3482094 - RNA, 21 nt, Human
agcccggccugcucccagcag

SEQ ID NO: 3482095 - RNA, 22 nt, Human
agcccggcgccccugccaccuc

SEQ ID NO: 3482096 - RNA, 15 nt, Human
agcccggcucccacc

SEQ ID NO: 3482097 - RNA, 13 nt, Human
agcccggcuccug

SEQ ID NO: 3482098 - RNA, 14 nt, Human
agcccggcuccugg

SEQ ID NO: 3482099 - RNA, 16 nt, Human
agcccggcuccugguc

SEQ ID NO: 3482100 - RNA, 21 nt, Human
agcccgggagccuaggaccac

SEQ ID NO: 3482101 - RNA, 20 nt, Human
agcccgggcucugccuccca

SEQ ID NO: 3482102 - RNA, 13 nt, Human
agcccgggcugcc

SEQ ID NO: 3482103 - RNA, 16 nt, Human
agcccgggcugccugg

SEQ ID NO: 3482104 - RNA, 22 nt, Human
agcccgguaagagcaaaagaau

SEQ ID NO: 3482105 - RNA, 16 nt, Human
agcccguguggccccu

SEQ ID NO: 3482106 - RNA, 17 nt, Human
agcccguguggccccuu

SEQ ID NO: 3482107 - RNA, 21 nt, Human
agcccuaaggaucucucagga

SEQ ID NO: 3482108 - RNA, 15 nt, Human
agcccuacagagcug

SEQ ID NO: 3482109 - RNA, 17 nt, Human
agcccuacagagcugug

SEQ ID NO: 3482110 - RNA, 13 nt, Human
agcccuacucccu

SEQ ID NO: 3482111 - RNA, 18 nt, Human
agcccuacucccugcaga

SEQ ID NO: 3482112 - RNA, 24 nt, Human
agcccuacucccugcagaugccac

SEQ ID NO: 3482113 - RNA, 17 nt, Human
agcccuagacuggugcu

SEQ ID NO: 3482114 - RNA, 15 nt, Human
agcccuagagccugc

SEQ ID NO: 3482115 - RNA, 16 nt, Human
agcccuagagccugcc

SEQ ID NO: 3482116 - RNA, 16 nt, Human
agcccuaggguggaga

SEQ ID NO: 3482117 - RNA, 12 nt, Human
agcccuauggau

SEQ ID NO: 3482118 - RNA, 15 nt, Human
agcccuauggaugug

SEQ ID NO: 3482119 - RNA, 16 nt, Human
agcccucacacacccu

SEQ ID NO: 3482120 - RNA, 19 nt, Human
agcccucacacacccuguc

SEQ ID NO: 3482121 - RNA, 17 nt, Human
agcccuccaaaagcacu

SEQ ID NO: 3482122 - RNA, 23 nt, Human
agcccuccaucuaaacugccccc

SEQ ID NO: 3482123 - RNA, 12 nt, Human
agcccuccccau

SEQ ID NO: 3482124 - RNA, 19 nt, Human
agcccucccugccccuccc

SEQ ID NO: 3482125 - RNA, 21 nt, Human
agcccucccuguccuccucgg

SEQ ID NO: 3482126 - RNA, 12 nt, Human
agcccuccucac

SEQ ID NO: 3482127 - RNA, 17 nt, Human
agcccucucacuguguc

SEQ ID NO: 3482128 - RNA, 23 nt, Human
agcccucucuggcuaaggacagg

SEQ ID NO: 3482129 - RNA, 13 nt, Human
agcccucuuccau

SEQ ID NO: 3482130 - RNA, 19 nt, Human
agcccucuuccaucauguc

SEQ ID NO: 3482131 - RNA, 18 nt, Human
agcccugaacauuucaug

SEQ ID NO: 3482132 - RNA, 20 nt, Human
agcccugcaccaugcugcug

SEQ ID NO: 3482133 - RNA, 15 nt, Human
agcccugcagagggc

SEQ ID NO: 3482134 - RNA, 16 nt, Human
agcccugcagagggca

SEQ ID NO: 3482135 - RNA, 19 nt, Human
agcccugcagagggcacag

SEQ ID NO: 3482136 - RNA, 20 nt, Human
agcccugcagugugguagcg

SEQ ID NO: 3482137 - RNA, 15 nt, Human
agcccugccccacac

SEQ ID NO: 3482138 - RNA, 16 nt, Human
agcccugccucuccgc

SEQ ID NO: 3482139 - RNA, 13 nt, Human
agcccugccugga

SEQ ID NO: 3482140 - RNA, 15 nt, Human
agcccugccuggagg

SEQ ID NO: 3482141 - RNA, 19 nt, Human
agcccugccuggaggaccu

SEQ ID NO: 3482142 - RNA, 22 nt, Human
agcccugccuggaggaccugag

SEQ ID NO: 3482143 - RNA, 23 nt, Human
agcccugccuggaggaccugagc

SEQ ID NO: 3482144 - RNA, 13 nt, Human
agcccugcucccu

SEQ ID NO: 3482145 - RNA, 18 nt, Human
agcccugcugcugccugc

SEQ ID NO: 3482146 - RNA, 20 nt, Human
agcccugcugcugccugccu

SEQ ID NO: 3482147 - RNA, 19 nt, Human
agcccugcuggggaucccc

SEQ ID NO: 3482148 - RNA, 19 nt, Human
agcccuggagccaacugcu

SEQ ID NO: 3482149 - RNA, 23 nt, Human
agcccuggagccaacugcugcuu

SEQ ID NO: 3482150 - RNA, 17 nt, Human
agcccuggaggugccag

SEQ ID NO: 3482151 - RNA, 18 nt, Human
agcccuggaggugccagc

SEQ ID NO: 3482152 - RNA, 13 nt, Human
agcccuggccaga

SEQ ID NO: 3482153 - RNA, 17 nt, Human
agcccuggcccaucaug

SEQ ID NO: 3482154 - RNA, 16 nt, Human
agcccuggcccccuga

SEQ ID NO: 3482155 - RNA, 14 nt, Human
agcccuggcucugc

SEQ ID NO: 3482156 - RNA, 15 nt, Human
agcccuggcugaagg

SEQ ID NO: 3482157 - RNA, 11 nt, Human
agcccugggac

SEQ ID NO: 3482158 - RNA, 15 nt, Human
agcccugggaccgcu

SEQ ID NO: 3482159 - RNA, 17 nt, Human
agcccugggccccacca

SEQ ID NO: 3482160 - RNA, 19 nt, Human
agcccugggccccaccacc

SEQ ID NO: 3482161 - RNA, 13 nt, Human
agcccuggggcug

SEQ ID NO: 3482162 - RNA, 14 nt, Human
agcccuggggcugg

SEQ ID NO: 3482163 - RNA, 14 nt, Human
agcccugguggcag

SEQ ID NO: 3482164 - RNA, 22 nt, Human
agcccuguaucguauucaccuu

SEQ ID NO: 3482165 - RNA, 14 nt, Human
agcccugucagugc

SEQ ID NO: 3482166 - RNA, 17 nt, Human
agcccugucagugcagc

SEQ ID NO: 3482167 - RNA, 21 nt, Human
agcccuguccuggugguauuu

SEQ ID NO: 3482168 - RNA, 17 nt, Human
agcccugucgagacacu

SEQ ID NO: 3482169 - RNA, 12 nt, Human
agcccuguggaa

SEQ ID NO: 3482170 - RNA, 22 nt, Human
agcccuguggaugagcccucag

SEQ ID NO: 3482171 - RNA, 23 nt, Human
agcccuguggaugagcccucaga

SEQ ID NO: 3482172 - RNA, 18 nt, Human
agcccuguugacacaggu

SEQ ID NO: 3482173 - RNA, 21 nt, Human
agcccuguugacacaggucuu

SEQ ID NO: 3482174 - RNA, 23 nt, Human
agcccuguugacacaggucuuuc

SEQ ID NO: 3482175 - RNA, 17 nt, Human
agcccuguugugccaca

SEQ ID NO: 3482176 - RNA, 16 nt, Human
agcccuuagcagggaa

SEQ ID NO: 3482177 - RNA, 15 nt, Human
agcccuuaucugugc

SEQ ID NO: 3482178 - RNA, 18 nt, Human
agcccuuaucugugcuca

SEQ ID NO: 3482179 - RNA, 13 nt, Human
agcccuucauuug

SEQ ID NO: 3482180 - RNA, 20 nt, Human
agcccuuccaugucgccucu

SEQ ID NO: 3482181 - RNA, 20 nt, Human
agcccuuccucugcuccccc

SEQ ID NO: 3482182 - RNA, 22 nt, Human
agcccuucuauacccacccaga

SEQ ID NO: 3482183 - RNA, 21 nt, Human
agcccuucuccauggcccugc

SEQ ID NO: 3482184 - RNA, 19 nt, Human
agcccuugaagucacccgg

SEQ ID NO: 3482185 - RNA, 17 nt, Human
agcccuugagcucccca

SEQ ID NO: 3482186 - RNA, 20 nt, Human
agcccuugagggagaacuua

SEQ ID NO: 3482187 - RNA, 13 nt, Human
agcccuugccucc

SEQ ID NO: 3482188 - RNA, 16 nt, Human
agcccuugccucccca

SEQ ID NO: 3482189 - RNA, 12 nt, Human
agcccuuggcca

SEQ ID NO: 3482190 - RNA, 14 nt, Human
agcccuuggggguc

SEQ ID NO: 3482191 - RNA, 21 nt, Human
agcccuuggggguccuccucc

SEQ ID NO: 3482192 - RNA, 22 nt, Human
agcccuuggggguccuccucca

SEQ ID NO: 3482193 - RNA, 12 nt, Human
agcccuuucugu

SEQ ID NO: 3482194 - RNA, 22 nt, Human
agcccuuugggaggcugaggcg

SEQ ID NO: 3482195 - RNA, 15 nt, Human
agcccuuuugucucu

SEQ ID NO: 3482196 - RNA, 21 nt, Human
agccgacaccuuuuuucaaca

SEQ ID NO: 3482197 - RNA, 13 nt, Human
agccgaccucagc

SEQ ID NO: 3482198 - RNA, 19 nt, Human
agccgaccugaggacaugg

SEQ ID NO: 3482199 - RNA, 13 nt, Human
agccgacucuggc

SEQ ID NO: 3482200 - RNA, 15 nt, Human
agccgacucuggccc

SEQ ID NO: 3482201 - RNA, 22 nt, Human
agccgagacucgacucugugcc

SEQ ID NO: 3482202 - RNA, 16 nt, Human
agccgagagccugcuc

SEQ ID NO: 3482203 - RNA, 13 nt, Human
aaaaaaaaaaaga

SEQ ID NO: 3482204 - RNA, 13 nt, Human
aaaaaaaaaguca

SEQ ID NO: 3482205 - RNA, 12 nt, Human
aaaaaaaaaugc

SEQ ID NO: 3482206 - RNA, 13 nt, Human
aaaaaaaacucuu

SEQ ID NO: 3482207 - RNA, 11 nt, Human
aaaaaaaagaa

SEQ ID NO: 3482208 - RNA, 12 nt, Human
aaaaaaaagaau

SEQ ID NO: 3482209 - RNA, 14 nt, Human
aaaaaaaagcuuua

SEQ ID NO: 3482210 - RNA, 12 nt, Human
aaaaaaaauaca

SEQ ID NO: 3482211 - RNA, 13 nt, Human
aaaaaaaauacuu

SEQ ID NO: 3482212 - RNA, 13 nt, Human
aaaaaaaauccuu

SEQ ID NO: 3482213 - RNA, 12 nt, Human
aaaaaaacucuu

SEQ ID NO: 3482214 - RNA, 9 nt, Human
aaaaaaaga

SEQ ID NO: 3482215 - RNA, 13 nt, Human
aaaaaaagaagaa

SEQ ID NO: 3482216 - RNA, 11 nt, Human
aaaaaaagaca

SEQ ID NO: 3482217 - RNA, 11 nt, Human
aaaaaaagcuu

SEQ ID NO: 3482218 - RNA, 11 nt, Human
aaaaaaauagu

SEQ ID NO: 3482219 - RNA, 12 nt, Human
aaaaaaaucuuc

SEQ ID NO: 3482220 - RNA, 13 nt, Human
aaaaaaaugcuga

SEQ ID NO: 3482221 - RNA, 16 nt, Human
aaaaaaccacaaaggc

SEQ ID NO: 3482222 - RNA, 15 nt, Human
aaaaaagagaauuag

SEQ ID NO: 3482223 - RNA, 11 nt, Human
aaaaaagauga

SEQ ID NO: 3482224 - RNA, 13 nt, Human
aaaaaagcuuuau

SEQ ID NO: 3482225 - RNA, 15 nt, Human
aaaaagggaggggga

SEQ ID NO: 3482226 - RNA, 21 nt, Human
aaaaagggucaaugcuauuuu

SEQ ID NO: 3482227 - RNA, 23 nt, Human
aaaaagggucaaugcuauuuuug

SEQ ID NO: 3482228 - RNA, 14 nt, Human
aaaaaguauaaaau

SEQ ID NO: 3482229 - RNA, 12 nt, Human
aaaaaguauugc

SEQ ID NO: 3482230 - RNA, 16 nt, Human
aaaaaguauugccaaa

SEQ ID NO: 3482231 - RNA, 20 nt, Human
aaaaaguauugccaaacauu

SEQ ID NO: 3482232 - RNA, 19 nt, Human
aaaaagucagagacagaua

SEQ ID NO: 3482233 - RNA, 22 nt, Human
aaaaagucucuauuuaaauucu

SEQ ID NO: 3482234 - RNA, 23 nt, Human
aaaaagucucuauuuaaauucuu

SEQ ID NO: 3482235 - RNA, 14 nt, Human
aaaaagugacacag

SEQ ID NO: 3482236 - RNA, 16 nt, Human
aaaaagugacacagca

SEQ ID NO: 3482237 - RNA, 17 nt, Human
aaaaagugacacagcag

SEQ ID NO: 3482238 - RNA, 23 nt, Human
aaaaagugacacagcagcuucac

SEQ ID NO: 3482239 - RNA, 17 nt, Human
aaaaaguggaauuucuu

SEQ ID NO: 3482240 - RNA, 15 nt, Human
aaaaaguggggcaga

SEQ ID NO: 3482241 - RNA, 22 nt, Human
aaaaaguggggcagagccuccc

SEQ ID NO: 3482242 - RNA, 22 nt, Human
aaaaaguggguuuuuuaguuga

SEQ ID NO: 3482243 - RNA, 12 nt, Human
aaaaagugucaa

SEQ ID NO: 3482244 - RNA, 12 nt, Human
aaaaaguguuua

SEQ ID NO: 3482245 - RNA, 13 nt, Human
aaaaaguguuuau

SEQ ID NO: 3482246 - RNA, 15 nt, Human
aaaaaguuaaugcuu

SEQ ID NO: 3482247 - RNA, 17 nt, Human
aaaaaguuauauagguu

SEQ ID NO: 3482248 - RNA, 20 nt, Human
aaaaaguugcagcuguuuug

SEQ ID NO: 3482249 - RNA, 12 nt, Human
aaaaaguuuaaa

SEQ ID NO: 3482250 - RNA, 17 nt, Human
aaaaaguuugccagaag

SEQ ID NO: 3482251 - RNA, 18 nt, Human
aaaaaguuugccagaagu

SEQ ID NO: 3482252 - RNA, 19 nt, Human
aaaaaguuugguucugugu

SEQ ID NO: 3482253 - RNA, 11 nt, Human
aaaaaguuugu

SEQ ID NO: 3482254 - RNA, 13 nt, Human
aaaaaguuuguuu

SEQ ID NO: 3482255 - RNA, 14 nt, Human
aaaaauaaaaaaca

SEQ ID NO: 3482256 - RNA, 21 nt, Human
aaaaauaaaaacugacuccuu

SEQ ID NO: 3482257 - RNA, 14 nt, Human
aaaaauaaaacugu

SEQ ID NO: 3482258 - RNA, 14 nt, Human
aaaaauaaacacua

SEQ ID NO: 3482259 - RNA, 12 nt, Human
aaaaauaaagaa

SEQ ID NO: 3482260 - RNA, 18 nt, Human
aaaaauaaauauaucuac

SEQ ID NO: 3482261 - RNA, 19 nt, Human
aaaaauaacuguaauuauu

SEQ ID NO: 3482262 - RNA, 16 nt, Human
aaaaauaagaagaaug

SEQ ID NO: 3482263 - RNA, 22 nt, Human
aaaaauaagaagaaugcuuaau

SEQ ID NO: 3482264 - RNA, 13 nt, Human
aaaaauacaaaaa

SEQ ID NO: 3482265 - RNA, 17 nt, Human
aaaaauacaaaaauuug

SEQ ID NO: 3482266 - RNA, 17 nt, Human
aaaaauacaauuuuuau

SEQ ID NO: 3482267 - RNA, 14 nt, Human
aaaaauacauguuc

SEQ ID NO: 3482268 - RNA, 15 nt, Human
aaaaauacauuuuau

SEQ ID NO: 3482269 - RNA, 15 nt, Human
aaaaauacucuaauu

SEQ ID NO: 3482270 - RNA, 16 nt, Human
aaaaauacucuaauuc

SEQ ID NO: 3482271 - RNA, 10 nt, Human
aaaaauacuu

SEQ ID NO: 3482272 - RNA, 18 nt, Human
aaaaauacuuuuucuaau

SEQ ID NO: 3482273 - RNA, 21 nt, Human
aaaaauacuuuuucuaaugag

SEQ ID NO: 3482274 - RNA, 21 nt, Human
aaaaauagcuaaauaccucaa

SEQ ID NO: 3482275 - RNA, 14 nt, Human
aaaaauaguuugga

SEQ ID NO: 3482276 - RNA, 12 nt, Human
aaaaauauaaaa

SEQ ID NO: 3482277 - RNA, 13 nt, Human
aaaaauauaaaac

SEQ ID NO: 3482278 - RNA, 17 nt, Human
aaaaauauacauguuua

SEQ ID NO: 3482279 - RNA, 15 nt, Human
aaaaauauauacuaa

SEQ ID NO: 3482280 - RNA, 18 nt, Human
aaaaauauauaucuaucu

SEQ ID NO: 3482281 - RNA, 17 nt, Human
aaaaauauauguauaua

SEQ ID NO: 3482282 - RNA, 13 nt, Human
aaaaauauauuua

SEQ ID NO: 3482283 - RNA, 14 nt, Human
aaaaauaucaaauu

SEQ ID NO: 3482284 - RNA, 16 nt, Human
aaaaauaucaaauuaa

SEQ ID NO: 3482285 - RNA, 21 nt, Human
aaaaauaugaccacacuccag

SEQ ID NO: 3482286 - RNA, 11 nt, Human
aaaaauauuua

SEQ ID NO: 3482287 - RNA, 13 nt, Human
aaaaauauuuaau

SEQ ID NO: 3482288 - RNA, 16 nt, Human
aaaaauauuuaauguu

SEQ ID NO: 3482289 - RNA, 22 nt, Human
aaaaauauuuucucuguacuuu

SEQ ID NO: 3482290 - RNA, 18 nt, Human
aaaaauauuuuuuuuucu

SEQ ID NO: 3482291 - RNA, 18 nt, Human
aaaaaucacaauuuuuaa

SEQ ID NO: 3482292 - RNA, 20 nt, Human
aaaaaucacuugauucauaa

SEQ ID NO: 3482293 - RNA, 18 nt, Human
aaaaagcucauauuuugu

SEQ ID NO: 3482294 - RNA, 22 nt, Human
aaaaagcuggugggugaaagaa

SEQ ID NO: 3482295 - RNA, 19 nt, Human
aaaaagcuuuaugauuuuc

SEQ ID NO: 3482296 - RNA, 16 nt, Human
aaaaaggaaaaaaaga

SEQ ID NO: 3482297 - RNA, 19 nt, Human
aaaaaggaaaaaauuaaua

SEQ ID NO: 3482298 - RNA, 13 nt, Human
aaaaaggaacugc

SEQ ID NO: 3482299 - RNA, 20 nt, Human
aaaaaggcuuauaaaacaga

SEQ ID NO: 3482300 - RNA, 16 nt, Human
aaaaagggaguuuuug

SEQ ID NO: 3482301 - RNA, 21 nt, Human
aaaaagggauccguacauuca

SEQ ID NO: 3482302 - RNA, 11 nt, Human
aaaaaggguca

SEQ ID NO: 3482303 - RNA, 19 nt, Human
aaaaagggucaaugcuauu

SEQ ID NO: 3482304 - RNA, 13 nt, Human
aaaaagguuuaca

SEQ ID NO: 3482305 - RNA, 18 nt, Human
aaaaagguuuacagaauu

SEQ ID NO: 3482306 - RNA, 21 nt, Human
aaaaaguaaguaccacucagg

SEQ ID NO: 3482307 - RNA, 19 nt, Human
aaaaaguaggaaaugaaug

SEQ ID NO: 3482308 - RNA, 22 nt, Human
aaaaagucuacgcucuccuuuc

SEQ ID NO: 3482309 - RNA, 15 nt, Human
aaaaagucucuauuu

SEQ ID NO: 3482310 - RNA, 18 nt, Human
aaaaagucucuauuuaaa

SEQ ID NO: 3482311 - RNA, 21 nt, Human
aaaaagucucuauuuaaauuc

SEQ ID NO: 3482312 - RNA, 14 nt, Human
aaaaagugaaauaa

SEQ ID NO: 3482313 - RNA, 13 nt, Human
aaaaagugacaca

SEQ ID NO: 3482314 - RNA, 15 nt, Human
aaaaagugacacagc

SEQ ID NO: 3482315 - RNA, 20 nt, Human
aaaaagugacacagcagcuu

SEQ ID NO: 3482316 - RNA, 20 nt, Human
aaaaaguggguuuuuuaguu

SEQ ID NO: 3482317 - RNA, 23 nt, Human
aaaaaguggguuuuuuaguugaa

SEQ ID NO: 3482318 - RNA, 12 nt, Human
aaaaaguuauau

SEQ ID NO: 3482319 - RNA, 23 nt, Human
aaaaaguuguaugaucugugccu

SEQ ID NO: 3482320 - RNA, 14 nt, Human
aaaaaguuuaaaau

SEQ ID NO: 3482321 - RNA, 18 nt, Human
aaaaaguuugucuuaguu

SEQ ID NO: 3482322 - RNA, 16 nt, Human
aaaaaguuuuaguuuu

SEQ ID NO: 3482323 - RNA, 17 nt, Human
aaaaaguuuuauuuuuc

SEQ ID NO: 3482324 - RNA, 23 nt, Human
aaaaaguuuugcccuuuuuaagg

SEQ ID NO: 3482325 - RNA, 14 nt, Human
aaaaauaaaacauu

SEQ ID NO: 3482326 - RNA, 12 nt, Human
aaaaauaaagca

SEQ ID NO: 3482327 - RNA, 24 nt, Human
aaaaauaaauauaucuaccccaga

SEQ ID NO: 3482328 - RNA, 22 nt, Human
aaaaauaaccccaaaaugaaga

SEQ ID NO: 3482329 - RNA, 17 nt, Human
aaaaauaauaaauugca

SEQ ID NO: 3482330 - RNA, 16 nt, Human
aaaaauaauaauaaug

SEQ ID NO: 3482331 - RNA, 18 nt, Human
aaaaauaaucaaaagcua

SEQ ID NO: 3482332 - RNA, 12 nt, Human
aaaaauaauuuu

SEQ ID NO: 3482333 - RNA, 14 nt, Human
aaaaauacucagau

SEQ ID NO: 3482334 - RNA, 22 nt, Human
aaaaauacucuaauucuaacca

SEQ ID NO: 3482335 - RNA, 11 nt, Human
aaaaauacugc

SEQ ID NO: 3482336 - RNA, 15 nt, Human
aaaaauacuugucaa

SEQ ID NO: 3482337 - RNA, 22 nt, Human
aaaaauacuugucaauauuuaa

SEQ ID NO: 3482338 - RNA, 11 nt, Human
aaaaauagaaa

SEQ ID NO: 3482339 - RNA, 16 nt, Human
aaaaauagaaacauau

SEQ ID NO: 3482340 - RNA, 14 nt, Human
aaaaauagcaacuu

SEQ ID NO: 3482341 - RNA, 15 nt, Human
aaaaauagcaacuug

SEQ ID NO: 3482342 - RNA, 17 nt, Human
aaaaauagugucuuugu

SEQ ID NO: 3482343 - RNA, 22 nt, Human
aaaaauauaaaauuaugagauu

SEQ ID NO: 3482344 - RNA, 14 nt, Human
aaaaauauaacuua

SEQ ID NO: 3482345 - RNA, 18 nt, Human
aaaaauauacauguuuau

SEQ ID NO: 3482346 - RNA, 15 nt, Human
aaaaauaucaaauua

SEQ ID NO: 3482347 - RNA, 15 nt, Human
aaaaauaucuguaag

SEQ ID NO: 3482348 - RNA, 23 nt, Human
aaaaauaugaccacacuccagcu

SEQ ID NO: 3482349 - RNA, 13 nt, Human
aaaaauauuccau

SEQ ID NO: 3482350 - RNA, 11 nt, Human
aaaaauauugu

SEQ ID NO: 3482351 - RNA, 15 nt, Human
aaaaauauuuaaugu

SEQ ID NO: 3482352 - RNA, 22 nt, Human
aaaaaucaacuuuuuauugccu

SEQ ID NO: 3482353 - RNA, 12 nt, Human
aaaaaucaagua

SEQ ID NO: 3482354 - RNA, 20 nt, Human
aaaaaucaugccaguauuuu

SEQ ID NO: 3482355 - RNA, 16 nt, Human
aaaaaucauguuugcu

SEQ ID NO: 3482356 - RNA, 18 nt, Human
aaaaauccaaauauuguu

SEQ ID NO: 3482357 - RNA, 14 nt, Human
aaaaauccagaaac

SEQ ID NO: 3482358 - RNA, 16 nt, Human
aaaaauccuucuaauc

SEQ ID NO: 3482359 - RNA, 17 nt, Human
aaaaauccuucuaaucu

SEQ ID NO: 3482360 - RNA, 18 nt, Human
aaaaauccuucuaaucug

SEQ ID NO: 3482361 - RNA, 20 nt, Human
aaaaauccuucuaaucugcu

SEQ ID NO: 3482362 - RNA, 17 nt, Human
aaaaaucucaaauuucu

SEQ ID NO: 3482363 - RNA, 13 nt, Human
aaaaaucugaaga

SEQ ID NO: 3482364 - RNA, 17 nt, Human
aaaaaucugaagauugu

SEQ ID NO: 3482365 - RNA, 20 nt, Human
aaaaaucugaagauuguuua

SEQ ID NO: 3482366 - RNA, 21 nt, Human
aaaaaucugaagauuguuuau

SEQ ID NO: 3482367 - RNA, 23 nt, Human
aaaaaucugaagauuguuuaucu

SEQ ID NO: 3482368 - RNA, 20 nt, Human
aaaaaucugcagaaggaaaa

SEQ ID NO: 3482369 - RNA, 17 nt, Human
aaaaaucuuccaauuua

SEQ ID NO: 3482370 - RNA, 16 nt, Human
aaaaaucuucuccaga

SEQ ID NO: 3482371 - RNA, 12 nt, Human
aaaaaugaaagc

SEQ ID NO: 3482372 - RNA, 15 nt, Human
aaaaaugaaugucua

SEQ ID NO: 3482373 - RNA, 14 nt, Human
aaaaaugagaacau

SEQ ID NO: 3482374 - RNA, 17 nt, Human
aaaaaugagaacauguu

SEQ ID NO: 3482375 - RNA, 14 nt, Human
aaaaaugaucuaaa

SEQ ID NO: 3482376 - RNA, 18 nt, Human
aaaaaugcaaauccuaug

SEQ ID NO: 3482377 - RNA, 22 nt, Human
aaaaaugcaaauccuaugugau

SEQ ID NO: 3482378 - RNA, 19 nt, Human
aaaaaugcacccuuucccu

SEQ ID NO: 3482379 - RNA, 18 nt, Human
aaaaaugccauaauacaa

SEQ ID NO: 3482380 - RNA, 24 nt, Human
aaaaaugccuuugagacaguuucu

SEQ ID NO: 3482381 - RNA, 23 nt, Human
aaaaauggaaacauuuauuccuu

SEQ ID NO: 3482382 - RNA, 14 nt, Human
aaaagggaguuuuu

SEQ ID NO: 3482383 - RNA, 21 nt, Human
aaaagggucaaugcuauuuuu

SEQ ID NO: 3482384 - RNA, 13 nt, Human
aaaagggucagag

SEQ ID NO: 3482385 - RNA, 14 nt, Human
aaaagguaaaacuu

SEQ ID NO: 3482386 - RNA, 23 nt, Human
aaaagguaaaacuuuuuauauuu

SEQ ID NO: 3482387 - RNA, 22 nt, Human
aaaaggugccugugaggcaggg

SEQ ID NO: 3482388 - RNA, 19 nt, Human
aaaagguucuuacugcuug

SEQ ID NO: 3482389 - RNA, 20 nt, Human
aaaagguucuucaucccuuu

SEQ ID NO: 3482390 - RNA, 13 nt, Human
aaaagguuuacag

SEQ ID NO: 3482391 - RNA, 14 nt, Human
aaaagguuuacaga

SEQ ID NO: 3482392 - RNA, 16 nt, Human
aaaagguuuacagaau

SEQ ID NO: 3482393 - RNA, 23 nt, Human
aaaagguuuaugaaaaagaagaa

SEQ ID NO: 3482394 - RNA, 16 nt, Human
aaaagguuuuauuuug

SEQ ID NO: 3482395 - RNA, 23 nt, Human
aaaagguuuuauuuuguaauuau

SEQ ID NO: 3482396 - RNA, 12 nt, Human
aaaaguaaaaug

SEQ ID NO: 3482397 - RNA, 11 nt, Human
aaaaguaaaca

SEQ ID NO: 3482398 - RNA, 15 nt, Human
aaaaguaaauguaca

SEQ ID NO: 3482399 - RNA, 12 nt, Human
aaaaguaacuug

SEQ ID NO: 3482400 - RNA, 16 nt, Human
aaaaguaaugccucug

SEQ ID NO: 3482401 - RNA, 21 nt, Human
aaaaguaucgggggcuggggc

SEQ ID NO: 3482402 - RNA, 20 nt, Human
aaaaguauguuagugcaaau

SEQ ID NO: 3482403 - RNA, 23 nt, Human
aaaaguauuuugaaguuuacauu

SEQ ID NO: 3482404 - RNA, 19 nt, Human
aaaaguauuuuuucaaguu

SEQ ID NO: 3482405 - RNA, 14 nt, Human
aaaagucacaaugu

SEQ ID NO: 3482406 - RNA, 15 nt, Human
aaaagucacaauguu

SEQ ID NO: 3482407 - RNA, 23 nt, Human
aaaagucaccaaauagugugaaa

SEQ ID NO: 3482408 - RNA, 15 nt, Human
aaaagucagauguuu

SEQ ID NO: 3482409 - RNA, 22 nt, Human
aaaagucauaaaauguaucuuc

SEQ ID NO: 3482410 - RNA, 13 nt, Human
aaaaguccaauuu

SEQ ID NO: 3482411 - RNA, 18 nt, Human
aaaaguccaauuuuaauu

SEQ ID NO: 3482412 - RNA, 20 nt, Human
aaaaguccauaccuuauaua

SEQ ID NO: 3482413 - RNA, 15 nt, Human
aaaagucguuuucca

SEQ ID NO: 3482414 - RNA, 16 nt, Human
aaaagucguuuuccaa

SEQ ID NO: 3482415 - RNA, 19 nt, Human
aaaagucguuuuccaaacu

SEQ ID NO: 3482416 - RNA, 22 nt, Human
aaaagucguuuuccaaacugac

SEQ ID NO: 3482417 - RNA, 20 nt, Human
aaaagucucuauuuaaauuc

SEQ ID NO: 3482418 - RNA, 19 nt, Human
aaaagucuuuuaaaaagua

SEQ ID NO: 3482419 - RNA, 21 nt, Human
aaaagugaucaauaaaaugug

SEQ ID NO: 3482420 - RNA, 18 nt, Human
aaaagugcuucauucuuu

SEQ ID NO: 3482421 - RNA, 16 nt, Human
aaaaguggaagugaca

SEQ ID NO: 3482422 - RNA, 16 nt, Human
aaaaguggccucuuug

SEQ ID NO: 3482423 - RNA, 14 nt, Human
aaaaguggggcaga

SEQ ID NO: 3482424 - RNA, 23 nt, Human
aaaaguggguuuuuuaguugaau

SEQ ID NO: 3482425 - RNA, 20 nt, Human
aaaaguguguauauauuuug

SEQ ID NO: 3482426 - RNA, 16 nt, Human
aaaaguuaaugcuuaa

SEQ ID NO: 3482427 - RNA, 18 nt, Human
aaaaguuaaugcuuaaga

SEQ ID NO: 3482428 - RNA, 23 nt, Human
aaaaguuccaagagucuaaagau

SEQ ID NO: 3482429 - RNA, 17 nt, Human
aaaaguucccugaaaca

SEQ ID NO: 3482430 - RNA, 17 nt, Human
aaaaguucugacuugac

SEQ ID NO: 3482431 - RNA, 18 nt, Human
aaaaguugaagaucguga

SEQ ID NO: 3482432 - RNA, 23 nt, Human
aaaaguuggacuaaaugccuagu

SEQ ID NO: 3482433 - RNA, 23 nt, Human
aaaaguuggguuuucuccauuca

SEQ ID NO: 3482434 - RNA, 18 nt, Human
aaaaguuguaugaucugu

SEQ ID NO: 3482435 - RNA, 15 nt, Human
aaaaguuguucaacu

SEQ ID NO: 3482436 - RNA, 18 nt, Human
aaaaguuuaauauuaaag

SEQ ID NO: 3482437 - RNA, 18 nt, Human
aaaacaagaaaguuuccc

SEQ ID NO: 3482438 - RNA, 15 nt, Human
aaaacaagaaugaaa

SEQ ID NO: 3482439 - RNA, 18 nt, Human
aaaacaauaggaugggcu

SEQ ID NO: 3482440 - RNA, 20 nt, Human
aaaacaauauuuauuguauu

SEQ ID NO: 3482441 - RNA, 23 nt, Human
aaaacaauauuuauuguauuuua

SEQ ID NO: 3482442 - RNA, 18 nt, Human
aaaacaauggaguauucu

SEQ ID NO: 3482443 - RNA, 19 nt, Human
aaaacaaugguaacauuuu

SEQ ID NO: 3482444 - RNA, 11 nt, Human
aaaacacagag

SEQ ID NO: 3482445 - RNA, 17 nt, Human
aaaacacauuuuucuua

SEQ ID NO: 3482446 - RNA, 15 nt, Human
aaaacaccuucuaua

SEQ ID NO: 3482447 - RNA, 21 nt, Human
aaaacacuaaaaauaaaaaug

SEQ ID NO: 3482448 - RNA, 21 nt, Human
aaaacacuauuuuuuuuucuu

SEQ ID NO: 3482449 - RNA, 23 nt, Human
aaaacacuguggaacuaauaaau

SEQ ID NO: 3482450 - RNA, 16 nt, Human
aaaacagaaaaaaaac

SEQ ID NO: 3482451 - RNA, 15 nt, Human
aaaacagaaauuggu

SEQ ID NO: 3482452 - RNA, 17 nt, Human
aaaacagacacuggcau

SEQ ID NO: 3482453 - RNA, 15 nt, Human
aaaacagacucaggu

SEQ ID NO: 3482454 - RNA, 18 nt, Human
aaaacagaguaaucuugu

SEQ ID NO: 3482455 - RNA, 19 nt, Human
aaaacagaguaaucuuguu

SEQ ID NO: 3482456 - RNA, 18 nt, Human
aaaacagggccacauaga

SEQ ID NO: 3482457 - RNA, 18 nt, Human
aaaacagguauauacuuu

SEQ ID NO: 3482458 - RNA, 19 nt, Human
aaaacagguauauacuuug

SEQ ID NO: 3482459 - RNA, 18 nt, Human
aaaacaggucaauacagu

SEQ ID NO: 3482460 - RNA, 21 nt, Human
aaaacaggucuucaucgaauc

SEQ ID NO: 3482461 - RNA, 18 nt, Human
aaaacaguaguguauuaa

SEQ ID NO: 3482462 - RNA, 21 nt, Human
aaaacaguauuuauuuuguaa

SEQ ID NO: 3482463 - RNA, 23 nt, Human
aaaacaguauuuauuuuguaauu

SEQ ID NO: 3482464 - RNA, 19 nt, Human
aaaacaguggaucacaaag

SEQ ID NO: 3482465 - RNA, 17 nt, Human
aaaacauaaucuucugc

SEQ ID NO: 3482466 - RNA, 18 nt, Human
aaaacauaaucuucugcc

SEQ ID NO: 3482467 - RNA, 22 nt, Human
aaaacaucauuccuuuuuauuu

SEQ ID NO: 3482468 - RNA, 21 nt, Human
aaaacaucuauucucuccaaa

SEQ ID NO: 3482469 - RNA, 13 nt, Human
aaaacaucucauc

SEQ ID NO: 3482470 - RNA, 24 nt, Human
aaaacaucuuugaaauuauguaaa

SEQ ID NO: 3482471 - RNA, 19 nt, Human
aaaacauguaauauaaaga

SEQ ID NO: 3482472 - RNA, 13 nt, Human
aaaacauguaugu

SEQ ID NO: 3482473 - RNA, 19 nt, Human
aaaacauguuuauuuuucu

SEQ ID NO: 3482474 - RNA, 16 nt, Human
aaaacauuaagaaaau

SEQ ID NO: 3482475 - RNA, 19 nt, Human
aaaacauuaagaaaaucau

SEQ ID NO: 3482476 - RNA, 23 nt, Human
aaaacauuaagaaaaucauauug

SEQ ID NO: 3482477 - RNA, 20 nt, Human
aaaacauuccguuuacauuu

SEQ ID NO: 3482478 - RNA, 21 nt, Human
aaaacauuccguuuacauuuu

SEQ ID NO: 3482479 - RNA, 12 nt, Human
aaaacauucuau

SEQ ID NO: 3482480 - RNA, 12 nt, Human
aaaacauuguuc

SEQ ID NO: 3482481 - RNA, 16 nt, Human
aaaacauuuauuuuga

SEQ ID NO: 3482482 - RNA, 13 nt, Human
aaaacauuugcug

SEQ ID NO: 3482483 - RNA, 18 nt, Human
aaaacauuuggcagaaaa

SEQ ID NO: 3482484 - RNA, 19 nt, Human
aaaacauuuuaaauggaca

SEQ ID NO: 3482485 - RNA, 21 nt, Human
aaaacauuuuuuaauagaaua

SEQ ID NO: 3482486 - RNA, 21 nt, Human
aaaacauuuuuuuuuuaaauc

SEQ ID NO: 3482487 - RNA, 23 nt, Human
aaaaccaaaaguuauuaaaauug

SEQ ID NO: 3482488 - RNA, 15 nt, Human
aaaaccaaauguuua

SEQ ID NO: 3482489 - RNA, 12 nt, Human
aaaaccaaauuc

SEQ ID NO: 3482490 - RNA, 14 nt, Human
aaaaccaagaagau

SEQ ID NO: 3482491 - RNA, 19 nt, Human
aaaaccaagccguggcuuc

SEQ ID NO: 3482492 - RNA, 15 nt, Human
aaaaccaauguucuc

SEQ ID NO: 3482493 - RNA, 12 nt, Human
aaaaccacacaa

SEQ ID NO: 3482494 - RNA, 12 nt, Human
aaaaccacagca

SEQ ID NO: 3482495 - RNA, 19 nt, Human
aaaaccacagcccugucag

SEQ ID NO: 3482496 - RNA, 18 nt, Human
aaaaccaccaaaaacaaa

SEQ ID NO: 3482497 - RNA, 17 nt, Human
aaaaccacuagaacucu

SEQ ID NO: 3482498 - RNA, 22 nt, Human
aaaacccaccuuguuggagccu

SEQ ID NO: 3482499 - RNA, 13 nt, Human
aaaacccagagag

SEQ ID NO: 3482500 - RNA, 19 nt, Human
aaaacccagcugcaccccu

SEQ ID NO: 3482501 - RNA, 13 nt, Human
aaaacccccaaac

SEQ ID NO: 3482502 - RNA, 17 nt, Human
aaaaccccccagauauc

SEQ ID NO: 3482503 - RNA, 15 nt, Human
aaaacccucaagggc

SEQ ID NO: 3482504 - RNA, 15 nt, Human
aaaacccugccccca

SEQ ID NO: 3482505 - RNA, 16 nt, Human
aaaacccuugggccag

SEQ ID NO: 3482506 - RNA, 14 nt, Human
aaaaccgaauaaau

SEQ ID NO: 3482507 - RNA, 15 nt, Human
aaaaccgaauaaaug

SEQ ID NO: 3482508 - RNA, 16 nt, Human
aaaaccuacauauucc

SEQ ID NO: 3482509 - RNA, 14 nt, Human
aaaaccugucaaug

SEQ ID NO: 3482510 - RNA, 17 nt, Human
aaaaccugucaaugaua

SEQ ID NO: 3482511 - RNA, 13 nt, Human
aaaacgaaaacag

SEQ ID NO: 3482512 - RNA, 15 nt, Human
aaaacgcgcagaugu

SEQ ID NO: 3482513 - RNA, 17 nt, Human
aaaacgcgcagaugugc

SEQ ID NO: 3482514 - RNA, 18 nt, Human
aaaacgguuaaaacuguc

SEQ ID NO: 3482515 - RNA, 21 nt, Human
aaaacguggcugcuucaagga

SEQ ID NO: 3482516 - RNA, 17 nt, Human
aaaacguuuuauugugu

SEQ ID NO: 3482517 - RNA, 19 nt, Human
aaaacguuuuauuguguuu

SEQ ID NO: 3482518 - RNA, 18 nt, Human
aaaacuaaaucucuaaua

SEQ ID NO: 3482519 - RNA, 19 nt, Human
aaaacuaaaucucuaauau

SEQ ID NO: 3482520 - RNA, 18 nt, Human
aaaacuacauuuuaacau

SEQ ID NO: 3482521 - RNA, 17 nt, Human
aaaacuacuucuuuuuu

SEQ ID NO: 3482522 - RNA, 21 nt, Human
aaaacuauacuugaacaaaag

SEQ ID NO: 3482523 - RNA, 20 nt, Human
aaaacuauucaugcuaccca

SEQ ID NO: 3482524 - RNA, 23 nt, Human
aaaacucaaccaaaugguacaaa

SEQ ID NO: 3482525 - RNA, 12 nt, Human
aaaacucagccu

SEQ ID NO: 3482526 - RNA, 23 nt, Human
aaaacucaggcaaagaaaaugaa

SEQ ID NO: 3482527 - RNA, 16 nt, Human
aaaacucccauuuacg

SEQ ID NO: 3482528 - RNA, 12 nt, Human
aaaacucuacuu

SEQ ID NO: 3482529 - RNA, 15 nt, Human
aaaacucuacuuaau

SEQ ID NO: 3482530 - RNA, 18 nt, Human
aaaacucuccucugcugc

SEQ ID NO: 3482531 - RNA, 19 nt, Human
aaaacucuuauaaauuucu

SEQ ID NO: 3482532 - RNA, 12 nt, Human
aaaacucuuuaa

SEQ ID NO: 3482533 - RNA, 15 nt, Human
aaaacucuuucggua

SEQ ID NO: 3482534 - RNA, 19 nt, Human
aaaacugaaaaucuaauau

SEQ ID NO: 3482535 - RNA, 15 nt, Human
aaaacugaagucuga

SEQ ID NO: 3482536 - RNA, 21 nt, Human
aaaacugaagucugaaauuug

SEQ ID NO: 3482537 - RNA, 15 nt, Human
aaaacugaugugaaa

SEQ ID NO: 3482538 - RNA, 14 nt, Human
aaaacugcauuuca

SEQ ID NO: 3482539 - RNA, 19 nt, Human
aaaacugcguuaaaggcuc

SEQ ID NO: 3482540 - RNA, 14 nt, Human
aaaagauaaauauu

SEQ ID NO: 3482541 - RNA, 15 nt, Human
aaaagauaauauuuu

SEQ ID NO: 3482542 - RNA, 21 nt, Human
aaaagauaccuuaaaauuuga

SEQ ID NO: 3482543 - RNA, 12 nt, Human
aaaagauauaag

SEQ ID NO: 3482544 - RNA, 18 nt, Human
aaaagaugaaagagcagu

SEQ ID NO: 3482545 - RNA, 22 nt, Human
aaaagaugcacuuugcuuuaau

SEQ ID NO: 3482546 - RNA, 19 nt, Human
aaaagaugcuuuuaacaga

SEQ ID NO: 3482547 - RNA, 18 nt, Human
aaaagauggccuuugcuu

SEQ ID NO: 3482548 - RNA, 19 nt, Human
aaaagauggggucuguaaa

SEQ ID NO: 3482549 - RNA, 16 nt, Human
aaaagaugguaucaua

SEQ ID NO: 3482550 - RNA, 23 nt, Human
aaaagauguagauuuauuucauc

SEQ ID NO: 3482551 - RNA, 14 nt, Human
aaaagauguauccu

SEQ ID NO: 3482552 - RNA, 16 nt, Human
aaaagauugcugaaau

SEQ ID NO: 3482553 - RNA, 18 nt, Human
aaaagauugcugaaauuu

SEQ ID NO: 3482554 - RNA, 15 nt, Human
aaaagauuguauugc

SEQ ID NO: 3482555 - RNA, 13 nt, Human
aaaagauuuaagc

SEQ ID NO: 3482556 - RNA, 13 nt, Human
aaaagauuuguuu

SEQ ID NO: 3482557 - RNA, 17 nt, Human
aaaagauuuguuuuguc

SEQ ID NO: 3482558 - RNA, 21 nt, Human
aaaagauuuucagaaaauauu

SEQ ID NO: 3482559 - RNA, 13 nt, Human
aaaagcaaaauaa

SEQ ID NO: 3482560 - RNA, 13 nt, Human
aaaagcaacacuu

SEQ ID NO: 3482561 - RNA, 14 nt, Human
aaaagcaacauuca

SEQ ID NO: 3482562 - RNA, 15 nt, Human
aaaagcaaugguuga

SEQ ID NO: 3482563 - RNA, 16 nt, Human
aaaagcaauuccaacc

SEQ ID NO: 3482564 - RNA, 14 nt, Human
aaaagcagcauaaa

SEQ ID NO: 3482565 - RNA, 16 nt, Human
aaaagcagcucucccc

SEQ ID NO: 3482566 - RNA, 22 nt, Human
aaaagcaggcuucuaugaaaga

SEQ ID NO: 3482567 - RNA, 19 nt, Human
aaaagcaguaaauuugcua

SEQ ID NO: 3482568 - RNA, 13 nt, Human
aaaagcauaaaug

SEQ ID NO: 3482569 - RNA, 12 nt, Human
aaaagcauguac

SEQ ID NO: 3482570 - RNA, 18 nt, Human
aaaagcauguacaguguu

SEQ ID NO: 3482571 - RNA, 10 nt, Human
aaaagcauuu

SEQ ID NO: 3482572 - RNA, 17 nt, Human
aaaagccacuagacucu

SEQ ID NO: 3482573 - RNA, 23 nt, Human
aaaagccagguuccacagaggac

SEQ ID NO: 3482574 - RNA, 13 nt, Human
aaaagccauguuu

SEQ ID NO: 3482575 - RNA, 14 nt, Human
aaaagccauguuua

SEQ ID NO: 3482576 - RNA, 15 nt, Human
aaaagccauguuuaa

SEQ ID NO: 3482577 - RNA, 20 nt, Human
aaaagccauguuuaagauuu

SEQ ID NO: 3482578 - RNA, 21 nt, Human
aaaagccauguuuaagauuua

SEQ ID NO: 3482579 - RNA, 17 nt, Human
aaaagcccaggagccca

SEQ ID NO: 3482580 - RNA, 16 nt, Human
aaaagccuaaucacag

SEQ ID NO: 3482581 - RNA, 14 nt, Human
aaaagccuugugua

SEQ ID NO: 3482582 - RNA, 14 nt, Human
aaaauggugccuga

SEQ ID NO: 3482583 - RNA, 18 nt, Human
aaaaugguggcuucagcu

SEQ ID NO: 3482584 - RNA, 21 nt, Human
aaaaugguggcuucagcucca

SEQ ID NO: 3482585 - RNA, 20 nt, Human
aaaaugguguuuuaucuucu

SEQ ID NO: 3482586 - RNA, 18 nt, Human
aaaaugguuuaaaugguc

SEQ ID NO: 3482587 - RNA, 14 nt, Human
aaaaugguuuauuu

SEQ ID NO: 3482588 - RNA, 19 nt, Human
aaaauguaaaggagucaaa

SEQ ID NO: 3482589 - RNA, 20 nt, Human
aaaauguaaauauucuauau

SEQ ID NO: 3482590 - RNA, 22 nt, Human
aaaauguaagauuauagauucu

SEQ ID NO: 3482591 - RNA, 18 nt, Human
aaaauguaauuuaaauga

SEQ ID NO: 3482592 - RNA, 15 nt, Human
aaaauguacauguau

SEQ ID NO: 3482593 - RNA, 12 nt, Human
aaaauguauaua

SEQ ID NO: 3482594 - RNA, 14 nt, Human
aaaauguauaugca

SEQ ID NO: 3482595 - RNA, 14 nt, Human
aaacauuuucacac

SEQ ID NO: 3482596 - RNA, 16 nt, Human
aaacauuuucacacaa

SEQ ID NO: 3482597 - RNA, 13 nt, Human
aaacauuuucucc

SEQ ID NO: 3482598 - RNA, 19 nt, Human
aaacauuuucucuuagaaa

SEQ ID NO: 3482599 - RNA, 12 nt, Human
aaacauuuucug

SEQ ID NO: 3482600 - RNA, 16 nt, Human
aaacauuuucuugaau

SEQ ID NO: 3482601 - RNA, 18 nt, Human
aaacauuuugucauauaa

SEQ ID NO: 3482602 - RNA, 14 nt, Human
aaaccaaagaagaa

SEQ ID NO: 3482603 - RNA, 20 nt, Human
aaaccaaagagggcuuccuc

SEQ ID NO: 3482604 - RNA, 17 nt, Human
aaaccaaaggacauuau

SEQ ID NO: 3482605 - RNA, 23 nt, Human
aaaccaaaggacauuaugugugc

SEQ ID NO: 3482606 - RNA, 16 nt, Human
aaaccaagagauugcu

SEQ ID NO: 3482607 - RNA, 20 nt, Human
aaaccaagagauugcuaauu

SEQ ID NO: 3482608 - RNA, 16 nt, Human
aaaccaagccguggcu

SEQ ID NO: 3482609 - RNA, 19 nt, Human
aaaccaagccguggcuucc

SEQ ID NO: 3482610 - RNA, 14 nt, Human
aaaccaaggacuga

SEQ ID NO: 3482611 - RNA, 22 nt, Human
aaaccaagggggaugacaugug

SEQ ID NO: 3482612 - RNA, 23 nt, Human
aaaccaagucaagugaaaaagga

SEQ ID NO: 3482613 - RNA, 22 nt, Human
aaaccacaacugacacaggaaa

SEQ ID NO: 3482614 - RNA, 21 nt, Human
aaaccacaaggcuguugcaug

SEQ ID NO: 3482615 - RNA, 14 nt, Human
aaaccacacaaaga

SEQ ID NO: 3482616 - RNA, 12 nt, Human
aaaccacagcag

SEQ ID NO: 3482617 - RNA, 15 nt, Human
aaaccacagcaguug

SEQ ID NO: 3482618 - RNA, 15 nt, Human
aaaccacagcccugu

SEQ ID NO: 3482619 - RNA, 16 nt, Human
aaaccacagcccuguc

SEQ ID NO: 3482620 - RNA, 18 nt, Human
aaaccaccagaagcccag

SEQ ID NO: 3482621 - RNA, 23 nt, Human
aaaccaccagugcccaaagucug

SEQ ID NO: 3482622 - RNA, 20 nt, Human
aaaccacuuuuugcagcuuu

SEQ ID NO: 3482623 - RNA, 16 nt, Human
aaaccagcuuccuuca

SEQ ID NO: 3482624 - RNA, 18 nt, Human
aaaccagcuuccuucaga

SEQ ID NO: 3482625 - RNA, 12 nt, Human
aaaccagggagc

SEQ ID NO: 3482626 - RNA, 23 nt, Human
aaaccaguuuagauuucaagaaa

SEQ ID NO: 3482627 - RNA, 22 nt, Human
aaaccaucaaguugugccaaau

SEQ ID NO: 3482628 - RNA, 19 nt, Human
aaaccaucucccuggugcu

SEQ ID NO: 3482629 - RNA, 20 nt, Human
aaaccaugggauaaaugcca

SEQ ID NO: 3482630 - RNA, 13 nt, Human
aaaccauugcuuc

SEQ ID NO: 3482631 - RNA, 15 nt, Human
aaaccauugcuucac

SEQ ID NO: 3482632 - RNA, 19 nt, Human
aaacccaagauuauuaaaa

SEQ ID NO: 3482633 - RNA, 15 nt, Human
aaacccaauccaaau

SEQ ID NO: 3482634 - RNA, 12 nt, Human
aaacccagagag

SEQ ID NO: 3482635 - RNA, 18 nt, Human
aaacccagcucuggucca

SEQ ID NO: 3482636 - RNA, 21 nt, Human
aaacccauaggcccacacaca

SEQ ID NO: 3482637 - RNA, 22 nt, Human
aaacccauaggcccacacacag

SEQ ID NO: 3482638 - RNA, 23 nt, Human
aaacccauaggcccacacacagg

SEQ ID NO: 3482639 - RNA, 20 nt, Human
aaaccccaccuuuauuccuu

SEQ ID NO: 3482640 - RNA, 13 nt, Human
aaaccccaucucu

SEQ ID NO: 3482641 - RNA, 17 nt, Human
aaaccccaucucuacaa

SEQ ID NO: 3482642 - RNA, 16 nt, Human
aaacccccacacacac

SEQ ID NO: 3482643 - RNA, 17 nt, Human
aaacccccuuugugcug

SEQ ID NO: 3482644 - RNA, 18 nt, Human
aaaccccuguaggccuca

SEQ ID NO: 3482645 - RNA, 16 nt, Human
aaacccuagccuugcu

SEQ ID NO: 3482646 - RNA, 23 nt, Human
aaacccucguuucugauuaaugc

SEQ ID NO: 3482647 - RNA, 18 nt, Human
aaacccugucaaacauua

SEQ ID NO: 3482648 - RNA, 12 nt, Human
aaacccugucuc

SEQ ID NO: 3482649 - RNA, 21 nt, Human
aaacccugucucuacuaaaaa

SEQ ID NO: 3482650 - RNA, 13 nt, Human
aaaccgccagcuc

SEQ ID NO: 3482651 - RNA, 14 nt, Human
aaaccgcuaaaaga

SEQ ID NO: 3482652 - RNA, 16 nt, Human
aaaccgcuaaaagaaa

SEQ ID NO: 3482653 - RNA, 23 nt, Human
aaaccgcuaaaagaaacuuucuu

SEQ ID NO: 3482654 - RNA, 13 nt, Human
aaaccguguuugu

SEQ ID NO: 3482655 - RNA, 20 nt, Human
aaaccguguuugucucuucu

SEQ ID NO: 3482656 - RNA, 21 nt, Human
aaaccguguuugucucuucug

SEQ ID NO: 3482657 - RNA, 17 nt, Human
aaaccuaaaaaagauau

SEQ ID NO: 3482658 - RNA, 15 nt, Human
aaaccuacauauucc

SEQ ID NO: 3482659 - RNA, 16 nt, Human
aaaccuaguacugccc

SEQ ID NO: 3482660 - RNA, 22 nt, Human
aaaccucaaaaugucuaagaua

SEQ ID NO: 3482661 - RNA, 21 nt, Human
aaaccuccaaaacuccugccc

SEQ ID NO: 3482662 - RNA, 22 nt, Human
aaaccugaaaaaaaguuuacaa

SEQ ID NO: 3482663 - RNA, 18 nt, Human
aaaccugaagacugagga

SEQ ID NO: 3482664 - RNA, 14 nt, Human
aaaccugauguuaa

SEQ ID NO: 3482665 - RNA, 14 nt, Human
aaaccugcuuuuca

SEQ ID NO: 3482666 - RNA, 21 nt, Human
aaaccugggauucaggaaugu

SEQ ID NO: 3482667 - RNA, 16 nt, Human
aaaccuguaucuuucu

SEQ ID NO: 3482668 - RNA, 16 nt, Human
aaaccuguuuaaauau

SEQ ID NO: 3482669 - RNA, 19 nt, Human
aaaccuguuuaaauauuuc

SEQ ID NO: 3482670 - RNA, 14 nt, Human
aaaccuuaauauuu

SEQ ID NO: 3482671 - RNA, 21 nt, Human
aaaccuuaauauuucuucaaa

SEQ ID NO: 3482672 - RNA, 17 nt, Human
aaaccuucacuuaggaa

SEQ ID NO: 3482673 - RNA, 23 nt, Human
aaaccuuccacccagugcugaau

SEQ ID NO: 3482674 - RNA, 14 nt, Human
aaaccuugccuuuc

SEQ ID NO: 3482675 - RNA, 22 nt, Human
aaaccuugguguaguugaacug

SEQ ID NO: 3482676 - RNA, 17 nt, Human
aaaccuuucuucaccaa

SEQ ID NO: 3482677 - RNA, 16 nt, Human
aaaccuuuucuuguau

SEQ ID NO: 3482678 - RNA, 13 nt, Human
aaaccuuuugaaa

SEQ ID NO: 3482679 - RNA, 21 nt, Human
aaaccuuuuuuaagauuuuuc

SEQ ID NO: 3482680 - RNA, 14 nt, Human
aaacgaaagcuggg

SEQ ID NO: 3482681 - RNA, 19 nt, Human
aaacgagucaauccccuca

SEQ ID NO: 3482682 - RNA, 13 nt, Human
aaacgcaucuagu

SEQ ID NO: 3482683 - RNA, 15 nt, Human
aaacgcgcagaugug

SEQ ID NO: 3482684 - RNA, 23 nt, Human
aaacgcgcagaugugcagcagau

SEQ ID NO: 3482685 - RNA, 22 nt, Human
aaacgcuaaagagcccuugccu

SEQ ID NO: 3482686 - RNA, 21 nt, Human
aaacgcuaccucucugucccu

SEQ ID NO: 3482687 - RNA, 19 nt, Human
aaacgcucucuacucugcu

SEQ ID NO: 3482688 - RNA, 13 nt, Human
aaacgcugucaaa

SEQ ID NO: 3482689 - RNA, 18 nt, Human
aaacgcugucaaaaguug

SEQ ID NO: 3482690 - RNA, 22 nt, Human
aaacgcugucaaaaguuggacu

SEQ ID NO: 3482691 - RNA, 18 nt, Human
aaacggaugauuucuaug

SEQ ID NO: 3482692 - RNA, 23 nt, Human
aaacggauuagggcauuugagaa

SEQ ID NO: 3482693 - RNA, 12 nt, Human
aaacggauuauu

SEQ ID NO: 3482694 - RNA, 23 nt, Human
aaacggauuauuuuuucagaccg

SEQ ID NO: 3482695 - RNA, 20 nt, Human
aaacgggaacaugcccccug

SEQ ID NO: 3482696 - RNA, 17 nt, Human
aaacgguucaguuucuu

SEQ ID NO: 3482697 - RNA, 16 nt, Human
aaacguaugcauguga

SEQ ID NO: 3482698 - RNA, 14 nt, Human
aaacguccucuuua

SEQ ID NO: 3482699 - RNA, 12 nt, Human
aaacgugaaaau

SEQ ID NO: 3482700 - RNA, 21 nt, Human
aaacguggcugcuucaaggau

SEQ ID NO: 3482701 - RNA, 21 nt, Human
aaacguuucaguaauaaaaca

SEQ ID NO: 3482702 - RNA, 16 nt, Human
aaacguuuuauugugu

SEQ ID NO: 3482703 - RNA, 17 nt, Human
aaacguuuuguuugaaa

SEQ ID NO: 3482704 - RNA, 17 nt, Human
aaacuaaaaaauuaaac

SEQ ID NO: 3482705 - RNA, 14 nt, Human
aaacuaaaaauaau

SEQ ID NO: 3482706 - RNA, 15 nt, Human
aaacuaaaagacauu

SEQ ID NO: 3482707 - RNA, 18 nt, Human
aaacuaaaagacauuugu

SEQ ID NO: 3482708 - RNA, 16 nt, Human
aaacuaaagcaauaga

SEQ ID NO: 3482709 - RNA, 17 nt, Human
aaacuaaauagcaugua

SEQ ID NO: 3482710 - RNA, 23 nt, Human
aaacuaaauagcauguauugugu

SEQ ID NO: 3482711 - RNA, 13 nt, Human
aaacuaaaucucu

SEQ ID NO: 3482712 - RNA, 15 nt, Human
aaacuaaauuguaaa

SEQ ID NO: 3482713 - RNA, 15 nt, Human
aaacuaacagauaag

SEQ ID NO: 3482714 - RNA, 16 nt, Human
aaacuaagaugugcag

SEQ ID NO: 3482715 - RNA, 18 nt, Human
aaacuaaggcccucuuga

SEQ ID NO: 3482716 - RNA, 12 nt, Human
aaacuaauaaaa

SEQ ID NO: 3482717 - RNA, 18 nt, Human
aaacuaauaaaauauuuu

SEQ ID NO: 3482718 - RNA, 20 nt, Human
aaacuaauaaaauauuuucu

SEQ ID NO: 3482719 - RNA, 22 nt, Human
aaacuaauaaaauauuuucugu

SEQ ID NO: 3482720 - RNA, 23 nt, Human
aaacuaauaaaauauuuucugug

SEQ ID NO: 3482721 - RNA, 13 nt, Human
aaacuaaugaguu

SEQ ID NO: 3482722 - RNA, 18 nt, Human
aaacuacagaccugcuuu

SEQ ID NO: 3482723 - RNA, 12 nt, Human
aaacuacucuuu

SEQ ID NO: 3482724 - RNA, 19 nt, Human
aaacuacugccuuuagaaa

SEQ ID NO: 3482725 - RNA, 16 nt, Human
aaacuacuuugcugcu

SEQ ID NO: 3482726 - RNA, 17 nt, Human
aaacugcccccucugcc

SEQ ID NO: 3482727 - RNA, 20 nt, Human
aaacugcccccucugcccug

SEQ ID NO: 3482728 - RNA, 22 nt, Human
aaacugcccccucugcccugcg

SEQ ID NO: 3482729 - RNA, 22 nt, Human
aaacugcuucccuuacuuugcu

SEQ ID NO: 3482730 - RNA, 19 nt, Human
aaacugcuuccuuucuuga

SEQ ID NO: 3482731 - RNA, 14 nt, Human
aaacugcuuguuuc

SEQ ID NO: 3482732 - RNA, 15 nt, Human
aaacuggaaguuauu

SEQ ID NO: 3482733 - RNA, 13 nt, Human
aaacuggcuuugg

SEQ ID NO: 3482734 - RNA, 20 nt, Human
aaacuggggccuccagaacu

SEQ ID NO: 3482735 - RNA, 22 nt, Human
aaacugguauuuuaucuuugau

SEQ ID NO: 3482736 - RNA, 11 nt, Human
aaacuguacag

SEQ ID NO: 3482737 - RNA, 13 nt, Human
aaacuguacagug

SEQ ID NO: 3482738 - RNA, 18 nt, Human
aaacuguacagugucuuu

SEQ ID NO: 3482739 - RNA, 16 nt, Human
aaacuguacauuuaaa

SEQ ID NO: 3482740 - RNA, 15 nt, Human
aaacuguacuuugau

SEQ ID NO: 3482741 - RNA, 15 nt, Human
aaacuguagaaauga

SEQ ID NO: 3482742 - RNA, 18 nt, Human
aaacuguagaaaugauga

SEQ ID NO: 3482743 - RNA, 13 nt, Human
aaacuguaugcuc

SEQ ID NO: 3482744 - RNA, 21 nt, Human
aaacuguccucuuucagaaaa

SEQ ID NO: 3482745 - RNA, 18 nt, Human
aaacugucuuuaaaagag

SEQ ID NO: 3482746 - RNA, 12 nt, Human
aaacugugcacc

SEQ ID NO: 3482747 - RNA, 20 nt, Human
aaacuguguaacugcccaaa

SEQ ID NO: 3482748 - RNA, 19 nt, Human
aaacuguguggacugugau

SEQ ID NO: 3482749 - RNA, 15 nt, Human
aaacuguguugccac

SEQ ID NO: 3482750 - RNA, 17 nt, Human
aaacuguguugccacag

SEQ ID NO: 3482751 - RNA, 22 nt, Human
aaacuguuaacuuauucaaaga

SEQ ID NO: 3482752 - RNA, 12 nt, Human
aaacuguuagca

SEQ ID NO: 3482753 - RNA, 19 nt, Human
aaacuguuagcacuguuga

SEQ ID NO: 3482754 - RNA, 21 nt, Human
aaacuguuagcacuguugaug

SEQ ID NO: 3482755 - RNA, 11 nt, Human
aaacuauuuau

SEQ ID NO: 3482756 - RNA, 22 nt, Human
aaacuauuuaucuguguuuuug

SEQ ID NO: 3482757 - RNA, 13 nt, Human
aaacucaaaacuu

SEQ ID NO: 3482758 - RNA, 19 nt, Human
aaacucaaaacuuaacaua

SEQ ID NO: 3482759 - RNA, 13 nt, Human
aaacucaaaauau

SEQ ID NO: 3482760 - RNA, 11 nt, Human
aaacucaaaug

SEQ ID NO: 3482761 - RNA, 18 nt, Human
aaacucaaccaaauggua

SEQ ID NO: 3482762 - RNA, 13 nt, Human
aaacucaagacaa

SEQ ID NO: 3482763 - RNA, 14 nt, Human
aaacucaaugcuuu

SEQ ID NO: 3482764 - RNA, 18 nt, Human
aaacucaccauguaaaag

SEQ ID NO: 3482765 - RNA, 16 nt, Human
aaacucacugcucaag

SEQ ID NO: 3482766 - RNA, 22 nt, Human
aaacucacugugaucaauauuu

SEQ ID NO: 3482767 - RNA, 22 nt, Human
aaacucauuuccuauguaacug

SEQ ID NO: 3482768 - RNA, 22 nt, Human
aaacuccugccccuguucucuu

SEQ ID NO: 3482769 - RNA, 16 nt, Human
aaacucguuuuuuaca

SEQ ID NO: 3482770 - RNA, 20 nt, Human
aaacucuaucggagaacaug

SEQ ID NO: 3482771 - RNA, 15 nt, Human
aaacucugaauuuau

SEQ ID NO: 3482772 - RNA, 14 nt, Human
aaacucugccagcc

SEQ ID NO: 3482773 - RNA, 12 nt, Human
aaacucuuaaaa

SEQ ID NO: 3482774 - RNA, 15 nt, Human
aaacucuuaucucag

SEQ ID NO: 3482775 - RNA, 12 nt, Human
aaacucuugcua

SEQ ID NO: 3482776 - RNA, 20 nt, Human
aaacucuuuaacuuguaaua

SEQ ID NO: 3482777 - RNA, 19 nt, Human
aaacugaaaaucuaauauu

SEQ ID NO: 3482778 - RNA, 18 nt, Human
aaacugaagcagccucuc

SEQ ID NO: 3482779 - RNA, 15 nt, Human
aaacugaagucugaa

SEQ ID NO: 3482780 - RNA, 16 nt, Human
aaacugaagucugaaa

SEQ ID NO: 3482781 - RNA, 16 nt, Human
aaacugacucuuaaga

SEQ ID NO: 3482782 - RNA, 17 nt, Human
aaacugacucuuaagaa

SEQ ID NO: 3482783 - RNA, 22 nt, Human
aaacugagauccuuccuuuuga

SEQ ID NO: 3482784 - RNA, 22 nt, Human
aaacugauccaguauaagacua

SEQ ID NO: 3482785 - RNA, 14 nt, Human
aaacugaugugaaa

SEQ ID NO: 3482786 - RNA, 20 nt, Human
aaacugauuuuuuuuuccuu

SEQ ID NO: 3482787 - RNA, 22 nt, Human
aaacugauuuuuuuuuccuuca

SEQ ID NO: 3482788 - RNA, 17 nt, Human
aaacugcaauagagacu

SEQ ID NO: 3482789 - RNA, 14 nt, Human
aaacugcacaugau

SEQ ID NO: 3482790 - RNA, 20 nt, Human
aaacugcacaugauuucaca

SEQ ID NO: 3482791 - RNA, 13 nt, Human
aaacugcaguccu

SEQ ID NO: 3482792 - RNA, 17 nt, Human
aaacugcauuagaaauu

SEQ ID NO: 3482793 - RNA, 11 nt, Human
aaacugcauuu

SEQ ID NO: 3482794 - RNA, 14 nt, Human
aaacugcauuugug

SEQ ID NO: 3482795 - RNA, 13 nt, Human
aaacugcccccuc

SEQ ID NO: 3482796 - RNA, 21 nt, Human
aaacugcccccucugcccugc

SEQ ID NO: 3482797 - RNA, 15 nt, Human
aaacugcccuggcuc

SEQ ID NO: 3482798 - RNA, 19 nt, Human
aaacugcucuaagcacacg

SEQ ID NO: 3482799 - RNA, 21 nt, Human
aaacugcuggacgucuuucuu

SEQ ID NO: 3482800 - RNA, 20 nt, Human
aaacugcuuccuuucuugau

SEQ ID NO: 3482801 - RNA, 19 nt, Human
aaacugcuuguuuccuagc

SEQ ID NO: 3482802 - RNA, 14 nt, Human
aaacuggaaauacu

SEQ ID NO: 3482803 - RNA, 21 nt, Human
aaacuggaaauacuagauuug

SEQ ID NO: 3482804 - RNA, 14 nt, Human
aaacuggaaguuau

SEQ ID NO: 3482805 - RNA, 14 nt, Human
aaacuggaauaaga

SEQ ID NO: 3482806 - RNA, 15 nt, Human
aaacuggaauaagaa

SEQ ID NO: 3482807 - RNA, 15 nt, Human
aaacuggaaugagca

SEQ ID NO: 3482808 - RNA, 11 nt, Human
aaacuggagac

SEQ ID NO: 3482809 - RNA, 15 nt, Human
aaacuggagucugga

SEQ ID NO: 3482810 - RNA, 16 nt, Human
aaacuggauuaaacuu

SEQ ID NO: 3482811 - RNA, 15 nt, Human
aaacuggcaaagcag

SEQ ID NO: 3482812 - RNA, 21 nt, Human
aaacuggcaucugacacaaaa

SEQ ID NO: 3482813 - RNA, 15 nt, Human
aaacuggccccggau

SEQ ID NO: 3482814 - RNA, 18 nt, Human
aaacugggaaccccuuuc

SEQ ID NO: 3482815 - RNA, 16 nt, Human
aaacuggggccucccu

SEQ ID NO: 3482816 - RNA, 21 nt, Human
aaacuguaaaaaaugugugua

SEQ ID NO: 3482817 - RNA, 12 nt, Human
aaacuguacagu

SEQ ID NO: 3482818 - RNA, 12 nt, Human
aaacuguacuuu

SEQ ID NO: 3482819 - RNA, 14 nt, Human
aaacuguacuuuga

SEQ ID NO: 3482820 - RNA, 16 nt, Human
aaacuguagaaaugau

SEQ ID NO: 3482821 - RNA, 15 nt, Human
aaacuguagucucag

SEQ ID NO: 3482822 - RNA, 16 nt, Human
aaacuguagucucagg

SEQ ID NO: 3482823 - RNA, 14 nt, Human
aaacuguauugaug

SEQ ID NO: 3482824 - RNA, 12 nt, Human
aaacugucccuu

SEQ ID NO: 3482825 - RNA, 15 nt, Human
aaacuguccucuuuc

SEQ ID NO: 3482826 - RNA, 19 nt, Human
aaacugucuuuaaaagaga

SEQ ID NO: 3482827 - RNA, 20 nt, Human
aaacugucuuuaaaagagag

SEQ ID NO: 3482828 - RNA, 10 nt, Human
aaacugugua

SEQ ID NO: 3482829 - RNA, 21 nt, Human
aaacuguguacauaacugaaa

SEQ ID NO: 3482830 - RNA, 18 nt, Human
aaacuguguauuccaaga

SEQ ID NO: 3482831 - RNA, 21 nt, Human
aaacuguuaccuaaaguauuu

SEQ ID NO: 3482832 - RNA, 16 nt, Human
aaacuguuagcacugu

SEQ ID NO: 3482833 - RNA, 14 nt, Human
aaacuguucucuau

SEQ ID NO: 3482834 - RNA, 23 nt, Human
aaacuguucucuauuagacuuua

SEQ ID NO: 3482835 - RNA, 23 nt, Human
aaacuguuucagauuuuuuauuu

SEQ ID NO: 3482836 - RNA, 21 nt, Human
aaacuuaaauguuauuaucug

SEQ ID NO: 3482837 - RNA, 20 nt, Human
aaacuuaaccgcaucagaag

SEQ ID NO: 3482838 - RNA, 15 nt, Human
aaacuuaagccaauu

SEQ ID NO: 3482839 - RNA, 17 nt, Human
aaacuuaaucuaaaugg

SEQ ID NO: 3482840 - RNA, 19 nt, Human
aaacuuaaucuaaauggaa

SEQ ID NO: 3482841 - RNA, 14 nt, Human
aaacuuacacacaa

SEQ ID NO: 3482842 - RNA, 14 nt, Human
aaacuuacuauuuu

SEQ ID NO: 3482843 - RNA, 18 nt, Human
aaacuuagaauaaaauug

SEQ ID NO: 3482844 - RNA, 21 nt, Human
aaacuuauaaaucauauugau

SEQ ID NO: 3482845 - RNA, 14 nt, Human
aaacuuaucuuaca

SEQ ID NO: 3482846 - RNA, 13 nt, Human
aaacuuauuuuuu

SEQ ID NO: 3482847 - RNA, 20 nt, Human
aaacuucagaugggaggaaa

SEQ ID NO: 3482848 - RNA, 15 nt, Human
aaacuucauguaacu

SEQ ID NO: 3482849 - RNA, 17 nt, Human
aaacuuccaaagaaagu

SEQ ID NO: 3482850 - RNA, 19 nt, Human
aaacuuccagugcaacacu

SEQ ID NO: 3482851 - RNA, 17 nt, Human
aaacuuccccaucuucu

SEQ ID NO: 3482852 - RNA, 19 nt, Human
aaacuucucugaagggagg

SEQ ID NO: 3482853 - RNA, 13 nt, Human
aaacuucuuaaau

SEQ ID NO: 3482854 - RNA, 21 nt, Human
aaacuucuuaaauaucuuuua

SEQ ID NO: 3482855 - RNA, 16 nt, Human
aaacuugcugagcugu

SEQ ID NO: 3482856 - RNA, 18 nt, Human
aaacuugcuuuaugccuu

SEQ ID NO: 3482857 - RNA, 17 nt, Human
aaacuuggauacuugga

SEQ ID NO: 3482858 - RNA, 18 nt, Human
aaacuuggauacuuggau

SEQ ID NO: 3482859 - RNA, 22 nt, Human
aaacuugucuuuucaaaauauu

SEQ ID NO: 3482860 - RNA, 12 nt, Human
aaacuugugaau

SEQ ID NO: 3482861 - RNA, 17 nt, Human
aaacuuguguaaauaca

SEQ ID NO: 3482862 - RNA, 16 nt, Human
aaacuuguuauuguga

SEQ ID NO: 3482863 - RNA, 21 nt, Human
aaacuuguuauugugaaugau

SEQ ID NO: 3482864 - RNA, 16 nt, Human
aaacuuuaaaaaauau

SEQ ID NO: 3482865 - RNA, 21 nt, Human
aaacuuuaaaaaauauuuauu

SEQ ID NO: 3482866 - RNA, 22 nt, Human
aaacuuuaaagcguuugcacag

SEQ ID NO: 3482867 - RNA, 22 nt, Human
aaacuuuaccuuuuuuauacau

SEQ ID NO: 3482868 - RNA, 19 nt, Human
aaacuuuacuaagaugaca

SEQ ID NO: 3482869 - RNA, 24 nt, Human
aaacuuuagguuuuuuuaaugaua

SEQ ID NO: 3482870 - RNA, 19 nt, Human
aaacuuuaugcuaagugaa

SEQ ID NO: 3482871 - RNA, 15 nt, Human
aaacuuugaaauaua

SEQ ID NO: 3482872 - RNA, 14 nt, Human
aaagaaauuuacua

SEQ ID NO: 3482873 - RNA, 21 nt, Human
aaagaacaugcaguuugaaau

SEQ ID NO: 3482874 - RNA, 20 nt, Human
aaagaacauggacuuguaua

SEQ ID NO: 3482875 - RNA, 23 nt, Human
aaagaaccaacaaccucaacugc

SEQ ID NO: 3482876 - RNA, 23 nt, Human
aaagaacguggucagaguagaac

SEQ ID NO: 3482877 - RNA, 12 nt, Human
aaagaacuuacu

SEQ ID NO: 3482878 - RNA, 17 nt, Human
aaagaacuuacugauua

SEQ ID NO: 3482879 - RNA, 16 nt, Human
aaagaagaaagacucu

SEQ ID NO: 3482880 - RNA, 15 nt, Human
aaagaagacaaacuu

SEQ ID NO: 3482881 - RNA, 15 nt, Human
aaagaagacauguuu

SEQ ID NO: 3482882 - RNA, 11 nt, Human
aaagaagaccg

SEQ ID NO: 3482883 - RNA, 22 nt, Human
aaagaagagcgagagaucaaag

SEQ ID NO: 3482884 - RNA, 15 nt, Human
aaagaagaucuguaa

SEQ ID NO: 3482885 - RNA, 15 nt, Human
aaagaagauguuuaa

SEQ ID NO: 3482886 - RNA, 13 nt, Human
aaagaagcagacc

SEQ ID NO: 3482887 - RNA, 16 nt, Human
aaagaagcagaccauu

SEQ ID NO: 3482888 - RNA, 16 nt, Human
aaagaagcccccagcu

SEQ ID NO: 3482889 - RNA, 23 nt, Human
aaagaaggcauggacuucuggau

SEQ ID NO: 3482890 - RNA, 21 nt, Human
aaagaagggcugguauuguuc

SEQ ID NO: 3482891 - RNA, 20 nt, Human
aaagaagguuucagaaagaa

SEQ ID NO: 3482892 - RNA, 15 nt, Human
aaagaaguaaaagca

SEQ ID NO: 3482893 - RNA, 14 nt, Human
aaagaauaagaaaa

SEQ ID NO: 3482894 - RNA, 17 nt, Human
aaagaauacuugaacuu

SEQ ID NO: 3482895 - RNA, 15 nt, Human
aaagaauaugacuuu

SEQ ID NO: 3482896 - RNA, 22 nt, Human
aaagaaucaccuaauuaauuuc

SEQ ID NO: 3482897 - RNA, 18 nt, Human
aaagaaucauuauuuauu

SEQ ID NO: 3482898 - RNA, 13 nt, Human
aaagaaugaaaga

SEQ ID NO: 3482899 - RNA, 14 nt, Human
aaagaaugaaagag

SEQ ID NO: 3482900 - RNA, 13 nt, Human
aaagaauguaaag

SEQ ID NO: 3482901 - RNA, 13 nt, Human
aaagaauguuacu

SEQ ID NO: 3482902 - RNA, 18 nt, Human
aaagaauguuacugccuu

SEQ ID NO: 3482903 - RNA, 15 nt, Human
aaagaauucaaauuu

SEQ ID NO: 3482904 - RNA, 18 nt, Human
aaagaauuccuacaauau

SEQ ID NO: 3482905 - RNA, 19 nt, Human
aaagaauugugguuuauau

SEQ ID NO: 3482906 - RNA, 22 nt, Human
aaagaauuguuggggguuuuuu

SEQ ID NO: 3482907 - RNA, 16 nt, Human
aaagaauuuaguauua

SEQ ID NO: 3482908 - RNA, 16 nt, Human
aaagaauuuuuggugu

SEQ ID NO: 3482909 - RNA, 16 nt, Human
aaagacaaauucuguu

SEQ ID NO: 3482910 - RNA, 13 nt, Human
aaagacaauucuu

SEQ ID NO: 3482911 - RNA, 15 nt, Human
aaagacaauucuuua

SEQ ID NO: 3482912 - RNA, 20 nt, Human
aaagacaauucuuuauacaa

SEQ ID NO: 3482913 - RNA, 17 nt, Human
aaagacaccauuuaucu

SEQ ID NO: 3482914 - RNA, 16 nt, Human
aaagacacugccuggg

SEQ ID NO: 3482915 - RNA, 9 nt, Human
aaagacaga

SEQ ID NO: 3482916 - RNA, 13 nt, Human
aaagacagaagcc

SEQ ID NO: 3482917 - RNA, 20 nt, Human
aaagaaaccccaaacucagg

SEQ ID NO: 3482918 - RNA, 23 nt, Human
aaagaaacccgacagagggaaga

SEQ ID NO: 3482919 - RNA, 15 nt, Human
aaagaaacugacaug

SEQ ID NO: 3482920 - RNA, 14 nt, Human
aaagaaagagagaa

SEQ ID NO: 3482921 - RNA, 17 nt, Human
aaagaaagagagaaaau

SEQ ID NO: 3482922 - RNA, 14 nt, Human
aaagaaagcaacuu

SEQ ID NO: 3482923 - RNA, 12 nt, Human
aaagaaaggaaa

SEQ ID NO: 3482924 - RNA, 17 nt, Human
aaagaaaggguucugua

SEQ ID NO: 3482925 - RNA, 10 nt, Human
aaagaaagug

SEQ ID NO: 3482926 - RNA, 12 nt, Human
aaagaaauacag

SEQ ID NO: 3482927 - RNA, 15 nt, Human
aaagaaauauaccua

SEQ ID NO: 3482928 - RNA, 18 nt, Human
aaagaaaucauguccaua

SEQ ID NO: 3482929 - RNA, 18 nt, Human
aaagaaaucauguuauga

SEQ ID NO: 3482930 - RNA, 18 nt, Human
aaagaaaucuauagaaag

SEQ ID NO: 3482931 - RNA, 22 nt, Human
aaagaaaucuauagaaaguguu

SEQ ID NO: 3482932 - RNA, 17 nt, Human
aaagaaaugucuuaauu

SEQ ID NO: 3482933 - RNA, 15 nt, Human
aaagaaauuaugugc

SEQ ID NO: 3482934 - RNA, 19 nt, Human
aaagaaauucccuggacca

SEQ ID NO: 3482935 - RNA, 21 nt, Human
aaagaaauuuacuauauauau

SEQ ID NO: 3482936 - RNA, 16 nt, Human
aaagaacaaaaaaauc

SEQ ID NO: 3482937 - RNA, 12 nt, Human
aaagaacauaaa

SEQ ID NO: 3482938 - RNA, 20 nt, Human
aaagaacaugcaguuugaaa

SEQ ID NO: 3482939 - RNA, 13 nt, Human
aaagaaccacuug

SEQ ID NO: 3482940 - RNA, 18 nt, Human
aaagaacgcugauuuaaa

SEQ ID NO: 3482941 - RNA, 16 nt, Human
aaagaacuaucuucau

SEQ ID NO: 3482942 - RNA, 20 nt, Human
aaagaacuaucuucaucuga

SEQ ID NO: 3482943 - RNA, 22 nt, Human
aaagaacuaucuucaucugaga

SEQ ID NO: 3482944 - RNA, 12 nt, Human
aaagaacuuacc

SEQ ID NO: 3482945 - RNA, 9 nt, Human
aaagaagaa

SEQ ID NO: 3482946 - RNA, 19 nt, Human
aaagaagaaauaguucugu

SEQ ID NO: 3482947 - RNA, 20 nt, Human
aaagaagaauguguuucaaa

SEQ ID NO: 3482948 - RNA, 14 nt, Human
aaagaagaccugag

SEQ ID NO: 3482949 - RNA, 20 nt, Human
aaagaagaccugagaaugua

SEQ ID NO: 3482950 - RNA, 14 nt, Human
aaagaagaucugua

SEQ ID NO: 3482951 - RNA, 12 nt, Human
aaagaagauguu

SEQ ID NO: 3482952 - RNA, 18 nt, Human
aaagaaggaaaaugaucu

SEQ ID NO: 3482953 - RNA, 17 nt, Human
aaagaaggaaagauggu

SEQ ID NO: 3482954 - RNA, 12 nt, Human
aaagaaggaagu

SEQ ID NO: 3482955 - RNA, 21 nt, Human
aaagaaguguccgagaacuaa

SEQ ID NO: 3482956 - RNA, 24 nt, Human
aaagaaguguggggauuuucacug

SEQ ID NO: 3482957 - RNA, 18 nt, Human
aaagaaguuauuuuccag

SEQ ID NO: 3482958 - RNA, 15 nt, Human
aaagaaguuugauau

SEQ ID NO: 3482959 - RNA, 13 nt, Human
aaagaauacuuga

SEQ ID NO: 3482960 - RNA, 16 nt, Human
aaagaauacuugaacu

SEQ ID NO: 3482961 - RNA, 16 nt, Human
aaagaauagaagcuaa

SEQ ID NO: 3482962 - RNA, 17 nt, Human
aaagaauauauuuauuu

SEQ ID NO: 3482963 - RNA, 15 nt, Human
aaagaaucauuauuu

SEQ ID NO: 3482964 - RNA, 16 nt, Human
aaagaaucccuguuca

SEQ ID NO: 3482965 - RNA, 22 nt, Human
aaagaaucccuguucauuguaa

SEQ ID NO: 3482966 - RNA, 12 nt, Human
aaagaaucuacu

SEQ ID NO: 3482967 - RNA, 16 nt, Human
aaagaaugaaagagua

SEQ ID NO: 3482968 - RNA, 13 nt, Human
aaagaaugacuau

SEQ ID NO: 3482969 - RNA, 16 nt, Human
aaagaaugauuaugaa

SEQ ID NO: 3482970 - RNA, 23 nt, Human
aaagaaugggcaguuacaugcau

SEQ ID NO: 3482971 - RNA, 19 nt, Human
aaagaauguuacugccuua

SEQ ID NO: 3482972 - RNA, 15 nt, Human
aaagaauuauuuugu

SEQ ID NO: 3482973 - RNA, 18 nt, Human
aaagaauuccaaagcaaa

SEQ ID NO: 3482974 - RNA, 20 nt, Human
aaagaauuguuggggguuuu

SEQ ID NO: 3482975 - RNA, 18 nt, Human
aaagacaaaagucugucu

SEQ ID NO: 3482976 - RNA, 11 nt, Human
aaagacaaaua

SEQ ID NO: 3482977 - RNA, 12 nt, Human
aaagacaaauag

SEQ ID NO: 3482978 - RNA, 16 nt, Human
aaagacaaaucaaagc

SEQ ID NO: 3482979 - RNA, 19 nt, Human
aaagacaaaucaaagcaga

SEQ ID NO: 3482980 - RNA, 17 nt, Human
aaagacaaauucuguuu

SEQ ID NO: 3482981 - RNA, 19 nt, Human
aaagacaaauucuguuucu

SEQ ID NO: 3482982 - RNA, 22 nt, Human
aaagacaaauucuguuucuuga

SEQ ID NO: 3482983 - RNA, 14 nt, Human
aaagacaacacaac

SEQ ID NO: 3482984 - RNA, 13 nt, Human
aaagacaagacuu

SEQ ID NO: 3482985 - RNA, 17 nt, Human
aaagacaagacuucagu

SEQ ID NO: 3482986 - RNA, 17 nt, Human
aaagacaauucuuuaua

SEQ ID NO: 3482987 - RNA, 18 nt, Human
aaagacacagaacacaga

SEQ ID NO: 3482988 - RNA, 22 nt, Human
aaagacacauuuuuuaggaaau

SEQ ID NO: 3482989 - RNA, 13 nt, Human
aaagacaccuacu

SEQ ID NO: 3482990 - RNA, 12 nt, Human
aaagacacugcc

SEQ ID NO: 3482991 - RNA, 14 nt, Human
aaagacaucaagca

SEQ ID NO: 3482992 - RNA, 19 nt, Human
aaagacauucugacaucuu

SEQ ID NO: 3482993 - RNA, 20 nt, Human
aaagacauugauucagccug

SEQ ID NO: 3482994 - RNA, 14 nt, Human
aaagaccaggccaa

SEQ ID NO: 3482995 - RNA, 14 nt, Human
aaagacccuggcuu

SEQ ID NO: 3482996 - RNA, 18 nt, Human
aaagacccuggcuuucau

SEQ ID NO: 3482997 - RNA, 19 nt, Human
aaagaccuuguguguaugu

SEQ ID NO: 3482998 - RNA, 22 nt, Human
aaagaccuuuggagcaaagcug

SEQ ID NO: 3482999 - RNA, 19 nt, Human
aaagacgauuugucaguua

SEQ ID NO: 3483000 - RNA, 14 nt, Human
aaagacuauucaaa

SEQ ID NO: 3483001 - RNA, 21 nt, Human
aaagacuauucaaacagucuc

SEQ ID NO: 3483002 - RNA, 14 nt, Human
aaagacucauccgu

SEQ ID NO: 3483003 - RNA, 19 nt, Human
aaagacugaccaauauugu

SEQ ID NO: 3483004 - RNA, 23 nt, Human
aaagacugaguacguugugcauu

SEQ ID NO: 3483005 - RNA, 13 nt, Human
aaagacuggcuuu

SEQ ID NO: 3483006 - RNA, 16 nt, Human
aaagacugguuuucug

SEQ ID NO: 3483007 - RNA, 15 nt, Human
aaagacuguacaaag

SEQ ID NO: 3483008 - RNA, 20 nt, Human
aaagacuuaguauauuuucu

SEQ ID NO: 3483009 - RNA, 16 nt, Human
aaagacuuccaaagaa

SEQ ID NO: 3483010 - RNA, 23 nt, Human
aaagacuucucuacccaucuuaa

SEQ ID NO: 3483011 - RNA, 13 nt, Human
aaagagaaaagaa

SEQ ID NO: 3483012 - RNA, 14 nt, Human
aaagagaaaagaaa

SEQ ID NO: 3483013 - RNA, 19 nt, Human
aaagagaaacaguugguaa

SEQ ID NO: 3483014 - RNA, 14 nt, Human
aaagagaaacuuug

SEQ ID NO: 3483015 - RNA, 14 nt, Human
aaagagaagaagaa

SEQ ID NO: 3483016 - RNA, 19 nt, Human
aaagagaagaagaaaaaaa

SEQ ID NO: 3483017 - RNA, 14 nt, Human
aaagagaaggagcc

SEQ ID NO: 3483018 - RNA, 12 nt, Human
aaagagaaugag

SEQ ID NO: 3483019 - RNA, 18 nt, Human
aaauuuuuuguugacauu

SEQ ID NO: 3483020 - RNA, 14 nt, Human
aaauuuuuuuguau

SEQ ID NO: 3483021 - RNA, 17 nt, Human
aaauuuuuuuguaugaa

SEQ ID NO: 3483022 - RNA, 18 nt, Human
aaauuuuuuuguaugaaa

SEQ ID NO: 3483023 - RNA, 15 nt, Human
aaauuuuuuuuacau

SEQ ID NO: 3483024 - RNA, 17 nt, Human
aaauuuuuuuuacauuu

SEQ ID NO: 3483025 - RNA, 23 nt, Human
aaauuuuuuuucaugcuuuauca

SEQ ID NO: 3483026 - RNA, 22 nt, Human
aaauuuuuuuucauguuuuaac

SEQ ID NO: 3483027 - RNA, 18 nt, Human
aaauuuuuuuuguuucau

SEQ ID NO: 3483028 - RNA, 19 nt, Human
aaauuuuuuuuuaaagcag

SEQ ID NO: 3483029 - RNA, 14 nt, Human
aacaaaaagcuucc

SEQ ID NO: 3483030 - RNA, 11 nt, Human
aacaaaaauaa

SEQ ID NO: 3483031 - RNA, 14 nt, Human
aacaaaaauuugaa

SEQ ID NO: 3483032 - RNA, 14 nt, Human
aacaaaacaaaaca

SEQ ID NO: 3483033 - RNA, 21 nt, Human
aacaaaagcgacccauucaga

SEQ ID NO: 3483034 - RNA, 11 nt, Human
aacaaaaggca

SEQ ID NO: 3483035 - RNA, 12 nt, Human
aacaaaaggguc

SEQ ID NO: 3483036 - RNA, 14 nt, Human
aacaaaauacauuc

SEQ ID NO: 3483037 - RNA, 17 nt, Human
aacaaaauacauucuuu

SEQ ID NO: 3483038 - RNA, 18 nt, Human
aacaaaauacauucuuuu

SEQ ID NO: 3483039 - RNA, 12 nt, Human
aacaaaauagaa

SEQ ID NO: 3483040 - RNA, 13 nt, Human
aacaaaaucuguu

SEQ ID NO: 3483041 - RNA, 14 nt, Human
aacaaaaugaagcu

SEQ ID NO: 3483042 - RNA, 14 nt, Human
aacaaaauguagaa

SEQ ID NO: 3483043 - RNA, 17 nt, Human
aacaaaauguaugucug

SEQ ID NO: 3483044 - RNA, 15 nt, Human
aacaaaauuauuugu

SEQ ID NO: 3483045 - RNA, 13 nt, Human
aacaaaauuucua

SEQ ID NO: 3483046 - RNA, 11 nt, Human
aacaaaauuug

SEQ ID NO: 3483047 - RNA, 21 nt, Human
aacaaaauuuuauuuugugcu

SEQ ID NO: 3483048 - RNA, 17 nt, Human
aacaaacagaugcucug

SEQ ID NO: 3483049 - RNA, 16 nt, Human
aacaaacucucugaac

SEQ ID NO: 3483050 - RNA, 20 nt, Human
aacaaacuguguaacugccc

SEQ ID NO: 3483051 - RNA, 22 nt, Human
aacaaacuuuucaaggcuuaua

SEQ ID NO: 3483052 - RNA, 15 nt, Human
aacaaagaaauuaug

SEQ ID NO: 3483053 - RNA, 17 nt, Human
aacaaagaaauuaugug

SEQ ID NO: 3483054 - RNA, 11 nt, Human
aacaaagauau

SEQ ID NO: 3483055 - RNA, 16 nt, Human
aacaaagcacaguguu

SEQ ID NO: 3483056 - RNA, 16 nt, Human
aacaaagccacuuuca

SEQ ID NO: 3483057 - RNA, 16 nt, Human
aaaguggugcucaguu

SEQ ID NO: 3483058 - RNA, 13 nt, Human
aaaguguaaagca

SEQ ID NO: 3483059 - RNA, 15 nt, Human
aaaguguaaagcauu

SEQ ID NO: 3483060 - RNA, 17 nt, Human
aaaguguaaagcauucc

SEQ ID NO: 3483061 - RNA, 22 nt, Human
aaaguguaaagcauuccaacaa

SEQ ID NO: 3483062 - RNA, 14 nt, Human
aaaguguauuauaa

SEQ ID NO: 3483063 - RNA, 23 nt, Human
aaaguguauuuggaaauaaaguc

SEQ ID NO: 3483064 - RNA, 19 nt, Human
aaaguguauuuuauaaaau

SEQ ID NO: 3483065 - RNA, 21 nt, Human
aaaguguauuuuauaaaauua

SEQ ID NO: 3483066 - RNA, 21 nt, Human
aaaguguccauugacauguac

SEQ ID NO: 3483067 - RNA, 17 nt, Human
aaaguguguauuaaaaa

SEQ ID NO: 3483068 - RNA, 22 nt, Human
aaaguguguauuaaaaaaaaca

SEQ ID NO: 3483069 - RNA, 23 nt, Human
aaaguguguauuaaaaaaaacaa

SEQ ID NO: 3483070 - RNA, 17 nt, Human
aaaguguucuguuacaa

SEQ ID NO: 3483071 - RNA, 19 nt, Human
aaaguguuggcuaaugaag

SEQ ID NO: 3483072 - RNA, 18 nt, Human
aaaguguuuauuuuucau

SEQ ID NO: 3483073 - RNA, 20 nt, Human
aaaguguuuauuuuucauau

SEQ ID NO: 3483074 - RNA, 15 nt, Human
aaaguguuucagcua

SEQ ID NO: 3483075 - RNA, 15 nt, Human
aaaguguuuccuuca

SEQ ID NO: 3483076 - RNA, 11 nt, Human
aaaguguuuuc

SEQ ID NO: 3483077 - RNA, 14 nt, Human
aaaguguuuucaga

SEQ ID NO: 3483078 - RNA, 16 nt, Human
aaaguguuuucagagc

SEQ ID NO: 3483079 - RNA, 15 nt, Human
aaaguguuuuguacc

SEQ ID NO: 3483080 - RNA, 16 nt, Human
aaaguguuuuguacca

SEQ ID NO: 3483081 - RNA, 22 nt, Human
aaaguuaaacauugaaguaaug

SEQ ID NO: 3483082 - RNA, 20 nt, Human
aaaguuaaacgugaugugcu

SEQ ID NO: 3483083 - RNA, 12 nt, Human
aaaguuaacauu

SEQ ID NO: 3483084 - RNA, 15 nt, Human
aaaguuaacauuaau

SEQ ID NO: 3483085 - RNA, 13 nt, Human
aaaguuaaguuga

SEQ ID NO: 3483086 - RNA, 15 nt, Human
aaaguuaaugcuuaa

SEQ ID NO: 3483087 - RNA, 16 nt, Human
aaaguuaccagugccu

SEQ ID NO: 3483088 - RNA, 22 nt, Human
aaaguuaccagugccuuaaacu

SEQ ID NO: 3483089 - RNA, 17 nt, Human
aaaguuacccacugaag

SEQ ID NO: 3483090 - RNA, 21 nt, Human
aaaguuaccuggaaucaaaua

SEQ ID NO: 3483091 - RNA, 15 nt, Human
aaaguuacuagguaa

SEQ ID NO: 3483092 - RNA, 20 nt, Human
aaaguuacuagguaacuuca

SEQ ID NO: 3483093 - RNA, 21 nt, Human
aaaguuacuagguaacuucau

SEQ ID NO: 3483094 - RNA, 22 nt, Human
aaaguuacugauucacugcaug

SEQ ID NO: 3483095 - RNA, 14 nt, Human
aaaguuagcugagc

SEQ ID NO: 3483096 - RNA, 22 nt, Human
aaaguuauauuucagauguaau

SEQ ID NO: 3483097 - RNA, 18 nt, Human
aaaguuauuagugguuua

SEQ ID NO: 3483098 - RNA, 14 nt, Human
aaaguuauucuuga

SEQ ID NO: 3483099 - RNA, 19 nt, Human
aaaguuauugugauauccu

SEQ ID NO: 3483100 - RNA, 22 nt, Human
aaaguucauagggucucuucag

SEQ ID NO: 3483101 - RNA, 21 nt, Human
aaaguuccaagagucuaaaga

SEQ ID NO: 3483102 - RNA, 18 nt, Human
aaaguucccugaaacacg

SEQ ID NO: 3483103 - RNA, 15 nt, Human
aaaguucuaagauuc

SEQ ID NO: 3483104 - RNA, 22 nt, Human
aaaguucugcuuucuccccaau

SEQ ID NO: 3483105 - RNA, 14 nt, Human
aaaguucuguacuc

SEQ ID NO: 3483106 - RNA, 20 nt, Human
aaaguucuguguauuuaauu

SEQ ID NO: 3483107 - RNA, 21 nt, Human
aaaguucuguguauuuaauug

SEQ ID NO: 3483108 - RNA, 12 nt, Human
aaaguugaaauu

SEQ ID NO: 3483109 - RNA, 13 nt, Human
aaaguugaauuua

SEQ ID NO: 3483110 - RNA, 16 nt, Human
aaaguugaauuuauug

SEQ ID NO: 3483111 - RNA, 22 nt, Human
aaaguugaauuuauuggcuuuu

SEQ ID NO: 3483112 - RNA, 17 nt, Human
aaaguugauaaagauuu

SEQ ID NO: 3483113 - RNA, 18 nt, Human
aaaguugauaaagauuuu

SEQ ID NO: 3483114 - RNA, 17 nt, Human
aaaguugcagcuguuuu

SEQ ID NO: 3483115 - RNA, 23 nt, Human
aaaguugccuaaauccauuugga

SEQ ID NO: 3483116 - RNA, 14 nt, Human
aaaguuggacuaaa

SEQ ID NO: 3483117 - RNA, 16 nt, Human
aaaguugguaaaccuu

SEQ ID NO: 3483118 - RNA, 17 nt, Human
aaaguugguauuaauaa

SEQ ID NO: 3483119 - RNA, 16 nt, Human
aaaguugguuggauaa

SEQ ID NO: 3483120 - RNA, 18 nt, Human
aaaguuguaugaucugug

SEQ ID NO: 3483121 - RNA, 17 nt, Human
aaaguuguucaacuauu

SEQ ID NO: 3483122 - RNA, 16 nt, Human
aaaguuuaaaauguau

SEQ ID NO: 3483123 - RNA, 12 nt, Human
aaaguuuaauaa

SEQ ID NO: 3483124 - RNA, 19 nt, Human
aaaguuuaauauuaaagcc

SEQ ID NO: 3483125 - RNA, 20 nt, Human
aaaguuuaauauuaaagcca

SEQ ID NO: 3483126 - RNA, 21 nt, Human
aaaguuuacaguaaauaaauu

SEQ ID NO: 3483127 - RNA, 18 nt, Human
aaaguuuauaaaagugaa

SEQ ID NO: 3483128 - RNA, 12 nt, Human
aaaguuucaaaa

SEQ ID NO: 3483129 - RNA, 13 nt, Human
aaaguuucaaugu

SEQ ID NO: 3483130 - RNA, 13 nt, Human
aaaguuuccauau

SEQ ID NO: 3483131 - RNA, 13 nt, Human
aaaguuucucaga

SEQ ID NO: 3483132 - RNA, 17 nt, Human
aaaguuucucagauccu

SEQ ID NO: 3483133 - RNA, 21 nt, Human
aaaguuucucuuuucaaaaca

SEQ ID NO: 3483134 - RNA, 23 nt, Human
aaaguuucucuuuucaaaacauu

SEQ ID NO: 3483135 - RNA, 13 nt, Human
aaaguuucuuuga

SEQ ID NO: 3483136 - RNA, 24 nt, Human
aaaguuugaucuuccucugcuaaa

SEQ ID NO: 3483137 - RNA, 22 nt, Human
aaaguuugcuuguuucuugguc

SEQ ID NO: 3483138 - RNA, 14 nt, Human
aaaguuuguuugcu

SEQ ID NO: 3483139 - RNA, 15 nt, Human
aaaguuuuauauauu

SEQ ID NO: 3483140 - RNA, 23 nt, Human
aaaguuuuauauauuauauggaa

SEQ ID NO: 3483141 - RNA, 17 nt, Human
aaaguuuuauaugcuuu

SEQ ID NO: 3483142 - RNA, 13 nt, Human
aaaguuuuaucaa

SEQ ID NO: 3483143 - RNA, 14 nt, Human
aaaguuuugaaaag

SEQ ID NO: 3483144 - RNA, 18 nt, Human
aaaguuuugaaaagcuau

SEQ ID NO: 3483145 - RNA, 19 nt, Human
aaaguuuugaguagauauu

SEQ ID NO: 3483146 - RNA, 22 nt, Human
aaaguuuugaguagauauuacu

SEQ ID NO: 3483147 - RNA, 24 nt, Human
aaaguuuugaguagauauuacuuu

SEQ ID NO: 3483148 - RNA, 13 nt, Human
aaaguuuugccua

SEQ ID NO: 3483149 - RNA, 16 nt, Human
aaaguuuuguaaaaga

SEQ ID NO: 3483150 - RNA, 12 nt, Human
aaaguuuuguug

SEQ ID NO: 3483151 - RNA, 22 nt, Human
aaaguuuuuuauuaugcauuau

SEQ ID NO: 3483152 - RNA, 17 nt, Human
aaauaaaaaaaagaaaa

SEQ ID NO: 3483153 - RNA, 15 nt, Human
aaauaaaaaagaucc

SEQ ID NO: 3483154 - RNA, 14 nt, Human
aaauaaaaacuaaa

SEQ ID NO: 3483155 - RNA, 13 nt, Human
aaauaaaaagaaa

SEQ ID NO: 3483156 - RNA, 20 nt, Human
aaauaaaaagugacacagca

SEQ ID NO: 3483157 - RNA, 21 nt, Human
aaauaaaaagugacacagcag

SEQ ID NO: 3483158 - RNA, 19 nt, Human
aaauaaaaaguuaaaaagu

SEQ ID NO: 3483159 - RNA, 14 nt, Human
aaauaaaaauaaau

SEQ ID NO: 3483160 - RNA, 13 nt, Human
aaauaaaacaaag

SEQ ID NO: 3483161 - RNA, 15 nt, Human
aaauaaaacaaaggg

SEQ ID NO: 3483162 - RNA, 16 nt, Human
aaauaaaacauagcaa

SEQ ID NO: 3483163 - RNA, 23 nt, Human
aaauaaaacauuuuaaauggaca

SEQ ID NO: 3483164 - RNA, 12 nt, Human
aaauaaaacugu

SEQ ID NO: 3483165 - RNA, 19 nt, Human
aacaucuuuauugaaauuc

SEQ ID NO: 3483166 - RNA, 20 nt, Human
aacaucuuugacacucugca

SEQ ID NO: 3483167 - RNA, 22 nt, Human
aacaucuuugacacucugcaga

SEQ ID NO: 3483168 - RNA, 15 nt, Human
aacaucuuuucuugc

SEQ ID NO: 3483169 - RNA, 21 nt, Human
aacaucuuuuuaaccugcaaa

SEQ ID NO: 3483170 - RNA, 22 nt, Human
aacaugaagaccuuuuucugca

SEQ ID NO: 3483171 - RNA, 23 nt, Human
aacaugaagaccuuuuucugcac

SEQ ID NO: 3483172 - RNA, 20 nt, Human
aacaugaaucaaaagugccu

SEQ ID NO: 3483173 - RNA, 13 nt, Human
aacaugacacuga

SEQ ID NO: 3483174 - RNA, 14 nt, Human
aacaugacacugac

SEQ ID NO: 3483175 - RNA, 22 nt, Human
aacaugacauuuaccagcaacu

SEQ ID NO: 3483176 - RNA, 20 nt, Human
aacaugacucuuuauugucu

SEQ ID NO: 3483177 - RNA, 18 nt, Human
aacaugaggggacauuuu

SEQ ID NO: 3483178 - RNA, 21 nt, Human
aacaugaggggacauuuuggu

SEQ ID NO: 3483179 - RNA, 23 nt, Human
aacaugaguagauaauuucaggg

SEQ ID NO: 3483180 - RNA, 17 nt, Human
aacaugagucaagagca

SEQ ID NO: 3483181 - RNA, 22 nt, Human
aacaugcaauuuugcauuugaa

SEQ ID NO: 3483182 - RNA, 19 nt, Human
aacaugcacugauguugug

SEQ ID NO: 3483183 - RNA, 19 nt, Human
aacaugcagaacaaaugaa

SEQ ID NO: 3483184 - RNA, 11 nt, Human
aacaugcaguu

SEQ ID NO: 3483185 - RNA, 19 nt, Human
aacaugcaguuugaaauuc

SEQ ID NO: 3483186 - RNA, 13 nt, Human
aacaugcccccug

SEQ ID NO: 3483187 - RNA, 14 nt, Human
aacaugcccccugc

SEQ ID NO: 3483188 - RNA, 22 nt, Human
aacaugcuggugaauauuuuca

SEQ ID NO: 3483189 - RNA, 14 nt, Human
aacaugcuguguaa

SEQ ID NO: 3483190 - RNA, 19 nt, Human
aacaugcuguguaagcugu

SEQ ID NO: 3483191 - RNA, 21 nt, Human
aacaugcuguguaagcugugu

SEQ ID NO: 3483192 - RNA, 16 nt, Human
aacauggacuuguaua

SEQ ID NO: 3483193 - RNA, 19 nt, Human
aacauggagaaacccuguc

SEQ ID NO: 3483194 - RNA, 20 nt, Human
aacauggcuacuugcuuuga

SEQ ID NO: 3483195 - RNA, 18 nt, Human
aacauggugucuggauuc

SEQ ID NO: 3483196 - RNA, 20 nt, Human
aacaugguuuaaaagaaaaa

SEQ ID NO: 3483197 - RNA, 14 nt, Human
aacauguaauuaag

SEQ ID NO: 3483198 - RNA, 17 nt, Human
aacauguauaauauuuu

SEQ ID NO: 3483199 - RNA, 16 nt, Human
aacauguaugugcauu

SEQ ID NO: 3483200 - RNA, 16 nt, Human
aacauguauuuaugua

SEQ ID NO: 3483201 - RNA, 19 nt, Human
aacaugucuccuauccugg

SEQ ID NO: 3483202 - RNA, 15 nt, Human
aacauguuaaaccau

SEQ ID NO: 3483203 - RNA, 16 nt, Human
aacauguuaaaccaug

SEQ ID NO: 3483204 - RNA, 23 nt, Human
aacauguuaaaccaugggauaaa

SEQ ID NO: 3483205 - RNA, 19 nt, Human
aacauguugguauuuaucu

SEQ ID NO: 3483206 - RNA, 15 nt, Human
aacauguuuccagca

SEQ ID NO: 3483207 - RNA, 15 nt, Human
aacauuaaaugucuu

SEQ ID NO: 3483208 - RNA, 23 nt, Human
aacauuaaaugucuuauauagca

SEQ ID NO: 3483209 - RNA, 13 nt, Human
aacauuaagaaaa

SEQ ID NO: 3483210 - RNA, 19 nt, Human
aacauuaagaaaaucauau

SEQ ID NO: 3483211 - RNA, 21 nt, Human
aacauuaagauugaggccugc

SEQ ID NO: 3483212 - RNA, 19 nt, Human
aacauuaauguugauuucu

SEQ ID NO: 3483213 - RNA, 20 nt, Human
aacauuaauguugauuucua

SEQ ID NO: 3483214 - RNA, 17 nt, Human
aacauuaccuuacugug

SEQ ID NO: 3483215 - RNA, 19 nt, Human
aacauuaccuuacugugga

SEQ ID NO: 3483216 - RNA, 24 nt, Human
aacauuaguacuuuauagaagaau

SEQ ID NO: 3483217 - RNA, 21 nt, Human
aacauuauagauuuucauguu

SEQ ID NO: 3483218 - RNA, 17 nt, Human
aacauuauuacuuuucc

SEQ ID NO: 3483219 - RNA, 11 nt, Human
aacauuccaag

SEQ ID NO: 3483220 - RNA, 19 nt, Human
aacauuccucaugaaugua

SEQ ID NO: 3483221 - RNA, 18 nt, Human
aacauucuccuguggaag

SEQ ID NO: 3483222 - RNA, 21 nt, Human
aacauucuuuuaacuucuuuc

SEQ ID NO: 3483223 - RNA, 22 nt, Human
aacauugaccaagaacugcaug

SEQ ID NO: 3483224 - RNA, 20 nt, Human
aacauugagauuaugaugaa

SEQ ID NO: 3483225 - RNA, 15 nt, Human
aacauugcaauagaa

SEQ ID NO: 3483226 - RNA, 16 nt, Human
aacauugccuauuuca

SEQ ID NO: 3483227 - RNA, 18 nt, Human
aacauugccuuugaaugu

SEQ ID NO: 3483228 - RNA, 22 nt, Human
aacauugccuuugaauguuaau

SEQ ID NO: 3483229 - RNA, 15 nt, Human
aacauugcuuuuaaa

SEQ ID NO: 3483230 - RNA, 23 nt, Human
aacauuggaagcagguuaaaugu

SEQ ID NO: 3483231 - RNA, 15 nt, Human
aacauuggaauguuc

SEQ ID NO: 3483232 - RNA, 18 nt, Human
aacauugguucuuguauu

SEQ ID NO: 3483233 - RNA, 19 nt, Human
aacauugguucuuguauua

SEQ ID NO: 3483234 - RNA, 22 nt, Human
aacauugguucuuguauuaaga

SEQ ID NO: 3483235 - RNA, 12 nt, Human
aacauuguauua

SEQ ID NO: 3483236 - RNA, 15 nt, Human
aacauugugauguau

SEQ ID NO: 3483237 - RNA, 22 nt, Human
aacauugugauguauauuccuu

SEQ ID NO: 3483238 - RNA, 19 nt, Human
aacauuguugcucccugug

SEQ ID NO: 3483239 - RNA, 15 nt, Human
aacauuuauauguag

SEQ ID NO: 3483240 - RNA, 21 nt, Human
aacauuuauuuuaugagaaau

SEQ ID NO: 3483241 - RNA, 23 nt, Human
aacauuuauuuuaugagaaaugu

SEQ ID NO: 3483242 - RNA, 17 nt, Human
aacauuuauuuugacau

SEQ ID NO: 3483243 - RNA, 22 nt, Human
aacauuucaagggcaauaccgu

SEQ ID NO: 3483244 - RNA, 22 nt, Human
aacauuucuauagccaaaaaua

SEQ ID NO: 3483245 - RNA, 18 nt, Human
aacauuucuguaaauacc

SEQ ID NO: 3483246 - RNA, 20 nt, Human
aacauuucuguaaauaccau

SEQ ID NO: 3483247 - RNA, 12 nt, Human
aacauuugcugc

SEQ ID NO: 3483248 - RNA, 13 nt, Human
aacauuugcugcc

SEQ ID NO: 3483249 - RNA, 14 nt, Human
aacauuugcuguuu

SEQ ID NO: 3483250 - RNA, 18 nt, Human
aacauuugguaaggggaa

SEQ ID NO: 3483251 - RNA, 20 nt, Human
aacauuuguucuauagcuuu

SEQ ID NO: 3483252 - RNA, 22 nt, Human
aacauuuuaaaaacauagaaaa

SEQ ID NO: 3483253 - RNA, 19 nt, Human
aacauuuuaaauaaaagaa

SEQ ID NO: 3483254 - RNA, 13 nt, Human
aacauuuuaaaug

SEQ ID NO: 3483255 - RNA, 15 nt, Human
aacauuuuacccaca

SEQ ID NO: 3483256 - RNA, 17 nt, Human
aacauuuuacccacaca

SEQ ID NO: 3483257 - RNA, 13 nt, Human
aacauuuucacac

SEQ ID NO: 3483258 - RNA, 14 nt, Human
aacauuuucucuua

SEQ ID NO: 3483259 - RNA, 18 nt, Human
aacauuuucucuuagaaa

SEQ ID NO: 3483260 - RNA, 16 nt, Human
aacauuuucuggccag

SEQ ID NO: 3483261 - RNA, 16 nt, Human
aacauuuugagaacaa

SEQ ID NO: 3483262 - RNA, 14 nt, Human
aacauuuuguucuu

SEQ ID NO: 3483263 - RNA, 23 nt, Human
aacauuuuguucuuacacauaca

SEQ ID NO: 3483264 - RNA, 19 nt, Human
aacauuuuugauaaagccu

SEQ ID NO: 3483265 - RNA, 14 nt, Human
aaccaaaaagaaaa

SEQ ID NO: 3483266 - RNA, 19 nt, Human
aaccaaaaagaccagacua

SEQ ID NO: 3483267 - RNA, 21 nt, Human
aaccaaaagaacaagaauuuc

SEQ ID NO: 3483268 - RNA, 18 nt, Human
aaccaggagcugcucacu

SEQ ID NO: 3483269 - RNA, 22 nt, Human
aaccaggagcugcucacuaccu

SEQ ID NO: 3483270 - RNA, 18 nt, Human
aaccagggaagcuguccc

SEQ ID NO: 3483271 - RNA, 15 nt, Human
aaccagggagcugca

SEQ ID NO: 3483272 - RNA, 16 nt, Human
aaccagggauuguuuc

SEQ ID NO: 3483273 - RNA, 17 nt, Human
aaccagguccaaugagc

SEQ ID NO: 3483274 - RNA, 21 nt, Human
aaccagguuuagacaguauga

SEQ ID NO: 3483275 - RNA, 16 nt, Human
aaccaguauacaagau

SEQ ID NO: 3483276 - RNA, 14 nt, Human
aaccaguauuguac

SEQ ID NO: 3483277 - RNA, 20 nt, Human
aaccaguauuguacaaagua

SEQ ID NO: 3483278 - RNA, 21 nt, Human
aaccaguauuuuugcugcuuc

SEQ ID NO: 3483279 - RNA, 22 nt, Human
aaccagucugaaguuucauuua

SEQ ID NO: 3483280 - RNA, 17 nt, Human
aaccaguguuguggauu

SEQ ID NO: 3483281 - RNA, 14 nt, Human
aaccaguuauguga

SEQ ID NO: 3483282 - RNA, 23 nt, Human
aaccaguuggcuaggggagcagg

SEQ ID NO: 3483283 - RNA, 19 nt, Human
aaccaguuguggugugagu

SEQ ID NO: 3483284 - RNA, 21 nt, Human
aaccaguuguggugugaguau

SEQ ID NO: 3483285 - RNA, 13 nt, Human
aaccauaaacuuc

SEQ ID NO: 3483286 - RNA, 22 nt, Human
aaccauacaaaaauuccuuuuc

SEQ ID NO: 3483287 - RNA, 21 nt, Human
aaccauaccuuccuucccugg

SEQ ID NO: 3483288 - RNA, 12 nt, Human
aaccauaguuac

SEQ ID NO: 3483289 - RNA, 13 nt, Human
aaccauaugauac

SEQ ID NO: 3483290 - RNA, 14 nt, Human
aaccauauggauau

SEQ ID NO: 3483291 - RNA, 18 nt, Human
aaccaucauugaaaucuu

SEQ ID NO: 3483292 - RNA, 19 nt, Human
aaccaucauugaaaucuuu

SEQ ID NO: 3483293 - RNA, 21 nt, Human
aaccauccacuuacauauauu

SEQ ID NO: 3483294 - RNA, 14 nt, Human
aaccaucucccugg

SEQ ID NO: 3483295 - RNA, 20 nt, Human
aaccaucugucccugccuca

SEQ ID NO: 3483296 - RNA, 15 nt, Human
aaccaugaagacagg

SEQ ID NO: 3483297 - RNA, 21 nt, Human
aaccaugaagagauuuuucau

SEQ ID NO: 3483298 - RNA, 22 nt, Human
aaccaugagaccacuguuauca

SEQ ID NO: 3483299 - RNA, 23 nt, Human
aaccaugaguggcauggccacca

SEQ ID NO: 3483300 - RNA, 15 nt, Human
aaccauggacuuuau

SEQ ID NO: 3483301 - RNA, 20 nt, Human
aaccaugggauaaaugccau

SEQ ID NO: 3483302 - RNA, 20 nt, Human
aaccauguaaagaacauaaa

SEQ ID NO: 3483303 - RNA, 22 nt, Human
aaccauguagcagugagucaua

SEQ ID NO: 3483304 - RNA, 21 nt, Human
aaccaugucagcaaaaagcaa

SEQ ID NO: 3483305 - RNA, 23 nt, Human
aaccaugucagcaaaaagcaaaa

SEQ ID NO: 3483306 - RNA, 13 nt, Human
aaccauuaaaguc

SEQ ID NO: 3483307 - RNA, 14 nt, Human
aaccauuaaaguca

SEQ ID NO: 3483308 - RNA, 22 nt, Human
aaccuacuuucauacugaagau

SEQ ID NO: 3483309 - RNA, 14 nt, Human
aaccuagaagggcu

SEQ ID NO: 3483310 - RNA, 17 nt, Human
aaccuagggugauauua

SEQ ID NO: 3483311 - RNA, 17 nt, Human
aaccuaguacugccccc

SEQ ID NO: 3483312 - RNA, 21 nt, Human
aaccuaugaagcaauggauau

SEQ ID NO: 3483313 - RNA, 12 nt, Human
aaccuauuucuc

SEQ ID NO: 3483314 - RNA, 22 nt, Human
aaccuauuucuuaaacacuugc

SEQ ID NO: 3483315 - RNA, 23 nt, Human
aaccuauuuugaaaaauuccuau

SEQ ID NO: 3483316 - RNA, 16 nt, Human
aaccucaacugccuac

SEQ ID NO: 3483317 - RNA, 20 nt, Human
aaccucaccaacuccuaguu

SEQ ID NO: 3483318 - RNA, 12 nt, Human
aaccucaccccg

SEQ ID NO: 3483319 - RNA, 21 nt, Human
aaccucacccgaggcugccca

SEQ ID NO: 3483320 - RNA, 19 nt, Human
aaccucagacuuaccagga

SEQ ID NO: 3483321 - RNA, 14 nt, Human
aaccucagccuggc

SEQ ID NO: 3483322 - RNA, 15 nt, Human
aaccucagcucuggg

SEQ ID NO: 3483323 - RNA, 16 nt, Human
aaccucagcucuggga

SEQ ID NO: 3483324 - RNA, 21 nt, Human
aaccucagcucugggagagga

SEQ ID NO: 3483325 - RNA, 19 nt, Human
aaccucagugucauuuaug

SEQ ID NO: 3483326 - RNA, 20 nt, Human
aaccucauccuccuucuuca

SEQ ID NO: 3483327 - RNA, 22 nt, Human
aaccuccauucuauuuuagaau

SEQ ID NO: 3483328 - RNA, 15 nt, Human
aaccucccaacccag

SEQ ID NO: 3483329 - RNA, 12 nt, Human
aaccucccagag

SEQ ID NO: 3483330 - RNA, 15 nt, Human
aaccuccccagccug

SEQ ID NO: 3483331 - RNA, 14 nt, Human
aaccucccucuugu

SEQ ID NO: 3483332 - RNA, 14 nt, Human
aaccuccucuguga

SEQ ID NO: 3483333 - RNA, 13 nt, Human
aaccuccuggaca

SEQ ID NO: 3483334 - RNA, 19 nt, Human
aaccucgaguacugugggc

SEQ ID NO: 3483335 - RNA, 16 nt, Human
aaccucgggccugcug

SEQ ID NO: 3483336 - RNA, 20 nt, Human
aaccucuaauuuauuuuguc

SEQ ID NO: 3483337 - RNA, 18 nt, Human
aaccucuagaauuuuaag

SEQ ID NO: 3483338 - RNA, 14 nt, Human
aaccucugucucau

SEQ ID NO: 3483339 - RNA, 16 nt, Human
aaccucugucucaucc

SEQ ID NO: 3483340 - RNA, 12 nt, Human
aaccucuguuca

SEQ ID NO: 3483341 - RNA, 18 nt, Human
aaccucuucagaggcccu

SEQ ID NO: 3483342 - RNA, 12 nt, Human
aaccucuucccc

SEQ ID NO: 3483343 - RNA, 12 nt, Human
aaccucuuccuc

SEQ ID NO: 3483344 - RNA, 18 nt, Human
aaccucuuuucugcauca

SEQ ID NO: 3483345 - RNA, 21 nt, Human
aaccugaaaaaaaguuuacaa

SEQ ID NO: 3483346 - RNA, 15 nt, Human
aaccugaaccuagga

SEQ ID NO: 3483347 - RNA, 16 nt, Human
aaccugaccccugcuc

SEQ ID NO: 3483348 - RNA, 20 nt, Human
aaccugaccgugggcggggc

SEQ ID NO: 3483349 - RNA, 17 nt, Human
aaccugacguagcugca

SEQ ID NO: 3483350 - RNA, 14 nt, Human
aaccugagauuuau

SEQ ID NO: 3483351 - RNA, 15 nt, Human
aaccugagauuuauu

SEQ ID NO: 3483352 - RNA, 22 nt, Human
aaccugagauuuauuaaagaaa

SEQ ID NO: 3483353 - RNA, 20 nt, Human
aaccugaugaaaauaaagaa

SEQ ID NO: 3483354 - RNA, 15 nt, Human
aaccugaugcugacu

SEQ ID NO: 3483355 - RNA, 18 nt, Human
aaccugauguuaaaauuc

SEQ ID NO: 3483356 - RNA, 19 nt, Human
aaccugauugugucucuug

SEQ ID NO: 3483357 - RNA, 21 nt, Human
aaccugcaaaaaauacuuuuu

SEQ ID NO: 3483358 - RNA, 19 nt, Human
aaccugcaagggcucccca

SEQ ID NO: 3483359 - RNA, 19 nt, Human
aaccugccagggagacaga

SEQ ID NO: 3483360 - RNA, 15 nt, Human
aaccugcccugccug

SEQ ID NO: 3483361 - RNA, 19 nt, Human
aaccugccugacauuugga

SEQ ID NO: 3483362 - RNA, 14 nt, Human
aaccugcucuccuc

SEQ ID NO: 3483363 - RNA, 23 nt, Human
aaccugcuuggguggagaagcca

SEQ ID NO: 3483364 - RNA, 17 nt, Human
aaccuggaccaaagcug

SEQ ID NO: 3483365 - RNA, 18 nt, Human
aaccuggaccaaagcuga

SEQ ID NO: 3483366 - RNA, 10 nt, Human
aaccuggaga

SEQ ID NO: 3483367 - RNA, 20 nt, Human
aaccuggaggggcuagaacc

SEQ ID NO: 3483368 - RNA, 19 nt, Human
aaccuggaggucaauguua

SEQ ID NO: 3483369 - RNA, 16 nt, Human
aaccugggaaagagau

SEQ ID NO: 3483370 - RNA, 20 nt, Human
aaccugggauucaggaaugu

SEQ ID NO: 3483371 - RNA, 17 nt, Human
aaccuguaaauuauuuu

SEQ ID NO: 3483372 - RNA, 18 nt, Human
aaccuguaauaaauauga

SEQ ID NO: 3483373 - RNA, 23 nt, Human
aaccuguacuucaaguuaaagug

SEQ ID NO: 3483374 - RNA, 22 nt, Human
aaccuguagaaucaauuuaagu

SEQ ID NO: 3483375 - RNA, 22 nt, Human
aaccuguauaaguggaggcacu

SEQ ID NO: 3483376 - RNA, 13 nt, Human
aaccuguaucuuu

SEQ ID NO: 3483377 - RNA, 14 nt, Human
aaccugucuuuugg

SEQ ID NO: 3483378 - RNA, 16 nt, Human
aaccugucuuuuggga

SEQ ID NO: 3483379 - RNA, 22 nt, Human
aaccugugaccagucugacccu

SEQ ID NO: 3483380 - RNA, 12 nt, Human
aaccugugucug

SEQ ID NO: 3483381 - RNA, 15 nt, Human
aaccugugucugcga

SEQ ID NO: 3483382 - RNA, 21 nt, Human
aaccugugucugcgaaguccu

SEQ ID NO: 3483383 - RNA, 22 nt, Human
aaccugugucugcgaaguccua

SEQ ID NO: 3483384 - RNA, 21 nt, Human
aaccuguuaccuacuuugacu

SEQ ID NO: 3483385 - RNA, 17 nt, Human
aaccuguucugcuuucc

SEQ ID NO: 3483386 - RNA, 19 nt, Human
aaccuguuuaaauauuuca

SEQ ID NO: 3483387 - RNA, 18 nt, Human
aaccuguuuuuuuuucau

SEQ ID NO: 3483388 - RNA, 12 nt, Human
aaccuuaaguaa

SEQ ID NO: 3483389 - RNA, 17 nt, Human
aaccuuauccugcauug

SEQ ID NO: 3483390 - RNA, 22 nt, Human
aaccuuaucuccacaaccucuu

SEQ ID NO: 3483391 - RNA, 18 nt, Human
aaccuuauuguaccucuc

SEQ ID NO: 3483392 - RNA, 19 nt, Human
aaccuuauuguaccucucu

SEQ ID NO: 3483393 - RNA, 13 nt, Human
aaccuuccaccca

SEQ ID NO: 3483394 - RNA, 15 nt, Human
aaccuuccacccagu

SEQ ID NO: 3483395 - RNA, 21 nt, Human
aaccuucgccaccuggguucc

SEQ ID NO: 3483396 - RNA, 17 nt, Human
aaccuucuggccuccca

SEQ ID NO: 3483397 - RNA, 17 nt, Human
aaccuugaaaaaaaaca

SEQ ID NO: 3483398 - RNA, 15 nt, Human
aaccuugaaugcugc

SEQ ID NO: 3483399 - RNA, 19 nt, Human
aaccuugaaugcugccagu

SEQ ID NO: 3483400 - RNA, 16 nt, Human
aaccuugagacagcuu

SEQ ID NO: 3483401 - RNA, 11 nt, Human
aaccuugcugu

SEQ ID NO: 3483402 - RNA, 16 nt, Human
aaccuugcuguccuga

SEQ ID NO: 3483403 - RNA, 21 nt, Human
aaccuuggguuagaccuacag

SEQ ID NO: 3483404 - RNA, 20 nt, Human
aaccuugguguaguugaacu

SEQ ID NO: 3483405 - RNA, 21 nt, Human
aaccuugguguaguugaacug

SEQ ID NO: 3483406 - RNA, 19 nt, Human
aaccuuguauaaauuauuc

SEQ ID NO: 3483407 - RNA, 23 nt, Human
aaccuugucucuaugccagcuca

SEQ ID NO: 3483408 - RNA, 18 nt, Human
aaccuuguuauuucucag

SEQ ID NO: 3483409 - RNA, 19 nt, Human
aaccuuguuuauuaaauug

SEQ ID NO: 3483410 - RNA, 14 nt, Human
aaccuuuaagaaaa

SEQ ID NO: 3483411 - RNA, 23 nt, Human
aaccuuuaagaaaagcccugaga

SEQ ID NO: 3483412 - RNA, 19 nt, Human
aaccuuuagggcagcuugc

SEQ ID NO: 3483413 - RNA, 15 nt, Human
aaccuuuauucuuuu

SEQ ID NO: 3483414 - RNA, 14 nt, Human
aaccuuucaaauuu

SEQ ID NO: 3483415 - RNA, 20 nt, Human
aaccuuucaccuuuguguau

SEQ ID NO: 3483416 - RNA, 13 nt, Human
aaccuuucccuca

SEQ ID NO: 3483417 - RNA, 15 nt, Human
aaccuuucccucacc

SEQ ID NO: 3483418 - RNA, 18 nt, Human
aaccuuucccucaccccc

SEQ ID NO: 3483419 - RNA, 19 nt, Human
aaccuuucccucacccccu

SEQ ID NO: 3483420 - RNA, 13 nt, Human
aaccuuuuacugg

SEQ ID NO: 3483421 - RNA, 22 nt, Human
aaccuuuucuuguaucuggauu

SEQ ID NO: 3483422 - RNA, 16 nt, Human
aaccuuuugagugccu

SEQ ID NO: 3483423 - RNA, 16 nt, Human
aaccuuuuuccuagua

SEQ ID NO: 3483424 - RNA, 23 nt, Human
aaccuuuuuuaagauuuuucuca

SEQ ID NO: 3483425 - RNA, 15 nt, Human
aacgaaacugcucua

SEQ ID NO: 3483426 - RNA, 13 nt, Human
aacgaaagcuggg

SEQ ID NO: 3483427 - RNA, 15 nt, Human
aacgaaccuuggccu

SEQ ID NO: 3483428 - RNA, 16 nt, Human
aacgaagaguucccuu

SEQ ID NO: 3483429 - RNA, 23 nt, Human
aacgacaaagccaaacucugcca

SEQ ID NO: 3483430 - RNA, 16 nt, Human
aacgagacuuuccauu

SEQ ID NO: 3483431 - RNA, 16 nt, Human
aacgagucaauccccu

SEQ ID NO: 3483432 - RNA, 16 nt, Human
aacccuagccuugcuu

SEQ ID NO: 3483433 - RNA, 20 nt, Human
aacccuagguucccgguccc

SEQ ID NO: 3483434 - RNA, 17 nt, Human
aacccuagguucccugu

SEQ ID NO: 3483435 - RNA, 19 nt, Human
aacccuaucuccugacaga

SEQ ID NO: 3483436 - RNA, 12 nt, Human
aacccucagagc

SEQ ID NO: 3483437 - RNA, 11 nt, Human
aacccucaggg

SEQ ID NO: 3483438 - RNA, 20 nt, Human
aacccucagggcaaagccag

SEQ ID NO: 3483439 - RNA, 23 nt, Human
aacccucaggggaaaacuguuac

SEQ ID NO: 3483440 - RNA, 13 nt, Human
aacccucccucag

SEQ ID NO: 3483441 - RNA, 17 nt, Human
aacccucccucagcccc

SEQ ID NO: 3483442 - RNA, 15 nt, Human
aacccucguuucuga

SEQ ID NO: 3483443 - RNA, 17 nt, Human
aacccugcaaaggacug

SEQ ID NO: 3483444 - RNA, 13 nt, Human
aacccugccaugg

SEQ ID NO: 3483445 - RNA, 14 nt, Human
aacccugccccugc

SEQ ID NO: 3483446 - RNA, 19 nt, Human
aacccugccgucaccacca

SEQ ID NO: 3483447 - RNA, 22 nt, Human
aacccugccgucaccaccaccc

SEQ ID NO: 3483448 - RNA, 21 nt, Human
aacccuggggaaggagccagu

SEQ ID NO: 3483449 - RNA, 12 nt, Human
aacccugugcug

SEQ ID NO: 3483450 - RNA, 16 nt, Human
aacccuguuacaaagc

SEQ ID NO: 3483451 - RNA, 15 nt, Human
aacccuguuuuauac

SEQ ID NO: 3483452 - RNA, 23 nt, Human
aacccuguuuuauacuguacuua

SEQ ID NO: 3483453 - RNA, 19 nt, Human
aacuuuuauaaacuuuacc

SEQ ID NO: 3483454 - RNA, 18 nt, Human
aacuuuuauaaauuaaau

SEQ ID NO: 3483455 - RNA, 19 nt, Human
aacuuuuauaaauuaaaua

SEQ ID NO: 3483456 - RNA, 17 nt, Human
aacuuuucaaugacauu

SEQ ID NO: 3483457 - RNA, 21 nt, Human
aacuuuuguaagacaaagguu

SEQ ID NO: 3483458 - RNA, 17 nt, Human
aacuuuuguacugaauu

SEQ ID NO: 3483459 - RNA, 20 nt, Human
aacuuuuguguaaugaaaau

SEQ ID NO: 3483460 - RNA, 20 nt, Human
aacuuuuuauugauuuuugg

SEQ ID NO: 3483461 - RNA, 16 nt, Human
aacuuuuuauugccuu

SEQ ID NO: 3483462 - RNA, 20 nt, Human
aacuuuuuauugccuucuca

SEQ ID NO: 3483463 - RNA, 15 nt, Human
aacuuuuuguucugg

SEQ ID NO: 3483464 - RNA, 14 nt, Human
aacuuuuuuaaaua

SEQ ID NO: 3483465 - RNA, 16 nt, Human
aacuuuuuuaaauaaa

SEQ ID NO: 3483466 - RNA, 18 nt, Human
aacuuuuuuaaauaaacu

SEQ ID NO: 3483467 - RNA, 20 nt, Human
aacuuuuuuaaauaaacuuu

SEQ ID NO: 3483468 - RNA, 16 nt, Human
aacuuuuuuucaaugu

SEQ ID NO: 3483469 - RNA, 17 nt, Human
aacuuuuuuuucuuuuu

SEQ ID NO: 3483470 - RNA, 18 nt, Human
aacuuuuuuuucuuuuuu

SEQ ID NO: 3483471 - RNA, 23 nt, Human
aacuuuuuuuuuucuuuauaaga

SEQ ID NO: 3483472 - RNA, 17 nt, Human
aagaaaaaaaaaagaag

SEQ ID NO: 3483473 - RNA, 22 nt, Human
aagaaaaaaaaaagaagaagaa

SEQ ID NO: 3483474 - RNA, 16 nt, Human
aagaaaaaaaaaauau

SEQ ID NO: 3483475 - RNA, 14 nt, Human
aagaaaaaaaaaga

SEQ ID NO: 3483476 - RNA, 19 nt, Human
aagaaaaaaaaagaaaaaa

SEQ ID NO: 3483477 - RNA, 18 nt, Human
aagaaaaaaaaaugccau

SEQ ID NO: 3483478 - RNA, 14 nt, Human
aagaaaaaaauacu

SEQ ID NO: 3483479 - RNA, 20 nt, Human
aagaaaaaaauugaaaugua

SEQ ID NO: 3483480 - RNA, 15 nt, Human
aagaaaaaagaaugu

SEQ ID NO: 3483481 - RNA, 20 nt, Human
aagaaaaaagagaaaagaaa

SEQ ID NO: 3483482 - RNA, 11 nt, Human
aagaaaaaagu

SEQ ID NO: 3483483 - RNA, 14 nt, Human
aagaaaaaauacau

SEQ ID NO: 3483484 - RNA, 15 nt, Human
aagaaaaagaagcaa

SEQ ID NO: 3483485 - RNA, 15 nt, Human
aagaaaaaggaugca

SEQ ID NO: 3483486 - RNA, 18 nt, Human
aagaaaaaggaugcacag

SEQ ID NO: 3483487 - RNA, 20 nt, Human
aagaaaaagucauccaaucu

SEQ ID NO: 3483488 - RNA, 18 nt, Human
aacaauaggcuguuccca

SEQ ID NO: 3483489 - RNA, 18 nt, Human
aacaauaucauaucauca

SEQ ID NO: 3483490 - RNA, 16 nt, Human
aacaauauuguuucua

SEQ ID NO: 3483491 - RNA, 12 nt, Human
aacaauauuuau

SEQ ID NO: 3483492 - RNA, 15 nt, Human
aacaaugaaguugaa

SEQ ID NO: 3483493 - RNA, 20 nt, Human
aacaaugacacuagaaaacu

SEQ ID NO: 3483494 - RNA, 16 nt, Human
aacaaugcgaauggua

SEQ ID NO: 3483495 - RNA, 14 nt, Human
aacaaugcuguauu

SEQ ID NO: 3483496 - RNA, 17 nt, Human
aacaauggaagauuugc

SEQ ID NO: 3483497 - RNA, 15 nt, Human
aacaauggaguauuc

SEQ ID NO: 3483498 - RNA, 11 nt, Human
aacaauguuaa

SEQ ID NO: 3483499 - RNA, 22 nt, Human
aacaauguuaaggaaacucuua

SEQ ID NO: 3483500 - RNA, 15 nt, Human
aacaauuaauugucu

SEQ ID NO: 3483501 - RNA, 17 nt, Human
aacaauugguaaaacuc

SEQ ID NO: 3483502 - RNA, 23 nt, Human
aacaauugguaaaacucacugug

SEQ ID NO: 3483503 - RNA, 24 nt, Human
aacaauugguaaaacucacuguga

SEQ ID NO: 3483504 - RNA, 19 nt, Human
aacaauuuaaaaaugagug

SEQ ID NO: 3483505 - RNA, 16 nt, Human
aacaauuuaugaauug

SEQ ID NO: 3483506 - RNA, 21 nt, Human
aacaauuuccuuuauauuuag

SEQ ID NO: 3483507 - RNA, 22 nt, Human
aacaauuuccuuuauauuuagu

SEQ ID NO: 3483508 - RNA, 18 nt, Human
aacaauuuggcaauuuug

SEQ ID NO: 3483509 - RNA, 19 nt, Human
aacaauuuggcaauuuugu

SEQ ID NO: 3483510 - RNA, 20 nt, Human
aacaauuugggcuuccuguu

SEQ ID NO: 3483511 - RNA, 17 nt, Human
aacaauuuucagauuug

SEQ ID NO: 3483512 - RNA, 18 nt, Human
aacaauuuucagauuugc

SEQ ID NO: 3483513 - RNA, 19 nt, Human
aacaauuuucagauuugca

SEQ ID NO: 3483514 - RNA, 15 nt, Human
aacacaaaccacaac

SEQ ID NO: 3483515 - RNA, 17 nt, Human
aacacaaacccccacuc

SEQ ID NO: 3483516 - RNA, 15 nt, Human
aacacaaacuguaaa

SEQ ID NO: 3483517 - RNA, 16 nt, Human
aacacaaacuguaaau

SEQ ID NO: 3483518 - RNA, 19 nt, Human
aacacaaacuguaaauaaa

SEQ ID NO: 3483519 - RNA, 19 nt, Human
aacacaaagcggggggagg

SEQ ID NO: 3483520 - RNA, 21 nt, Human
aacacaaagcuuuugcauauu

SEQ ID NO: 3483521 - RNA, 20 nt, Human
aacacaaaugcagggauugc

SEQ ID NO: 3483522 - RNA, 16 nt, Human
aacacaacuauauugu

SEQ ID NO: 3483523 - RNA, 23 nt, Human
aacacaagauugguguuuuuuuc

SEQ ID NO: 3483524 - RNA, 16 nt, Human
aacacaagccacagaa

SEQ ID NO: 3483525 - RNA, 17 nt, Human
aacacaauguuauucgu

SEQ ID NO: 3483526 - RNA, 14 nt, Human
aacacacacaaaag

SEQ ID NO: 3483527 - RNA, 17 nt, Human
aacacacacauauacac

SEQ ID NO: 3483528 - RNA, 22 nt, Human
aacacacagaaggggacugcca

SEQ ID NO: 3483529 - RNA, 18 nt, Human
aacacacauaaaggauaa

SEQ ID NO: 3483530 - RNA, 18 nt, Human
aacacacuguuguuuagu

SEQ ID NO: 3483531 - RNA, 19 nt, Human
aacacagaaaccuuuuuaa

SEQ ID NO: 3483532 - RNA, 19 nt, Human
aacacagacauucugccag

SEQ ID NO: 3483533 - RNA, 18 nt, Human
aacacagcaauuccucag

SEQ ID NO: 3483534 - RNA, 19 nt, Human
aacacagcaguucugcaga

SEQ ID NO: 3483535 - RNA, 14 nt, Human
aacacagccugggc

SEQ ID NO: 3483536 - RNA, 19 nt, Human
aacacagcugagagacuuu

SEQ ID NO: 3483537 - RNA, 11 nt, Human
aacacagcugu

SEQ ID NO: 3483538 - RNA, 24 nt, Human
aacacagcuguucuucuguucugc

SEQ ID NO: 3483539 - RNA, 16 nt, Human
aacacaggccacccug

SEQ ID NO: 3483540 - RNA, 14 nt, Human
aacacaguauuuuc

SEQ ID NO: 3483541 - RNA, 16 nt, Human
aacacagucaaaauaa

SEQ ID NO: 3483542 - RNA, 19 nt, Human
aacacaguguuuuuguaaa

SEQ ID NO: 3483543 - RNA, 17 nt, Human
aacacauaauuaacacu

SEQ ID NO: 3483544 - RNA, 16 nt, Human
aacacaucacagauga

SEQ ID NO: 3483545 - RNA, 21 nt, Human
aacacauggggaaaaaaauca

SEQ ID NO: 3483546 - RNA, 20 nt, Human
aacacauuaaagguacuuug

SEQ ID NO: 3483547 - RNA, 16 nt, Human
aacacauuguuauuuu

SEQ ID NO: 3483548 - RNA, 20 nt, Human
aacacauuguuauuuucagu

SEQ ID NO: 3483549 - RNA, 20 nt, Human
aacacauuugauucugugug

SEQ ID NO: 3483550 - RNA, 20 nt, Human
aacacauuuugguucuucuc

SEQ ID NO: 3483551 - RNA, 15 nt, Human
aacacauuuuguaua

SEQ ID NO: 3483552 - RNA, 19 nt, Human
aacacauuuuguauaauug

SEQ ID NO: 3483553 - RNA, 15 nt, Human
aacaccaacauaaaa

SEQ ID NO: 3483554 - RNA, 19 nt, Human
aacaccaagcacagcagcc

SEQ ID NO: 3483555 - RNA, 15 nt, Human
aacaccagccccugc

SEQ ID NO: 3483556 - RNA, 18 nt, Human
aacaccagccccugcccc

SEQ ID NO: 3483557 - RNA, 19 nt, Human
aacaccagccccugcccca

SEQ ID NO: 3483558 - RNA, 23 nt, Human
aacaccagccccugccccagccc

SEQ ID NO: 3483559 - RNA, 15 nt, Human
aacaccauugaaggc

SEQ ID NO: 3483560 - RNA, 21 nt, Human
aacacccaugaaucaaagaca

SEQ ID NO: 3483561 - RNA, 17 nt, Human
aacacccauuuuuccuu

SEQ ID NO: 3483562 - RNA, 13 nt, Human
aacaccccucagu

SEQ ID NO: 3483563 - RNA, 17 nt, Human
aacacccucacacuggg

SEQ ID NO: 3483564 - RNA, 13 nt, Human
aacacccuuagaa

SEQ ID NO: 3483565 - RNA, 15 nt, Human
aacacccuuagaaaa

SEQ ID NO: 3483566 - RNA, 21 nt, Human
aacaccucacaccucacucuu

SEQ ID NO: 3483567 - RNA, 13 nt, Human
aacaccucccagg

SEQ ID NO: 3483568 - RNA, 19 nt, Human
aacaccucugcacaagcug

SEQ ID NO: 3483569 - RNA, 13 nt, Human
aacaccugaugug

SEQ ID NO: 3483570 - RNA, 22 nt, Human
aacaccuucagaggcugaggug

SEQ ID NO: 3483571 - RNA, 19 nt, Human
aacaccuucuuauuauaua

SEQ ID NO: 3483572 - RNA, 21 nt, Human
aacaccuucuuauuauauaua

SEQ ID NO: 3483573 - RNA, 22 nt, Human
aacaccuucuuauuauauauau

SEQ ID NO: 3483574 - RNA, 15 nt, Human
aacacgagcaggcua

SEQ ID NO: 3483575 - RNA, 13 nt, Human
aacacgcaggagc

SEQ ID NO: 3483576 - RNA, 14 nt, Human
aacacgcaggagca

SEQ ID NO: 3483577 - RNA, 19 nt, Human
aacacgcauggucaacccu

SEQ ID NO: 3483578 - RNA, 16 nt, Human
aacacgcguauuuaca

SEQ ID NO: 3483579 - RNA, 16 nt, Human
aacacgugaugugaua

SEQ ID NO: 3483580 - RNA, 13 nt, Human
aacacguuuuaag

SEQ ID NO: 3483581 - RNA, 19 nt, Human
aacacuaaacagacuauuu

SEQ ID NO: 3483582 - RNA, 15 nt, Human
aacacuaaauguuaa

SEQ ID NO: 3483583 - RNA, 17 nt, Human
aacacuaacucaccagc

SEQ ID NO: 3483584 - RNA, 18 nt, Human
aacacuaacucaccagcc

SEQ ID NO: 3483585 - RNA, 14 nt, Human
aacacuaauauauu

SEQ ID NO: 3483586 - RNA, 20 nt, Human
aacacuaauauauuuaaaaa

SEQ ID NO: 3483587 - RNA, 14 nt, Human
aacacuaauucaua

SEQ ID NO: 3483588 - RNA, 15 nt, Human
aacacuaauucauaa

SEQ ID NO: 3483589 - RNA, 18 nt, Human
aacacuagacaagccaga

SEQ ID NO: 3483590 - RNA, 19 nt, Human
aacacuagacaagccagaa

SEQ ID NO: 3483591 - RNA, 14 nt, Human
aacacuagccagac

SEQ ID NO: 3483592 - RNA, 13 nt, Human
aacacuauuuuau

SEQ ID NO: 3483593 - RNA, 15 nt, Human
aacacuauuuucaga

SEQ ID NO: 3483594 - RNA, 17 nt, Human
aacacuauuuucagaau

SEQ ID NO: 3483595 - RNA, 17 nt, Human
aacacucagaagccugg

SEQ ID NO: 3483596 - RNA, 20 nt, Human
aacacucagaagccuggggg

SEQ ID NO: 3483597 - RNA, 22 nt, Human
aagaacaugcaguuugaaauuc

SEQ ID NO: 3483598 - RNA, 22 nt, Human
aagaacauggacuuguauauuu

SEQ ID NO: 3483599 - RNA, 22 nt, Human
aagaaccaaaaguuuuccugag

SEQ ID NO: 3483600 - RNA, 16 nt, Human
aagaaccaaagaagaa

SEQ ID NO: 3483601 - RNA, 15 nt, Human
aagaaccccucugcu

SEQ ID NO: 3483602 - RNA, 17 nt, Human
aagaaccccucugcuuu

SEQ ID NO: 3483603 - RNA, 14 nt, Human
aagaaccuggaacu

SEQ ID NO: 3483604 - RNA, 21 nt, Human
aagaacggggcucuucucauu

SEQ ID NO: 3483605 - RNA, 23 nt, Human
aagaacggggcucuucucauuuc

SEQ ID NO: 3483606 - RNA, 20 nt, Human
aagaacuacaaacaaaauuu

SEQ ID NO: 3483607 - RNA, 19 nt, Human
aagaacugaaaacauaaaa

SEQ ID NO: 3483608 - RNA, 17 nt, Human
aagaacugcacaugaag

SEQ ID NO: 3483609 - RNA, 23 nt, Human
aagaacugcaggcccuggccucc

SEQ ID NO: 3483610 - RNA, 11 nt, Human
aagaacugcau

SEQ ID NO: 3483611 - RNA, 13 nt, Human
aagaacugcaugg

SEQ ID NO: 3483612 - RNA, 20 nt, Human
aagaacuuacugauuauuuu

SEQ ID NO: 3483613 - RNA, 12 nt, Human
aagaacuuguuu

SEQ ID NO: 3483614 - RNA, 17 nt, Human
aagaacuuuaaauugug

SEQ ID NO: 3483615 - RNA, 13 nt, Human
aagaacuuugagc

SEQ ID NO: 3483616 - RNA, 12 nt, Human
aagaagaaaaag

SEQ ID NO: 3483617 - RNA, 15 nt, Human
aagaagaaaagagaa

SEQ ID NO: 3483618 - RNA, 21 nt, Human
aagaagaaaauugcugugccu

SEQ ID NO: 3483619 - RNA, 21 nt, Human
aagaagaacucaccaggguuu

SEQ ID NO: 3483620 - RNA, 13 nt, Human
aagaagaaguuca

SEQ ID NO: 3483621 - RNA, 13 nt, Human
aagaagaaugugu

SEQ ID NO: 3483622 - RNA, 15 nt, Human
aagaagacaaacuuu

SEQ ID NO: 3483623 - RNA, 12 nt, Human
aagaagacauga

SEQ ID NO: 3483624 - RNA, 13 nt, Human
aagaagacauguu

SEQ ID NO: 3483625 - RNA, 20 nt, Human
aagaagacugcauuauauuu

SEQ ID NO: 3483626 - RNA, 13 nt, Human
aagaagacuuuuu

SEQ ID NO: 3483627 - RNA, 16 nt, Human
aagaagagaagcugcu

SEQ ID NO: 3483628 - RNA, 14 nt, Human
aagaagagccacag

SEQ ID NO: 3483629 - RNA, 15 nt, Human
aagaagagccacagu

SEQ ID NO: 3483630 - RNA, 14 nt, Human
aagaagaugaaugg

SEQ ID NO: 3483631 - RNA, 18 nt, Human
aagaagaugaauggcguc

SEQ ID NO: 3483632 - RNA, 17 nt, Human
aagaagaugacuuccca

SEQ ID NO: 3483633 - RNA, 22 nt, Human
aagaagaugaucaguggacagu

SEQ ID NO: 3483634 - RNA, 17 nt, Human
aagaagcccaggaaagg

SEQ ID NO: 3483635 - RNA, 16 nt, Human
aagaagcccccagcua

SEQ ID NO: 3483636 - RNA, 19 nt, Human
aagaagcccccagcuaaga

SEQ ID NO: 3483637 - RNA, 17 nt, Human
aagaagcccggcuccug

SEQ ID NO: 3483638 - RNA, 24 nt, Human
aagaagcccggcuccuggucaccu

SEQ ID NO: 3483639 - RNA, 15 nt, Human
aagaagcucucuccu

SEQ ID NO: 3483640 - RNA, 16 nt, Human
aagaagcuguuguaca

SEQ ID NO: 3483641 - RNA, 22 nt, Human
aagaagcuguuguacauuuaug

SEQ ID NO: 3483642 - RNA, 16 nt, Human
aagaagcuuaggcagg

SEQ ID NO: 3483643 - RNA, 19 nt, Human
aagaagcuucuaauaaauu

SEQ ID NO: 3483644 - RNA, 16 nt, Human
aagaagcuuuauuucu

SEQ ID NO: 3483645 - RNA, 20 nt, Human
aagaaggaaaugaauuucuc

SEQ ID NO: 3483646 - RNA, 14 nt, Human
aagaaggaugaugu

SEQ ID NO: 3483647 - RNA, 17 nt, Human
aagaaggaugaugucuu

SEQ ID NO: 3483648 - RNA, 23 nt, Human
aagaaggcaucgucaugcacagu

SEQ ID NO: 3483649 - RNA, 11 nt, Human
aagaagggcug

SEQ ID NO: 3483650 - RNA, 21 nt, Human
aagaagggcugcaugauguuu

SEQ ID NO: 3483651 - RNA, 16 nt, Human
aagaagggcugguauu

SEQ ID NO: 3483652 - RNA, 14 nt, Human
aagaaggugaauag

SEQ ID NO: 3483653 - RNA, 20 nt, Human
aagaagguggaccuuuuaaa

SEQ ID NO: 3483654 - RNA, 15 nt, Human
aacagaacagcuuca

SEQ ID NO: 3483655 - RNA, 12 nt, Human
aacagaacaggg

SEQ ID NO: 3483656 - RNA, 18 nt, Human
aacagaacauagacagaa

SEQ ID NO: 3483657 - RNA, 15 nt, Human
aacagaagcauuugu

SEQ ID NO: 3483658 - RNA, 22 nt, Human
aacagaagcucuuacucuuucc

SEQ ID NO: 3483659 - RNA, 14 nt, Human
aacagaagcuucca

SEQ ID NO: 3483660 - RNA, 13 nt, Human
aacagaaggauga

SEQ ID NO: 3483661 - RNA, 18 nt, Human
aacagaagggagggcaga

SEQ ID NO: 3483662 - RNA, 21 nt, Human
aacagaagggagggcagagcu

SEQ ID NO: 3483663 - RNA, 22 nt, Human
aacagaagggagggcagagcug

SEQ ID NO: 3483664 - RNA, 23 nt, Human
aacagaauacuguuaaaggaaaa

SEQ ID NO: 3483665 - RNA, 12 nt, Human
aacagaaugaaa

SEQ ID NO: 3483666 - RNA, 21 nt, Human
aacagacaaaaacagccucac

SEQ ID NO: 3483667 - RNA, 18 nt, Human
aacagacaacagaaguca

SEQ ID NO: 3483668 - RNA, 11 nt, Human
aacagacaagu

SEQ ID NO: 3483669 - RNA, 21 nt, Human
aacagacaauaugugagugcc

SEQ ID NO: 3483670 - RNA, 13 nt, Human
aacagacauuguu

SEQ ID NO: 3483671 - RNA, 14 nt, Human
aacagacauuguuu

SEQ ID NO: 3483672 - RNA, 18 nt, Human
aacagacccccucuagaa

SEQ ID NO: 3483673 - RNA, 19 nt, Human
aacagacccccucuagaaa

SEQ ID NO: 3483674 - RNA, 13 nt, Human
aacagacuauuua

SEQ ID NO: 3483675 - RNA, 17 nt, Human
aacagacuauuuaacuu

SEQ ID NO: 3483676 - RNA, 20 nt, Human
aacagacuauuuaacuugag

SEQ ID NO: 3483677 - RNA, 19 nt, Human
aacagacuggaagcacagc

SEQ ID NO: 3483678 - RNA, 20 nt, Human
aacagacuggaagcacagcu

SEQ ID NO: 3483679 - RNA, 19 nt, Human
aacagagacaggcccaaga

SEQ ID NO: 3483680 - RNA, 12 nt, Human
aacagaggacca

SEQ ID NO: 3483681 - RNA, 18 nt, Human
aacagaggaccagcacac

SEQ ID NO: 3483682 - RNA, 20 nt, Human
aacagaggaccagcacacuc

SEQ ID NO: 3483683 - RNA, 17 nt, Human
aacagaggccauggcag

SEQ ID NO: 3483684 - RNA, 14 nt, Human
aacagauaaagauu

SEQ ID NO: 3483685 - RNA, 18 nt, Human
aacagauaagcaagagag

SEQ ID NO: 3483686 - RNA, 19 nt, Human
aacagauaagcaagagaga

SEQ ID NO: 3483687 - RNA, 23 nt, Human
aacagauacuggaaguuuugcau

SEQ ID NO: 3483688 - RNA, 20 nt, Human
aacagauauaaauggcuggu

SEQ ID NO: 3483689 - RNA, 18 nt, Human
aacagaucuccaaagcuu

SEQ ID NO: 3483690 - RNA, 13 nt, Human
aacagaucuggaa

SEQ ID NO: 3483691 - RNA, 13 nt, Human
aacagaugaaaag

SEQ ID NO: 3483692 - RNA, 14 nt, Human
aacagaugaaaagc

SEQ ID NO: 3483693 - RNA, 18 nt, Human
aacagaugaccccugccc

SEQ ID NO: 3483694 - RNA, 21 nt, Human
aacagaugaugagaauuucua

SEQ ID NO: 3483695 - RNA, 22 nt, Human
aacagaugcaaugugcuacuga

SEQ ID NO: 3483696 - RNA, 23 nt, Human
aacagaugcaaugugcuacugau

SEQ ID NO: 3483697 - RNA, 19 nt, Human
aacagauguccaucagaug

SEQ ID NO: 3483698 - RNA, 20 nt, Human
aacagauguccaucagauga

SEQ ID NO: 3483699 - RNA, 19 nt, Human
aacagauuauuaccuuaca

SEQ ID NO: 3483700 - RNA, 14 nt, Human
aacagauucuuuua

SEQ ID NO: 3483701 - RNA, 18 nt, Human
aacagauuggauuuuaug

SEQ ID NO: 3483702 - RNA, 23 nt, Human
aacagauuggauuuuauguugac

SEQ ID NO: 3483703 - RNA, 24 nt, Human
aacagauuggauuuuauguugaca

SEQ ID NO: 3483704 - RNA, 14 nt, Human
aacagauuuuuaca

SEQ ID NO: 3483705 - RNA, 18 nt, Human
aacagcaaaccaagagau

SEQ ID NO: 3483706 - RNA, 15 nt, Human
aacagcaagugugaa

SEQ ID NO: 3483707 - RNA, 16 nt, Human
aacagcaagugugaau

SEQ ID NO: 3483708 - RNA, 23 nt, Human
aacagcacuggcucucuccagga

SEQ ID NO: 3483709 - RNA, 17 nt, Human
aacagcagagguucuuu

SEQ ID NO: 3483710 - RNA, 22 nt, Human
aacagcauccccaaaacaaagu

SEQ ID NO: 3483711 - RNA, 10 nt, Human
aacagcaucu

SEQ ID NO: 3483712 - RNA, 19 nt, Human
aacagcaucuccaagcagc

SEQ ID NO: 3483713 - RNA, 21 nt, Human
aacagcaucuccaagcagcuu

SEQ ID NO: 3483714 - RNA, 12 nt, Human
aacagcauugcu

SEQ ID NO: 3483715 - RNA, 16 nt, Human
aacagcauugcuuucu

SEQ ID NO: 3483716 - RNA, 20 nt, Human
aacagcauugcuuucugaaa

SEQ ID NO: 3483717 - RNA, 15 nt, Human
aacagccaacaggug

SEQ ID NO: 3483718 - RNA, 22 nt, Human
aacagccgaguggauagaugcc

SEQ ID NO: 3483719 - RNA, 21 nt, Human
aacagccgcuccugucugcca

SEQ ID NO: 3483720 - RNA, 14 nt, Human
aacagccucacaga

SEQ ID NO: 3483721 - RNA, 20 nt, Human
aacagccuuugggaaaugcu

SEQ ID NO: 3483722 - RNA, 19 nt, Human
aacagcguuccuagagaag

SEQ ID NO: 3483723 - RNA, 16 nt, Human
aacagcuaaugggaca

SEQ ID NO: 3483724 - RNA, 22 nt, Human
aacagcuacaacagccucacuu

SEQ ID NO: 3483725 - RNA, 16 nt, Human
aacagcuaugagagga

SEQ ID NO: 3483726 - RNA, 18 nt, Human
aacagcuccuugggagga

SEQ ID NO: 3483727 - RNA, 22 nt, Human
aacagcuccuugggaggaagca

SEQ ID NO: 3483728 - RNA, 24 nt, Human
aacagcucgauccaaauugugcuu

SEQ ID NO: 3483729 - RNA, 22 nt, Human
aacagcucucuucaaugacaua

SEQ ID NO: 3483730 - RNA, 20 nt, Human
aacagcucugcaggcuuaau

SEQ ID NO: 3483731 - RNA, 20 nt, Human
aacagcugaggucucuugag

SEQ ID NO: 3483732 - RNA, 16 nt, Human
aacagcugcauuagaa

SEQ ID NO: 3483733 - RNA, 18 nt, Human
aacagcugcauuagaaaa

SEQ ID NO: 3483734 - RNA, 10 nt, Human
aacagcugcc

SEQ ID NO: 3483735 - RNA, 14 nt, Human
aacagcugccuuag

SEQ ID NO: 3483736 - RNA, 15 nt, Human
aacagcugccuuagc

SEQ ID NO: 3483737 - RNA, 23 nt, Human
aacagcuggacccugaccagcuc

SEQ ID NO: 3483738 - RNA, 17 nt, Human
aacagcuggugcccugc

SEQ ID NO: 3483739 - RNA, 16 nt, Human
aacagcugguguagcu

SEQ ID NO: 3483740 - RNA, 23 nt, Human
aacagcugguguagcuacagaga

SEQ ID NO: 3483741 - RNA, 11 nt, Human
aagcaggaagc

SEQ ID NO: 3483742 - RNA, 13 nt, Human
aagcaggaagcuc

SEQ ID NO: 3483743 - RNA, 15 nt, Human
aagcagggacuugaa

SEQ ID NO: 3483744 - RNA, 19 nt, Human
aagcaggggaguaugcaaa

SEQ ID NO: 3483745 - RNA, 17 nt, Human
aagcagggucugggcag

SEQ ID NO: 3483746 - RNA, 19 nt, Human
aagcagguggaucuauuuc

SEQ ID NO: 3483747 - RNA, 15 nt, Human
aagcagguuaaaugu

SEQ ID NO: 3483748 - RNA, 17 nt, Human
aagcagguuaaauguuu

SEQ ID NO: 3483749 - RNA, 20 nt, Human
aagcagguuaaauguuuugu

SEQ ID NO: 3483750 - RNA, 14 nt, Human
aagcagguucuugu

SEQ ID NO: 3483751 - RNA, 15 nt, Human
aagcagguucuuguu

SEQ ID NO: 3483752 - RNA, 19 nt, Human
aagcagguugauaaaucau

SEQ ID NO: 3483753 - RNA, 20 nt, Human
aagcaguauauuaguauuau

SEQ ID NO: 3483754 - RNA, 13 nt, Human
aagcaguauuuug

SEQ ID NO: 3483755 - RNA, 19 nt, Human
aagcagucgugccuguguc

SEQ ID NO: 3483756 - RNA, 18 nt, Human
aagcagucuacccaccuc

SEQ ID NO: 3483757 - RNA, 22 nt, Human
aagcaguugaaaugaggcauga

SEQ ID NO: 3483758 - RNA, 14 nt, Human
aagcaguuucaaua

SEQ ID NO: 3483759 - RNA, 20 nt, Human
aagcaguuucaauaaaguuu

SEQ ID NO: 3483760 - RNA, 22 nt, Human
aagcaguuucaauaaaguuuga

SEQ ID NO: 3483761 - RNA, 15 nt, Human
aagcauaaaaacauu

SEQ ID NO: 3483762 - RNA, 23 nt, Human
aagcauacaugcaaaaagaaaug

SEQ ID NO: 3483763 - RNA, 22 nt, Human
aagcauagauaauauuguuugg

SEQ ID NO: 3483764 - RNA, 17 nt, Human
aagcauagauguuuugg

SEQ ID NO: 3483765 - RNA, 13 nt, Human
aagcauauaaaau

SEQ ID NO: 3483766 - RNA, 14 nt, Human
aagcauauaaaaug

SEQ ID NO: 3483767 - RNA, 16 nt, Human
aagcauauaaaauggc

SEQ ID NO: 3483768 - RNA, 17 nt, Human
aagcauauaaaauggca

SEQ ID NO: 3483769 - RNA, 16 nt, Human
aagcauauagagauga

SEQ ID NO: 3483770 - RNA, 23 nt, Human
aagcauauauuuuuauauuuacu

SEQ ID NO: 3483771 - RNA, 19 nt, Human
aagcauauguguuggcuug

SEQ ID NO: 3483772 - RNA, 13 nt, Human
aagcauauugacu

SEQ ID NO: 3483773 - RNA, 15 nt, Human
aagcaucaccucagg

SEQ ID NO: 3483774 - RNA, 16 nt, Human
aagcaucaccucaggc

SEQ ID NO: 3483775 - RNA, 23 nt, Human
aagcaucaccucaggccaggugc

SEQ ID NO: 3483776 - RNA, 21 nt, Human
aagcaucauuauuuauguauu

SEQ ID NO: 3483777 - RNA, 14 nt, Human
aagcaucccucacc

SEQ ID NO: 3483778 - RNA, 13 nt, Human
aagcaucuaaacu

SEQ ID NO: 3483779 - RNA, 13 nt, Human
aagcaucuacuuc

SEQ ID NO: 3483780 - RNA, 13 nt, Human
aagcaucuggcuc

SEQ ID NO: 3483781 - RNA, 21 nt, Human
aagcaucuuccagaaguguga

SEQ ID NO: 3483782 - RNA, 12 nt, Human
aagcaugaaaug

SEQ ID NO: 3483783 - RNA, 13 nt, Human
aagcaugaaaugu

SEQ ID NO: 3483784 - RNA, 18 nt, Human
aagcaugaaaugugaauu

SEQ ID NO: 3483785 - RNA, 19 nt, Human
aagcaugacagaaaauaug

SEQ ID NO: 3483786 - RNA, 22 nt, Human
aagcaugacagaaaauauguau

SEQ ID NO: 3483787 - RNA, 18 nt, Human
aagcauguacaguguucu

SEQ ID NO: 3483788 - RNA, 13 nt, Human
aagcaugugucau

SEQ ID NO: 3483789 - RNA, 15 nt, Human
aagcauguguuugca

SEQ ID NO: 3483790 - RNA, 20 nt, Human
aagcauguuucauguuuugu

SEQ ID NO: 3483791 - RNA, 13 nt, Human
aagcauguuuugc

SEQ ID NO: 3483792 - RNA, 15 nt, Human
aagcauguuuugcau

SEQ ID NO: 3483793 - RNA, 18 nt, Human
aagcauuacauuuccaaa

SEQ ID NO: 3483794 - RNA, 18 nt, Human
aagcauuaccacucaggc

SEQ ID NO: 3483795 - RNA, 17 nt, Human
aagcauuacucuuguaa

SEQ ID NO: 3483796 - RNA, 19 nt, Human
aagcauuacucuuguaaga

SEQ ID NO: 3483797 - RNA, 20 nt, Human
aagcauuacucuuguaagau

SEQ ID NO: 3483798 - RNA, 22 nt, Human
aagcauuacucuuguaagauuu

SEQ ID NO: 3483799 - RNA, 15 nt, Human
aagcauucagagagc

SEQ ID NO: 3483800 - RNA, 14 nt, Human
aagcauuccaacaa

SEQ ID NO: 3483801 - RNA, 17 nt, Human
aagcauuccaacaaagg

SEQ ID NO: 3483802 - RNA, 14 nt, Human
aagcauuccuucuu

SEQ ID NO: 3483803 - RNA, 16 nt, Human
aagcauuccuucuuug

SEQ ID NO: 3483804 - RNA, 17 nt, Human
aagcauuccuucuuuga

SEQ ID NO: 3483805 - RNA, 15 nt, Human
aagcauucucauugg

SEQ ID NO: 3483806 - RNA, 18 nt, Human
aagcauucucauuggaaa

SEQ ID NO: 3483807 - RNA, 13 nt, Human
aagcauugaaugg

SEQ ID NO: 3483808 - RNA, 16 nt, Human
aagcauugaauggcua

SEQ ID NO: 3483809 - RNA, 14 nt, Human
aagcauugccuggc

SEQ ID NO: 3483810 - RNA, 20 nt, Human
aagcauugcuuuuauuuuga

SEQ ID NO: 3483811 - RNA, 13 nt, Human
aagcauuguaaau

SEQ ID NO: 3483812 - RNA, 18 nt, Human
aagcauuguaaaugugcu

SEQ ID NO: 3483813 - RNA, 19 nt, Human
aagcauuguaaaugugcuu

SEQ ID NO: 3483814 - RNA, 14 nt, Human
aagcauugugagua

SEQ ID NO: 3483815 - RNA, 11 nt, Human
aagcauuguuu

SEQ ID NO: 3483816 - RNA, 21 nt, Human
aagcauuguuugcuuauuguu

SEQ ID NO: 3483817 - RNA, 16 nt, Human
aagcauuuacuuugaa

SEQ ID NO: 3483818 - RNA, 16 nt, Human
aagcauuuagaaaacu

SEQ ID NO: 3483819 - RNA, 16 nt, Human
aagcauuuagauguau

SEQ ID NO: 3483820 - RNA, 17 nt, Human
aagcauuugaaugcauu

SEQ ID NO: 3483821 - RNA, 18 nt, Human
aagcauuugaaugcauuu

SEQ ID NO: 3483822 - RNA, 21 nt, Human
aagcauuugaaugcauuuugu

SEQ ID NO: 3483823 - RNA, 17 nt, Human
aagcauuuguauuuugu

SEQ ID NO: 3483824 - RNA, 23 nt, Human
aagcauuuguuucuacuuugaua

SEQ ID NO: 3483825 - RNA, 19 nt, Human
aagcauuuuguaaguugaa

SEQ ID NO: 3483826 - RNA, 18 nt, Human
aagccaaaacaauguuua

SEQ ID NO: 3483827 - RNA, 14 nt, Human
aagccaaaauuaag

SEQ ID NO: 3483828 - RNA, 11 nt, Human
aagccaaagaa

SEQ ID NO: 3483829 - RNA, 15 nt, Human
aagccaaagaaaaau

SEQ ID NO: 3483830 - RNA, 21 nt, Human
aagccaaagaaaaauaacccu

SEQ ID NO: 3483831 - RNA, 15 nt, Human
aagccaaagaaauga

SEQ ID NO: 3483832 - RNA, 22 nt, Human
aagccaaagaaaugaacauucc

SEQ ID NO: 3483833 - RNA, 23 nt, Human
aagccaaagaaaugaacauucca

SEQ ID NO: 3483834 - RNA, 16 nt, Human
aagccaaagacuuagu

SEQ ID NO: 3483835 - RNA, 13 nt, Human
aagccaaauuuau

SEQ ID NO: 3483836 - RNA, 16 nt, Human
aagccaacuuguaaau

SEQ ID NO: 3483837 - RNA, 13 nt, Human
aagccaagaggca

SEQ ID NO: 3483838 - RNA, 13 nt, Human
aagccaagcagcc

SEQ ID NO: 3483839 - RNA, 14 nt, Human
aagccaagcagcca

SEQ ID NO: 3483840 - RNA, 17 nt, Human
aagccaagcagccaagc

SEQ ID NO: 3483841 - RNA, 13 nt, Human
aagccaagggaaa

SEQ ID NO: 3483842 - RNA, 19 nt, Human
aagccaagggaaccugugu

SEQ ID NO: 3483843 - RNA, 13 nt, Human
aagccaagugggg

SEQ ID NO: 3483844 - RNA, 17 nt, Human
aagccaauaacacacag

SEQ ID NO: 3483845 - RNA, 14 nt, Human
aagccaauuucaau

SEQ ID NO: 3483846 - RNA, 11 nt, Human
aagccaauuuu

SEQ ID NO: 3483847 - RNA, 14 nt, Human
aagccaauuuuucu

SEQ ID NO: 3483848 - RNA, 17 nt, Human
aagccaauuuuucugca

SEQ ID NO: 3483849 - RNA, 11 nt, Human
aagccacagaa

SEQ ID NO: 3483850 - RNA, 22 nt, Human
aagccacaggccugagauuuca

SEQ ID NO: 3483851 - RNA, 21 nt, Human
aagccaccaacauacucccau

SEQ ID NO: 3483852 - RNA, 11 nt, Human
aagccaccucu

SEQ ID NO: 3483853 - RNA, 20 nt, Human
aagccaccucucccucaaca

SEQ ID NO: 3483854 - RNA, 17 nt, Human
aagccacuagacucuuc

SEQ ID NO: 3483855 - RNA, 14 nt, Human
aagccacugaagcu

SEQ ID NO: 3483856 - RNA, 17 nt, Human
aagccacugaagcuggg

SEQ ID NO: 3483857 - RNA, 17 nt, Human
aagccacugccucuccc

SEQ ID NO: 3483858 - RNA, 22 nt, Human
aagccacugccucucccucugg

SEQ ID NO: 3483859 - RNA, 18 nt, Human
aagccacuugaaauguua

SEQ ID NO: 3483860 - RNA, 20 nt, Human
aagccagaagcuaagcugca

SEQ ID NO: 3483861 - RNA, 13 nt, Human
aagccagaagcug

SEQ ID NO: 3483862 - RNA, 23 nt, Human
aagccagacucugccaaaaccaa

SEQ ID NO: 3483863 - RNA, 15 nt, Human
aagccagaggcuggg

SEQ ID NO: 3483864 - RNA, 13 nt, Human
aagccagauuuuc

SEQ ID NO: 3483865 - RNA, 19 nt, Human
aagccagauuuuccugaaa

SEQ ID NO: 3483866 - RNA, 23 nt, Human
aagccagauuuuuuaaaauuuau

SEQ ID NO: 3483867 - RNA, 14 nt, Human
aaccugggauucag

SEQ ID NO: 3483868 - RNA, 17 nt, Human
aaccuggguccaaauaa

SEQ ID NO: 3483869 - RNA, 22 nt, Human
aaccuggguccaaauaaaaacu

SEQ ID NO: 3483870 - RNA, 20 nt, Human
aaccuggguugcagacagga

SEQ ID NO: 3483871 - RNA, 11 nt, Human
aaccuggugcu

SEQ ID NO: 3483872 - RNA, 11 nt, Human
aaccuguaaau

SEQ ID NO: 3483873 - RNA, 15 nt, Human
aaccuguaaauuauu

SEQ ID NO: 3483874 - RNA, 16 nt, Human
aaccuguaaauuauuu

SEQ ID NO: 3483875 - RNA, 14 nt, Human
aaccuguaauaaau

SEQ ID NO: 3483876 - RNA, 16 nt, Human
aaccuguaauaaauau

SEQ ID NO: 3483877 - RNA, 17 nt, Human
aaccuguagaaucaauu

SEQ ID NO: 3483878 - RNA, 18 nt, Human
aaccuguagaaucaauuu

SEQ ID NO: 3483879 - RNA, 24 nt, Human
aaccugucuccacugugccuuugc

SEQ ID NO: 3483880 - RNA, 11 nt, Human
aaccugucuga

SEQ ID NO: 3483881 - RNA, 16 nt, Human
aaccugugucugcgaa

SEQ ID NO: 3483882 - RNA, 24 nt, Human
aaccuguuaccuacuuugacuuuu

SEQ ID NO: 3483883 - RNA, 13 nt, Human
aaccuguucugcu

SEQ ID NO: 3483884 - RNA, 21 nt, Human
aaccuguugauagcaagugaa

SEQ ID NO: 3483885 - RNA, 21 nt, Human
aaccuguugcuguguuuaauu

SEQ ID NO: 3483886 - RNA, 23 nt, Human
aaccuguugcuguguuuaauuug

SEQ ID NO: 3483887 - RNA, 22 nt, Human
aagcuaacagcaguuucaggua

SEQ ID NO: 3483888 - RNA, 22 nt, Human
aagcuaacagggaaggcaggca

SEQ ID NO: 3483889 - RNA, 15 nt, Human
aagcuaauuauuuua

SEQ ID NO: 3483890 - RNA, 16 nt, Human
aagcuaauuauuuuaa

SEQ ID NO: 3483891 - RNA, 17 nt, Human
aagcuacaaucuguuca

SEQ ID NO: 3483892 - RNA, 13 nt, Human
aagcuacagguua

SEQ ID NO: 3483893 - RNA, 22 nt, Human
aagcuacagguuacaacagauu

SEQ ID NO: 3483894 - RNA, 17 nt, Human
aagcuacuagcaaaaua

SEQ ID NO: 3483895 - RNA, 22 nt, Human
aagcuacugccauccuggccca

SEQ ID NO: 3483896 - RNA, 22 nt, Human
aagcuacugugugugugaauga

SEQ ID NO: 3483897 - RNA, 19 nt, Human
aagcuagaaggccacaugu

SEQ ID NO: 3483898 - RNA, 10 nt, Human
aagcuagaau

SEQ ID NO: 3483899 - RNA, 21 nt, Human
aagcuagacagauccccguuc

SEQ ID NO: 3483900 - RNA, 22 nt, Human
aagcuagacgagcaggcuucuu

SEQ ID NO: 3483901 - RNA, 14 nt, Human
aagcuagagauaug

SEQ ID NO: 3483902 - RNA, 18 nt, Human
aagcuagcuccccuccuc

SEQ ID NO: 3483903 - RNA, 20 nt, Human
aagcuagcuccccuccucuc

SEQ ID NO: 3483904 - RNA, 21 nt, Human
aagcuaggaaaagaaaucuau

SEQ ID NO: 3483905 - RNA, 23 nt, Human
aagcuaggaaaagaaaucuauag

SEQ ID NO: 3483906 - RNA, 21 nt, Human
aagcuaggugcuauuugucau

SEQ ID NO: 3483907 - RNA, 14 nt, Human
aagcuagucuuuug

SEQ ID NO: 3483908 - RNA, 15 nt, Human
aagcuagucuuuugc

SEQ ID NO: 3483909 - RNA, 20 nt, Human
aagcuagucuuuugcuuuug

SEQ ID NO: 3483910 - RNA, 21 nt, Human
aagcuaguguaccuccucuca

SEQ ID NO: 3483911 - RNA, 13 nt, Human
aagcuaguugaau

SEQ ID NO: 3483912 - RNA, 15 nt, Human
aagcuaguugaauac

SEQ ID NO: 3483913 - RNA, 17 nt, Human
aagcuaguugaauacuu

SEQ ID NO: 3483914 - RNA, 15 nt, Human
aagcuauaaagcagu

SEQ ID NO: 3483915 - RNA, 21 nt, Human
aagcuauaaauuccucuuugc

SEQ ID NO: 3483916 - RNA, 17 nt, Human
aagcuauccaaauaacu

SEQ ID NO: 3483917 - RNA, 12 nt, Human
aagcuaugguga

SEQ ID NO: 3483918 - RNA, 19 nt, Human
aagcuauuagccaggauca

SEQ ID NO: 3483919 - RNA, 18 nt, Human
aagcuauucacauuguua

SEQ ID NO: 3483920 - RNA, 13 nt, Human
aagcuauuccuuu

SEQ ID NO: 3483921 - RNA, 19 nt, Human
aagcuauuccuuucccuuc

SEQ ID NO: 3483922 - RNA, 22 nt, Human
aagcuauuccuuucccuuccuc

SEQ ID NO: 3483923 - RNA, 18 nt, Human
aagcuauuuaaagcaucu

SEQ ID NO: 3483924 - RNA, 18 nt, Human
aagcuauuugauguaaua

SEQ ID NO: 3483925 - RNA, 13 nt, Human
aagcuauuuuucu

SEQ ID NO: 3483926 - RNA, 16 nt, Human
aagcuauuuuucuaac

SEQ ID NO: 3483927 - RNA, 21 nt, Human
aagcuauuuuucuaacuacaa

SEQ ID NO: 3483928 - RNA, 11 nt, Human
aagcucacagu

SEQ ID NO: 3483929 - RNA, 23 nt, Human
aagcucacaguuccucgcccugg

SEQ ID NO: 3483930 - RNA, 16 nt, Human
aagcucaccuguugcu

SEQ ID NO: 3483931 - RNA, 18 nt, Human
aagcucaccuguugcuua

SEQ ID NO: 3483932 - RNA, 17 nt, Human
aagcucacguccugaga

SEQ ID NO: 3483933 - RNA, 19 nt, Human
aagcucacguccugagaaa

SEQ ID NO: 3483934 - RNA, 14 nt, Human
aagcucagaaggcu

SEQ ID NO: 3483935 - RNA, 12 nt, Human
aagcucagaauc

SEQ ID NO: 3483936 - RNA, 22 nt, Human
aagcucagaggcgcacugugac

SEQ ID NO: 3483937 - RNA, 15 nt, Human
aagcucagcccaccc

SEQ ID NO: 3483938 - RNA, 21 nt, Human
aagcucagcccaccccccuca

SEQ ID NO: 3483939 - RNA, 18 nt, Human
aagcucagggccuggcuc

SEQ ID NO: 3483940 - RNA, 20 nt, Human
aagcucagggccuggcucag

SEQ ID NO: 3483941 - RNA, 20 nt, Human
aagcucauauuuuguauaua

SEQ ID NO: 3483942 - RNA, 19 nt, Human
aagcucauuucaugcucug

SEQ ID NO: 3483943 - RNA, 18 nt, Human
aagcuccaagcucccagg

SEQ ID NO: 3483944 - RNA, 21 nt, Human
aagcuccacugucacccucca

SEQ ID NO: 3483945 - RNA, 21 nt, Human
aagcuccaguccugcucucua

SEQ ID NO: 3483946 - RNA, 19 nt, Human
aagcucccaagggauggug

SEQ ID NO: 3483947 - RNA, 14 nt, Human
aagcucccaggaac

SEQ ID NO: 3483948 - RNA, 16 nt, Human
aagcucccaggaacaa

SEQ ID NO: 3483949 - RNA, 22 nt, Human
aagcucccaggcauuccccagg

SEQ ID NO: 3483950 - RNA, 15 nt, Human
aagcucccagggccu

SEQ ID NO: 3483951 - RNA, 16 nt, Human
aagcuccgcaggacuu

SEQ ID NO: 3483952 - RNA, 15 nt, Human
aagcuccuccucccu

SEQ ID NO: 3483953 - RNA, 14 nt, Human
aagcuccuccucgg

SEQ ID NO: 3483954 - RNA, 21 nt, Human
aagcuccucuccccagcccag

SEQ ID NO: 3483955 - RNA, 23 nt, Human
aagcuccucuccccagcccagag

SEQ ID NO: 3483956 - RNA, 21 nt, Human
aagcucuacugaggugcuaug

SEQ ID NO: 3483957 - RNA, 15 nt, Human
aagcucuagaaucug

SEQ ID NO: 3483958 - RNA, 23 nt, Human
aagcucucuugccgaggagccag

SEQ ID NO: 3483959 - RNA, 15 nt, Human
aagcucugaagaacu

SEQ ID NO: 3483960 - RNA, 13 nt, Human
aagcucugcuccu

SEQ ID NO: 3483961 - RNA, 15 nt, Human
aagcucuggcugaac

SEQ ID NO: 3483962 - RNA, 22 nt, Human
aagcucuggcugaacccugugc

SEQ ID NO: 3483963 - RNA, 16 nt, Human
aagcucuuacucuuuc

SEQ ID NO: 3483964 - RNA, 12 nt, Human
aagcucuuccuu

SEQ ID NO: 3483965 - RNA, 20 nt, Human
aagcucuugaagacacugaa

SEQ ID NO: 3483966 - RNA, 19 nt, Human
aagcucuuggagcugugag

SEQ ID NO: 3483967 - RNA, 14 nt, Human
aagcugaaaauaua

SEQ ID NO: 3483968 - RNA, 18 nt, Human
aagcugaaauuuuagaaa

SEQ ID NO: 3483969 - RNA, 14 nt, Human
aagcugaagugcau

SEQ ID NO: 3483970 - RNA, 22 nt, Human
aagcugacauugccaaaaagga

SEQ ID NO: 3483971 - RNA, 22 nt, Human
aagcugacgaacuuccauggcc

SEQ ID NO: 3483972 - RNA, 14 nt, Human
aagcugacuuggcu

SEQ ID NO: 3483973 - RNA, 18 nt, Human
aagcugacuuggcuggug

SEQ ID NO: 3483974 - RNA, 20 nt, Human
aagcugacuuggcuggugug

SEQ ID NO: 3483975 - RNA, 11 nt, Human
aagcugagccu

SEQ ID NO: 3483976 - RNA, 13 nt, Human
aagcugagccugc

SEQ ID NO: 3483977 - RNA, 17 nt, Human
aagcugaggugcccagg

SEQ ID NO: 3483978 - RNA, 20 nt, Human
aagcugaggugcccaggaga

SEQ ID NO: 3483979 - RNA, 13 nt, Human
aagcugaguauua

SEQ ID NO: 3483980 - RNA, 13 nt, Human
aagcugaguuucc

SEQ ID NO: 3483981 - RNA, 22 nt, Human
aagcugaguuuccuaugggaac

SEQ ID NO: 3483982 - RNA, 15 nt, Human
aagcugauuaaauga

SEQ ID NO: 3483983 - RNA, 17 nt, Human
aagcugauuacugucaa

SEQ ID NO: 3483984 - RNA, 20 nt, Human
aagcugcacccucaggcagg

SEQ ID NO: 3483985 - RNA, 15 nt, Human
aagcugcagagauuu

SEQ ID NO: 3483986 - RNA, 23 nt, Human
aagcugcagagauuucucauuga

SEQ ID NO: 3483987 - RNA, 18 nt, Human
aagcugcaucuagaggcu

SEQ ID NO: 3483988 - RNA, 12 nt, Human
aagcugccagcc

SEQ ID NO: 3483989 - RNA, 15 nt, Human
aagcugcccugccca

SEQ ID NO: 3483990 - RNA, 20 nt, Human
aagcugccgaaccaaaagaa

SEQ ID NO: 3483991 - RNA, 18 nt, Human
aagcugccucccugucca

SEQ ID NO: 3483992 - RNA, 19 nt, Human
aagcugccucccuguccac

SEQ ID NO: 3483993 - RNA, 20 nt, Human
aagcugccucccuguccacc

SEQ ID NO: 3483994 - RNA, 22 nt, Human
aagcugccucccuguccacccc

SEQ ID NO: 3483995 - RNA, 12 nt, Human
aagcugcucaac

SEQ ID NO: 3483996 - RNA, 20 nt, Human
aagcugcucaacuugcaaaa

SEQ ID NO: 3483997 - RNA, 16 nt, Human
aagcugcuccaggccu

SEQ ID NO: 3483998 - RNA, 20 nt, Human
aagcugcucugagccacagu

SEQ ID NO: 3483999 - RNA, 16 nt, Human
aagcugcugacagugu

SEQ ID NO: 3484000 - RNA, 22 nt, Human
aagcugcugaccaauugugcug

SEQ ID NO: 3484001 - RNA, 13 nt, Human
aagcugcugugau

SEQ ID NO: 3484002 - RNA, 23 nt, Human
aagcugcuuggaccucgugcuuu

SEQ ID NO: 3484003 - RNA, 21 nt, Human
aagcugcuuuaaaaaaauaca

SEQ ID NO: 3484004 - RNA, 11 nt, Human
aagcugcuuuu

SEQ ID NO: 3484005 - RNA, 11 nt, Human
aagcuggaagc

SEQ ID NO: 3484006 - RNA, 17 nt, Human
aagcuggagugcagugg

SEQ ID NO: 3484007 - RNA, 21 nt, Human
aagcuggccgaggguccuggc

SEQ ID NO: 3484008 - RNA, 22 nt, Human
aagcuggccgaggguccuggcu

SEQ ID NO: 3484009 - RNA, 14 nt, Human
aagcuggccugaga

SEQ ID NO: 3484010 - RNA, 15 nt, Human
aagcuggcuggggug

SEQ ID NO: 3484011 - RNA, 16 nt, Human
aagcugggguucauga

SEQ ID NO: 3484012 - RNA, 22 nt, Human
aagcugggguucaugacaaugg

SEQ ID NO: 3484013 - RNA, 23 nt, Human
aagcuggugggugaaagaaauca

SEQ ID NO: 3484014 - RNA, 18 nt, Human
aagcuguaaaaagagaga

SEQ ID NO: 3484015 - RNA, 13 nt, Human
aagcuguggccag

SEQ ID NO: 3484016 - RNA, 12 nt, Human
aagcuguguccu

SEQ ID NO: 3484017 - RNA, 21 nt, Human
aagcugugucugcccaaugaa

SEQ ID NO: 3484018 - RNA, 16 nt, Human
aagcuguuaaacuguu

SEQ ID NO: 3484019 - RNA, 13 nt, Human
aagcuguuccugu

SEQ ID NO: 3484020 - RNA, 16 nt, Human
aagcuguucuuccugg

SEQ ID NO: 3484021 - RNA, 22 nt, Human
aagcuguugaugguagguggca

SEQ ID NO: 3484022 - RNA, 18 nt, Human
aagcuguuguacauuuau

SEQ ID NO: 3484023 - RNA, 15 nt, Human
aagcuguuuccauag

SEQ ID NO: 3484024 - RNA, 17 nt, Human
aagcuguuuggaaaaga

SEQ ID NO: 3484025 - RNA, 17 nt, Human
aagcuguuugguuuuaa

SEQ ID NO: 3484026 - RNA, 15 nt, Human
aagcuuaaaacuuug

SEQ ID NO: 3484027 - RNA, 21 nt, Human
aagcuuaauggcugauaauuu

SEQ ID NO: 3484028 - RNA, 11 nt, Human
aagcuuagaac

SEQ ID NO: 3484029 - RNA, 18 nt, Human
aagcuuaugcuuaaauuc

SEQ ID NO: 3484030 - RNA, 18 nt, Human
aagcuuauuaaaacucau

SEQ ID NO: 3484031 - RNA, 23 nt, Human
aaguacggcuggcuacaacugcu

SEQ ID NO: 3484032 - RNA, 19 nt, Human
aaguacuaagcgcuagagg

SEQ ID NO: 3484033 - RNA, 16 nt, Human
aaguacugagcaguga

SEQ ID NO: 3484034 - RNA, 20 nt, Human
aaguacugcuguaaauaaau

SEQ ID NO: 3484035 - RNA, 23 nt, Human
aaguacugguaagauuguuauua

SEQ ID NO: 3484036 - RNA, 17 nt, Human
aaguacuguaagaauaa

SEQ ID NO: 3484037 - RNA, 22 nt, Human
aaguacuguaagaauaauuuau

SEQ ID NO: 3484038 - RNA, 19 nt, Human
aaguacuguaauaauaccu

SEQ ID NO: 3484039 - RNA, 22 nt, Human
aaguacuguaauaauaccucaa

SEQ ID NO: 3484040 - RNA, 16 nt, Human
aaguacuguguacaga

SEQ ID NO: 3484041 - RNA, 14 nt, Human
aaguacuguuuacc

SEQ ID NO: 3484042 - RNA, 21 nt, Human
aaguacuucuccacccugcuc

SEQ ID NO: 3484043 - RNA, 22 nt, Human
aaguacuucuccacccugcucu

SEQ ID NO: 3484044 - RNA, 23 nt, Human
aaguacuucuccacccugcucuc

SEQ ID NO: 3484045 - RNA, 11 nt, Human
aaguacuucuu

SEQ ID NO: 3484046 - RNA, 14 nt, Human
aaguacuugagugu

SEQ ID NO: 3484047 - RNA, 14 nt, Human
aaguacuuuuggca

SEQ ID NO: 3484048 - RNA, 13 nt, Human
aaguagaaaucau

SEQ ID NO: 3484049 - RNA, 15 nt, Human
aaguagaaaucauag

SEQ ID NO: 3484050 - RNA, 23 nt, Human
aaguagaacuuuguauaguuaug

SEQ ID NO: 3484051 - RNA, 20 nt, Human
aaguagaagucuuagaugua

SEQ ID NO: 3484052 - RNA, 17 nt, Human
aaguagacaaucauugu

SEQ ID NO: 3484053 - RNA, 18 nt, Human
aaguagacaguuuugaga

SEQ ID NO: 3484054 - RNA, 21 nt, Human
aaguagacaguuuugagaacg

SEQ ID NO: 3484055 - RNA, 19 nt, Human
aaguagacuucauuuuucc

SEQ ID NO: 3484056 - RNA, 19 nt, Human
aaguagaugauaaaggcca

SEQ ID NO: 3484057 - RNA, 14 nt, Human
aaguagauuucaug

SEQ ID NO: 3484058 - RNA, 21 nt, Human
aaguagcaaaugagacagcag

SEQ ID NO: 3484059 - RNA, 15 nt, Human
aaguagcacaggcug

SEQ ID NO: 3484060 - RNA, 16 nt, Human
aaguagcauuuacugu

SEQ ID NO: 3484061 - RNA, 14 nt, Human
aaguagccucuccu

SEQ ID NO: 3484062 - RNA, 19 nt, Human
aaguagcugggauuuuaaa

SEQ ID NO: 3484063 - RNA, 15 nt, Human
aaguaggaaaaauaa

SEQ ID NO: 3484064 - RNA, 15 nt, Human
aaguaggcaggacca

SEQ ID NO: 3484065 - RNA, 15 nt, Human
aaguaggcaugaggg

SEQ ID NO: 3484066 - RNA, 17 nt, Human
aaguaggggaagaauaa

SEQ ID NO: 3484067 - RNA, 19 nt, Human
aaguaguaaaaauuaaaaa

SEQ ID NO: 3484068 - RNA, 18 nt, Human
aaguaguacuucuucugu

SEQ ID NO: 3484069 - RNA, 14 nt, Human
aaguaguccuguga

SEQ ID NO: 3484070 - RNA, 14 nt, Human
aaguagucugcuca

SEQ ID NO: 3484071 - RNA, 17 nt, Human
aaguaguggagccccug

SEQ ID NO: 3484072 - RNA, 18 nt, Human
aaguaguuaucauguuag

SEQ ID NO: 3484073 - RNA, 16 nt, Human
aaguaguucuguauuu

SEQ ID NO: 3484074 - RNA, 12 nt, Human
aaguaguuugua

SEQ ID NO: 3484075 - RNA, 15 nt, Human
aaguauaaaauacaa

SEQ ID NO: 3484076 - RNA, 18 nt, Human
aaguauaaauuuguguaa

SEQ ID NO: 3484077 - RNA, 20 nt, Human
aaguauaauguuuauuaaau

SEQ ID NO: 3484078 - RNA, 22 nt, Human
aaguauaauguuuauuaaaugc

SEQ ID NO: 3484079 - RNA, 18 nt, Human
aaguauagaaaaucuuca

SEQ ID NO: 3484080 - RNA, 19 nt, Human
aaguauagaaaaucuucau

SEQ ID NO: 3484081 - RNA, 14 nt, Human
aaguauagagagaa

SEQ ID NO: 3484082 - RNA, 17 nt, Human
aaguauagagagaaguu

SEQ ID NO: 3484083 - RNA, 23 nt, Human
aaguauagagagaaguucauaca

SEQ ID NO: 3484084 - RNA, 23 nt, Human
aaguauauaaugguuucaaagau

SEQ ID NO: 3484085 - RNA, 22 nt, Human
aaguauauaauuuuuuuauguu

SEQ ID NO: 3484086 - RNA, 16 nt, Human
aaguauauauagaauc

SEQ ID NO: 3484087 - RNA, 17 nt, Human
aaguaucaaguauagaa

SEQ ID NO: 3484088 - RNA, 21 nt, Human
aaguaucaaguauagaaaauc

SEQ ID NO: 3484089 - RNA, 11 nt, Human
aaguaucaugc

SEQ ID NO: 3484090 - RNA, 18 nt, Human
aaguaucccuacuguaau

SEQ ID NO: 3484091 - RNA, 14 nt, Human
aaguaucuucaugu

SEQ ID NO: 3484092 - RNA, 19 nt, Human
aaguaucuucguucuuguu

SEQ ID NO: 3484093 - RNA, 16 nt, Human
aaguaugaaucuaugc

SEQ ID NO: 3484094 - RNA, 17 nt, Human
aaguaugagggaaaaug

SEQ ID NO: 3484095 - RNA, 18 nt, Human
aaguaugcauuauuaaau

SEQ ID NO: 3484096 - RNA, 20 nt, Human
aaguaugcauuauuaaauug

SEQ ID NO: 3484097 - RNA, 19 nt, Human
aaguauguauauuaaaaaa

SEQ ID NO: 3484098 - RNA, 18 nt, Human
aaguauguguaaaaugug

SEQ ID NO: 3484099 - RNA, 19 nt, Human
aaguauguguaaaauguga

SEQ ID NO: 3484100 - RNA, 15 nt, Human
aaguauguuuuacuu

SEQ ID NO: 3484101 - RNA, 13 nt, Human
aaguauuaaaaca

SEQ ID NO: 3484102 - RNA, 15 nt, Human
aaguauuaagcauau

SEQ ID NO: 3484103 - RNA, 17 nt, Human
aaguauuacuaaauuga

SEQ ID NO: 3484104 - RNA, 13 nt, Human
aaguauuagaaua

SEQ ID NO: 3484105 - RNA, 20 nt, Human
aaguauuauaaacaagaaug

SEQ ID NO: 3484106 - RNA, 13 nt, Human
aaguauuaucaga

SEQ ID NO: 3484107 - RNA, 15 nt, Human
aaguauuaugucucu

SEQ ID NO: 3484108 - RNA, 12 nt, Human
aaguauucaaga

SEQ ID NO: 3484109 - RNA, 18 nt, Human
aaguauuccaccuuaaau

SEQ ID NO: 3484110 - RNA, 15 nt, Human
aaguauucuaaauuu

SEQ ID NO: 3484111 - RNA, 13 nt, Human
aaguauucucuuu

SEQ ID NO: 3484112 - RNA, 18 nt, Human
aaguauucucuuuucaag

SEQ ID NO: 3484113 - RNA, 22 nt, Human
aaguauucugccuuugcagaaa

SEQ ID NO: 3484114 - RNA, 21 nt, Human
aaguauucuuauuuaaugaaa

SEQ ID NO: 3484115 - RNA, 14 nt, Human
aaguauucuuuuuc

SEQ ID NO: 3484116 - RNA, 18 nt, Human
aaguauugcaucuguaua

SEQ ID NO: 3484117 - RNA, 22 nt, Human
aaguauugcaucuguauaagua

SEQ ID NO: 3484118 - RNA, 12 nt, Human
aaguauuguaaa

SEQ ID NO: 3484119 - RNA, 15 nt, Human
aaguauuguaaauua

SEQ ID NO: 3484120 - RNA, 17 nt, Human
aaguauuguaaauuaua

SEQ ID NO: 3484121 - RNA, 22 nt, Human
aaguauuguaaauuauauuugu

SEQ ID NO: 3484122 - RNA, 17 nt, Human
aaguauuguacaaauaa

SEQ ID NO: 3484123 - RNA, 20 nt, Human
aaguauuuaagccuaaagau

SEQ ID NO: 3484124 - RNA, 21 nt, Human
aaguauuuaagccuaaagauu

SEQ ID NO: 3484125 - RNA, 18 nt, Human
aaguauuuaauuagugcu

SEQ ID NO: 3484126 - RNA, 10 nt, Human
aaguauuuag

SEQ ID NO: 3484127 - RNA, 16 nt, Human
aaguauuuagguuuuu

SEQ ID NO: 3484128 - RNA, 12 nt, Human
aaguauuuauau

SEQ ID NO: 3484129 - RNA, 18 nt, Human
aaguauuuauauauuuau

SEQ ID NO: 3484130 - RNA, 14 nt, Human
aaguauuucccagc

SEQ ID NO: 3484131 - RNA, 15 nt, Human
aaguauuuugaaguu

SEQ ID NO: 3484132 - RNA, 19 nt, Human
aaguauuuugaaguuuaca

SEQ ID NO: 3484133 - RNA, 20 nt, Human
aaguauuuugaaguuuacau

SEQ ID NO: 3484134 - RNA, 11 nt, Human
aaguauuuugc

SEQ ID NO: 3484135 - RNA, 15 nt, Human
aaguauuuugcugga

SEQ ID NO: 3484136 - RNA, 15 nt, Human
aaguauuuuuaauua

SEQ ID NO: 3484137 - RNA, 18 nt, Human
aaguauuuuuaauuaauu

SEQ ID NO: 3484138 - RNA, 17 nt, Human
aaguauuuuuagaauaa

SEQ ID NO: 3484139 - RNA, 15 nt, Human
aaguauuuuuuuauc

SEQ ID NO: 3484140 - RNA, 19 nt, Human
aagucaaaaggugccugug

SEQ ID NO: 3484141 - RNA, 16 nt, Human
aagucaaacacuugug

SEQ ID NO: 3484142 - RNA, 19 nt, Human
aagucaaacacuugugacu

SEQ ID NO: 3484143 - RNA, 15 nt, Human
aagucaaacuuggau

SEQ ID NO: 3484144 - RNA, 16 nt, Human
aagucaaccaauguag

SEQ ID NO: 3484145 - RNA, 13 nt, Human
aagucaaggcuua

SEQ ID NO: 3484146 - RNA, 18 nt, Human
aagucaauguuuucaguu

SEQ ID NO: 3484147 - RNA, 18 nt, Human
aagucacaaaggaaugga

SEQ ID NO: 3484148 - RNA, 15 nt, Human
aagucacaauguucu

SEQ ID NO: 3484149 - RNA, 19 nt, Human
aagucacagggcaguaccu

SEQ ID NO: 3484150 - RNA, 23 nt, Human
aagucacagggcaguaccugagg

SEQ ID NO: 3484151 - RNA, 20 nt, Human
aagucacauuccugaacagg

SEQ ID NO: 3484152 - RNA, 19 nt, Human
aagucaccacuccauuccc

SEQ ID NO: 3484153 - RNA, 14 nt, Human
aagucaccggagcu

SEQ ID NO: 3484154 - RNA, 18 nt, Human
aagucaccggagcuuuca

SEQ ID NO: 3484155 - RNA, 16 nt, Human
aagucacucaauuguu

SEQ ID NO: 3484156 - RNA, 22 nt, Human
aagucacugcaaaaccagguuu

SEQ ID NO: 3484157 - RNA, 12 nt, Human
aagucacugcac

SEQ ID NO: 3484158 - RNA, 21 nt, Human
aagucacuggccaguggcugg

SEQ ID NO: 3484159 - RNA, 19 nt, Human
aagucagacugcugggacu

SEQ ID NO: 3484160 - RNA, 14 nt, Human
aagucagagacaga

SEQ ID NO: 3484161 - RNA, 15 nt, Human
aagucagaggauggc

SEQ ID NO: 3484162 - RNA, 20 nt, Human
aagucagaggauggccagug

SEQ ID NO: 3484163 - RNA, 21 nt, Human
aagucagaggauggccagugu

SEQ ID NO: 3484164 - RNA, 18 nt, Human
aagucagaucugccuaag

SEQ ID NO: 3484165 - RNA, 21 nt, Human
aagucagaucugccuaaggac

SEQ ID NO: 3484166 - RNA, 23 nt, Human
aagucagaucugccuaaggacuu

SEQ ID NO: 3484167 - RNA, 23 nt, Human
aagucagauggaaaauucauuuu

SEQ ID NO: 3484168 - RNA, 18 nt, Human
aagucagauguuugagca

SEQ ID NO: 3484169 - RNA, 18 nt, Human
aagucagcucuucuccau

SEQ ID NO: 3484170 - RNA, 19 nt, Human
aagucagcuuugccuucca

SEQ ID NO: 3484171 - RNA, 15 nt, Human
aagucagguccaauu

SEQ ID NO: 3484172 - RNA, 21 nt, Human
aagucagugcccaacuguuau

SEQ ID NO: 3484173 - RNA, 15 nt, Human
aagucauccaaucua

SEQ ID NO: 3484174 - RNA, 21 nt, Human
aagucaucuauaguugauaug

SEQ ID NO: 3484175 - RNA, 14 nt, Human
aagaaacauuggaa

SEQ ID NO: 3484176 - RNA, 17 nt, Human
aagaaacauuggaagca

SEQ ID NO: 3484177 - RNA, 11 nt, Human
aagaaacccaa

SEQ ID NO: 3484178 - RNA, 15 nt, Human
aagaaaccuacugcc

SEQ ID NO: 3484179 - RNA, 19 nt, Human
aagaaacucuauggucuua

SEQ ID NO: 3484180 - RNA, 21 nt, Human
aagaaacugaggaauuuucuu

SEQ ID NO: 3484181 - RNA, 21 nt, Human
aagaaacuggggcuccuccag

SEQ ID NO: 3484182 - RNA, 19 nt, Human
aagaaacuuuuguaaagaa

SEQ ID NO: 3484183 - RNA, 16 nt, Human
aagaaagaacuaucuu

SEQ ID NO: 3484184 - RNA, 20 nt, Human
aagaaagaauguuacugccu

SEQ ID NO: 3484185 - RNA, 12 nt, Human
aagaaagacauc

SEQ ID NO: 3484186 - RNA, 14 nt, Human
aagaaagacaucuu

SEQ ID NO: 3484187 - RNA, 20 nt, Human
aagaaagacgcacuuuggcu

SEQ ID NO: 3484188 - RNA, 15 nt, Human
aagaaagagagaaaa

SEQ ID NO: 3484189 - RNA, 17 nt, Human
aagaaagaggagugcuu

SEQ ID NO: 3484190 - RNA, 16 nt, Human
aagaaagcauagacau

SEQ ID NO: 3484191 - RNA, 17 nt, Human
aagaaagccagucuuaa

SEQ ID NO: 3484192 - RNA, 22 nt, Human
aagaaagcuucaaacugcauga

SEQ ID NO: 3484193 - RNA, 20 nt, Human
aagaaaggaagcauuguaaa

SEQ ID NO: 3484194 - RNA, 12 nt, Human
aagaaaguguau

SEQ ID NO: 3484195 - RNA, 22 nt, Human
aagaaaguugcacggcugcuga

SEQ ID NO: 3484196 - RNA, 13 nt, Human
aagaaaguuuccc

SEQ ID NO: 3484197 - RNA, 15 nt, Human
aagaaaguuucccca

SEQ ID NO: 3484198 - RNA, 21 nt, Human
aagaaauaaaaggaagccaaa

SEQ ID NO: 3484199 - RNA, 19 nt, Human
aagaaauaaugcuacaauu

SEQ ID NO: 3484200 - RNA, 15 nt, Human
aagaaauacuguaca

SEQ ID NO: 3484201 - RNA, 15 nt, Human
aagaaauagaacaag

SEQ ID NO: 3484202 - RNA, 20 nt, Human
aagaaauagaacaaggcuga

SEQ ID NO: 3484203 - RNA, 22 nt, Human
aagaaauauaaacacaaauaua

SEQ ID NO: 3484204 - RNA, 23 nt, Human
aagaaauaucugagcucuuugca

SEQ ID NO: 3484205 - RNA, 11 nt, Human
aagaaauaugu

SEQ ID NO: 3484206 - RNA, 14 nt, Human
aagaaaucacagaa

SEQ ID NO: 3484207 - RNA, 16 nt, Human
aagaaaucauguccau

SEQ ID NO: 3484208 - RNA, 15 nt, Human
aagaaaucauguuau

SEQ ID NO: 3484209 - RNA, 19 nt, Human
aagaaauccggagaagcug

SEQ ID NO: 3484210 - RNA, 12 nt, Human
aagaaaugaaca

SEQ ID NO: 3484211 - RNA, 12 nt, Human
aagaaaugaaga

SEQ ID NO: 3484212 - RNA, 16 nt, Human
aagaaaugacuaauua

SEQ ID NO: 3484213 - RNA, 12 nt, Human
aagaaaugaugu

SEQ ID NO: 3484214 - RNA, 15 nt, Human
aagaaaugauguugg

SEQ ID NO: 3484215 - RNA, 16 nt, Human
aagaaaugcaaaaauc

SEQ ID NO: 3484216 - RNA, 16 nt, Human
aagaaaugcacaaugu

SEQ ID NO: 3484217 - RNA, 20 nt, Human
aagaaaugcauaugucacua

SEQ ID NO: 3484218 - RNA, 18 nt, Human
aagaaauggauucuauuu

SEQ ID NO: 3484219 - RNA, 13 nt, Human
aagaaauggugaa

SEQ ID NO: 3484220 - RNA, 13 nt, Human
aagaaauuaacuu

SEQ ID NO: 3484221 - RNA, 17 nt, Human
aagaaauuauaaagaua

SEQ ID NO: 3484222 - RNA, 17 nt, Human
aagaaauugaauacuuu

SEQ ID NO: 3484223 - RNA, 18 nt, Human
aagaaauugaauacuuug

SEQ ID NO: 3484224 - RNA, 16 nt, Human
aagaaauuuacuauau

SEQ ID NO: 3484225 - RNA, 15 nt, Human
aagaaauuucacaua

SEQ ID NO: 3484226 - RNA, 21 nt, Human
aagaacaaagagaaaaaauac

SEQ ID NO: 3484227 - RNA, 12 nt, Human
aagaacaaagua

SEQ ID NO: 3484228 - RNA, 14 nt, Human
aagaacaagaauuu

SEQ ID NO: 3484229 - RNA, 13 nt, Human
aagaacaggccuc

SEQ ID NO: 3484230 - RNA, 20 nt, Human
aagaaccaguccccccaccc

SEQ ID NO: 3484231 - RNA, 22 nt, Human
aagaacccauggaaaaaugcca

SEQ ID NO: 3484232 - RNA, 13 nt, Human
aagaaccccucug

SEQ ID NO: 3484233 - RNA, 18 nt, Human
aagaacggggcucuucuc

SEQ ID NO: 3484234 - RNA, 21 nt, Human
aagaacuagagguuuuaugau

SEQ ID NO: 3484235 - RNA, 14 nt, Human
aagaacuagcauaa

SEQ ID NO: 3484236 - RNA, 14 nt, Human
aagaacuaucuuca

SEQ ID NO: 3484237 - RNA, 16 nt, Human
aagaacuaucuucauc

SEQ ID NO: 3484238 - RNA, 19 nt, Human
aagaacucaucacuguggc

SEQ ID NO: 3484239 - RNA, 14 nt, Human
aagaacugaaaaca

SEQ ID NO: 3484240 - RNA, 12 nt, Human
aagaacugaaau

SEQ ID NO: 3484241 - RNA, 18 nt, Human
aagaacugcaggcccugg

SEQ ID NO: 3484242 - RNA, 18 nt, Human
aagaacugcauggaccua

SEQ ID NO: 3484243 - RNA, 13 nt, Human
aagucuguuuacu

SEQ ID NO: 3484244 - RNA, 14 nt, Human
aagucuguuuacug

SEQ ID NO: 3484245 - RNA, 14 nt, Human
aagucuguuuuaug

SEQ ID NO: 3484246 - RNA, 19 nt, Human
aagucuguuuuaugacuuc

SEQ ID NO: 3484247 - RNA, 20 nt, Human
aagucuguuuuaugacuuca

SEQ ID NO: 3484248 - RNA, 23 nt, Human
aagucuuaaaauaacuuauauca

SEQ ID NO: 3484249 - RNA, 17 nt, Human
aagucuuagauguauau

SEQ ID NO: 3484250 - RNA, 19 nt, Human
aagucuuagauguauauau

SEQ ID NO: 3484251 - RNA, 22 nt, Human
aagucuuauauauuguagauaa

SEQ ID NO: 3484252 - RNA, 17 nt, Human
aagucuucaagggcugc

SEQ ID NO: 3484253 - RNA, 13 nt, Human
aagucuucaugaa

SEQ ID NO: 3484254 - RNA, 16 nt, Human
aagucuucaugaaaug

SEQ ID NO: 3484255 - RNA, 19 nt, Human
aagucuucaugaaaugcua

SEQ ID NO: 3484256 - RNA, 13 nt, Human
aagucuucuauuu

SEQ ID NO: 3484257 - RNA, 17 nt, Human
aagucuucuauuuauuu

SEQ ID NO: 3484258 - RNA, 17 nt, Human
aagucuugccuauauuu

SEQ ID NO: 3484259 - RNA, 21 nt, Human
aagucuugcuguggucucuuu

SEQ ID NO: 3484260 - RNA, 19 nt, Human
aagucuugugacuagugcu

SEQ ID NO: 3484261 - RNA, 23 nt, Human
aagucuugugacuagugcugaag

SEQ ID NO: 3484262 - RNA, 18 nt, Human
aagucuuuaauaaauaac

SEQ ID NO: 3484263 - RNA, 23 nt, Human
aagucuuuaggucuuuguaagaa

SEQ ID NO: 3484264 - RNA, 17 nt, Human
aagucuuucaagaauga

SEQ ID NO: 3484265 - RNA, 17 nt, Human
aagucuuucucuuuccc

SEQ ID NO: 3484266 - RNA, 18 nt, Human
aagucuuucucuuucccu

SEQ ID NO: 3484267 - RNA, 20 nt, Human
aagucuuucucuuucccugg

SEQ ID NO: 3484268 - RNA, 22 nt, Human
aagucuuucucuuucccugguc

SEQ ID NO: 3484269 - RNA, 23 nt, Human
aagucuuucucuuucccuggucc

SEQ ID NO: 3484270 - RNA, 16 nt, Human
aagucuuuuaaaaagu

SEQ ID NO: 3484271 - RNA, 18 nt, Human
aagucuuuuguucgcaug

SEQ ID NO: 3484272 - RNA, 16 nt, Human
aagucuuuuuugauca

SEQ ID NO: 3484273 - RNA, 15 nt, Human
aagucuuuuuuuucc

SEQ ID NO: 3484274 - RNA, 13 nt, Human
aagugaaaaacau

SEQ ID NO: 3484275 - RNA, 14 nt, Human
aagugaaaaucuua

SEQ ID NO: 3484276 - RNA, 18 nt, Human
aagugaaauaacaaaaug

SEQ ID NO: 3484277 - RNA, 12 nt, Human
aagugaaauuua

SEQ ID NO: 3484278 - RNA, 17 nt, Human
aagugaagacaaugacu

SEQ ID NO: 3484279 - RNA, 13 nt, Human
aagugaagacaga

SEQ ID NO: 3484280 - RNA, 14 nt, Human
aagugaauaaaaau

SEQ ID NO: 3484281 - RNA, 13 nt, Human
aagugaauaaacu

SEQ ID NO: 3484282 - RNA, 15 nt, Human
aagugaauugaaguu

SEQ ID NO: 3484283 - RNA, 16 nt, Human
aagugaauugaaguuu

SEQ ID NO: 3484284 - RNA, 21 nt, Human
aagugaauugaaguuucaagu

SEQ ID NO: 3484285 - RNA, 13 nt, Human
aagugaauuuaua

SEQ ID NO: 3484286 - RNA, 14 nt, Human
aagugaauuugaau

SEQ ID NO: 3484287 - RNA, 17 nt, Human
aagugaauuugaaugaa

SEQ ID NO: 3484288 - RNA, 17 nt, Human
aagugaauuugccugua

SEQ ID NO: 3484289 - RNA, 14 nt, Human
aagugaauuuuucu

SEQ ID NO: 3484290 - RNA, 19 nt, Human
aagugaauuuuucucuaac

SEQ ID NO: 3484291 - RNA, 19 nt, Human
aagugacaaggccccagag

SEQ ID NO: 3484292 - RNA, 21 nt, Human
aagugacaaggccccagagac

SEQ ID NO: 3484293 - RNA, 24 nt, Human
aagugacacagcagcuucaccaga

SEQ ID NO: 3484294 - RNA, 16 nt, Human
aagugacagggaagcu

SEQ ID NO: 3484295 - RNA, 20 nt, Human
aagugacagggaagcuacag

SEQ ID NO: 3484296 - RNA, 22 nt, Human
aagugacauugcaucaaagcau

SEQ ID NO: 3484297 - RNA, 16 nt, Human
aagugacuguaucugu

SEQ ID NO: 3484298 - RNA, 15 nt, Human
aagugagaagauggu

SEQ ID NO: 3484299 - RNA, 22 nt, Human
aagugagacaguccagccugga

SEQ ID NO: 3484300 - RNA, 12 nt, Human
aagugagagagg

SEQ ID NO: 3484301 - RNA, 15 nt, Human
aagugagcaaaccug

SEQ ID NO: 3484302 - RNA, 19 nt, Human
aagugagcaaaccugcccc

SEQ ID NO: 3484303 - RNA, 17 nt, Human
aagugagcuuugcugcu

SEQ ID NO: 3484304 - RNA, 21 nt, Human
aagugagcuuugcugcuacag

SEQ ID NO: 3484305 - RNA, 11 nt, Human
aagugaggaag

SEQ ID NO: 3484306 - RNA, 15 nt, Human
aagugaggccacuga

SEQ ID NO: 3484307 - RNA, 17 nt, Human
aagugagucucucuggg

SEQ ID NO: 3484308 - RNA, 17 nt, Human
aagugagugugcugcug

SEQ ID NO: 3484309 - RNA, 19 nt, Human
aagugagugugcugcugua

SEQ ID NO: 3484310 - RNA, 15 nt, Human
aagugauaauuucug

SEQ ID NO: 3484311 - RNA, 22 nt, Human
aagugaucaauaaaaugugauu

SEQ ID NO: 3484312 - RNA, 22 nt, Human
aagugaucuacaugaggaacug

SEQ ID NO: 3484313 - RNA, 13 nt, Human
aagugauucucau

SEQ ID NO: 3484314 - RNA, 16 nt, Human
aagugauucuccugcc

SEQ ID NO: 3484315 - RNA, 18 nt, Human
aagugauugggacagagg

SEQ ID NO: 3484316 - RNA, 13 nt, Human
aagugauuguaug

SEQ ID NO: 3484317 - RNA, 22 nt, Human
aagugcaauaaaucugacccag

SEQ ID NO: 3484318 - RNA, 17 nt, Human
aagugcacacagaaaua

SEQ ID NO: 3484319 - RNA, 18 nt, Human
aagugcacacagaaauau

SEQ ID NO: 3484320 - RNA, 22 nt, Human
aagugcacacagaaauauauau

SEQ ID NO: 3484321 - RNA, 22 nt, Human
aagugcaguucuuagcccucua

SEQ ID NO: 3484322 - RNA, 16 nt, Human
aagugcauccaaaggu

SEQ ID NO: 3484323 - RNA, 16 nt, Human
aagugcaugcucucug

SEQ ID NO: 3484324 - RNA, 13 nt, Human
aagugccaaagaa

SEQ ID NO: 3484325 - RNA, 14 nt, Human
aagugccaaagaaa

SEQ ID NO: 3484326 - RNA, 17 nt, Human
aagugccaaaugcucuc

SEQ ID NO: 3484327 - RNA, 12 nt, Human
aagugccagaaa

SEQ ID NO: 3484328 - RNA, 14 nt, Human
aagugccagaggug

SEQ ID NO: 3484329 - RNA, 15 nt, Human
aagugccagaggugg

SEQ ID NO: 3484330 - RNA, 18 nt, Human
aagugccagaggugggca

SEQ ID NO: 3484331 - RNA, 19 nt, Human
aagugccagaggugggcag

SEQ ID NO: 3484332 - RNA, 20 nt, Human
aagugccagaggugggcagg

SEQ ID NO: 3484333 - RNA, 15 nt, Human
aagugcccuuccugc

SEQ ID NO: 3484334 - RNA, 20 nt, Human
aagugccucaagaggaauga

SEQ ID NO: 3484335 - RNA, 20 nt, Human
aagugccuuucaggaucuau

SEQ ID NO: 3484336 - RNA, 18 nt, Human
aagugccuuucugcaguu

SEQ ID NO: 3484337 - RNA, 16 nt, Human
aagugccuuugcagcu

SEQ ID NO: 3484338 - RNA, 17 nt, Human
aagugcggugcuuuagc

SEQ ID NO: 3484339 - RNA, 17 nt, Human
aagugcguguguagagu

SEQ ID NO: 3484340 - RNA, 15 nt, Human
aagugcuaagguucu

SEQ ID NO: 3484341 - RNA, 17 nt, Human
aagugcuaagguucuaa

SEQ ID NO: 3484342 - RNA, 19 nt, Human
aagugcuaagguucuaagg

SEQ ID NO: 3484343 - RNA, 18 nt, Human
aagugcuauuacgaaguu

SEQ ID NO: 3484344 - RNA, 13 nt, Human
aagugcugagauu

SEQ ID NO: 3484345 - RNA, 14 nt, Human
aagugcugagauua

SEQ ID NO: 3484346 - RNA, 14 nt, Human
aagugcugcacuca

SEQ ID NO: 3484347 - RNA, 19 nt, Human
aagugcugcacucaaauga

SEQ ID NO: 3484348 - RNA, 19 nt, Human
aagugcugcggagcaagag

SEQ ID NO: 3484349 - RNA, 21 nt, Human
aagugcuggcaccaccaggca

SEQ ID NO: 3484350 - RNA, 12 nt, Human
aagugcuguaua

SEQ ID NO: 3484351 - RNA, 15 nt, Human
aagugcuguauaaaa

SEQ ID NO: 3484352 - RNA, 23 nt, Human
aagugcuguauaaaaucagccaa

SEQ ID NO: 3484353 - RNA, 14 nt, Human
aagugcuguuuauu

SEQ ID NO: 3484354 - RNA, 16 nt, Human
aagugcuguuuauuaa

SEQ ID NO: 3484355 - RNA, 17 nt, Human
aagugcuuccaaggcag

SEQ ID NO: 3484356 - RNA, 22 nt, Human
aagugcuuggaacauacuguuc

SEQ ID NO: 3484357 - RNA, 13 nt, Human
aagugcuugugua

SEQ ID NO: 3484358 - RNA, 15 nt, Human
aagugcuuguguaau

SEQ ID NO: 3484359 - RNA, 14 nt, Human
aagugcuuuaaaaa

SEQ ID NO: 3484360 - RNA, 21 nt, Human
aaguggaaaaauagccugccu

SEQ ID NO: 3484361 - RNA, 20 nt, Human
aaguggaacgaaaaugaaag

SEQ ID NO: 3484362 - RNA, 17 nt, Human
aaguggaaggaaagaug

SEQ ID NO: 3484363 - RNA, 17 nt, Human
aaguggaauuucuuguu

SEQ ID NO: 3484364 - RNA, 16 nt, Human
aaguggaccaggacag

SEQ ID NO: 3484365 - RNA, 20 nt, Human
aaguggaccaggacaggacc

SEQ ID NO: 3484366 - RNA, 22 nt, Human
aaguggaccuuaggccuuccuc

SEQ ID NO: 3484367 - RNA, 22 nt, Human
aaguggcaaucucagaugcagu

SEQ ID NO: 3484368 - RNA, 14 nt, Human
aaguggcauaaaaa

SEQ ID NO: 3484369 - RNA, 22 nt, Human
aaguggcauguuuugugcauuu

SEQ ID NO: 3484370 - RNA, 17 nt, Human
aaguggccucuuugucu

SEQ ID NO: 3484371 - RNA, 16 nt, Human
aaguggcuauuucuuu

SEQ ID NO: 3484372 - RNA, 19 nt, Human
aagugggaggucaggaaac

SEQ ID NO: 3484373 - RNA, 16 nt, Human
aagugggccaggacag

SEQ ID NO: 3484374 - RNA, 13 nt, Human
aagugggcccacc

SEQ ID NO: 3484375 - RNA, 16 nt, Human
aagugggcuugauucu

SEQ ID NO: 3484376 - RNA, 20 nt, Human
aaguggggcagcagcagugg

SEQ ID NO: 3484377 - RNA, 13 nt, Human
aaguggggcucgc

SEQ ID NO: 3484378 - RNA, 19 nt, Human
aagugggugagaugcugga

SEQ ID NO: 3484379 - RNA, 19 nt, Human
aaguggguuauucuggagu

SEQ ID NO: 3484380 - RNA, 19 nt, Human
aaguggugcucaguuguag

SEQ ID NO: 3484381 - RNA, 18 nt, Human
aaguggugguaacccugg

SEQ ID NO: 3484382 - RNA, 22 nt, Human
aaguguaaaauauuuugaauca

SEQ ID NO: 3484383 - RNA, 13 nt, Human
aaguguaaagcau

SEQ ID NO: 3484384 - RNA, 21 nt, Human
aaguguaaagcauuccaacaa

SEQ ID NO: 3484385 - RNA, 18 nt, Human
aaguguaaguucacaacu

SEQ ID NO: 3484386 - RNA, 14 nt, Human
aaguguaaugaaua

SEQ ID NO: 3484387 - RNA, 14 nt, Human
aaguguaauugaga

SEQ ID NO: 3484388 - RNA, 17 nt, Human
aaguguacuaauuaaca

SEQ ID NO: 3484389 - RNA, 21 nt, Human
aaguguaggcagacacaggga

SEQ ID NO: 3484390 - RNA, 18 nt, Human
aaguguagguaucauuuu

SEQ ID NO: 3484391 - RNA, 21 nt, Human
aaguguauaauauaaaaaauu

SEQ ID NO: 3484392 - RNA, 19 nt, Human
aaguguauuugaaaaauau

SEQ ID NO: 3484393 - RNA, 18 nt, Human
aagggcagaacacuaacc

SEQ ID NO: 3484394 - RNA, 13 nt, Human
aagggcagaauga

SEQ ID NO: 3484395 - RNA, 22 nt, Human
aagggcaggcccaaauuaucaa

SEQ ID NO: 3484396 - RNA, 22 nt, Human
aagggcagggcaucuccugugc

SEQ ID NO: 3484397 - RNA, 17 nt, Human
aagggcauccuucugcc

SEQ ID NO: 3484398 - RNA, 14 nt, Human
aagggcaugccuug

SEQ ID NO: 3484399 - RNA, 20 nt, Human
aagggccaaagaaccaaaga

SEQ ID NO: 3484400 - RNA, 13 nt, Human
aagggccagagcc

SEQ ID NO: 3484401 - RNA, 15 nt, Human
aagggccagagccag

SEQ ID NO: 3484402 - RNA, 21 nt, Human
aagggccagcguggcucuaaa

SEQ ID NO: 3484403 - RNA, 14 nt, Human
aagggccaguccug

SEQ ID NO: 3484404 - RNA, 15 nt, Human
aagggcccagagagg

SEQ ID NO: 3484405 - RNA, 11 nt, Human
aagggcccagg

SEQ ID NO: 3484406 - RNA, 23 nt, Human
aagggccugcccaguugcacuca

SEQ ID NO: 3484407 - RNA, 14 nt, Human
aagggcugcaugau

SEQ ID NO: 3484408 - RNA, 17 nt, Human
aagggcugcaugauguu

SEQ ID NO: 3484409 - RNA, 21 nt, Human
aagggcugccggggcagcccc

SEQ ID NO: 3484410 - RNA, 17 nt, Human
aagggcuucugcacccu

SEQ ID NO: 3484411 - RNA, 14 nt, Human
aagggcuuuccugu

SEQ ID NO: 3484412 - RNA, 18 nt, Human
aagggcuuuguuuugcac

SEQ ID NO: 3484413 - RNA, 20 nt, Human
aagggcuuuucaaaaucauu

SEQ ID NO: 3484414 - RNA, 18 nt, Human
aaggggaagcacucgugu

SEQ ID NO: 3484415 - RNA, 23 nt, Human
aaggggaauguuugccucugccu

SEQ ID NO: 3484416 - RNA, 16 nt, Human
aaggggacagcugugu

SEQ ID NO: 3484417 - RNA, 12 nt, Human
aaggggacaggc

SEQ ID NO: 3484418 - RNA, 19 nt, Human
aaggggacccuccgcucug

SEQ ID NO: 3484419 - RNA, 17 nt, Human
aaggggacugccaccuc

SEQ ID NO: 3484420 - RNA, 16 nt, Human
aaggggagaagggaau

SEQ ID NO: 3484421 - RNA, 19 nt, Human
aaggggaggaccucugggc

SEQ ID NO: 3484422 - RNA, 15 nt, Human
aaggggaggagggcg

SEQ ID NO: 3484423 - RNA, 16 nt, Human
aaggggaggcagccgg

SEQ ID NO: 3484424 - RNA, 19 nt, Human
aaggggagucaccuucccu

SEQ ID NO: 3484425 - RNA, 21 nt, Human
aaggggagucaccuucccuug

SEQ ID NO: 3484426 - RNA, 21 nt, Human
aaggggaucauaaaguuagaa

SEQ ID NO: 3484427 - RNA, 22 nt, Human
aaggggauguauccaugggggc

SEQ ID NO: 3484428 - RNA, 18 nt, Human
aaggggcaaauuuuuauu

SEQ ID NO: 3484429 - RNA, 18 nt, Human
aaggggcagucuggaggg

SEQ ID NO: 3484430 - RNA, 17 nt, Human
aaggggccagaggcucg

SEQ ID NO: 3484431 - RNA, 15 nt, Human
aaggggcccguggga

SEQ ID NO: 3484432 - RNA, 13 nt, Human
aaggggcccuggu

SEQ ID NO: 3484433 - RNA, 23 nt, Human
aaggggccucaccgagugggggc

SEQ ID NO: 3484434 - RNA, 21 nt, Human
aaggggccuuugucuugucaa

SEQ ID NO: 3484435 - RNA, 18 nt, Human
aagggggaggggaagucc

SEQ ID NO: 3484436 - RNA, 18 nt, Human
aagggggcaucuggccuu

SEQ ID NO: 3484437 - RNA, 13 nt, Human
aaggggggagggg

SEQ ID NO: 3484438 - RNA, 19 nt, Human
aagggggggcuacauuaua

SEQ ID NO: 3484439 - RNA, 19 nt, Human
aagggggucccagugggag

SEQ ID NO: 3484440 - RNA, 17 nt, Human
aaggggucaaaauuugc

SEQ ID NO: 3484441 - RNA, 14 nt, Human
aaggggugcuuuua

SEQ ID NO: 3484442 - RNA, 17 nt, Human
aaggggugcuuuuauag

SEQ ID NO: 3484443 - RNA, 15 nt, Human
aagggguugggguga

SEQ ID NO: 3484444 - RNA, 22 nt, Human
aagggguuggggugacagucau

SEQ ID NO: 3484445 - RNA, 20 nt, Human
aagggguugguugaggugga

SEQ ID NO: 3484446 - RNA, 16 nt, Human
aagggguuugccauuu

SEQ ID NO: 3484447 - RNA, 12 nt, Human
aagggguuuucu

SEQ ID NO: 3484448 - RNA, 22 nt, Human
aagggguuuucuugauaauuuu

SEQ ID NO: 3484449 - RNA, 13 nt, Human
aaggguaaacaau

SEQ ID NO: 3484450 - RNA, 13 nt, Human
aaggguaaagaag

SEQ ID NO: 3484451 - RNA, 18 nt, Human
aagggucaacaucuuuua

SEQ ID NO: 3484452 - RNA, 14 nt, Human
aagggucaggccuu

SEQ ID NO: 3484453 - RNA, 19 nt, Human
aagggucgaaagcucuaga

SEQ ID NO: 3484454 - RNA, 21 nt, Human
aagggucgaaagcucuagaau

SEQ ID NO: 3484455 - RNA, 20 nt, Human
aagggucuagggagagaccc

SEQ ID NO: 3484456 - RNA, 23 nt, Human
aagggucuccgaaaugcugucuu

SEQ ID NO: 3484457 - RNA, 15 nt, Human
aagggugaaaauuau

SEQ ID NO: 3484458 - RNA, 19 nt, Human
aagggugaugggaaagcau

SEQ ID NO: 3484459 - RNA, 19 nt, Human
aagggugauguacacaugu

SEQ ID NO: 3484460 - RNA, 20 nt, Human
aagggugcugcuucccucug

SEQ ID NO: 3484461 - RNA, 16 nt, Human
aagggugggugcucag

SEQ ID NO: 3484462 - RNA, 14 nt, Human
aaggguuaagaaaa

SEQ ID NO: 3484463 - RNA, 15 nt, Human
aaggguuaaggccug

SEQ ID NO: 3484464 - RNA, 16 nt, Human
aaggguuaaggccuga

SEQ ID NO: 3484465 - RNA, 14 nt, Human
aaggguuauauuuu

SEQ ID NO: 3484466 - RNA, 22 nt, Human
aagugcauuucugaauagaaau

SEQ ID NO: 3484467 - RNA, 23 nt, Human
aagugcauuucugaauagaaaug

SEQ ID NO: 3484468 - RNA, 16 nt, Human
aagugcauuuuuguaa

SEQ ID NO: 3484469 - RNA, 20 nt, Human
aagugccacucauuccugua

SEQ ID NO: 3484470 - RNA, 22 nt, Human
aagugccacugcccgagcuggu

SEQ ID NO: 3484471 - RNA, 15 nt, Human
aagugccaguauuuu

SEQ ID NO: 3484472 - RNA, 23 nt, Human
aagugccaguauuuuaaaauagc

SEQ ID NO: 3484473 - RNA, 12 nt, Human
aagugcccccuc

SEQ ID NO: 3484474 - RNA, 14 nt, Human
aagugcccccuccc

SEQ ID NO: 3484475 - RNA, 19 nt, Human
aagugccccugcugccucc

SEQ ID NO: 3484476 - RNA, 18 nt, Human
aagugcccuccaggcuuu

SEQ ID NO: 3484477 - RNA, 15 nt, Human
aagugcccucuccca

SEQ ID NO: 3484478 - RNA, 16 nt, Human
aagugccgcaaauugu

SEQ ID NO: 3484479 - RNA, 18 nt, Human
aagugccuacauuaucua

SEQ ID NO: 3484480 - RNA, 21 nt, Human
aagugccuuucaggaucuauu

SEQ ID NO: 3484481 - RNA, 23 nt, Human
aagugccuuucugcaguuuuuca

SEQ ID NO: 3484482 - RNA, 15 nt, Human
aagugcgugaaugua

SEQ ID NO: 3484483 - RNA, 18 nt, Human
aagugcguguguagaguu

SEQ ID NO: 3484484 - RNA, 14 nt, Human
aagugcuacauaaa

SEQ ID NO: 3484485 - RNA, 17 nt, Human
aagugcuacauaaauug

SEQ ID NO: 3484486 - RNA, 13 nt, Human
aagugcugcauuu

SEQ ID NO: 3484487 - RNA, 22 nt, Human
aagugcugcauuuaaaagauac

SEQ ID NO: 3484488 - RNA, 23 nt, Human
aagugcuggcaaccacuaagaau

SEQ ID NO: 3484489 - RNA, 17 nt, Human
aagugcuguuuauuaau

SEQ ID NO: 3484490 - RNA, 18 nt, Human
aagugcuguuuauuaauc

SEQ ID NO: 3484491 - RNA, 20 nt, Human
aagugcuguuuauuaaucuu

SEQ ID NO: 3484492 - RNA, 21 nt, Human
aagugcuguuuauuaaucuua

SEQ ID NO: 3484493 - RNA, 22 nt, Human
aagugcuguuuauuaaucuuag

SEQ ID NO: 3484494 - RNA, 19 nt, Human
aagugcuucauucuuugca

SEQ ID NO: 3484495 - RNA, 13 nt, Human
aaguggaaauguu

SEQ ID NO: 3484496 - RNA, 13 nt, Human
aaguggaaggaaa

SEQ ID NO: 3484497 - RNA, 18 nt, Human
aaguggacuggccccugg

SEQ ID NO: 3484498 - RNA, 20 nt, Human
aaguggacuggccccugggu

SEQ ID NO: 3484499 - RNA, 18 nt, Human
aaguggcaccugucugcu

SEQ ID NO: 3484500 - RNA, 23 nt, Human
aaguggccuccgucacuaccugg

SEQ ID NO: 3484501 - RNA, 14 nt, Human
aaguggccucuuug

SEQ ID NO: 3484502 - RNA, 12 nt, Human
aaguggcugcug

SEQ ID NO: 3484503 - RNA, 20 nt, Human
aagugggaggucaggaaacu

SEQ ID NO: 3484504 - RNA, 15 nt, Human
aagugggcccacccg

SEQ ID NO: 3484505 - RNA, 13 nt, Human
aaguggggcagag

SEQ ID NO: 3484506 - RNA, 15 nt, Human
aaguggggcucgcca

SEQ ID NO: 3484507 - RNA, 20 nt, Human
aagugggguugcaaccacug

SEQ ID NO: 3484508 - RNA, 15 nt, Human
aaguggguaccccca

SEQ ID NO: 3484509 - RNA, 21 nt, Human
aaguggguuuuuuaguugaau

SEQ ID NO: 3484510 - RNA, 17 nt, Human
aagugguauagaaaugc

SEQ ID NO: 3484511 - RNA, 17 nt, Human
aaguggugguaacccug

SEQ ID NO: 3484512 - RNA, 17 nt, Human
aaguguaaacaccauag

SEQ ID NO: 3484513 - RNA, 14 nt, Human
aaguguaaagcauu

SEQ ID NO: 3484514 - RNA, 20 nt, Human
aaguguaaagcauuccaaca

SEQ ID NO: 3484515 - RNA, 16 nt, Human
aaguguaaauccuuuu

SEQ ID NO: 3484516 - RNA, 14 nt, Human
aaguguaacagcug

SEQ ID NO: 3484517 - RNA, 21 nt, Human
aaguguaacagcugaggucuc

SEQ ID NO: 3484518 - RNA, 11 nt, Human
aaguguaacug

SEQ ID NO: 3484519 - RNA, 15 nt, Human
aaguguacuggauuu

SEQ ID NO: 3484520 - RNA, 15 nt, Human
aaguguaggcagaca

SEQ ID NO: 3484521 - RNA, 16 nt, Human
aaguguaggcagacac

SEQ ID NO: 3484522 - RNA, 20 nt, Human
aaguguaggcagacacaggg

SEQ ID NO: 3484523 - RNA, 17 nt, Human
aaguguauuuugaaauu

SEQ ID NO: 3484524 - RNA, 23 nt, Human
aaguguauuuuuuuacuaauaga

SEQ ID NO: 3484525 - RNA, 23 nt, Human
aagugucaccuuuucuugccuga

SEQ ID NO: 3484526 - RNA, 14 nt, Human
aagugucugugugc

SEQ ID NO: 3484527 - RNA, 18 nt, Human
aagugugaauacugcuug

SEQ ID NO: 3484528 - RNA, 11 nt, Human
aagugugagua

SEQ ID NO: 3484529 - RNA, 20 nt, Human
aagugugaguaagagcuggu

SEQ ID NO: 3484530 - RNA, 21 nt, Human
aagugugauugggaauaaaua

SEQ ID NO: 3484531 - RNA, 22 nt, Human
aagugugauugggaauaaauau

SEQ ID NO: 3484532 - RNA, 11 nt, Human
aagugugcaua

SEQ ID NO: 3484533 - RNA, 17 nt, Human
aagugugcauauuguac

SEQ ID NO: 3484534 - RNA, 19 nt, Human
aagugugcauauuguacac

SEQ ID NO: 3484535 - RNA, 23 nt, Human
aagugugcuuuaugcugaaacag

SEQ ID NO: 3484536 - RNA, 19 nt, Human
aaguguggucccaacagga

SEQ ID NO: 3484537 - RNA, 16 nt, Human
aaguguguauauauuu

SEQ ID NO: 3484538 - RNA, 17 nt, Human
aaguguguauauauuuu

SEQ ID NO: 3484539 - RNA, 16 nt, Human
aaguguguguaguuuu

SEQ ID NO: 3484540 - RNA, 12 nt, Human
aaguguguguuu

SEQ ID NO: 3484541 - RNA, 15 nt, Human
aaguguuagauagaa

SEQ ID NO: 3484542 - RNA, 23 nt, Human
aaguguuagccuuuuuuccccag

SEQ ID NO: 3484543 - RNA, 21 nt, Human
aaguguuauuuuucaaggaag

SEQ ID NO: 3484544 - RNA, 22 nt, Human
aaguguuauuuuucaaggaagg

SEQ ID NO: 3484545 - RNA, 18 nt, Human
aaguguugaagggaggug

SEQ ID NO: 3484546 - RNA, 23 nt, Human
aaguguugggguuugguuuuguu

SEQ ID NO: 3484547 - RNA, 17 nt, Human
aaguguuguaaauauuu

SEQ ID NO: 3484548 - RNA, 20 nt, Human
aaguguuguaaauauuuaug

SEQ ID NO: 3484549 - RNA, 23 nt, Human
aaguguuuaacuugucaaaaaac

SEQ ID NO: 3484550 - RNA, 16 nt, Human
aaguguuuauuuuuca

SEQ ID NO: 3484551 - RNA, 22 nt, Human
aaguguuuucucugaacacauu

SEQ ID NO: 3484552 - RNA, 11 nt, Human
aaguuaaaagu

SEQ ID NO: 3484553 - RNA, 13 nt, Human
aaguuaaaauugu

SEQ ID NO: 3484554 - RNA, 14 nt, Human
aaguuaaauaaauc

SEQ ID NO: 3484555 - RNA, 17 nt, Human
aaguuaaauguagaguu

SEQ ID NO: 3484556 - RNA, 20 nt, Human
aaguuaagagaaacuuuaua

SEQ ID NO: 3484557 - RNA, 17 nt, Human
aaguuaauguauauaaa

SEQ ID NO: 3484558 - RNA, 19 nt, Human
aaguuaauguauauaaaaa

SEQ ID NO: 3484559 - RNA, 13 nt, Human
aaguuacagaaau

SEQ ID NO: 3484560 - RNA, 20 nt, Human
aaguuacauguuugcaccuu

SEQ ID NO: 3484561 - RNA, 18 nt, Human
aaguuacuauccuggcuu

SEQ ID NO: 3484562 - RNA, 15 nt, Human
aaguuacuuauucua

SEQ ID NO: 3484563 - RNA, 23 nt, Human
aaguuacuucacuuuaauucuca

SEQ ID NO: 3484564 - RNA, 16 nt, Human
aaguuacuuucuuaau

SEQ ID NO: 3484565 - RNA, 12 nt, Human
aaguuacuuugu

SEQ ID NO: 3484566 - RNA, 22 nt, Human
aaguuagaacuagccaaaccag

SEQ ID NO: 3484567 - RNA, 16 nt, Human
aaguuagaaucuauuu

SEQ ID NO: 3484568 - RNA, 17 nt, Human
aaguuagaaucuauuuu

SEQ ID NO: 3484569 - RNA, 21 nt, Human
aaguuagaauuccuucagggu

SEQ ID NO: 3484570 - RNA, 21 nt, Human
aaguuagccuuuaucuaccaa

SEQ ID NO: 3484571 - RNA, 15 nt, Human
aaguuagcucaggag

SEQ ID NO: 3484572 - RNA, 14 nt, Human
aaguuagcugagcg

SEQ ID NO: 3484573 - RNA, 19 nt, Human
aaguuaguaucuuuugaua

SEQ ID NO: 3484574 - RNA, 11 nt, Human
aaguuagucua

SEQ ID NO: 3484575 - RNA, 23 nt, Human
aaguuagugcuuguucuaagauu

SEQ ID NO: 3484576 - RNA, 16 nt, Human
aaguuaguggaaaucu

SEQ ID NO: 3484577 - RNA, 19 nt, Human
aaguuaguggaaaucugaa

SEQ ID NO: 3484578 - RNA, 22 nt, Human
aaguuaguggaaaucugaacau

SEQ ID NO: 3484579 - RNA, 15 nt, Human
aaguuaguuuguaua

SEQ ID NO: 3484580 - RNA, 17 nt, Human
aaguuaguuuguauaua

SEQ ID NO: 3484581 - RNA, 20 nt, Human
aaguuauaaaucaaugucac

SEQ ID NO: 3484582 - RNA, 15 nt, Human
aaguuauaagacucu

SEQ ID NO: 3484583 - RNA, 16 nt, Human
aaguuauauaaagaga

SEQ ID NO: 3484584 - RNA, 19 nt, Human
aaguuauauaaagagaaaa

SEQ ID NO: 3484585 - RNA, 20 nt, Human
aaguuauauaaagagaaaau

SEQ ID NO: 3484586 - RNA, 17 nt, Human
aaguuauauuucagaug

SEQ ID NO: 3484587 - RNA, 22 nt, Human
aaguuauauuuccuauaccauu

SEQ ID NO: 3484588 - RNA, 16 nt, Human
aaguuauguguaugug

SEQ ID NO: 3484589 - RNA, 23 nt, Human
aaguuauuaagagguaagacuua

SEQ ID NO: 3484590 - RNA, 17 nt, Human
aaguuauuaauuucuuc

SEQ ID NO: 3484591 - RNA, 14 nt, Human
aaguuauugacaaa

SEQ ID NO: 3484592 - RNA, 14 nt, Human
aaguuauugcaguu

SEQ ID NO: 3484593 - RNA, 17 nt, Human
aaguuauugcaguuuau

SEQ ID NO: 3484594 - RNA, 13 nt, Human
aaguuauuucuug

SEQ ID NO: 3484595 - RNA, 19 nt, Human
aaguuauuucuuguuuguu

SEQ ID NO: 3484596 - RNA, 18 nt, Human
aaguuauuuucuacagug

SEQ ID NO: 3484597 - RNA, 15 nt, Human
aaguuauuuuuguac

SEQ ID NO: 3484598 - RNA, 15 nt, Human
aagaugcaaggacca

SEQ ID NO: 3484599 - RNA, 15 nt, Human
aagaugcaauguaga

SEQ ID NO: 3484600 - RNA, 23 nt, Human
aagaugcacuuugcuuuaauaua

SEQ ID NO: 3484601 - RNA, 12 nt, Human
aagaugcagccg

SEQ ID NO: 3484602 - RNA, 15 nt, Human
aagaugcauuguagu

SEQ ID NO: 3484603 - RNA, 23 nt, Human
aagaugcuccagcaacacagccu

SEQ ID NO: 3484604 - RNA, 15 nt, Human
aagaugcucuaucuu

SEQ ID NO: 3484605 - RNA, 17 nt, Human
aagaugcucuucugugg

SEQ ID NO: 3484606 - RNA, 21 nt, Human
aagaugcugaaacaggagaga

SEQ ID NO: 3484607 - RNA, 14 nt, Human
aagaugcuggguug

SEQ ID NO: 3484608 - RNA, 20 nt, Human
aagaugcuggguuggugcac

SEQ ID NO: 3484609 - RNA, 15 nt, Human
aagauggaaaggauu

SEQ ID NO: 3484610 - RNA, 23 nt, Human
aaguucaaauucuucugaacuca

SEQ ID NO: 3484611 - RNA, 14 nt, Human
aaguucagaguuuu

SEQ ID NO: 3484612 - RNA, 12 nt, Human
aaguucauacau

SEQ ID NO: 3484613 - RNA, 21 nt, Human
aaguucauaccuaaguacugu

SEQ ID NO: 3484614 - RNA, 23 nt, Human
aaguucauaccuaaguacuguaa

SEQ ID NO: 3484615 - RNA, 21 nt, Human
aaguucauauuccauauuuau

SEQ ID NO: 3484616 - RNA, 21 nt, Human
aaguucauguccaaacguccu

SEQ ID NO: 3484617 - RNA, 16 nt, Human
aaguuccaagagucua

SEQ ID NO: 3484618 - RNA, 17 nt, Human
aaguuccaagagucuaa

SEQ ID NO: 3484619 - RNA, 20 nt, Human
aaguuccaagagucuaaaga

SEQ ID NO: 3484620 - RNA, 21 nt, Human
aaguuccaagagucuaaagau

SEQ ID NO: 3484621 - RNA, 15 nt, Human
aaguuccacugagcu

SEQ ID NO: 3484622 - RNA, 17 nt, Human
aaguucccaguuggagc

SEQ ID NO: 3484623 - RNA, 14 nt, Human
aaguucccuacuuc

SEQ ID NO: 3484624 - RNA, 11 nt, Human
aaguuccuucc

SEQ ID NO: 3484625 - RNA, 14 nt, Human
aaguuccuuugggu

SEQ ID NO: 3484626 - RNA, 15 nt, Human
aaguucgucuguugu

SEQ ID NO: 3484627 - RNA, 14 nt, Human
aaguucuaagauuc

SEQ ID NO: 3484628 - RNA, 19 nt, Human
aaguucuaagauucuaaug

SEQ ID NO: 3484629 - RNA, 16 nt, Human
aaguucuaagauucug

SEQ ID NO: 3484630 - RNA, 17 nt, Human
aaguucuaauaauuucu

SEQ ID NO: 3484631 - RNA, 18 nt, Human
aaguucuaauaauuucua

SEQ ID NO: 3484632 - RNA, 19 nt, Human
aaguucuaauaauuucuaa

SEQ ID NO: 3484633 - RNA, 14 nt, Human
aaguucuaguguuu

SEQ ID NO: 3484634 - RNA, 17 nt, Human
aaguucuauuuaagugu

SEQ ID NO: 3484635 - RNA, 13 nt, Human
aaguucugcagau

SEQ ID NO: 3484636 - RNA, 15 nt, Human
aaguucugccucuga

SEQ ID NO: 3484637 - RNA, 17 nt, Human
aaguucugccucugaug

SEQ ID NO: 3484638 - RNA, 20 nt, Human
aaguucuggaugcauuucuc

SEQ ID NO: 3484639 - RNA, 22 nt, Human
aaguucuguguuuaauuucuuc

SEQ ID NO: 3484640 - RNA, 9 nt, Human
aaguucuua

SEQ ID NO: 3484641 - RNA, 15 nt, Human
aaguucuuaguugcu

SEQ ID NO: 3484642 - RNA, 11 nt, Human
aaguucuuaug

SEQ ID NO: 3484643 - RNA, 19 nt, Human
aaguucuuaugaggagggg

SEQ ID NO: 3484644 - RNA, 15 nt, Human
aaguucuucuccaau

SEQ ID NO: 3484645 - RNA, 14 nt, Human
aaguucuuugauuc

SEQ ID NO: 3484646 - RNA, 17 nt, Human
aaguugaaauuaaccau

SEQ ID NO: 3484647 - RNA, 24 nt, Human
aaguugaauuuauuggcuuuucug

SEQ ID NO: 3484648 - RNA, 20 nt, Human
aaguugacuuauaguacaug

SEQ ID NO: 3484649 - RNA, 23 nt, Human
aaguugagauaguuuucauccau

SEQ ID NO: 3484650 - RNA, 19 nt, Human
aaguugagcuaugacuuaa

SEQ ID NO: 3484651 - RNA, 16 nt, Human
aaguugaggcauuugg

SEQ ID NO: 3484652 - RNA, 13 nt, Human
aaguugaggggcu

SEQ ID NO: 3484653 - RNA, 20 nt, Human
aaguugauauagaacagugc

SEQ ID NO: 3484654 - RNA, 17 nt, Human
aaguugaucuccccagc

SEQ ID NO: 3484655 - RNA, 14 nt, Human
aaguugcagcuguu

SEQ ID NO: 3484656 - RNA, 17 nt, Human
aaguugcagcuguuuug

SEQ ID NO: 3484657 - RNA, 21 nt, Human
aaguugcagcuguuuuguuga

SEQ ID NO: 3484658 - RNA, 16 nt, Human
aaguugcagugagcug

SEQ ID NO: 3484659 - RNA, 20 nt, Human
aaguugcgacggagagaaaa

SEQ ID NO: 3484660 - RNA, 22 nt, Human
aaguugcgacggagagaaaaaa

SEQ ID NO: 3484661 - RNA, 20 nt, Human
aaguuggaaacacuaaaugu

SEQ ID NO: 3484662 - RNA, 18 nt, Human
aaguuggacuaaaugccu

SEQ ID NO: 3484663 - RNA, 16 nt, Human
aaguuggcuucuguuu

SEQ ID NO: 3484664 - RNA, 17 nt, Human
aaguuggcuucuguuuc

SEQ ID NO: 3484665 - RNA, 16 nt, Human
aaguugggacucugga

SEQ ID NO: 3484666 - RNA, 16 nt, Human
aaguugggagccugaa

SEQ ID NO: 3484667 - RNA, 20 nt, Human
aaguugggcaauauaaccaa

SEQ ID NO: 3484668 - RNA, 21 nt, Human
aaguuggggacacauguauuu

SEQ ID NO: 3484669 - RNA, 16 nt, Human
aaguugguauuaauaa

SEQ ID NO: 3484670 - RNA, 19 nt, Human
aaguugguauuaauaaaaa

SEQ ID NO: 3484671 - RNA, 14 nt, Human
aaguuguaaaguau

SEQ ID NO: 3484672 - RNA, 17 nt, Human
aaguuguaaaguaugua

SEQ ID NO: 3484673 - RNA, 12 nt, Human
aaguuguacuuu

SEQ ID NO: 3484674 - RNA, 21 nt, Human
aaguuguacuuuaaaaauuua

SEQ ID NO: 3484675 - RNA, 22 nt, Human
aaguuguaggcauaaagucagg

SEQ ID NO: 3484676 - RNA, 18 nt, Human
aaguugugccuuuuauag

SEQ ID NO: 3484677 - RNA, 16 nt, Human
aaguuguggugcugac

SEQ ID NO: 3484678 - RNA, 18 nt, Human
aaguuguucaaacauuua

SEQ ID NO: 3484679 - RNA, 14 nt, Human
aaguuguucaacua

SEQ ID NO: 3484680 - RNA, 20 nt, Human
aaguuguuccuuaagucaga

SEQ ID NO: 3484681 - RNA, 15 nt, Human
aaguuguuugagaaa

SEQ ID NO: 3484682 - RNA, 21 nt, Human
aaguuguuugagaaauuaagu

SEQ ID NO: 3484683 - RNA, 17 nt, Human
aaguuguuugucaucuu

SEQ ID NO: 3484684 - RNA, 13 nt, Human
aaguuuaaaaugu

SEQ ID NO: 3484685 - RNA, 17 nt, Human
aaguuuaaagcucgaaa

SEQ ID NO: 3484686 - RNA, 15 nt, Human
aaguuuaauauuaaa

SEQ ID NO: 3484687 - RNA, 18 nt, Human
aaguuuacaaguguauau

SEQ ID NO: 3484688 - RNA, 21 nt, Human
aaguuuacaaguguauaucag

SEQ ID NO: 3484689 - RNA, 18 nt, Human
aaguuuacaguaaauaaa

SEQ ID NO: 3484690 - RNA, 18 nt, Human
aaguuuacauuguaaaua

SEQ ID NO: 3484691 - RNA, 11 nt, Human
aaguuuagaga

SEQ ID NO: 3484692 - RNA, 14 nt, Human
aaguuuagcucuga

SEQ ID NO: 3484693 - RNA, 15 nt, Human
aaguuuagcucugag

SEQ ID NO: 3484694 - RNA, 13 nt, Human
aaguuuauauaua

SEQ ID NO: 3484695 - RNA, 20 nt, Human
aaguuuaucaguaaauaacu

SEQ ID NO: 3484696 - RNA, 12 nt, Human
aaguuuauucuc

SEQ ID NO: 3484697 - RNA, 14 nt, Human
aaguuucaaaaauc

SEQ ID NO: 3484698 - RNA, 21 nt, Human
aaguuucaaaaaucugaagau

SEQ ID NO: 3484699 - RNA, 20 nt, Human
aaguuucaaacuuacuauuu

SEQ ID NO: 3484700 - RNA, 12 nt, Human
aaguuucaggug

SEQ ID NO: 3484701 - RNA, 15 nt, Human
aaguuucaggugaca

SEQ ID NO: 3484702 - RNA, 22 nt, Human
aaguuucaggugacaugugaaa

SEQ ID NO: 3484703 - RNA, 15 nt, Human
aaguuucaucauuuu

SEQ ID NO: 3484704 - RNA, 13 nt, Human
aaguuuccaagca

SEQ ID NO: 3484705 - RNA, 24 nt, Human
aaguuuccaagcaaauguuacaua

SEQ ID NO: 3484706 - RNA, 17 nt, Human
aaguuuccccaccagug

SEQ ID NO: 3484707 - RNA, 21 nt, Human
aaguuuccuaaucagaaauuu

SEQ ID NO: 3484708 - RNA, 20 nt, Human
aaguuuccuuccagcccaga

SEQ ID NO: 3484709 - RNA, 21 nt, Human
aaguuuccuuccagcccagaa

SEQ ID NO: 3484710 - RNA, 20 nt, Human
aaguuuccuuggcuggugca

SEQ ID NO: 3484711 - RNA, 12 nt, Human
aaguuucuaaga

SEQ ID NO: 3484712 - RNA, 16 nt, Human
aaguuucuaagauucu

SEQ ID NO: 3484713 - RNA, 18 nt, Human
aaguuucuaagauucuaa

SEQ ID NO: 3484714 - RNA, 21 nt, Human
aaguuucuaagauucuaaagg

SEQ ID NO: 3484715 - RNA, 21 nt, Human
aaguuucuagcuagaaauaug

SEQ ID NO: 3484716 - RNA, 23 nt, Human
aaguuucuagcuagaaauaugau

SEQ ID NO: 3484717 - RNA, 13 nt, Human
aaguuucucagau

SEQ ID NO: 3484718 - RNA, 22 nt, Human
aaguuucucagauccuuguuuc

SEQ ID NO: 3484719 - RNA, 23 nt, Human
aaguuucucagauccuuguuuca

SEQ ID NO: 3484720 - RNA, 13 nt, Human
aaguuugaauguu

SEQ ID NO: 3484721 - RNA, 22 nt, Human
aaguuugaauguuaaauaaauu

SEQ ID NO: 3484722 - RNA, 15 nt, Human
aaguuugaucuuccu

SEQ ID NO: 3484723 - RNA, 18 nt, Human
aaguuugaucuuccucug

SEQ ID NO: 3484724 - RNA, 12 nt, Human
aaguuugcaauu

SEQ ID NO: 3484725 - RNA, 21 nt, Human
aaguuugcacuaucuuucagc

SEQ ID NO: 3484726 - RNA, 19 nt, Human
aaguuuguaguuguuuuaa

SEQ ID NO: 3484727 - RNA, 23 nt, Human
aaguuuguuagauagcugcaugu

SEQ ID NO: 3484728 - RNA, 16 nt, Human
aaguuuguuuuugcgu

SEQ ID NO: 3484729 - RNA, 13 nt, Human
aaguuuuaaaguu

SEQ ID NO: 3484730 - RNA, 15 nt, Human
aaguuuuaaaguuca

SEQ ID NO: 3484731 - RNA, 13 nt, Human
aaguuuuaaugua

SEQ ID NO: 3484732 - RNA, 14 nt, Human
aaguuuuaauguau

SEQ ID NO: 3484733 - RNA, 21 nt, Human
aaguuuuaggacaaacagcuc

SEQ ID NO: 3484734 - RNA, 15 nt, Human
aaguuuuauauauua

SEQ ID NO: 3484735 - RNA, 17 nt, Human
aaguuuuauauauuaua

SEQ ID NO: 3484736 - RNA, 13 nt, Human
aaguuuuauaugc

SEQ ID NO: 3484737 - RNA, 23 nt, Human
aaguuuucagaaccucuucccca

SEQ ID NO: 3484738 - RNA, 16 nt, Human
aaguuuucccugaagu

SEQ ID NO: 3484739 - RNA, 23 nt, Human
aaguuuucccugaaguuaugugu

SEQ ID NO: 3484740 - RNA, 15 nt, Human
aaguuuugcauuuau

SEQ ID NO: 3484741 - RNA, 23 nt, Human
aaguuuuggguauguuuaaucug

SEQ ID NO: 3484742 - RNA, 19 nt, Human
aaguuuuguaaaagaaauc

SEQ ID NO: 3484743 - RNA, 14 nt, Human
aaguuuuguacaga

SEQ ID NO: 3484744 - RNA, 12 nt, Human
aaguuuugugaa

SEQ ID NO: 3484745 - RNA, 19 nt, Human
aaguuuugugaaauuuuuc

SEQ ID NO: 3484746 - RNA, 17 nt, Human
aaguuuuuguacuguaa

SEQ ID NO: 3484747 - RNA, 13 nt, Human
aaguuuuuuugcu

SEQ ID NO: 3484748 - RNA, 13 nt, Human
aauaaaaaaaaga

SEQ ID NO: 3484749 - RNA, 15 nt, Human
aauaaaaaaaagaaa

SEQ ID NO: 3484750 - RNA, 18 nt, Human
aauaaaaaaaagaaaaaa

SEQ ID NO: 3484751 - RNA, 14 nt, Human
aauaaaaaaagaaa

SEQ ID NO: 3484752 - RNA, 13 nt, Human
aauaaaaaauaua

SEQ ID NO: 3484753 - RNA, 13 nt, Human
aauaaaaaaugga

SEQ ID NO: 3484754 - RNA, 14 nt, Human
aauaaaaaauuaug

SEQ ID NO: 3484755 - RNA, 15 nt, Human
aaucaucauuauuau

SEQ ID NO: 3484756 - RNA, 14 nt, Human
aaucaucgaaaauu

SEQ ID NO: 3484757 - RNA, 12 nt, Human
aaucaucuauuu

SEQ ID NO: 3484758 - RNA, 18 nt, Human
aaucaugaaagcaucuga

SEQ ID NO: 3484759 - RNA, 17 nt, Human
aaucaugaaauaugcau

SEQ ID NO: 3484760 - RNA, 19 nt, Human
aaucaugaaucuuuguuuc

SEQ ID NO: 3484761 - RNA, 17 nt, Human
aaucaugagccugcugg

SEQ ID NO: 3484762 - RNA, 18 nt, Human
aaucaugagccugcugga

SEQ ID NO: 3484763 - RNA, 17 nt, Human
aaucaugaugcuagcca

SEQ ID NO: 3484764 - RNA, 17 nt, Human
aagcaauagaaacaaca

SEQ ID NO: 3484765 - RNA, 19 nt, Human
aagcaauaugcauuuaaau

SEQ ID NO: 3484766 - RNA, 12 nt, Human
aagcaaucaaga

SEQ ID NO: 3484767 - RNA, 18 nt, Human
aagcaauccuccugagug

SEQ ID NO: 3484768 - RNA, 13 nt, Human
aagcaaugguuga

SEQ ID NO: 3484769 - RNA, 15 nt, Human
aagcaauuagacaag

SEQ ID NO: 3484770 - RNA, 13 nt, Human
aagcaauugcugc

SEQ ID NO: 3484771 - RNA, 14 nt, Human
aagcaauuuuccuu

SEQ ID NO: 3484772 - RNA, 13 nt, Human
aagcacaagaagc

SEQ ID NO: 3484773 - RNA, 23 nt, Human
aagcacaagcagagugcacagcu

SEQ ID NO: 3484774 - RNA, 21 nt, Human
aagcacaaugucucacauggg

SEQ ID NO: 3484775 - RNA, 19 nt, Human
aagcacacucauccccuca

SEQ ID NO: 3484776 - RNA, 17 nt, Human
aagcacagaaaacuaga

SEQ ID NO: 3484777 - RNA, 13 nt, Human
aagcacagcccuu

SEQ ID NO: 3484778 - RNA, 18 nt, Human
aagcacaggagacacugu

SEQ ID NO: 3484779 - RNA, 15 nt, Human
aagcacaguuugaac

SEQ ID NO: 3484780 - RNA, 17 nt, Human
aagcacaguuugaacaa

SEQ ID NO: 3484781 - RNA, 21 nt, Human
aagcacauauuagugcagcca

SEQ ID NO: 3484782 - RNA, 16 nt, Human
aagcacauguuuauuu

SEQ ID NO: 3484783 - RNA, 16 nt, Human
aagcaccaaaauaaga

SEQ ID NO: 3484784 - RNA, 21 nt, Human
aagcaccagcuucuccaggcu

SEQ ID NO: 3484785 - RNA, 13 nt, Human
aagcaccuccugc

SEQ ID NO: 3484786 - RNA, 14 nt, Human
aagcaccuccugcc

SEQ ID NO: 3484787 - RNA, 15 nt, Human
aagcaccuccugccu

SEQ ID NO: 3484788 - RNA, 17 nt, Human
aagcaccugccgaccuc

SEQ ID NO: 3484789 - RNA, 20 nt, Human
aagcaccugccgaccucguc

SEQ ID NO: 3484790 - RNA, 13 nt, Human
aagcaccuguaau

SEQ ID NO: 3484791 - RNA, 16 nt, Human
aagcaccuuagcuggc

SEQ ID NO: 3484792 - RNA, 19 nt, Human
aagcaccuuagcuggcauu

SEQ ID NO: 3484793 - RNA, 17 nt, Human
aagcacuacauaaacug

SEQ ID NO: 3484794 - RNA, 19 nt, Human
aagcacucuggaugaugga

SEQ ID NO: 3484795 - RNA, 11 nt, Human
aagcacugaua

SEQ ID NO: 3484796 - RNA, 13 nt, Human
aagcacuguuuuu

SEQ ID NO: 3484797 - RNA, 19 nt, Human
aagcagaaaauaaaggaag

SEQ ID NO: 3484798 - RNA, 20 nt, Human
aagcagaaaauacagcugga

SEQ ID NO: 3484799 - RNA, 13 nt, Human
aagcagaaagugc

SEQ ID NO: 3484800 - RNA, 15 nt, Human
aagcagaaagugccu

SEQ ID NO: 3484801 - RNA, 20 nt, Human
aagcagaaagugccuuucag

SEQ ID NO: 3484802 - RNA, 12 nt, Human
aagcagaaauac

SEQ ID NO: 3484803 - RNA, 15 nt, Human
aagcagaaauccaag

SEQ ID NO: 3484804 - RNA, 13 nt, Human
aagcagaauaaag

SEQ ID NO: 3484805 - RNA, 16 nt, Human
aagcagaauaaagcaa

SEQ ID NO: 3484806 - RNA, 20 nt, Human
aagcagaauaaagcaauuuu

SEQ ID NO: 3484807 - RNA, 14 nt, Human
aagcagaaugugau

SEQ ID NO: 3484808 - RNA, 15 nt, Human
aagcagaauuggaaa

SEQ ID NO: 3484809 - RNA, 16 nt, Human
aagcagacauuuuaaa

SEQ ID NO: 3484810 - RNA, 22 nt, Human
aagcagaccauuggggcuccca

SEQ ID NO: 3484811 - RNA, 14 nt, Human
aagcagagaagcuc

SEQ ID NO: 3484812 - RNA, 23 nt, Human
aagcagagauuuucaacauuuca

SEQ ID NO: 3484813 - RNA, 13 nt, Human
aagcagagcuucc

SEQ ID NO: 3484814 - RNA, 13 nt, Human
aagcagaggacca

SEQ ID NO: 3484815 - RNA, 19 nt, Human
aagcagaggaccagggccu

SEQ ID NO: 3484816 - RNA, 12 nt, Human
aagcagaggagg

SEQ ID NO: 3484817 - RNA, 20 nt, Human
aagcagaggaggggccgcug

SEQ ID NO: 3484818 - RNA, 11 nt, Human
aagcagagugg

SEQ ID NO: 3484819 - RNA, 14 nt, Human
aagcagaguggcag

SEQ ID NO: 3484820 - RNA, 16 nt, Human
aagcagcaacuauuca

SEQ ID NO: 3484821 - RNA, 14 nt, Human
aagcagcagccucg

SEQ ID NO: 3484822 - RNA, 16 nt, Human
aagcagcagccucgcc

SEQ ID NO: 3484823 - RNA, 16 nt, Human
aagcagcaucuucugg

SEQ ID NO: 3484824 - RNA, 16 nt, Human
aagcagccaagcuccu

SEQ ID NO: 3484825 - RNA, 13 nt, Human
aagcagcucaaag

SEQ ID NO: 3484826 - RNA, 14 nt, Human
aagcagcucucccc

SEQ ID NO: 3484827 - RNA, 16 nt, Human
aagcaggaagcucaga

SEQ ID NO: 3484828 - RNA, 23 nt, Human
aagcaggacuuugaggcaagugu

SEQ ID NO: 3484829 - RNA, 17 nt, Human
aagcagggaauuucuau

SEQ ID NO: 3484830 - RNA, 17 nt, Human
aagcaggggaguaugca

SEQ ID NO: 3484831 - RNA, 21 nt, Human
aagcaggggcuacaagaggga

SEQ ID NO: 3484832 - RNA, 22 nt, Human
aagcaggggcuacaagagggaa

SEQ ID NO: 3484833 - RNA, 14 nt, Human
aagcagguggaucu

SEQ ID NO: 3484834 - RNA, 20 nt, Human
aagcagguggaucuauuuca

SEQ ID NO: 3484835 - RNA, 16 nt, Human
aagcagguuaaauguu

SEQ ID NO: 3484836 - RNA, 18 nt, Human
aagcagguuaaauguuuu

SEQ ID NO: 3484837 - RNA, 15 nt, Human
aagcagguuagagaa

SEQ ID NO: 3484838 - RNA, 19 nt, Human
aagcagguucccaagcuca

SEQ ID NO: 3484839 - RNA, 22 nt, Human
aagcagguugaggggcuccugg

SEQ ID NO: 3484840 - RNA, 14 nt, Human
aagcagguugauaa

SEQ ID NO: 3484841 - RNA, 19 nt, Human
aagcagguuucaaggaagu

SEQ ID NO: 3484842 - RNA, 14 nt, Human
aagcaguaaaaacu

SEQ ID NO: 3484843 - RNA, 17 nt, Human
aagcaguaaauuugcua

SEQ ID NO: 3484844 - RNA, 13 nt, Human
aagcaguaacuga

SEQ ID NO: 3484845 - RNA, 20 nt, Human
aagcaguagaaauaauaugc

SEQ ID NO: 3484846 - RNA, 21 nt, Human
aagcaguagaaauaauaugca

SEQ ID NO: 3484847 - RNA, 12 nt, Human
aagcaguauuuu

SEQ ID NO: 3484848 - RNA, 17 nt, Human
aagcagucacuuuuccu

SEQ ID NO: 3484849 - RNA, 19 nt, Human
aagcagucuacccaccuca

SEQ ID NO: 3484850 - RNA, 12 nt, Human
aagcagugcaug

SEQ ID NO: 3484851 - RNA, 15 nt, Human
aagcagugcaugcug

SEQ ID NO: 3484852 - RNA, 14 nt, Human
aagcagugcccagg

SEQ ID NO: 3484853 - RNA, 16 nt, Human
aagcagugcccaggug

SEQ ID NO: 3484854 - RNA, 18 nt, Human
aagcagugcccagguggc

SEQ ID NO: 3484855 - RNA, 15 nt, Human
aagcagugcuucuca

SEQ ID NO: 3484856 - RNA, 17 nt, Human
aagcaguggauacgugu

SEQ ID NO: 3484857 - RNA, 13 nt, Human
aagcaguuucaau

SEQ ID NO: 3484858 - RNA, 17 nt, Human
aagcauaaaaacauuuu

SEQ ID NO: 3484859 - RNA, 14 nt, Human
aagcauaaagcuca

SEQ ID NO: 3484860 - RNA, 18 nt, Human
aagcauacuuuguaaaua

SEQ ID NO: 3484861 - RNA, 16 nt, Human
aagcauagauguuuug

SEQ ID NO: 3484862 - RNA, 21 nt, Human
aagcaucacaaaugauauuaa

SEQ ID NO: 3484863 - RNA, 18 nt, Human
aagcaucauuauuuaugu

SEQ ID NO: 3484864 - RNA, 22 nt, Human
aagcaucauuauuuauguauug

SEQ ID NO: 3484865 - RNA, 17 nt, Human
aagcauccaugugugga

SEQ ID NO: 3484866 - RNA, 19 nt, Human
aagcauccauguguggacu

SEQ ID NO: 3484867 - RNA, 23 nt, Human
aagcaucccucacccauccuaga

SEQ ID NO: 3484868 - RNA, 23 nt, Human
aagcauccuuuaggguucugccu

SEQ ID NO: 3484869 - RNA, 12 nt, Human
aagcaucuaaac

SEQ ID NO: 3484870 - RNA, 20 nt, Human
aagcaucuaaacuuuaauau

SEQ ID NO: 3484871 - RNA, 13 nt, Human
aagcaucuaagga

SEQ ID NO: 3484872 - RNA, 16 nt, Human
aagcaucuccugagga

SEQ ID NO: 3484873 - RNA, 17 nt, Human
aagcaucuccugaggau

SEQ ID NO: 3484874 - RNA, 17 nt, Human
aagcaucuggcucuaau

SEQ ID NO: 3484875 - RNA, 19 nt, Human
aagcaucuggcucuaauuc

SEQ ID NO: 3484876 - RNA, 13 nt, Human
aagcaugaaaaag

SEQ ID NO: 3484877 - RNA, 19 nt, Human
aagcaugccaauuucucuu

SEQ ID NO: 3484878 - RNA, 22 nt, Human
aagcaugcuugugaaaaugugu

SEQ ID NO: 3484879 - RNA, 14 nt, Human
aagcauggacauuu

SEQ ID NO: 3484880 - RNA, 16 nt, Human
aagcauggagaacagu

SEQ ID NO: 3484881 - RNA, 15 nt, Human
aagcauggcuauuuu

SEQ ID NO: 3484882 - RNA, 17 nt, Human
aagcaugggauuauuag

SEQ ID NO: 3484883 - RNA, 12 nt, Human
aagcauguacag

SEQ ID NO: 3484884 - RNA, 13 nt, Human
aagcauguacagu

SEQ ID NO: 3484885 - RNA, 22 nt, Human
aagcauguacaguguucuguuu

SEQ ID NO: 3484886 - RNA, 18 nt, Human
aagcauguauucagcuuu

SEQ ID NO: 3484887 - RNA, 17 nt, Human
aagcaugugucaugcau

SEQ ID NO: 3484888 - RNA, 17 nt, Human
aagcauguuuugcaugu

SEQ ID NO: 3484889 - RNA, 16 nt, Human
aagcauuacucuugua

SEQ ID NO: 3484890 - RNA, 18 nt, Human
aagcauuacucuuguaag

SEQ ID NO: 3484891 - RNA, 21 nt, Human
aagcauucaauuuauucaaga

SEQ ID NO: 3484892 - RNA, 22 nt, Human
aagcauucaauuuauucaagaa

SEQ ID NO: 3484893 - RNA, 23 nt, Human
aagcauucaauuuauucaagaaa

SEQ ID NO: 3484894 - RNA, 15 nt, Human
aagcauucagaagaa

SEQ ID NO: 3484895 - RNA, 17 nt, Human
aagcauucagagagcag

SEQ ID NO: 3484896 - RNA, 13 nt, Human
aagcauuccaaca

SEQ ID NO: 3484897 - RNA, 13 nt, Human
aagcauuccuucu

SEQ ID NO: 3484898 - RNA, 17 nt, Human
aagcauucucauuggaa

SEQ ID NO: 3484899 - RNA, 23 nt, Human
aagcauucucauuggaaauuuag

SEQ ID NO: 3484900 - RNA, 14 nt, Human
aagcauucucccca

SEQ ID NO: 3484901 - RNA, 18 nt, Human
aagcauucuccccagugu

SEQ ID NO: 3484902 - RNA, 23 nt, Human
aaugcuggacuggaggccccugg

SEQ ID NO: 3484903 - RNA, 12 nt, Human
aaugcuggagcg

SEQ ID NO: 3484904 - RNA, 18 nt, Human
aaugcugggacucagccu

SEQ ID NO: 3484905 - RNA, 12 nt, Human
aaugcugggcug

SEQ ID NO: 3484906 - RNA, 18 nt, Human
aaugcugguuuuccuaaa

SEQ ID NO: 3484907 - RNA, 21 nt, Human
aaugcugguuuuccuaaaugc

SEQ ID NO: 3484908 - RNA, 15 nt, Human
aaugcugguuuuuca

SEQ ID NO: 3484909 - RNA, 20 nt, Human
aaugcuguauuuuaaaagaa

SEQ ID NO: 3484910 - RNA, 17 nt, Human
aaugcugucuuucuugc

SEQ ID NO: 3484911 - RNA, 22 nt, Human
aaugcugucuuucuugcucccu

SEQ ID NO: 3484912 - RNA, 16 nt, Human
aaugcuguugccucau

SEQ ID NO: 3484913 - RNA, 12 nt, Human
aaugcuuaagag

SEQ ID NO: 3484914 - RNA, 21 nt, Human
aaugcuuaagagggaaugaua

SEQ ID NO: 3484915 - RNA, 14 nt, Human
aaugcuuaaucaga

SEQ ID NO: 3484916 - RNA, 22 nt, Human
aaugcuuaaucagauagauauu

SEQ ID NO: 3484917 - RNA, 20 nt, Human
aaugcuuaucaucuaaagau

SEQ ID NO: 3484918 - RNA, 11 nt, Human
aaugcuucaga

SEQ ID NO: 3484919 - RNA, 17 nt, Human
aaugcuucauucaauau

SEQ ID NO: 3484920 - RNA, 20 nt, Human
aaugcuucuaaguaaauaca

SEQ ID NO: 3484921 - RNA, 23 nt, Human
aaugcuucuaaguaaauacaauu

SEQ ID NO: 3484922 - RNA, 16 nt, Human
aaugcuucuucucagg

SEQ ID NO: 3484923 - RNA, 19 nt, Human
aaugcuugaaaaaugugca

SEQ ID NO: 3484924 - RNA, 12 nt, Human
aaugcuuggaau

SEQ ID NO: 3484925 - RNA, 21 nt, Human
aaugcuuggaauaucugcugu

SEQ ID NO: 3484926 - RNA, 22 nt, Human
aaugcuuggaauaucugcugua

SEQ ID NO: 3484927 - RNA, 21 nt, Human
aaugcuuggcuucucauacgu

SEQ ID NO: 3484928 - RNA, 18 nt, Human
aaugcuuuaaaaacuauu

SEQ ID NO: 3484929 - RNA, 23 nt, Human
aaugcuuuaaaaacuauuuaacu

SEQ ID NO: 3484930 - RNA, 19 nt, Human
aaugcuuuagaaagguuuu

SEQ ID NO: 3484931 - RNA, 14 nt, Human
aaugcuuuauuugu

SEQ ID NO: 3484932 - RNA, 16 nt, Human
aaugcuuuauuuguaa

SEQ ID NO: 3484933 - RNA, 19 nt, Human
aaugcuuuauuuguaaauu

SEQ ID NO: 3484934 - RNA, 13 nt, Human
aaugcuuucugaa

SEQ ID NO: 3484935 - RNA, 12 nt, Human
aaugcuuugaua

SEQ ID NO: 3484936 - RNA, 13 nt, Human
aaugcuuuuaaaa

SEQ ID NO: 3484937 - RNA, 14 nt, Human
aaugcuuuuagugu

SEQ ID NO: 3484938 - RNA, 20 nt, Human
aauggaaaaaaaaaaaagag

SEQ ID NO: 3484939 - RNA, 21 nt, Human
aauggaaaaaaaaaaaagagg

SEQ ID NO: 3484940 - RNA, 22 nt, Human
aauggaaaaaaaaaaaagagga

SEQ ID NO: 3484941 - RNA, 19 nt, Human
aauggaaaacagacucagg

SEQ ID NO: 3484942 - RNA, 16 nt, Human
aauggaaacugaaugc

SEQ ID NO: 3484943 - RNA, 17 nt, Human
aauggaaacugaaugcu

SEQ ID NO: 3484944 - RNA, 15 nt, Human
aauggaaauuuugcu

SEQ ID NO: 3484945 - RNA, 17 nt, Human
aauggaaauuuugcuau

SEQ ID NO: 3484946 - RNA, 16 nt, Human
aauggaaccuccuuuc

SEQ ID NO: 3484947 - RNA, 13 nt, Human
aauggaagacaca

SEQ ID NO: 3484948 - RNA, 16 nt, Human
aauggaagacagcucu

SEQ ID NO: 3484949 - RNA, 23 nt, Human
aauggaagauuugcccauuuaca

SEQ ID NO: 3484950 - RNA, 18 nt, Human
aauggaagguuuguauau

SEQ ID NO: 3484951 - RNA, 20 nt, Human
aauggaagguuuguauauug

SEQ ID NO: 3484952 - RNA, 22 nt, Human
aauggacauccuguauaagcac

SEQ ID NO: 3484953 - RNA, 20 nt, Human
aauggacgguuuaggugaaa

SEQ ID NO: 3484954 - RNA, 16 nt, Human
aauggacguguuauga

SEQ ID NO: 3484955 - RNA, 21 nt, Human
aauggacguguuaugacucca

SEQ ID NO: 3484956 - RNA, 17 nt, Human
aauggacuggaagggga

SEQ ID NO: 3484957 - RNA, 17 nt, Human
aauggacugguuugaga

SEQ ID NO: 3484958 - RNA, 19 nt, Human
aauggacuuuuguacauag

SEQ ID NO: 3484959 - RNA, 16 nt, Human
aauggagaagcugcag

SEQ ID NO: 3484960 - RNA, 20 nt, Human
aauggagauucaguuuucau

SEQ ID NO: 3484961 - RNA, 21 nt, Human
aauggaggaacuuuccaaaca

SEQ ID NO: 3484962 - RNA, 19 nt, Human
aauggaggaucucuaaaga

SEQ ID NO: 3484963 - RNA, 19 nt, Human
aauggaggggcagagccag

SEQ ID NO: 3484964 - RNA, 22 nt, Human
aauggaggggcagagccaggaa

SEQ ID NO: 3484965 - RNA, 19 nt, Human
aauggagucaguuugcagu

SEQ ID NO: 3484966 - RNA, 13 nt, Human
aauggaguuggag

SEQ ID NO: 3484967 - RNA, 21 nt, Human
aagcuguuugguuuuaaaaua

SEQ ID NO: 3484968 - RNA, 16 nt, Human
aagcuuaaaaaaaacu

SEQ ID NO: 3484969 - RNA, 14 nt, Human
aagcuuaaaacuuu

SEQ ID NO: 3484970 - RNA, 13 nt, Human
aagcuuagcagga

SEQ ID NO: 3484971 - RNA, 15 nt, Human
aagcuuagcaggaga

SEQ ID NO: 3484972 - RNA, 14 nt, Human
aagcuuaguauaaa

SEQ ID NO: 3484973 - RNA, 22 nt, Human
aagcuuauccauaaaaaaaaau

SEQ ID NO: 3484974 - RNA, 19 nt, Human
aagcuuauuaaugcuaagg

SEQ ID NO: 3484975 - RNA, 18 nt, Human
aagcuucaaacugcauga

SEQ ID NO: 3484976 - RNA, 15 nt, Human
aagcuucaguugcuu

SEQ ID NO: 3484977 - RNA, 18 nt, Human
aagcuucaguugcuuguc

SEQ ID NO: 3484978 - RNA, 15 nt, Human
aagcuuccaggaaaa

SEQ ID NO: 3484979 - RNA, 19 nt, Human
aagcuuccaguccaaucuc

SEQ ID NO: 3484980 - RNA, 21 nt, Human
aagcuuccaguccaaucucau

SEQ ID NO: 3484981 - RNA, 23 nt, Human
aagcuuccuuuguuuuuuuuucc

SEQ ID NO: 3484982 - RNA, 22 nt, Human
aagcuucgaggcccagcgaccu

SEQ ID NO: 3484983 - RNA, 18 nt, Human
aagcuucuaauaaauuau

SEQ ID NO: 3484984 - RNA, 20 nt, Human
aagcuucugucuccagcuuc

SEQ ID NO: 3484985 - RNA, 12 nt, Human
aagcuucuuaau

SEQ ID NO: 3484986 - RNA, 15 nt, Human
aagcuugacucccaa

SEQ ID NO: 3484987 - RNA, 14 nt, Human
aagcuugcucacau

SEQ ID NO: 3484988 - RNA, 12 nt, Human
aagcuuggggaa

SEQ ID NO: 3484989 - RNA, 23 nt, Human
aagcuuguguauccauuaucaug

SEQ ID NO: 3484990 - RNA, 13 nt, Human
aagcuuuaaauua

SEQ ID NO: 3484991 - RNA, 17 nt, Human
aagcuuuaaauuaugug

SEQ ID NO: 3484992 - RNA, 22 nt, Human
aagcuuuacuggggcuggggaa

SEQ ID NO: 3484993 - RNA, 19 nt, Human
aagcuuuauacguguagcu

SEQ ID NO: 3484994 - RNA, 12 nt, Human
aagcuuuaugau

SEQ ID NO: 3484995 - RNA, 18 nt, Human
aagcuuuaugauuuucau

SEQ ID NO: 3484996 - RNA, 16 nt, Human
aagcuuuauuucuagc

SEQ ID NO: 3484997 - RNA, 20 nt, Human
aagcuuuauuuugagaugua

SEQ ID NO: 3484998 - RNA, 22 nt, Human
aagcuuucauguaaacugugca

SEQ ID NO: 3484999 - RNA, 23 nt, Human
aagcuuucauguaaacugugcac

SEQ ID NO: 3485000 - RNA, 21 nt, Human
aagcuuucaugucccagaacu

SEQ ID NO: 3485001 - RNA, 22 nt, Human
aagcuuuccugccccaggccug

SEQ ID NO: 3485002 - RNA, 11 nt, Human
aagcuuucucu

SEQ ID NO: 3485003 - RNA, 17 nt, Human
aagcuuucucugcuuca

SEQ ID NO: 3485004 - RNA, 15 nt, Human
aagcuuucugucucc

SEQ ID NO: 3485005 - RNA, 20 nt, Human
aagcuuugacucuauaagca

SEQ ID NO: 3485006 - RNA, 22 nt, Human
aagcuuugauuuagauugagua

SEQ ID NO: 3485007 - RNA, 23 nt, Human
aagcuuugcuuaugguaauaaaa

SEQ ID NO: 3485008 - RNA, 21 nt, Human
aagcuuuggacccaaggaaaa

SEQ ID NO: 3485009 - RNA, 20 nt, Human
aagcuuuguccccugcuuca

SEQ ID NO: 3485010 - RNA, 20 nt, Human
aagcuuuguugaaagaaagu

SEQ ID NO: 3485011 - RNA, 13 nt, Human
aagcuuuuagaaa

SEQ ID NO: 3485012 - RNA, 14 nt, Human
aagcuuuuagaaau

SEQ ID NO: 3485013 - RNA, 14 nt, Human
aagcuuuuccuaau

SEQ ID NO: 3485014 - RNA, 22 nt, Human
aagcuuuugucuacacacccug

SEQ ID NO: 3485015 - RNA, 12 nt, Human
aagcuuuuuagu

SEQ ID NO: 3485016 - RNA, 23 nt, Human
aagcuuuuuauuccuccugcuca

SEQ ID NO: 3485017 - RNA, 18 nt, Human
aagcuuuuuggaaucuuu

SEQ ID NO: 3485018 - RNA, 14 nt, Human
aaggaaaaaaagac

SEQ ID NO: 3485019 - RNA, 19 nt, Human
aaggaaaaacacaagcaaa

SEQ ID NO: 3485020 - RNA, 16 nt, Human
aaggaaaaagcacaag

SEQ ID NO: 3485021 - RNA, 12 nt, Human
aaggaaaaagcu

SEQ ID NO: 3485022 - RNA, 12 nt, Human
aaggaaaaguuu

SEQ ID NO: 3485023 - RNA, 12 nt, Human
aaggaaaaugau

SEQ ID NO: 3485024 - RNA, 14 nt, Human
aaggaaaaugauac

SEQ ID NO: 3485025 - RNA, 13 nt, Human
aaggaaaaugauc

SEQ ID NO: 3485026 - RNA, 17 nt, Human
aaggaaaccacagcugc

SEQ ID NO: 3485027 - RNA, 18 nt, Human
aaggaaaccacagcugcu

SEQ ID NO: 3485028 - RNA, 15 nt, Human
aaggaaaccagugca

SEQ ID NO: 3485029 - RNA, 16 nt, Human
aaggaaacccagcucu

SEQ ID NO: 3485030 - RNA, 17 nt, Human
aaggaaacccagcucug

SEQ ID NO: 3485031 - RNA, 21 nt, Human
aaggaaaccgccuaguuuacu

SEQ ID NO: 3485032 - RNA, 19 nt, Human
aaggaaaccuuuucuugua

SEQ ID NO: 3485033 - RNA, 21 nt, Human
aaggaaacuugaaucaaagca

SEQ ID NO: 3485034 - RNA, 13 nt, Human
aaggaaaggcaaa

SEQ ID NO: 3485035 - RNA, 23 nt, Human
aaggaaauacccuucuuuuauga

SEQ ID NO: 3485036 - RNA, 15 nt, Human
aaggaaauauauuuu

SEQ ID NO: 3485037 - RNA, 14 nt, Human
aaggaaaugauuga

SEQ ID NO: 3485038 - RNA, 13 nt, Human
aaggaaauuuuac

SEQ ID NO: 3485039 - RNA, 16 nt, Human
aaggaaccaacaaucu

SEQ ID NO: 3485040 - RNA, 12 nt, Human
aaggaaccuucc

SEQ ID NO: 3485041 - RNA, 23 nt, Human
aaggaacuaggucaaaaaucugu

SEQ ID NO: 3485042 - RNA, 18 nt, Human
aaggaacucuggcuucca

SEQ ID NO: 3485043 - RNA, 20 nt, Human
aaggaacucuggcuuccagg

SEQ ID NO: 3485044 - RNA, 22 nt, Human
aaggaacucuggcuuccaggua

SEQ ID NO: 3485045 - RNA, 18 nt, Human
aaggaacuugaaaaauac

SEQ ID NO: 3485046 - RNA, 15 nt, Human
aaugguucugaaaua

SEQ ID NO: 3485047 - RNA, 18 nt, Human
aaugguugccuuaaagaa

SEQ ID NO: 3485048 - RNA, 12 nt, Human
aaugguuguauu

SEQ ID NO: 3485049 - RNA, 18 nt, Human
aaugguuguauuagaugu

SEQ ID NO: 3485050 - RNA, 19 nt, Human
aaugguuguauuagauguu

SEQ ID NO: 3485051 - RNA, 14 nt, Human
aaugguuuaaaugg

SEQ ID NO: 3485052 - RNA, 16 nt, Human
aaugguuuauuuugua

SEQ ID NO: 3485053 - RNA, 17 nt, Human
aaugguuugaauauaaa

SEQ ID NO: 3485054 - RNA, 14 nt, Human
aaugguuuucaaaa

SEQ ID NO: 3485055 - RNA, 16 nt, Human
aaugguuuucuugugu

SEQ ID NO: 3485056 - RNA, 12 nt, Human
aauguaaaauga

SEQ ID NO: 3485057 - RNA, 14 nt, Human
aauguaaacauuuu

SEQ ID NO: 3485058 - RNA, 15 nt, Human
aauguaaagacaaaa

SEQ ID NO: 3485059 - RNA, 15 nt, Human
aauguaaagauuugc

SEQ ID NO: 3485060 - RNA, 23 nt, Human
aauguaaaggagucaaaacuaca

SEQ ID NO: 3485061 - RNA, 12 nt, Human
aauguaaauauu

SEQ ID NO: 3485062 - RNA, 16 nt, Human
aauguaaauauuuuaa

SEQ ID NO: 3485063 - RNA, 19 nt, Human
aauguaaauauuuuaaaga

SEQ ID NO: 3485064 - RNA, 12 nt, Human
aauguaaauguc

SEQ ID NO: 3485065 - RNA, 13 nt, Human
aauguaaaugucu

SEQ ID NO: 3485066 - RNA, 14 nt, Human
aauguaaauuugua

SEQ ID NO: 3485067 - RNA, 11 nt, Human
aauguaacugc

SEQ ID NO: 3485068 - RNA, 20 nt, Human
aauguaacuguuaccauugg

SEQ ID NO: 3485069 - RNA, 23 nt, Human
aauguaacuguuaccauuggaaa

SEQ ID NO: 3485070 - RNA, 15 nt, Human
aauguaacuuuugua

SEQ ID NO: 3485071 - RNA, 22 nt, Human
aauguaagauuauagauucuaa

SEQ ID NO: 3485072 - RNA, 16 nt, Human
aauguaagcauacuuu

SEQ ID NO: 3485073 - RNA, 15 nt, Human
aauguaagcucuacu

SEQ ID NO: 3485074 - RNA, 22 nt, Human
aauguaaggcuguguaagauuu

SEQ ID NO: 3485075 - RNA, 19 nt, Human
aauguaaguaaaugucugu

SEQ ID NO: 3485076 - RNA, 19 nt, Human
aauguaaucaauguuucuu

SEQ ID NO: 3485077 - RNA, 18 nt, Human
aauguaauuaaacuguua

SEQ ID NO: 3485078 - RNA, 12 nt, Human
aauguaauuauu

SEQ ID NO: 3485079 - RNA, 17 nt, Human
aauguaauuauuuaugu

SEQ ID NO: 3485080 - RNA, 17 nt, Human
aauguaauuuaaaugaa

SEQ ID NO: 3485081 - RNA, 17 nt, Human
aauguaauuuguguaau

SEQ ID NO: 3485082 - RNA, 18 nt, Human
aauguaauuuguguaaua

SEQ ID NO: 3485083 - RNA, 16 nt, Human
aauguacagacauauu

SEQ ID NO: 3485084 - RNA, 17 nt, Human
aauguacagacauauuu

SEQ ID NO: 3485085 - RNA, 23 nt, Human
aauguacagcaaggagauuuaca

SEQ ID NO: 3485086 - RNA, 16 nt, Human
aauguacaguugaaau

SEQ ID NO: 3485087 - RNA, 17 nt, Human
aauguacaucuggccuu

SEQ ID NO: 3485088 - RNA, 18 nt, Human
aauguacccaccgggcca

SEQ ID NO: 3485089 - RNA, 20 nt, Human
aauguacuaggauacugcug

SEQ ID NO: 3485090 - RNA, 12 nt, Human
aauguacugaga

SEQ ID NO: 3485091 - RNA, 15 nt, Human
aauguacugagauuu

SEQ ID NO: 3485092 - RNA, 20 nt, Human
aauguagaauauucagacaa

SEQ ID NO: 3485093 - RNA, 12 nt, Human
aauguagagggg

SEQ ID NO: 3485094 - RNA, 15 nt, Human
aauguagauaagugu

SEQ ID NO: 3485095 - RNA, 21 nt, Human
aauguaggccaaauuuguagu

SEQ ID NO: 3485096 - RNA, 22 nt, Human
aauguaggcuuaguuugugugu

SEQ ID NO: 3485097 - RNA, 20 nt, Human
aauguaggggaaaguuucau

SEQ ID NO: 3485098 - RNA, 23 nt, Human
aauguaguucugcuccagacagg

SEQ ID NO: 3485099 - RNA, 15 nt, Human
aauguaguuugagga

SEQ ID NO: 3485100 - RNA, 15 nt, Human
aauguauaaauauac

SEQ ID NO: 3485101 - RNA, 14 nt, Human
aauguauaaguuga

SEQ ID NO: 3485102 - RNA, 20 nt, Human
aauguauaccuguaacugca

SEQ ID NO: 3485103 - RNA, 21 nt, Human
aauguauaguauuugaaaaca

SEQ ID NO: 3485104 - RNA, 13 nt, Human
aauguauauaaaa

SEQ ID NO: 3485105 - RNA, 15 nt, Human
aauguauauaaaaau

SEQ ID NO: 3485106 - RNA, 13 nt, Human
aauguauauacac

SEQ ID NO: 3485107 - RNA, 14 nt, Human
aauguauauacaca

SEQ ID NO: 3485108 - RNA, 15 nt, Human
aauguauauacacau

SEQ ID NO: 3485109 - RNA, 13 nt, Human
aauguauaugcac

SEQ ID NO: 3485110 - RNA, 18 nt, Human
aauguaucaaauacauuu

SEQ ID NO: 3485111 - RNA, 13 nt, Human
aauguaucaggaa

SEQ ID NO: 3485112 - RNA, 16 nt, Human
aauguaucuuauucac

SEQ ID NO: 3485113 - RNA, 15 nt, Human
aauguaugcuucaua

SEQ ID NO: 3485114 - RNA, 21 nt, Human
aauguaugcuucauacaggga

SEQ ID NO: 3485115 - RNA, 19 nt, Human
aauguauguaauguguggu

SEQ ID NO: 3485116 - RNA, 13 nt, Human
aauguaugucugg

SEQ ID NO: 3485117 - RNA, 13 nt, Human
aauguaugugcac

SEQ ID NO: 3485118 - RNA, 12 nt, Human
aauguaugugua

SEQ ID NO: 3485119 - RNA, 14 nt, Human
aauguauguguaag

SEQ ID NO: 3485120 - RNA, 13 nt, Human
aauguauguuacc

SEQ ID NO: 3485121 - RNA, 22 nt, Human
aauguauuacaguggggaauga

SEQ ID NO: 3485122 - RNA, 17 nt, Human
aauguauuauucugcag

SEQ ID NO: 3485123 - RNA, 13 nt, Human
aauguauucaaau

SEQ ID NO: 3485124 - RNA, 20 nt, Human
aaggagaaucauguuucuuu

SEQ ID NO: 3485125 - RNA, 22 nt, Human
aaggagaaucauguuucuuuga

SEQ ID NO: 3485126 - RNA, 14 nt, Human
aaggagacaaguuc

SEQ ID NO: 3485127 - RNA, 12 nt, Human
aaggagacacaa

SEQ ID NO: 3485128 - RNA, 17 nt, Human
aaggagacacagauguu

SEQ ID NO: 3485129 - RNA, 22 nt, Human
aaggagacucaccucugccuca

SEQ ID NO: 3485130 - RNA, 23 nt, Human
aaggagacucaccucugccucaa

SEQ ID NO: 3485131 - RNA, 12 nt, Human
aaggagagaaag

SEQ ID NO: 3485132 - RNA, 18 nt, Human
aaggagagaaggggagga

SEQ ID NO: 3485133 - RNA, 18 nt, Human
aaggagagacucccauga

SEQ ID NO: 3485134 - RNA, 22 nt, Human
aaggagagacucccaugaagcc

SEQ ID NO: 3485135 - RNA, 14 nt, Human
aaggagagccugcu

SEQ ID NO: 3485136 - RNA, 20 nt, Human
aaggagaggcaacauccaaa

SEQ ID NO: 3485137 - RNA, 15 nt, Human
aaggagagucuugca

SEQ ID NO: 3485138 - RNA, 15 nt, Human
aaggagauguaagag

SEQ ID NO: 3485139 - RNA, 17 nt, Human
aaggagauuuacaacug

SEQ ID NO: 3485140 - RNA, 18 nt, Human
aaggagauuuacaacugg

SEQ ID NO: 3485141 - RNA, 13 nt, Human
aaggagcacaagc

SEQ ID NO: 3485142 - RNA, 19 nt, Human
aaggagccccauuccuggg

SEQ ID NO: 3485143 - RNA, 22 nt, Human
aaggagcucacuguggugucug

SEQ ID NO: 3485144 - RNA, 17 nt, Human
aaggagcugagaauaga

SEQ ID NO: 3485145 - RNA, 23 nt, Human
aaggagcugagaauagaaggaaa

SEQ ID NO: 3485146 - RNA, 11 nt, Human
aaggagcugcc

SEQ ID NO: 3485147 - RNA, 12 nt, Human
aaggagcugccu

SEQ ID NO: 3485148 - RNA, 19 nt, Human
aaggagcugccuggacccg

SEQ ID NO: 3485149 - RNA, 12 nt, Human
aaggagcugcua

SEQ ID NO: 3485150 - RNA, 21 nt, Human
aaggagcuuaccucccaccuu

SEQ ID NO: 3485151 - RNA, 18 nt, Human
aaggaggaagagaaaaaa

SEQ ID NO: 3485152 - RNA, 14 nt, Human
aaggaggacccagg

SEQ ID NO: 3485153 - RNA, 15 nt, Human
aaggaggagagggaa

SEQ ID NO: 3485154 - RNA, 16 nt, Human
aaggaggagccugucc

SEQ ID NO: 3485155 - RNA, 17 nt, Human
aaggaggagccuguccu

SEQ ID NO: 3485156 - RNA, 23 nt, Human
aaggaggauggcauauaauacaa

SEQ ID NO: 3485157 - RNA, 23 nt, Human
aaggaggauuccauuuggcagag

SEQ ID NO: 3485158 - RNA, 12 nt, Human
aaggaggccacc

SEQ ID NO: 3485159 - RNA, 15 nt, Human
aaggaggccaccucc

SEQ ID NO: 3485160 - RNA, 23 nt, Human
aaggaggcgcacuuuccuccugg

SEQ ID NO: 3485161 - RNA, 14 nt, Human
aaggaggcuccagg

SEQ ID NO: 3485162 - RNA, 21 nt, Human
aaggaggggaaaaaaauguug

SEQ ID NO: 3485163 - RNA, 13 nt, Human
aaggaggggaacc

SEQ ID NO: 3485164 - RNA, 18 nt, Human
aaggaggggaagcugcag

SEQ ID NO: 3485165 - RNA, 18 nt, Human
aaggaggguuagggaggg

SEQ ID NO: 3485166 - RNA, 19 nt, Human
aaggaggugagggauguga

SEQ ID NO: 3485167 - RNA, 13 nt, Human
aaggaguagaaaa

SEQ ID NO: 3485168 - RNA, 17 nt, Human
aaggagucaaaacuaca

SEQ ID NO: 3485169 - RNA, 17 nt, Human
aaggagucacugagacc

SEQ ID NO: 3485170 - RNA, 18 nt, Human
aaggagucacugagacca

SEQ ID NO: 3485171 - RNA, 17 nt, Human
aaggaguuuauguucca

SEQ ID NO: 3485172 - RNA, 21 nt, Human
aaggauacaaaagcaugugag

SEQ ID NO: 3485173 - RNA, 19 nt, Human
aaggauaccuucuuauuua

SEQ ID NO: 3485174 - RNA, 19 nt, Human
aaggauacuguaacacuuu

SEQ ID NO: 3485175 - RNA, 23 nt, Human
aaggauacuguaacacuuuacaa

SEQ ID NO: 3485176 - RNA, 16 nt, Human
aaggauacuuauuuaa

SEQ ID NO: 3485177 - RNA, 19 nt, Human
aaggauagaugcuggccca

SEQ ID NO: 3485178 - RNA, 14 nt, Human
aaggauaguaagca

SEQ ID NO: 3485179 - RNA, 20 nt, Human
aaggauaguaagcauagaaa

SEQ ID NO: 3485180 - RNA, 17 nt, Human
aaggauaguauuuuuau

SEQ ID NO: 3485181 - RNA, 18 nt, Human
aaggauauuuaagaaaau

SEQ ID NO: 3485182 - RNA, 22 nt, Human
aaggauauuuacuacuuuugca

SEQ ID NO: 3485183 - RNA, 22 nt, Human
aaggaucagaacagcagagguu

SEQ ID NO: 3485184 - RNA, 16 nt, Human
aaggauccggaaagaa

SEQ ID NO: 3485185 - RNA, 11 nt, Human
aaggauccuga

SEQ ID NO: 3485186 - RNA, 20 nt, Human
aaggauccugagccagauuu

SEQ ID NO: 3485187 - RNA, 16 nt, Human
aaggaucucucaggag

SEQ ID NO: 3485188 - RNA, 21 nt, Human
aaggaucucucaggagcacag

SEQ ID NO: 3485189 - RNA, 21 nt, Human
aaggaucuguuuuuaaaaauc

SEQ ID NO: 3485190 - RNA, 22 nt, Human
aaggaucuuucacccacagaaa

SEQ ID NO: 3485191 - RNA, 19 nt, Human
aaggaugaagggcccgaga

SEQ ID NO: 3485192 - RNA, 18 nt, Human
aauauuuaugaagaaaau

SEQ ID NO: 3485193 - RNA, 13 nt, Human
aauauuuauggau

SEQ ID NO: 3485194 - RNA, 15 nt, Human
aauauuuauguaaac

SEQ ID NO: 3485195 - RNA, 19 nt, Human
aauauuuaugucuauuuaa

SEQ ID NO: 3485196 - RNA, 16 nt, Human
aauauuuauuaaauuu

SEQ ID NO: 3485197 - RNA, 20 nt, Human
aauauuuauuauuuucaccu

SEQ ID NO: 3485198 - RNA, 13 nt, Human
aauauuuauuuau

SEQ ID NO: 3485199 - RNA, 15 nt, Human
aauauuucaagacau

SEQ ID NO: 3485200 - RNA, 18 nt, Human
aauauuuccuuaaacugu

SEQ ID NO: 3485201 - RNA, 18 nt, Human
aauauuucuauugaauuc

SEQ ID NO: 3485202 - RNA, 17 nt, Human
aauauuucugcuuucuu

SEQ ID NO: 3485203 - RNA, 12 nt, Human
aauauuugaauc

SEQ ID NO: 3485204 - RNA, 20 nt, Human
aauauuugaaucuugucuca

SEQ ID NO: 3485205 - RNA, 21 nt, Human
aauauuugaauguaugcuuca

SEQ ID NO: 3485206 - RNA, 18 nt, Human
aauauuugacuauucugu

SEQ ID NO: 3485207 - RNA, 23 nt, Human
aauauuugacuugcaugaagaga

SEQ ID NO: 3485208 - RNA, 17 nt, Human
aauauuugugugcuaaa

SEQ ID NO: 3485209 - RNA, 15 nt, Human
aauauuuuaaagaau

SEQ ID NO: 3485210 - RNA, 23 nt, Human
aauauuuuaagcauuacucuugu

SEQ ID NO: 3485211 - RNA, 15 nt, Human
aauauuuuaaguauu

SEQ ID NO: 3485212 - RNA, 17 nt, Human
aauauuuuaaguauugc

SEQ ID NO: 3485213 - RNA, 11 nt, Human
aauauuuuaau

SEQ ID NO: 3485214 - RNA, 20 nt, Human
aauauuuuaauuuuuaaaug

SEQ ID NO: 3485215 - RNA, 15 nt, Human
aauauuuuacauaca

SEQ ID NO: 3485216 - RNA, 19 nt, Human
aauauuuuaccacugcugu

SEQ ID NO: 3485217 - RNA, 16 nt, Human
aauauuuucagccuac

SEQ ID NO: 3485218 - RNA, 13 nt, Human
aauauuuucuauu

SEQ ID NO: 3485219 - RNA, 16 nt, Human
aauauuuucuauuuua

SEQ ID NO: 3485220 - RNA, 23 nt, Human
aauauuuucucuguacuuuucau

SEQ ID NO: 3485221 - RNA, 15 nt, Human
aauauuuucuggguu

SEQ ID NO: 3485222 - RNA, 14 nt, Human
aauauuuucuuuuc

SEQ ID NO: 3485223 - RNA, 16 nt, Human
aauauuuugaaucaau

SEQ ID NO: 3485224 - RNA, 20 nt, Human
aauauuuugaaucaauaaua

SEQ ID NO: 3485225 - RNA, 22 nt, Human
aauauuuugaaucaauaauaua

SEQ ID NO: 3485226 - RNA, 14 nt, Human
aauauuuugauaau

SEQ ID NO: 3485227 - RNA, 21 nt, Human
aauauuuugaucuucaacaaa

SEQ ID NO: 3485228 - RNA, 16 nt, Human
aauauuuuguauuauu

SEQ ID NO: 3485229 - RNA, 21 nt, Human
aauauuuugucuaaaaugccu

SEQ ID NO: 3485230 - RNA, 17 nt, Human
aauauuuuuaauauaua

SEQ ID NO: 3485231 - RNA, 23 nt, Human
aauauuuuuauauacagaggaaa

SEQ ID NO: 3485232 - RNA, 23 nt, Human
aauauuuuuauaucaugcaaaau

SEQ ID NO: 3485233 - RNA, 21 nt, Human
aauauuuuuauauuuccuuua

SEQ ID NO: 3485234 - RNA, 18 nt, Human
aauauuuuuucuuuucua

SEQ ID NO: 3485235 - RNA, 21 nt, Human
aauauuuuuuuguagaugaaa

SEQ ID NO: 3485236 - RNA, 10 nt, Human
aaucaaaacu

SEQ ID NO: 3485237 - RNA, 18 nt, Human
aaucaaaacucuccuaca

SEQ ID NO: 3485238 - RNA, 15 nt, Human
aaucaaaaucucucc

SEQ ID NO: 3485239 - RNA, 16 nt, Human
aaucaaacauuuucug

SEQ ID NO: 3485240 - RNA, 15 nt, Human
aaucaaacauuuuga

SEQ ID NO: 3485241 - RNA, 18 nt, Human
aaucaaagcaaugcauuu

SEQ ID NO: 3485242 - RNA, 17 nt, Human
aaucaaagccagggucu

SEQ ID NO: 3485243 - RNA, 13 nt, Human
aaucaaagugcua

SEQ ID NO: 3485244 - RNA, 14 nt, Human
aaucaaauguaaag

SEQ ID NO: 3485245 - RNA, 19 nt, Human
aaucaaauuuguaggguuu

SEQ ID NO: 3485246 - RNA, 15 nt, Human
aaucaacagggcagc

SEQ ID NO: 3485247 - RNA, 14 nt, Human
aaucaacucuaaua

SEQ ID NO: 3485248 - RNA, 17 nt, Human
aaucaacugaaaguguu

SEQ ID NO: 3485249 - RNA, 18 nt, Human
aaucaacugaaaguguuu

SEQ ID NO: 3485250 - RNA, 19 nt, Human
aaucaacugggcugaacac

SEQ ID NO: 3485251 - RNA, 13 nt, Human
aaucaacuugcuu

SEQ ID NO: 3485252 - RNA, 15 nt, Human
aaucaacuugcuuau

SEQ ID NO: 3485253 - RNA, 18 nt, Human
aaucaacuuuuuauugcc

SEQ ID NO: 3485254 - RNA, 20 nt, Human
aaucaacuuuuuauugccuu

SEQ ID NO: 3485255 - RNA, 21 nt, Human
aaucaacuuuuuauugccuuc

SEQ ID NO: 3485256 - RNA, 23 nt, Human
aaucaacuuuuuauugccuucuc

SEQ ID NO: 3485257 - RNA, 14 nt, Human
aaucaagaaacaaa

SEQ ID NO: 3485258 - RNA, 15 nt, Human
aaucaagaaacuuaa

SEQ ID NO: 3485259 - RNA, 17 nt, Human
aaucaagagccuuaaaa

SEQ ID NO: 3485260 - RNA, 21 nt, Human
aaucaagagccuuaaaacauc

SEQ ID NO: 3485261 - RNA, 16 nt, Human
aaucaagagcugcccu

SEQ ID NO: 3485262 - RNA, 11 nt, Human
aaucaagauaa

SEQ ID NO: 3485263 - RNA, 18 nt, Human
aaucaagcagguuagaga

SEQ ID NO: 3485264 - RNA, 13 nt, Human
aaucaagccucug

SEQ ID NO: 3485265 - RNA, 23 nt, Human
aaucaagccucuggucacauggc

SEQ ID NO: 3485266 - RNA, 23 nt, Human
aaucaagggcaaaaagucuacau

SEQ ID NO: 3485267 - RNA, 14 nt, Human
aaucaagggucagg

SEQ ID NO: 3485268 - RNA, 14 nt, Human
aaucaaguaaugaa

SEQ ID NO: 3485269 - RNA, 17 nt, Human
aaucaaguauuauaaac

SEQ ID NO: 3485270 - RNA, 14 nt, Human
aaucaaguauuuug

SEQ ID NO: 3485271 - RNA, 15 nt, Human
aaucaaguauuuugu

SEQ ID NO: 3485272 - RNA, 15 nt, Human
aaucaagucuguuua

SEQ ID NO: 3485273 - RNA, 22 nt, Human
aaucaaguuggcuucuaaucaa

SEQ ID NO: 3485274 - RNA, 20 nt, Human
aaucaaguuuccaagcaaau

SEQ ID NO: 3485275 - RNA, 16 nt, Human
aaucaauaaacgauuu

SEQ ID NO: 3485276 - RNA, 17 nt, Human
aaucaauaacagccgcu

SEQ ID NO: 3485277 - RNA, 18 nt, Human
aaucaauacacuaguugu

SEQ ID NO: 3485278 - RNA, 19 nt, Human
aaucaauacacuaguuguu

SEQ ID NO: 3485279 - RNA, 18 nt, Human
aauguauugaacuuggaa

SEQ ID NO: 3485280 - RNA, 19 nt, Human
aauguauugaacuuggaaa

SEQ ID NO: 3485281 - RNA, 14 nt, Human
aauguauuguaccu

SEQ ID NO: 3485282 - RNA, 16 nt, Human
aauguauuguaccuuu

SEQ ID NO: 3485283 - RNA, 22 nt, Human
aauguauuguaccuuuuaacac

SEQ ID NO: 3485284 - RNA, 21 nt, Human
aauguauuuauuuaaaagauu

SEQ ID NO: 3485285 - RNA, 14 nt, Human
aauguauuuguuca

SEQ ID NO: 3485286 - RNA, 15 nt, Human
aauguauuuguucau

SEQ ID NO: 3485287 - RNA, 17 nt, Human
aauguauuuguucaugu

SEQ ID NO: 3485288 - RNA, 18 nt, Human
aauguauuuguucauguu

SEQ ID NO: 3485289 - RNA, 21 nt, Human
aauguauuuguucauguuugg

SEQ ID NO: 3485290 - RNA, 15 nt, Human
aauguauuuuauguu

SEQ ID NO: 3485291 - RNA, 19 nt, Human
aauguauuuuauguuauau

SEQ ID NO: 3485292 - RNA, 16 nt, Human
aauguauuuuauugua

SEQ ID NO: 3485293 - RNA, 13 nt, Human
aauguauuuucuu

SEQ ID NO: 3485294 - RNA, 14 nt, Human
aauguauuuuuccu

SEQ ID NO: 3485295 - RNA, 15 nt, Human
aaugucaaaaguaga

SEQ ID NO: 3485296 - RNA, 19 nt, Human
aaugucaaaaguagaacuu

SEQ ID NO: 3485297 - RNA, 23 nt, Human
aaugucaaaaguagaacuuugua

SEQ ID NO: 3485298 - RNA, 13 nt, Human
aaugucacaggca

SEQ ID NO: 3485299 - RNA, 19 nt, Human
aaugucacaggcaggucca

SEQ ID NO: 3485300 - RNA, 19 nt, Human
aaugucacguacugucuga

SEQ ID NO: 3485301 - RNA, 20 nt, Human
aaugucacguacugucugau

SEQ ID NO: 3485302 - RNA, 18 nt, Human
aaugucagaaaaacaaua

SEQ ID NO: 3485303 - RNA, 22 nt, Human
aaugucagaaaaacaauaagag

SEQ ID NO: 3485304 - RNA, 18 nt, Human
aaugucaggaacagaagg

SEQ ID NO: 3485305 - RNA, 20 nt, Human
aaugucaggaacagaaggau

SEQ ID NO: 3485306 - RNA, 15 nt, Human
aaugucaguaugugg

SEQ ID NO: 3485307 - RNA, 22 nt, Human
aaugucaguauguggaagugug

SEQ ID NO: 3485308 - RNA, 13 nt, Human
aaugucaguguga

SEQ ID NO: 3485309 - RNA, 21 nt, Human
aaugucagugugacugaucuc

SEQ ID NO: 3485310 - RNA, 22 nt, Human
aaugucaguuguuauuuauuga

SEQ ID NO: 3485311 - RNA, 17 nt, Human
aaugucaucagaacuuu

SEQ ID NO: 3485312 - RNA, 15 nt, Human
aaugucaugcugccu

SEQ ID NO: 3485313 - RNA, 19 nt, Human
aaugucauuaaaauaaaua

SEQ ID NO: 3485314 - RNA, 23 nt, Human
aauguccaacuaaaaacaaaccc

SEQ ID NO: 3485315 - RNA, 15 nt, Human
aauguccauaugcua

SEQ ID NO: 3485316 - RNA, 18 nt, Human
aauguccaugauggaaua

SEQ ID NO: 3485317 - RNA, 18 nt, Human
aauguccauucuuuauca

SEQ ID NO: 3485318 - RNA, 23 nt, Human
aauguccuccagaagccucuggc

SEQ ID NO: 3485319 - RNA, 19 nt, Human
aaugucuaauguauuuuau

SEQ ID NO: 3485320 - RNA, 22 nt, Human
aaugucuaguuguaacaccaug

SEQ ID NO: 3485321 - RNA, 14 nt, Human
aaugucuauuaagg

SEQ ID NO: 3485322 - RNA, 20 nt, Human
aaugucucaaggcaguuaau

SEQ ID NO: 3485323 - RNA, 22 nt, Human
aaugucucacugagcacuguuu

SEQ ID NO: 3485324 - RNA, 13 nt, Human
aaugucuccuccc

SEQ ID NO: 3485325 - RNA, 17 nt, Human
aaugucucugugagacu

SEQ ID NO: 3485326 - RNA, 18 nt, Human
aaugucucugugagacuc

SEQ ID NO: 3485327 - RNA, 15 nt, Human
aaugucugcagcccu

SEQ ID NO: 3485328 - RNA, 22 nt, Human
aaugucuggagaauaauucuuu

SEQ ID NO: 3485329 - RNA, 23 nt, Human
aaugucuguagcuccucaacuca

SEQ ID NO: 3485330 - RNA, 18 nt, Human
aaugucuuaauuuuugaa

SEQ ID NO: 3485331 - RNA, 15 nt, Human
aaugucuucaaggcu

SEQ ID NO: 3485332 - RNA, 19 nt, Human
aaugucuucaaggcuucag

SEQ ID NO: 3485333 - RNA, 17 nt, Human
aaugucuucuagaauau

SEQ ID NO: 3485334 - RNA, 13 nt, Human
aaugucuugagcu

SEQ ID NO: 3485335 - RNA, 17 nt, Human
aaugucuugagcucuau

SEQ ID NO: 3485336 - RNA, 20 nt, Human
aaucagccaauuauguuaaa

SEQ ID NO: 3485337 - RNA, 23 nt, Human
aaucagccuaggggucagggacc

SEQ ID NO: 3485338 - RNA, 11 nt, Human
aaucagccugc

SEQ ID NO: 3485339 - RNA, 23 nt, Human
aaucagcuauuuacugccaaagg

SEQ ID NO: 3485340 - RNA, 13 nt, Human
aaucagcugcuuu

SEQ ID NO: 3485341 - RNA, 16 nt, Human
aaucagcugcuuuguu

SEQ ID NO: 3485342 - RNA, 20 nt, Human
aaucaggaauauuuuccaaa

SEQ ID NO: 3485343 - RNA, 16 nt, Human
aaucaggguuaguauu

SEQ ID NO: 3485344 - RNA, 18 nt, Human
aaucagguccugcucagc

SEQ ID NO: 3485345 - RNA, 14 nt, Human
aaucaguaaacacu

SEQ ID NO: 3485346 - RNA, 16 nt, Human
aaucaguaaacacugu

SEQ ID NO: 3485347 - RNA, 21 nt, Human
aaucaguaauauuuauauauu

SEQ ID NO: 3485348 - RNA, 21 nt, Human
aaucaguagcuuaagaaaaaa

SEQ ID NO: 3485349 - RNA, 14 nt, Human
aaucaguauaaaca

SEQ ID NO: 3485350 - RNA, 14 nt, Human
aaucaguauaauuc

SEQ ID NO: 3485351 - RNA, 14 nt, Human
aaucaguccccucc

SEQ ID NO: 3485352 - RNA, 16 nt, Human
aaucaguccccuccca

SEQ ID NO: 3485353 - RNA, 17 nt, Human
aaucaguccccucccau

SEQ ID NO: 3485354 - RNA, 18 nt, Human
aaucaguccccucccauc

SEQ ID NO: 3485355 - RNA, 17 nt, Human
aaucagugugucuaaau

SEQ ID NO: 3485356 - RNA, 23 nt, Human
aaucaguucauuagaaauauuuu

SEQ ID NO: 3485357 - RNA, 13 nt, Human
aaucauaaaacuu

SEQ ID NO: 3485358 - RNA, 16 nt, Human
aaucauaguuacugug

SEQ ID NO: 3485359 - RNA, 17 nt, Human
aaucauaguuacugugu

SEQ ID NO: 3485360 - RNA, 20 nt, Human
aaucauauaaauagaaugua

SEQ ID NO: 3485361 - RNA, 21 nt, Human
aaucauauaaauagaauguaa

SEQ ID NO: 3485362 - RNA, 22 nt, Human
aaucauauaaauagaauguaaa

SEQ ID NO: 3485363 - RNA, 13 nt, Human
aaucauauauaau

SEQ ID NO: 3485364 - RNA, 14 nt, Human
aaucauaugauucu

SEQ ID NO: 3485365 - RNA, 13 nt, Human
aaucauaugugau

SEQ ID NO: 3485366 - RNA, 23 nt, Human
aaucauaugugaucugucuugua

SEQ ID NO: 3485367 - RNA, 19 nt, Human
aaucauauuaauacaauga

SEQ ID NO: 3485368 - RNA, 14 nt, Human
aaucauauugauga

SEQ ID NO: 3485369 - RNA, 18 nt, Human
aaucauauugaugaaaag

SEQ ID NO: 3485370 - RNA, 12 nt, Human
aaucaucaagaa

SEQ ID NO: 3485371 - RNA, 20 nt, Human
aaucauccauccuugccaau

SEQ ID NO: 3485372 - RNA, 16 nt, Human
aaucaucgaaaauuca

SEQ ID NO: 3485373 - RNA, 19 nt, Human
aaucaucgaaaauucauuu

SEQ ID NO: 3485374 - RNA, 21 nt, Human
aaucaucgaaaauucauuuca

SEQ ID NO: 3485375 - RNA, 24 nt, Human
aaucaucggagucagccaggagcu

SEQ ID NO: 3485376 - RNA, 23 nt, Human
aaucaucuauuuugaugcagcau

SEQ ID NO: 3485377 - RNA, 18 nt, Human
aaucaucugugugaaaau

SEQ ID NO: 3485378 - RNA, 16 nt, Human
aaucaugaaauaugca

SEQ ID NO: 3485379 - RNA, 15 nt, Human
aaucaugaauuaguu

SEQ ID NO: 3485380 - RNA, 19 nt, Human
aaucaugaauuaguuuuau

SEQ ID NO: 3485381 - RNA, 16 nt, Human
aaucaugagccugcug

SEQ ID NO: 3485382 - RNA, 15 nt, Human
aaucaugccaguauu

SEQ ID NO: 3485383 - RNA, 12 nt, Human
aaucaugugugu

SEQ ID NO: 3485384 - RNA, 13 nt, Human
aaucauguguguu

SEQ ID NO: 3485385 - RNA, 13 nt, Human
aaucauguuauga

SEQ ID NO: 3485386 - RNA, 22 nt, Human
aaucauguugaucauguacuuu

SEQ ID NO: 3485387 - RNA, 23 nt, Human
aaucauguugaucauguacuuuu

SEQ ID NO: 3485388 - RNA, 13 nt, Human
aaucauguuucuu

SEQ ID NO: 3485389 - RNA, 19 nt, Human
aaucauguuucuuugauca

SEQ ID NO: 3485390 - RNA, 20 nt, Human
aaucauuauuuauuaaauuu

SEQ ID NO: 3485391 - RNA, 22 nt, Human
aaucauuauuuauuaaauuuuu

SEQ ID NO: 3485392 - RNA, 13 nt, Human
aaucauucagaaa

SEQ ID NO: 3485393 - RNA, 15 nt, Human
aaucauucucgauuu

SEQ ID NO: 3485394 - RNA, 17 nt, Human
aaucauucucgauuuaa

SEQ ID NO: 3485395 - RNA, 18 nt, Human
aaucauucuuacuaaaaa

SEQ ID NO: 3485396 - RNA, 12 nt, Human
aaucauugcuua

SEQ ID NO: 3485397 - RNA, 14 nt, Human
aaucauugcuuuga

SEQ ID NO: 3485398 - RNA, 19 nt, Human
aaucauugcuuugaagcag

SEQ ID NO: 3485399 - RNA, 22 nt, Human
aaucauugcuuugaagcaguug

SEQ ID NO: 3485400 - RNA, 15 nt, Human
aaucauuguacaguu

SEQ ID NO: 3485401 - RNA, 17 nt, Human
aaucauuguacaguuug

SEQ ID NO: 3485402 - RNA, 20 nt, Human
aaucauuguacaguuuguuu

SEQ ID NO: 3485403 - RNA, 14 nt, Human
aaucauuguugccu

SEQ ID NO: 3485404 - RNA, 18 nt, Human
aaucauuguuuugaauau

SEQ ID NO: 3485405 - RNA, 15 nt, Human
aaucauuuguuuaaa

SEQ ID NO: 3485406 - RNA, 22 nt, Human
aaucauuuuaauuauuauucuu

SEQ ID NO: 3485407 - RNA, 19 nt, Human
aaucauuuuauaugucaaa

SEQ ID NO: 3485408 - RNA, 20 nt, Human
aaucauuuuauaugucaaag

SEQ ID NO: 3485409 - RNA, 17 nt, Human
aaucauuuucauuccua

SEQ ID NO: 3485410 - RNA, 17 nt, Human
aauccaagcaaauguga

SEQ ID NO: 3485411 - RNA, 18 nt, Human
aauccaagcaaaugugaa

SEQ ID NO: 3485412 - RNA, 18 nt, Human
aauccaagcucccugccc

SEQ ID NO: 3485413 - RNA, 20 nt, Human
aauccaagcucccugcccca

SEQ ID NO: 3485414 - RNA, 15 nt, Human
aauccaaugaaauga

SEQ ID NO: 3485415 - RNA, 16 nt, Human
aauccacauuucuaaa

SEQ ID NO: 3485416 - RNA, 23 nt, Human
aauccacccauccuaccaaugca

SEQ ID NO: 3485417 - RNA, 19 nt, Human
aauccagaaacuuguucuu

SEQ ID NO: 3485418 - RNA, 18 nt, Human
aauccagcgguucucaaa

SEQ ID NO: 3485419 - RNA, 16 nt, Human
aauccaggcacagcug

SEQ ID NO: 3485420 - RNA, 21 nt, Human
aauccaggcagauccaggacu

SEQ ID NO: 3485421 - RNA, 17 nt, Human
aauccagugaccucucu

SEQ ID NO: 3485422 - RNA, 13 nt, Human
aauccaguuauaa

SEQ ID NO: 3485423 - RNA, 16 nt, Human
aauccaguuauaagaa

SEQ ID NO: 3485424 - RNA, 19 nt, Human
aauccaguuauaagaagaa

SEQ ID NO: 3485425 - RNA, 19 nt, Human
aauccauguuaguuuuuac

SEQ ID NO: 3485426 - RNA, 15 nt, Human
aauccauuuggaaau

SEQ ID NO: 3485427 - RNA, 18 nt, Human
aauccauuuggaaaucuu

SEQ ID NO: 3485428 - RNA, 21 nt, Human
aaucccaaauuugauugauuu

SEQ ID NO: 3485429 - RNA, 20 nt, Human
aaucccaagaucugugcagc

SEQ ID NO: 3485430 - RNA, 18 nt, Human
aaucccacccacauguga

SEQ ID NO: 3485431 - RNA, 23 nt, Human
aaucccagccggccaauggaaac

SEQ ID NO: 3485432 - RNA, 18 nt, Human
aaucccagcuacucagga

SEQ ID NO: 3485433 - RNA, 12 nt, Human
aaucccaggaug

SEQ ID NO: 3485434 - RNA, 17 nt, Human
aaucccauuuaaaaaaa

SEQ ID NO: 3485435 - RNA, 16 nt, Human
aauccccaguaaaauu

SEQ ID NO: 3485436 - RNA, 17 nt, Human
aauccccaguaaaauug

SEQ ID NO: 3485437 - RNA, 21 nt, Human
aaggccuggggugacccggca

SEQ ID NO: 3485438 - RNA, 23 nt, Human
aaggccugucccuggccaucucu

SEQ ID NO: 3485439 - RNA, 16 nt, Human
aaggccuuuaaaauuu

SEQ ID NO: 3485440 - RNA, 19 nt, Human
aaggcguggagcugccuga

SEQ ID NO: 3485441 - RNA, 13 nt, Human
aaggcuaaaaagu

SEQ ID NO: 3485442 - RNA, 19 nt, Human
aaggcuaccuuuguauucu

SEQ ID NO: 3485443 - RNA, 15 nt, Human
aaggcuauacuuguc

SEQ ID NO: 3485444 - RNA, 23 nt, Human
aaggcuauggggauagaugugug

SEQ ID NO: 3485445 - RNA, 17 nt, Human
aaggcucagucucagga

SEQ ID NO: 3485446 - RNA, 14 nt, Human
aaggcuccaggagc

SEQ ID NO: 3485447 - RNA, 15 nt, Human
aaggcuccugccccc

SEQ ID NO: 3485448 - RNA, 19 nt, Human
aaggcucgagcaugccugg

SEQ ID NO: 3485449 - RNA, 22 nt, Human
aaggcucgauuuuguaucugca

SEQ ID NO: 3485450 - RNA, 17 nt, Human
aaggcucugaaagccag

SEQ ID NO: 3485451 - RNA, 17 nt, Human
aaggcucugagagucua

SEQ ID NO: 3485452 - RNA, 22 nt, Human
aaggcucugagagucuagauuc

SEQ ID NO: 3485453 - RNA, 16 nt, Human
aaggcucuucugacua

SEQ ID NO: 3485454 - RNA, 22 nt, Human
aaggcugagacagugaauuugg

SEQ ID NO: 3485455 - RNA, 23 nt, Human
aaggcugagacagugaauuuggg

SEQ ID NO: 3485456 - RNA, 19 nt, Human
aaggcugaggaaaggccag

SEQ ID NO: 3485457 - RNA, 23 nt, Human
aaggcugaugccaaguuguuuga

SEQ ID NO: 3485458 - RNA, 16 nt, Human
aaggcugaugucaauu

SEQ ID NO: 3485459 - RNA, 16 nt, Human
aaggcugcgucuggag

SEQ ID NO: 3485460 - RNA, 19 nt, Human
aaggcugcgucuggagggg

SEQ ID NO: 3485461 - RNA, 13 nt, Human
aaggcuggcaggu

SEQ ID NO: 3485462 - RNA, 20 nt, Human
aaggcuggcgagagucuggc

SEQ ID NO: 3485463 - RNA, 22 nt, Human
aaggcuggcgagagucuggccc

SEQ ID NO: 3485464 - RNA, 14 nt, Human
aaggcugggggaag

SEQ ID NO: 3485465 - RNA, 22 nt, Human
aaggcugguacaacggaggccu

SEQ ID NO: 3485466 - RNA, 14 nt, Human
aaggcuguguaaga

SEQ ID NO: 3485467 - RNA, 16 nt, Human
aaggcuguguaagauu

SEQ ID NO: 3485468 - RNA, 21 nt, Human
aaggcuguuaaauacaggaaa

SEQ ID NO: 3485469 - RNA, 13 nt, Human
aaggcuguuugcu

SEQ ID NO: 3485470 - RNA, 15 nt, Human
aaggcuuaaacccau

SEQ ID NO: 3485471 - RNA, 19 nt, Human
aaggcuucaauuuauugca

SEQ ID NO: 3485472 - RNA, 15 nt, Human
aaggcuucagucuca

SEQ ID NO: 3485473 - RNA, 12 nt, Human
aaggcuucucuc

SEQ ID NO: 3485474 - RNA, 15 nt, Human
aaggcuucucucuca

SEQ ID NO: 3485475 - RNA, 15 nt, Human
aaggcuugcugcaga

SEQ ID NO: 3485476 - RNA, 14 nt, Human
aaggcuugggauuu

SEQ ID NO: 3485477 - RNA, 17 nt, Human
aaggcuuguugugcuuu

SEQ ID NO: 3485478 - RNA, 19 nt, Human
aaggcuuguugugcuuuua

SEQ ID NO: 3485479 - RNA, 20 nt, Human
aaggcuuguugugcuuuuag

SEQ ID NO: 3485480 - RNA, 18 nt, Human
agcaccacucaagaccaa

SEQ ID NO: 3485481 - RNA, 19 nt, Human
agcaccagcuucuccaggc

SEQ ID NO: 3485482 - RNA, 17 nt, Human
agcaccagggcucacgu

SEQ ID NO: 3485483 - RNA, 20 nt, Human
agcaccauccgccagggccc

SEQ ID NO: 3485484 - RNA, 20 nt, Human
agcaccauuuuaagucccug

SEQ ID NO: 3485485 - RNA, 23 nt, Human
agcaccauuuuaagucccuguca

SEQ ID NO: 3485486 - RNA, 23 nt, Human
agcacccauccaccguccccucc

SEQ ID NO: 3485487 - RNA, 15 nt, Human
agcaccccucucugc

SEQ ID NO: 3485488 - RNA, 18 nt, Human
agcaccggaccagccugg

SEQ ID NO: 3485489 - RNA, 20 nt, Human
agcaccgugucaagcugcuc

SEQ ID NO: 3485490 - RNA, 22 nt, Human
agcaccuacaguguacagucuu

SEQ ID NO: 3485491 - RNA, 16 nt, Human
agcaccucagccugca

SEQ ID NO: 3485492 - RNA, 14 nt, Human
agcaccuccagccu

SEQ ID NO: 3485493 - RNA, 22 nt, Human
agcaccucccagccccugcccc

SEQ ID NO: 3485494 - RNA, 18 nt, Human
agcaccuccucagccuga

SEQ ID NO: 3485495 - RNA, 13 nt, Human
agcaccuccugcc

SEQ ID NO: 3485496 - RNA, 19 nt, Human
agcaccuccuugucacuuu

SEQ ID NO: 3485497 - RNA, 21 nt, Human
agcaccugccuccucguuccu

SEQ ID NO: 3485498 - RNA, 14 nt, Human
agcaccugcugucu

SEQ ID NO: 3485499 - RNA, 14 nt, Human
agcaccuguaagaa

SEQ ID NO: 3485500 - RNA, 22 nt, Human
agcaccuuagacagucccugcc

SEQ ID NO: 3485501 - RNA, 20 nt, Human
agcaccuuccucacuuccau

SEQ ID NO: 3485502 - RNA, 16 nt, Human
agcaccuugugccugg

SEQ ID NO: 3485503 - RNA, 18 nt, Human
agcacgaaauguuauuuu

SEQ ID NO: 3485504 - RNA, 17 nt, Human
agcacgacaguggaugc

SEQ ID NO: 3485505 - RNA, 15 nt, Human
agcacgauuucuguu

SEQ ID NO: 3485506 - RNA, 16 nt, Human
agcacgauuucuguuu

SEQ ID NO: 3485507 - RNA, 15 nt, Human
agcacggacaauaaa

SEQ ID NO: 3485508 - RNA, 17 nt, Human
agcacggacaauaaacc

SEQ ID NO: 3485509 - RNA, 20 nt, Human
agcacggccaacaaagcugu

SEQ ID NO: 3485510 - RNA, 17 nt, Human
agcacguuuaaaguucu

SEQ ID NO: 3485511 - RNA, 18 nt, Human
agcacguuuaaaguucug

SEQ ID NO: 3485512 - RNA, 13 nt, Human
agcacuaaagcag

SEQ ID NO: 3485513 - RNA, 17 nt, Human
agcacuaaagcagugga

SEQ ID NO: 3485514 - RNA, 18 nt, Human
agcacuacaccuugccuu

SEQ ID NO: 3485515 - RNA, 15 nt, Human
acugcauguuuguga

SEQ ID NO: 3485516 - RNA, 22 nt, Human
acugcauuaccgcguuguaaaa

SEQ ID NO: 3485517 - RNA, 23 nt, Human
acugcauuaccgcguuguaaaau

SEQ ID NO: 3485518 - RNA, 15 nt, Human
acugcauuauucucu

SEQ ID NO: 3485519 - RNA, 15 nt, Human
acugcauugagaacu

SEQ ID NO: 3485520 - RNA, 19 nt, Human
acugcauuuagggaguauu

SEQ ID NO: 3485521 - RNA, 14 nt, Human
acugccaaccucgc

SEQ ID NO: 3485522 - RNA, 14 nt, Human
acugccaaccuggg

SEQ ID NO: 3485523 - RNA, 17 nt, Human
acugccaacugaucugu

SEQ ID NO: 3485524 - RNA, 16 nt, Human
acugccaagacugcug

SEQ ID NO: 3485525 - RNA, 19 nt, Human
acugccaagacugcugugg

SEQ ID NO: 3485526 - RNA, 20 nt, Human
acugccaagacugcuguggc

SEQ ID NO: 3485527 - RNA, 18 nt, Human
acugccaagccaugggua

SEQ ID NO: 3485528 - RNA, 15 nt, Human
acugccacaaggaag

SEQ ID NO: 3485529 - RNA, 18 nt, Human
acugccacaaggaagaaa

SEQ ID NO: 3485530 - RNA, 18 nt, Human
acugccacacucuccauc

SEQ ID NO: 3485531 - RNA, 21 nt, Human
acugccacacucuccaucacc

SEQ ID NO: 3485532 - RNA, 11 nt, Human
acugccaccuc

SEQ ID NO: 3485533 - RNA, 23 nt, Human
acugccaccuccccuugccagcu

SEQ ID NO: 3485534 - RNA, 16 nt, Human
acugccacuuugcaca

SEQ ID NO: 3485535 - RNA, 23 nt, Human
acugccagaugcugauguucagu

SEQ ID NO: 3485536 - RNA, 12 nt, Human
acugccagcagc

SEQ ID NO: 3485537 - RNA, 12 nt, Human
acugccagcauu

SEQ ID NO: 3485538 - RNA, 16 nt, Human
acugccaggccagccu

SEQ ID NO: 3485539 - RNA, 18 nt, Human
acugccaggccagccucc

SEQ ID NO: 3485540 - RNA, 13 nt, Human
acugccaggcucu

SEQ ID NO: 3485541 - RNA, 18 nt, Human
acugccagucccccugcc

SEQ ID NO: 3485542 - RNA, 23 nt, Human
acugccauaaaacauuaagaaaa

SEQ ID NO: 3485543 - RNA, 19 nt, Human
acugccauaugauuuacau

SEQ ID NO: 3485544 - RNA, 16 nt, Human
acugccaugcagggcc

SEQ ID NO: 3485545 - RNA, 14 nt, Human
acugccaugccagc

SEQ ID NO: 3485546 - RNA, 18 nt, Human
acugccauggaggcacac

SEQ ID NO: 3485547 - RNA, 21 nt, Human
acugccauggaggcacacagc

SEQ ID NO: 3485548 - RNA, 18 nt, Human
acugccauuauuuucugu

SEQ ID NO: 3485549 - RNA, 21 nt, Human
acugccauuauuuucugucag

SEQ ID NO: 3485550 - RNA, 14 nt, Human
acugcccaaagugc

SEQ ID NO: 3485551 - RNA, 14 nt, Human
acugcccagcggac

SEQ ID NO: 3485552 - RNA, 22 nt, Human
acugccccccaugaggaaggaa

SEQ ID NO: 3485553 - RNA, 16 nt, Human
acugcccccugcugcc

SEQ ID NO: 3485554 - RNA, 18 nt, Human
acugcccccugcugccau

SEQ ID NO: 3485555 - RNA, 17 nt, Human
acugccccgugcagacu

SEQ ID NO: 3485556 - RNA, 14 nt, Human
acugcccgagcugg

SEQ ID NO: 3485557 - RNA, 16 nt, Human
acugcccgagcuggug

SEQ ID NO: 3485558 - RNA, 18 nt, Human
acugcccgagcuggugca

SEQ ID NO: 3485559 - RNA, 22 nt, Human
acugcccggcaggguccuagaa

SEQ ID NO: 3485560 - RNA, 20 nt, Human
acugcccggggcagcugcca

SEQ ID NO: 3485561 - RNA, 21 nt, Human
acugcccggggcagcugccag

SEQ ID NO: 3485562 - RNA, 19 nt, Human
acugcccuaacuguacauu

SEQ ID NO: 3485563 - RNA, 20 nt, Human
acugcccuccagcucuuucc

SEQ ID NO: 3485564 - RNA, 11 nt, Human
acugcccucug

SEQ ID NO: 3485565 - RNA, 12 nt, Human
acugcccucugu

SEQ ID NO: 3485566 - RNA, 14 nt, Human
acugcccucuguuc

SEQ ID NO: 3485567 - RNA, 12 nt, Human
acugcccuggcu

SEQ ID NO: 3485568 - RNA, 23 nt, Human
acugccgaccgaggcuggagcug

SEQ ID NO: 3485569 - RNA, 15 nt, Human
acugccguaauuuaa

SEQ ID NO: 3485570 - RNA, 16 nt, Human
acugccguaauuuaac

SEQ ID NO: 3485571 - RNA, 17 nt, Human
acugccguaauuuaacu

SEQ ID NO: 3485572 - RNA, 18 nt, Human
acugccgucagugcugug

SEQ ID NO: 3485573 - RNA, 21 nt, Human
acugccuagaaacaacacugu

SEQ ID NO: 3485574 - RNA, 23 nt, Human
acugccuagaaacaacacuguag

SEQ ID NO: 3485575 - RNA, 16 nt, Human
acugccuauuuuaaua

SEQ ID NO: 3485576 - RNA, 12 nt, Human
acugccucaggu

SEQ ID NO: 3485577 - RNA, 13 nt, Human
acugccucagguu

SEQ ID NO: 3485578 - RNA, 21 nt, Human
acugccuccccaaggcccccu

SEQ ID NO: 3485579 - RNA, 17 nt, Human
acugccucgaaacacag

SEQ ID NO: 3485580 - RNA, 22 nt, Human
acugccucgggaaccucacucu

SEQ ID NO: 3485581 - RNA, 15 nt, Human
acugccucucacagc

SEQ ID NO: 3485582 - RNA, 22 nt, Human
acugccucucacagcugaguug

SEQ ID NO: 3485583 - RNA, 13 nt, Human
acugccucucccu

SEQ ID NO: 3485584 - RNA, 16 nt, Human
acugccucucccuggc

SEQ ID NO: 3485585 - RNA, 14 nt, Human
acugccucuuccuc

SEQ ID NO: 3485586 - RNA, 15 nt, Human
acugccugaauaaag

SEQ ID NO: 3485587 - RNA, 17 nt, Human
acugccugaauaaagag

SEQ ID NO: 3485588 - RNA, 19 nt, Human
acugccugaauaaagagcc

SEQ ID NO: 3485589 - RNA, 22 nt, Human
acugccugcagaggucugugcu

SEQ ID NO: 3485590 - RNA, 23 nt, Human
acugccugcagaggucugugcug

SEQ ID NO: 3485591 - RNA, 16 nt, Human
acugccugcccacccg

SEQ ID NO: 3485592 - RNA, 22 nt, Human
acugccugcccacccguggaga

SEQ ID NO: 3485593 - RNA, 14 nt, Human
acugccugccuuaa

SEQ ID NO: 3485594 - RNA, 15 nt, Human
acugccugcucccau

SEQ ID NO: 3485595 - RNA, 13 nt, Human
acugccuguauac

SEQ ID NO: 3485596 - RNA, 14 nt, Human
acugccuguauacu

SEQ ID NO: 3485597 - RNA, 17 nt, Human
acugccuguauacuuua

SEQ ID NO: 3485598 - RNA, 18 nt, Human
acugccuguauacuuuag

SEQ ID NO: 3485599 - RNA, 19 nt, Human
acugccuguauacuuuagu

SEQ ID NO: 3485600 - RNA, 23 nt, Human
acugccuuaauaaaaaaugaaaa

SEQ ID NO: 3485601 - RNA, 13 nt, Human
acugccuucucaa

SEQ ID NO: 3485602 - RNA, 20 nt, Human
acugccuucucaacuccaaa

SEQ ID NO: 3485603 - RNA, 12 nt, Human
acugccuugaaa

SEQ ID NO: 3485604 - RNA, 23 nt, Human
acugccuugaaccugugaguaaa

SEQ ID NO: 3485605 - RNA, 17 nt, Human
acugccuugaauauccc

SEQ ID NO: 3485606 - RNA, 18 nt, Human
acugccuugaauaucccc

SEQ ID NO: 3485607 - RNA, 22 nt, Human
acugccuugaauauccccuccc

SEQ ID NO: 3485608 - RNA, 13 nt, Human
acugccuuugacc

SEQ ID NO: 3485609 - RNA, 18 nt, Human
acugcgacuuucugccug

SEQ ID NO: 3485610 - RNA, 21 nt, Human
acugcgacuuucugccuggag

SEQ ID NO: 3485611 - RNA, 23 nt, Human
acugcgacuuucugccuggagug

SEQ ID NO: 3485612 - RNA, 18 nt, Human
acugcgaucuucagagca

SEQ ID NO: 3485613 - RNA, 20 nt, Human
acugcggaaaaggaaggaaa

SEQ ID NO: 3485614 - RNA, 20 nt, Human
acugcgggaugguccugggg

SEQ ID NO: 3485615 - RNA, 20 nt, Human
acugcguucugcaagcauca

SEQ ID NO: 3485616 - RNA, 17 nt, Human
acugcuaaauaaaauuu

SEQ ID NO: 3485617 - RNA, 23 nt, Human
acugcuacaaauacucuuaggaa

SEQ ID NO: 3485618 - RNA, 20 nt, Human
acugcuaccuuucaaagcuu

SEQ ID NO: 3485619 - RNA, 20 nt, Human
acugcuaggugggccagccc

SEQ ID NO: 3485620 - RNA, 21 nt, Human
acugcuaggugggccagcccc

SEQ ID NO: 3485621 - RNA, 23 nt, Human
acugcuaggugggccagccccuc

SEQ ID NO: 3485622 - RNA, 15 nt, Human
acugcuaguguucug

SEQ ID NO: 3485623 - RNA, 17 nt, Human
acugcuaguguucuguc

SEQ ID NO: 3485624 - RNA, 22 nt, Human
agguucugguuagcucagcccc

SEQ ID NO: 3485625 - RNA, 16 nt, Human
agguucuucuuccuga

SEQ ID NO: 3485626 - RNA, 21 nt, Human
agguucuucuuccugaagcug

SEQ ID NO: 3485627 - RNA, 19 nt, Human
agguucuucuuguucugag

SEQ ID NO: 3485628 - RNA, 17 nt, Human
agguucuuguuggugca

SEQ ID NO: 3485629 - RNA, 18 nt, Human
agguucuuguuggugcac

SEQ ID NO: 3485630 - RNA, 15 nt, Human
agguugaagccaagu

SEQ ID NO: 3485631 - RNA, 15 nt, Human
agguugaauaauaua

SEQ ID NO: 3485632 - RNA, 21 nt, Human
agguugacaauaaaugugcuu

SEQ ID NO: 3485633 - RNA, 20 nt, Human
agguugaggggcuccuggaa

SEQ ID NO: 3485634 - RNA, 12 nt, Human
agguugauaaau

SEQ ID NO: 3485635 - RNA, 20 nt, Human
agguugauaaaucauuuuau

SEQ ID NO: 3485636 - RNA, 22 nt, Human
agguugauaaaucauuuuaugu

SEQ ID NO: 3485637 - RNA, 18 nt, Human
agguugauaacuuugcuu

SEQ ID NO: 3485638 - RNA, 20 nt, Human
agguugauaacuuugcuugc

SEQ ID NO: 3485639 - RNA, 13 nt, Human
agguugcacacuu

SEQ ID NO: 3485640 - RNA, 16 nt, Human
agguugcacacuuugg

SEQ ID NO: 3485641 - RNA, 19 nt, Human
agguugcagugagccaaga

SEQ ID NO: 3485642 - RNA, 17 nt, Human
agguugcagugagcuga

SEQ ID NO: 3485643 - RNA, 18 nt, Human
agguugcagugagcugag

SEQ ID NO: 3485644 - RNA, 14 nt, Human
agguuggaagagaa

SEQ ID NO: 3485645 - RNA, 19 nt, Human
agguuggcucugccagucc

SEQ ID NO: 3485646 - RNA, 19 nt, Human
agguugggagccaaaugug

SEQ ID NO: 3485647 - RNA, 14 nt, Human
agguuguagcaugg

SEQ ID NO: 3485648 - RNA, 12 nt, Human
agguugugaaug

SEQ ID NO: 3485649 - RNA, 16 nt, Human
agguuuaaagagucua

SEQ ID NO: 3485650 - RNA, 14 nt, Human
agguuuaaaugaac

SEQ ID NO: 3485651 - RNA, 17 nt, Human
agguuuaacucagauca

SEQ ID NO: 3485652 - RNA, 18 nt, Human
agguuuaacucagaucac

SEQ ID NO: 3485653 - RNA, 19 nt, Human
agguuuaaguagauuucau

SEQ ID NO: 3485654 - RNA, 18 nt, Human
agguuuacaauuuacaaa

SEQ ID NO: 3485655 - RNA, 18 nt, Human
agguuuaggcugguggcc

SEQ ID NO: 3485656 - RNA, 14 nt, Human
agguuuaugaaaaa

SEQ ID NO: 3485657 - RNA, 12 nt, Human
agguuuaugaca

SEQ ID NO: 3485658 - RNA, 22 nt, Human
agguuuaugacaguaauugugu

SEQ ID NO: 3485659 - RNA, 20 nt, Human
agguuucacuguguuggcca

SEQ ID NO: 3485660 - RNA, 12 nt, Human
agguuucauacu

SEQ ID NO: 3485661 - RNA, 16 nt, Human
agguuucccaauggug

SEQ ID NO: 3485662 - RNA, 18 nt, Human
agguuucccaaugguguu

SEQ ID NO: 3485663 - RNA, 19 nt, Human
agguuucugaguuccugca

SEQ ID NO: 3485664 - RNA, 22 nt, Human
agguuucuggucucuaggcugg

SEQ ID NO: 3485665 - RNA, 18 nt, Human
agguuugcagucccaagc

SEQ ID NO: 3485666 - RNA, 20 nt, Human
agguuuggcuccugcccacu

SEQ ID NO: 3485667 - RNA, 21 nt, Human
agguuugggaccccugguggu

SEQ ID NO: 3485668 - RNA, 20 nt, Human
agguuuguauauugucagau

SEQ ID NO: 3485669 - RNA, 23 nt, Human
agguuugucgggcaccagccagc

SEQ ID NO: 3485670 - RNA, 10 nt, Human
agguuuguga

SEQ ID NO: 3485671 - RNA, 20 nt, Human
agguuuuaauuuaguaaacc

SEQ ID NO: 3485672 - RNA, 15 nt, Human
agguuuuagguucua

SEQ ID NO: 3485673 - RNA, 16 nt, Human
agguuuuagguucuaa

SEQ ID NO: 3485674 - RNA, 17 nt, Human
agguuuuauaaggcuga

SEQ ID NO: 3485675 - RNA, 20 nt, Human
agguuuuauuucauuuuuca

SEQ ID NO: 3485676 - RNA, 14 nt, Human
agguuuuauuuugu

SEQ ID NO: 3485677 - RNA, 14 nt, Human
agguuuucuccacu

SEQ ID NO: 3485678 - RNA, 13 nt, Human
agguuuuguacaa

SEQ ID NO: 3485679 - RNA, 12 nt, Human
agguuuuguugu

SEQ ID NO: 3485680 - RNA, 17 nt, Human
agguuuuguuugcuauc

SEQ ID NO: 3485681 - RNA, 23 nt, Human
agguuuuguuugcuaucuuaauu

SEQ ID NO: 3485682 - RNA, 13 nt, Human
agguuuuuauuag

SEQ ID NO: 3485683 - RNA, 15 nt, Human
agguuuuuauuagua

SEQ ID NO: 3485684 - RNA, 21 nt, Human
agguuuuucaauuaaacggau

SEQ ID NO: 3485685 - RNA, 20 nt, Human
agguuuuuccuuauuugcuu

SEQ ID NO: 3485686 - RNA, 13 nt, Human
agguuuuucuuaa

SEQ ID NO: 3485687 - RNA, 19 nt, Human
agguuuuuguuuguuuccu

SEQ ID NO: 3485688 - RNA, 21 nt, Human
agguuuuuuuguauaguaaag

SEQ ID NO: 3485689 - RNA, 22 nt, Human
agguuuuuuuguauaguaaagu

SEQ ID NO: 3485690 - RNA, 19 nt, Human
aguaaaaaacaacuucuuu

SEQ ID NO: 3485691 - RNA, 12 nt, Human
aguaaaaauaaa

SEQ ID NO: 3485692 - RNA, 19 nt, Human
aguaaaaauacaaaaauua

SEQ ID NO: 3485693 - RNA, 16 nt, Human
aguaaaacaaacaaua

SEQ ID NO: 3485694 - RNA, 19 nt, Human
aguaaaacaaacaauaccu

SEQ ID NO: 3485695 - RNA, 13 nt, Human
aguaaaacacaga

SEQ ID NO: 3485696 - RNA, 20 nt, Human
aguaaaaccacagcaguuga

SEQ ID NO: 3485697 - RNA, 14 nt, Human
aguaaaacuugcug

SEQ ID NO: 3485698 - RNA, 23 nt, Human
aguaaaagaagaaauaguucugu

SEQ ID NO: 3485699 - RNA, 19 nt, Human
aguaaaauaaauauugucu

SEQ ID NO: 3485700 - RNA, 13 nt, Human
aguaaaauccaca

SEQ ID NO: 3485701 - RNA, 21 nt, Human
aguaaaauuauacugugugug

SEQ ID NO: 3485702 - RNA, 14 nt, Human
aguaaaauucaguu

SEQ ID NO: 3485703 - RNA, 23 nt, Human
aguaaacaauaaaaguguccauu

SEQ ID NO: 3485704 - RNA, 13 nt, Human
aguaaacacugug

SEQ ID NO: 3485705 - RNA, 16 nt, Human
aguaaacacuguguau

SEQ ID NO: 3485706 - RNA, 15 nt, Human
aguaaaccacugaaa

SEQ ID NO: 3485707 - RNA, 15 nt, Human
aguaaaccugucuga

SEQ ID NO: 3485708 - RNA, 21 nt, Human
aguaaacgggaacaugccccc

SEQ ID NO: 3485709 - RNA, 15 nt, Human
aguaaacugcagucc

SEQ ID NO: 3485710 - RNA, 16 nt, Human
aguaaagaauuauuuu

SEQ ID NO: 3485711 - RNA, 13 nt, Human
aguaaagagaaac

SEQ ID NO: 3485712 - RNA, 22 nt, Human
aguaaagagaaacuuugugcua

SEQ ID NO: 3485713 - RNA, 18 nt, Human
aguaaagccguuguuuac

SEQ ID NO: 3485714 - RNA, 19 nt, Human
aguaaaggaguaagaaccu

SEQ ID NO: 3485715 - RNA, 16 nt, Human
aguaaagguuaaaaau

SEQ ID NO: 3485716 - RNA, 15 nt, Human
aguaaaguguaacau

SEQ ID NO: 3485717 - RNA, 15 nt, Human
aguaaauaaauuguu

SEQ ID NO: 3485718 - RNA, 18 nt, Human
aguaaauaaauuguuuga

SEQ ID NO: 3485719 - RNA, 19 nt, Human
aguaaauaaauuguuugac

SEQ ID NO: 3485720 - RNA, 14 nt, Human
aguaaauaaugcuu

SEQ ID NO: 3485721 - RNA, 15 nt, Human
aguaaauacaauuuu

SEQ ID NO: 3485722 - RNA, 13 nt, Human
aguaaauauugag

SEQ ID NO: 3485723 - RNA, 14 nt, Human
aguaaauauuucag

SEQ ID NO: 3485724 - RNA, 20 nt, Human
aguaaaucacgcuuuuugaa

SEQ ID NO: 3485725 - RNA, 18 nt, Human
aguaaaucagauguugaa

SEQ ID NO: 3485726 - RNA, 22 nt, Human
aguaaaugcuagguuaauucca

SEQ ID NO: 3485727 - RNA, 23 nt, Human
aguaaaugcuagguuaauuccaa

SEQ ID NO: 3485728 - RNA, 22 nt, Human
aguaaauggcuuauccagcugg

SEQ ID NO: 3485729 - RNA, 19 nt, Human
aguaaaugggggugcauuu

SEQ ID NO: 3485730 - RNA, 11 nt, Human
aguaaaugucu

SEQ ID NO: 3485731 - RNA, 12 nt, Human
aguaaaugucuu

SEQ ID NO: 3485732 - RNA, 16 nt, Human
aguaaaugucuuugua

SEQ ID NO: 3485733 - RNA, 19 nt, Human
aguaaaugucuuuguaagu

SEQ ID NO: 3485734 - RNA, 22 nt, Human
aguaaauguuaucuuauacugu

SEQ ID NO: 3485735 - RNA, 13 nt, Human
aguaacaaaaaua

SEQ ID NO: 3485736 - RNA, 15 nt, Human
aguaacaaaaauaaa

SEQ ID NO: 3485737 - RNA, 22 nt, Human
aguaacaagagugauucuugcu

SEQ ID NO: 3485738 - RNA, 19 nt, Human
aguaacaauacaaauggau

SEQ ID NO: 3485739 - RNA, 20 nt, Human
aguaacaauacaaauggauu

SEQ ID NO: 3485740 - RNA, 14 nt, Human
aguaacacaggcca

SEQ ID NO: 3485741 - RNA, 17 nt, Human
aguaacagggccuugcu

SEQ ID NO: 3485742 - RNA, 17 nt, Human
aguaacaugaggggaca

SEQ ID NO: 3485743 - RNA, 18 nt, Human
aguaacauucauguucua

SEQ ID NO: 3485744 - RNA, 21 nt, Human
aguaaccuuuugcaccugcuc

SEQ ID NO: 3485745 - RNA, 23 nt, Human
aguaaccuuuugcaccugcucuc

SEQ ID NO: 3485746 - RNA, 17 nt, Human
aguaacuacaguuaggg

SEQ ID NO: 3485747 - RNA, 11 nt, Human
aguaacuccca

SEQ ID NO: 3485748 - RNA, 18 nt, Human
aguaacuggugauauauc

SEQ ID NO: 3485749 - RNA, 14 nt, Human
aguaacuugggagu

SEQ ID NO: 3485750 - RNA, 18 nt, Human
aguaacuugggagugugg

SEQ ID NO: 3485751 - RNA, 17 nt, Human
aguaacuugguuauaca

SEQ ID NO: 3485752 - RNA, 16 nt, Human
aguaacuuuaugugua

SEQ ID NO: 3485753 - RNA, 17 nt, Human
aguaacuuuauguguaa

SEQ ID NO: 3485754 - RNA, 19 nt, Human
aguaacuuuauguguaaau

SEQ ID NO: 3485755 - RNA, 21 nt, Human
aguaagaaagugaagcaaauc

SEQ ID NO: 3485756 - RNA, 17 nt, Human
aguaagaaccuugccug

SEQ ID NO: 3485757 - RNA, 15 nt, Human
aguaagaagacauga

SEQ ID NO: 3485758 - RNA, 14 nt, Human
aguaagagcuggug

SEQ ID NO: 3485759 - RNA, 14 nt, Human
aguccucuccaccu

SEQ ID NO: 3485760 - RNA, 19 nt, Human
aguccucuccaccuagugg

SEQ ID NO: 3485761 - RNA, 21 nt, Human
aguccucuccaccuaguggcu

SEQ ID NO: 3485762 - RNA, 22 nt, Human
aguccucuggauggcaccagag

SEQ ID NO: 3485763 - RNA, 20 nt, Human
aguccucuggguaggaauca

SEQ ID NO: 3485764 - RNA, 19 nt, Human
aguccugaagaggcgggcc

SEQ ID NO: 3485765 - RNA, 21 nt, Human
aguccugaagaggcgggccag

SEQ ID NO: 3485766 - RNA, 22 nt, Human
aguccugaagaggcgggccagc

SEQ ID NO: 3485767 - RNA, 23 nt, Human
aguccuggaagccagcuuucccu

SEQ ID NO: 3485768 - RNA, 16 nt, Human
aguggcaugugcugug

SEQ ID NO: 3485769 - RNA, 20 nt, Human
aguggcauuggcagcaggug

SEQ ID NO: 3485770 - RNA, 22 nt, Human
aguggccacuaagcagaggagg

SEQ ID NO: 3485771 - RNA, 14 nt, Human
aguggccacucagc

SEQ ID NO: 3485772 - RNA, 11 nt, Human
aguggccagac

SEQ ID NO: 3485773 - RNA, 17 nt, Human
aguggccagaccagagc

SEQ ID NO: 3485774 - RNA, 16 nt, Human
aguggccaucauuucu

SEQ ID NO: 3485775 - RNA, 15 nt, Human
aguggcccaacaggg

SEQ ID NO: 3485776 - RNA, 13 nt, Human
aguggccccaccu

SEQ ID NO: 3485777 - RNA, 18 nt, Human
aguggccuacaaaucagu

SEQ ID NO: 3485778 - RNA, 21 nt, Human
aguggccucgaacuccuggca

SEQ ID NO: 3485779 - RNA, 15 nt, Human
aguggccucuuuguc

SEQ ID NO: 3485780 - RNA, 23 nt, Human
aguggccucuuugucuaaaacaa

SEQ ID NO: 3485781 - RNA, 15 nt, Human
aguggccuggccagg

SEQ ID NO: 3485782 - RNA, 18 nt, Human
aguggccuggccaggagc

SEQ ID NO: 3485783 - RNA, 20 nt, Human
aguggccuggccaggagcuc

SEQ ID NO: 3485784 - RNA, 22 nt, Human
aguggccuggccaggagcucuu

SEQ ID NO: 3485785 - RNA, 23 nt, Human
aguggccuggccaggagcucuuc

SEQ ID NO: 3485786 - RNA, 14 nt, Human
aguggccuggcucc

SEQ ID NO: 3485787 - RNA, 18 nt, Human
aguggccuuaccccugcc

SEQ ID NO: 3485788 - RNA, 19 nt, Human
aguggccuuccccagcaug

SEQ ID NO: 3485789 - RNA, 23 nt, Human
aguggcgaaaucccugcucacug

SEQ ID NO: 3485790 - RNA, 20 nt, Human
aguggcgcgaucucagcuca

SEQ ID NO: 3485791 - RNA, 19 nt, Human
aguggcgugggagccagcc

SEQ ID NO: 3485792 - RNA, 15 nt, Human
aguggcguugggagg

SEQ ID NO: 3485793 - RNA, 14 nt, Human
aguggcucaacauu

SEQ ID NO: 3485794 - RNA, 17 nt, Human
aguggcuccucccggug

SEQ ID NO: 3485795 - RNA, 16 nt, Human
aguggcucgccaggcc

SEQ ID NO: 3485796 - RNA, 11 nt, Human
aguggcugcug

SEQ ID NO: 3485797 - RNA, 16 nt, Human
aguggcuggggcaugg

SEQ ID NO: 3485798 - RNA, 12 nt, Human
aguggcugucca

SEQ ID NO: 3485799 - RNA, 15 nt, Human
aguggcuucaaaaua

SEQ ID NO: 3485800 - RNA, 22 nt, Human
aguggcuucauuagagcaggcg

SEQ ID NO: 3485801 - RNA, 14 nt, Human
aguggcuuguccuc

SEQ ID NO: 3485802 - RNA, 17 nt, Human
agugggaaaaauguagg

SEQ ID NO: 3485803 - RNA, 18 nt, Human
agugggaacucugacaag

SEQ ID NO: 3485804 - RNA, 19 nt, Human
agugggacagggcauggcc

SEQ ID NO: 3485805 - RNA, 21 nt, Human
agugggacccauagaucuucu

SEQ ID NO: 3485806 - RNA, 22 nt, Human
agugggacccauagaucuucug

SEQ ID NO: 3485807 - RNA, 14 nt, Human
agugggagaaggca

SEQ ID NO: 3485808 - RNA, 15 nt, Human
agugggagcugccug

SEQ ID NO: 3485809 - RNA, 16 nt, Human
agugggaggcgcgagc

SEQ ID NO: 3485810 - RNA, 15 nt, Human
agugggaggggcagg

SEQ ID NO: 3485811 - RNA, 18 nt, Human
agugggaggggcaggcug

SEQ ID NO: 3485812 - RNA, 19 nt, Human
agugggaggggcaggcuga

SEQ ID NO: 3485813 - RNA, 24 nt, Human
agugggcaaaagcuuacaaauacu

SEQ ID NO: 3485814 - RNA, 20 nt, Human
agugggcagagcccccagga

SEQ ID NO: 3485815 - RNA, 14 nt, Human
agugggcagucaca

SEQ ID NO: 3485816 - RNA, 15 nt, Human
agugggccagggcug

SEQ ID NO: 3485817 - RNA, 16 nt, Human
agugggcuugauucug

SEQ ID NO: 3485818 - RNA, 12 nt, Human
aguggggaagag

SEQ ID NO: 3485819 - RNA, 16 nt, Human
aguggggaaugaagau

SEQ ID NO: 3485820 - RNA, 16 nt, Human
aguggggcagagccuc

SEQ ID NO: 3485821 - RNA, 18 nt, Human
aguggggcucgccaugcc

SEQ ID NO: 3485822 - RNA, 15 nt, Human
aguggggcucucuga

SEQ ID NO: 3485823 - RNA, 17 nt, Human
aguggggggaacgccca

SEQ ID NO: 3485824 - RNA, 16 nt, Human
agugggguagguuggg

SEQ ID NO: 3485825 - RNA, 19 nt, Human
aguggggucucccucuccu

SEQ ID NO: 3485826 - RNA, 23 nt, Human
aguggggucucccucuccugccu

SEQ ID NO: 3485827 - RNA, 14 nt, Human
aguggggugcuggg

SEQ ID NO: 3485828 - RNA, 18 nt, Human
aguggggugcugggagga

SEQ ID NO: 3485829 - RNA, 21 nt, Human
agugggguuaucucuguguua

SEQ ID NO: 3485830 - RNA, 22 nt, Human
agugggguugcaaccacugcaa

SEQ ID NO: 3485831 - RNA, 15 nt, Human
agugggguuuccugg

SEQ ID NO: 3485832 - RNA, 19 nt, Human
aguggguaaaauuagaugc

SEQ ID NO: 3485833 - RNA, 22 nt, Human
aguggguacccccaggaccaga

SEQ ID NO: 3485834 - RNA, 14 nt, Human
agugggucccagau

SEQ ID NO: 3485835 - RNA, 18 nt, Human
agugggugguggaucugu

SEQ ID NO: 3485836 - RNA, 16 nt, Human
aguggguuauucugga

SEQ ID NO: 3485837 - RNA, 12 nt, Human
aguggguuuuuu

SEQ ID NO: 3485838 - RNA, 19 nt, Human
agugguaaaaaggccuccu

SEQ ID NO: 3485839 - RNA, 19 nt, Human
agugguaagcucuggcuuu

SEQ ID NO: 3485840 - RNA, 14 nt, Human
agugguauagaaau

SEQ ID NO: 3485841 - RNA, 15 nt, Human
agugguauagaaaug

SEQ ID NO: 3485842 - RNA, 16 nt, Human
agugguauagaaaugc

SEQ ID NO: 3485843 - RNA, 22 nt, Human
aguggucaaaccgcacucaccc

SEQ ID NO: 3485844 - RNA, 15 nt, Human
aguggucccugcccu

SEQ ID NO: 3485845 - RNA, 13 nt, Human
agugguccuagag

SEQ ID NO: 3485846 - RNA, 23 nt, Human
aguggucuuaagaaauguauaaa

SEQ ID NO: 3485847 - RNA, 20 nt, Human
aguggucuuuguaagagugu

SEQ ID NO: 3485848 - RNA, 21 nt, Human
aguggucuuuguaagagugua

SEQ ID NO: 3485849 - RNA, 16 nt, Human
aguggugcgaucuggg

SEQ ID NO: 3485850 - RNA, 13 nt, Human
aguggugcucagu

SEQ ID NO: 3485851 - RNA, 11 nt, Human
agugguggcag

SEQ ID NO: 3485852 - RNA, 16 nt, Human
agugguggcagggccu

SEQ ID NO: 3485853 - RNA, 18 nt, Human
agugguggcagggccuag

SEQ ID NO: 3485854 - RNA, 15 nt, Human
agugguggcucugag

SEQ ID NO: 3485855 - RNA, 16 nt, Human
agugguggcucugaga

SEQ ID NO: 3485856 - RNA, 16 nt, Human
aguggugggggaaggc

SEQ ID NO: 3485857 - RNA, 18 nt, Human
aguggugguaacccuggu

SEQ ID NO: 3485858 - RNA, 19 nt, Human
aguggugguaacccuggug

SEQ ID NO: 3485859 - RNA, 17 nt, Human
aguggugguuuucuguu

SEQ ID NO: 3485860 - RNA, 19 nt, Human
aguggugguuuucuguucu

SEQ ID NO: 3485861 - RNA, 17 nt, Human
agugguguuuuaaagag

SEQ ID NO: 3485862 - RNA, 21 nt, Human
agugguuccuaauccucuagg

SEQ ID NO: 3485863 - RNA, 20 nt, Human
agugguucuacaaucuauuu

SEQ ID NO: 3485864 - RNA, 21 nt, Human
agugguucuacaaucuauuua

SEQ ID NO: 3485865 - RNA, 13 nt, Human
agugguugaauau

SEQ ID NO: 3485866 - RNA, 14 nt, Human
agugguugaauaug

SEQ ID NO: 3485867 - RNA, 15 nt, Human
agugguugaauauga

SEQ ID NO: 3485868 - RNA, 18 nt, Human
agugguugaauaugauua

SEQ ID NO: 3485869 - RNA, 13 nt, Human
agugguuuagaaa

SEQ ID NO: 3485870 - RNA, 20 nt, Human
agugguuuccacaugcucug

SEQ ID NO: 3485871 - RNA, 23 nt, Human
agugguuuuauacugaaggaaaa

SEQ ID NO: 3485872 - RNA, 13 nt, Human
aguguaaaaauga

SEQ ID NO: 3485873 - RNA, 21 nt, Human
aguguaaaauauuuugaauca

SEQ ID NO: 3485874 - RNA, 14 nt, Human
aguguaaagcauuc

SEQ ID NO: 3485875 - RNA, 22 nt, Human
aguguaaagcauuccaacaaag

SEQ ID NO: 3485876 - RNA, 21 nt, Human
aguguaaauaguuacuccagu

SEQ ID NO: 3485877 - RNA, 15 nt, Human
aguguaacaagaaag

SEQ ID NO: 3485878 - RNA, 16 nt, Human
aguguaacaagaaagg

SEQ ID NO: 3485879 - RNA, 15 nt, Human
aguguaacaauugug

SEQ ID NO: 3485880 - RNA, 18 nt, Human
aguguaacaauuguguag

SEQ ID NO: 3485881 - RNA, 14 nt, Human
aguguaacagcuga

SEQ ID NO: 3485882 - RNA, 15 nt, Human
aguguaacagcugag

SEQ ID NO: 3485883 - RNA, 13 nt, Human
aguguaaguguga

SEQ ID NO: 3485884 - RNA, 13 nt, Human
aguguaauaagac

SEQ ID NO: 3485885 - RNA, 19 nt, Human
aguguaaucccccaggaga

SEQ ID NO: 3485886 - RNA, 22 nt, Human
aguguaaugaauaccuuagugc

SEQ ID NO: 3485887 - RNA, 16 nt, Human
aguguacagucuugua

SEQ ID NO: 3485888 - RNA, 21 nt, Human
aguguacauggaauaacaugu

SEQ ID NO: 3485889 - RNA, 13 nt, Human
aguguaccauaau

SEQ ID NO: 3485890 - RNA, 21 nt, Human
aguguaccauuaaaauaugca

SEQ ID NO: 3485891 - RNA, 17 nt, Human
aguguaccuccucucag

SEQ ID NO: 3485892 - RNA, 20 nt, Human
aguguaccuguguacauaac

SEQ ID NO: 3485893 - RNA, 16 nt, Human
aguguacgauucuuaa

SEQ ID NO: 3485894 - RNA, 16 nt, Human
aguguacuggauuuaa

SEQ ID NO: 3485895 - RNA, 22 nt, Human
aguguagaaaagaacuggaaac

SEQ ID NO: 3485896 - RNA, 14 nt, Human
aguguagaagcauu

SEQ ID NO: 3485897 - RNA, 15 nt, Human
aguguagaagcauuc

SEQ ID NO: 3485898 - RNA, 18 nt, Human
aguguagaagcauuccuu

SEQ ID NO: 3485899 - RNA, 19 nt, Human
aguguagaagcauuccuuc

SEQ ID NO: 3485900 - RNA, 22 nt, Human
aguguagaagcauuccuucuuu

SEQ ID NO: 3485901 - RNA, 15 nt, Human
aguguagaucagagc

SEQ ID NO: 3485902 - RNA, 15 nt, Human
aguguagccaggucc

SEQ ID NO: 3485903 - RNA, 23 nt, Human
aguguagcccacacuugagagga

SEQ ID NO: 3485904 - RNA, 13 nt, Human
aguguagccuugc

SEQ ID NO: 3485905 - RNA, 17 nt, Human
aguguagccuugcccgg

SEQ ID NO: 3485906 - RNA, 18 nt, Human
aguguagccuugcccgga

SEQ ID NO: 3485907 - RNA, 16 nt, Human
aguguaggcagacaca

SEQ ID NO: 3485908 - RNA, 18 nt, Human
aguguaggcagacacagg

SEQ ID NO: 3485909 - RNA, 16 nt, Human
aguguaguuaauuuau

SEQ ID NO: 3485910 - RNA, 19 nt, Human
aguguaguuuacagaaaaa

SEQ ID NO: 3485911 - RNA, 14 nt, Human
aguguaucaaaaug

SEQ ID NO: 3485912 - RNA, 18 nt, Human
aguguaucaaaaugcucu

SEQ ID NO: 3485913 - RNA, 14 nt, Human
aguuaaacauaaau

SEQ ID NO: 3485914 - RNA, 16 nt, Human
aguuaaagaaaggaaa

SEQ ID NO: 3485915 - RNA, 23 nt, Human
aguuaaagugaggccacugaaga

SEQ ID NO: 3485916 - RNA, 12 nt, Human
aguuaaauaaau

SEQ ID NO: 3485917 - RNA, 21 nt, Human
aguuaaauagaguauaugcac

SEQ ID NO: 3485918 - RNA, 12 nt, Human
aguuaacagaga

SEQ ID NO: 3485919 - RNA, 21 nt, Human
aguuaacgggugaauaauaaa

SEQ ID NO: 3485920 - RNA, 20 nt, Human
aguuaacuauugcauuuaua

SEQ ID NO: 3485921 - RNA, 24 nt, Human
aguuaacuauugcauuuauaugua

SEQ ID NO: 3485922 - RNA, 14 nt, Human
aguuaacuuucaga

SEQ ID NO: 3485923 - RNA, 14 nt, Human
aguuaagaaaaaaa

SEQ ID NO: 3485924 - RNA, 18 nt, Human
aguuaagaaaaaaauaau

SEQ ID NO: 3485925 - RNA, 18 nt, Human
aguuaagaagcuguugua

SEQ ID NO: 3485926 - RNA, 21 nt, Human
aguuaagaagcuguuguacau

SEQ ID NO: 3485927 - RNA, 14 nt, Human
aguuaagagaaacu

SEQ ID NO: 3485928 - RNA, 19 nt, Human
aguuaagagaaacuuuaua

SEQ ID NO: 3485929 - RNA, 21 nt, Human
aguuaagagaaacuuuauaca

SEQ ID NO: 3485930 - RNA, 13 nt, Human
aguuaagccuuug

SEQ ID NO: 3485931 - RNA, 19 nt, Human
aguuaaggaccguggcccu

SEQ ID NO: 3485932 - RNA, 22 nt, Human
aguuaaggagaaucauguuucu

SEQ ID NO: 3485933 - RNA, 16 nt, Human
aguuaauaagcaaaau

SEQ ID NO: 3485934 - RNA, 21 nt, Human
aguuaauauaucccagaaauu

SEQ ID NO: 3485935 - RNA, 15 nt, Human
aguuaauauugugaa

SEQ ID NO: 3485936 - RNA, 18 nt, Human
aguuaaucaucaagagaa

SEQ ID NO: 3485937 - RNA, 19 nt, Human
aguuaaucaucaagagaau

SEQ ID NO: 3485938 - RNA, 14 nt, Human
aguuaaucuugcuu

SEQ ID NO: 3485939 - RNA, 15 nt, Human
aguuaaucuugcuuu

SEQ ID NO: 3485940 - RNA, 18 nt, Human
aguuaaucuugcuuucuu

SEQ ID NO: 3485941 - RNA, 15 nt, Human
aguuaauguauauaa

SEQ ID NO: 3485942 - RNA, 18 nt, Human
aguuaauguauauaaaaa

SEQ ID NO: 3485943 - RNA, 19 nt, Human
aguuaauguauauaaaaau

SEQ ID NO: 3485944 - RNA, 15 nt, Human
aguuaauuuaucuaa

SEQ ID NO: 3485945 - RNA, 18 nt, Human
aguuaauuuaucuaaauu

SEQ ID NO: 3485946 - RNA, 23 nt, Human
aguuaauuuuuccaacuacuaau

SEQ ID NO: 3485947 - RNA, 23 nt, Human
aguuacaaauuauaauguauuca

SEQ ID NO: 3485948 - RNA, 21 nt, Human
aguuacaacuuccuaauuuua

SEQ ID NO: 3485949 - RNA, 12 nt, Human
aguuacagaaag

SEQ ID NO: 3485950 - RNA, 17 nt, Human
aguuacagcgagaggca

SEQ ID NO: 3485951 - RNA, 13 nt, Human
aguuacaguucug

SEQ ID NO: 3485952 - RNA, 16 nt, Human
aguuacaguucugugg

SEQ ID NO: 3485953 - RNA, 21 nt, Human
aguuacauauguauacaugug

SEQ ID NO: 3485954 - RNA, 17 nt, Human
aguuacaugcauacuuc

SEQ ID NO: 3485955 - RNA, 16 nt, Human
aguuacauuaauguua

SEQ ID NO: 3485956 - RNA, 21 nt, Human
aguuaccuuauaguuacugug

SEQ ID NO: 3485957 - RNA, 18 nt, Human
aguuacuagguaacuuca

SEQ ID NO: 3485958 - RNA, 17 nt, Human
aguuacuauccuggcuu

SEQ ID NO: 3485959 - RNA, 16 nt, Human
aguuacucagcccugg

SEQ ID NO: 3485960 - RNA, 17 nt, Human
aguuacucagcccuggg

SEQ ID NO: 3485961 - RNA, 18 nt, Human
aguuacucagcccugggc

SEQ ID NO: 3485962 - RNA, 19 nt, Human
aguuacucagcccugggcc

SEQ ID NO: 3485963 - RNA, 21 nt, Human
aguuacuccagugccaacaau

SEQ ID NO: 3485964 - RNA, 16 nt, Human
aguuacucugaagggc

SEQ ID NO: 3485965 - RNA, 21 nt, Human
aguuacugccgguuugaaaau

SEQ ID NO: 3485966 - RNA, 16 nt, Human
aguuacuguaaaaugc

SEQ ID NO: 3485967 - RNA, 15 nt, Human
aguuacuguguaaac

SEQ ID NO: 3485968 - RNA, 15 nt, Human
aguuacuguguaauu

SEQ ID NO: 3485969 - RNA, 18 nt, Human
aguuacuguguaauuagu

SEQ ID NO: 3485970 - RNA, 13 nt, Human
aguuacuguugug

SEQ ID NO: 3485971 - RNA, 14 nt, Human
aguuacuuuagaug

SEQ ID NO: 3485972 - RNA, 22 nt, Human
aguuacuuuccaauucuccuuu

SEQ ID NO: 3485973 - RNA, 19 nt, Human
aguuagaauaauaaauauu

SEQ ID NO: 3485974 - RNA, 13 nt, Human
aguuagacuguug

SEQ ID NO: 3485975 - RNA, 14 nt, Human
aguuagagaaucug

SEQ ID NO: 3485976 - RNA, 19 nt, Human
aguuagcucaggaggcuug

SEQ ID NO: 3485977 - RNA, 22 nt, Human
aguuagcucaggaggcuuggaa

SEQ ID NO: 3485978 - RNA, 13 nt, Human
aguuaggaaauaa

SEQ ID NO: 3485979 - RNA, 15 nt, Human
aguuaggaaugagaa

SEQ ID NO: 3485980 - RNA, 18 nt, Human
aguuaggauagcauuuuu

SEQ ID NO: 3485981 - RNA, 19 nt, Human
agccucagcccccugcuuc

SEQ ID NO: 3485982 - RNA, 21 nt, Human
agccucaggacugggagcccc

SEQ ID NO: 3485983 - RNA, 23 nt, Human
agccucaggggucugagcuccag

SEQ ID NO: 3485984 - RNA, 11 nt, Human
agccucagucc

SEQ ID NO: 3485985 - RNA, 15 nt, Human
agccucaguccuccc

SEQ ID NO: 3485986 - RNA, 16 nt, Human
agccucaguccucccc

SEQ ID NO: 3485987 - RNA, 20 nt, Human
agccucagugacccuggcuc

SEQ ID NO: 3485988 - RNA, 14 nt, Human
agccucauauuuaa

SEQ ID NO: 3485989 - RNA, 17 nt, Human
agccucauauuuaaaga

SEQ ID NO: 3485990 - RNA, 17 nt, Human
agccucauccgaggcag

SEQ ID NO: 3485991 - RNA, 12 nt, Human
agccucaucucu

SEQ ID NO: 3485992 - RNA, 20 nt, Human
agccucauguccacugguuc

SEQ ID NO: 3485993 - RNA, 21 nt, Human
agccuccaagcuccaucucca

SEQ ID NO: 3485994 - RNA, 22 nt, Human
agccuccaauuuuuuaagugaa

SEQ ID NO: 3485995 - RNA, 14 nt, Human
agccuccacagcga

SEQ ID NO: 3485996 - RNA, 21 nt, Human
agccuccacagcgagggcagc

SEQ ID NO: 3485997 - RNA, 13 nt, Human
agccuccagccuc

SEQ ID NO: 3485998 - RNA, 22 nt, Human
agccuccaguccaaggaaacca

SEQ ID NO: 3485999 - RNA, 18 nt, Human
agccuccaugcugccucc

SEQ ID NO: 3486000 - RNA, 15 nt, Human
agccuccauuuaguu

SEQ ID NO: 3486001 - RNA, 21 nt, Human
agccucccaaagugcugggau

SEQ ID NO: 3486002 - RNA, 20 nt, Human
agccucccaaggagaacaaa

SEQ ID NO: 3486003 - RNA, 18 nt, Human
agccucccacagugcugg

SEQ ID NO: 3486004 - RNA, 13 nt, Human
agccucccacccc

SEQ ID NO: 3486005 - RNA, 17 nt, Human
agccucccauccagggc

SEQ ID NO: 3486006 - RNA, 14 nt, Human
agccuccccugcca

SEQ ID NO: 3486007 - RNA, 15 nt, Human
agccuccccugccag

SEQ ID NO: 3486008 - RNA, 16 nt, Human
agccuccccugccagg

SEQ ID NO: 3486009 - RNA, 22 nt, Human
agccuccccugccagggcaggg

SEQ ID NO: 3486010 - RNA, 19 nt, Human
agccucccgaauagcuggg

SEQ ID NO: 3486011 - RNA, 17 nt, Human
agccucccgaguagcug

SEQ ID NO: 3486012 - RNA, 22 nt, Human
agccucccgaguagcugggacu

SEQ ID NO: 3486013 - RNA, 12 nt, Human
agccucccugaa

SEQ ID NO: 3486014 - RNA, 15 nt, Human
agccucccugaagcc

SEQ ID NO: 3486015 - RNA, 12 nt, Human
agccucccugcc

SEQ ID NO: 3486016 - RNA, 13 nt, Human
agccucccugccu

SEQ ID NO: 3486017 - RNA, 14 nt, Human
agccucccugccuc

SEQ ID NO: 3486018 - RNA, 20 nt, Human
agccuccgcuucccugguuc

SEQ ID NO: 3486019 - RNA, 22 nt, Human
agccuccgcuucccugguucaa

SEQ ID NO: 3486020 - RNA, 16 nt, Human
agccuccuccugacca

SEQ ID NO: 3486021 - RNA, 19 nt, Human
agccuccucuggacggcag

SEQ ID NO: 3486022 - RNA, 19 nt, Human
agccuccucugucugcccu

SEQ ID NO: 3486023 - RNA, 21 nt, Human
agccuccucugucugcccuuc

SEQ ID NO: 3486024 - RNA, 14 nt, Human
agccuccugaccug

SEQ ID NO: 3486025 - RNA, 17 nt, Human
agccuccugaccugagg

SEQ ID NO: 3486026 - RNA, 11 nt, Human
agccuccugag

SEQ ID NO: 3486027 - RNA, 11 nt, Human
agccuccugcc

SEQ ID NO: 3486028 - RNA, 13 nt, Human
agccuccugccca

SEQ ID NO: 3486029 - RNA, 16 nt, Human
agccuccugcccaguc

SEQ ID NO: 3486030 - RNA, 18 nt, Human
agccuccugcccuuaccu

SEQ ID NO: 3486031 - RNA, 21 nt, Human
agccuccuguguagcugggau

SEQ ID NO: 3486032 - RNA, 17 nt, Human
agccuccuuagaaaaaa

SEQ ID NO: 3486033 - RNA, 16 nt, Human
agccuccuuucuggcu

SEQ ID NO: 3486034 - RNA, 17 nt, Human
agccucgaacuccuggg

SEQ ID NO: 3486035 - RNA, 23 nt, Human
agccucgcaggccucccugccag

SEQ ID NO: 3486036 - RNA, 14 nt, Human
agccucgccccugg

SEQ ID NO: 3486037 - RNA, 21 nt, Human
agccucguuggaagaggaaca

SEQ ID NO: 3486038 - RNA, 21 nt, Human
agccucuagggaccccuccuc

SEQ ID NO: 3486039 - RNA, 22 nt, Human
agccucuagggaccccuccucc

SEQ ID NO: 3486040 - RNA, 18 nt, Human
agccucucaccuguacuc

SEQ ID NO: 3486041 - RNA, 12 nt, Human
agccucuccagg

SEQ ID NO: 3486042 - RNA, 18 nt, Human
agccucuccccaggucca

SEQ ID NO: 3486043 - RNA, 22 nt, Human
agccucuccccagguccagcuc

SEQ ID NO: 3486044 - RNA, 23 nt, Human
agccucuccccagguccagcucu

SEQ ID NO: 3486045 - RNA, 21 nt, Human
agccucuccccugccugcccu

SEQ ID NO: 3486046 - RNA, 14 nt, Human
agccucucucccag

SEQ ID NO: 3486047 - RNA, 16 nt, Human
agccucucucccaguc

SEQ ID NO: 3486048 - RNA, 18 nt, Human
agccucucucccagucua

SEQ ID NO: 3486049 - RNA, 20 nt, Human
agccucugaccccuccucac

SEQ ID NO: 3486050 - RNA, 22 nt, Human
agccucugcagcggaaucuguu

SEQ ID NO: 3486051 - RNA, 16 nt, Human
agccucugccugugca

SEQ ID NO: 3486052 - RNA, 16 nt, Human
agccucugcuccccag

SEQ ID NO: 3486053 - RNA, 13 nt, Human
agccucugcugcc

SEQ ID NO: 3486054 - RNA, 22 nt, Human
agccucuggcauuagaauuauu

SEQ ID NO: 3486055 - RNA, 14 nt, Human
agccucuggcuaga

SEQ ID NO: 3486056 - RNA, 20 nt, Human
agccucugggggguggccag

SEQ ID NO: 3486057 - RNA, 13 nt, Human
aguuuguuggaaa

SEQ ID NO: 3486058 - RNA, 16 nt, Human
aguuuguuucuuugaa

SEQ ID NO: 3486059 - RNA, 18 nt, Human
aguuuguuucuuugaauu

SEQ ID NO: 3486060 - RNA, 13 nt, Human
aguuuguuuuugc

SEQ ID NO: 3486061 - RNA, 13 nt, Human
aguuuuaacugug

SEQ ID NO: 3486062 - RNA, 18 nt, Human
aguuuuaacuguggauau

SEQ ID NO: 3486063 - RNA, 17 nt, Human
aguuuuacccuauaucu

SEQ ID NO: 3486064 - RNA, 20 nt, Human
aguuuuacucugcugcaaaa

SEQ ID NO: 3486065 - RNA, 15 nt, Human
aguuuuaguugcaga

SEQ ID NO: 3486066 - RNA, 14 nt, Human
aguuuuauaaaaga

SEQ ID NO: 3486067 - RNA, 12 nt, Human
aguuuuauauau

SEQ ID NO: 3486068 - RNA, 20 nt, Human
aguuuuauauauuauaugga

SEQ ID NO: 3486069 - RNA, 17 nt, Human
aguuuuaucacauguau

SEQ ID NO: 3486070 - RNA, 20 nt, Human
aguuuuaucacauguauguu

SEQ ID NO: 3486071 - RNA, 12 nt, Human
aguuuuaucauu

SEQ ID NO: 3486072 - RNA, 23 nt, Human
aguuuuaugcucuuuuuuacuca

SEQ ID NO: 3486073 - RNA, 17 nt, Human
aguuuuauuuauauuua

SEQ ID NO: 3486074 - RNA, 22 nt, Human
aguuuucacucuuauugcccac

SEQ ID NO: 3486075 - RNA, 20 nt, Human
aguuuucagaaccucuuccc

SEQ ID NO: 3486076 - RNA, 11 nt, Human
aguuuucaguu

SEQ ID NO: 3486077 - RNA, 15 nt, Human
aguuuucaguuugua

SEQ ID NO: 3486078 - RNA, 18 nt, Human
aguuuucauaguauccau

SEQ ID NO: 3486079 - RNA, 22 nt, Human
aguuuucaugugcucagaauua

SEQ ID NO: 3486080 - RNA, 21 nt, Human
aguuuucauuuagaaaauaga

SEQ ID NO: 3486081 - RNA, 13 nt, Human
aguuuuccaugaa

SEQ ID NO: 3486082 - RNA, 16 nt, Human
aguuuuccaugaaaac

SEQ ID NO: 3486083 - RNA, 11 nt, Human
aguuuuccuga

SEQ ID NO: 3486084 - RNA, 14 nt, Human
aguuuuccuucuca

SEQ ID NO: 3486085 - RNA, 18 nt, Human
aguuuuccuucucaucug

SEQ ID NO: 3486086 - RNA, 23 nt, Human
aguuuuccuucucaucugugauu

SEQ ID NO: 3486087 - RNA, 13 nt, Human
aguuuucuccuuu

SEQ ID NO: 3486088 - RNA, 14 nt, Human
aguuuucugagaaa

SEQ ID NO: 3486089 - RNA, 17 nt, Human
aguuuucugagaaagac

SEQ ID NO: 3486090 - RNA, 18 nt, Human
aguuuucugagaaagacu

SEQ ID NO: 3486091 - RNA, 19 nt, Human
aguuuucuggcuggagccu

SEQ ID NO: 3486092 - RNA, 19 nt, Human
aguuuucuuguugcuuugu

SEQ ID NO: 3486093 - RNA, 19 nt, Human
aguuuucuuuccuccuuuc

SEQ ID NO: 3486094 - RNA, 12 nt, Human
aguuuugaaaag

SEQ ID NO: 3486095 - RNA, 17 nt, Human
aguuuugaagauucuau

SEQ ID NO: 3486096 - RNA, 13 nt, Human
aguuuugaauguu

SEQ ID NO: 3486097 - RNA, 21 nt, Human
aguuuugaauguuaagaauug

SEQ ID NO: 3486098 - RNA, 15 nt, Human
aguuuugacaagcug

SEQ ID NO: 3486099 - RNA, 18 nt, Human
aguuuugacaagcuggcu

SEQ ID NO: 3486100 - RNA, 22 nt, Human
aguuuugaguagauauuacuuu

SEQ ID NO: 3486101 - RNA, 23 nt, Human
aguuuugaugacuggcauuuuau

SEQ ID NO: 3486102 - RNA, 23 nt, Human
aguuuugcuuuuaguuuuucugu

SEQ ID NO: 3486103 - RNA, 17 nt, Human
aguuuuggccaccacau

SEQ ID NO: 3486104 - RNA, 16 nt, Human
aguuuugggaaguuaa

SEQ ID NO: 3486105 - RNA, 15 nt, Human
aguuuugguugcuuu

SEQ ID NO: 3486106 - RNA, 13 nt, Human
aguuuugucuuga

SEQ ID NO: 3486107 - RNA, 19 nt, Human
aguuuuguguuuguuguag

SEQ ID NO: 3486108 - RNA, 22 nt, Human
aguuuuguguuuguuguagauu

SEQ ID NO: 3486109 - RNA, 12 nt, Human
aguuuuguugcc

SEQ ID NO: 3486110 - RNA, 23 nt, Human
aguuuuguuguacuuaaauggua

SEQ ID NO: 3486111 - RNA, 17 nt, Human
aguuuuguuuaaaagga

SEQ ID NO: 3486112 - RNA, 14 nt, Human
aguuuuguuuggac

SEQ ID NO: 3486113 - RNA, 23 nt, Human
aguuuuuaacucuacuguguaau

SEQ ID NO: 3486114 - RNA, 17 nt, Human
aguuuuuaccuaccaca

SEQ ID NO: 3486115 - RNA, 22 nt, Human
aguuuuuaccuaccacaguguc

SEQ ID NO: 3486116 - RNA, 16 nt, Human
aguuuuuaugagaaac

SEQ ID NO: 3486117 - RNA, 18 nt, Human
aguuuuuaugagaaacuu

SEQ ID NO: 3486118 - RNA, 19 nt, Human
aguuuuuauuaaaccccuu

SEQ ID NO: 3486119 - RNA, 18 nt, Human
aguuuuuauuccuuguga

SEQ ID NO: 3486120 - RNA, 18 nt, Human
aguuuuucauuaaauaaa

SEQ ID NO: 3486121 - RNA, 22 nt, Human
aguuuuucauuaaauaaauuug

SEQ ID NO: 3486122 - RNA, 15 nt, Human
aguuuuucauuuuaa

SEQ ID NO: 3486123 - RNA, 11 nt, Human
aguuuuucugu

SEQ ID NO: 3486124 - RNA, 12 nt, Human
aguuuuucuguc

SEQ ID NO: 3486125 - RNA, 22 nt, Human
aguuuuucuguuuuguuuggca

SEQ ID NO: 3486126 - RNA, 22 nt, Human
aguuuuuggaguguuauguauu

SEQ ID NO: 3486127 - RNA, 21 nt, Human
aguuuuuggauaaagaauacu

SEQ ID NO: 3486128 - RNA, 18 nt, Human
aguuuuuguacuguaaag

SEQ ID NO: 3486129 - RNA, 13 nt, Human
aguuuuuucaucu

SEQ ID NO: 3486130 - RNA, 22 nt, Human
aguuuuuugaaaaugggcucaa

SEQ ID NO: 3486131 - RNA, 23 nt, Human
aguuuuuuuuuauacacuguaau

SEQ ID NO: 3486132 - RNA, 22 nt, Human
aguuuuuuuuuucuugucuaua

SEQ ID NO: 3486133 - RNA, 17 nt, Human
auaaaaaaaagaaaaaa

SEQ ID NO: 3486134 - RNA, 17 nt, Human
auaaaaaaacaaucauu

SEQ ID NO: 3486135 - RNA, 14 nt, Human
auaaaaaaauaaaa

SEQ ID NO: 3486136 - RNA, 11 nt, Human
auaaaaaagau

SEQ ID NO: 3486137 - RNA, 15 nt, Human
auaaaaaagauccca

SEQ ID NO: 3486138 - RNA, 17 nt, Human
auaaaaaagaucccaaa

SEQ ID NO: 3486139 - RNA, 22 nt, Human
auaaaaaagcuggugggugaaa

SEQ ID NO: 3486140 - RNA, 18 nt, Human
auaaaaaagucucuauuu

SEQ ID NO: 3486141 - RNA, 14 nt, Human
auaaaaaauaauaa

SEQ ID NO: 3486142 - RNA, 17 nt, Human
auaaaaaauauguauuu

SEQ ID NO: 3486143 - RNA, 19 nt, Human
auaaaaaauauucuuguca

SEQ ID NO: 3486144 - RNA, 11 nt, Human
auaaaaaaugg

SEQ ID NO: 3486145 - RNA, 13 nt, Human
auaaaaaaugguu

SEQ ID NO: 3486146 - RNA, 13 nt, Human
auaaaaaauuuua

SEQ ID NO: 3486147 - RNA, 18 nt, Human
auaaaaaauuuuguaauu

SEQ ID NO: 3486148 - RNA, 14 nt, Human
auaaaaacaacuuu

SEQ ID NO: 3486149 - RNA, 18 nt, Human
auaaaaacccacaaaaau

SEQ ID NO: 3486150 - RNA, 22 nt, Human
auaaaaagaaaagauaaagaug

SEQ ID NO: 3486151 - RNA, 13 nt, Human
auaaaaagaauga

SEQ ID NO: 3486152 - RNA, 14 nt, Human
auaaaaagaucacu

SEQ ID NO: 3486153 - RNA, 13 nt, Human
auaaaaagcaaaa

SEQ ID NO: 3486154 - RNA, 11 nt, Human
auaaaaaggac

SEQ ID NO: 3486155 - RNA, 17 nt, Human
auaaaaagugacacagc

SEQ ID NO: 3486156 - RNA, 16 nt, Human
auaaaaagugcuuuug

SEQ ID NO: 3486157 - RNA, 20 nt, Human
auaaaaaguggaauuucuug

SEQ ID NO: 3486158 - RNA, 13 nt, Human
auaaaaaguuaaa

SEQ ID NO: 3486159 - RNA, 14 nt, Human
auaaaaauaaaaaa

SEQ ID NO: 3486160 - RNA, 13 nt, Human
auaaaaauauauu

SEQ ID NO: 3486161 - RNA, 16 nt, Human
auaaaaauauguacaa

SEQ ID NO: 3486162 - RNA, 14 nt, Human
auaaaaauauugug

SEQ ID NO: 3486163 - RNA, 12 nt, Human
auaaaaauggau

SEQ ID NO: 3486164 - RNA, 14 nt, Human
auaaaaaugucuug

SEQ ID NO: 3486165 - RNA, 15 nt, Human
auaaaaauucugaau

SEQ ID NO: 3486166 - RNA, 12 nt, Human
auaaaacaggua

SEQ ID NO: 3486167 - RNA, 18 nt, Human
auaaaacaggucaauaca

SEQ ID NO: 3486168 - RNA, 22 nt, Human
auaaaacaguuggcaugcaucc

SEQ ID NO: 3486169 - RNA, 15 nt, Human
auaaaacauagcaaa

SEQ ID NO: 3486170 - RNA, 20 nt, Human
auaaaacaucuuugaaauua

SEQ ID NO: 3486171 - RNA, 14 nt, Human
auaaaacauuaaga

SEQ ID NO: 3486172 - RNA, 18 nt, Human
auaaaacauuaagaaaau

SEQ ID NO: 3486173 - RNA, 22 nt, Human
auaaaacauuaugcuccagaaa

SEQ ID NO: 3486174 - RNA, 18 nt, Human
auaaaacauuuuaaaugg

SEQ ID NO: 3486175 - RNA, 18 nt, Human
auaaaacauuuucacaca

SEQ ID NO: 3486176 - RNA, 12 nt, Human
auaaaacccuua

SEQ ID NO: 3486177 - RNA, 20 nt, Human
auaaaaccuuucaaauuuca

SEQ ID NO: 3486178 - RNA, 22 nt, Human
auaaaaccuuucaaauuucaca

SEQ ID NO: 3486179 - RNA, 11 nt, Human
auaaaacucug

SEQ ID NO: 3486180 - RNA, 17 nt, Human
auaaaacuuuuuaaaau

SEQ ID NO: 3486181 - RNA, 13 nt, Human
auaaaagaaauaa

SEQ ID NO: 3486182 - RNA, 15 nt, Human
auaaaagacaaggaa

SEQ ID NO: 3486183 - RNA, 14 nt, Human
auaaaagacacaga

SEQ ID NO: 3486184 - RNA, 15 nt, Human
auaaaagacagugaa

SEQ ID NO: 3486185 - RNA, 19 nt, Human
auaaaagauggggucugua

SEQ ID NO: 3486186 - RNA, 16 nt, Human
auaaaagcagcaucug

SEQ ID NO: 3486187 - RNA, 15 nt, Human
aguguaguuaauuua

SEQ ID NO: 3486188 - RNA, 17 nt, Human
aguguaguuaauuuauc

SEQ ID NO: 3486189 - RNA, 15 nt, Human
aguguauaauaagaa

SEQ ID NO: 3486190 - RNA, 15 nt, Human
aguguaucaaaaugc

SEQ ID NO: 3486191 - RNA, 18 nt, Human
aguguaugacugcacaug

SEQ ID NO: 3486192 - RNA, 17 nt, Human
aguguaugcacgugugc

SEQ ID NO: 3486193 - RNA, 21 nt, Human
aguguauggaaauaaauguau

SEQ ID NO: 3486194 - RNA, 15 nt, Human
aguguauuauaacag

SEQ ID NO: 3486195 - RNA, 12 nt, Human
aguguauuuauu

SEQ ID NO: 3486196 - RNA, 14 nt, Human
aguguauuuggaaa

SEQ ID NO: 3486197 - RNA, 14 nt, Human
aguguauuuguauu

SEQ ID NO: 3486198 - RNA, 18 nt, Human
aguguauuuuauaaaauu

SEQ ID NO: 3486199 - RNA, 19 nt, Human
agugucaaauaaacacugu

SEQ ID NO: 3486200 - RNA, 21 nt, Human
agugucaaauaaacacugugu

SEQ ID NO: 3486201 - RNA, 17 nt, Human
agugucaaccagacaga

SEQ ID NO: 3486202 - RNA, 15 nt, Human
agugucaaguugugc

SEQ ID NO: 3486203 - RNA, 13 nt, Human
aguuaaaaaaaau

SEQ ID NO: 3486204 - RNA, 20 nt, Human
aguuaaaaaaaauaauaaau

SEQ ID NO: 3486205 - RNA, 13 nt, Human
aguuaaagcagug

SEQ ID NO: 3486206 - RNA, 17 nt, Human
aguuaaaggcugacuac

SEQ ID NO: 3486207 - RNA, 16 nt, Human
aguuaaagugaauaac

SEQ ID NO: 3486208 - RNA, 23 nt, Human
aguuaaauagaguauaugcacuu

SEQ ID NO: 3486209 - RNA, 18 nt, Human
aguuaaauguuaccucug

SEQ ID NO: 3486210 - RNA, 20 nt, Human
aguuaacaccuuuaaagugu

SEQ ID NO: 3486211 - RNA, 21 nt, Human
aguuaacaucaugaauuuauu

SEQ ID NO: 3486212 - RNA, 13 nt, Human
aguuaacggguga

SEQ ID NO: 3486213 - RNA, 17 nt, Human
aguuaacgggugaauaa

SEQ ID NO: 3486214 - RNA, 18 nt, Human
aguuaacuuuaagacuga

SEQ ID NO: 3486215 - RNA, 17 nt, Human
aguuaagaaaaaaauaa

SEQ ID NO: 3486216 - RNA, 17 nt, Human
aguuaagaagcuguugu

SEQ ID NO: 3486217 - RNA, 20 nt, Human
aguuaagaagcuguuguaca

SEQ ID NO: 3486218 - RNA, 20 nt, Human
aguuaagacaugauuuccuu

SEQ ID NO: 3486219 - RNA, 13 nt, Human
aguuaagaccugg

SEQ ID NO: 3486220 - RNA, 16 nt, Human
aguuaagagaaacuuu

SEQ ID NO: 3486221 - RNA, 17 nt, Human
aguuaagagaaacuuua

SEQ ID NO: 3486222 - RNA, 23 nt, Human
aguuaagagaaacuuuauacauu

SEQ ID NO: 3486223 - RNA, 23 nt, Human
aguuaagagaaaugagcuugacc

SEQ ID NO: 3486224 - RNA, 14 nt, Human
aguuaagaguagca

SEQ ID NO: 3486225 - RNA, 21 nt, Human
aguuaaggagaaucauguuuc

SEQ ID NO: 3486226 - RNA, 15 nt, Human
aguuaagugaauguc

SEQ ID NO: 3486227 - RNA, 13 nt, Human
aguuaaucuauaa

SEQ ID NO: 3486228 - RNA, 20 nt, Human
aguuaaugaugguugauggg

SEQ ID NO: 3486229 - RNA, 20 nt, Human
aguuaauuacauccucaugc

SEQ ID NO: 3486230 - RNA, 19 nt, Human
aguuaauuagcauucuggc

SEQ ID NO: 3486231 - RNA, 13 nt, Human
aguuaauuuaucu

SEQ ID NO: 3486232 - RNA, 20 nt, Human
aguuacaaauugcuugaaag

SEQ ID NO: 3486233 - RNA, 20 nt, Human
aguuacacagaaaugcugcu

SEQ ID NO: 3486234 - RNA, 22 nt, Human
aguuacacagaaaugcugcugg

SEQ ID NO: 3486235 - RNA, 18 nt, Human
aguuacacaugaucauaa

SEQ ID NO: 3486236 - RNA, 16 nt, Human
aguuacacauuuuuca

SEQ ID NO: 3486237 - RNA, 18 nt, Human
aguuacacuaaaagguga

SEQ ID NO: 3486238 - RNA, 15 nt, Human
aguuacagaaagugg

SEQ ID NO: 3486239 - RNA, 14 nt, Human
aguuacagacaaag

SEQ ID NO: 3486240 - RNA, 17 nt, Human
aguuacagacaaagcgu

SEQ ID NO: 3486241 - RNA, 20 nt, Human
aguuacagccuguuaguaac

SEQ ID NO: 3486242 - RNA, 15 nt, Human
aguuacaguucugug

SEQ ID NO: 3486243 - RNA, 20 nt, Human
aguuacauauguauacaugu

SEQ ID NO: 3486244 - RNA, 20 nt, Human
aguuacaugcauacuucaaa

SEQ ID NO: 3486245 - RNA, 15 nt, Human
aguuacauguuugca

SEQ ID NO: 3486246 - RNA, 17 nt, Human
aguuaccauuaaaccau

SEQ ID NO: 3486247 - RNA, 16 nt, Human
aguuaccuuauaguua

SEQ ID NO: 3486248 - RNA, 22 nt, Human
aguuacuagguaacuucauauu

SEQ ID NO: 3486249 - RNA, 23 nt, Human
aguuacuaucaugucaaacguga

SEQ ID NO: 3486250 - RNA, 16 nt, Human
aguuacuauccuggcu

SEQ ID NO: 3486251 - RNA, 13 nt, Human
aguuacucagaau

SEQ ID NO: 3486252 - RNA, 14 nt, Human
aguuacucagcccu

SEQ ID NO: 3486253 - RNA, 15 nt, Human
aguuacucagcccug

SEQ ID NO: 3486254 - RNA, 23 nt, Human
aguuacucagcccugggccccac

SEQ ID NO: 3486255 - RNA, 16 nt, Human
aguuacugaacaguaa

SEQ ID NO: 3486256 - RNA, 21 nt, Human
aguuacuguccuguugauuaa

SEQ ID NO: 3486257 - RNA, 11 nt, Human
aguuacugugu

SEQ ID NO: 3486258 - RNA, 14 nt, Human
aguuacuguguaaa

SEQ ID NO: 3486259 - RNA, 19 nt, Human
aguuacuguguaauuagug

SEQ ID NO: 3486260 - RNA, 17 nt, Human
aguuacuguugugaccu

SEQ ID NO: 3486261 - RNA, 14 nt, Human
aguuacuuccuauc

SEQ ID NO: 3486262 - RNA, 15 nt, Human
aguuacuuccuauca

SEQ ID NO: 3486263 - RNA, 23 nt, Human
aguuacuugcugcccugugcucc

SEQ ID NO: 3486264 - RNA, 14 nt, Human
aguuacuuuauguu

SEQ ID NO: 3486265 - RNA, 16 nt, Human
aguuacuuucuuaaug

SEQ ID NO: 3486266 - RNA, 19 nt, Human
aguuacuuugucagaggca

SEQ ID NO: 3486267 - RNA, 14 nt, Human
aguuacuuuuccuu

SEQ ID NO: 3486268 - RNA, 18 nt, Human
aguuacuuuuccuugcau

SEQ ID NO: 3486269 - RNA, 23 nt, Human
aguuacuuuuccuugcauacaaa

SEQ ID NO: 3486270 - RNA, 15 nt, Human
aguuagaauaauaaa

SEQ ID NO: 3486271 - RNA, 17 nt, Human
aguuagaaucuauuuuc

SEQ ID NO: 3486272 - RNA, 18 nt, Human
aguuagaaucuauuuucu

SEQ ID NO: 3486273 - RNA, 19 nt, Human
aguuagaauuccuucaggg

SEQ ID NO: 3486274 - RNA, 21 nt, Human
aguuagagaacuaaacuaguu

SEQ ID NO: 3486275 - RNA, 14 nt, Human
aguuagagaugccu

SEQ ID NO: 3486276 - RNA, 15 nt, Human
aguuagcaaacuuug

SEQ ID NO: 3486277 - RNA, 11 nt, Human
aguuagcacca

SEQ ID NO: 3486278 - RNA, 16 nt, Human
aguuagccuuuaucua

SEQ ID NO: 3486279 - RNA, 14 nt, Human
aguuagcucaggag

SEQ ID NO: 3486280 - RNA, 18 nt, Human
aguuagcugaagaauuga

SEQ ID NO: 3486281 - RNA, 20 nt, Human
aguuagcuuuaacuuaaaua

SEQ ID NO: 3486282 - RNA, 21 nt, Human
aguuagcuuuaacuuaaauag

SEQ ID NO: 3486283 - RNA, 22 nt, Human
aguuagcuuuaacuuaaauagu

SEQ ID NO: 3486284 - RNA, 12 nt, Human
aguuaggaaaua

SEQ ID NO: 3486285 - RNA, 17 nt, Human
aguuaggaaauaaaacc

SEQ ID NO: 3486286 - RNA, 16 nt, Human
aguuaggaugcucagu

SEQ ID NO: 3486287 - RNA, 16 nt, Human
aguuaggcuuucucuu

SEQ ID NO: 3486288 - RNA, 14 nt, Human
aguuaggggccuua

SEQ ID NO: 3486289 - RNA, 19 nt, Human
aguuagguuuaacauaaag

SEQ ID NO: 3486290 - RNA, 14 nt, Human
aguuaguagcaugu

SEQ ID NO: 3486291 - RNA, 22 nt, Human
aguuagucuacucuuaagccau

SEQ ID NO: 3486292 - RNA, 23 nt, Human
aguuagucuacucuuaagccauc

SEQ ID NO: 3486293 - RNA, 17 nt, Human
aguuaguggauuacugc

SEQ ID NO: 3486294 - RNA, 20 nt, Human
aguuaguggauuacugccau

SEQ ID NO: 3486295 - RNA, 15 nt, Human
aguuauaaaauuaaa

SEQ ID NO: 3486296 - RNA, 18 nt, Human
aguuauacaguuauaaaa

SEQ ID NO: 3486297 - RNA, 15 nt, Human
aguuauagaaagcaa

SEQ ID NO: 3486298 - RNA, 16 nt, Human
aguuauaguuucagau

SEQ ID NO: 3486299 - RNA, 22 nt, Human
aguuauauaaagagaaaauuga

SEQ ID NO: 3486300 - RNA, 14 nt, Human
aguuauauuuugca

SEQ ID NO: 3486301 - RNA, 18 nt, Human
aguuaucaugaauuuuaa

SEQ ID NO: 3486302 - RNA, 18 nt, Human
aguuaucaugcauguuau

SEQ ID NO: 3486303 - RNA, 14 nt, Human
aguuaucauguuag

SEQ ID NO: 3486304 - RNA, 15 nt, Human
aguuaucauguuagu

SEQ ID NO: 3486305 - RNA, 18 nt, Human
aguuaucauguuaguaau

SEQ ID NO: 3486306 - RNA, 17 nt, Human
aguuaucuaaaagaaau

SEQ ID NO: 3486307 - RNA, 22 nt, Human
aguuaucuaaguuaauuuaaag

SEQ ID NO: 3486308 - RNA, 20 nt, Human
aguuaugauuuuuuuuucau

SEQ ID NO: 3486309 - RNA, 21 nt, Human
aguuauggccuauacacuauu

SEQ ID NO: 3486310 - RNA, 19 nt, Human
aguuauggcuauaggugcu

SEQ ID NO: 3486311 - RNA, 23 nt, Human
aguuauggugccgaauugucuuu

SEQ ID NO: 3486312 - RNA, 13 nt, Human
aguuauguaaaua

SEQ ID NO: 3486313 - RNA, 15 nt, Human
aguuaugugaaugau

SEQ ID NO: 3486314 - RNA, 14 nt, Human
aguuauuaaaauug

SEQ ID NO: 3486315 - RNA, 21 nt, Human
aguuauuaagagguaagacuu

SEQ ID NO: 3486316 - RNA, 19 nt, Human
aguuauucacaaaaauuga

SEQ ID NO: 3486317 - RNA, 19 nt, Human
aguuauucauauucuguug

SEQ ID NO: 3486318 - RNA, 19 nt, Human
aguuauugagauuguccuc

SEQ ID NO: 3486319 - RNA, 19 nt, Human
aguuauugauaaguucaua

SEQ ID NO: 3486320 - RNA, 19 nt, Human
aguuauugcaguuuaucau

SEQ ID NO: 3486321 - RNA, 13 nt, Human
aguuauuguacag

SEQ ID NO: 3486322 - RNA, 21 nt, Human
aguuauuuauuuauuggagau

SEQ ID NO: 3486323 - RNA, 18 nt, Human
aguuauuucuuguuuguu

SEQ ID NO: 3486324 - RNA, 19 nt, Human
aguuauuuuaauuaucuuu

SEQ ID NO: 3486325 - RNA, 15 nt, Human
aguucaaagucauga

SEQ ID NO: 3486326 - RNA, 19 nt, Human
aguucaagaaauaaguuuu

SEQ ID NO: 3486327 - RNA, 15 nt, Human
aguucaagaaaugaa

SEQ ID NO: 3486328 - RNA, 16 nt, Human
aguucaagaccagccu

SEQ ID NO: 3486329 - RNA, 19 nt, Human
aguucaagaccagccuggc

SEQ ID NO: 3486330 - RNA, 23 nt, Human
aguucaaggaacuugaaaaauac

SEQ ID NO: 3486331 - RNA, 21 nt, Human
aguucaauaaaugucuguuga

SEQ ID NO: 3486332 - RNA, 24 nt, Human
aguucaaucuggauucauauuuaa

SEQ ID NO: 3486333 - RNA, 11 nt, Human
aguucaaugau

SEQ ID NO: 3486334 - RNA, 12 nt, Human
aguucaaugauc

SEQ ID NO: 3486335 - RNA, 15 nt, Human
aguucaaugaucuag

SEQ ID NO: 3486336 - RNA, 16 nt, Human
aguucaaugaucuagg

SEQ ID NO: 3486337 - RNA, 20 nt, Human
aguucaaugaucuagguuua

SEQ ID NO: 3486338 - RNA, 23 nt, Human
aguucaaugaucuagguuuaacu

SEQ ID NO: 3486339 - RNA, 14 nt, Human
aguucaauggcugc

SEQ ID NO: 3486340 - RNA, 17 nt, Human
aguucaauggcugcuga

SEQ ID NO: 3486341 - RNA, 18 nt, Human
aguucacacccugcaagg

SEQ ID NO: 3486342 - RNA, 18 nt, Human
aguucacauuagaauuag

SEQ ID NO: 3486343 - RNA, 22 nt, Human
aguucacuucaucuucucagcu

SEQ ID NO: 3486344 - RNA, 15 nt, Human
aguucagaauuuagu

SEQ ID NO: 3486345 - RNA, 16 nt, Human
aguucagagcugcccu

SEQ ID NO: 3486346 - RNA, 19 nt, Human
aguucagagcugcccucuc

SEQ ID NO: 3486347 - RNA, 21 nt, Human
auacuacugaaacagauuuca

SEQ ID NO: 3486348 - RNA, 12 nt, Human
auacuacuuaug

SEQ ID NO: 3486349 - RNA, 19 nt, Human
auacuacuuaugaaaugug

SEQ ID NO: 3486350 - RNA, 15 nt, Human
auacuagauuuggga

SEQ ID NO: 3486351 - RNA, 16 nt, Human
auacuagggagccauu

SEQ ID NO: 3486352 - RNA, 13 nt, Human
auacuaguuguga

SEQ ID NO: 3486353 - RNA, 16 nt, Human
auacuaguugugaccu

SEQ ID NO: 3486354 - RNA, 20 nt, Human
auacuaguugugaccuuagu

SEQ ID NO: 3486355 - RNA, 15 nt, Human
auacuauauuuuagg

SEQ ID NO: 3486356 - RNA, 22 nt, Human
auacuauuaaaaagguuuacag

SEQ ID NO: 3486357 - RNA, 17 nt, Human
auacuauuaaacaugcu

SEQ ID NO: 3486358 - RNA, 20 nt, Human
auacuauuaaacaugcugua

SEQ ID NO: 3486359 - RNA, 20 nt, Human
auacuauuuaagaugugaaa

SEQ ID NO: 3486360 - RNA, 20 nt, Human
auacuauuuaguuuuuguaa

SEQ ID NO: 3486361 - RNA, 18 nt, Human
auacuauuuuuacugcca

SEQ ID NO: 3486362 - RNA, 20 nt, Human
auacuauuuuuacugccacu

SEQ ID NO: 3486363 - RNA, 23 nt, Human
auacucaagagugguaucuugca

SEQ ID NO: 3486364 - RNA, 20 nt, Human
auacucagccugcugcccag

SEQ ID NO: 3486365 - RNA, 17 nt, Human
auacucauaaugugaag

SEQ ID NO: 3486366 - RNA, 18 nt, Human
auacucauaaugugaagu

SEQ ID NO: 3486367 - RNA, 14 nt, Human
auacucauguguau

SEQ ID NO: 3486368 - RNA, 14 nt, Human
auacucauuucuaa

SEQ ID NO: 3486369 - RNA, 22 nt, Human
auacuccaaccauauggauauu

SEQ ID NO: 3486370 - RNA, 17 nt, Human
auacuccuaugcuuuag

SEQ ID NO: 3486371 - RNA, 13 nt, Human
auacucuaauucu

SEQ ID NO: 3486372 - RNA, 21 nt, Human
auacucuagauuuuguuuugc

SEQ ID NO: 3486373 - RNA, 16 nt, Human
auacucugcuuagaau

SEQ ID NO: 3486374 - RNA, 12 nt, Human
auacucugucag

SEQ ID NO: 3486375 - RNA, 14 nt, Human
auacucugucagau

SEQ ID NO: 3486376 - RNA, 16 nt, Human
auacucugucagaugg

SEQ ID NO: 3486377 - RNA, 21 nt, Human
auacucuuaggaagagaaacc

SEQ ID NO: 3486378 - RNA, 18 nt, Human
auacucuuauaucuauau

SEQ ID NO: 3486379 - RNA, 22 nt, Human
auacucuuccuauuuuuguagu

SEQ ID NO: 3486380 - RNA, 23 nt, Human
auacucuuucuguauauacuuuu

SEQ ID NO: 3486381 - RNA, 15 nt, Human
auacugaacaucuga

SEQ ID NO: 3486382 - RNA, 20 nt, Human
auacugaacaucugaguccu

SEQ ID NO: 3486383 - RNA, 23 nt, Human
auacugaaccacuuguagauuug

SEQ ID NO: 3486384 - RNA, 13 nt, Human
auacugaagaugc

SEQ ID NO: 3486385 - RNA, 14 nt, Human
auacugaaggaaaa

SEQ ID NO: 3486386 - RNA, 13 nt, Human
auacugauguguu

SEQ ID NO: 3486387 - RNA, 17 nt, Human
auacugauuaugucuuu

SEQ ID NO: 3486388 - RNA, 15 nt, Human
auacugcagggccag

SEQ ID NO: 3486389 - RNA, 17 nt, Human
auacugcagggccagga

SEQ ID NO: 3486390 - RNA, 17 nt, Human
auacugccagaugcuga

SEQ ID NO: 3486391 - RNA, 13 nt, Human
auacugccucccc

SEQ ID NO: 3486392 - RNA, 15 nt, Human
auacugccuccccca

SEQ ID NO: 3486393 - RNA, 15 nt, Human
auacugcuacagcaa

SEQ ID NO: 3486394 - RNA, 19 nt, Human
auacugcuacagcaauuuc

SEQ ID NO: 3486395 - RNA, 15 nt, Human
auacugcuuggagcu

SEQ ID NO: 3486396 - RNA, 14 nt, Human
auacuggaaagcuu

SEQ ID NO: 3486397 - RNA, 16 nt, Human
auacuggaaguuuugc

SEQ ID NO: 3486398 - RNA, 20 nt, Human
auacuggaaguuuugcauuu

SEQ ID NO: 3486399 - RNA, 15 nt, Human
auacuggccuggacu

SEQ ID NO: 3486400 - RNA, 23 nt, Human
auacugggacaccauuaccaaaa

SEQ ID NO: 3486401 - RNA, 16 nt, Human
auacuguaaagaaaga

SEQ ID NO: 3486402 - RNA, 18 nt, Human
auacuguaaagaaagaga

SEQ ID NO: 3486403 - RNA, 19 nt, Human
auacuguaaagaaagagag

SEQ ID NO: 3486404 - RNA, 15 nt, Human
auacuguacaugaaa

SEQ ID NO: 3486405 - RNA, 19 nt, Human
auacuguacaugaaaguag

SEQ ID NO: 3486406 - RNA, 16 nt, Human
auacuguaguauucuu

SEQ ID NO: 3486407 - RNA, 16 nt, Human
auacuguauuaagagu

SEQ ID NO: 3486408 - RNA, 22 nt, Human
auacugugugcuuguuuuauaa

SEQ ID NO: 3486409 - RNA, 14 nt, Human
auacuguguggaac

SEQ ID NO: 3486410 - RNA, 15 nt, Human
auacuguuauucuuu

SEQ ID NO: 3486411 - RNA, 14 nt, Human
agcuguuaaacugu

SEQ ID NO: 3486412 - RNA, 16 nt, Human
agcuguuaaacuguua

SEQ ID NO: 3486413 - RNA, 19 nt, Human
agcuguuaaacuguuagca

SEQ ID NO: 3486414 - RNA, 23 nt, Human
agcuguuaaacuguuagcacugu

SEQ ID NO: 3486415 - RNA, 15 nt, Human
agcuguuaccauuca

SEQ ID NO: 3486416 - RNA, 14 nt, Human
agcuguuacugucu

SEQ ID NO: 3486417 - RNA, 19 nt, Human
agcuguuacugucuucagu

SEQ ID NO: 3486418 - RNA, 16 nt, Human
agcuguucacagccag

SEQ ID NO: 3486419 - RNA, 19 nt, Human
agcuguucacagccagacu

SEQ ID NO: 3486420 - RNA, 19 nt, Human
agcuguuccuguucaguaa

SEQ ID NO: 3486421 - RNA, 17 nt, Human
agcuguucuaauggauu

SEQ ID NO: 3486422 - RNA, 15 nt, Human
agcuguucugucccu

SEQ ID NO: 3486423 - RNA, 20 nt, Human
agcuguucugucccuuggag

SEQ ID NO: 3486424 - RNA, 22 nt, Human
agcuguucugucccuuggagcu

SEQ ID NO: 3486425 - RNA, 15 nt, Human
agcuguucuuccugg

SEQ ID NO: 3486426 - RNA, 13 nt, Human
agcuguugaccag

SEQ ID NO: 3486427 - RNA, 15 nt, Human
agcuguugaccaggc

SEQ ID NO: 3486428 - RNA, 13 nt, Human
agcuguugacucu

SEQ ID NO: 3486429 - RNA, 14 nt, Human
agcuguugagcugu

SEQ ID NO: 3486430 - RNA, 23 nt, Human
agcuguugaugggaugauugaag

SEQ ID NO: 3486431 - RNA, 18 nt, Human
agcuguuguacauuuaug

SEQ ID NO: 3486432 - RNA, 20 nt, Human
agcuguuguacauuuaugau

SEQ ID NO: 3486433 - RNA, 22 nt, Human
agcuguuguacauuuaugauuu

SEQ ID NO: 3486434 - RNA, 21 nt, Human
agcuguugucucuucuccuua

SEQ ID NO: 3486435 - RNA, 13 nt, Human
agcuguuuaugca

SEQ ID NO: 3486436 - RNA, 17 nt, Human
agcuguuuauggccuca

SEQ ID NO: 3486437 - RNA, 19 nt, Human
agcuguuuauggccucagc

SEQ ID NO: 3486438 - RNA, 17 nt, Human
agcuguuuauguuuuua

SEQ ID NO: 3486439 - RNA, 13 nt, Human
agcuguuuggaaa

SEQ ID NO: 3486440 - RNA, 18 nt, Human
agcuguuuuaguuaaauu

SEQ ID NO: 3486441 - RNA, 12 nt, Human
agcuuaaaacuu

SEQ ID NO: 3486442 - RNA, 16 nt, Human
agcuuaaaacuuugaa

SEQ ID NO: 3486443 - RNA, 23 nt, Human
agcuuaaaauaaacaguugugaa

SEQ ID NO: 3486444 - RNA, 13 nt, Human
agcuuaaaauaca

SEQ ID NO: 3486445 - RNA, 15 nt, Human
agcuuaaaauacaag

SEQ ID NO: 3486446 - RNA, 17 nt, Human
agcuuaaaauacaagac

SEQ ID NO: 3486447 - RNA, 20 nt, Human
agcuuaaaauacaagacugc

SEQ ID NO: 3486448 - RNA, 20 nt, Human
agcuuaagaaauuuguggaa

SEQ ID NO: 3486449 - RNA, 16 nt, Human
agcuuaagccacugcc

SEQ ID NO: 3486450 - RNA, 20 nt, Human
agcuuaagccacugccucuc

SEQ ID NO: 3486451 - RNA, 21 nt, Human
agcuuaagccacugccucucc

SEQ ID NO: 3486452 - RNA, 23 nt, Human
agcuuaagccacugccucucccu

SEQ ID NO: 3486453 - RNA, 14 nt, Human
agcuuaaugcuaca

SEQ ID NO: 3486454 - RNA, 22 nt, Human
agcuuaauggcugauaauuuua

SEQ ID NO: 3486455 - RNA, 19 nt, Human
agcuuacaagccagcugga

SEQ ID NO: 3486456 - RNA, 16 nt, Human
agcuuacacaaaucua

SEQ ID NO: 3486457 - RNA, 20 nt, Human
agcuuacacaaaucuauuua

SEQ ID NO: 3486458 - RNA, 15 nt, Human
agcuuaccugacaca

SEQ ID NO: 3486459 - RNA, 17 nt, Human
agcuuaccugacacaag

SEQ ID NO: 3486460 - RNA, 10 nt, Human
agcuuagaac

SEQ ID NO: 3486461 - RNA, 18 nt, Human
agcuuagaauuauuugca

SEQ ID NO: 3486462 - RNA, 15 nt, Human
agcuuagagccuccc

SEQ ID NO: 3486463 - RNA, 22 nt, Human
agcuuagaguuggccauauuua

SEQ ID NO: 3486464 - RNA, 15 nt, Human
agcuuagauuucaua

SEQ ID NO: 3486465 - RNA, 16 nt, Human
agcuuagcaggagagg

SEQ ID NO: 3486466 - RNA, 22 nt, Human
agcuuagcaggagaggagagcc

SEQ ID NO: 3486467 - RNA, 17 nt, Human
agcuuagccaauguggg

SEQ ID NO: 3486468 - RNA, 15 nt, Human
agcuuagggcccugg

SEQ ID NO: 3486469 - RNA, 14 nt, Human
agcuuagggucuca

SEQ ID NO: 3486470 - RNA, 18 nt, Human
agcuuagggucucagggu

SEQ ID NO: 3486471 - RNA, 22 nt, Human
agcuuaucaauuugucauuuug

SEQ ID NO: 3486472 - RNA, 19 nt, Human
agcuuaucaugcugucuuu

SEQ ID NO: 3486473 - RNA, 23 nt, Human
agcuuaucuacuuccaaacuaau

SEQ ID NO: 3486474 - RNA, 12 nt, Human
agcuuaucucag

SEQ ID NO: 3486475 - RNA, 14 nt, Human
agcuuaucucaggg

SEQ ID NO: 3486476 - RNA, 11 nt, Human
agcuuaucucu

SEQ ID NO: 3486477 - RNA, 23 nt, Human
agcuuaucucuuuuauauuugua

SEQ ID NO: 3486478 - RNA, 15 nt, Human
agcuuauuaaaacuc

SEQ ID NO: 3486479 - RNA, 15 nt, Human
agcuuauuaaugcua

SEQ ID NO: 3486480 - RNA, 16 nt, Human
agcuuauuaaugcuaa

SEQ ID NO: 3486481 - RNA, 21 nt, Human
agcuuauuaaugcuaagggca

SEQ ID NO: 3486482 - RNA, 20 nt, Human
agcuuauuuccucauuuuua

SEQ ID NO: 3486483 - RNA, 14 nt, Human
agcuuauuuuuaca

SEQ ID NO: 3486484 - RNA, 22 nt, Human
agcuuauuuuuacaguuauaga

SEQ ID NO: 3486485 - RNA, 17 nt, Human
agcuucaagucugugcc

SEQ ID NO: 3486486 - RNA, 19 nt, Human
agcuucaagucugugccug

SEQ ID NO: 3486487 - RNA, 24 nt, Human
agcuucaagucugugccuggagcu

SEQ ID NO: 3486488 - RNA, 15 nt, Human
agcuucaccagagca

SEQ ID NO: 3486489 - RNA, 21 nt, Human
agcuucaccccaaucccagcu

SEQ ID NO: 3486490 - RNA, 18 nt, Human
agcuucacuguaaaauaa

SEQ ID NO: 3486491 - RNA, 16 nt, Human
agcuucagaaguuugg

SEQ ID NO: 3486492 - RNA, 14 nt, Human
auaacaaagauauc

SEQ ID NO: 3486493 - RNA, 17 nt, Human
auaacaaagauaucuuu

SEQ ID NO: 3486494 - RNA, 15 nt, Human
auaacaaccuggaga

SEQ ID NO: 3486495 - RNA, 16 nt, Human
auaacaagaucuuuca

SEQ ID NO: 3486496 - RNA, 21 nt, Human
auaacaagguccaagauaccu

SEQ ID NO: 3486497 - RNA, 15 nt, Human
auaacaaugcuguau

SEQ ID NO: 3486498 - RNA, 22 nt, Human
auaacaauguuaaggaaacucu

SEQ ID NO: 3486499 - RNA, 15 nt, Human
auaacaauuccucua

SEQ ID NO: 3486500 - RNA, 23 nt, Human
auaacacacagcuaacacacagc

SEQ ID NO: 3486501 - RNA, 12 nt, Human
auaacacauuuu

SEQ ID NO: 3486502 - RNA, 23 nt, Human
auaacacuauaaagguugacaau

SEQ ID NO: 3486503 - RNA, 17 nt, Human
auaacacugugaagagc

SEQ ID NO: 3486504 - RNA, 16 nt, Human
auaacagaaugcacca

SEQ ID NO: 3486505 - RNA, 15 nt, Human
auaacagauuucuca

SEQ ID NO: 3486506 - RNA, 20 nt, Human
auaacagggauugauuuuaa

SEQ ID NO: 3486507 - RNA, 21 nt, Human
auaacagggauugauuuuaaa

SEQ ID NO: 3486508 - RNA, 22 nt, Human
auaacagggauugauuuuaaaa

SEQ ID NO: 3486509 - RNA, 18 nt, Human
auaacagguuauuuuagu

SEQ ID NO: 3486510 - RNA, 16 nt, Human
auaacaguaaaugugc

SEQ ID NO: 3486511 - RNA, 19 nt, Human
auaacagucuuacugcagg

SEQ ID NO: 3486512 - RNA, 20 nt, Human
auaacagugcauauuccuuu

SEQ ID NO: 3486513 - RNA, 14 nt, Human
auaacagugccauu

SEQ ID NO: 3486514 - RNA, 23 nt, Human
auaacagugccauugucuuuaua

SEQ ID NO: 3486515 - RNA, 14 nt, Human
auaacauaaaucug

SEQ ID NO: 3486516 - RNA, 15 nt, Human
auaacauaaaucugu

SEQ ID NO: 3486517 - RNA, 18 nt, Human
auaacauaaaucugugaa

SEQ ID NO: 3486518 - RNA, 18 nt, Human
auaacaucuuuauugaaa

SEQ ID NO: 3486519 - RNA, 16 nt, Human
auaacaugaaaugaua

SEQ ID NO: 3486520 - RNA, 12 nt, Human
auaacauguaau

SEQ ID NO: 3486521 - RNA, 18 nt, Human
auaacauguaauuaagua

SEQ ID NO: 3486522 - RNA, 20 nt, Human
auaaccaaagcccaaagugg

SEQ ID NO: 3486523 - RNA, 12 nt, Human
auaaccacugcu

SEQ ID NO: 3486524 - RNA, 12 nt, Human
auaaccccaccc

SEQ ID NO: 3486525 - RNA, 15 nt, Human
auaacccuaacacac

SEQ ID NO: 3486526 - RNA, 23 nt, Human
auaaccguuuccuuucauuuacu

SEQ ID NO: 3486527 - RNA, 15 nt, Human
auaaccuaguuaaag

SEQ ID NO: 3486528 - RNA, 17 nt, Human
auaaccuaguuaaagaa

SEQ ID NO: 3486529 - RNA, 20 nt, Human
auaaccuaguuaaagaaagg

SEQ ID NO: 3486530 - RNA, 17 nt, Human
auaacgaaguugggcaa

SEQ ID NO: 3486531 - RNA, 21 nt, Human
auaacggaucagaaauacaga

SEQ ID NO: 3486532 - RNA, 18 nt, Human
auaacguuuaagccaaaa

SEQ ID NO: 3486533 - RNA, 17 nt, Human
auaacguuuuuccuuua

SEQ ID NO: 3486534 - RNA, 15 nt, Human
auaacuaaaauguau

SEQ ID NO: 3486535 - RNA, 15 nt, Human
auaacuaaauuugau

SEQ ID NO: 3486536 - RNA, 16 nt, Human
auaacuaaauuugaua

SEQ ID NO: 3486537 - RNA, 21 nt, Human
auaacuaacaaccaaagacua

SEQ ID NO: 3486538 - RNA, 19 nt, Human
auaacuacuccggagacag

SEQ ID NO: 3486539 - RNA, 13 nt, Human
auaacuacugugu

SEQ ID NO: 3486540 - RNA, 18 nt, Human
auaacuacuguguuccug

SEQ ID NO: 3486541 - RNA, 19 nt, Human
auaacuagaacugaauuuu

SEQ ID NO: 3486542 - RNA, 14 nt, Human
auaacuauucaguu

SEQ ID NO: 3486543 - RNA, 16 nt, Human
auaacucaucauaaaa

SEQ ID NO: 3486544 - RNA, 17 nt, Human
auaacuccucauuguaa

SEQ ID NO: 3486545 - RNA, 22 nt, Human
auaacuccucccaggguuuuaa

SEQ ID NO: 3486546 - RNA, 21 nt, Human
auaacucuguaaaaacacuga

SEQ ID NO: 3486547 - RNA, 13 nt, Human
auaacugaaaaug

SEQ ID NO: 3486548 - RNA, 17 nt, Human
auaacugaaaauuauuu

SEQ ID NO: 3486549 - RNA, 14 nt, Human
auaacugaacaucc

SEQ ID NO: 3486550 - RNA, 16 nt, Human
auaacugaaggagaag

SEQ ID NO: 3486551 - RNA, 16 nt, Human
auaacugacaaaucaa

SEQ ID NO: 3486552 - RNA, 17 nt, Human
auaacugacaaaucaag

SEQ ID NO: 3486553 - RNA, 21 nt, Human
auaacugacaaaucaaguuuc

SEQ ID NO: 3486554 - RNA, 20 nt, Human
auaacugcaaagugaaguug

SEQ ID NO: 3486555 - RNA, 22 nt, Human
auaacuggaaaacagaacacuu

SEQ ID NO: 3486556 - RNA, 15 nt, Human
auaacuggaaagaag

SEQ ID NO: 3486557 - RNA, 13 nt, Human
auaacugugaagu

SEQ ID NO: 3486558 - RNA, 15 nt, Human
auaacuguguacugu

SEQ ID NO: 3486559 - RNA, 16 nt, Human
auaacuguguacuguu

SEQ ID NO: 3486560 - RNA, 12 nt, Human
auaacuuaaaaa

SEQ ID NO: 3486561 - RNA, 16 nt, Human
auaacuuaaaaaaaug

SEQ ID NO: 3486562 - RNA, 21 nt, Human
auaacuuaaaaauguaaauau

SEQ ID NO: 3486563 - RNA, 16 nt, Human
auaacuuaaugaaaac

SEQ ID NO: 3486564 - RNA, 23 nt, Human
auaacuuaaugaaaacaaugcag

SEQ ID NO: 3486565 - RNA, 13 nt, Human
auaacuucaaauu

SEQ ID NO: 3486566 - RNA, 18 nt, Human
auaacuuccacagggucc

SEQ ID NO: 3486567 - RNA, 12 nt, Human
auaacuuccugu

SEQ ID NO: 3486568 - RNA, 19 nt, Human
auaacuugagaccuaaucu

SEQ ID NO: 3486569 - RNA, 21 nt, Human
auaacuuugcuugcaguagau

SEQ ID NO: 3486570 - RNA, 18 nt, Human
auaacuuuuacacgacca

SEQ ID NO: 3486571 - RNA, 18 nt, Human
auaacuuuuuauauucuc

SEQ ID NO: 3486572 - RNA, 23 nt, Human
auaacuuuuuuuuuucuuuauaa

SEQ ID NO: 3486573 - RNA, 15 nt, Human
auaagaaaaacuuuu

SEQ ID NO: 3486574 - RNA, 15 nt, Human
auaagaaaaaucaug

SEQ ID NO: 3486575 - RNA, 22 nt, Human
auaagaaaaccaccccuuagau

SEQ ID NO: 3486576 - RNA, 18 nt, Human
agcuugggagagccccug

SEQ ID NO: 3486577 - RNA, 22 nt, Human
agcuugggagagccccuggggc

SEQ ID NO: 3486578 - RNA, 10 nt, Human
agcuugggcc

SEQ ID NO: 3486579 - RNA, 18 nt, Human
agcuugggcccagcuggg

SEQ ID NO: 3486580 - RNA, 21 nt, Human
agcuugggcccagcugggcuc

SEQ ID NO: 3486581 - RNA, 14 nt, Human
agcuuggggaagac

SEQ ID NO: 3486582 - RNA, 20 nt, Human
agcuuggggccaccaaagcu

SEQ ID NO: 3486583 - RNA, 14 nt, Human
agcuuggggccagg

SEQ ID NO: 3486584 - RNA, 21 nt, Human
agcuugggggaugacuagagg

SEQ ID NO: 3486585 - RNA, 20 nt, Human
agcuuguaaauagcucaggu

SEQ ID NO: 3486586 - RNA, 14 nt, Human
agcuuguagccagc

SEQ ID NO: 3486587 - RNA, 15 nt, Human
agcuuguagccagcc

SEQ ID NO: 3486588 - RNA, 17 nt, Human
agcuuguaggagcugag

SEQ ID NO: 3486589 - RNA, 22 nt, Human
agcuuguauuuugugaagacug

SEQ ID NO: 3486590 - RNA, 18 nt, Human
agcuuguggcaagugaau

SEQ ID NO: 3486591 - RNA, 12 nt, Human
agcuuguguauc

SEQ ID NO: 3486592 - RNA, 17 nt, Human
agcuuguucccugucuu

SEQ ID NO: 3486593 - RNA, 18 nt, Human
agcuuguuuacaugcuua

SEQ ID NO: 3486594 - RNA, 19 nt, Human
agcuuuaaacucagggaca

SEQ ID NO: 3486595 - RNA, 20 nt, Human
agcuuuaaacucagggacag

SEQ ID NO: 3486596 - RNA, 21 nt, Human
agcuuuaaacucagggacaga

SEQ ID NO: 3486597 - RNA, 20 nt, Human
agcuuuaaccauuaaaacug

SEQ ID NO: 3486598 - RNA, 13 nt, Human
agcuuuacacaca

SEQ ID NO: 3486599 - RNA, 14 nt, Human
agcuuuaccagcug

SEQ ID NO: 3486600 - RNA, 15 nt, Human
agcuuuacuguuugu

SEQ ID NO: 3486601 - RNA, 19 nt, Human
agcuuuagacccugggugg

SEQ ID NO: 3486602 - RNA, 18 nt, Human
agcuuuauacguguagcu

SEQ ID NO: 3486603 - RNA, 23 nt, Human
agcuuuaucaccagagagggacu

SEQ ID NO: 3486604 - RNA, 10 nt, Human
agcuuuauga

SEQ ID NO: 3486605 - RNA, 15 nt, Human
agcuuuaugauuuuc

SEQ ID NO: 3486606 - RNA, 17 nt, Human
agcuuuaugauuuucau

SEQ ID NO: 3486607 - RNA, 23 nt, Human
agcuuuaugauuuucauaacuua

SEQ ID NO: 3486608 - RNA, 14 nt, Human
agcuuuauucuuca

SEQ ID NO: 3486609 - RNA, 21 nt, Human
agcuuuauuuugagauguaaa

SEQ ID NO: 3486610 - RNA, 16 nt, Human
agcuuucaagugccuu

SEQ ID NO: 3486611 - RNA, 17 nt, Human
agcuuucagaauauguc

SEQ ID NO: 3486612 - RNA, 22 nt, Human
agcuuucauguaaacugugcac

SEQ ID NO: 3486613 - RNA, 16 nt, Human
agcuuuccauguugcu

SEQ ID NO: 3486614 - RNA, 21 nt, Human
agcuuucccaaauaaacucua

SEQ ID NO: 3486615 - RNA, 16 nt, Human
agcuuucccugccucu

SEQ ID NO: 3486616 - RNA, 12 nt, Human
agcuuuccugcc

SEQ ID NO: 3486617 - RNA, 20 nt, Human
agcuuuccugccccaggccu

SEQ ID NO: 3486618 - RNA, 21 nt, Human
agcuuuccugccccaggccug

SEQ ID NO: 3486619 - RNA, 22 nt, Human
agcuuucuagaaguuucccuuc

SEQ ID NO: 3486620 - RNA, 15 nt, Human
agcuuucucugcuuc

SEQ ID NO: 3486621 - RNA, 16 nt, Human
agcuuucucugcuuca

SEQ ID NO: 3486622 - RNA, 18 nt, Human
agcuuucucugcuucagc

SEQ ID NO: 3486623 - RNA, 12 nt, Human
agcuuucugaac

SEQ ID NO: 3486624 - RNA, 21 nt, Human
agcuuucugaacagcuggugu

SEQ ID NO: 3486625 - RNA, 14 nt, Human
agcuuucugagcaa

SEQ ID NO: 3486626 - RNA, 20 nt, Human
agcuuucuguccuuuuggca

SEQ ID NO: 3486627 - RNA, 16 nt, Human
agcuuucuugcucccu

SEQ ID NO: 3486628 - RNA, 12 nt, Human
agcuuucuuuuu

SEQ ID NO: 3486629 - RNA, 22 nt, Human
agcuuugaaggccgaaggcagu

SEQ ID NO: 3486630 - RNA, 22 nt, Human
agcuuugacacuggaaugaguu

SEQ ID NO: 3486631 - RNA, 15 nt, Human
agcuuugacucagga

SEQ ID NO: 3486632 - RNA, 19 nt, Human
agcuuugacucuauaagca

SEQ ID NO: 3486633 - RNA, 19 nt, Human
agcuuugauuuagauugag

SEQ ID NO: 3486634 - RNA, 16 nt, Human
agcuuugccagcugcu

SEQ ID NO: 3486635 - RNA, 15 nt, Human
agcuuugcccaacac

SEQ ID NO: 3486636 - RNA, 10 nt, Human
agcuuugcua

SEQ ID NO: 3486637 - RNA, 16 nt, Human
agcucucugcccugug

SEQ ID NO: 3486638 - RNA, 17 nt, Human
agcucucugcccugugu

SEQ ID NO: 3486639 - RNA, 19 nt, Human
agcucucugcccuguguac

SEQ ID NO: 3486640 - RNA, 12 nt, Human
agcucucuguau

SEQ ID NO: 3486641 - RNA, 21 nt, Human
agcucucuguauaaacauuaa

SEQ ID NO: 3486642 - RNA, 13 nt, Human
agcucugaaaucu

SEQ ID NO: 3486643 - RNA, 20 nt, Human
agcucugacauucugauucg

SEQ ID NO: 3486644 - RNA, 22 nt, Human
agcucugaccacuugaggccug

SEQ ID NO: 3486645 - RNA, 15 nt, Human
agcucugagaggccc

SEQ ID NO: 3486646 - RNA, 15 nt, Human
agcucugagcuguca

SEQ ID NO: 3486647 - RNA, 15 nt, Human
agcucugagggaaag

SEQ ID NO: 3486648 - RNA, 16 nt, Human
agcucugcagcccagg

SEQ ID NO: 3486649 - RNA, 12 nt, Human
agcucugcaggc

SEQ ID NO: 3486650 - RNA, 23 nt, Human
agcucugcaggcuuaauaaaaau

SEQ ID NO: 3486651 - RNA, 16 nt, Human
agcucugcaucuccug

SEQ ID NO: 3486652 - RNA, 12 nt, Human
agcucugcauua

SEQ ID NO: 3486653 - RNA, 17 nt, Human
agcucugccgcaauggc

SEQ ID NO: 3486654 - RNA, 23 nt, Human
agcucugcgucgguccuggugcc

SEQ ID NO: 3486655 - RNA, 23 nt, Human
agcucugcuauuaggccagcaag

SEQ ID NO: 3486656 - RNA, 22 nt, Human
agcucugcuccucuccccagca

SEQ ID NO: 3486657 - RNA, 18 nt, Human
agcucuggacagccccac

SEQ ID NO: 3486658 - RNA, 21 nt, Human
agcucuggacagccccacccu

SEQ ID NO: 3486659 - RNA, 19 nt, Human
agcucuggagccaccuguc

SEQ ID NO: 3486660 - RNA, 16 nt, Human
agcucuggaggggagg

SEQ ID NO: 3486661 - RNA, 19 nt, Human
agcucuggaggggaggggg

SEQ ID NO: 3486662 - RNA, 22 nt, Human
agcucuggccacaacagggcau

SEQ ID NO: 3486663 - RNA, 12 nt, Human
agcucuggcuga

SEQ ID NO: 3486664 - RNA, 17 nt, Human
agcucuggcugaacccu

SEQ ID NO: 3486665 - RNA, 20 nt, Human
agcucuggcugaacccugug

SEQ ID NO: 3486666 - RNA, 22 nt, Human
agcucuggcugaacccugugcu

SEQ ID NO: 3486667 - RNA, 23 nt, Human
agcucuggcugaacccugugcug

SEQ ID NO: 3486668 - RNA, 15 nt, Human
agcucugggagagga

SEQ ID NO: 3486669 - RNA, 14 nt, Human
agcucugggguggg

SEQ ID NO: 3486670 - RNA, 21 nt, Human
agcucuggggugggcaguuuu

SEQ ID NO: 3486671 - RNA, 19 nt, Human
agcucuggugacaccagcc

SEQ ID NO: 3486672 - RNA, 20 nt, Human
agcucuggugacaccagccu

SEQ ID NO: 3486673 - RNA, 23 nt, Human
agcucuggugagucuuggcggca

SEQ ID NO: 3486674 - RNA, 12 nt, Human
agcucuguccug

SEQ ID NO: 3486675 - RNA, 16 nt, Human
agcucuguggccacau

SEQ ID NO: 3486676 - RNA, 18 nt, Human
agcucuguguugccaugu

SEQ ID NO: 3486677 - RNA, 23 nt, Human
agcucuguguugccaugugugcu

SEQ ID NO: 3486678 - RNA, 21 nt, Human
agcucuguucuuccucagcca

SEQ ID NO: 3486679 - RNA, 21 nt, Human
agcucuguugcaauuaggauu

SEQ ID NO: 3486680 - RNA, 17 nt, Human
agcucuuacucuuuccu

SEQ ID NO: 3486681 - RNA, 19 nt, Human
agcucuuacucuuuccuau

SEQ ID NO: 3486682 - RNA, 23 nt, Human
agcucuucaucugcccaacugug

SEQ ID NO: 3486683 - RNA, 20 nt, Human
agcucuuccuggacaggcca

SEQ ID NO: 3486684 - RNA, 22 nt, Human
agcucuuccuuacucccaggca

SEQ ID NO: 3486685 - RNA, 16 nt, Human
agcucuucuccaggcu

SEQ ID NO: 3486686 - RNA, 17 nt, Human
agcucuucuccaggcug

SEQ ID NO: 3486687 - RNA, 18 nt, Human
agcucuucuccaggcugu

SEQ ID NO: 3486688 - RNA, 21 nt, Human
agcucuucugccggcccuggg

SEQ ID NO: 3486689 - RNA, 22 nt, Human
agcucuucugccggcccugggg

SEQ ID NO: 3486690 - RNA, 19 nt, Human
agcucuugaagacacugaa

SEQ ID NO: 3486691 - RNA, 12 nt, Human
agcucuugcccu

SEQ ID NO: 3486692 - RNA, 15 nt, Human
agcucuugcccuucc

SEQ ID NO: 3486693 - RNA, 21 nt, Human
agcucuugcccuucccugucc

SEQ ID NO: 3486694 - RNA, 21 nt, Human
agcucuugcuaaucagugucu

SEQ ID NO: 3486695 - RNA, 23 nt, Human
agcucuuguccucaguccauuua

SEQ ID NO: 3486696 - RNA, 16 nt, Human
agcucuugugaggaaa

SEQ ID NO: 3486697 - RNA, 12 nt, Human
agcucuuuccuc

SEQ ID NO: 3486698 - RNA, 15 nt, Human
agcucuuuccuccuu

SEQ ID NO: 3486699 - RNA, 18 nt, Human
agcucuuuuuuguuuguu

SEQ ID NO: 3486700 - RNA, 22 nt, Human
agcugaaaaaucacauccuggc

SEQ ID NO: 3486701 - RNA, 12 nt, Human
agcugaaauacu

SEQ ID NO: 3486702 - RNA, 18 nt, Human
agcugaaaugcugcauuu

SEQ ID NO: 3486703 - RNA, 17 nt, Human
agcugaaauuuuagaaa

SEQ ID NO: 3486704 - RNA, 22 nt, Human
agcugaacagaugaccccugcc

SEQ ID NO: 3486705 - RNA, 15 nt, Human
agcugaaccugggua

SEQ ID NO: 3486706 - RNA, 23 nt, Human
agcugaagagugaggauaugagu

SEQ ID NO: 3486707 - RNA, 14 nt, Human
agcugaagccgcca

SEQ ID NO: 3486708 - RNA, 23 nt, Human
agcugaagguuguggccuuugcg

SEQ ID NO: 3486709 - RNA, 17 nt, Human
agcugaagugcauccaa

SEQ ID NO: 3486710 - RNA, 13 nt, Human
agcugaaguuacu

SEQ ID NO: 3486711 - RNA, 18 nt, Human
agcugaauacauucugcu

SEQ ID NO: 3486712 - RNA, 20 nt, Human
agcugaaugccuccuguggg

SEQ ID NO: 3486713 - RNA, 21 nt, Human
agcugaaugccuccugugggg

SEQ ID NO: 3486714 - RNA, 16 nt, Human
agcugacaaaauacuu

SEQ ID NO: 3486715 - RNA, 21 nt, Human
agcugacaguccucuccaccu

SEQ ID NO: 3486716 - RNA, 16 nt, Human
agcugaccacaggcag

SEQ ID NO: 3486717 - RNA, 17 nt, Human
agcugaccacaggcagu

SEQ ID NO: 3486718 - RNA, 21 nt, Human
agcugaccucuguuguccucc

SEQ ID NO: 3486719 - RNA, 19 nt, Human
agcugacgaacuuccaugg

SEQ ID NO: 3486720 - RNA, 16 nt, Human
agcugacgaggcuggg

SEQ ID NO: 3486721 - RNA, 17 nt, Human
agcugacuuggcuggug

SEQ ID NO: 3486722 - RNA, 18 nt, Human
agcugacuuggcuggugu

SEQ ID NO: 3486723 - RNA, 22 nt, Human
agcugacuuggcugguguggua

SEQ ID NO: 3486724 - RNA, 19 nt, Human
agcugacuuucaaagugga

SEQ ID NO: 3486725 - RNA, 19 nt, Human
agcugagaacuccugacug

SEQ ID NO: 3486726 - RNA, 14 nt, Human
agcugagaauagaa

SEQ ID NO: 3486727 - RNA, 15 nt, Human
agcugagaauagaag

SEQ ID NO: 3486728 - RNA, 19 nt, Human
agcugagacuacaagugug

SEQ ID NO: 3486729 - RNA, 16 nt, Human
agcugagagaaaauaa

SEQ ID NO: 3486730 - RNA, 14 nt, Human
agcugagagacuuu

SEQ ID NO: 3486731 - RNA, 23 nt, Human
agcugagauuauaggcaccuacc

SEQ ID NO: 3486732 - RNA, 16 nt, Human
agcugagcaaaucacc

SEQ ID NO: 3486733 - RNA, 13 nt, Human
agcugagcaggga

SEQ ID NO: 3486734 - RNA, 15 nt, Human
agcugagcagggaga

SEQ ID NO: 3486735 - RNA, 18 nt, Human
agcuucccucccugcugu

SEQ ID NO: 3486736 - RNA, 15 nt, Human
agcuuccugucaaca

SEQ ID NO: 3486737 - RNA, 21 nt, Human
agcuuccuguccccaucuguc

SEQ ID NO: 3486738 - RNA, 19 nt, Human
agcuuccuucugugaaagu

SEQ ID NO: 3486739 - RNA, 15 nt, Human
agcuuccuuggcuuu

SEQ ID NO: 3486740 - RNA, 18 nt, Human
agcuucuaauaaauuaua

SEQ ID NO: 3486741 - RNA, 18 nt, Human
agcuucuaccaugaacag

SEQ ID NO: 3486742 - RNA, 18 nt, Human
agcuucuaucccaggagg

SEQ ID NO: 3486743 - RNA, 12 nt, Human
agcuucuccagg

SEQ ID NO: 3486744 - RNA, 12 nt, Human
agcuucuccugu

SEQ ID NO: 3486745 - RNA, 19 nt, Human
agcuucucuuuaacucagg

SEQ ID NO: 3486746 - RNA, 22 nt, Human
agcuucucuuuaacucaggacu

SEQ ID NO: 3486747 - RNA, 16 nt, Human
agcuucugaccucagc

SEQ ID NO: 3486748 - RNA, 12 nt, Human
agcuucugagac

SEQ ID NO: 3486749 - RNA, 18 nt, Human
agcuucugaggcgcugcu

SEQ ID NO: 3486750 - RNA, 15 nt, Human
agcuucugcccccug

SEQ ID NO: 3486751 - RNA, 14 nt, Human
agcuucugcugggc

SEQ ID NO: 3486752 - RNA, 17 nt, Human
agcuucugcugggcugg

SEQ ID NO: 3486753 - RNA, 17 nt, Human
agcuucugguacucucc

SEQ ID NO: 3486754 - RNA, 20 nt, Human
agcuucugguacucuccuag

SEQ ID NO: 3486755 - RNA, 13 nt, Human
agcuucugucucc

SEQ ID NO: 3486756 - RNA, 16 nt, Human
agcuucuuaaaugaga

SEQ ID NO: 3486757 - RNA, 22 nt, Human
agcuucuuaauauaacugccuu

SEQ ID NO: 3486758 - RNA, 18 nt, Human
agcuucuuaauuaauuug

SEQ ID NO: 3486759 - RNA, 20 nt, Human
agcuucuuccaggugcccag

SEQ ID NO: 3486760 - RNA, 22 nt, Human
agcuucuuccaggugcccagcu

SEQ ID NO: 3486761 - RNA, 17 nt, Human
agcuucuuguuuccuug

SEQ ID NO: 3486762 - RNA, 16 nt, Human
agcuugaaaguuuuca

SEQ ID NO: 3486763 - RNA, 20 nt, Human
agcuugaccgugaggccaga

SEQ ID NO: 3486764 - RNA, 23 nt, Human
agcuugaccgugaggccagagac

SEQ ID NO: 3486765 - RNA, 16 nt, Human
agcuugaccugaggcu

SEQ ID NO: 3486766 - RNA, 15 nt, Human
agcuugacucccaag

SEQ ID NO: 3486767 - RNA, 13 nt, Human
agcuugagccuga

SEQ ID NO: 3486768 - RNA, 18 nt, Human
agcuugauaaagggccaa

SEQ ID NO: 3486769 - RNA, 15 nt, Human
agcuugcacauuugg

SEQ ID NO: 3486770 - RNA, 15 nt, Human
agcuugccagaugcu

SEQ ID NO: 3486771 - RNA, 14 nt, Human
agcuugccccggcc

SEQ ID NO: 3486772 - RNA, 16 nt, Human
agcuugcccuguuaaa

SEQ ID NO: 3486773 - RNA, 19 nt, Human
agcuugcccuguuaaaaga

SEQ ID NO: 3486774 - RNA, 23 nt, Human
agcuugcguuagaaugaggagga

SEQ ID NO: 3486775 - RNA, 16 nt, Human
agcuugcucccugugu

SEQ ID NO: 3486776 - RNA, 20 nt, Human
agcuugcugcccuaggcucc

SEQ ID NO: 3486777 - RNA, 19 nt, Human
agcuugcuucauugggcug

SEQ ID NO: 3486778 - RNA, 16 nt, Human
agcuuggaagagccug

SEQ ID NO: 3486779 - RNA, 17 nt, Human
agcuuggaagagccugc

SEQ ID NO: 3486780 - RNA, 16 nt, Human
agcuuggauuaaauac

SEQ ID NO: 3486781 - RNA, 18 nt, Human
agaauuauuuuuaaaaag

SEQ ID NO: 3486782 - RNA, 17 nt, Human
agaauucaaauuuuauc

SEQ ID NO: 3486783 - RNA, 13 nt, Human
agaauucagcugc

SEQ ID NO: 3486784 - RNA, 16 nt, Human
agaauucagcugcccc

SEQ ID NO: 3486785 - RNA, 17 nt, Human
agaauucagcugccccc

SEQ ID NO: 3486786 - RNA, 15 nt, Human
agaauuccaaagcaa

SEQ ID NO: 3486787 - RNA, 13 nt, Human
agaauuccaagga

SEQ ID NO: 3486788 - RNA, 14 nt, Human
agaauuccaaggag

SEQ ID NO: 3486789 - RNA, 20 nt, Human
agaauuccaaggaguuccau

SEQ ID NO: 3486790 - RNA, 22 nt, Human
agaauucccucucucugacucu

SEQ ID NO: 3486791 - RNA, 19 nt, Human
agaauuccuacaauauaua

SEQ ID NO: 3486792 - RNA, 18 nt, Human
agaauucuagugcugcug

SEQ ID NO: 3486793 - RNA, 19 nt, Human
agaauucucuaguuugauu

SEQ ID NO: 3486794 - RNA, 15 nt, Human
agaauucugauugau

SEQ ID NO: 3486795 - RNA, 15 nt, Human
agaauugaaacacuu

SEQ ID NO: 3486796 - RNA, 16 nt, Human
agaauugaagguuuuu

SEQ ID NO: 3486797 - RNA, 18 nt, Human
agaauugaagguuuuuga

SEQ ID NO: 3486798 - RNA, 16 nt, Human
agaauugacauugaaa

SEQ ID NO: 3486799 - RNA, 17 nt, Human
agaauugacauugaaau

SEQ ID NO: 3486800 - RNA, 21 nt, Human
agaauugaccaucugcuuuua

SEQ ID NO: 3486801 - RNA, 20 nt, Human
agaauugauauacacggaug

SEQ ID NO: 3486802 - RNA, 21 nt, Human
agaauugaucauuuucccccc

SEQ ID NO: 3486803 - RNA, 22 nt, Human
agaauugauugggcacaucauu

SEQ ID NO: 3486804 - RNA, 21 nt, Human
agaauuggagaguaaaaacug

SEQ ID NO: 3486805 - RNA, 21 nt, Human
agaauuggcugaacucaugag

SEQ ID NO: 3486806 - RNA, 18 nt, Human
agaauugugcaaauggaa

SEQ ID NO: 3486807 - RNA, 23 nt, Human
agaauugugcaaauggaagacaa

SEQ ID NO: 3486808 - RNA, 15 nt, Human
agaauugugucugca

SEQ ID NO: 3486809 - RNA, 18 nt, Human
agaauugugucugcagga

SEQ ID NO: 3486810 - RNA, 16 nt, Human
agaauuguugagauac

SEQ ID NO: 3486811 - RNA, 21 nt, Human
agaauuguuggggguuuuuuu

SEQ ID NO: 3486812 - RNA, 21 nt, Human
agaauuuaucacacuucugug

SEQ ID NO: 3486813 - RNA, 14 nt, Human
agaauuuauucaau

SEQ ID NO: 3486814 - RNA, 14 nt, Human
agaauuucaauuug

SEQ ID NO: 3486815 - RNA, 22 nt, Human
agaauuucuaaaaagauuagca

SEQ ID NO: 3486816 - RNA, 23 nt, Human
agaauuucuaaaaagauuagcaa

SEQ ID NO: 3486817 - RNA, 16 nt, Human
agaauuucuaccauuu

SEQ ID NO: 3486818 - RNA, 21 nt, Human
agaauuucuaggacugaauua

SEQ ID NO: 3486819 - RNA, 13 nt, Human
agaauuucuuuau

SEQ ID NO: 3486820 - RNA, 18 nt, Human
agaauuugagugcucuga

SEQ ID NO: 3486821 - RNA, 17 nt, Human
agaauuugauaugugaa

SEQ ID NO: 3486822 - RNA, 20 nt, Human
agaauuugauaugugaacag

SEQ ID NO: 3486823 - RNA, 21 nt, Human
agaauuugauaugugaacagu

SEQ ID NO: 3486824 - RNA, 22 nt, Human
agaauuugauaugugaacaguu

SEQ ID NO: 3486825 - RNA, 19 nt, Human
agaauuuguguugaaggaa

SEQ ID NO: 3486826 - RNA, 23 nt, Human
agaauuuguguugaaggaacuug

SEQ ID NO: 3486827 - RNA, 12 nt, Human
agaauuuuaaaa

SEQ ID NO: 3486828 - RNA, 14 nt, Human
agaauuuuaaaaau

SEQ ID NO: 3486829 - RNA, 16 nt, Human
agaauuuuaaaaauga

SEQ ID NO: 3486830 - RNA, 16 nt, Human
agaauuuuaagugcuu

SEQ ID NO: 3486831 - RNA, 21 nt, Human
agaauuuucagaccccagcgg

SEQ ID NO: 3486832 - RNA, 14 nt, Human
agaauuuuuaaugu

SEQ ID NO: 3486833 - RNA, 14 nt, Human
agaauuuuuuauuu

SEQ ID NO: 3486834 - RNA, 19 nt, Human
agacaaaaaacuauaugua

SEQ ID NO: 3486835 - RNA, 14 nt, Human
agacaaaaaguaua

SEQ ID NO: 3486836 - RNA, 12 nt, Human
agacaaaaauua

SEQ ID NO: 3486837 - RNA, 14 nt, Human
agacaaaaauuauc

SEQ ID NO: 3486838 - RNA, 24 nt, Human
agacaaaaucucuauacugcccug

SEQ ID NO: 3486839 - RNA, 13 nt, Human
agacaaaauuuua

SEQ ID NO: 3486840 - RNA, 20 nt, Human
agacaaaauuuuaguccaaa

SEQ ID NO: 3486841 - RNA, 15 nt, Human
agacaaacuuugcau

SEQ ID NO: 3486842 - RNA, 17 nt, Human
agacaaauacucaugug

SEQ ID NO: 3486843 - RNA, 18 nt, Human
agacaaauacucaugugu

SEQ ID NO: 3486844 - RNA, 17 nt, Human
agacaaauaguaggcaa

SEQ ID NO: 3486845 - RNA, 12 nt, Human
agacaaauauuc

SEQ ID NO: 3486846 - RNA, 12 nt, Human
agacaaauauuu

SEQ ID NO: 3486847 - RNA, 18 nt, Human
agacaaauucauauucuu

SEQ ID NO: 3486848 - RNA, 17 nt, Human
agacaaauucuguuucu

SEQ ID NO: 3486849 - RNA, 18 nt, Human
agacaaauucuguuucuu

SEQ ID NO: 3486850 - RNA, 21 nt, Human
agacaaauucuguuucuugag

SEQ ID NO: 3486851 - RNA, 13 nt, Human
agacaacagaagu

SEQ ID NO: 3486852 - RNA, 15 nt, Human
agacaacagaaguca

SEQ ID NO: 3486853 - RNA, 19 nt, Human
agacaacagguaaaacagg

SEQ ID NO: 3486854 - RNA, 15 nt, Human
agacaaccaaguaug

SEQ ID NO: 3486855 - RNA, 14 nt, Human
agacaacccugcaa

SEQ ID NO: 3486856 - RNA, 20 nt, Human
agacaacccugcaaaggacu

SEQ ID NO: 3486857 - RNA, 17 nt, Human
agacaagaaaucccugu

SEQ ID NO: 3486858 - RNA, 17 nt, Human
agacaagauauuguaca

SEQ ID NO: 3486859 - RNA, 20 nt, Human
agacaagauauuguacauaa

SEQ ID NO: 3486860 - RNA, 23 nt, Human
agacaagauuuuuuaauuguuua

SEQ ID NO: 3486861 - RNA, 13 nt, Human
agacaagcugcaa

SEQ ID NO: 3486862 - RNA, 19 nt, Human
agacaaggaaaaaauaaca

SEQ ID NO: 3486863 - RNA, 16 nt, Human
agacaagguagcccug

SEQ ID NO: 3486864 - RNA, 23 nt, Human
agacaagugaugcuaaaaccuga

SEQ ID NO: 3486865 - RNA, 22 nt, Human
agacaaguuccaugggauacaa

SEQ ID NO: 3486866 - RNA, 12 nt, Human
agacaauaaacc

SEQ ID NO: 3486867 - RNA, 11 nt, Human
agacaauauac

SEQ ID NO: 3486868 - RNA, 13 nt, Human
agacaauauacaa

SEQ ID NO: 3486869 - RNA, 15 nt, Human
agacaauauacaagc

SEQ ID NO: 3486870 - RNA, 14 nt, Human
agacaaucauuguu

SEQ ID NO: 3486871 - RNA, 16 nt, Human
agacaaucauuguuuu

SEQ ID NO: 3486872 - RNA, 22 nt, Human
agacaaucauuguuuugaauau

SEQ ID NO: 3486873 - RNA, 23 nt, Human
agacaaucauuguuuugaauauu

SEQ ID NO: 3486874 - RNA, 23 nt, Human
agacaaugacuuacuguacauga

SEQ ID NO: 3486875 - RNA, 20 nt, Human
agacaaugucugcagcccug

SEQ ID NO: 3486876 - RNA, 17 nt, Human
agacaaugugaaaagaa

SEQ ID NO: 3486877 - RNA, 13 nt, Human
agacaauucuuua

SEQ ID NO: 3486878 - RNA, 19 nt, Human
agacaauugacaacaguua

SEQ ID NO: 3486879 - RNA, 23 nt, Human
agacaauugagguaaguuuuuug

SEQ ID NO: 3486880 - RNA, 18 nt, Human
agacaauuugcacaucuu

SEQ ID NO: 3486881 - RNA, 20 nt, Human
agacacaaacaaacaagcua

SEQ ID NO: 3486882 - RNA, 15 nt, Human
agacacacaaagcag

SEQ ID NO: 3486883 - RNA, 15 nt, Human
agacacacacacgca

SEQ ID NO: 3486884 - RNA, 16 nt, Human
agacacacacacgcac

SEQ ID NO: 3486885 - RNA, 18 nt, Human
agacacacgcacacacac

SEQ ID NO: 3486886 - RNA, 16 nt, Human
agacacagaacacaga

SEQ ID NO: 3486887 - RNA, 14 nt, Human
agacacagauaaua

SEQ ID NO: 3486888 - RNA, 14 nt, Human
agacacagauguuc

SEQ ID NO: 3486889 - RNA, 12 nt, Human
agacacaggccc

SEQ ID NO: 3486890 - RNA, 13 nt, Human
agcugagcagggc

SEQ ID NO: 3486891 - RNA, 14 nt, Human
agcugagcagggcc

SEQ ID NO: 3486892 - RNA, 14 nt, Human
agcugagccaggcu

SEQ ID NO: 3486893 - RNA, 13 nt, Human
agcugagccucuc

SEQ ID NO: 3486894 - RNA, 15 nt, Human
agcugagccuucuga

SEQ ID NO: 3486895 - RNA, 14 nt, Human
agcugagcgccagg

SEQ ID NO: 3486896 - RNA, 22 nt, Human
agcugagcucacaaggcagcaa

SEQ ID NO: 3486897 - RNA, 17 nt, Human
agcugaggcaauucuaa

SEQ ID NO: 3486898 - RNA, 18 nt, Human
agcugaggucucuugagg

SEQ ID NO: 3486899 - RNA, 22 nt, Human
agcugaggugcccaggagaaga

SEQ ID NO: 3486900 - RNA, 21 nt, Human
agcugaguuaggugucugucc

SEQ ID NO: 3486901 - RNA, 16 nt, Human
agcugaguuaugaugu

SEQ ID NO: 3486902 - RNA, 14 nt, Human
agcugaguuuccua

SEQ ID NO: 3486903 - RNA, 13 nt, Human
agcugaucaguuu

SEQ ID NO: 3486904 - RNA, 19 nt, Human
agcugauccagagcacaga

SEQ ID NO: 3486905 - RNA, 20 nt, Human
agcugaucgcuucuccccca

SEQ ID NO: 3486906 - RNA, 23 nt, Human
agcugaugaaacucacaaaugau

SEQ ID NO: 3486907 - RNA, 11 nt, Human
agcugaugacu

SEQ ID NO: 3486908 - RNA, 15 nt, Human
agcugauggagaagg

SEQ ID NO: 3486909 - RNA, 19 nt, Human
agcugauggagaaggaagg

SEQ ID NO: 3486910 - RNA, 17 nt, Human
agcugauguuggaagag

SEQ ID NO: 3486911 - RNA, 21 nt, Human
agcugauguuggaagagaaag

SEQ ID NO: 3486912 - RNA, 19 nt, Human
agcugauuacugucaauaa

SEQ ID NO: 3486913 - RNA, 20 nt, Human
agcugauuacugucaauaaa

SEQ ID NO: 3486914 - RNA, 14 nt, Human
agcugauuuuaaca

SEQ ID NO: 3486915 - RNA, 21 nt, Human
agcugauuuugaggguuuuua

SEQ ID NO: 3486916 - RNA, 20 nt, Human
agcugcaaaguguuuuguac

SEQ ID NO: 3486917 - RNA, 18 nt, Human
agcugcaagugacaucuc

SEQ ID NO: 3486918 - RNA, 19 nt, Human
agcugcaaucgcuuuccua

SEQ ID NO: 3486919 - RNA, 21 nt, Human
agcugcacagggcagcugggc

SEQ ID NO: 3486920 - RNA, 18 nt, Human
agcugcacccucaggcag

SEQ ID NO: 3486921 - RNA, 20 nt, Human
agcugcacugaugcugcccc

SEQ ID NO: 3486922 - RNA, 11 nt, Human
agcugcagcuu

SEQ ID NO: 3486923 - RNA, 23 nt, Human
agcugcaggaaucaaaaauugaa

SEQ ID NO: 3486924 - RNA, 14 nt, Human
agcugcaggggcau

SEQ ID NO: 3486925 - RNA, 18 nt, Human
agcugcauacaguuugca

SEQ ID NO: 3486926 - RNA, 13 nt, Human
aggaaagcaagaa

SEQ ID NO: 3486927 - RNA, 19 nt, Human
aggaaagcaguugaaauga

SEQ ID NO: 3486928 - RNA, 20 nt, Human
aggaaagccucacugauaua

SEQ ID NO: 3486929 - RNA, 16 nt, Human
aggaaaggcuccagga

SEQ ID NO: 3486930 - RNA, 20 nt, Human
aggaaaggcuccaggagcag

SEQ ID NO: 3486931 - RNA, 23 nt, Human
aggaaaggcuccaggagcagcca

SEQ ID NO: 3486932 - RNA, 13 nt, Human
aggaaagggaagg

SEQ ID NO: 3486933 - RNA, 18 nt, Human
aggaaaggggagaaggga

SEQ ID NO: 3486934 - RNA, 16 nt, Human
aggaaagucauuggcu

SEQ ID NO: 3486935 - RNA, 17 nt, Human
aggaaagucauuggcuu

SEQ ID NO: 3486936 - RNA, 20 nt, Human
aggaaagucauuggcuuuau

SEQ ID NO: 3486937 - RNA, 21 nt, Human
aggaaaguucagaguuuucug

SEQ ID NO: 3486938 - RNA, 18 nt, Human
aggaaauaaaaaagucuc

SEQ ID NO: 3486939 - RNA, 16 nt, Human
aggaaauaaaaccuuu

SEQ ID NO: 3486940 - RNA, 20 nt, Human
aggaaauaaaaccuuucaaa

SEQ ID NO: 3486941 - RNA, 21 nt, Human
aggaaauaaaaccuuucaaau

SEQ ID NO: 3486942 - RNA, 13 nt, Human
aggaaaucaaagu

SEQ ID NO: 3486943 - RNA, 14 nt, Human
aggaaaucaaagug

SEQ ID NO: 3486944 - RNA, 19 nt, Human
aggaaaucaaagugcuauu

SEQ ID NO: 3486945 - RNA, 20 nt, Human
aggaaaucaaauaugcaaag

SEQ ID NO: 3486946 - RNA, 13 nt, Human
aggaaaucaaaug

SEQ ID NO: 3486947 - RNA, 21 nt, Human
aggaaaucaacuugcuuauca

SEQ ID NO: 3486948 - RNA, 22 nt, Human
aggaaaucccuucauacuugaa

SEQ ID NO: 3486949 - RNA, 11 nt, Human
aggaaaucugu

SEQ ID NO: 3486950 - RNA, 17 nt, Human
aggaaaugaaugugugu

SEQ ID NO: 3486951 - RNA, 21 nt, Human
aggaaaugcugacccaugggc

SEQ ID NO: 3486952 - RNA, 22 nt, Human
aggaaaugcugacccaugggca

SEQ ID NO: 3486953 - RNA, 23 nt, Human
aggaaaugcugacccaugggcag

SEQ ID NO: 3486954 - RNA, 20 nt, Human
aggaaauguuuuuaauaaaa

SEQ ID NO: 3486955 - RNA, 22 nt, Human
aggaacaaaaaaaccacaaagg

SEQ ID NO: 3486956 - RNA, 13 nt, Human
aggaacaaaucuu

SEQ ID NO: 3486957 - RNA, 17 nt, Human
aggaacaaggcaaggcu

SEQ ID NO: 3486958 - RNA, 23 nt, Human
aggaacacaggcgcugaguaugg

SEQ ID NO: 3486959 - RNA, 23 nt, Human
aggaacacccgacuccucaaaag

SEQ ID NO: 3486960 - RNA, 15 nt, Human
aggaacacucugaau

SEQ ID NO: 3486961 - RNA, 14 nt, Human
aggaacagaaggau

SEQ ID NO: 3486962 - RNA, 13 nt, Human
aggaaccaaagcg

SEQ ID NO: 3486963 - RNA, 13 nt, Human
aggaaccaacaau

SEQ ID NO: 3486964 - RNA, 23 nt, Human
aggaaccgagggggcugcuccca

SEQ ID NO: 3486965 - RNA, 21 nt, Human
aggaaccucugauuuauuuug

SEQ ID NO: 3486966 - RNA, 19 nt, Human
aggaaccuggaccaaagcu

SEQ ID NO: 3486967 - RNA, 13 nt, Human
aggaaccuguccu

SEQ ID NO: 3486968 - RNA, 19 nt, Human
aggaaccuuccuuccugcu

SEQ ID NO: 3486969 - RNA, 13 nt, Human
aggaacucccagc

SEQ ID NO: 3486970 - RNA, 17 nt, Human
aggaacugcagcaaucu

SEQ ID NO: 3486971 - RNA, 22 nt, Human
aggaacugcugggcuuggcagc

SEQ ID NO: 3486972 - RNA, 13 nt, Human
aggaacuguacag

SEQ ID NO: 3486973 - RNA, 15 nt, Human
aggaacuguacagaa

SEQ ID NO: 3486974 - RNA, 18 nt, Human
aggaacuguagaugaugu

SEQ ID NO: 3486975 - RNA, 17 nt, Human
aggaacuguccagagag

SEQ ID NO: 3486976 - RNA, 20 nt, Human
aggaacuguccagagagcaa

SEQ ID NO: 3486977 - RNA, 18 nt, Human
aggaacuugaaaaauacu

SEQ ID NO: 3486978 - RNA, 18 nt, Human
aggaacuugagaacuuua

SEQ ID NO: 3486979 - RNA, 19 nt, Human
aggaagaaacagaagagag

SEQ ID NO: 3486980 - RNA, 11 nt, Human
aggaagaaauu

SEQ ID NO: 3486981 - RNA, 12 nt, Human
aggaagaacggg

SEQ ID NO: 3486982 - RNA, 18 nt, Human
aggaagaacggggcucuu

SEQ ID NO: 3486983 - RNA, 20 nt, Human
aggaagaagcuuaggcaggg

SEQ ID NO: 3486984 - RNA, 18 nt, Human
aggaagaauagggcccau

SEQ ID NO: 3486985 - RNA, 20 nt, Human
aggaagaauggugugggaga

SEQ ID NO: 3486986 - RNA, 20 nt, Human
aggaagaauuuuaaaaauga

SEQ ID NO: 3486987 - RNA, 14 nt, Human
aggaagacuuugga

SEQ ID NO: 3486988 - RNA, 17 nt, Human
aggaagagaaggagcag

SEQ ID NO: 3486989 - RNA, 17 nt, Human
aggaagagcaggcacau

SEQ ID NO: 3486990 - RNA, 14 nt, Human
aggaagagggacag

SEQ ID NO: 3486991 - RNA, 21 nt, Human
aggaagaguagcauuucauuc

SEQ ID NO: 3486992 - RNA, 20 nt, Human
aggaagaucacuuugcucug

SEQ ID NO: 3486993 - RNA, 14 nt, Human
aggaagaucaggcc

SEQ ID NO: 3486994 - RNA, 19 nt, Human
aggaagaugggggcaagaa

SEQ ID NO: 3486995 - RNA, 13 nt, Human
aggaagauuugga

SEQ ID NO: 3486996 - RNA, 16 nt, Human
aggaagcaaacuaagc

SEQ ID NO: 3486997 - RNA, 15 nt, Human
aggaagcaagcuuaa

SEQ ID NO: 3486998 - RNA, 16 nt, Human
aggaagcacaugccuc

SEQ ID NO: 3486999 - RNA, 13 nt, Human
aggaagcagaaua

SEQ ID NO: 3487000 - RNA, 16 nt, Human
aggaagcauuguaaaa

SEQ ID NO: 3487001 - RNA, 19 nt, Human
aggaagcauuguaaaauaa

SEQ ID NO: 3487002 - RNA, 13 nt, Human
aggaagccagcag

SEQ ID NO: 3487003 - RNA, 14 nt, Human
aggaagccagcagg

SEQ ID NO: 3487004 - RNA, 17 nt, Human
aggaagccagcaggcuc

SEQ ID NO: 3487005 - RNA, 22 nt, Human
aggaagccagcaggcucucagg

SEQ ID NO: 3487006 - RNA, 19 nt, Human
aggaagcccaauugcugga

SEQ ID NO: 3487007 - RNA, 22 nt, Human
aggaagcccccaccgugggcag

SEQ ID NO: 3487008 - RNA, 18 nt, Human
aggaagccgcuggggcca

SEQ ID NO: 3487009 - RNA, 17 nt, Human
aggaagccugauuaaag

SEQ ID NO: 3487010 - RNA, 20 nt, Human
aggaagccugcaguccugga

SEQ ID NO: 3487011 - RNA, 14 nt, Human
aggaagcucagacu

SEQ ID NO: 3487012 - RNA, 17 nt, Human
aggaagcucagacuggu

SEQ ID NO: 3487013 - RNA, 15 nt, Human
aggaagcuccacugu

SEQ ID NO: 3487014 - RNA, 21 nt, Human
aggaagcuccaguccugcucu

SEQ ID NO: 3487015 - RNA, 17 nt, Human
aggaagcuuucucugcu

SEQ ID NO: 3487016 - RNA, 21 nt, Human
aggaagcuuucucugcuucag

SEQ ID NO: 3487017 - RNA, 23 nt, Human
aggaagcuuuggugagaaccugg

SEQ ID NO: 3487018 - RNA, 19 nt, Human
aggaaggaaacccagcucu

SEQ ID NO: 3487019 - RNA, 22 nt, Human
aggaaggaaacccagcucuggu

SEQ ID NO: 3487020 - RNA, 23 nt, Human
aggaaggaaacccagcucugguc

SEQ ID NO: 3487021 - RNA, 14 nt, Human
aggaaggacccuga

SEQ ID NO: 3487022 - RNA, 21 nt, Human
aggaaggagcugccuggaccc

SEQ ID NO: 3487023 - RNA, 16 nt, Human
aggaaggcagggagga

SEQ ID NO: 3487024 - RNA, 14 nt, Human
aggaaggccugggu

SEQ ID NO: 3487025 - RNA, 21 nt, Human
aggaaggcucuucuccccaga

SEQ ID NO: 3487026 - RNA, 23 nt, Human
aggaagggaccaaggcaaggcag

SEQ ID NO: 3487027 - RNA, 12 nt, Human
aggaagggcaaa

SEQ ID NO: 3487028 - RNA, 21 nt, Human
aggaagggggucuaaggucua

SEQ ID NO: 3487029 - RNA, 20 nt, Human
aggaagggguuggauugcaa

SEQ ID NO: 3487030 - RNA, 17 nt, Human
aggaagguacuguauga

SEQ ID NO: 3487031 - RNA, 14 nt, Human
aggaaggucauuuc

SEQ ID NO: 3487032 - RNA, 16 nt, Human
aggaaggucucauucu

SEQ ID NO: 3487033 - RNA, 15 nt, Human
aggaaguacuggaga

SEQ ID NO: 3487034 - RNA, 14 nt, Human
aggaaguaggaagu

SEQ ID NO: 3487035 - RNA, 15 nt, Human
aggaaguaggaagua

SEQ ID NO: 3487036 - RNA, 18 nt, Human
aggaagucaaagcaagga

SEQ ID NO: 3487037 - RNA, 23 nt, Human
aggaaguccuuaucuagcugcau

SEQ ID NO: 3487038 - RNA, 17 nt, Human
aggaagucuaggagcug

SEQ ID NO: 3487039 - RNA, 19 nt, Human
aggaagucucaucugggga

SEQ ID NO: 3487040 - RNA, 23 nt, Human
aggaagugauuuuugagcccuug

SEQ ID NO: 3487041 - RNA, 13 nt, Human
aggaaguggaaug

SEQ ID NO: 3487042 - RNA, 18 nt, Human
aggaaguguaacagcuga

SEQ ID NO: 3487043 - RNA, 19 nt, Human
aggaauaaauaaaaaugga

SEQ ID NO: 3487044 - RNA, 22 nt, Human
agcugggcaugguaccagcccu

SEQ ID NO: 3487045 - RNA, 15 nt, Human
agcugggcccaaccc

SEQ ID NO: 3487046 - RNA, 21 nt, Human
agcugggcccaacccugucug

SEQ ID NO: 3487047 - RNA, 16 nt, Human
agcugggccccagccc

SEQ ID NO: 3487048 - RNA, 11 nt, Human
agcugggcccg

SEQ ID NO: 3487049 - RNA, 15 nt, Human
agcugggccgggacc

SEQ ID NO: 3487050 - RNA, 13 nt, Human
agcugggccuggu

SEQ ID NO: 3487051 - RNA, 15 nt, Human
agcugggccuggucu

SEQ ID NO: 3487052 - RNA, 15 nt, Human
agcugggcucugcaa

SEQ ID NO: 3487053 - RNA, 11 nt, Human
agcugggcugu

SEQ ID NO: 3487054 - RNA, 14 nt, Human
agcuggggaccugg

SEQ ID NO: 3487055 - RNA, 17 nt, Human
agcuggggcugagggau

SEQ ID NO: 3487056 - RNA, 22 nt, Human
agcuggggcuuugauguuccuu

SEQ ID NO: 3487057 - RNA, 18 nt, Human
agcugggggugggccagg

SEQ ID NO: 3487058 - RNA, 19 nt, Human
agcugggggugggccaggc

SEQ ID NO: 3487059 - RNA, 15 nt, Human
agcuggggugcaggg

SEQ ID NO: 3487060 - RNA, 22 nt, Human
agcuggggugcagggauguggg

SEQ ID NO: 3487061 - RNA, 23 nt, Human
agcuggggugcagggaugugggu

SEQ ID NO: 3487062 - RNA, 20 nt, Human
agcugggguggggaccucag

SEQ ID NO: 3487063 - RNA, 19 nt, Human
agcugggguucaugacaau

SEQ ID NO: 3487064 - RNA, 16 nt, Human
agcugggucaggcagg

SEQ ID NO: 3487065 - RNA, 19 nt, Human
agcugguaguuaguagcau

SEQ ID NO: 3487066 - RNA, 17 nt, Human
agcuggucccacucagu

SEQ ID NO: 3487067 - RNA, 18 nt, Human
agcuggucccacucaguc

SEQ ID NO: 3487068 - RNA, 21 nt, Human
agcuggucccacucaguccau

SEQ ID NO: 3487069 - RNA, 19 nt, Human
agcuggugcauuacagaga

SEQ ID NO: 3487070 - RNA, 14 nt, Human
aggauauauuuuau

SEQ ID NO: 3487071 - RNA, 18 nt, Human
aggauauauuuuauuuuu

SEQ ID NO: 3487072 - RNA, 21 nt, Human
aggauauauuuucacuuugug

SEQ ID NO: 3487073 - RNA, 20 nt, Human
aggauauccuuaucagagcu

SEQ ID NO: 3487074 - RNA, 17 nt, Human
aggauaucggcauuugu

SEQ ID NO: 3487075 - RNA, 19 nt, Human
aggauauucagauguaugu

SEQ ID NO: 3487076 - RNA, 15 nt, Human
aggaucaagaaagug

SEQ ID NO: 3487077 - RNA, 20 nt, Human
aggaucacuggagcccagga

SEQ ID NO: 3487078 - RNA, 22 nt, Human
aggaucacuggagcccaggagu

SEQ ID NO: 3487079 - RNA, 19 nt, Human
aggaucacuugagcccagg

SEQ ID NO: 3487080 - RNA, 13 nt, Human
aggaucagaaagu

SEQ ID NO: 3487081 - RNA, 14 nt, Human
aggaucagaaagua

SEQ ID NO: 3487082 - RNA, 18 nt, Human
aggaucagaaaguaauuu

SEQ ID NO: 3487083 - RNA, 12 nt, Human
aggaucagucug

SEQ ID NO: 3487084 - RNA, 13 nt, Human
aggaucagucuga

SEQ ID NO: 3487085 - RNA, 18 nt, Human
aggaucaugguguaauaa

SEQ ID NO: 3487086 - RNA, 22 nt, Human
aggaucaugguguaauaagaca

SEQ ID NO: 3487087 - RNA, 14 nt, Human
aggauccugagcca

SEQ ID NO: 3487088 - RNA, 16 nt, Human
aggauccugagccaga

SEQ ID NO: 3487089 - RNA, 18 nt, Human
aggauccugagccagauu

SEQ ID NO: 3487090 - RNA, 14 nt, Human
agacuaauuuaaaa

SEQ ID NO: 3487091 - RNA, 16 nt, Human
agacuacagcuggggu

SEQ ID NO: 3487092 - RNA, 15 nt, Human
agacuacuguucagc

SEQ ID NO: 3487093 - RNA, 17 nt, Human
agacuagaauucuagug

SEQ ID NO: 3487094 - RNA, 23 nt, Human
agacuagaauucuagugcugcug

SEQ ID NO: 3487095 - RNA, 14 nt, Human
agacuagauguagu

SEQ ID NO: 3487096 - RNA, 16 nt, Human
agacuagauguaguau

SEQ ID NO: 3487097 - RNA, 22 nt, Human
agacuaggauaauguccaacua

SEQ ID NO: 3487098 - RNA, 13 nt, Human
agacuauauacau

SEQ ID NO: 3487099 - RNA, 14 nt, Human
agacuauauacaug

SEQ ID NO: 3487100 - RNA, 20 nt, Human
agacuauauacaugugugua

SEQ ID NO: 3487101 - RNA, 21 nt, Human
agacuauauacauguguguau

SEQ ID NO: 3487102 - RNA, 18 nt, Human
agacuaucuaaauguuga

SEQ ID NO: 3487103 - RNA, 16 nt, Human
agacuauggagccugg

SEQ ID NO: 3487104 - RNA, 18 nt, Human
agacuauguaaaaauaac

SEQ ID NO: 3487105 - RNA, 12 nt, Human
agacuauucaaa

SEQ ID NO: 3487106 - RNA, 14 nt, Human
agacuauucaaaca

SEQ ID NO: 3487107 - RNA, 15 nt, Human
agacuauucaaacag

SEQ ID NO: 3487108 - RNA, 18 nt, Human
agacuauucaaacagucu

SEQ ID NO: 3487109 - RNA, 23 nt, Human
agacuauucaaacagucucagga

SEQ ID NO: 3487110 - RNA, 18 nt, Human
agacuauuuaacuugagg

SEQ ID NO: 3487111 - RNA, 23 nt, Human
agacucaaauguucuaaguuucu

SEQ ID NO: 3487112 - RNA, 20 nt, Human
agacucacaaccugaaccua

SEQ ID NO: 3487113 - RNA, 14 nt, Human
agacucacaggaag

SEQ ID NO: 3487114 - RNA, 15 nt, Human
agacucacaggaagg

SEQ ID NO: 3487115 - RNA, 15 nt, Human
agacucaccucugcc

SEQ ID NO: 3487116 - RNA, 17 nt, Human
agacucaccucugccuc

SEQ ID NO: 3487117 - RNA, 15 nt, Human
agacucagacuccau

SEQ ID NO: 3487118 - RNA, 14 nt, Human
agacucagccugca

SEQ ID NO: 3487119 - RNA, 23 nt, Human
agacucagccugcaguuaauuag

SEQ ID NO: 3487120 - RNA, 18 nt, Human
agacucagcucugacauu

SEQ ID NO: 3487121 - RNA, 20 nt, Human
agacucagcucugacauucu

SEQ ID NO: 3487122 - RNA, 20 nt, Human
agacucaggccaagaaacgu

SEQ ID NO: 3487123 - RNA, 17 nt, Human
agacucagggccccagc

SEQ ID NO: 3487124 - RNA, 21 nt, Human
agacucagggccccagcacua

SEQ ID NO: 3487125 - RNA, 23 nt, Human
agacucagguuguaguaaagaaa

SEQ ID NO: 3487126 - RNA, 16 nt, Human
agacucagugcagaug

SEQ ID NO: 3487127 - RNA, 21 nt, Human
agacucaguggggaggggcug

SEQ ID NO: 3487128 - RNA, 13 nt, Human
agacucaguguuc

SEQ ID NO: 3487129 - RNA, 15 nt, Human
agacucauauuacug

SEQ ID NO: 3487130 - RNA, 14 nt, Human
agacuccagaccug

SEQ ID NO: 3487131 - RNA, 21 nt, Human
agacuccagcuggguuggaaa

SEQ ID NO: 3487132 - RNA, 16 nt, Human
agacucccaugaggga

SEQ ID NO: 3487133 - RNA, 17 nt, Human
agacucccauuccugaa

SEQ ID NO: 3487134 - RNA, 23 nt, Human
agacuccugacugucucccggga

SEQ ID NO: 3487135 - RNA, 21 nt, Human
agacuccuucaacaauucuaa

SEQ ID NO: 3487136 - RNA, 14 nt, Human
agacucgagaacuu

SEQ ID NO: 3487137 - RNA, 15 nt, Human
agacucgagaacuuu

SEQ ID NO: 3487138 - RNA, 18 nt, Human
agacucgagaacuuucau

SEQ ID NO: 3487139 - RNA, 17 nt, Human
agacucgcgacaaugca

SEQ ID NO: 3487140 - RNA, 12 nt, Human
agacucuaagaa

SEQ ID NO: 3487141 - RNA, 17 nt, Human
agacucuacagaggcca

SEQ ID NO: 3487142 - RNA, 23 nt, Human
agacucuagacaagauauuguac

SEQ ID NO: 3487143 - RNA, 17 nt, Human
agacucuagaguccaag

SEQ ID NO: 3487144 - RNA, 21 nt, Human
agacucuagaguccaagguuu

SEQ ID NO: 3487145 - RNA, 21 nt, Human
agacucuaggacauaaauuag

SEQ ID NO: 3487146 - RNA, 16 nt, Human
agacucucagcccaga

SEQ ID NO: 3487147 - RNA, 17 nt, Human
agacucucagcccagaa

SEQ ID NO: 3487148 - RNA, 23 nt, Human
agacucucgcaucuucccaaccc

SEQ ID NO: 3487149 - RNA, 14 nt, Human
agacucucuuagga

SEQ ID NO: 3487150 - RNA, 16 nt, Human
agacucugaaaucuca

SEQ ID NO: 3487151 - RNA, 13 nt, Human
agacucugucuaa

SEQ ID NO: 3487152 - RNA, 18 nt, Human
agacucugucucagucca

SEQ ID NO: 3487153 - RNA, 16 nt, Human
agacucuguggggccu

SEQ ID NO: 3487154 - RNA, 17 nt, Human
agacucuugccuguuuc

SEQ ID NO: 3487155 - RNA, 22 nt, Human
agacucuugccuguuucccagg

SEQ ID NO: 3487156 - RNA, 18 nt, Human
agacugaacuuaccguga

SEQ ID NO: 3487157 - RNA, 21 nt, Human
agacugaauagauaugaaagc

SEQ ID NO: 3487158 - RNA, 22 nt, Human
agacugacaguuuacagacgcu

SEQ ID NO: 3487159 - RNA, 21 nt, Human
agacugaccaauauuguacag

SEQ ID NO: 3487160 - RNA, 22 nt, Human
agacugaccaauauuguacagu

SEQ ID NO: 3487161 - RNA, 20 nt, Human
agacugaccuugaugagcug

SEQ ID NO: 3487162 - RNA, 13 nt, Human
agacugagcucaa

SEQ ID NO: 3487163 - RNA, 15 nt, Human
agacugaggggucga

SEQ ID NO: 3487164 - RNA, 22 nt, Human
agacugaguacguugugcauuu

SEQ ID NO: 3487165 - RNA, 23 nt, Human
agacugaguacguugugcauuug

SEQ ID NO: 3487166 - RNA, 16 nt, Human
agacugaucaggaccu

SEQ ID NO: 3487167 - RNA, 21 nt, Human
agacugcaagugagcaaaccu

SEQ ID NO: 3487168 - RNA, 14 nt, Human
agacugcacccagg

SEQ ID NO: 3487169 - RNA, 22 nt, Human
agacugccagcucuuccuagcu

SEQ ID NO: 3487170 - RNA, 23 nt, Human
agacugcgauuugucccaggucc

SEQ ID NO: 3487171 - RNA, 23 nt, Human
agacugcgggaugguccuggggc

SEQ ID NO: 3487172 - RNA, 17 nt, Human
agacugcguucugcaag

SEQ ID NO: 3487173 - RNA, 18 nt, Human
agacugcuaguguucugu

SEQ ID NO: 3487174 - RNA, 19 nt, Human
agacugcuccugagccccc

SEQ ID NO: 3487175 - RNA, 14 nt, Human
agacugcugggacu

SEQ ID NO: 3487176 - RNA, 19 nt, Human
agacugcugggacuggcca

SEQ ID NO: 3487177 - RNA, 22 nt, Human
agacugcugggacuggccaggu

SEQ ID NO: 3487178 - RNA, 14 nt, Human
agacugcuucccau

SEQ ID NO: 3487179 - RNA, 22 nt, Human
agacugcuucccauccuacccu

SEQ ID NO: 3487180 - RNA, 23 nt, Human
agacugcuucccauccuacccuc

SEQ ID NO: 3487181 - RNA, 16 nt, Human
agacugcuuugagaaa

SEQ ID NO: 3487182 - RNA, 18 nt, Human
agacuggaaaaaaugagc

SEQ ID NO: 3487183 - RNA, 18 nt, Human
agacuggaacacuagaca

SEQ ID NO: 3487184 - RNA, 23 nt, Human
agacuggaacuugaacugauuca

SEQ ID NO: 3487185 - RNA, 19 nt, Human
agacuggaagcacagcuuc

SEQ ID NO: 3487186 - RNA, 19 nt, Human
agacuggaagcuaauuugc

SEQ ID NO: 3487187 - RNA, 21 nt, Human
agacuggaagcuaauuugcau

SEQ ID NO: 3487188 - RNA, 14 nt, Human
agacuggaaguuca

SEQ ID NO: 3487189 - RNA, 19 nt, Human
agacuggaaguucauaccu

SEQ ID NO: 3487190 - RNA, 17 nt, Human
agacuggacagcuugug

SEQ ID NO: 3487191 - RNA, 16 nt, Human
agacuggagcaucuga

SEQ ID NO: 3487192 - RNA, 13 nt, Human
agacuggagggga

SEQ ID NO: 3487193 - RNA, 14 nt, Human
agacuggcacaguu

SEQ ID NO: 3487194 - RNA, 23 nt, Human
agacuggcacaguuuucugagaa

SEQ ID NO: 3487195 - RNA, 20 nt, Human
agacuggccugaaccacagg

SEQ ID NO: 3487196 - RNA, 18 nt, Human
agacuggcuuuuauuaau

SEQ ID NO: 3487197 - RNA, 21 nt, Human
agacugggaagauaggcucug

SEQ ID NO: 3487198 - RNA, 23 nt, Human
agacugggaagauaggcucugca

SEQ ID NO: 3487199 - RNA, 15 nt, Human
agacugggcugaggg

SEQ ID NO: 3487200 - RNA, 22 nt, Human
agacuggguaggaaagaggaag

SEQ ID NO: 3487201 - RNA, 21 nt, Human
agacugggugaggauaacaca

SEQ ID NO: 3487202 - RNA, 15 nt, Human
agacuggguuucuag

SEQ ID NO: 3487203 - RNA, 14 nt, Human
agacuggugacuga

SEQ ID NO: 3487204 - RNA, 16 nt, Human
agacuggugacugauu

SEQ ID NO: 3487205 - RNA, 19 nt, Human
agacuggugacugauucuu

SEQ ID NO: 3487206 - RNA, 21 nt, Human
agacuggugacugauucuuca

SEQ ID NO: 3487207 - RNA, 22 nt, Human
agacuguaacuuccaaauaaau

SEQ ID NO: 3487208 - RNA, 16 nt, Human
agacuguaaugaaucu

SEQ ID NO: 3487209 - RNA, 15 nt, Human
agacuguacaaagua

SEQ ID NO: 3487210 - RNA, 18 nt, Human
agacuguagccuggauau

SEQ ID NO: 3487211 - RNA, 18 nt, Human
agacuguggagacugcuc

SEQ ID NO: 3487212 - RNA, 20 nt, Human
agacuguggagacugcuccu

SEQ ID NO: 3487213 - RNA, 15 nt, Human
aggacauggcuucug

SEQ ID NO: 3487214 - RNA, 15 nt, Human
aggacauguuuuugu

SEQ ID NO: 3487215 - RNA, 21 nt, Human
aggacauguuuuuguuuucuu

SEQ ID NO: 3487216 - RNA, 14 nt, Human
aggacauuccaaga

SEQ ID NO: 3487217 - RNA, 18 nt, Human
aggacauuccaagacagu

SEQ ID NO: 3487218 - RNA, 14 nt, Human
aggacauucuugua

SEQ ID NO: 3487219 - RNA, 22 nt, Human
aggacauugauuugauuuuuau

SEQ ID NO: 3487220 - RNA, 17 nt, Human
aggacauugcggacagc

SEQ ID NO: 3487221 - RNA, 23 nt, Human
aggacauugcggacagccacggc

SEQ ID NO: 3487222 - RNA, 14 nt, Human
aggacauuucucua

SEQ ID NO: 3487223 - RNA, 17 nt, Human
aggaccaaaaaaauaag

SEQ ID NO: 3487224 - RNA, 17 nt, Human
aggaccaagcaucuugg

SEQ ID NO: 3487225 - RNA, 17 nt, Human
aggaccacaggcucagg

SEQ ID NO: 3487226 - RNA, 14 nt, Human
aggaccacucagcc

SEQ ID NO: 3487227 - RNA, 22 nt, Human
aggaccacuccuguacacugaa

SEQ ID NO: 3487228 - RNA, 14 nt, Human
aggaccagcccacg

SEQ ID NO: 3487229 - RNA, 18 nt, Human
aggaccagcccacgcuga

SEQ ID NO: 3487230 - RNA, 24 nt, Human
aggaccagcucaggacagaugcca

SEQ ID NO: 3487231 - RNA, 16 nt, Human
aggaccaggacucccu

SEQ ID NO: 3487232 - RNA, 21 nt, Human
aggaccaggacucccuccuca

SEQ ID NO: 3487233 - RNA, 16 nt, Human
aggaccagucccagag

SEQ ID NO: 3487234 - RNA, 13 nt, Human
aggacccaagcag

SEQ ID NO: 3487235 - RNA, 12 nt, Human
aggacccaggac

SEQ ID NO: 3487236 - RNA, 13 nt, Human
aggacccaggaca

SEQ ID NO: 3487237 - RNA, 17 nt, Human
aggacccagggcucugu

SEQ ID NO: 3487238 - RNA, 14 nt, Human
aggaccccagcucu

SEQ ID NO: 3487239 - RNA, 16 nt, Human
aggaccccagcucugc

SEQ ID NO: 3487240 - RNA, 17 nt, Human
aggaccccagcucugcg

SEQ ID NO: 3487241 - RNA, 16 nt, Human
aggacccccuuccccu

SEQ ID NO: 3487242 - RNA, 13 nt, Human
aggaccccucacc

SEQ ID NO: 3487243 - RNA, 23 nt, Human
aggaccccucaccuugcaacaca

SEQ ID NO: 3487244 - RNA, 14 nt, Human
aggaucucuaaaga

SEQ ID NO: 3487245 - RNA, 19 nt, Human
aggaucucuaaagagcauc

SEQ ID NO: 3487246 - RNA, 22 nt, Human
aggaucucucaggagcacaggc

SEQ ID NO: 3487247 - RNA, 17 nt, Human
aggaucucuugagccug

SEQ ID NO: 3487248 - RNA, 19 nt, Human
aggaucucuugagccuggg

SEQ ID NO: 3487249 - RNA, 22 nt, Human
aggaucucuugagccugggagg

SEQ ID NO: 3487250 - RNA, 20 nt, Human
aggaucuguuuuuaaaaauc

SEQ ID NO: 3487251 - RNA, 18 nt, Human
aggaucuuuguggccaag

SEQ ID NO: 3487252 - RNA, 21 nt, Human
aggaugaaugaggucccaggc

SEQ ID NO: 3487253 - RNA, 22 nt, Human
aggaugaaugaggucccaggca

SEQ ID NO: 3487254 - RNA, 18 nt, Human
aggaugaauguaugugca

SEQ ID NO: 3487255 - RNA, 20 nt, Human
aggaugaauguaugugcacu

SEQ ID NO: 3487256 - RNA, 20 nt, Human
aggaugaccuggauaacuua

SEQ ID NO: 3487257 - RNA, 23 nt, Human
aggaugacgguauuaugcuucuu

SEQ ID NO: 3487258 - RNA, 18 nt, Human
aggaugagagcccagagg

SEQ ID NO: 3487259 - RNA, 20 nt, Human
aggaugagcucuacccaggg

SEQ ID NO: 3487260 - RNA, 15 nt, Human
aggaugagcuggaag

SEQ ID NO: 3487261 - RNA, 16 nt, Human
aggaugagcuggaagg

SEQ ID NO: 3487262 - RNA, 16 nt, Human
aggaugaucuaggaag

SEQ ID NO: 3487263 - RNA, 17 nt, Human
aggaugaucuaggaaga

SEQ ID NO: 3487264 - RNA, 20 nt, Human
aggaugaucuaggaagacuu

SEQ ID NO: 3487265 - RNA, 22 nt, Human
aggaugaucuaggaagacuuug

SEQ ID NO: 3487266 - RNA, 15 nt, Human
aggaugauuguacag

SEQ ID NO: 3487267 - RNA, 20 nt, Human
aggaugauuguacagaauca

SEQ ID NO: 3487268 - RNA, 22 nt, Human
aggaugcacagaguuguuacau

SEQ ID NO: 3487269 - RNA, 19 nt, Human
aggaugcagagucagcaga

SEQ ID NO: 3487270 - RNA, 22 nt, Human
aggaugcccagggccacucugc

SEQ ID NO: 3487271 - RNA, 16 nt, Human
aggaugcuaacaucua

SEQ ID NO: 3487272 - RNA, 19 nt, Human
aggauggaacacggccaca

SEQ ID NO: 3487273 - RNA, 19 nt, Human
aggauggagagaggggaau

SEQ ID NO: 3487274 - RNA, 19 nt, Human
aggauggaggggugguccu

SEQ ID NO: 3487275 - RNA, 16 nt, Human
aggauggccagugucu

SEQ ID NO: 3487276 - RNA, 19 nt, Human
aggauggccagugucuguc

SEQ ID NO: 3487277 - RNA, 17 nt, Human
aggauggccuggccagg

SEQ ID NO: 3487278 - RNA, 22 nt, Human
aggauggccuggccagggccug

SEQ ID NO: 3487279 - RNA, 18 nt, Human
aggauggcuuugaaugcg

SEQ ID NO: 3487280 - RNA, 20 nt, Human
aggaugggcaugguguucuc

SEQ ID NO: 3487281 - RNA, 16 nt, Human
aggaugggcuucugug

SEQ ID NO: 3487282 - RNA, 19 nt, Human
aggaugggggcuggccucu

SEQ ID NO: 3487283 - RNA, 16 nt, Human
aggaugggucagagcu

SEQ ID NO: 3487284 - RNA, 17 nt, Human
aggaugggucagagcua

SEQ ID NO: 3487285 - RNA, 18 nt, Human
aggauguaaacagugccu

SEQ ID NO: 3487286 - RNA, 16 nt, Human
aggauguauauuuuau

SEQ ID NO: 3487287 - RNA, 15 nt, Human
aggaugucacagggc

SEQ ID NO: 3487288 - RNA, 22 nt, Human
aggaugucccugggccaggguc

SEQ ID NO: 3487289 - RNA, 13 nt, Human
aggaugucugggc

SEQ ID NO: 3487290 - RNA, 14 nt, Human
aggaugugauauau

SEQ ID NO: 3487291 - RNA, 18 nt, Human
aggaugugauauauaagu

SEQ ID NO: 3487292 - RNA, 20 nt, Human
aggauguggaaaccuccuuc

SEQ ID NO: 3487293 - RNA, 21 nt, Human
aggaugugucccaucuaggga

SEQ ID NO: 3487294 - RNA, 15 nt, Human
aggaugugugcaugu

SEQ ID NO: 3487295 - RNA, 17 nt, Human
aggauguguuugcuuuc

SEQ ID NO: 3487296 - RNA, 17 nt, Human
aggauguugaaaaaguu

SEQ ID NO: 3487297 - RNA, 18 nt, Human
aggauuaguuuagaacag

SEQ ID NO: 3487298 - RNA, 12 nt, Human
aggauuauggaa

SEQ ID NO: 3487299 - RNA, 14 nt, Human
aggauucacacccc

SEQ ID NO: 3487300 - RNA, 13 nt, Human
aggauucuaugag

SEQ ID NO: 3487301 - RNA, 16 nt, Human
aggauucuaugaggca

SEQ ID NO: 3487302 - RNA, 18 nt, Human
aggauucucaccagcugu

SEQ ID NO: 3487303 - RNA, 22 nt, Human
aggauucucaccagcugugucc

SEQ ID NO: 3487304 - RNA, 14 nt, Human
aggauucuccuuuu

SEQ ID NO: 3487305 - RNA, 13 nt, Human
aggauucugcugg

SEQ ID NO: 3487306 - RNA, 22 nt, Human
aggauucugcuggccucugcga

SEQ ID NO: 3487307 - RNA, 19 nt, Human
aggauucuuccucccuccc

SEQ ID NO: 3487308 - RNA, 14 nt, Human
aggauugaagagca

SEQ ID NO: 3487309 - RNA, 15 nt, Human
aggauugcgagagau

SEQ ID NO: 3487310 - RNA, 18 nt, Human
aggauugcgagagaugug

SEQ ID NO: 3487311 - RNA, 19 nt, Human
aggauugcgagagaugugu

SEQ ID NO: 3487312 - RNA, 14 nt, Human
aggauugcuaucug

SEQ ID NO: 3487313 - RNA, 17 nt, Human
aggauugcuugagccca

SEQ ID NO: 3487314 - RNA, 22 nt, Human
aggauugcuugagcccaggagu

SEQ ID NO: 3487315 - RNA, 19 nt, Human
aggauuguaaaaaaaaaug

SEQ ID NO: 3487316 - RNA, 23 nt, Human
aggauuguaaaaaaaaaugccuu

SEQ ID NO: 3487317 - RNA, 20 nt, Human
aggauuuaacagucauuuaa

SEQ ID NO: 3487318 - RNA, 19 nt, Human
aggauuucaugauuucauu

SEQ ID NO: 3487319 - RNA, 18 nt, Human
aggauuucuaaucaaaag

SEQ ID NO: 3487320 - RNA, 11 nt, Human
aggauuuuaug

SEQ ID NO: 3487321 - RNA, 15 nt, Human
aggauuuuaugcuuu

SEQ ID NO: 3487322 - RNA, 16 nt, Human
aggauuuuaugcuuua

SEQ ID NO: 3487323 - RNA, 12 nt, Human
aggauuuuuaga

SEQ ID NO: 3487324 - RNA, 15 nt, Human
aggauuuuuaucuuu

SEQ ID NO: 3487325 - RNA, 16 nt, Human
aggauuuuuuucugag

SEQ ID NO: 3487326 - RNA, 19 nt, Human
aggcaaaauugcaaaucuu

SEQ ID NO: 3487327 - RNA, 23 nt, Human
aggcaaacauuuucucuuagaaa

SEQ ID NO: 3487328 - RNA, 22 nt, Human
aggcaaacccaucaacaaaaau

SEQ ID NO: 3487329 - RNA, 22 nt, Human
aggcaaaccuuucuauaauuuu

SEQ ID NO: 3487330 - RNA, 17 nt, Human
aggcaaagaaaaugaaa

SEQ ID NO: 3487331 - RNA, 14 nt, Human
aggcaaaugacuuu

SEQ ID NO: 3487332 - RNA, 15 nt, Human
aggcaaaugacuuug

SEQ ID NO: 3487333 - RNA, 18 nt, Human
aggcaaaugacuuuggac

SEQ ID NO: 3487334 - RNA, 14 nt, Human
aggcaaaugcccaa

SEQ ID NO: 3487335 - RNA, 17 nt, Human
aggcaaauguguacaug

SEQ ID NO: 3487336 - RNA, 19 nt, Human
aggcaaauguuuaaacauu

SEQ ID NO: 3487337 - RNA, 14 nt, Human
aggcaaauguuuau

SEQ ID NO: 3487338 - RNA, 16 nt, Human
aggcaacauccaaaau

SEQ ID NO: 3487339 - RNA, 15 nt, Human
aggcaaccugauugu

SEQ ID NO: 3487340 - RNA, 19 nt, Human
aggcaaccugauuguaaac

SEQ ID NO: 3487341 - RNA, 19 nt, Human
aggcaacugaacaaaaaaa

SEQ ID NO: 3487342 - RNA, 14 nt, Human
aggcaacugaggca

SEQ ID NO: 3487343 - RNA, 15 nt, Human
aggcaacugaggcag

SEQ ID NO: 3487344 - RNA, 17 nt, Human
aggcaacuucaguccug

SEQ ID NO: 3487345 - RNA, 21 nt, Human
aggcaagaggggguggagggg

SEQ ID NO: 3487346 - RNA, 13 nt, Human
aggcaagaggggu

SEQ ID NO: 3487347 - RNA, 16 nt, Human
aggcaagauggcacag

SEQ ID NO: 3487348 - RNA, 17 nt, Human
aggcaagcaccuccugc

SEQ ID NO: 3487349 - RNA, 20 nt, Human
aggcaagcaccuccugccuc

SEQ ID NO: 3487350 - RNA, 22 nt, Human
aggcaagccaggcucacucaca

SEQ ID NO: 3487351 - RNA, 20 nt, Human
aggcaaggaaagaaauacag

SEQ ID NO: 3487352 - RNA, 22 nt, Human
aggcaaggcaggugccuccagg

SEQ ID NO: 3487353 - RNA, 20 nt, Human
aggcaaggcuaugugauuac

SEQ ID NO: 3487354 - RNA, 16 nt, Human
aggcaaggcugucaau

SEQ ID NO: 3487355 - RNA, 18 nt, Human
aggcaaggggugccuggg

SEQ ID NO: 3487356 - RNA, 22 nt, Human
aggcaaguuuucccugaaguua

SEQ ID NO: 3487357 - RNA, 13 nt, Human
aggcaaucauggu

SEQ ID NO: 3487358 - RNA, 22 nt, Human
aggcaaugauuguuaauuuaca

SEQ ID NO: 3487359 - RNA, 18 nt, Human
aggcacacaaggggcccu

SEQ ID NO: 3487360 - RNA, 14 nt, Human
aggcacacacugug

SEQ ID NO: 3487361 - RNA, 16 nt, Human
aggcacacacugugcu

SEQ ID NO: 3487362 - RNA, 19 nt, Human
aggcacacacugugcuuuc

SEQ ID NO: 3487363 - RNA, 20 nt, Human
aggcacacacugugcuuucu

SEQ ID NO: 3487364 - RNA, 16 nt, Human
aggcacacuucuucuu

SEQ ID NO: 3487365 - RNA, 20 nt, Human
aggcacacuucuucuugguc

SEQ ID NO: 3487366 - RNA, 14 nt, Human
aggcacagcugagu

SEQ ID NO: 3487367 - RNA, 14 nt, Human
aggcacaggcaggg

SEQ ID NO: 3487368 - RNA, 15 nt, Human
aggcacaggcagggc

SEQ ID NO: 3487369 - RNA, 14 nt, Human
aggcacauggagga

SEQ ID NO: 3487370 - RNA, 20 nt, Human
aggcaccaaaagaaguaaaa

SEQ ID NO: 3487371 - RNA, 14 nt, Human
aggcaccagaagaa

SEQ ID NO: 3487372 - RNA, 12 nt, Human
aggcaccaggaa

SEQ ID NO: 3487373 - RNA, 13 nt, Human
aggcaccaggaag

SEQ ID NO: 3487374 - RNA, 16 nt, Human
aggcaccaggaagccg

SEQ ID NO: 3487375 - RNA, 16 nt, Human
aggcaccagucccugu

SEQ ID NO: 3487376 - RNA, 20 nt, Human
aggcaccaguguccuccccu

SEQ ID NO: 3487377 - RNA, 14 nt, Human
aggcacccaucugu

SEQ ID NO: 3487378 - RNA, 12 nt, Human
aggcaccucaag

SEQ ID NO: 3487379 - RNA, 19 nt, Human
aggcaccucacagaaauga

SEQ ID NO: 3487380 - RNA, 13 nt, Human
aggcaccucuucc

SEQ ID NO: 3487381 - RNA, 21 nt, Human
aggcaccugguggccaugcuc

SEQ ID NO: 3487382 - RNA, 14 nt, Human
aggcacgaacccac

SEQ ID NO: 3487383 - RNA, 17 nt, Human
aggcacgaacccaccug

SEQ ID NO: 3487384 - RNA, 19 nt, Human
aggcacgaacccaccugcu

SEQ ID NO: 3487385 - RNA, 16 nt, Human
aggcacgggugguccc

SEQ ID NO: 3487386 - RNA, 15 nt, Human
aggcacuagccuuug

SEQ ID NO: 3487387 - RNA, 23 nt, Human
aggcacuagccuuuggcucugga

SEQ ID NO: 3487388 - RNA, 15 nt, Human
aggcacucuagauuc

SEQ ID NO: 3487389 - RNA, 17 nt, Human
aggcacugaagugcuua

SEQ ID NO: 3487390 - RNA, 19 nt, Human
aggcacugcaaaccgccac

SEQ ID NO: 3487391 - RNA, 14 nt, Human
aggcacugcccugg

SEQ ID NO: 3487392 - RNA, 16 nt, Human
aggcacugcugcccag

SEQ ID NO: 3487393 - RNA, 15 nt, Human
agacuugagaacuug

SEQ ID NO: 3487394 - RNA, 12 nt, Human
agacuugccaac

SEQ ID NO: 3487395 - RNA, 17 nt, Human
agacuugccaugugacu

SEQ ID NO: 3487396 - RNA, 13 nt, Human
agacuugcucucu

SEQ ID NO: 3487397 - RNA, 15 nt, Human
agacuuggauucuuu

SEQ ID NO: 3487398 - RNA, 23 nt, Human
agacuugguguccuuucccucca

SEQ ID NO: 3487399 - RNA, 22 nt, Human
agacuugguugguaggguggga

SEQ ID NO: 3487400 - RNA, 11 nt, Human
agacuuguugg

SEQ ID NO: 3487401 - RNA, 21 nt, Human
agacuuuaacauaagcuauuu

SEQ ID NO: 3487402 - RNA, 16 nt, Human
agacuuuaggcuuuca

SEQ ID NO: 3487403 - RNA, 17 nt, Human
agacuuuaggcuuucag

SEQ ID NO: 3487404 - RNA, 18 nt, Human
agacuuuccccauacucu

SEQ ID NO: 3487405 - RNA, 17 nt, Human
agacuuugaugucagca

SEQ ID NO: 3487406 - RNA, 21 nt, Human
agacuuuggaaaaugcauugu

SEQ ID NO: 3487407 - RNA, 15 nt, Human
agacuuuggaaagac

SEQ ID NO: 3487408 - RNA, 13 nt, Human
agacuuuuuggug

SEQ ID NO: 3487409 - RNA, 19 nt, Human
agacuuuuuuuaaauagua

SEQ ID NO: 3487410 - RNA, 15 nt, Human
agacuuuuuuuauga

SEQ ID NO: 3487411 - RNA, 14 nt, Human
agagaaaaaagcca

SEQ ID NO: 3487412 - RNA, 22 nt, Human
agagaaaaaauauuuuccugcc

SEQ ID NO: 3487413 - RNA, 15 nt, Human
agagaaaaacaaauu

SEQ ID NO: 3487414 - RNA, 13 nt, Human
agagaaaaagaaa

SEQ ID NO: 3487415 - RNA, 14 nt, Human
agagaaaaagaaau

SEQ ID NO: 3487416 - RNA, 20 nt, Human
agagaaaaagaaaugcaaaa

SEQ ID NO: 3487417 - RNA, 17 nt, Human
agagaaaacaugcagaa

SEQ ID NO: 3487418 - RNA, 20 nt, Human
agagaaaacuuauuugagug

SEQ ID NO: 3487419 - RNA, 14 nt, Human
agagaaaagaaaaa

SEQ ID NO: 3487420 - RNA, 21 nt, Human
agagaaaagaaaaaaaaagaa

SEQ ID NO: 3487421 - RNA, 16 nt, Human
agagaaaauaaaaagu

SEQ ID NO: 3487422 - RNA, 20 nt, Human
agagaaaauaaaaaguuaaa

SEQ ID NO: 3487423 - RNA, 14 nt, Human
agagaaaauauaug

SEQ ID NO: 3487424 - RNA, 17 nt, Human
agagaaaauguaaauaa

SEQ ID NO: 3487425 - RNA, 21 nt, Human
agagaaaauugaauuuaacaa

SEQ ID NO: 3487426 - RNA, 13 nt, Human
agagaaacaaacu

SEQ ID NO: 3487427 - RNA, 18 nt, Human
agagaaacaauaaagaga

SEQ ID NO: 3487428 - RNA, 14 nt, Human
agagaaaccagcuu

SEQ ID NO: 3487429 - RNA, 18 nt, Human
agagaaaccagcuuccuu

SEQ ID NO: 3487430 - RNA, 19 nt, Human
agagaaaccagcuuccuuc

SEQ ID NO: 3487431 - RNA, 17 nt, Human
agagaaaccguccucuu

SEQ ID NO: 3487432 - RNA, 23 nt, Human
agagaaaccguccucuuuuucca

SEQ ID NO: 3487433 - RNA, 12 nt, Human
agagaaacuuua

SEQ ID NO: 3487434 - RNA, 19 nt, Human
agagaaacuuugugcuaca

SEQ ID NO: 3487435 - RNA, 15 nt, Human
agagaaagaaaauga

SEQ ID NO: 3487436 - RNA, 14 nt, Human
agagaaagaagaga

SEQ ID NO: 3487437 - RNA, 17 nt, Human
agagaaagaagagacag

SEQ ID NO: 3487438 - RNA, 13 nt, Human
agagaaagagaga

SEQ ID NO: 3487439 - RNA, 18 nt, Human
agagaaagcacgugucuc

SEQ ID NO: 3487440 - RNA, 19 nt, Human
agagaaagcauauugacuu

SEQ ID NO: 3487441 - RNA, 17 nt, Human
agagaaaggccugcaca

SEQ ID NO: 3487442 - RNA, 20 nt, Human
agagaaaggccugcacacaa

SEQ ID NO: 3487443 - RNA, 21 nt, Human
agagaaaggggagcccacugu

SEQ ID NO: 3487444 - RNA, 23 nt, Human
agagaaaggggagcccacugucc

SEQ ID NO: 3487445 - RNA, 18 nt, Human
agagaaaguacuucucca

SEQ ID NO: 3487446 - RNA, 23 nt, Human
agagaaauaagugcccucuccca

SEQ ID NO: 3487447 - RNA, 14 nt, Human
agagaaauaugaag

SEQ ID NO: 3487448 - RNA, 14 nt, Human
agagaaauauggaa

SEQ ID NO: 3487449 - RNA, 15 nt, Human
agagaaauauuuuaa

SEQ ID NO: 3487450 - RNA, 18 nt, Human
agagaaauauuuuaauuu

SEQ ID NO: 3487451 - RNA, 13 nt, Human
agagaaauggcaa

SEQ ID NO: 3487452 - RNA, 14 nt, Human
agagaaaugucuuu

SEQ ID NO: 3487453 - RNA, 18 nt, Human
agagaacccagcccaccc

SEQ ID NO: 3487454 - RNA, 23 nt, Human
agagaaccucacgcaccucccau

SEQ ID NO: 3487455 - RNA, 14 nt, Human
agagaacgcagccc

SEQ ID NO: 3487456 - RNA, 15 nt, Human
agagaacgcagcccu

SEQ ID NO: 3487457 - RNA, 12 nt, Human
agagaacugaaa

SEQ ID NO: 3487458 - RNA, 14 nt, Human
agagaacugaaaag

SEQ ID NO: 3487459 - RNA, 12 nt, Human
agagaagaagaa

SEQ ID NO: 3487460 - RNA, 15 nt, Human
agagaagaagaaaaa

SEQ ID NO: 3487461 - RNA, 14 nt, Human
agagaagacaggcu

SEQ ID NO: 3487462 - RNA, 15 nt, Human
agagaagacaggcug

SEQ ID NO: 3487463 - RNA, 21 nt, Human
agagaagauggauaugaccag

SEQ ID NO: 3487464 - RNA, 15 nt, Human
agagaagcaaguaaa

SEQ ID NO: 3487465 - RNA, 22 nt, Human
agagaagcauucucauuggaaa

SEQ ID NO: 3487466 - RNA, 23 nt, Human
agagaagcauucucauuggaaau

SEQ ID NO: 3487467 - RNA, 12 nt, Human
agagaagccagc

SEQ ID NO: 3487468 - RNA, 13 nt, Human
agagaagccagcu

SEQ ID NO: 3487469 - RNA, 14 nt, Human
agagaagccagcuu

SEQ ID NO: 3487470 - RNA, 16 nt, Human
agagaagccaucaccu

SEQ ID NO: 3487471 - RNA, 21 nt, Human
agagaagccuucaagcucuga

SEQ ID NO: 3487472 - RNA, 22 nt, Human
agagaagccuucaagcucugag

SEQ ID NO: 3487473 - RNA, 20 nt, Human
agagaaggaaugucuuuggu

SEQ ID NO: 3487474 - RNA, 13 nt, Human
agagaaggagcca

SEQ ID NO: 3487475 - RNA, 18 nt, Human
agagaaggccucccuagc

SEQ ID NO: 3487476 - RNA, 12 nt, Human
agagaaggggag

SEQ ID NO: 3487477 - RNA, 18 nt, Human
agagaagucacagggcag

SEQ ID NO: 3487478 - RNA, 19 nt, Human
agagaagucacagggcagu

SEQ ID NO: 3487479 - RNA, 23 nt, Human
agagaagucacagggcaguaccu

SEQ ID NO: 3487480 - RNA, 15 nt, Human
agagaagugacaggg

SEQ ID NO: 3487481 - RNA, 17 nt, Human
agagaagugacagggaa

SEQ ID NO: 3487482 - RNA, 19 nt, Human
agagaagugacgguuccua

SEQ ID NO: 3487483 - RNA, 18 nt, Human
agagaagugccccugcug

SEQ ID NO: 3487484 - RNA, 12 nt, Human
agagaaguugua

SEQ ID NO: 3487485 - RNA, 13 nt, Human
agagaauauaaca

SEQ ID NO: 3487486 - RNA, 17 nt, Human
agagaauauaacaugaa

SEQ ID NO: 3487487 - RNA, 18 nt, Human
agagaauauaacaugaaa

SEQ ID NO: 3487488 - RNA, 12 nt, Human
agagaaucaaca

SEQ ID NO: 3487489 - RNA, 18 nt, Human
agagaaugaaagggccca

SEQ ID NO: 3487490 - RNA, 14 nt, Human
agagaaugcacaga

SEQ ID NO: 3487491 - RNA, 16 nt, Human
agagaaugcugaccug

SEQ ID NO: 3487492 - RNA, 18 nt, Human
agagaauguuauagugaa

SEQ ID NO: 3487493 - RNA, 13 nt, Human
agagacaaaauau

SEQ ID NO: 3487494 - RNA, 22 nt, Human
agagacaaacuguaaaaaaugu

SEQ ID NO: 3487495 - RNA, 14 nt, Human
agagacaagaagca

SEQ ID NO: 3487496 - RNA, 16 nt, Human
agagacaagaagcaaa

SEQ ID NO: 3487497 - RNA, 15 nt, Human
agagacaagacuucg

SEQ ID NO: 3487498 - RNA, 14 nt, Human
agagacaaguaauu

SEQ ID NO: 3487499 - RNA, 19 nt, Human
agagacaaguaauuucagu

SEQ ID NO: 3487500 - RNA, 19 nt, Human
agagacaauagcauuagaa

SEQ ID NO: 3487501 - RNA, 19 nt, Human
agagacacaagccuucggc

SEQ ID NO: 3487502 - RNA, 18 nt, Human
agagacacacugaagaag

SEQ ID NO: 3487503 - RNA, 15 nt, Human
agagacaccugcacc

SEQ ID NO: 3487504 - RNA, 19 nt, Human
agagacaccugcaccuccc

SEQ ID NO: 3487505 - RNA, 20 nt, Human
agagacaccugcaccucccc

SEQ ID NO: 3487506 - RNA, 21 nt, Human
agagacaccugcaccuccccc

SEQ ID NO: 3487507 - RNA, 15 nt, Human
agagacacugguggg

SEQ ID NO: 3487508 - RNA, 15 nt, Human
agagacagaaagcag

SEQ ID NO: 3487509 - RNA, 24 nt, Human
agagacagaaagcagaacagugau

SEQ ID NO: 3487510 - RNA, 20 nt, Human
agagacagaagcaggcugga

SEQ ID NO: 3487511 - RNA, 18 nt, Human
agagacagacuugagaac

SEQ ID NO: 3487512 - RNA, 13 nt, Human
agagacagagagg

SEQ ID NO: 3487513 - RNA, 14 nt, Human
agagacagcccagg

SEQ ID NO: 3487514 - RNA, 16 nt, Human
agagacagcccaggau

SEQ ID NO: 3487515 - RNA, 21 nt, Human
agagacagcuacacagagcuu

SEQ ID NO: 3487516 - RNA, 21 nt, Human
agagacaggaaaauccucugg

SEQ ID NO: 3487517 - RNA, 23 nt, Human
agagacaggaaaauccucuggcu

SEQ ID NO: 3487518 - RNA, 20 nt, Human
agagacaggguuucaccaug

SEQ ID NO: 3487519 - RNA, 12 nt, Human
agagacagucac

SEQ ID NO: 3487520 - RNA, 22 nt, Human
agagacaguuauuuauagucau

SEQ ID NO: 3487521 - RNA, 20 nt, Human
agagacaguugggugagaac

SEQ ID NO: 3487522 - RNA, 17 nt, Human
agagacauacuugaagg

SEQ ID NO: 3487523 - RNA, 23 nt, Human
agagacauacuugaagggccaga

SEQ ID NO: 3487524 - RNA, 24 nt, Human
agagacaucuuugggccugucccu

SEQ ID NO: 3487525 - RNA, 12 nt, Human
agagacauuccu

SEQ ID NO: 3487526 - RNA, 14 nt, Human
agagaccagggcuc

SEQ ID NO: 3487527 - RNA, 20 nt, Human
agagaccagggcuccagccc

SEQ ID NO: 3487528 - RNA, 23 nt, Human
agagaccaucccugaaggccccg

SEQ ID NO: 3487529 - RNA, 13 nt, Human
agagacccaagga

SEQ ID NO: 3487530 - RNA, 19 nt, Human
agagacccucugccaccag

SEQ ID NO: 3487531 - RNA, 15 nt, Human
agagaccguccucac

SEQ ID NO: 3487532 - RNA, 23 nt, Human
agagaccguccucaccccugucc

SEQ ID NO: 3487533 - RNA, 21 nt, Human
agagaccgucgggggcugagg

SEQ ID NO: 3487534 - RNA, 13 nt, Human
agagaccucauca

SEQ ID NO: 3487535 - RNA, 19 nt, Human
agagaccucaucaggauga

SEQ ID NO: 3487536 - RNA, 15 nt, Human
agagaccuccugccu

SEQ ID NO: 3487537 - RNA, 16 nt, Human
agagaccuuccagaaa

SEQ ID NO: 3487538 - RNA, 17 nt, Human
agagacgggcccuggug

SEQ ID NO: 3487539 - RNA, 16 nt, Human
agagacggugucuugu

SEQ ID NO: 3487540 - RNA, 21 nt, Human
agagacggugucuuguucugu

SEQ ID NO: 3487541 - RNA, 14 nt, Human
agagacguguacau

SEQ ID NO: 3487542 - RNA, 13 nt, Human
agagacucagccu

SEQ ID NO: 3487543 - RNA, 15 nt, Human
agagacucagccugc

SEQ ID NO: 3487544 - RNA, 20 nt, Human
aggaccccuccaugugggcu

SEQ ID NO: 3487545 - RNA, 15 nt, Human
aggacccugaagggg

SEQ ID NO: 3487546 - RNA, 19 nt, Human
aggacccugaaggggccau

SEQ ID NO: 3487547 - RNA, 18 nt, Human
aggacccugccaggcaca

SEQ ID NO: 3487548 - RNA, 20 nt, Human
aggacccugccaggcacagg

SEQ ID NO: 3487549 - RNA, 21 nt, Human
aggacccugccaggcacaggc

SEQ ID NO: 3487550 - RNA, 22 nt, Human
aggacccugccaggcacaggca

SEQ ID NO: 3487551 - RNA, 23 nt, Human
aggacccugccaggcacaggcag

SEQ ID NO: 3487552 - RNA, 19 nt, Human
aggacccuucagagguggc

SEQ ID NO: 3487553 - RNA, 23 nt, Human
aggaccguggcccugcccucucc

SEQ ID NO: 3487554 - RNA, 19 nt, Human
aggaccuagggauguucug

SEQ ID NO: 3487555 - RNA, 22 nt, Human
aggaccuagggauguucuggcc

SEQ ID NO: 3487556 - RNA, 21 nt, Human
aggaccuauguuugcucagaa

SEQ ID NO: 3487557 - RNA, 13 nt, Human
aggaccucaggug

SEQ ID NO: 3487558 - RNA, 15 nt, Human
aggaccuccaagcca

SEQ ID NO: 3487559 - RNA, 13 nt, Human
aggaccucccuuc

SEQ ID NO: 3487560 - RNA, 15 nt, Human
aggaccucccuuccg

SEQ ID NO: 3487561 - RNA, 22 nt, Human
aggaccuccucuucccccuucc

SEQ ID NO: 3487562 - RNA, 13 nt, Human
aggaccucugggc

SEQ ID NO: 3487563 - RNA, 13 nt, Human
aggaccugcaaac

SEQ ID NO: 3487564 - RNA, 14 nt, Human
aggaccugccugua

SEQ ID NO: 3487565 - RNA, 19 nt, Human
aggaccugggaccuccccu

SEQ ID NO: 3487566 - RNA, 13 nt, Human
aggaccuggggca

SEQ ID NO: 3487567 - RNA, 23 nt, Human
aggaccuggggcacaguccagga

SEQ ID NO: 3487568 - RNA, 17 nt, Human
aggaccuguauuuaagc

SEQ ID NO: 3487569 - RNA, 21 nt, Human
aggaccuucacucuaagaugu

SEQ ID NO: 3487570 - RNA, 14 nt, Human
aggaccuugggcca

SEQ ID NO: 3487571 - RNA, 15 nt, Human
aggaccuugggccaa

SEQ ID NO: 3487572 - RNA, 20 nt, Human
aggacgaacauccaaccuuc

SEQ ID NO: 3487573 - RNA, 16 nt, Human
aggacgcucucuggcc

SEQ ID NO: 3487574 - RNA, 13 nt, Human
aggacggccggcu

SEQ ID NO: 3487575 - RNA, 14 nt, Human
aggacguacguaau

SEQ ID NO: 3487576 - RNA, 18 nt, Human
aggacuaacacucagaag

SEQ ID NO: 3487577 - RNA, 20 nt, Human
aggacuaacacucagaagcc

SEQ ID NO: 3487578 - RNA, 21 nt, Human
aggacuaacacucagaagccu

SEQ ID NO: 3487579 - RNA, 23 nt, Human
aggacuaacacucagaagccugg

SEQ ID NO: 3487580 - RNA, 13 nt, Human
aggacuaauagaa

SEQ ID NO: 3487581 - RNA, 19 nt, Human
aggacuacguuaagggaag

SEQ ID NO: 3487582 - RNA, 20 nt, Human
aggacuacguuaagggaagg

SEQ ID NO: 3487583 - RNA, 22 nt, Human
aggacuagaaccuggagggcug

SEQ ID NO: 3487584 - RNA, 18 nt, Human
aggacuauagcccagguc

SEQ ID NO: 3487585 - RNA, 20 nt, Human
aggacuauagcccagguccu

SEQ ID NO: 3487586 - RNA, 17 nt, Human
aggacucaccacugccc

SEQ ID NO: 3487587 - RNA, 18 nt, Human
aggacucagaagccucug

SEQ ID NO: 3487588 - RNA, 14 nt, Human
aggacucagcuccc

SEQ ID NO: 3487589 - RNA, 18 nt, Human
aggacucagcuccccaga

SEQ ID NO: 3487590 - RNA, 12 nt, Human
aggacuccagcc

SEQ ID NO: 3487591 - RNA, 23 nt, Human
aggacuccaggcagcagacacau

SEQ ID NO: 3487592 - RNA, 20 nt, Human
aggacuccaggcccaaggcu

SEQ ID NO: 3487593 - RNA, 18 nt, Human
aggacucccaacccuggc

SEQ ID NO: 3487594 - RNA, 19 nt, Human
aggacucccaacccuggcu

SEQ ID NO: 3487595 - RNA, 13 nt, Human
aggacuccccagg

SEQ ID NO: 3487596 - RNA, 19 nt, Human
aggacuccccaggccaggc

SEQ ID NO: 3487597 - RNA, 19 nt, Human
aggacuccuccuuuuucca

SEQ ID NO: 3487598 - RNA, 14 nt, Human
aggacuccugaaaa

SEQ ID NO: 3487599 - RNA, 16 nt, Human
aggacucgcuuguaaa

SEQ ID NO: 3487600 - RNA, 17 nt, Human
aggacucgcuuguaaau

SEQ ID NO: 3487601 - RNA, 14 nt, Human
aggacucugaggcu

SEQ ID NO: 3487602 - RNA, 15 nt, Human
aggacucugcagccu

SEQ ID NO: 3487603 - RNA, 17 nt, Human
aggacucugcagccuca

SEQ ID NO: 3487604 - RNA, 12 nt, Human
aggacucugccu

SEQ ID NO: 3487605 - RNA, 16 nt, Human
aggacucugccuccuc

SEQ ID NO: 3487606 - RNA, 19 nt, Human
aggacugaauuaugaaacu

SEQ ID NO: 3487607 - RNA, 20 nt, Human
aggacugaauuguccccagu

SEQ ID NO: 3487608 - RNA, 20 nt, Human
aggacugagcacccucugga

SEQ ID NO: 3487609 - RNA, 15 nt, Human
aggacugaugucucc

SEQ ID NO: 3487610 - RNA, 19 nt, Human
aggacugcaccauugcugc

SEQ ID NO: 3487611 - RNA, 19 nt, Human
aggacugcaugguaauuua

SEQ ID NO: 3487612 - RNA, 18 nt, Human
aggacugccccgugcaga

SEQ ID NO: 3487613 - RNA, 21 nt, Human
aggacugccgaccgaggcugg

SEQ ID NO: 3487614 - RNA, 22 nt, Human
aggacugccgaccgaggcugga

SEQ ID NO: 3487615 - RNA, 22 nt, Human
aggacuggcuuugucccacagc

SEQ ID NO: 3487616 - RNA, 21 nt, Human
aggacugggagcccccagccu

SEQ ID NO: 3487617 - RNA, 22 nt, Human
aggacugggagcccccagccug

SEQ ID NO: 3487618 - RNA, 23 nt, Human
aggacugggagcccccagccugu

SEQ ID NO: 3487619 - RNA, 17 nt, Human
aggacuguauuugugac

SEQ ID NO: 3487620 - RNA, 22 nt, Human
aggacuguauuugugacuaauu

SEQ ID NO: 3487621 - RNA, 17 nt, Human
aggacugugacaggcag

SEQ ID NO: 3487622 - RNA, 19 nt, Human
aggacugugacaggcagca

SEQ ID NO: 3487623 - RNA, 22 nt, Human
aggacugugacaggcagcagag

SEQ ID NO: 3487624 - RNA, 22 nt, Human
aggacuguuacucaaugugugc

SEQ ID NO: 3487625 - RNA, 17 nt, Human
aggacuuaacggcucca

SEQ ID NO: 3487626 - RNA, 21 nt, Human
aggacuuccccggagggcugc

SEQ ID NO: 3487627 - RNA, 15 nt, Human
aggacuucccugugu

SEQ ID NO: 3487628 - RNA, 21 nt, Human
aggacuuccuguccagcucca

SEQ ID NO: 3487629 - RNA, 21 nt, Human
aggacuucuuuaauuuuggaa

SEQ ID NO: 3487630 - RNA, 22 nt, Human
aggacuucuuuaauuuuggaau

SEQ ID NO: 3487631 - RNA, 20 nt, Human
aggacuuggucugauuucag

SEQ ID NO: 3487632 - RNA, 13 nt, Human
aggacuugugucu

SEQ ID NO: 3487633 - RNA, 16 nt, Human
aggacuugugucucug

SEQ ID NO: 3487634 - RNA, 21 nt, Human
aggacuuuauagaucagccag

SEQ ID NO: 3487635 - RNA, 21 nt, Human
aggacuuuccuaaauguuuaa

SEQ ID NO: 3487636 - RNA, 11 nt, Human
aggacuuugca

SEQ ID NO: 3487637 - RNA, 13 nt, Human
aggacuuuguaca

SEQ ID NO: 3487638 - RNA, 19 nt, Human
aggacuuuucuuuguggcu

SEQ ID NO: 3487639 - RNA, 12 nt, Human
aggagaaacaca

SEQ ID NO: 3487640 - RNA, 14 nt, Human
aggagaaacacauc

SEQ ID NO: 3487641 - RNA, 18 nt, Human
aggagaaacagagacagg

SEQ ID NO: 3487642 - RNA, 14 nt, Human
aggagaacaaauau

SEQ ID NO: 3487643 - RNA, 16 nt, Human
aggagaacuugcugcc

SEQ ID NO: 3487644 - RNA, 18 nt, Human
aggagaacuugcugccuc

SEQ ID NO: 3487645 - RNA, 18 nt, Human
aggagaagaguugaggaa

SEQ ID NO: 3487646 - RNA, 14 nt, Human
aggagaagccagga

SEQ ID NO: 3487647 - RNA, 13 nt, Human
aggagaagcucag

SEQ ID NO: 3487648 - RNA, 20 nt, Human
aggagaaucacuugaaccug

SEQ ID NO: 3487649 - RNA, 18 nt, Human
aggagaaucaucaggacc

SEQ ID NO: 3487650 - RNA, 18 nt, Human
aggagaauccaagcgagg

SEQ ID NO: 3487651 - RNA, 16 nt, Human
aggagaaugaaaugua

SEQ ID NO: 3487652 - RNA, 14 nt, Human
aggagaaugaauca

SEQ ID NO: 3487653 - RNA, 15 nt, Human
aggagaaugagccuc

SEQ ID NO: 3487654 - RNA, 20 nt, Human
aggagaauugcuugaaccug

SEQ ID NO: 3487655 - RNA, 11 nt, Human
aggagacacaa

SEQ ID NO: 3487656 - RNA, 19 nt, Human
aggagacacaacaacuccu

SEQ ID NO: 3487657 - RNA, 18 nt, Human
aggagacacaccugaggc

SEQ ID NO: 3487658 - RNA, 14 nt, Human
aggagacacagaug

SEQ ID NO: 3487659 - RNA, 20 nt, Human
aggagacacguguggcgggc

SEQ ID NO: 3487660 - RNA, 22 nt, Human
aggagacacugugcuauaaauc

SEQ ID NO: 3487661 - RNA, 13 nt, Human
aggagacaggcag

SEQ ID NO: 3487662 - RNA, 18 nt, Human
aggagacaggcagagcug

SEQ ID NO: 3487663 - RNA, 17 nt, Human
aggagaccaaggcggga

SEQ ID NO: 3487664 - RNA, 14 nt, Human
aggagacccacagg

SEQ ID NO: 3487665 - RNA, 14 nt, Human
aggagacucaccuc

SEQ ID NO: 3487666 - RNA, 21 nt, Human
aggagacuguggagacugcuc

SEQ ID NO: 3487667 - RNA, 16 nt, Human
aggagagaaaauauau

SEQ ID NO: 3487668 - RNA, 17 nt, Human
aggagagaaaauauaug

SEQ ID NO: 3487669 - RNA, 17 nt, Human
aggagagaaggggagga

SEQ ID NO: 3487670 - RNA, 14 nt, Human
aggagagacacugg

SEQ ID NO: 3487671 - RNA, 21 nt, Human
aggagagacucccaugaagcc

SEQ ID NO: 3487672 - RNA, 22 nt, Human
aggagagacucccaugaagccu

SEQ ID NO: 3487673 - RNA, 20 nt, Human
aggagagagaucaugagaaa

SEQ ID NO: 3487674 - RNA, 19 nt, Human
aggagagcaucggccuagg

SEQ ID NO: 3487675 - RNA, 12 nt, Human
aggagagccaga

SEQ ID NO: 3487676 - RNA, 15 nt, Human
aggagagccagagaa

SEQ ID NO: 3487677 - RNA, 16 nt, Human
aggagagcccuucauu

SEQ ID NO: 3487678 - RNA, 13 nt, Human
aggagagccugcu

SEQ ID NO: 3487679 - RNA, 18 nt, Human
aggagagccugcugcaug

SEQ ID NO: 3487680 - RNA, 13 nt, Human
aggagagccuggu

SEQ ID NO: 3487681 - RNA, 15 nt, Human
aggagaggagagagg

SEQ ID NO: 3487682 - RNA, 16 nt, Human
aggagaggagagaggc

SEQ ID NO: 3487683 - RNA, 17 nt, Human
aggagaggagagaggca

SEQ ID NO: 3487684 - RNA, 14 nt, Human
aggagaggagagcc

SEQ ID NO: 3487685 - RNA, 15 nt, Human
aggagaggagagcca

SEQ ID NO: 3487686 - RNA, 15 nt, Human
aggagaggagagggg

SEQ ID NO: 3487687 - RNA, 21 nt, Human
aggagaggaugagagcccaga

SEQ ID NO: 3487688 - RNA, 19 nt, Human
aggagagggaaaauguuuu

SEQ ID NO: 3487689 - RNA, 20 nt, Human
aggagagggcgcuccucucu

SEQ ID NO: 3487690 - RNA, 18 nt, Human
aggagaggggaagggcca

SEQ ID NO: 3487691 - RNA, 19 nt, Human
aggagaggggaagggccag

SEQ ID NO: 3487692 - RNA, 18 nt, Human
aggagaggggcacagggu

SEQ ID NO: 3487693 - RNA, 17 nt, Human
aggcacuguaguucuaa

SEQ ID NO: 3487694 - RNA, 21 nt, Human
aggcacuguaguucuaagacu

SEQ ID NO: 3487695 - RNA, 16 nt, Human
aggcacuuauuguaaa

SEQ ID NO: 3487696 - RNA, 17 nt, Human
aggcacuuauuguaaau

SEQ ID NO: 3487697 - RNA, 21 nt, Human
aggcacuuauuguaaauuuua

SEQ ID NO: 3487698 - RNA, 15 nt, Human
aggcacuucugccug

SEQ ID NO: 3487699 - RNA, 19 nt, Human
aggcacuugagggggaagg

SEQ ID NO: 3487700 - RNA, 15 nt, Human
aggcacuuuaaaaca

SEQ ID NO: 3487701 - RNA, 22 nt, Human
aggcacuuuagggcuguaaaau

SEQ ID NO: 3487702 - RNA, 23 nt, Human
aggcacuuuggggguuugagggu

SEQ ID NO: 3487703 - RNA, 15 nt, Human
aggcagaagaauuga

SEQ ID NO: 3487704 - RNA, 11 nt, Human
aggcagacaca

SEQ ID NO: 3487705 - RNA, 14 nt, Human
aggcagacacaggg

SEQ ID NO: 3487706 - RNA, 15 nt, Human
aggcagacacaggga

SEQ ID NO: 3487707 - RNA, 13 nt, Human
aggcagacagcag

SEQ ID NO: 3487708 - RNA, 19 nt, Human
aggcagacagcagcucagg

SEQ ID NO: 3487709 - RNA, 18 nt, Human
aggcagacuacacaggau

SEQ ID NO: 3487710 - RNA, 14 nt, Human
aggcagagaaaucu

SEQ ID NO: 3487711 - RNA, 14 nt, Human
aggcagagcccaga

SEQ ID NO: 3487712 - RNA, 14 nt, Human
aggcagaggcccag

SEQ ID NO: 3487713 - RNA, 19 nt, Human
aggcagaggcccaggcugc

SEQ ID NO: 3487714 - RNA, 22 nt, Human
aggcagaggcccaggcugccgu

SEQ ID NO: 3487715 - RNA, 20 nt, Human
aggcagagugccccaccugc

SEQ ID NO: 3487716 - RNA, 19 nt, Human
aggcagaguuugccuuccu

SEQ ID NO: 3487717 - RNA, 16 nt, Human
aggcagauccaggacu

SEQ ID NO: 3487718 - RNA, 15 nt, Human
aggcagaucugugcc

SEQ ID NO: 3487719 - RNA, 16 nt, Human
aggcagaucugugccc

SEQ ID NO: 3487720 - RNA, 17 nt, Human
aggcagauugaaaagga

SEQ ID NO: 3487721 - RNA, 16 nt, Human
aggcagcaaggcccga

SEQ ID NO: 3487722 - RNA, 18 nt, Human
aggcagcaaggcccgagc

SEQ ID NO: 3487723 - RNA, 23 nt, Human
aggcagcagugugaggccagggc

SEQ ID NO: 3487724 - RNA, 16 nt, Human
aggcagcauguauagu

SEQ ID NO: 3487725 - RNA, 16 nt, Human
aggcagccaggccaca

SEQ ID NO: 3487726 - RNA, 20 nt, Human
aggcagccagugcccugagc

SEQ ID NO: 3487727 - RNA, 16 nt, Human
aggcagccuccagccu

SEQ ID NO: 3487728 - RNA, 17 nt, Human
aggcagccugagagucu

SEQ ID NO: 3487729 - RNA, 20 nt, Human
aggcagccuggacauagaga

SEQ ID NO: 3487730 - RNA, 21 nt, Human
aggcagcuguugucucuucuc

SEQ ID NO: 3487731 - RNA, 19 nt, Human
aggcaggaacaaacagggc

SEQ ID NO: 3487732 - RNA, 13 nt, Human
aggcaggaagccc

SEQ ID NO: 3487733 - RNA, 14 nt, Human
aggcaggacaugcu

SEQ ID NO: 3487734 - RNA, 16 nt, Human
aggcaggauugaaaau

SEQ ID NO: 3487735 - RNA, 18 nt, Human
aggcaggauugaaaaugu

SEQ ID NO: 3487736 - RNA, 14 nt, Human
aggcaggcagggcu

SEQ ID NO: 3487737 - RNA, 20 nt, Human
aggcaggcagggcucuccug

SEQ ID NO: 3487738 - RNA, 17 nt, Human
aggcaggcauggcccug

SEQ ID NO: 3487739 - RNA, 18 nt, Human
aggcaggcauggcccugg

SEQ ID NO: 3487740 - RNA, 20 nt, Human
aggcaggcauggcccugggc

SEQ ID NO: 3487741 - RNA, 14 nt, Human
aggcaggcauugag

SEQ ID NO: 3487742 - RNA, 19 nt, Human
aggcaggccuauuucauca

SEQ ID NO: 3487743 - RNA, 22 nt, Human
aggcaggcuaaggcguggagcu

SEQ ID NO: 3487744 - RNA, 14 nt, Human
aggcaggcuuuguu

SEQ ID NO: 3487745 - RNA, 22 nt, Human
aggcagggaaaggcucugaaag

SEQ ID NO: 3487746 - RNA, 16 nt, Human
aggcagggagggccug

SEQ ID NO: 3487747 - RNA, 14 nt, Human
aggcagggauuuga

SEQ ID NO: 3487748 - RNA, 15 nt, Human
aggcagggauuugag

SEQ ID NO: 3487749 - RNA, 24 nt, Human
aggcagggcaaaugacaugcacug

SEQ ID NO: 3487750 - RNA, 16 nt, Human
aggcagggcaggacca

SEQ ID NO: 3487751 - RNA, 21 nt, Human
aggcagggccuugcccagaga

SEQ ID NO: 3487752 - RNA, 22 nt, Human
aggcagggcucuccuggcuucc

SEQ ID NO: 3487753 - RNA, 22 nt, Human
aggcagggcucucuuuccuucu

SEQ ID NO: 3487754 - RNA, 18 nt, Human
aggcaggggcccugcagc

SEQ ID NO: 3487755 - RNA, 19 nt, Human
aggcaggggcccugcagcu

SEQ ID NO: 3487756 - RNA, 20 nt, Human
aggcaggggcccugcagcuc

SEQ ID NO: 3487757 - RNA, 21 nt, Human
aggcaggggcccugcagcucu

SEQ ID NO: 3487758 - RNA, 15 nt, Human
aggcaggggccucca

SEQ ID NO: 3487759 - RNA, 14 nt, Human
aggcaggggcuucc

SEQ ID NO: 3487760 - RNA, 15 nt, Human
aggcaggggcuuccu

SEQ ID NO: 3487761 - RNA, 23 nt, Human
aggcagggggaaggugggguccu

SEQ ID NO: 3487762 - RNA, 14 nt, Human
aggcagggucagga

SEQ ID NO: 3487763 - RNA, 17 nt, Human
aggcagggucaggagag

SEQ ID NO: 3487764 - RNA, 19 nt, Human
aggcagggucaggagaggg

SEQ ID NO: 3487765 - RNA, 12 nt, Human
aggcagggucuc

SEQ ID NO: 3487766 - RNA, 20 nt, Human
aggcagggucucacucuguc

SEQ ID NO: 3487767 - RNA, 22 nt, Human
aggcagggucucacucugucgc

SEQ ID NO: 3487768 - RNA, 15 nt, Human
aggcagguagccagg

SEQ ID NO: 3487769 - RNA, 12 nt, Human
aggcaggucccc

SEQ ID NO: 3487770 - RNA, 14 nt, Human
aggcagguccccag

SEQ ID NO: 3487771 - RNA, 21 nt, Human
aggcaggucuugaacuccugg

SEQ ID NO: 3487772 - RNA, 17 nt, Human
aggcaggugacagugag

SEQ ID NO: 3487773 - RNA, 17 nt, Human
aggcaggugccuccagg

SEQ ID NO: 3487774 - RNA, 18 nt, Human
aggcaggugccuccaggu

SEQ ID NO: 3487775 - RNA, 20 nt, Human
aggcaggugccuccaggugu

SEQ ID NO: 3487776 - RNA, 22 nt, Human
aggcaguaggccggugugccug

SEQ ID NO: 3487777 - RNA, 22 nt, Human
aggcagucgggggcuggccuag

SEQ ID NO: 3487778 - RNA, 19 nt, Human
aggcagugaugcuggaugc

SEQ ID NO: 3487779 - RNA, 16 nt, Human
aggcagugggucccac

SEQ ID NO: 3487780 - RNA, 18 nt, Human
aggcagugggucccacuu

SEQ ID NO: 3487781 - RNA, 14 nt, Human
aggcagugucauuu

SEQ ID NO: 3487782 - RNA, 21 nt, Human
aggcaguuagagaugccuccc

SEQ ID NO: 3487783 - RNA, 18 nt, Human
aggcaguucaaagcagga

SEQ ID NO: 3487784 - RNA, 15 nt, Human
aggcaguuugaggau

SEQ ID NO: 3487785 - RNA, 23 nt, Human
aggcaguuugaggauuaguuuag

SEQ ID NO: 3487786 - RNA, 14 nt, Human
aggcaguuugcaaa

SEQ ID NO: 3487787 - RNA, 14 nt, Human
aggcaguuuucuaa

SEQ ID NO: 3487788 - RNA, 22 nt, Human
aggcauaaagucagggguuccc

SEQ ID NO: 3487789 - RNA, 20 nt, Human
aggcauacgagagcagaggu

SEQ ID NO: 3487790 - RNA, 14 nt, Human
aggcauaggccugg

SEQ ID NO: 3487791 - RNA, 17 nt, Human
aggcauaggccugggug

SEQ ID NO: 3487792 - RNA, 18 nt, Human
aggcauaggccugggugc

SEQ ID NO: 3487793 - RNA, 20 nt, Human
aggcauaggccugggugcug

SEQ ID NO: 3487794 - RNA, 22 nt, Human
aggcauauugcuuuuucuaaug

SEQ ID NO: 3487795 - RNA, 19 nt, Human
aggcaucagucccuaugua

SEQ ID NO: 3487796 - RNA, 13 nt, Human
aggcaucccaggg

SEQ ID NO: 3487797 - RNA, 23 nt, Human
aggcaucccaggggaccacaccu

SEQ ID NO: 3487798 - RNA, 19 nt, Human
aggcaucggggagccggga

SEQ ID NO: 3487799 - RNA, 19 nt, Human
aggcaucgucaugcacagu

SEQ ID NO: 3487800 - RNA, 15 nt, Human
aggcaugccucugau

SEQ ID NO: 3487801 - RNA, 23 nt, Human
aggcaugccucugauaugggacu

SEQ ID NO: 3487802 - RNA, 13 nt, Human
aggcauggcccug

SEQ ID NO: 3487803 - RNA, 14 nt, Human
aggcauggcccugg

SEQ ID NO: 3487804 - RNA, 16 nt, Human
aggcauggcccugggc

SEQ ID NO: 3487805 - RNA, 21 nt, Human
aggcauggcccugggguccca

SEQ ID NO: 3487806 - RNA, 17 nt, Human
aggcaugggccaccacg

SEQ ID NO: 3487807 - RNA, 19 nt, Human
aggcaugggugcaaggaaa

SEQ ID NO: 3487808 - RNA, 20 nt, Human
aggcaugggugcaaggaaaa

SEQ ID NO: 3487809 - RNA, 15 nt, Human
aggcaugguggccca

SEQ ID NO: 3487810 - RNA, 12 nt, Human
aggcauguccug

SEQ ID NO: 3487811 - RNA, 19 nt, Human
aggcaugugaugagaggaa

SEQ ID NO: 3487812 - RNA, 22 nt, Human
aggcaugugccacccacccaac

SEQ ID NO: 3487813 - RNA, 23 nt, Human
aggcaugugucaccaugcccagc

SEQ ID NO: 3487814 - RNA, 17 nt, Human
aggcauguucucugagg

SEQ ID NO: 3487815 - RNA, 22 nt, Human
aggcauguucucugaggacacu

SEQ ID NO: 3487816 - RNA, 13 nt, Human
aggcauuaacaca

SEQ ID NO: 3487817 - RNA, 17 nt, Human
aggcauuccccaggagg

SEQ ID NO: 3487818 - RNA, 22 nt, Human
aggcauuccccaggaggccagc

SEQ ID NO: 3487819 - RNA, 13 nt, Human
aggcauugccaag

SEQ ID NO: 3487820 - RNA, 16 nt, Human
aggcauugccaagggc

SEQ ID NO: 3487821 - RNA, 21 nt, Human
aggcauugccaagggcuuugu

SEQ ID NO: 3487822 - RNA, 18 nt, Human
aggcauugugggaagggg

SEQ ID NO: 3487823 - RNA, 20 nt, Human
aggcauuuaggccaugggac

SEQ ID NO: 3487824 - RNA, 13 nt, Human
aggcauuuccugg

SEQ ID NO: 3487825 - RNA, 15 nt, Human
aggcauuuccugggu

SEQ ID NO: 3487826 - RNA, 20 nt, Human
aggcauuucuaucacauauu

SEQ ID NO: 3487827 - RNA, 21 nt, Human
aggcauuugcaggguccucuu

SEQ ID NO: 3487828 - RNA, 20 nt, Human
aggcauuugcugaauacaga

SEQ ID NO: 3487829 - RNA, 18 nt, Human
aggcauuuggcauuuauu

SEQ ID NO: 3487830 - RNA, 17 nt, Human
aggccaaacaggcccuc

SEQ ID NO: 3487831 - RNA, 16 nt, Human
aggccaaaccucuguu

SEQ ID NO: 3487832 - RNA, 17 nt, Human
aggccaaaccucuguuc

SEQ ID NO: 3487833 - RNA, 18 nt, Human
aggccaaaccucuguuca

SEQ ID NO: 3487834 - RNA, 13 nt, Human
aggccaaacugcu

SEQ ID NO: 3487835 - RNA, 21 nt, Human
aggccaaacuggcaaacuuca

SEQ ID NO: 3487836 - RNA, 13 nt, Human
aggccaaagacaa

SEQ ID NO: 3487837 - RNA, 15 nt, Human
aggccaaagacaaau

SEQ ID NO: 3487838 - RNA, 17 nt, Human
aggccaaagacaaauag

SEQ ID NO: 3487839 - RNA, 19 nt, Human
aggccaaagacaaauagua

SEQ ID NO: 3487840 - RNA, 21 nt, Human
aggccaaagagucuccaguuu

SEQ ID NO: 3487841 - RNA, 14 nt, Human
aggccaaaggaagc

SEQ ID NO: 3487842 - RNA, 16 nt, Human
agagacuccagcuggg

SEQ ID NO: 3487843 - RNA, 16 nt, Human
agagacucccaugaag

SEQ ID NO: 3487844 - RNA, 11 nt, Human
agagacuccug

SEQ ID NO: 3487845 - RNA, 15 nt, Human
agagacuccugcagg

SEQ ID NO: 3487846 - RNA, 17 nt, Human
agagacuccugcaggca

SEQ ID NO: 3487847 - RNA, 17 nt, Human
agagacuggagcaucug

SEQ ID NO: 3487848 - RNA, 13 nt, Human
agagacugggaag

SEQ ID NO: 3487849 - RNA, 13 nt, Human
agagacuguagau

SEQ ID NO: 3487850 - RNA, 18 nt, Human
agagacuuguuuuggaug

SEQ ID NO: 3487851 - RNA, 17 nt, Human
agagacuuuuaaucaga

SEQ ID NO: 3487852 - RNA, 17 nt, Human
agagacuuuuuucuagu

SEQ ID NO: 3487853 - RNA, 19 nt, Human
agagagaaaacuuauuuga

SEQ ID NO: 3487854 - RNA, 12 nt, Human
agagagaaaaua

SEQ ID NO: 3487855 - RNA, 16 nt, Human
agagagaaaauaaaaa

SEQ ID NO: 3487856 - RNA, 20 nt, Human
agagagaaaauaaaaaguua

SEQ ID NO: 3487857 - RNA, 14 nt, Human
agagagaaagccag

SEQ ID NO: 3487858 - RNA, 15 nt, Human
agagagaaagccagg

SEQ ID NO: 3487859 - RNA, 13 nt, Human
agagagaaauucu

SEQ ID NO: 3487860 - RNA, 14 nt, Human
agagagaaauucug

SEQ ID NO: 3487861 - RNA, 21 nt, Human
agagagaaauucuguuaaaau

SEQ ID NO: 3487862 - RNA, 20 nt, Human
agagagaacaacuacuguga

SEQ ID NO: 3487863 - RNA, 16 nt, Human
agagagaacaggacua

SEQ ID NO: 3487864 - RNA, 19 nt, Human
agagagaaccuaacuguau

SEQ ID NO: 3487865 - RNA, 18 nt, Human
agagagaagacccuucuc

SEQ ID NO: 3487866 - RNA, 13 nt, Human
agagagagaagug

SEQ ID NO: 3487867 - RNA, 17 nt, Human
agagagagagacagaga

SEQ ID NO: 3487868 - RNA, 12 nt, Human
agagagagagag

SEQ ID NO: 3487869 - RNA, 15 nt, Human
agagagagaggacag

SEQ ID NO: 3487870 - RNA, 15 nt, Human
agagagaggcaaugg

SEQ ID NO: 3487871 - RNA, 11 nt, Human
agagagcaaga

SEQ ID NO: 3487872 - RNA, 19 nt, Human
agagagcagcuucugccac

SEQ ID NO: 3487873 - RNA, 23 nt, Human
agagagcagcuucugccacuucc

SEQ ID NO: 3487874 - RNA, 19 nt, Human
agagagccauuuugugaau

SEQ ID NO: 3487875 - RNA, 18 nt, Human
agagagcccgaggaggug

SEQ ID NO: 3487876 - RNA, 14 nt, Human
agagagccugcagg

SEQ ID NO: 3487877 - RNA, 13 nt, Human
agagagcgcagcc

SEQ ID NO: 3487878 - RNA, 20 nt, Human
agagagcgcagccgccuuca

SEQ ID NO: 3487879 - RNA, 21 nt, Human
agagagcggucucaggcuggu

SEQ ID NO: 3487880 - RNA, 12 nt, Human
agagagcuggua

SEQ ID NO: 3487881 - RNA, 23 nt, Human
agagagcugguaguuaguagcau

SEQ ID NO: 3487882 - RNA, 16 nt, Human
agagagcuucuguugc

SEQ ID NO: 3487883 - RNA, 20 nt, Human
agagagcuucuguugcugcc

SEQ ID NO: 3487884 - RNA, 23 nt, Human
agagagcuucuguugcugccuca

SEQ ID NO: 3487885 - RNA, 16 nt, Human
agagaggagaaacaca

SEQ ID NO: 3487886 - RNA, 18 nt, Human
agagaggagaaacacauc

SEQ ID NO: 3487887 - RNA, 17 nt, Human
agagaggaguucaauga

SEQ ID NO: 3487888 - RNA, 21 nt, Human
agagaggaguucaaugaucua

SEQ ID NO: 3487889 - RNA, 22 nt, Human
agagaggcagaagaacccuggc

SEQ ID NO: 3487890 - RNA, 14 nt, Human
agagaggcagagag

SEQ ID NO: 3487891 - RNA, 12 nt, Human
agagaggccauu

SEQ ID NO: 3487892 - RNA, 17 nt, Human
agagagggaggcaagcc

SEQ ID NO: 3487893 - RNA, 18 nt, Human
agagagggaggcaagccc

SEQ ID NO: 3487894 - RNA, 22 nt, Human
agagagggugaguccuccagaa

SEQ ID NO: 3487895 - RNA, 15 nt, Human
agagagucccacugc

SEQ ID NO: 3487896 - RNA, 18 nt, Human
agagagucccacugccuc

SEQ ID NO: 3487897 - RNA, 22 nt, Human
agagaguccucuggauggcacc

SEQ ID NO: 3487898 - RNA, 16 nt, Human
agagaguggcuccucc

SEQ ID NO: 3487899 - RNA, 15 nt, Human
agagaguuaaucaac

SEQ ID NO: 3487900 - RNA, 22 nt, Human
agagaguuaaucaacugaaagu

SEQ ID NO: 3487901 - RNA, 22 nt, Human
agagauaccaagaugccaucug

SEQ ID NO: 3487902 - RNA, 14 nt, Human
agagauagccugug

SEQ ID NO: 3487903 - RNA, 15 nt, Human
agagauagccugugg

SEQ ID NO: 3487904 - RNA, 16 nt, Human
agagauauaucugaaa

SEQ ID NO: 3487905 - RNA, 17 nt, Human
agagauauggcagcgaa

SEQ ID NO: 3487906 - RNA, 17 nt, Human
agagauauuuuaaaaug

SEQ ID NO: 3487907 - RNA, 20 nt, Human
agagauauuuugggcaugug

SEQ ID NO: 3487908 - RNA, 13 nt, Human
agagauauuuugu

SEQ ID NO: 3487909 - RNA, 14 nt, Human
agagaucaggaaga

SEQ ID NO: 3487910 - RNA, 15 nt, Human
agagaucaggaagag

SEQ ID NO: 3487911 - RNA, 14 nt, Human
agagauccaaagac

SEQ ID NO: 3487912 - RNA, 16 nt, Human
agagauccaaagacuc

SEQ ID NO: 3487913 - RNA, 14 nt, Human
agagaucugcuguc

SEQ ID NO: 3487914 - RNA, 14 nt, Human
agagaugagcuuuc

SEQ ID NO: 3487915 - RNA, 15 nt, Human
agagaugagcuuucu

SEQ ID NO: 3487916 - RNA, 16 nt, Human
agagaugcagaaauau

SEQ ID NO: 3487917 - RNA, 17 nt, Human
agagaugcagaaauauu

SEQ ID NO: 3487918 - RNA, 12 nt, Human
agagaugccucc

SEQ ID NO: 3487919 - RNA, 14 nt, Human
agagaugccuccac

SEQ ID NO: 3487920 - RNA, 21 nt, Human
agagaugccuccaccgcugcc

SEQ ID NO: 3487921 - RNA, 14 nt, Human
agagaugccucccu

SEQ ID NO: 3487922 - RNA, 15 nt, Human
agagaugccucccug

SEQ ID NO: 3487923 - RNA, 13 nt, Human
agagauggaggag

SEQ ID NO: 3487924 - RNA, 14 nt, Human
agagauggaggagg

SEQ ID NO: 3487925 - RNA, 18 nt, Human
agagauggagucuugcua

SEQ ID NO: 3487926 - RNA, 20 nt, Human
agagauggcuuacaaaaaga

SEQ ID NO: 3487927 - RNA, 19 nt, Human
agagaugggagcuccucuc

SEQ ID NO: 3487928 - RNA, 17 nt, Human
agagaugucaucagagc

SEQ ID NO: 3487929 - RNA, 21 nt, Human
agagaugugcaauugauuucu

SEQ ID NO: 3487930 - RNA, 15 nt, Human
agagaugugcaccca

SEQ ID NO: 3487931 - RNA, 17 nt, Human
agagaugugcacccaug

SEQ ID NO: 3487932 - RNA, 14 nt, Human
agagauguguaauu

SEQ ID NO: 3487933 - RNA, 13 nt, Human
agagauguguguu

SEQ ID NO: 3487934 - RNA, 15 nt, Human
agagauguguguuga

SEQ ID NO: 3487935 - RNA, 20 nt, Human
agagauguguguugauacug

SEQ ID NO: 3487936 - RNA, 16 nt, Human
agagauuaccuccuga

SEQ ID NO: 3487937 - RNA, 13 nt, Human
aggcuccuuccug

SEQ ID NO: 3487938 - RNA, 15 nt, Human
aggcuccuuccuguc

SEQ ID NO: 3487939 - RNA, 17 nt, Human
aggcucgagcaugccug

SEQ ID NO: 3487940 - RNA, 14 nt, Human
aggcucgauuuugu

SEQ ID NO: 3487941 - RNA, 23 nt, Human
aggcucgauuuuguaucugcagg

SEQ ID NO: 3487942 - RNA, 15 nt, Human
aggcucgccuucccu

SEQ ID NO: 3487943 - RNA, 16 nt, Human
aggcucgccuucccuc

SEQ ID NO: 3487944 - RNA, 19 nt, Human
aggcucgccuucccuccug

SEQ ID NO: 3487945 - RNA, 20 nt, Human
aggcucuaaccacacagccu

SEQ ID NO: 3487946 - RNA, 21 nt, Human
aggcucuaugagucuagaugu

SEQ ID NO: 3487947 - RNA, 12 nt, Human
aggcucucaggc

SEQ ID NO: 3487948 - RNA, 20 nt, Human
aggcucucaggccagcugcu

SEQ ID NO: 3487949 - RNA, 18 nt, Human
aggcucugaaagccagcu

SEQ ID NO: 3487950 - RNA, 20 nt, Human
aggcucugagagucuagauu

SEQ ID NO: 3487951 - RNA, 23 nt, Human
aggcucugagagucuagauucuc

SEQ ID NO: 3487952 - RNA, 13 nt, Human
aggcucugcccug

SEQ ID NO: 3487953 - RNA, 13 nt, Human
aggcucugcccuu

SEQ ID NO: 3487954 - RNA, 18 nt, Human
aggcucugcgccugcccc

SEQ ID NO: 3487955 - RNA, 15 nt, Human
aggcucuggagccca

SEQ ID NO: 3487956 - RNA, 18 nt, Human
aggcucuggagcccacug

SEQ ID NO: 3487957 - RNA, 22 nt, Human
aggcucuggagcccacuguacu

SEQ ID NO: 3487958 - RNA, 16 nt, Human
aggcucugugcugacc

SEQ ID NO: 3487959 - RNA, 18 nt, Human
aggcucuguuuaugcuuu

SEQ ID NO: 3487960 - RNA, 16 nt, Human
aggcucuucuccccag

SEQ ID NO: 3487961 - RNA, 17 nt, Human
aggcucuucuccccaga

SEQ ID NO: 3487962 - RNA, 15 nt, Human
aggcucuucugacua

SEQ ID NO: 3487963 - RNA, 15 nt, Human
aggcucuuucugggc

SEQ ID NO: 3487964 - RNA, 18 nt, Human
aggcucuuucugggccaa

SEQ ID NO: 3487965 - RNA, 22 nt, Human
aggcucuuuggggucagccagg

SEQ ID NO: 3487966 - RNA, 16 nt, Human
aggcugaaagaggcca

SEQ ID NO: 3487967 - RNA, 20 nt, Human
aggcugacgugugagggagg

SEQ ID NO: 3487968 - RNA, 17 nt, Human
aggcugacguuccgggc

SEQ ID NO: 3487969 - RNA, 15 nt, Human
aggcugacuccuggu

SEQ ID NO: 3487970 - RNA, 16 nt, Human
aggcugacuccugguc

SEQ ID NO: 3487971 - RNA, 16 nt, Human
aggcugagaacacugu

SEQ ID NO: 3487972 - RNA, 19 nt, Human
aggcugagaacacugugaa

SEQ ID NO: 3487973 - RNA, 17 nt, Human
aggcugagacugcggga

SEQ ID NO: 3487974 - RNA, 11 nt, Human
aggcugagccu

SEQ ID NO: 3487975 - RNA, 13 nt, Human
aggcugagccuca

SEQ ID NO: 3487976 - RNA, 11 nt, Human
aggcugaggac

SEQ ID NO: 3487977 - RNA, 13 nt, Human
aggcugaggcaca

SEQ ID NO: 3487978 - RNA, 14 nt, Human
aggcugaggcacaa

SEQ ID NO: 3487979 - RNA, 14 nt, Human
aggcugaggcuggc

SEQ ID NO: 3487980 - RNA, 15 nt, Human
aggcugaggcuggca

SEQ ID NO: 3487981 - RNA, 19 nt, Human
aggcugagugcaggcccac

SEQ ID NO: 3487982 - RNA, 21 nt, Human
aggcugagugcaggcccaccc

SEQ ID NO: 3487983 - RNA, 17 nt, Human
aggcugaguuuucucuu

SEQ ID NO: 3487984 - RNA, 21 nt, Human
aggcugcaagguuuaggcugg

SEQ ID NO: 3487985 - RNA, 22 nt, Human
aggcugcaagguuuaggcuggu

SEQ ID NO: 3487986 - RNA, 18 nt, Human
aggcugcagaaggccaag

SEQ ID NO: 3487987 - RNA, 21 nt, Human
aggcugcagaaggccaagaau

SEQ ID NO: 3487988 - RNA, 23 nt, Human
aggcugcagauaacagaaaggcu

SEQ ID NO: 3487989 - RNA, 15 nt, Human
aggcugcagcgagcu

SEQ ID NO: 3487990 - RNA, 16 nt, Human
aggcugcagcuggaca

SEQ ID NO: 3487991 - RNA, 17 nt, Human
aggcugcagcuggacag

SEQ ID NO: 3487992 - RNA, 18 nt, Human
aggcugcagcuggacaga

SEQ ID NO: 3487993 - RNA, 19 nt, Human
aggcugcauagaaggagga

SEQ ID NO: 3487994 - RNA, 23 nt, Human
aggcugcauagaaggaggagagg

SEQ ID NO: 3487995 - RNA, 20 nt, Human
aggcugcauugaaaagagcu

SEQ ID NO: 3487996 - RNA, 17 nt, Human
aggcugccaaggccaga

SEQ ID NO: 3487997 - RNA, 20 nt, Human
aggcugccagugccugggug

SEQ ID NO: 3487998 - RNA, 20 nt, Human
aggcugcccccggcccccug

SEQ ID NO: 3487999 - RNA, 12 nt, Human
aggcugccccuc

SEQ ID NO: 3488000 - RNA, 15 nt, Human
aggcugccccucuca

SEQ ID NO: 3488001 - RNA, 18 nt, Human
aggcugccucucccauca

SEQ ID NO: 3488002 - RNA, 13 nt, Human
aggcugccugagu

SEQ ID NO: 3488003 - RNA, 16 nt, Human
aggcugcggccccucc

SEQ ID NO: 3488004 - RNA, 18 nt, Human
aggcugcggccccucccc

SEQ ID NO: 3488005 - RNA, 23 nt, Human
aggcugcucggggugcacaggag

SEQ ID NO: 3488006 - RNA, 16 nt, Human
aggcugcucugccugu

SEQ ID NO: 3488007 - RNA, 14 nt, Human
aggcugcuggcgcc

SEQ ID NO: 3488008 - RNA, 18 nt, Human
aggcugcuggcgccucug

SEQ ID NO: 3488009 - RNA, 18 nt, Human
aggcugcuggggccucag

SEQ ID NO: 3488010 - RNA, 13 nt, Human
aggcugcuuucca

SEQ ID NO: 3488011 - RNA, 21 nt, Human
aggcugcuuuccaaagccaau

SEQ ID NO: 3488012 - RNA, 18 nt, Human
aggcuggaagcugggagg

SEQ ID NO: 3488013 - RNA, 13 nt, Human
aggcuggaaggag

SEQ ID NO: 3488014 - RNA, 17 nt, Human
aggcuggacaugcugac

SEQ ID NO: 3488015 - RNA, 18 nt, Human
aggcuggacaugcugacu

SEQ ID NO: 3488016 - RNA, 16 nt, Human
aggcuggacuccagau

SEQ ID NO: 3488017 - RNA, 17 nt, Human
aggcuggacuccagauc

SEQ ID NO: 3488018 - RNA, 12 nt, Human
aggcuggagaag

SEQ ID NO: 3488019 - RNA, 13 nt, Human
aggcuggagccca

SEQ ID NO: 3488020 - RNA, 15 nt, Human
aggcuggaggcaggg

SEQ ID NO: 3488021 - RNA, 19 nt, Human
aggcuggaggcagggccuu

SEQ ID NO: 3488022 - RNA, 23 nt, Human
aggcuggaggcagggccuugccc

SEQ ID NO: 3488023 - RNA, 18 nt, Human
aggcuggaguacaguggu

SEQ ID NO: 3488024 - RNA, 20 nt, Human
aggcuggagugcaguggcau

SEQ ID NO: 3488025 - RNA, 22 nt, Human
aggcuggauccuagccuuaucc

SEQ ID NO: 3488026 - RNA, 22 nt, Human
aggcuggauuuugaauuuucuu

SEQ ID NO: 3488027 - RNA, 17 nt, Human
aggcuggcacaggacau

SEQ ID NO: 3488028 - RNA, 19 nt, Human
aggcuggcaccgccuucuc

SEQ ID NO: 3488029 - RNA, 20 nt, Human
aggcuggcaccgccuucucu

SEQ ID NO: 3488030 - RNA, 16 nt, Human
aggcuggcagcucucc

SEQ ID NO: 3488031 - RNA, 20 nt, Human
aggcuggcagcucuccaguc

SEQ ID NO: 3488032 - RNA, 12 nt, Human
aggcuggcaggu

SEQ ID NO: 3488033 - RNA, 15 nt, Human
aggcuggcagguaug

SEQ ID NO: 3488034 - RNA, 18 nt, Human
aggcuggccagccccaca

SEQ ID NO: 3488035 - RNA, 19 nt, Human
aggcuggccagccccacag

SEQ ID NO: 3488036 - RNA, 20 nt, Human
aggcuggccagccccacagc

SEQ ID NO: 3488037 - RNA, 21 nt, Human
aggcuggccagccccacagcc

SEQ ID NO: 3488038 - RNA, 18 nt, Human
aggcaugugugaaacaua

SEQ ID NO: 3488039 - RNA, 18 nt, Human
aggcauguucucugagga

SEQ ID NO: 3488040 - RNA, 20 nt, Human
aggcauguucucugaggaca

SEQ ID NO: 3488041 - RNA, 13 nt, Human
aggcauuaauguu

SEQ ID NO: 3488042 - RNA, 21 nt, Human
aggcauuccccaggaggccag

SEQ ID NO: 3488043 - RNA, 14 nt, Human
aggcauugaggaag

SEQ ID NO: 3488044 - RNA, 19 nt, Human
aggcauugaggaagagucu

SEQ ID NO: 3488045 - RNA, 14 nt, Human
aggcauugccaagg

SEQ ID NO: 3488046 - RNA, 21 nt, Human
aggcauugccucggcuggcuc

SEQ ID NO: 3488047 - RNA, 17 nt, Human
aggcauuuccugggugg

SEQ ID NO: 3488048 - RNA, 20 nt, Human
aggcauuuguugguuuauca

SEQ ID NO: 3488049 - RNA, 23 nt, Human
aggccaaaauuaccaaaaaucuu

SEQ ID NO: 3488050 - RNA, 15 nt, Human
aggccaaaccucugu

SEQ ID NO: 3488051 - RNA, 17 nt, Human
aggccaaacugcuggac

SEQ ID NO: 3488052 - RNA, 16 nt, Human
aggccaaaggcuggug

SEQ ID NO: 3488053 - RNA, 21 nt, Human
aggccaaaggggaccuggaag

SEQ ID NO: 3488054 - RNA, 22 nt, Human
aggccaacccaaaauaagcagg

SEQ ID NO: 3488055 - RNA, 14 nt, Human
aggccaagaggcug

SEQ ID NO: 3488056 - RNA, 15 nt, Human
aggccaagaguggcc

SEQ ID NO: 3488057 - RNA, 19 nt, Human
aggccaagaguggccccac

SEQ ID NO: 3488058 - RNA, 22 nt, Human
aggccaagaguggccccaccug

SEQ ID NO: 3488059 - RNA, 13 nt, Human
aggccaaggggag

SEQ ID NO: 3488060 - RNA, 18 nt, Human
aggccaaggucugagcca

SEQ ID NO: 3488061 - RNA, 16 nt, Human
aggccaaggugggagg

SEQ ID NO: 3488062 - RNA, 18 nt, Human
aggccaaggugggaggau

SEQ ID NO: 3488063 - RNA, 19 nt, Human
aggccaagguguccuacag

SEQ ID NO: 3488064 - RNA, 19 nt, Human
aggccaaguacacugagag

SEQ ID NO: 3488065 - RNA, 14 nt, Human
aggccaagugcagg

SEQ ID NO: 3488066 - RNA, 15 nt, Human
aggccaagugcaggc

SEQ ID NO: 3488067 - RNA, 20 nt, Human
aggccacaagacccuugugg

SEQ ID NO: 3488068 - RNA, 17 nt, Human
aggccacacucagcaca

SEQ ID NO: 3488069 - RNA, 18 nt, Human
aggccacacucagcacaa

SEQ ID NO: 3488070 - RNA, 12 nt, Human
aggccaccagga

SEQ ID NO: 3488071 - RNA, 15 nt, Human
aggccacccugugca

SEQ ID NO: 3488072 - RNA, 17 nt, Human
aggccaccuccccagca

SEQ ID NO: 3488073 - RNA, 22 nt, Human
aggccaccuccuaaaaggccca

SEQ ID NO: 3488074 - RNA, 23 nt, Human
aggccaccuccuaaaaggcccag

SEQ ID NO: 3488075 - RNA, 12 nt, Human
aggccaccucuc

SEQ ID NO: 3488076 - RNA, 14 nt, Human
aggccaccucucca

SEQ ID NO: 3488077 - RNA, 17 nt, Human
aggccaccucuccaagg

SEQ ID NO: 3488078 - RNA, 18 nt, Human
aggccaccucuccaaggg

SEQ ID NO: 3488079 - RNA, 21 nt, Human
aggccaccucuuccuggccgg

SEQ ID NO: 3488080 - RNA, 17 nt, Human
aggccaccugcccccuu

SEQ ID NO: 3488081 - RNA, 13 nt, Human
aggccacuccucc

SEQ ID NO: 3488082 - RNA, 12 nt, Human
aggccacugaag

SEQ ID NO: 3488083 - RNA, 16 nt, Human
aggccacugaagagga

SEQ ID NO: 3488084 - RNA, 14 nt, Human
aggccacuggagac

SEQ ID NO: 3488085 - RNA, 19 nt, Human
aggccacuguguuccuucc

SEQ ID NO: 3488086 - RNA, 19 nt, Human
aggccacuguuuggaaaua

SEQ ID NO: 3488087 - RNA, 12 nt, Human
aggccagaccug

SEQ ID NO: 3488088 - RNA, 12 nt, Human
aggccagagaca

SEQ ID NO: 3488089 - RNA, 23 nt, Human
aggccagagacacaagccuucgg

SEQ ID NO: 3488090 - RNA, 14 nt, Human
aggccagagcccac

SEQ ID NO: 3488091 - RNA, 18 nt, Human
aggccagauuacaaauua

SEQ ID NO: 3488092 - RNA, 12 nt, Human
aggccagcaacg

SEQ ID NO: 3488093 - RNA, 18 nt, Human
aggccagcaagguggagu

SEQ ID NO: 3488094 - RNA, 22 nt, Human
aggccagccagugaccugagga

SEQ ID NO: 3488095 - RNA, 13 nt, Human
aggccagccccac

SEQ ID NO: 3488096 - RNA, 14 nt, Human
aggccagccccacc

SEQ ID NO: 3488097 - RNA, 16 nt, Human
aggccagccccaccca

SEQ ID NO: 3488098 - RNA, 21 nt, Human
aggccagccccacccaggagg

SEQ ID NO: 3488099 - RNA, 22 nt, Human
aggccagccgcgcaucagacug

SEQ ID NO: 3488100 - RNA, 11 nt, Human
aggccagccuc

SEQ ID NO: 3488101 - RNA, 18 nt, Human
aggccagccuccgagagg

SEQ ID NO: 3488102 - RNA, 13 nt, Human
aggccagccuggc

SEQ ID NO: 3488103 - RNA, 14 nt, Human
aggccagccuggcc

SEQ ID NO: 3488104 - RNA, 15 nt, Human
aggccagccuggccu

SEQ ID NO: 3488105 - RNA, 18 nt, Human
aggccagccuggccuccu

SEQ ID NO: 3488106 - RNA, 20 nt, Human
aggccagccuggccuccugc

SEQ ID NO: 3488107 - RNA, 22 nt, Human
aggccagccuggccuccugccu

SEQ ID NO: 3488108 - RNA, 13 nt, Human
aggccagccuuga

SEQ ID NO: 3488109 - RNA, 17 nt, Human
aggccagcuggcagcag

SEQ ID NO: 3488110 - RNA, 17 nt, Human
aggccaggacucugcag

SEQ ID NO: 3488111 - RNA, 21 nt, Human
aggccaggacucugcagccuc

SEQ ID NO: 3488112 - RNA, 22 nt, Human
aggccaggacucugcagccuca

SEQ ID NO: 3488113 - RNA, 13 nt, Human
aggccaggccagc

SEQ ID NO: 3488114 - RNA, 13 nt, Human
aggccaggcccuc

SEQ ID NO: 3488115 - RNA, 23 nt, Human
aggccaggcccucugcccacucc

SEQ ID NO: 3488116 - RNA, 12 nt, Human
aggccaggccgg

SEQ ID NO: 3488117 - RNA, 20 nt, Human
aggccaggcgcgguggcuca

SEQ ID NO: 3488118 - RNA, 23 nt, Human
aggccagggcuauagcucaggac

SEQ ID NO: 3488119 - RNA, 23 nt, Human
aggccagggucacugaaggccug

SEQ ID NO: 3488120 - RNA, 21 nt, Human
aggccaguaagggaaauagaa

SEQ ID NO: 3488121 - RNA, 19 nt, Human
aggccaguaguucucaaag

SEQ ID NO: 3488122 - RNA, 21 nt, Human
aggccauccuucccugucugc

SEQ ID NO: 3488123 - RNA, 10 nt, Human
aggccaucug

SEQ ID NO: 3488124 - RNA, 15 nt, Human
aggccaucuggagag

SEQ ID NO: 3488125 - RNA, 13 nt, Human
aggccauggacuc

SEQ ID NO: 3488126 - RNA, 18 nt, Human
aggccauggacucugucc

SEQ ID NO: 3488127 - RNA, 22 nt, Human
aggccauggagagcuggagccu

SEQ ID NO: 3488128 - RNA, 16 nt, Human
aggccauggaggcagu

SEQ ID NO: 3488129 - RNA, 15 nt, Human
aggccauggcagaau

SEQ ID NO: 3488130 - RNA, 22 nt, Human
aggccauggcaucccuuuuuca

SEQ ID NO: 3488131 - RNA, 12 nt, Human
aggccauggcuc

SEQ ID NO: 3488132 - RNA, 14 nt, Human
aggccaugggccuc

SEQ ID NO: 3488133 - RNA, 20 nt, Human
aggccauuccccgucucugg

SEQ ID NO: 3488134 - RNA, 17 nt, Human
aggccauucuuucccaa

SEQ ID NO: 3488135 - RNA, 18 nt, Human
aggccauugugaaccaau

SEQ ID NO: 3488136 - RNA, 21 nt, Human
aggcccaaauuaucaagcuaa

SEQ ID NO: 3488137 - RNA, 15 nt, Human
aggcccaaggcuccc

SEQ ID NO: 3488138 - RNA, 12 nt, Human
aggcccacagga

SEQ ID NO: 3488139 - RNA, 13 nt, Human
aggcccacaggag

SEQ ID NO: 3488140 - RNA, 19 nt, Human
aggcccacauuggaagagc

SEQ ID NO: 3488141 - RNA, 12 nt, Human
aggcccacccug

SEQ ID NO: 3488142 - RNA, 13 nt, Human
aggcccacccugc

SEQ ID NO: 3488143 - RNA, 23 nt, Human
aggcccaccuaccuucaaagcug

SEQ ID NO: 3488144 - RNA, 15 nt, Human
aggcccacucagggg

SEQ ID NO: 3488145 - RNA, 19 nt, Human
aggcccagagggccugcaa

SEQ ID NO: 3488146 - RNA, 12 nt, Human
aggcccagcacc

SEQ ID NO: 3488147 - RNA, 18 nt, Human
aggcccagcauugcuggu

SEQ ID NO: 3488148 - RNA, 19 nt, Human
aggcccagcauugcugguu

SEQ ID NO: 3488149 - RNA, 20 nt, Human
aggcccagcauugcugguuc

SEQ ID NO: 3488150 - RNA, 14 nt, Human
aggcccagccccua

SEQ ID NO: 3488151 - RNA, 16 nt, Human
aggcccagccccuaga

SEQ ID NO: 3488152 - RNA, 17 nt, Human
aggcccagccccuagaa

SEQ ID NO: 3488153 - RNA, 19 nt, Human
aggcccagccccuagaaac

SEQ ID NO: 3488154 - RNA, 18 nt, Human
aggcccagccgacccccu

SEQ ID NO: 3488155 - RNA, 13 nt, Human
aggcccaggcugc

SEQ ID NO: 3488156 - RNA, 18 nt, Human
aggcccaggcugccgucc

SEQ ID NO: 3488157 - RNA, 17 nt, Human
aggcccaggcugggaac

SEQ ID NO: 3488158 - RNA, 16 nt, Human
aggcccauuccccucg

SEQ ID NO: 3488159 - RNA, 18 nt, Human
aggccccaaaaccacagc

SEQ ID NO: 3488160 - RNA, 13 nt, Human
aggccccaaagga

SEQ ID NO: 3488161 - RNA, 15 nt, Human
aggccccacugaugc

SEQ ID NO: 3488162 - RNA, 13 nt, Human
aggccccacuggg

SEQ ID NO: 3488163 - RNA, 14 nt, Human
aggccccagccucc

SEQ ID NO: 3488164 - RNA, 12 nt, Human
aggccccaggaa

SEQ ID NO: 3488165 - RNA, 14 nt, Human
aggccccaggaagc

SEQ ID NO: 3488166 - RNA, 16 nt, Human
aggccccaugaccucc

SEQ ID NO: 3488167 - RNA, 17 nt, Human
aggcccccaccuggcuc

SEQ ID NO: 3488168 - RNA, 18 nt, Human
aggcccccaccuggcuca

SEQ ID NO: 3488169 - RNA, 19 nt, Human
aggcccccaccuggcucac

SEQ ID NO: 3488170 - RNA, 13 nt, Human
aggcccccacuug

SEQ ID NO: 3488171 - RNA, 22 nt, Human
aggcccccagcccagggcuccu

SEQ ID NO: 3488172 - RNA, 23 nt, Human
aggcccccagcccagggcuccug

SEQ ID NO: 3488173 - RNA, 15 nt, Human
aggcccccaggugcc

SEQ ID NO: 3488174 - RNA, 19 nt, Human
aggcccccaucauccucug

SEQ ID NO: 3488175 - RNA, 20 nt, Human
aggcccccaucauccucugg

SEQ ID NO: 3488176 - RNA, 21 nt, Human
aggcccccaucauccucuggc

SEQ ID NO: 3488177 - RNA, 23 nt, Human
aggcccccgggugugaagcacag

SEQ ID NO: 3488178 - RNA, 16 nt, Human
aggccccgcccaggcu

SEQ ID NO: 3488179 - RNA, 17 nt, Human
aggccccgcccaggcuu

SEQ ID NO: 3488180 - RNA, 17 nt, Human
aggccccgcuuguccag

SEQ ID NO: 3488181 - RNA, 18 nt, Human
aggccccgcuuguccagc

SEQ ID NO: 3488182 - RNA, 21 nt, Human
aggccccgcuuguccagcgcc

SEQ ID NO: 3488183 - RNA, 20 nt, Human
aggccccucccucuccagca

SEQ ID NO: 3488184 - RNA, 16 nt, Human
aggccccuggagccag

SEQ ID NO: 3488185 - RNA, 15 nt, Human
aggccccuggcccag

SEQ ID NO: 3488186 - RNA, 20 nt, Human
aggccccuggcccagcggcc

SEQ ID NO: 3488187 - RNA, 18 nt, Human
aggccccuucucucccug

SEQ ID NO: 3488188 - RNA, 14 nt, Human
aggcccgagcagcu

SEQ ID NO: 3488189 - RNA, 19 nt, Human
aggcccgagcagcugagca

SEQ ID NO: 3488190 - RNA, 21 nt, Human
aggcccgagcagcugagcagg

SEQ ID NO: 3488191 - RNA, 20 nt, Human
aggcccgcucuacaucuucu

SEQ ID NO: 3488192 - RNA, 13 nt, Human
aggcccggccucu

SEQ ID NO: 3488193 - RNA, 14 nt, Human
aggcccggccucuc

SEQ ID NO: 3488194 - RNA, 14 nt, Human
aggcccggcuccag

SEQ ID NO: 3488195 - RNA, 13 nt, Human
aggcccggggcug

SEQ ID NO: 3488196 - RNA, 14 nt, Human
aggcccggggcugg

SEQ ID NO: 3488197 - RNA, 15 nt, Human
aggcccggggcuggc

SEQ ID NO: 3488198 - RNA, 20 nt, Human
aggcccgucuguccaucugc

SEQ ID NO: 3488199 - RNA, 21 nt, Human
aggcccgucuguccaucugcc

SEQ ID NO: 3488200 - RNA, 22 nt, Human
aggcccuaucuguuuacagugu

SEQ ID NO: 3488201 - RNA, 23 nt, Human
aggcccuccacaccugcggccca

SEQ ID NO: 3488202 - RNA, 20 nt, Human
aggcccucccuguuccccag

SEQ ID NO: 3488203 - RNA, 23 nt, Human
aggcccucccuguuccccagaga

SEQ ID NO: 3488204 - RNA, 21 nt, Human
aggcccuccucucccauccuu

SEQ ID NO: 3488205 - RNA, 17 nt, Human
aggcccuccugugcugg

SEQ ID NO: 3488206 - RNA, 16 nt, Human
aggcccucgggcccag

SEQ ID NO: 3488207 - RNA, 15 nt, Human
aggcccucugcccac

SEQ ID NO: 3488208 - RNA, 20 nt, Human
aggcccucuggaguggccac

SEQ ID NO: 3488209 - RNA, 22 nt, Human
aggcccucuggaguggccacua

SEQ ID NO: 3488210 - RNA, 15 nt, Human
aggcccugagacagg

SEQ ID NO: 3488211 - RNA, 15 nt, Human
aggcccugcacuguc

SEQ ID NO: 3488212 - RNA, 12 nt, Human
aggcccugcaug

SEQ ID NO: 3488213 - RNA, 16 nt, Human
aggcccugcuccugca

SEQ ID NO: 3488214 - RNA, 21 nt, Human
aggcccugcuccugcagcaug

SEQ ID NO: 3488215 - RNA, 22 nt, Human
aggcccugcuccugcagcaugg

SEQ ID NO: 3488216 - RNA, 13 nt, Human
aggcccuggauca

SEQ ID NO: 3488217 - RNA, 18 nt, Human
aggcccuggaucagcgug

SEQ ID NO: 3488218 - RNA, 10 nt, Human
aggcccuggc

SEQ ID NO: 3488219 - RNA, 14 nt, Human
aggcccuggccucc

SEQ ID NO: 3488220 - RNA, 15 nt, Human
aggcccuggccuccc

SEQ ID NO: 3488221 - RNA, 21 nt, Human
aggcccuucucuccagccccu

SEQ ID NO: 3488222 - RNA, 17 nt, Human
aggcccuuuccucaggc

SEQ ID NO: 3488223 - RNA, 13 nt, Human
aggcccuuugcug

SEQ ID NO: 3488224 - RNA, 14 nt, Human
aggcccuuugcugu

SEQ ID NO: 3488225 - RNA, 15 nt, Human
aggcccuuugcuguc

SEQ ID NO: 3488226 - RNA, 17 nt, Human
aggccgaagaagggucc

SEQ ID NO: 3488227 - RNA, 23 nt, Human
aggccgaagcucuggcugaaccc

SEQ ID NO: 3488228 - RNA, 16 nt, Human
agauaacaaucuguau

SEQ ID NO: 3488229 - RNA, 22 nt, Human
agauaacacacuuuuuauuaga

SEQ ID NO: 3488230 - RNA, 22 nt, Human
agauaacgcuuaaaggaaguca

SEQ ID NO: 3488231 - RNA, 14 nt, Human
agauaacucuuugg

SEQ ID NO: 3488232 - RNA, 16 nt, Human
agauaacucuuuggau

SEQ ID NO: 3488233 - RNA, 19 nt, Human
agauaacuuugacuuucuu

SEQ ID NO: 3488234 - RNA, 11 nt, Human
agauaacuuuu

SEQ ID NO: 3488235 - RNA, 20 nt, Human
agauaagcaagagagauguu

SEQ ID NO: 3488236 - RNA, 17 nt, Human
agauaaggguaucuggu

SEQ ID NO: 3488237 - RNA, 23 nt, Human
agauaaguggccuugacacauua

SEQ ID NO: 3488238 - RNA, 20 nt, Human
agauaaguguauuuuucaau

SEQ ID NO: 3488239 - RNA, 20 nt, Human
agauaaguuggaaacacuaa

SEQ ID NO: 3488240 - RNA, 22 nt, Human
agauaaguuggaaacacuaaau

SEQ ID NO: 3488241 - RNA, 14 nt, Human
agauaauaauauau

SEQ ID NO: 3488242 - RNA, 17 nt, Human
agauaauaauauauguu

SEQ ID NO: 3488243 - RNA, 22 nt, Human
agauaauaauggguuucuuuca

SEQ ID NO: 3488244 - RNA, 17 nt, Human
agauaauaugagaauca

SEQ ID NO: 3488245 - RNA, 20 nt, Human
agauaauauuguuugguaaa

SEQ ID NO: 3488246 - RNA, 20 nt, Human
agauaauauuuuacauacac

SEQ ID NO: 3488247 - RNA, 17 nt, Human
agauaaucagccucuua

SEQ ID NO: 3488248 - RNA, 19 nt, Human
agauaaucagugugucuaa

SEQ ID NO: 3488249 - RNA, 16 nt, Human
agauaaucucagugcu

SEQ ID NO: 3488250 - RNA, 19 nt, Human
agauaaucucagugcuuuc

SEQ ID NO: 3488251 - RNA, 15 nt, Human
agauaaucucucagc

SEQ ID NO: 3488252 - RNA, 22 nt, Human
agauaaugugaacuagcuggaa

SEQ ID NO: 3488253 - RNA, 18 nt, Human
agauaauugcuauuuauu

SEQ ID NO: 3488254 - RNA, 16 nt, Human
agauaauuucagggug

SEQ ID NO: 3488255 - RNA, 12 nt, Human
agauacaauaaa

SEQ ID NO: 3488256 - RNA, 15 nt, Human
agauacaaucagcug

SEQ ID NO: 3488257 - RNA, 16 nt, Human
agauacaaucagcugc

SEQ ID NO: 3488258 - RNA, 17 nt, Human
agauacaaucagcugcu

SEQ ID NO: 3488259 - RNA, 18 nt, Human
agauacaaucagcugcuu

SEQ ID NO: 3488260 - RNA, 13 nt, Human
agauacaauguau

SEQ ID NO: 3488261 - RNA, 15 nt, Human
agauacaauguauuu

SEQ ID NO: 3488262 - RNA, 23 nt, Human
agauacaauguauuuauuuaaaa

SEQ ID NO: 3488263 - RNA, 18 nt, Human
agauacagaacucuuuca

SEQ ID NO: 3488264 - RNA, 17 nt, Human
agauacaggaaaagcug

SEQ ID NO: 3488265 - RNA, 13 nt, Human
agauacaguuacu

SEQ ID NO: 3488266 - RNA, 15 nt, Human
agauacauacagaau

SEQ ID NO: 3488267 - RNA, 22 nt, Human
agauacauaugaguguggaagc

SEQ ID NO: 3488268 - RNA, 13 nt, Human
agauacaucacug

SEQ ID NO: 3488269 - RNA, 16 nt, Human
agauacaucacugcuu

SEQ ID NO: 3488270 - RNA, 18 nt, Human
agauacauuuguauguug

SEQ ID NO: 3488271 - RNA, 19 nt, Human
agauaccauacucauuucu

SEQ ID NO: 3488272 - RNA, 19 nt, Human
agauaccuaaaagagauuu

SEQ ID NO: 3488273 - RNA, 17 nt, Human
agauaccucacccugcu

SEQ ID NO: 3488274 - RNA, 18 nt, Human
agauaccuuaaaauuuga

SEQ ID NO: 3488275 - RNA, 19 nt, Human
agauacgacuuuauuuucu

SEQ ID NO: 3488276 - RNA, 12 nt, Human
agauacucuggg

SEQ ID NO: 3488277 - RNA, 15 nt, Human
agauacugaaauaaa

SEQ ID NO: 3488278 - RNA, 19 nt, Human
agauacuggaaguuuugca

SEQ ID NO: 3488279 - RNA, 20 nt, Human
agauacuggaaguuuugcau

SEQ ID NO: 3488280 - RNA, 21 nt, Human
agauacuggaaguuuugcauu

SEQ ID NO: 3488281 - RNA, 17 nt, Human
agauacuggauuguacu

SEQ ID NO: 3488282 - RNA, 22 nt, Human
agauacuuggggggcugaggug

SEQ ID NO: 3488283 - RNA, 21 nt, Human
agauacuuggucacagccagg

SEQ ID NO: 3488284 - RNA, 14 nt, Human
agauacuuugcauu

SEQ ID NO: 3488285 - RNA, 16 nt, Human
agauacuuugcauugu

SEQ ID NO: 3488286 - RNA, 16 nt, Human
agauacuuuguauugu

SEQ ID NO: 3488287 - RNA, 17 nt, Human
agauacuuuuucuuuug

SEQ ID NO: 3488288 - RNA, 23 nt, Human
agauacuuuuucuuuuguaagug

SEQ ID NO: 3488289 - RNA, 14 nt, Human
agauagaaagcauu

SEQ ID NO: 3488290 - RNA, 20 nt, Human
agauagaaagggugcugcca

SEQ ID NO: 3488291 - RNA, 18 nt, Human
agauagaaauaaauagcu

SEQ ID NO: 3488292 - RNA, 21 nt, Human
agauagaagaaaaaagaaugu

SEQ ID NO: 3488293 - RNA, 13 nt, Human
agauagaagaacu

SEQ ID NO: 3488294 - RNA, 17 nt, Human
agauagaagauguuugc

SEQ ID NO: 3488295 - RNA, 15 nt, Human
agauagaaugacagu

SEQ ID NO: 3488296 - RNA, 16 nt, Human
agauagaaugacaguc

SEQ ID NO: 3488297 - RNA, 21 nt, Human
agauagagagugaguacaugc

SEQ ID NO: 3488298 - RNA, 20 nt, Human
agauagauaggucagugcaa

SEQ ID NO: 3488299 - RNA, 14 nt, Human
agauagcauuguga

SEQ ID NO: 3488300 - RNA, 13 nt, Human
agauagccaaggc

SEQ ID NO: 3488301 - RNA, 16 nt, Human
agauagccaaggccaa

SEQ ID NO: 3488302 - RNA, 14 nt, Human
agauagccuguggc

SEQ ID NO: 3488303 - RNA, 20 nt, Human
agauaggaaggucauuucca

SEQ ID NO: 3488304 - RNA, 16 nt, Human
agauaggaccuugggc

SEQ ID NO: 3488305 - RNA, 14 nt, Human
agauaggcucugca

SEQ ID NO: 3488306 - RNA, 16 nt, Human
agauaggcucugcaca

SEQ ID NO: 3488307 - RNA, 21 nt, Human
agauaggcucugcacagaugg

SEQ ID NO: 3488308 - RNA, 18 nt, Human
agauaguacauaaaggug

SEQ ID NO: 3488309 - RNA, 22 nt, Human
agauaguaucuagcaaucacaa

SEQ ID NO: 3488310 - RNA, 14 nt, Human
agauaguuuucauc

SEQ ID NO: 3488311 - RNA, 15 nt, Human
agauauaaaagacug

SEQ ID NO: 3488312 - RNA, 15 nt, Human
agauauaaauuuuua

SEQ ID NO: 3488313 - RNA, 18 nt, Human
agauauaagugcuguaua

SEQ ID NO: 3488314 - RNA, 16 nt, Human
agauauaaugaacaaa

SEQ ID NO: 3488315 - RNA, 11 nt, Human
agauauacugg

SEQ ID NO: 3488316 - RNA, 23 nt, Human
agauauacuuguuuuuguaaaga

SEQ ID NO: 3488317 - RNA, 17 nt, Human
agauauacuuuguggac

SEQ ID NO: 3488318 - RNA, 23 nt, Human
agauauacuuuguggaccaauua

SEQ ID NO: 3488319 - RNA, 17 nt, Human
agauauaucugaaaacu

SEQ ID NO: 3488320 - RNA, 13 nt, Human
agauauauuaaaa

SEQ ID NO: 3488321 - RNA, 17 nt, Human
agauauauuaaaaauau

SEQ ID NO: 3488322 - RNA, 20 nt, Human
agauauauuaagugacuguu

SEQ ID NO: 3488323 - RNA, 21 nt, Human
agauauauuuuuaagauaaua

SEQ ID NO: 3488324 - RNA, 15 nt, Human
agauauauuuuucac

SEQ ID NO: 3488325 - RNA, 21 nt, Human
agauaucacagaggccuauaa

SEQ ID NO: 3488326 - RNA, 23 nt, Human
agauaucaucuaccuagauuuaa

SEQ ID NO: 3488327 - RNA, 18 nt, Human
agauauccucugcuuaaa

SEQ ID NO: 3488328 - RNA, 17 nt, Human
agauaucuugaaaugaa

SEQ ID NO: 3488329 - RNA, 18 nt, Human
agauaucuuuuuauugau

SEQ ID NO: 3488330 - RNA, 16 nt, Human
agauaugauucaaaug

SEQ ID NO: 3488331 - RNA, 16 nt, Human
agauaugggaacacug

SEQ ID NO: 3488332 - RNA, 15 nt, Human
agauauguauucuuu

SEQ ID NO: 3488333 - RNA, 14 nt, Human
agauauuauugcuu

SEQ ID NO: 3488334 - RNA, 16 nt, Human
agauauuggacaaaga

SEQ ID NO: 3488335 - RNA, 19 nt, Human
agauauugugaaguacaua

SEQ ID NO: 3488336 - RNA, 21 nt, Human
agauauugugaaguacauauu

SEQ ID NO: 3488337 - RNA, 13 nt, Human
agauauuguucaa

SEQ ID NO: 3488338 - RNA, 23 nt, Human
agauauuuacaugaauugcauuu

SEQ ID NO: 3488339 - RNA, 17 nt, Human
agauauuuauauauauu

SEQ ID NO: 3488340 - RNA, 17 nt, Human
agauauuuauauuuuua

SEQ ID NO: 3488341 - RNA, 20 nt, Human
agauauuuauauuuuuauuu

SEQ ID NO: 3488342 - RNA, 23 nt, Human
agauauuuauauuuuuauuuuau

SEQ ID NO: 3488343 - RNA, 15 nt, Human
aggcuggccagccgc

SEQ ID NO: 3488344 - RNA, 17 nt, Human
aggcuggccaguccagg

SEQ ID NO: 3488345 - RNA, 15 nt, Human
aggcuggcccugccc

SEQ ID NO: 3488346 - RNA, 19 nt, Human
aggcuggcccugcccuggu

SEQ ID NO: 3488347 - RNA, 13 nt, Human
aggcuggccucag

SEQ ID NO: 3488348 - RNA, 20 nt, Human
aggcuggcgagagucuggcc

SEQ ID NO: 3488349 - RNA, 17 nt, Human
aggcuggcgcagccaag

SEQ ID NO: 3488350 - RNA, 18 nt, Human
aggcuggcgugcaguggu

SEQ ID NO: 3488351 - RNA, 20 nt, Human
aggcuggcgugcaguggugc

SEQ ID NO: 3488352 - RNA, 20 nt, Human
aggcuggcuuguccccuccu

SEQ ID NO: 3488353 - RNA, 17 nt, Human
aggcuggcuuucagagu

SEQ ID NO: 3488354 - RNA, 18 nt, Human
aggcugggaacucaucug

SEQ ID NO: 3488355 - RNA, 14 nt, Human
aggcugggagagcc

SEQ ID NO: 3488356 - RNA, 16 nt, Human
aggcugggagagccuu

SEQ ID NO: 3488357 - RNA, 19 nt, Human
aggcugggagagccuucca

SEQ ID NO: 3488358 - RNA, 12 nt, Human
aggcugggccaa

SEQ ID NO: 3488359 - RNA, 20 nt, Human
aggcugggccaagccaggga

SEQ ID NO: 3488360 - RNA, 18 nt, Human
aggcugggccauguccaa

SEQ ID NO: 3488361 - RNA, 21 nt, Human
aggcugggccauguccaaaga

SEQ ID NO: 3488362 - RNA, 22 nt, Human
aggcugggcccagaggcacagc

SEQ ID NO: 3488363 - RNA, 18 nt, Human
aggcugggcguaguggcu

SEQ ID NO: 3488364 - RNA, 15 nt, Human
aggcugggcugggca

SEQ ID NO: 3488365 - RNA, 22 nt, Human
aggcugggcugggcacugcucu

SEQ ID NO: 3488366 - RNA, 20 nt, Human
aggcugggcuucaguggcag

SEQ ID NO: 3488367 - RNA, 21 nt, Human
aggcugggcuucaguggcagc

SEQ ID NO: 3488368 - RNA, 23 nt, Human
aggcugggcuucaguggcagcug

SEQ ID NO: 3488369 - RNA, 22 nt, Human
aggcuggggaaguccucugggu

SEQ ID NO: 3488370 - RNA, 12 nt, Human
aggcuggggcug

SEQ ID NO: 3488371 - RNA, 22 nt, Human
aggcugggggaagaagcucucu

SEQ ID NO: 3488372 - RNA, 12 nt, Human
aaaaacaggcac

SEQ ID NO: 3488373 - RNA, 18 nt, Human
aaaaacagguauauacuu

SEQ ID NO: 3488374 - RNA, 19 nt, Human
aaaaacauucuaucuacug

SEQ ID NO: 3488375 - RNA, 12 nt, Human
aaaaacauugcc

SEQ ID NO: 3488376 - RNA, 15 nt, Human
aaaaacauugccuuu

SEQ ID NO: 3488377 - RNA, 15 nt, Human
aaaaaccaacaucua

SEQ ID NO: 3488378 - RNA, 20 nt, Human
aaaaaccaguauuguacaaa

SEQ ID NO: 3488379 - RNA, 16 nt, Human
aaaaaccuauuccacu

SEQ ID NO: 3488380 - RNA, 22 nt, Human
aaaaaccugagauuuauuaaag

SEQ ID NO: 3488381 - RNA, 13 nt, Human
aaaaacuacacau

SEQ ID NO: 3488382 - RNA, 18 nt, Human
aaaaacucaaccaaaugg

SEQ ID NO: 3488383 - RNA, 22 nt, Human
aaaaacucaaccaaaugguaca

SEQ ID NO: 3488384 - RNA, 17 nt, Human
aaaaacucgaggacugu

SEQ ID NO: 3488385 - RNA, 21 nt, Human
aaaaacucgaggacuguauuu

SEQ ID NO: 3488386 - RNA, 12 nt, Human
aaaaacugaaug

SEQ ID NO: 3488387 - RNA, 15 nt, Human
aaaaacugagugacu

SEQ ID NO: 3488388 - RNA, 15 nt, Human
aaaaacugucuuuaa

SEQ ID NO: 3488389 - RNA, 21 nt, Human
aaaaacuuagugacaaaauag

SEQ ID NO: 3488390 - RNA, 19 nt, Human
aaaaacuucaguaaguacg

SEQ ID NO: 3488391 - RNA, 12 nt, Human
aaaaacuuuuau

SEQ ID NO: 3488392 - RNA, 11 nt, Human
aaaaagaaaaa

SEQ ID NO: 3488393 - RNA, 23 nt, Human
aaaaagaaaggcuguuaaauaca

SEQ ID NO: 3488394 - RNA, 14 nt, Human
aaaaagaagugcug

SEQ ID NO: 3488395 - RNA, 11 nt, Human
aaaaagaaugu

SEQ ID NO: 3488396 - RNA, 15 nt, Human
aaaaagacucuuuuu

SEQ ID NO: 3488397 - RNA, 19 nt, Human
aaaaagacuuuaaaaguga

SEQ ID NO: 3488398 - RNA, 19 nt, Human
aaaaagagaauuagauuau

SEQ ID NO: 3488399 - RNA, 12 nt, Human
aaaaagagacau

SEQ ID NO: 3488400 - RNA, 15 nt, Human
aaaaagagacaucca

SEQ ID NO: 3488401 - RNA, 18 nt, Human
aaaaagaggaaagaauga

SEQ ID NO: 3488402 - RNA, 19 nt, Human
aaaaagaggaaagaaugaa

SEQ ID NO: 3488403 - RNA, 19 nt, Human
aaaaagauaaacacaagau

SEQ ID NO: 3488404 - RNA, 17 nt, Human
aaaaagauauauuaaaa

SEQ ID NO: 3488405 - RNA, 23 nt, Human
aaaaagauuuucagaaaauauua

SEQ ID NO: 3488406 - RNA, 17 nt, Human
aaaaagcauaaaaacau

SEQ ID NO: 3488407 - RNA, 12 nt, Human
aaaaagcaugua

SEQ ID NO: 3488408 - RNA, 20 nt, Human
aaaaagccugcaauuucaua

SEQ ID NO: 3488409 - RNA, 12 nt, Human
aaaaagccuucc

SEQ ID NO: 3488410 - RNA, 19 nt, Human
aaaaagcucauauuuugua

SEQ ID NO: 3488411 - RNA, 20 nt, Human
aaaaagcuccuguccuccca

SEQ ID NO: 3488412 - RNA, 15 nt, Human
aaaaagcuuaaaacu

SEQ ID NO: 3488413 - RNA, 19 nt, Human
aaaaagcuuaaaacuuuga

SEQ ID NO: 3488414 - RNA, 12 nt, Human
aaaaagcuuuau

SEQ ID NO: 3488415 - RNA, 14 nt, Human
aaaaagcuuuuucc

SEQ ID NO: 3488416 - RNA, 15 nt, Human
aaaaaggauacauaa

SEQ ID NO: 3488417 - RNA, 21 nt, Human
aaaaaggaugcacagaguugu

SEQ ID NO: 3488418 - RNA, 12 nt, Human
aaaaaggcagga

SEQ ID NO: 3488419 - RNA, 13 nt, Human
aaaaaggcaguua

SEQ ID NO: 3488420 - RNA, 17 nt, Human
aaaaaggcauuguuuga

SEQ ID NO: 3488421 - RNA, 22 nt, Human
aaaaaguaucauggaaauauua

SEQ ID NO: 3488422 - RNA, 13 nt, Human
aaaaaguauuauu

SEQ ID NO: 3488423 - RNA, 14 nt, Human
aaaaaguauuauuu

SEQ ID NO: 3488424 - RNA, 15 nt, Human
aaaaaguauugccaa

SEQ ID NO: 3488425 - RNA, 14 nt, Human
aaaaagucagaugu

SEQ ID NO: 3488426 - RNA, 16 nt, Human
aaaaagucagauguuu

SEQ ID NO: 3488427 - RNA, 20 nt, Human
aaaaaguccaauuuuaauuu

SEQ ID NO: 3488428 - RNA, 14 nt, Human
aaaaagucugcauu

SEQ ID NO: 3488429 - RNA, 17 nt, Human
aaaaagugaaauaaugu

SEQ ID NO: 3488430 - RNA, 19 nt, Human
aaaaagugacacagcagcu

SEQ ID NO: 3488431 - RNA, 18 nt, Human
aaaaagugcuucauucuu

SEQ ID NO: 3488432 - RNA, 19 nt, Human
aaaaaguggaauuucuugu

SEQ ID NO: 3488433 - RNA, 20 nt, Human
aaaaaguuaaaaaaaauaau

SEQ ID NO: 3488434 - RNA, 13 nt, Human
aaaaaguugaagg

SEQ ID NO: 3488435 - RNA, 15 nt, Human
aaaaaguugcagcug

SEQ ID NO: 3488436 - RNA, 13 nt, Human
aaaaaguuguuca

SEQ ID NO: 3488437 - RNA, 17 nt, Human
aaaaaguuuacaagugu

SEQ ID NO: 3488438 - RNA, 12 nt, Human
aaaaauaaaaua

SEQ ID NO: 3488439 - RNA, 20 nt, Human
aaaaauaaaauaauuauaaa

SEQ ID NO: 3488440 - RNA, 11 nt, Human
aaaaauaaagc

SEQ ID NO: 3488441 - RNA, 17 nt, Human
aaaaauaaauaaaagcc

SEQ ID NO: 3488442 - RNA, 12 nt, Human
aaaaauaaaugg

SEQ ID NO: 3488443 - RNA, 21 nt, Human
aaaaauaaauuugguucuaau

SEQ ID NO: 3488444 - RNA, 14 nt, Human
aaaaauaacaauga

SEQ ID NO: 3488445 - RNA, 18 nt, Human
aaaaauaacuguaauuau

SEQ ID NO: 3488446 - RNA, 11 nt, Human
aaaaauaaggu

SEQ ID NO: 3488447 - RNA, 18 nt, Human
aaaaauaagucaacagua

SEQ ID NO: 3488448 - RNA, 21 nt, Human
aaaaauaagucaacaguaaac

SEQ ID NO: 3488449 - RNA, 12 nt, Human
aaaaauaauaaa

SEQ ID NO: 3488450 - RNA, 12 nt, Human
aaaaauaauaau

SEQ ID NO: 3488451 - RNA, 17 nt, Human
aaaaauaauuuuuauau

SEQ ID NO: 3488452 - RNA, 13 nt, Human
aaaaauacaaaau

SEQ ID NO: 3488453 - RNA, 14 nt, Human
aaaaauacaugcau

SEQ ID NO: 3488454 - RNA, 14 nt, Human
aaaaauacauuuua

SEQ ID NO: 3488455 - RNA, 23 nt, Human
aaaaauaccucaggaaagaauag

SEQ ID NO: 3488456 - RNA, 18 nt, Human
aaaaauacuauuuaagau

SEQ ID NO: 3488457 - RNA, 13 nt, Human
aaaaauacucaga

SEQ ID NO: 3488458 - RNA, 14 nt, Human
aaaaauacucuaau

SEQ ID NO: 3488459 - RNA, 17 nt, Human
aaaaauacucuaauucu

SEQ ID NO: 3488460 - RNA, 12 nt, Human
aaaaauagaaac

SEQ ID NO: 3488461 - RNA, 15 nt, Human
aaaaauagaaacaua

SEQ ID NO: 3488462 - RNA, 17 nt, Human
aaaaauagcaacuugug

SEQ ID NO: 3488463 - RNA, 23 nt, Human
aaaaauaguuuggauauguaaaa

SEQ ID NO: 3488464 - RNA, 14 nt, Human
aaaaauauaaaacu

SEQ ID NO: 3488465 - RNA, 14 nt, Human
aaaaauauacaugu

SEQ ID NO: 3488466 - RNA, 20 nt, Human
aaaaauauggaacuucuaau

SEQ ID NO: 3488467 - RNA, 13 nt, Human
aaaaauaugugaa

SEQ ID NO: 3488468 - RNA, 16 nt, Human
aaaaauaugugaagga

SEQ ID NO: 3488469 - RNA, 10 nt, Human
aaaaauauua

SEQ ID NO: 3488470 - RNA, 23 nt, Human
aaaaauauuguuucugcauucau

SEQ ID NO: 3488471 - RNA, 14 nt, Human
aaaaauauuuuaug

SEQ ID NO: 3488472 - RNA, 23 nt, Human
aaaaaucaacuuuuuauugccuu

SEQ ID NO: 3488473 - RNA, 16 nt, Human
aaaaaucaauuaacca

SEQ ID NO: 3488474 - RNA, 17 nt, Human
aaaaaucauaaacugug

SEQ ID NO: 3488475 - RNA, 20 nt, Human
aaaaaucaucuauuuugaug

SEQ ID NO: 3488476 - RNA, 19 nt, Human
aaaaauccucuuccucuga

SEQ ID NO: 3488477 - RNA, 20 nt, Human
aaaaaucucaaauuucuaaa

SEQ ID NO: 3488478 - RNA, 22 nt, Human
aaaaaucugaccaaaacaaaca

SEQ ID NO: 3488479 - RNA, 18 nt, Human
aaaaaucugcagaaggaa

SEQ ID NO: 3488480 - RNA, 15 nt, Human
aaaaaucuuaauacu

SEQ ID NO: 3488481 - RNA, 18 nt, Human
aaaaaucuuaauacuguu

SEQ ID NO: 3488482 - RNA, 20 nt, Human
aaaaaucuugugcuagaaua

SEQ ID NO: 3488483 - RNA, 12 nt, Human
aaaaaugaaaga

SEQ ID NO: 3488484 - RNA, 17 nt, Human
aaaaaugaaagaugauu

SEQ ID NO: 3488485 - RNA, 14 nt, Human
aaaaaugaaauuau

SEQ ID NO: 3488486 - RNA, 11 nt, Human
aaaaaugagaa

SEQ ID NO: 3488487 - RNA, 16 nt, Human
aaaaaugagaacaugu

SEQ ID NO: 3488488 - RNA, 16 nt, Human
aaaaaugauuucagua

SEQ ID NO: 3488489 - RNA, 21 nt, Human
aaaaaugcacaaacaaugcaa

SEQ ID NO: 3488490 - RNA, 21 nt, Human
aaaaaugcacguagcugaggc

SEQ ID NO: 3488491 - RNA, 21 nt, Human
aaaaaugccauaauacaaaag

SEQ ID NO: 3488492 - RNA, 18 nt, Human
aaaaaugccaucaaauga

SEQ ID NO: 3488493 - RNA, 18 nt, Human
aaaaaugcccuuaaauca

SEQ ID NO: 3488494 - RNA, 13 nt, Human
aaaaaugccuuug

SEQ ID NO: 3488495 - RNA, 12 nt, Human
aaaaaugcuaau

SEQ ID NO: 3488496 - RNA, 14 nt, Human
aaaaaugcugaaca

SEQ ID NO: 3488497 - RNA, 15 nt, Human
aaaaaugcugaacau

SEQ ID NO: 3488498 - RNA, 19 nt, Human
aaaaaugcugaacauugca

SEQ ID NO: 3488499 - RNA, 23 nt, Human
aaaaauggauauuauuagaaauu

SEQ ID NO: 3488500 - RNA, 19 nt, Human
aggcgagaagggcugcuuc

SEQ ID NO: 3488501 - RNA, 19 nt, Human
aggcgagagaggagccaga

SEQ ID NO: 3488502 - RNA, 23 nt, Human
aggcgagagaggagccagacaga

SEQ ID NO: 3488503 - RNA, 18 nt, Human
aggcgagugccaggacuc

SEQ ID NO: 3488504 - RNA, 19 nt, Human
aggcgaucacaacgugcau

SEQ ID NO: 3488505 - RNA, 21 nt, Human
aggcgaucacaacgugcauug

SEQ ID NO: 3488506 - RNA, 22 nt, Human
aggcgcacugugacccccagcu

SEQ ID NO: 3488507 - RNA, 22 nt, Human
aggcgccccaacccguggaggc

SEQ ID NO: 3488508 - RNA, 14 nt, Human
aggcgccccuuccc

SEQ ID NO: 3488509 - RNA, 19 nt, Human
aggcgcuagcacagcuccc

SEQ ID NO: 3488510 - RNA, 17 nt, Human
aggcggacguuccagcc

SEQ ID NO: 3488511 - RNA, 15 nt, Human
aggcggagaguacag

SEQ ID NO: 3488512 - RNA, 16 nt, Human
aggcggccccucccgc

SEQ ID NO: 3488513 - RNA, 14 nt, Human
aggcgggaaggagg

SEQ ID NO: 3488514 - RNA, 18 nt, Human
aggcgggacagugcugca

SEQ ID NO: 3488515 - RNA, 14 nt, Human
aggcgggccagcca

SEQ ID NO: 3488516 - RNA, 16 nt, Human
aggcgggccagccagg

SEQ ID NO: 3488517 - RNA, 21 nt, Human
aggcgggccagccaggcgggc

SEQ ID NO: 3488518 - RNA, 15 nt, Human
aggcgggcggucagg

SEQ ID NO: 3488519 - RNA, 17 nt, Human
agggacaggaccccagc

SEQ ID NO: 3488520 - RNA, 20 nt, Human
agggacaggaccccagcucu

SEQ ID NO: 3488521 - RNA, 21 nt, Human
agggacaggaccccagcucug

SEQ ID NO: 3488522 - RNA, 17 nt, Human
agggacaggauaagagg

SEQ ID NO: 3488523 - RNA, 16 nt, Human
agggacagucucacca

SEQ ID NO: 3488524 - RNA, 22 nt, Human
agggacauguuuugauaaagua

SEQ ID NO: 3488525 - RNA, 24 nt, Human
agggacauguuuugauaaaguagu

SEQ ID NO: 3488526 - RNA, 19 nt, Human
agggaccaacugggcccaa

SEQ ID NO: 3488527 - RNA, 14 nt, Human
agggaccaaggacc

SEQ ID NO: 3488528 - RNA, 18 nt, Human
agggaccaaggaccccuc

SEQ ID NO: 3488529 - RNA, 12 nt, Human
agggaccaaggc

SEQ ID NO: 3488530 - RNA, 21 nt, Human
agggaccaaggcaaggcaggu

SEQ ID NO: 3488531 - RNA, 13 nt, Human
agggaccacagca

SEQ ID NO: 3488532 - RNA, 23 nt, Human
agggaccacagcaaggcaccugc

SEQ ID NO: 3488533 - RNA, 12 nt, Human
agggaccccucc

SEQ ID NO: 3488534 - RNA, 13 nt, Human
agggaccccuccu

SEQ ID NO: 3488535 - RNA, 14 nt, Human
agggaccccuccuc

SEQ ID NO: 3488536 - RNA, 15 nt, Human
agggacccuccacca

SEQ ID NO: 3488537 - RNA, 16 nt, Human
agggaccucucccagg

SEQ ID NO: 3488538 - RNA, 14 nt, Human
agggaccuggggaa

SEQ ID NO: 3488539 - RNA, 13 nt, Human
agggacgccuggg

SEQ ID NO: 3488540 - RNA, 22 nt, Human
agggacgccugggggugccagg

SEQ ID NO: 3488541 - RNA, 23 nt, Human
agggacgccugggggugccagga

SEQ ID NO: 3488542 - RNA, 21 nt, Human
agggacgcuuugggagaaugu

SEQ ID NO: 3488543 - RNA, 14 nt, Human
agggacgcuuuguc

SEQ ID NO: 3488544 - RNA, 20 nt, Human
agggacucaauuucucccca

SEQ ID NO: 3488545 - RNA, 20 nt, Human
agggacucaucauuuccauu

SEQ ID NO: 3488546 - RNA, 19 nt, Human
agggacucaucuuucccuc

SEQ ID NO: 3488547 - RNA, 23 nt, Human
agggacucaucuuucccuccuug

SEQ ID NO: 3488548 - RNA, 14 nt, Human
agggacucugaagc

SEQ ID NO: 3488549 - RNA, 19 nt, Human
agggacucugaagccucug

SEQ ID NO: 3488550 - RNA, 15 nt, Human
agggacugagaaauu

SEQ ID NO: 3488551 - RNA, 13 nt, Human
agggacugagaga

SEQ ID NO: 3488552 - RNA, 20 nt, Human
agggacugagagaugcagaa

SEQ ID NO: 3488553 - RNA, 23 nt, Human
agggacugccagucccccugccc

SEQ ID NO: 3488554 - RNA, 13 nt, Human
agggacuuaaaaa

SEQ ID NO: 3488555 - RNA, 22 nt, Human
agggacuucaggaucaaguccu

SEQ ID NO: 3488556 - RNA, 14 nt, Human
agggacuugaaguu

SEQ ID NO: 3488557 - RNA, 18 nt, Human
agggacuuggaagcuccg

SEQ ID NO: 3488558 - RNA, 20 nt, Human
agggacuuggaagcuccgcu

SEQ ID NO: 3488559 - RNA, 14 nt, Human
agggagaacuuaug

SEQ ID NO: 3488560 - RNA, 13 nt, Human
agggagaagcucc

SEQ ID NO: 3488561 - RNA, 15 nt, Human
agggagaaggaucua

SEQ ID NO: 3488562 - RNA, 22 nt, Human
agggagaaggaucuagaaugug

SEQ ID NO: 3488563 - RNA, 18 nt, Human
agggagaagggauggagg

SEQ ID NO: 3488564 - RNA, 16 nt, Human
agggagaccuggacac

SEQ ID NO: 3488565 - RNA, 22 nt, Human
agggagaccuggacacaggccu

SEQ ID NO: 3488566 - RNA, 20 nt, Human
agggagacgguuuccaggga

SEQ ID NO: 3488567 - RNA, 16 nt, Human
agggagagaccucauc

SEQ ID NO: 3488568 - RNA, 23 nt, Human
agggagagaccucaucaggauga

SEQ ID NO: 3488569 - RNA, 15 nt, Human
agggagagccagcuc

SEQ ID NO: 3488570 - RNA, 14 nt, Human
agggagagcggggc

SEQ ID NO: 3488571 - RNA, 16 nt, Human
agggagagcggggcag

SEQ ID NO: 3488572 - RNA, 16 nt, Human
agggagagggggcugg

SEQ ID NO: 3488573 - RNA, 20 nt, Human
agggagagucucccagggag

SEQ ID NO: 3488574 - RNA, 19 nt, Human
agggagcaaguccuucccu

SEQ ID NO: 3488575 - RNA, 23 nt, Human
agggagcacaacccccagcuccc

SEQ ID NO: 3488576 - RNA, 16 nt, Human
agggagcaccugguga

SEQ ID NO: 3488577 - RNA, 23 nt, Human
agggagcagacuuuuaaagacuu

SEQ ID NO: 3488578 - RNA, 19 nt, Human
agggagcagggaaggccug

SEQ ID NO: 3488579 - RNA, 14 nt, Human
agggagcaguggcu

SEQ ID NO: 3488580 - RNA, 21 nt, Human
agggagcauagaaggcaggug

SEQ ID NO: 3488581 - RNA, 17 nt, Human
agggagcaugagaggag

SEQ ID NO: 3488582 - RNA, 20 nt, Human
agggagcaugagaggaggca

SEQ ID NO: 3488583 - RNA, 15 nt, Human
agggagcauuuuccu

SEQ ID NO: 3488584 - RNA, 11 nt, Human
agggagccaag

SEQ ID NO: 3488585 - RNA, 12 nt, Human
agggagccaagg

SEQ ID NO: 3488586 - RNA, 14 nt, Human
agggagccaaggga

SEQ ID NO: 3488587 - RNA, 16 nt, Human
agggagccaagggaug

SEQ ID NO: 3488588 - RNA, 17 nt, Human
agggagccaagggaugg

SEQ ID NO: 3488589 - RNA, 17 nt, Human
agggagccauuugagag

SEQ ID NO: 3488590 - RNA, 20 nt, Human
agggagccuagaagcuggug

SEQ ID NO: 3488591 - RNA, 16 nt, Human
agggagccuccugccc

SEQ ID NO: 3488592 - RNA, 17 nt, Human
agggagccuccugccca

SEQ ID NO: 3488593 - RNA, 16 nt, Human
agggagcgagggagaa

SEQ ID NO: 3488594 - RNA, 14 nt, Human
agggagcggaaagc

SEQ ID NO: 3488595 - RNA, 17 nt, Human
agggagcguagaaucug

SEQ ID NO: 3488596 - RNA, 22 nt, Human
agggagcuccaacucagaaggg

SEQ ID NO: 3488597 - RNA, 20 nt, Human
agggagcuggcuccagccug

SEQ ID NO: 3488598 - RNA, 21 nt, Human
agggagcuggcuccagccugg

SEQ ID NO: 3488599 - RNA, 22 nt, Human
agggagcuggcuccagccugga

SEQ ID NO: 3488600 - RNA, 16 nt, Human
agggagcugggcccga

SEQ ID NO: 3488601 - RNA, 23 nt, Human
agggaggaagaagcuuaggcagg

SEQ ID NO: 3488602 - RNA, 17 nt, Human
agggaggaccuggggca

SEQ ID NO: 3488603 - RNA, 20 nt, Human
agggaggaccuggggcacag

SEQ ID NO: 3488604 - RNA, 19 nt, Human
agggaggacgggagcuggg

SEQ ID NO: 3488605 - RNA, 15 nt, Human
agggaggaggccacc

SEQ ID NO: 3488606 - RNA, 21 nt, Human
agggaggaggccaccucucca

SEQ ID NO: 3488607 - RNA, 23 nt, Human
agggaggaggccaccucuccaag

SEQ ID NO: 3488608 - RNA, 15 nt, Human
agggaggaguggagg

SEQ ID NO: 3488609 - RNA, 12 nt, Human
agggaggcagcc

SEQ ID NO: 3488610 - RNA, 15 nt, Human
agggaggcagccucc

SEQ ID NO: 3488611 - RNA, 13 nt, Human
agggaggcagggg

SEQ ID NO: 3488612 - RNA, 15 nt, Human
agggaggccccaggg

SEQ ID NO: 3488613 - RNA, 16 nt, Human
agggaggccgaagcua

SEQ ID NO: 3488614 - RNA, 23 nt, Human
agggaggccgaagcuaacaggga

SEQ ID NO: 3488615 - RNA, 15 nt, Human
agggaggcugcugcu

SEQ ID NO: 3488616 - RNA, 14 nt, Human
agggaggcuggucc

SEQ ID NO: 3488617 - RNA, 15 nt, Human
agggaggcugguccu

SEQ ID NO: 3488618 - RNA, 15 nt, Human
agggagggagggcuc

SEQ ID NO: 3488619 - RNA, 13 nt, Human
agggagggagugg

SEQ ID NO: 3488620 - RNA, 17 nt, Human
agggagggcagagcugg

SEQ ID NO: 3488621 - RNA, 16 nt, Human
agggagggcuccagac

SEQ ID NO: 3488622 - RNA, 22 nt, Human
agggagggcuccagacacaugu

SEQ ID NO: 3488623 - RNA, 14 nt, Human
agggagggcucuga

SEQ ID NO: 3488624 - RNA, 20 nt, Human
agggagggcucugaggcgcc

SEQ ID NO: 3488625 - RNA, 15 nt, Human
agggagggcuucugc

SEQ ID NO: 3488626 - RNA, 12 nt, Human
agggaggggccu

SEQ ID NO: 3488627 - RNA, 13 nt, Human
agggaggggcugu

SEQ ID NO: 3488628 - RNA, 17 nt, Human
agggaggucaggcccug

SEQ ID NO: 3488629 - RNA, 19 nt, Human
agggaggugugaggcagga

SEQ ID NO: 3488630 - RNA, 13 nt, Human
agggagguuugug

SEQ ID NO: 3488631 - RNA, 18 nt, Human
agggagguuugugagagc

SEQ ID NO: 3488632 - RNA, 15 nt, Human
agggaguauucuaau

SEQ ID NO: 3488633 - RNA, 14 nt, Human
agggagucagcugu

SEQ ID NO: 3488634 - RNA, 20 nt, Human
agggaguccgaaagggacuu

SEQ ID NO: 3488635 - RNA, 14 nt, Human
agggagucugccag

SEQ ID NO: 3488636 - RNA, 18 nt, Human
agggagugacagaggcag

SEQ ID NO: 3488637 - RNA, 20 nt, Human
agggagugaguugauagcac

SEQ ID NO: 3488638 - RNA, 16 nt, Human
agggagugcuggcuca

SEQ ID NO: 3488639 - RNA, 18 nt, Human
agggagugcuggcucaca

SEQ ID NO: 3488640 - RNA, 13 nt, Human
agggaguuuuuga

SEQ ID NO: 3488641 - RNA, 21 nt, Human
agggauaaagaaaaaaauacu

SEQ ID NO: 3488642 - RNA, 20 nt, Human
agggauagucaccuuuuaaa

SEQ ID NO: 3488643 - RNA, 22 nt, Human
agggaucacagggccccagaag

SEQ ID NO: 3488644 - RNA, 18 nt, Human
agggaucagcccugcccu

SEQ ID NO: 3488645 - RNA, 19 nt, Human
agggaucuugcauucccag

SEQ ID NO: 3488646 - RNA, 17 nt, Human
agggaugaaagagaagg

SEQ ID NO: 3488647 - RNA, 18 nt, Human
agggaugaaggccucccu

SEQ ID NO: 3488648 - RNA, 15 nt, Human
agggaugacuaaaau

SEQ ID NO: 3488649 - RNA, 19 nt, Human
agggaugaggugcugggag

SEQ ID NO: 3488650 - RNA, 18 nt, Human
agggaugauucaagccau

SEQ ID NO: 3488651 - RNA, 15 nt, Human
agggaugcauggaga

SEQ ID NO: 3488652 - RNA, 21 nt, Human
agggaugcccuggagguggcu

SEQ ID NO: 3488653 - RNA, 15 nt, Human
agggauggaaaagga

SEQ ID NO: 3488654 - RNA, 11 nt, Human
agauauuuuau

SEQ ID NO: 3488655 - RNA, 21 nt, Human
agauauuuugcuuugugauuu

SEQ ID NO: 3488656 - RNA, 13 nt, Human
agauauuuuguaa

SEQ ID NO: 3488657 - RNA, 15 nt, Human
agauauuuuguaaaa

SEQ ID NO: 3488658 - RNA, 22 nt, Human
agauauuuuguaaaauguauua

SEQ ID NO: 3488659 - RNA, 13 nt, Human
agauauuuuucau

SEQ ID NO: 3488660 - RNA, 19 nt, Human
agauauuuuucaugauuuu

SEQ ID NO: 3488661 - RNA, 19 nt, Human
agauauuuuuccauuuuuu

SEQ ID NO: 3488662 - RNA, 13 nt, Human
agauauuuuuucu

SEQ ID NO: 3488663 - RNA, 16 nt, Human
agaucaaaaaggcuua

SEQ ID NO: 3488664 - RNA, 23 nt, Human
agguauaauucacauuguauuca

SEQ ID NO: 3488665 - RNA, 11 nt, Human
agguauaauuu

SEQ ID NO: 3488666 - RNA, 15 nt, Human
agguauaccucacuu

SEQ ID NO: 3488667 - RNA, 17 nt, Human
agguauacuuuaguaga

SEQ ID NO: 3488668 - RNA, 21 nt, Human
agguauacuuuaguagacauu

SEQ ID NO: 3488669 - RNA, 21 nt, Human
agguauaucauucuaaagaua

SEQ ID NO: 3488670 - RNA, 22 nt, Human
agguauaucauucuaaagauag

SEQ ID NO: 3488671 - RNA, 22 nt, Human
agguauaucuagguuuaugaca

SEQ ID NO: 3488672 - RNA, 17 nt, Human
agguauauuggaagagg

SEQ ID NO: 3488673 - RNA, 17 nt, Human
agguaucaguugcaaua

SEQ ID NO: 3488674 - RNA, 22 nt, Human
agguaucaguugcaauaauacu

SEQ ID NO: 3488675 - RNA, 15 nt, Human
agguaucuagagcuu

SEQ ID NO: 3488676 - RNA, 15 nt, Human
agguaucuccaggau

SEQ ID NO: 3488677 - RNA, 20 nt, Human
agguaugaccuucuaggaag

SEQ ID NO: 3488678 - RNA, 16 nt, Human
agguaugaggucuagg

SEQ ID NO: 3488679 - RNA, 17 nt, Human
agguaugcaaucaaauc

SEQ ID NO: 3488680 - RNA, 21 nt, Human
agguaugcaaucaaaucugcu

SEQ ID NO: 3488681 - RNA, 20 nt, Human
agguauguugccuuuauggu

SEQ ID NO: 3488682 - RNA, 15 nt, Human
agguauuauuaucuu

SEQ ID NO: 3488683 - RNA, 18 nt, Human
agguauuauuaucuuuaa

SEQ ID NO: 3488684 - RNA, 20 nt, Human
agguauucaauauccuuugc

SEQ ID NO: 3488685 - RNA, 17 nt, Human
agguauuuugaauacca

SEQ ID NO: 3488686 - RNA, 19 nt, Human
agguauuuuucuuuaacca

SEQ ID NO: 3488687 - RNA, 20 nt, Human
aggucaaaauagugccacua

SEQ ID NO: 3488688 - RNA, 19 nt, Human
aggucaacagaaugaaaaa

SEQ ID NO: 3488689 - RNA, 19 nt, Human
aggucaaggccugucccug

SEQ ID NO: 3488690 - RNA, 21 nt, Human
aggucaaggcugcagugagcc

SEQ ID NO: 3488691 - RNA, 17 nt, Human
aggucaaguugucaggu

SEQ ID NO: 3488692 - RNA, 19 nt, Human
aggucaaguugucagguua

SEQ ID NO: 3488693 - RNA, 21 nt, Human
aggucaauacaguacaggcag

SEQ ID NO: 3488694 - RNA, 19 nt, Human
aggucacauucaggaagau

SEQ ID NO: 3488695 - RNA, 12 nt, Human
aggucaccagca

SEQ ID NO: 3488696 - RNA, 15 nt, Human
aggucacccuuugcu

SEQ ID NO: 3488697 - RNA, 14 nt, Human
aggucaccucacuc

SEQ ID NO: 3488698 - RNA, 17 nt, Human
aggucaccucacucagc

SEQ ID NO: 3488699 - RNA, 23 nt, Human
aggucaccucacucagcaccacu

SEQ ID NO: 3488700 - RNA, 22 nt, Human
agauuuguuuuuaaacuguaca

SEQ ID NO: 3488701 - RNA, 16 nt, Human
agauuuuaaucaaauu

SEQ ID NO: 3488702 - RNA, 16 nt, Human
agauuuuaauugucau

SEQ ID NO: 3488703 - RNA, 14 nt, Human
agauuuuaauuuug

SEQ ID NO: 3488704 - RNA, 19 nt, Human
agauuuuacaaaagaugua

SEQ ID NO: 3488705 - RNA, 20 nt, Human
agauuuuacaaaagauguau

SEQ ID NO: 3488706 - RNA, 13 nt, Human
agauuuuacauga

SEQ ID NO: 3488707 - RNA, 18 nt, Human
agauuuuauuauguaaau

SEQ ID NO: 3488708 - RNA, 19 nt, Human
agauuuuauuauguaaauc

SEQ ID NO: 3488709 - RNA, 14 nt, Human
agauuuucagucua

SEQ ID NO: 3488710 - RNA, 20 nt, Human
agauuuuccucuugugauuu

SEQ ID NO: 3488711 - RNA, 14 nt, Human
agauuuuccugaaa

SEQ ID NO: 3488712 - RNA, 15 nt, Human
agauuuuccugaaaa

SEQ ID NO: 3488713 - RNA, 13 nt, Human
agauuuuccugug

SEQ ID NO: 3488714 - RNA, 22 nt, Human
agauuuucugggccuaaaggau

SEQ ID NO: 3488715 - RNA, 17 nt, Human
agauuuucugguucuaa

SEQ ID NO: 3488716 - RNA, 20 nt, Human
agauuuucuuuaaaagaaug

SEQ ID NO: 3488717 - RNA, 21 nt, Human
agauuuugaaauuuuuauuaa

SEQ ID NO: 3488718 - RNA, 14 nt, Human
agauuuugauaacu

SEQ ID NO: 3488719 - RNA, 17 nt, Human
agauuuugauaacuguu

SEQ ID NO: 3488720 - RNA, 12 nt, Human
agauuuuguugg

SEQ ID NO: 3488721 - RNA, 16 nt, Human
agauuuuguuuugcuu

SEQ ID NO: 3488722 - RNA, 24 nt, Human
agauuuuguuuugcuuuuucugac

SEQ ID NO: 3488723 - RNA, 21 nt, Human
agauuuuuaaaaaauauuuuc

SEQ ID NO: 3488724 - RNA, 21 nt, Human
agauuuuuauauuaguugcuu

SEQ ID NO: 3488725 - RNA, 14 nt, Human
agauuuuugcaaua

SEQ ID NO: 3488726 - RNA, 14 nt, Human
agauuuuuuaauaa

SEQ ID NO: 3488727 - RNA, 18 nt, Human
agauuuuuuauugcuagu

SEQ ID NO: 3488728 - RNA, 22 nt, Human
agauuuuuuauugcuaguauuu

SEQ ID NO: 3488729 - RNA, 22 nt, Human
agauuuuuucagacuugucaag

SEQ ID NO: 3488730 - RNA, 18 nt, Human
agauuuuuuuguuguuug

SEQ ID NO: 3488731 - RNA, 19 nt, Human
agauuuuuuuguuguuugu

SEQ ID NO: 3488732 - RNA, 13 nt, Human
agauuuuuuuuaa

SEQ ID NO: 3488733 - RNA, 18 nt, Human
agauuuuuuuuuuuucuc

SEQ ID NO: 3488734 - RNA, 15 nt, Human
agcaaaaaaaguugu

SEQ ID NO: 3488735 - RNA, 18 nt, Human
agcaaaaaaaguuguaug

SEQ ID NO: 3488736 - RNA, 20 nt, Human
agcaaaaaaaguuguaugau

SEQ ID NO: 3488737 - RNA, 12 nt, Human
agcaaaaaagaa

SEQ ID NO: 3488738 - RNA, 22 nt, Human
agcaaaaaaguccaauuuuaau

SEQ ID NO: 3488739 - RNA, 17 nt, Human
agcaaaaaguggggcag

SEQ ID NO: 3488740 - RNA, 11 nt, Human
agcaaaaaugc

SEQ ID NO: 3488741 - RNA, 14 nt, Human
agcaaaaaugcuaa

SEQ ID NO: 3488742 - RNA, 15 nt, Human
agcaaaaaugcuaau

SEQ ID NO: 3488743 - RNA, 17 nt, Human
agcaaaaaugcuaauau

SEQ ID NO: 3488744 - RNA, 12 nt, Human
agcaaaacaaaa

SEQ ID NO: 3488745 - RNA, 18 nt, Human
agcaaaaccauugcuuca

SEQ ID NO: 3488746 - RNA, 20 nt, Human
agcaaaaccauugcuucacu

SEQ ID NO: 3488747 - RNA, 17 nt, Human
agcaaaacuccaucuca

SEQ ID NO: 3488748 - RNA, 13 nt, Human
agcaaaacuuuua

SEQ ID NO: 3488749 - RNA, 13 nt, Human
agcaaaagaaaaa

SEQ ID NO: 3488750 - RNA, 14 nt, Human
agcaaaagaaaaag

SEQ ID NO: 3488751 - RNA, 21 nt, Human
agcaaaagaauggcagaaaag

SEQ ID NO: 3488752 - RNA, 18 nt, Human
agcaaaagaugcuucuca

SEQ ID NO: 3488753 - RNA, 12 nt, Human
agcaaaaggcau

SEQ ID NO: 3488754 - RNA, 21 nt, Human
agcaaaagggugucugagccc

SEQ ID NO: 3488755 - RNA, 16 nt, Human
agcaaaauaaaaacua

SEQ ID NO: 3488756 - RNA, 20 nt, Human
agcaaaaucauggaaugguu

SEQ ID NO: 3488757 - RNA, 23 nt, Human
agcaaaaucauggaaugguuaua

SEQ ID NO: 3488758 - RNA, 15 nt, Human
agcaaaaugugaaug

SEQ ID NO: 3488759 - RNA, 13 nt, Human
agcaaaauugaug

SEQ ID NO: 3488760 - RNA, 23 nt, Human
agcaaaauugauguguuuauuua

SEQ ID NO: 3488761 - RNA, 21 nt, Human
agcaaaccaagagauugcuaa

SEQ ID NO: 3488762 - RNA, 17 nt, Human
agcaaaccauuuuuaaa

SEQ ID NO: 3488763 - RNA, 13 nt, Human
agcaaacccagac

SEQ ID NO: 3488764 - RNA, 15 nt, Human
agcaaacccagacgg

SEQ ID NO: 3488765 - RNA, 20 nt, Human
agcaaacccugucaaacauu

SEQ ID NO: 3488766 - RNA, 19 nt, Human
agcaaaccuaauugcacaa

SEQ ID NO: 3488767 - RNA, 20 nt, Human
agcaaaccuaauugcacaac

SEQ ID NO: 3488768 - RNA, 14 nt, Human
agcaaaccugcccc

SEQ ID NO: 3488769 - RNA, 13 nt, Human
agcaaacuaagcc

SEQ ID NO: 3488770 - RNA, 15 nt, Human
agcaaacugcaugcc

SEQ ID NO: 3488771 - RNA, 18 nt, Human
agcaaacugguuauuuaa

SEQ ID NO: 3488772 - RNA, 13 nt, Human
agcaaacuuggaa

SEQ ID NO: 3488773 - RNA, 22 nt, Human
agcaaagaggacucgcuuguaa

SEQ ID NO: 3488774 - RNA, 13 nt, Human
agcaaagaucaaa

SEQ ID NO: 3488775 - RNA, 14 nt, Human
agcaaagaucaaaa

SEQ ID NO: 3488776 - RNA, 15 nt, Human
agcaaagaucaaaau

SEQ ID NO: 3488777 - RNA, 20 nt, Human
agcaaagcaugccaauuucu

SEQ ID NO: 3488778 - RNA, 16 nt, Human
agcaaagcccccagag

SEQ ID NO: 3488779 - RNA, 21 nt, Human
agcaaagcccccagagcccag

SEQ ID NO: 3488780 - RNA, 22 nt, Human
agcaaagcccccagagcccagg

SEQ ID NO: 3488781 - RNA, 21 nt, Human
agcaaagccuguucauggcag

SEQ ID NO: 3488782 - RNA, 22 nt, Human
agcaaagcggguuauaaugaau

SEQ ID NO: 3488783 - RNA, 20 nt, Human
agcaaaggagauuggaagga

SEQ ID NO: 3488784 - RNA, 23 nt, Human
agcaaaggaguagaaagacagag

SEQ ID NO: 3488785 - RNA, 11 nt, Human
agcaaauacau

SEQ ID NO: 3488786 - RNA, 14 nt, Human
agcaaauacuuagc

SEQ ID NO: 3488787 - RNA, 22 nt, Human
agcaaauacuuagcaaaaagug

SEQ ID NO: 3488788 - RNA, 11 nt, Human
agcaaaucacc

SEQ ID NO: 3488789 - RNA, 13 nt, Human
agcaaaucaguuu

SEQ ID NO: 3488790 - RNA, 12 nt, Human
agcaaauccuuu

SEQ ID NO: 3488791 - RNA, 17 nt, Human
agcaaaucgaaugaaau

SEQ ID NO: 3488792 - RNA, 15 nt, Human
agcaaauggccucau

SEQ ID NO: 3488793 - RNA, 14 nt, Human
agcaaauguuacau

SEQ ID NO: 3488794 - RNA, 13 nt, Human
agcaaauguuucu

SEQ ID NO: 3488795 - RNA, 16 nt, Human
agcaaauuaauuggca

SEQ ID NO: 3488796 - RNA, 21 nt, Human
agcaaauuaauuggcagcaga

SEQ ID NO: 3488797 - RNA, 16 nt, Human
agcaaauuuauaauuu

SEQ ID NO: 3488798 - RNA, 19 nt, Human
agcaaauuuauaauuuuaa

SEQ ID NO: 3488799 - RNA, 15 nt, Human
agcaacacaaagcuu

SEQ ID NO: 3488800 - RNA, 18 nt, Human
agcaacacaagcuggaag

SEQ ID NO: 3488801 - RNA, 15 nt, Human
agcaacacagccugg

SEQ ID NO: 3488802 - RNA, 21 nt, Human
agcaacaucuagcaaauguua

SEQ ID NO: 3488803 - RNA, 12 nt, Human
agcaacauggcu

SEQ ID NO: 3488804 - RNA, 14 nt, Human
agcaaccaaaaaga

SEQ ID NO: 3488805 - RNA, 16 nt, Human
agcaaccagagcacug

SEQ ID NO: 3488806 - RNA, 22 nt, Human
agcaaccauauagaaagcuuug

SEQ ID NO: 3488807 - RNA, 16 nt, Human
agcaaccccaggcuga

SEQ ID NO: 3488808 - RNA, 19 nt, Human
agcaaccccuggaccccag

SEQ ID NO: 3488809 - RNA, 15 nt, Human
agcacaugcuggcca

SEQ ID NO: 3488810 - RNA, 22 nt, Human
agcaccaaaagcuuaccaaggg

SEQ ID NO: 3488811 - RNA, 19 nt, Human
agcaccaaaauaagaaaag

SEQ ID NO: 3488812 - RNA, 21 nt, Human
agcaccaaaauaagaaaagau

SEQ ID NO: 3488813 - RNA, 18 nt, Human
agcaccaaaucaaaaucu

SEQ ID NO: 3488814 - RNA, 18 nt, Human
agcaccaagcucaaagcg

SEQ ID NO: 3488815 - RNA, 12 nt, Human
agcaccacccua

SEQ ID NO: 3488816 - RNA, 23 nt, Human
agcaccaggcacgaacccaccug

SEQ ID NO: 3488817 - RNA, 10 nt, Human
agcaccaggg

SEQ ID NO: 3488818 - RNA, 13 nt, Human
agcaccagggaag

SEQ ID NO: 3488819 - RNA, 14 nt, Human
agcaccauccccuc

SEQ ID NO: 3488820 - RNA, 19 nt, Human
agcaccauccgccagggcc

SEQ ID NO: 3488821 - RNA, 20 nt, Human
agcacccagcaacuccaacu

SEQ ID NO: 3488822 - RNA, 19 nt, Human
agcaccccucucugcaucu

SEQ ID NO: 3488823 - RNA, 15 nt, Human
agcaccccugucucu

SEQ ID NO: 3488824 - RNA, 17 nt, Human
agcacccgggcucaggg

SEQ ID NO: 3488825 - RNA, 13 nt, Human
agcacccucugga

SEQ ID NO: 3488826 - RNA, 12 nt, Human
agcacccugagg

SEQ ID NO: 3488827 - RNA, 14 nt, Human
agcacccugagggc

SEQ ID NO: 3488828 - RNA, 14 nt, Human
agcaccgaggggcc

SEQ ID NO: 3488829 - RNA, 17 nt, Human
agcaccgaggggccuuu

SEQ ID NO: 3488830 - RNA, 15 nt, Human
agcaccguucugugc

SEQ ID NO: 3488831 - RNA, 15 nt, Human
agcaccuacagugua

SEQ ID NO: 3488832 - RNA, 17 nt, Human
agcaccuagccucgcuc

SEQ ID NO: 3488833 - RNA, 16 nt, Human
agcaccuccagccuga

SEQ ID NO: 3488834 - RNA, 21 nt, Human
agcaccuccauuaaagucuga

SEQ ID NO: 3488835 - RNA, 13 nt, Human
agcaccucccagc

SEQ ID NO: 3488836 - RNA, 16 nt, Human
agcaccuccucagccu

SEQ ID NO: 3488837 - RNA, 14 nt, Human
agcaccuccugccu

SEQ ID NO: 3488838 - RNA, 21 nt, Human
agcaccugccgaccucguccu

SEQ ID NO: 3488839 - RNA, 15 nt, Human
agcaccugcugucug

SEQ ID NO: 3488840 - RNA, 21 nt, Human
agcaccugcuucaugcucagc

SEQ ID NO: 3488841 - RNA, 15 nt, Human
agcaccuuccucacu

SEQ ID NO: 3488842 - RNA, 16 nt, Human
agcaccuuccucacuu

SEQ ID NO: 3488843 - RNA, 18 nt, Human
agcaccuugugccugggg

SEQ ID NO: 3488844 - RNA, 19 nt, Human
agcaccuugugccuggggu

SEQ ID NO: 3488845 - RNA, 19 nt, Human
agcaccuuugcacaggaug

SEQ ID NO: 3488846 - RNA, 14 nt, Human
agcacgauuucugu

SEQ ID NO: 3488847 - RNA, 19 nt, Human
agcacgauuucuguuuaga

SEQ ID NO: 3488848 - RNA, 21 nt, Human
agcacggacaauaaaccuccg

SEQ ID NO: 3488849 - RNA, 20 nt, Human
agcacggcucuguccccagc

SEQ ID NO: 3488850 - RNA, 21 nt, Human
agcacggcucuguccccagcc

SEQ ID NO: 3488851 - RNA, 16 nt, Human
agcacguuuaaaguuc

SEQ ID NO: 3488852 - RNA, 19 nt, Human
agcacuaaacuuggugcuu

SEQ ID NO: 3488853 - RNA, 16 nt, Human
agcacuaaagcagugg

SEQ ID NO: 3488854 - RNA, 19 nt, Human
agcacuaaggugugcucug

SEQ ID NO: 3488855 - RNA, 20 nt, Human
agcacuagagaaugcacaga

SEQ ID NO: 3488856 - RNA, 23 nt, Human
agcacuagguucaauucccugaa

SEQ ID NO: 3488857 - RNA, 16 nt, Human
agcacucacacaggac

SEQ ID NO: 3488858 - RNA, 13 nt, Human
agcacucacaugc

SEQ ID NO: 3488859 - RNA, 21 nt, Human
agcacucacaugcuggacagg

SEQ ID NO: 3488860 - RNA, 18 nt, Human
agcacucacgcccuaagc

SEQ ID NO: 3488861 - RNA, 18 nt, Human
agcacucaggcucuccau

SEQ ID NO: 3488862 - RNA, 13 nt, Human
agcacucccaagu

SEQ ID NO: 3488863 - RNA, 20 nt, Human
agcacucccaagucuacaga

SEQ ID NO: 3488864 - RNA, 24 nt, Human
agcacucgcuagcaguggcaggca

SEQ ID NO: 3488865 - RNA, 19 nt, Human
agggccgacuaagagaagu

SEQ ID NO: 3488866 - RNA, 21 nt, Human
agggccgaggaggugccugga

SEQ ID NO: 3488867 - RNA, 18 nt, Human
agggccgggcagaggggc

SEQ ID NO: 3488868 - RNA, 20 nt, Human
agggccggggaacuggccaa

SEQ ID NO: 3488869 - RNA, 23 nt, Human
agggccggggaacuggccaagcu

SEQ ID NO: 3488870 - RNA, 18 nt, Human
agggccguaccccacccu

SEQ ID NO: 3488871 - RNA, 16 nt, Human
agggccuagcugcuac

SEQ ID NO: 3488872 - RNA, 20 nt, Human
agggccuccauuccuggagc

SEQ ID NO: 3488873 - RNA, 20 nt, Human
agggccugagccuggccagc

SEQ ID NO: 3488874 - RNA, 22 nt, Human
agggccugagccuggccagccu

SEQ ID NO: 3488875 - RNA, 21 nt, Human
agggccugaggucuggcugcu

SEQ ID NO: 3488876 - RNA, 19 nt, Human
agggccugaugggguggaa

SEQ ID NO: 3488877 - RNA, 15 nt, Human
agggccugcaaggga

SEQ ID NO: 3488878 - RNA, 15 nt, Human
agggccugcuggagg

SEQ ID NO: 3488879 - RNA, 16 nt, Human
agggccugcuggaggc

SEQ ID NO: 3488880 - RNA, 19 nt, Human
agggccugcuggaggccuc

SEQ ID NO: 3488881 - RNA, 16 nt, Human
agggccuggcccaugu

SEQ ID NO: 3488882 - RNA, 15 nt, Human
agggccuggccugag

SEQ ID NO: 3488883 - RNA, 17 nt, Human
agggccuggccugagcu

SEQ ID NO: 3488884 - RNA, 18 nt, Human
agggccuggccugagcug

SEQ ID NO: 3488885 - RNA, 19 nt, Human
agggccugggccuggcucc

SEQ ID NO: 3488886 - RNA, 21 nt, Human
agggccuggggccugagagaa

SEQ ID NO: 3488887 - RNA, 17 nt, Human
agggccuggucccuggg

SEQ ID NO: 3488888 - RNA, 17 nt, Human
agggccugguugaagaa

SEQ ID NO: 3488889 - RNA, 17 nt, Human
agggccuuaaaagccau

SEQ ID NO: 3488890 - RNA, 12 nt, Human
agggccuugccc

SEQ ID NO: 3488891 - RNA, 17 nt, Human
agggccuugcccagaga

SEQ ID NO: 3488892 - RNA, 23 nt, Human
agggccuugcccagagaugccuc

SEQ ID NO: 3488893 - RNA, 19 nt, Human
agggccuuuucuggcaccg

SEQ ID NO: 3488894 - RNA, 21 nt, Human
agggcgaccccgucacagccu

SEQ ID NO: 3488895 - RNA, 17 nt, Human
agggcgggcagagggcu

SEQ ID NO: 3488896 - RNA, 23 nt, Human
agggcggggcacagauuggagag

SEQ ID NO: 3488897 - RNA, 21 nt, Human
agggcggggugucugucuucc

SEQ ID NO: 3488898 - RNA, 16 nt, Human
agggcgugacucaccc

SEQ ID NO: 3488899 - RNA, 21 nt, Human
agggcguucuuaggcugcugg

SEQ ID NO: 3488900 - RNA, 23 nt, Human
agggcuaagagcuagcgcugccg

SEQ ID NO: 3488901 - RNA, 19 nt, Human
agggcuacccucccccagg

SEQ ID NO: 3488902 - RNA, 17 nt, Human
agggcuagaaccuggaa

SEQ ID NO: 3488903 - RNA, 18 nt, Human
agggcuagaaccuggaag

SEQ ID NO: 3488904 - RNA, 19 nt, Human
agggcuagaaccuggaagg

SEQ ID NO: 3488905 - RNA, 19 nt, Human
agggcuagaaccuggagag

SEQ ID NO: 3488906 - RNA, 17 nt, Human
agggcuagaacuggaga

SEQ ID NO: 3488907 - RNA, 18 nt, Human
agggcuagaacuggagag

SEQ ID NO: 3488908 - RNA, 18 nt, Human
agggcuagaaucuggaga

SEQ ID NO: 3488909 - RNA, 15 nt, Human
agggcuauggugugg

SEQ ID NO: 3488910 - RNA, 19 nt, Human
agggcuaugguguggacug

SEQ ID NO: 3488911 - RNA, 23 nt, Human
agggcucagcggggacagcuccu

SEQ ID NO: 3488912 - RNA, 15 nt, Human
agggcuccagacaca

SEQ ID NO: 3488913 - RNA, 14 nt, Human
agggcuccagcccc

SEQ ID NO: 3488914 - RNA, 20 nt, Human
agggcuccagccccucuugg

SEQ ID NO: 3488915 - RNA, 14 nt, Human
agggcucccagggg

SEQ ID NO: 3488916 - RNA, 20 nt, Human
agggcuccccacugccuacu

SEQ ID NO: 3488917 - RNA, 14 nt, Human
agggcuccucccag

SEQ ID NO: 3488918 - RNA, 19 nt, Human
agggcuccucuccagucug

SEQ ID NO: 3488919 - RNA, 15 nt, Human
agggcuccugccuuc

SEQ ID NO: 3488920 - RNA, 22 nt, Human
agggcuccuugugggccugggc

SEQ ID NO: 3488921 - RNA, 15 nt, Human
agggcucuccuggcu

SEQ ID NO: 3488922 - RNA, 16 nt, Human
agggcucucuuaggca

SEQ ID NO: 3488923 - RNA, 21 nt, Human
agggcucucuuuccuucuugc

SEQ ID NO: 3488924 - RNA, 17 nt, Human
agggcucugacaaagcu

SEQ ID NO: 3488925 - RNA, 15 nt, Human
agggcucugauauuc

SEQ ID NO: 3488926 - RNA, 14 nt, Human
agggcucugcccca

SEQ ID NO: 3488927 - RNA, 15 nt, Human
agggcucugccccag

SEQ ID NO: 3488928 - RNA, 14 nt, Human
agggcugaaagcca

SEQ ID NO: 3488929 - RNA, 15 nt, Human
agggcugaccugccu

SEQ ID NO: 3488930 - RNA, 23 nt, Human
agggcugaccugccucucacaca

SEQ ID NO: 3488931 - RNA, 16 nt, Human
agggcugagccugguc

SEQ ID NO: 3488932 - RNA, 12 nt, Human
agggcugcaguu

SEQ ID NO: 3488933 - RNA, 23 nt, Human
agggcugcggcguacaggcuggc

SEQ ID NO: 3488934 - RNA, 17 nt, Human
agggcugcuagacggag

SEQ ID NO: 3488935 - RNA, 13 nt, Human
agggcugcuguga

SEQ ID NO: 3488936 - RNA, 12 nt, Human
agggcuggaccu

SEQ ID NO: 3488937 - RNA, 14 nt, Human
agggcuggagaaca

SEQ ID NO: 3488938 - RNA, 17 nt, Human
agggcuggaggcccagg

SEQ ID NO: 3488939 - RNA, 19 nt, Human
agggcuggaggcccaggcu

SEQ ID NO: 3488940 - RNA, 18 nt, Human
agggcuggcccagcccug

SEQ ID NO: 3488941 - RNA, 19 nt, Human
agggcuggcccagcccugc

SEQ ID NO: 3488942 - RNA, 14 nt, Human
agggcuggcuccug

SEQ ID NO: 3488943 - RNA, 19 nt, Human
agggcuggcuccugaucca

SEQ ID NO: 3488944 - RNA, 12 nt, Human
agggcuggcugg

SEQ ID NO: 3488945 - RNA, 13 nt, Human
agggcuggcuggc

SEQ ID NO: 3488946 - RNA, 22 nt, Human
agggcugggaaacacuccuugc

SEQ ID NO: 3488947 - RNA, 14 nt, Human
agggcugggaggaa

SEQ ID NO: 3488948 - RNA, 16 nt, Human
agggcugggaggaagg

SEQ ID NO: 3488949 - RNA, 20 nt, Human
agggcugggcaaggaaaaag

SEQ ID NO: 3488950 - RNA, 21 nt, Human
agggcugggcaaggaaaaaga

SEQ ID NO: 3488951 - RNA, 18 nt, Human
agggcuggggcagccucu

SEQ ID NO: 3488952 - RNA, 12 nt, Human
agggcugggugu

SEQ ID NO: 3488953 - RNA, 19 nt, Human
acacguauuugaauggccu

SEQ ID NO: 3488954 - RNA, 14 nt, Human
acacguccacccca

SEQ ID NO: 3488955 - RNA, 21 nt, Human
acacgugggcuccccucuucc

SEQ ID NO: 3488956 - RNA, 15 nt, Human
acacguuggaguaua

SEQ ID NO: 3488957 - RNA, 15 nt, Human
acacguuuuaaggac

SEQ ID NO: 3488958 - RNA, 22 nt, Human
acacguuuuaaggacugacuga

SEQ ID NO: 3488959 - RNA, 12 nt, Human
acacuaaaauuu

SEQ ID NO: 3488960 - RNA, 15 nt, Human
acacuaaacagacua

SEQ ID NO: 3488961 - RNA, 20 nt, Human
acacuaacgauuuguuaaug

SEQ ID NO: 3488962 - RNA, 13 nt, Human
acacuaagagaga

SEQ ID NO: 3488963 - RNA, 19 nt, Human
acacuaaguuauaguauau

SEQ ID NO: 3488964 - RNA, 22 nt, Human
acacuaauauauuuaaaaauaa

SEQ ID NO: 3488965 - RNA, 22 nt, Human
acacuaaugaggaaacugcacu

SEQ ID NO: 3488966 - RNA, 13 nt, Human
acacuaauucaua

SEQ ID NO: 3488967 - RNA, 17 nt, Human
acacuaauuccuuucua

SEQ ID NO: 3488968 - RNA, 13 nt, Human
acacuacacccag

SEQ ID NO: 3488969 - RNA, 23 nt, Human
acacuacacccagcaauagagac

SEQ ID NO: 3488970 - RNA, 14 nt, Human
acacuacauuagaa

SEQ ID NO: 3488971 - RNA, 20 nt, Human
acacuaccagcguauauaua

SEQ ID NO: 3488972 - RNA, 16 nt, Human
acacuagacaagccag

SEQ ID NO: 3488973 - RNA, 13 nt, Human
acacuagccucuc

SEQ ID NO: 3488974 - RNA, 22 nt, Human
acacuagcuaauaucaauagaa

SEQ ID NO: 3488975 - RNA, 15 nt, Human
acacuagucugugug

SEQ ID NO: 3488976 - RNA, 13 nt, Human
acacuauaucugu

SEQ ID NO: 3488977 - RNA, 14 nt, Human
acacuauaucugua

SEQ ID NO: 3488978 - RNA, 18 nt, Human
acacuauaucuguauaua

SEQ ID NO: 3488979 - RNA, 19 nt, Human
acacuaucauaguuaacau

SEQ ID NO: 3488980 - RNA, 11 nt, Human
acacuauuuua

SEQ ID NO: 3488981 - RNA, 13 nt, Human
acacuauuuucag

SEQ ID NO: 3488982 - RNA, 16 nt, Human
acacuauuuucagaau

SEQ ID NO: 3488983 - RNA, 19 nt, Human
acacuauuuucagaaucug

SEQ ID NO: 3488984 - RNA, 20 nt, Human
acacuauuuuuuuuucuuuu

SEQ ID NO: 3488985 - RNA, 21 nt, Human
acacucaaaagcugggcaggu

SEQ ID NO: 3488986 - RNA, 19 nt, Human
acacucaaaucaagaaacu

SEQ ID NO: 3488987 - RNA, 20 nt, Human
acacucacauuuauucugcu

SEQ ID NO: 3488988 - RNA, 20 nt, Human
acacucaccaugaagcgaaa

SEQ ID NO: 3488989 - RNA, 15 nt, Human
acacucacuucucuu

SEQ ID NO: 3488990 - RNA, 13 nt, Human
acacucagaagcc

SEQ ID NO: 3488991 - RNA, 14 nt, Human
acacucagaagccu

SEQ ID NO: 3488992 - RNA, 15 nt, Human
acacucagaagccug

SEQ ID NO: 3488993 - RNA, 17 nt, Human
acacucagaagccuggg

SEQ ID NO: 3488994 - RNA, 14 nt, Human
acacucagaccuga

SEQ ID NO: 3488995 - RNA, 12 nt, Human
acacucagcugu

SEQ ID NO: 3488996 - RNA, 20 nt, Human
acacucagcuguucagauug

SEQ ID NO: 3488997 - RNA, 14 nt, Human
acacucaugcugaa

SEQ ID NO: 3488998 - RNA, 16 nt, Human
acacucauugaccuga

SEQ ID NO: 3488999 - RNA, 18 nt, Human
acacuccaauuaaggauu

SEQ ID NO: 3489000 - RNA, 15 nt, Human
acaggagagaaaggg

SEQ ID NO: 3489001 - RNA, 18 nt, Human
acaggagaugcugugccc

SEQ ID NO: 3489002 - RNA, 14 nt, Human
acaggagcuaccug

SEQ ID NO: 3489003 - RNA, 19 nt, Human
acaggaggcaagcaagcuc

SEQ ID NO: 3489004 - RNA, 18 nt, Human
acaggagggcaagggcca

SEQ ID NO: 3489005 - RNA, 23 nt, Human
acaggagggggucguggagagcu

SEQ ID NO: 3489006 - RNA, 17 nt, Human
acaggagguuggaggga

SEQ ID NO: 3489007 - RNA, 21 nt, Human
acaggaguguccucuucccuc

SEQ ID NO: 3489008 - RNA, 12 nt, Human
acaggauccagg

SEQ ID NO: 3489009 - RNA, 18 nt, Human
acaggauccaggccggcu

SEQ ID NO: 3489010 - RNA, 14 nt, Human
acaggaugaaggca

SEQ ID NO: 3489011 - RNA, 18 nt, Human
acaggaugaccuggauaa

SEQ ID NO: 3489012 - RNA, 19 nt, Human
acaggauguguuugcuuuc

SEQ ID NO: 3489013 - RNA, 19 nt, Human
acaggcaacugaggcagac

SEQ ID NO: 3489014 - RNA, 15 nt, Human
acaggcaagcaccuc

SEQ ID NO: 3489015 - RNA, 23 nt, Human
acaggcaagcaccuccugccucg

SEQ ID NO: 3489016 - RNA, 23 nt, Human
acaggcaaugcuggcuguuggcu

SEQ ID NO: 3489017 - RNA, 12 nt, Human
acaggcaauucc

SEQ ID NO: 3489018 - RNA, 12 nt, Human
acaggcacaaaa

SEQ ID NO: 3489019 - RNA, 23 nt, Human
acaggcacccaccaucaugucug

SEQ ID NO: 3489020 - RNA, 14 nt, Human
acaggcaccgagaa

SEQ ID NO: 3489021 - RNA, 21 nt, Human
acaggcaccgagaauguugua

SEQ ID NO: 3489022 - RNA, 15 nt, Human
acaggcacugcccug

SEQ ID NO: 3489023 - RNA, 18 nt, Human
acaggcacugcccuggug

SEQ ID NO: 3489024 - RNA, 12 nt, Human
acaggcagaaag

SEQ ID NO: 3489025 - RNA, 15 nt, Human
acaggcagaaagagu

SEQ ID NO: 3489026 - RNA, 17 nt, Human
acaggcagcacagagac

SEQ ID NO: 3489027 - RNA, 21 nt, Human
acaggcagccagugcccugag

SEQ ID NO: 3489028 - RNA, 20 nt, Human
acaggcagcuuuaaccauua

SEQ ID NO: 3489029 - RNA, 14 nt, Human
acaggcagguccag

SEQ ID NO: 3489030 - RNA, 16 nt, Human
acaggcagguccaggg

SEQ ID NO: 3489031 - RNA, 22 nt, Human
acaggcagucucucucuuccuc

SEQ ID NO: 3489032 - RNA, 19 nt, Human
acaggcaguuacuucugag

SEQ ID NO: 3489033 - RNA, 18 nt, Human
acaggcauuuguucacug

SEQ ID NO: 3489034 - RNA, 19 nt, Human
acaggccacccugugcaga

SEQ ID NO: 3489035 - RNA, 21 nt, Human
acaggccacccugugcagaag

SEQ ID NO: 3489036 - RNA, 15 nt, Human
acaggcccagcauug

SEQ ID NO: 3489037 - RNA, 21 nt, Human
acaggcccccuugaguggggu

SEQ ID NO: 3489038 - RNA, 17 nt, Human
acaggcccggcuccagg

SEQ ID NO: 3489039 - RNA, 17 nt, Human
acaggcccugcuccugc

SEQ ID NO: 3489040 - RNA, 12 nt, Human
acaggcccuggc

SEQ ID NO: 3489041 - RNA, 16 nt, Human
acaggcccuuccucuc

SEQ ID NO: 3489042 - RNA, 22 nt, Human
acaggcccuuccucuccacugc

SEQ ID NO: 3489043 - RNA, 19 nt, Human
acaggccucacacacaaug

SEQ ID NO: 3489044 - RNA, 14 nt, Human
acaggccucagggc

SEQ ID NO: 3489045 - RNA, 18 nt, Human
acaggccucagggcuccu

SEQ ID NO: 3489046 - RNA, 11 nt, Human
acaggccuccc

SEQ ID NO: 3489047 - RNA, 19 nt, Human
acaggccuguguagcugug

SEQ ID NO: 3489048 - RNA, 20 nt, Human
acaggccuguguagcuguga

SEQ ID NO: 3489049 - RNA, 17 nt, Human
acaggcgggaggaggug

SEQ ID NO: 3489050 - RNA, 19 nt, Human
acaggcgugagccaccucg

SEQ ID NO: 3489051 - RNA, 16 nt, Human
acaggcucaggcaggg

SEQ ID NO: 3489052 - RNA, 15 nt, Human
acaggcucuuagcag

SEQ ID NO: 3489053 - RNA, 18 nt, Human
acaggcugagugcaggcc

SEQ ID NO: 3489054 - RNA, 19 nt, Human
acaggcugagugcaggccc

SEQ ID NO: 3489055 - RNA, 24 nt, Human
acaggcugcggccccucccccguc

SEQ ID NO: 3489056 - RNA, 18 nt, Human
acaggcuggaagauagcu

SEQ ID NO: 3489057 - RNA, 14 nt, Human
acaggcuggcgggg

SEQ ID NO: 3489058 - RNA, 17 nt, Human
acaggcugggcuucagu

SEQ ID NO: 3489059 - RNA, 22 nt, Human
acaggcuguucugcacugaaaa

SEQ ID NO: 3489060 - RNA, 21 nt, Human
acagggaacgugauuagugaa

SEQ ID NO: 3489061 - RNA, 15 nt, Human
acagggaagcuacag

SEQ ID NO: 3489062 - RNA, 19 nt, Human
acagggaagcuacagguua

SEQ ID NO: 3489063 - RNA, 23 nt, Human
acagggaagcuacagguuacaac

SEQ ID NO: 3489064 - RNA, 14 nt, Human
acagggaaggcagg

SEQ ID NO: 3489065 - RNA, 23 nt, Human
acagggaaggcaggcagggcucu

SEQ ID NO: 3489066 - RNA, 22 nt, Human
acagggaaugccugagugccug

SEQ ID NO: 3489067 - RNA, 22 nt, Human
acagggaauuaggcccccauca

SEQ ID NO: 3489068 - RNA, 12 nt, Human
acagggacccac

SEQ ID NO: 3489069 - RNA, 16 nt, Human
acagggacuugaaguu

SEQ ID NO: 3489070 - RNA, 18 nt, Human
acagggagccuccugccc

SEQ ID NO: 3489071 - RNA, 19 nt, Human
acagggagccuccugccca

SEQ ID NO: 3489072 - RNA, 20 nt, Human
acagggaggacgcucucugg

SEQ ID NO: 3489073 - RNA, 10 nt, Human
acagggaggg

SEQ ID NO: 3489074 - RNA, 18 nt, Human
acagggauaaggccugug

SEQ ID NO: 3489075 - RNA, 23 nt, Human
acagggaugagcauggagcuggc

SEQ ID NO: 3489076 - RNA, 16 nt, Human
acagggauucucacaa

SEQ ID NO: 3489077 - RNA, 15 nt, Human
acagggcaccugcca

SEQ ID NO: 3489078 - RNA, 18 nt, Human
acagggcagcugggccca

SEQ ID NO: 3489079 - RNA, 16 nt, Human
acagggcaucuccagg

SEQ ID NO: 3489080 - RNA, 17 nt, Human
acagggcaucuccagga

SEQ ID NO: 3489081 - RNA, 20 nt, Human
acagggccaguggggccugu

SEQ ID NO: 3489082 - RNA, 20 nt, Human
acagggcccuguugaauuuu

SEQ ID NO: 3489083 - RNA, 12 nt, Human
acagggccucug

SEQ ID NO: 3489084 - RNA, 19 nt, Human
acagggccuggcccaugua

SEQ ID NO: 3489085 - RNA, 15 nt, Human
acagggcuggcccag

SEQ ID NO: 3489086 - RNA, 24 nt, Human
acagggcuggcccagcccugcugg

SEQ ID NO: 3489087 - RNA, 22 nt, Human
acaggggaauauuuuauucaag

SEQ ID NO: 3489088 - RNA, 22 nt, Human
acaggggcgugaggucccagga

SEQ ID NO: 3489089 - RNA, 14 nt, Human
acaggggcuugacu

SEQ ID NO: 3489090 - RNA, 16 nt, Human
acagggggccagaaca

SEQ ID NO: 3489091 - RNA, 19 nt, Human
acagggggucuggcuggug

SEQ ID NO: 3489092 - RNA, 21 nt, Human
acaggguaacuaacuaaaaca

SEQ ID NO: 3489093 - RNA, 19 nt, Human
acagggucucuagugcugu

SEQ ID NO: 3489094 - RNA, 15 nt, Human
acagggucugcucuu

SEQ ID NO: 3489095 - RNA, 14 nt, Human
acagggugggccuc

SEQ ID NO: 3489096 - RNA, 21 nt, Human
acaggguguugucagcaucuu

SEQ ID NO: 3489097 - RNA, 13 nt, Human
acagcuacacaga

SEQ ID NO: 3489098 - RNA, 16 nt, Human
acagcuaccaugacaa

SEQ ID NO: 3489099 - RNA, 14 nt, Human
acagcuacucuccc

SEQ ID NO: 3489100 - RNA, 15 nt, Human
acagcuauauuucug

SEQ ID NO: 3489101 - RNA, 14 nt, Human
acagcuaugaagaa

SEQ ID NO: 3489102 - RNA, 16 nt, Human
acagcuaugggagccc

SEQ ID NO: 3489103 - RNA, 21 nt, Human
acagcucagcuuuuugucuuu

SEQ ID NO: 3489104 - RNA, 13 nt, Human
acagcucaggcug

SEQ ID NO: 3489105 - RNA, 14 nt, Human
acagcucauuaaac

SEQ ID NO: 3489106 - RNA, 19 nt, Human
acagcucauuaaacuuuuu

SEQ ID NO: 3489107 - RNA, 15 nt, Human
acagcuccaagaauu

SEQ ID NO: 3489108 - RNA, 14 nt, Human
acagcucccacccc

SEQ ID NO: 3489109 - RNA, 16 nt, Human
acagcucccaccccac

SEQ ID NO: 3489110 - RNA, 14 nt, Human
acagcucccucugc

SEQ ID NO: 3489111 - RNA, 12 nt, Human
acagcuccuucu

SEQ ID NO: 3489112 - RNA, 13 nt, Human
acagcuccuucug

SEQ ID NO: 3489113 - RNA, 15 nt, Human
acagcuccuucuguc

SEQ ID NO: 3489114 - RNA, 23 nt, Human
acagcuccuucuguccuacucug

SEQ ID NO: 3489115 - RNA, 14 nt, Human
acagcuccuuggga

SEQ ID NO: 3489116 - RNA, 15 nt, Human
acagcucugacuuua

SEQ ID NO: 3489117 - RNA, 17 nt, Human
acagcucugacuuuaca

SEQ ID NO: 3489118 - RNA, 14 nt, Human
acagcucugcauac

SEQ ID NO: 3489119 - RNA, 15 nt, Human
acagcucuggccaca

SEQ ID NO: 3489120 - RNA, 16 nt, Human
acagcucuuaaaugua

SEQ ID NO: 3489121 - RNA, 19 nt, Human
acagcugagagacuuuuaa

SEQ ID NO: 3489122 - RNA, 22 nt, Human
acagcugaggucucuugaggga

SEQ ID NO: 3489123 - RNA, 17 nt, Human
acagcugaguuguugag

SEQ ID NO: 3489124 - RNA, 20 nt, Human
acagcugcauuagaaaaaga

SEQ ID NO: 3489125 - RNA, 13 nt, Human
acagcugccuggg

SEQ ID NO: 3489126 - RNA, 11 nt, Human
acagcugccuu

SEQ ID NO: 3489127 - RNA, 12 nt, Human
acagcugccuua

SEQ ID NO: 3489128 - RNA, 21 nt, Human
acagcugcucaauaaaguaca

SEQ ID NO: 3489129 - RNA, 20 nt, Human
acagcugcuccuagagggag

SEQ ID NO: 3489130 - RNA, 23 nt, Human
acagcugcuccuagagggagggg

SEQ ID NO: 3489131 - RNA, 16 nt, Human
acagcuggcucuacuu

SEQ ID NO: 3489132 - RNA, 21 nt, Human
acagcuggggugcagggaugu

SEQ ID NO: 3489133 - RNA, 12 nt, Human
acagcuggugua

SEQ ID NO: 3489134 - RNA, 15 nt, Human
acagcugguguagcu

SEQ ID NO: 3489135 - RNA, 14 nt, Human
acagcuguaugauu

SEQ ID NO: 3489136 - RNA, 19 nt, Human
acagcuguaugauucccag

SEQ ID NO: 3489137 - RNA, 20 nt, Human
acagcuguaugauucccagc

SEQ ID NO: 3489138 - RNA, 23 nt, Human
acagcuguaugauucccagccag

SEQ ID NO: 3489139 - RNA, 20 nt, Human
acagcuguauugucugaacu

SEQ ID NO: 3489140 - RNA, 15 nt, Human
acagcugugccucgc

SEQ ID NO: 3489141 - RNA, 16 nt, Human
acagcugugccucgcu

SEQ ID NO: 3489142 - RNA, 17 nt, Human
acagcugugccucgcuc

SEQ ID NO: 3489143 - RNA, 10 nt, Human
acagcugugu

SEQ ID NO: 3489144 - RNA, 23 nt, Human
acagcugugugacauuuggagag

SEQ ID NO: 3489145 - RNA, 22 nt, Human
acagcuguguuauucuuugcgu

SEQ ID NO: 3489146 - RNA, 14 nt, Human
acagcuguugacuc

SEQ ID NO: 3489147 - RNA, 17 nt, Human
acagcuguuuaagaugg

SEQ ID NO: 3489148 - RNA, 16 nt, Human
acagcuuagauuucau

SEQ ID NO: 3489149 - RNA, 17 nt, Human
acagcuucagccaggag

SEQ ID NO: 3489150 - RNA, 15 nt, Human
acagcuucagguuau

SEQ ID NO: 3489151 - RNA, 20 nt, Human
acagcuucaugccuuuguaa

SEQ ID NO: 3489152 - RNA, 19 nt, Human
acagcuucauuuccugugu

SEQ ID NO: 3489153 - RNA, 11 nt, Human
acagcuuccug

SEQ ID NO: 3489154 - RNA, 15 nt, Human
acagcuugaccugag

SEQ ID NO: 3489155 - RNA, 21 nt, Human
acagcuugaccugaggcugug

SEQ ID NO: 3489156 - RNA, 22 nt, Human
acagcuugaccugaggcugugg

SEQ ID NO: 3489157 - RNA, 19 nt, Human
acagcuuguuuuggacuuu

SEQ ID NO: 3489158 - RNA, 22 nt, Human
acagcuuguuuuggacuuuguu

SEQ ID NO: 3489159 - RNA, 16 nt, Human
acagcuuuacacacac

SEQ ID NO: 3489160 - RNA, 20 nt, Human
acagcuuucaugauuagcaa

SEQ ID NO: 3489161 - RNA, 22 nt, Human
acagcuuucugaccuucagcuc

SEQ ID NO: 3489162 - RNA, 21 nt, Human
acagcuuucuugcucccuuca

SEQ ID NO: 3489163 - RNA, 12 nt, Human
acagcuuugcug

SEQ ID NO: 3489164 - RNA, 15 nt, Human
acagcuuugcugcug

SEQ ID NO: 3489165 - RNA, 19 nt, Human
acagcuuuuaguacccacc

SEQ ID NO: 3489166 - RNA, 22 nt, Human
acagcuuuuaguacccaccuga

SEQ ID NO: 3489167 - RNA, 14 nt, Human
acagcuuuugcaac

SEQ ID NO: 3489168 - RNA, 22 nt, Human
acagcuuuugcaacuuaauacu

SEQ ID NO: 3489169 - RNA, 23 nt, Human
acaggaaaaaaacuuuuauaaau

SEQ ID NO: 3489170 - RNA, 12 nt, Human
acaggaaaaagu

SEQ ID NO: 3489171 - RNA, 19 nt, Human
acaggaaaagcaugucuua

SEQ ID NO: 3489172 - RNA, 21 nt, Human
acaggaaaagcaugucuuauu

SEQ ID NO: 3489173 - RNA, 15 nt, Human
acaggaaaagcugcu

SEQ ID NO: 3489174 - RNA, 20 nt, Human
acaggaaaagcugcugacag

SEQ ID NO: 3489175 - RNA, 21 nt, Human
acaggaaaagcugcugacagu

SEQ ID NO: 3489176 - RNA, 16 nt, Human
acaggaaaguguuauu

SEQ ID NO: 3489177 - RNA, 22 nt, Human
acaggaaaguucagaguuuucu

SEQ ID NO: 3489178 - RNA, 22 nt, Human
acaggaaccacaagacugcaca

SEQ ID NO: 3489179 - RNA, 18 nt, Human
acaggaagaucuuaaauu

SEQ ID NO: 3489180 - RNA, 20 nt, Human
acaggaagguggugcuuaca

SEQ ID NO: 3489181 - RNA, 13 nt, Human
acaggaaguacug

SEQ ID NO: 3489182 - RNA, 17 nt, Human
acaggaagucuucaggg

SEQ ID NO: 3489183 - RNA, 15 nt, Human
acaggaagugaagaa

SEQ ID NO: 3489184 - RNA, 19 nt, Human
acaggaaucaagagcugcc

SEQ ID NO: 3489185 - RNA, 14 nt, Human
acaggacacaguca

SEQ ID NO: 3489186 - RNA, 22 nt, Human
acaggacagcauggugcaugcc

SEQ ID NO: 3489187 - RNA, 18 nt, Human
acaggacagggguuccuu

SEQ ID NO: 3489188 - RNA, 13 nt, Human
acaggaccccagc

SEQ ID NO: 3489189 - RNA, 14 nt, Human
acaggaccccagcu

SEQ ID NO: 3489190 - RNA, 15 nt, Human
acaggaccccagcuc

SEQ ID NO: 3489191 - RNA, 14 nt, Human
acaggacccccuuc

SEQ ID NO: 3489192 - RNA, 20 nt, Human
acaggaccccugcaguuccc

SEQ ID NO: 3489193 - RNA, 21 nt, Human
acaggacuaacacucagaagc

SEQ ID NO: 3489194 - RNA, 22 nt, Human
acaggacuaacacucagaagcc

SEQ ID NO: 3489195 - RNA, 15 nt, Human
acaggagacaaaaga

SEQ ID NO: 3489196 - RNA, 18 nt, Human
acaggagacaaaagagca

SEQ ID NO: 3489197 - RNA, 19 nt, Human
acaggagaugcugugcccc

SEQ ID NO: 3489198 - RNA, 16 nt, Human
acaggaggacaauuca

SEQ ID NO: 3489199 - RNA, 17 nt, Human
acaggaggacaauucau

SEQ ID NO: 3489200 - RNA, 20 nt, Human
acaggagggcggccuccuuc

SEQ ID NO: 3489201 - RNA, 20 nt, Human
acaggagggggucguggaga

SEQ ID NO: 3489202 - RNA, 16 nt, Human
acaggagugagcacua

SEQ ID NO: 3489203 - RNA, 19 nt, Human
acaggauaaagauaucaau

SEQ ID NO: 3489204 - RNA, 14 nt, Human
acaggaucagucug

SEQ ID NO: 3489205 - RNA, 13 nt, Human
acaggauccaggc

SEQ ID NO: 3489206 - RNA, 21 nt, Human
acaggauccuauucucaccag

SEQ ID NO: 3489207 - RNA, 16 nt, Human
aaugugaagaugcauu

SEQ ID NO: 3489208 - RNA, 17 nt, Human
aaugugaauaaaauuau

SEQ ID NO: 3489209 - RNA, 17 nt, Human
aaugugaaugggaaaag

SEQ ID NO: 3489210 - RNA, 15 nt, Human
aaugugaccaggggu

SEQ ID NO: 3489211 - RNA, 19 nt, Human
aaugugacccuccaaaugg

SEQ ID NO: 3489212 - RNA, 14 nt, Human
aaugugacuuugaa

SEQ ID NO: 3489213 - RNA, 23 nt, Human
aaugugagugguugaauaugauu

SEQ ID NO: 3489214 - RNA, 14 nt, Human
aaugugaucuaugu

SEQ ID NO: 3489215 - RNA, 17 nt, Human
aaugugaugauguaauu

SEQ ID NO: 3489216 - RNA, 15 nt, Human
aaugugauguucuaa

SEQ ID NO: 3489217 - RNA, 19 nt, Human
aaugugauguucuaaggcu

SEQ ID NO: 3489218 - RNA, 21 nt, Human
aaugugauuccuuugaagagg

SEQ ID NO: 3489219 - RNA, 22 nt, Human
aaugugauucuaaugucuucau

SEQ ID NO: 3489220 - RNA, 20 nt, Human
aaugugauuuacgcucauug

SEQ ID NO: 3489221 - RNA, 15 nt, Human
aaugugcaauagaag

SEQ ID NO: 3489222 - RNA, 20 nt, Human
aaugugcagaugcaauuguu

SEQ ID NO: 3489223 - RNA, 19 nt, Human
aaugugcagguuuguuaca

SEQ ID NO: 3489224 - RNA, 24 nt, Human
aaugugcauucuuuuaaaagacaa

SEQ ID NO: 3489225 - RNA, 13 nt, Human
aaugugcugugua

SEQ ID NO: 3489226 - RNA, 15 nt, Human
aaugugcuguguaaa

SEQ ID NO: 3489227 - RNA, 16 nt, Human
aaugugcuguguaaag

SEQ ID NO: 3489228 - RNA, 18 nt, Human
aaugugcuguguaaaguu

SEQ ID NO: 3489229 - RNA, 15 nt, Human
aauguggaagaaaau

SEQ ID NO: 3489230 - RNA, 16 nt, Human
aauguggaagaaaaug

SEQ ID NO: 3489231 - RNA, 21 nt, Human
aauguggacucaaucccuagg

SEQ ID NO: 3489232 - RNA, 22 nt, Human
aauguggcaaggaaaaacaggu

SEQ ID NO: 3489233 - RNA, 17 nt, Human
aauguggccgaggacuu

SEQ ID NO: 3489234 - RNA, 20 nt, Human
aauguggccuaaaaaugcaa

SEQ ID NO: 3489235 - RNA, 14 nt, Human
aauguggcuccugg

SEQ ID NO: 3489236 - RNA, 18 nt, Human
aaugugggagcagcgguu

SEQ ID NO: 3489237 - RNA, 15 nt, Human
aauguggucucagga

SEQ ID NO: 3489238 - RNA, 16 nt, Human
aauguggucucaggau

SEQ ID NO: 3489239 - RNA, 18 nt, Human
aaugugguuauuucucug

SEQ ID NO: 3489240 - RNA, 21 nt, Human
aaugugguuauuucucugauu

SEQ ID NO: 3489241 - RNA, 18 nt, Human
aaugugguuucaaucuaa

SEQ ID NO: 3489242 - RNA, 14 nt, Human
acauuuuuaaauug

SEQ ID NO: 3489243 - RNA, 20 nt, Human
acauuuuuaaauuguuagcu

SEQ ID NO: 3489244 - RNA, 22 nt, Human
acauuuuuaagugcugcauuua

SEQ ID NO: 3489245 - RNA, 12 nt, Human
acauuuuuauuu

SEQ ID NO: 3489246 - RNA, 13 nt, Human
acauuuuuauuua

SEQ ID NO: 3489247 - RNA, 14 nt, Human
acauuuuucaacuu

SEQ ID NO: 3489248 - RNA, 15 nt, Human
acauuuuucaacuuu

SEQ ID NO: 3489249 - RNA, 16 nt, Human
acauuuuucaacuuug

SEQ ID NO: 3489250 - RNA, 13 nt, Human
acauuuuucuuag

SEQ ID NO: 3489251 - RNA, 15 nt, Human
acauuuuuugaaaug

SEQ ID NO: 3489252 - RNA, 18 nt, Human
acauuuuuuugcaugcau

SEQ ID NO: 3489253 - RNA, 21 nt, Human
accaaaaaagcuguauuuuga

SEQ ID NO: 3489254 - RNA, 12 nt, Human
accaaaaaccag

SEQ ID NO: 3489255 - RNA, 23 nt, Human
accaaaaaucucaauauuucaga

SEQ ID NO: 3489256 - RNA, 14 nt, Human
accaaaacugcucc

SEQ ID NO: 3489257 - RNA, 18 nt, Human
accaaaacugugcagagu

SEQ ID NO: 3489258 - RNA, 14 nt, Human
accaaaagaaguaa

SEQ ID NO: 3489259 - RNA, 21 nt, Human
accaaaagaaguaaaagcaaa

SEQ ID NO: 3489260 - RNA, 14 nt, Human
accaaaagacacug

SEQ ID NO: 3489261 - RNA, 17 nt, Human
accaaaauaagaaaaga

SEQ ID NO: 3489262 - RNA, 15 nt, Human
accaaaauaauaaaa

SEQ ID NO: 3489263 - RNA, 16 nt, Human
accaaaaugacaauga

SEQ ID NO: 3489264 - RNA, 16 nt, Human
accaaaaugacaucuu

SEQ ID NO: 3489265 - RNA, 22 nt, Human
accaaaaugacaucuuuuuaaa

SEQ ID NO: 3489266 - RNA, 17 nt, Human
accaaaauuauuucaga

SEQ ID NO: 3489267 - RNA, 23 nt, Human
accaaaccgccagcgaacuugac

SEQ ID NO: 3489268 - RNA, 15 nt, Human
accaaacucccauca

SEQ ID NO: 3489269 - RNA, 18 nt, Human
accaaacuggaucacugg

SEQ ID NO: 3489270 - RNA, 18 nt, Human
accaaagagggcuuccuc

SEQ ID NO: 3489271 - RNA, 11 nt, Human
accaaagcaca

SEQ ID NO: 3489272 - RNA, 21 nt, Human
accaaagcugacgaggcuggg

SEQ ID NO: 3489273 - RNA, 23 nt, Human
accaaagcugacgaggcugggcc

SEQ ID NO: 3489274 - RNA, 19 nt, Human
accaaaggacauuaugugu

SEQ ID NO: 3489275 - RNA, 21 nt, Human
accaaaguucuaauaauuucu

SEQ ID NO: 3489276 - RNA, 23 nt, Human
accaaaguucuaauaauuucuaa

SEQ ID NO: 3489277 - RNA, 16 nt, Human
accaaauaaaaauauu

SEQ ID NO: 3489278 - RNA, 18 nt, Human
accaaauaaaaauauugu

SEQ ID NO: 3489279 - RNA, 16 nt, Human
accaaauagugugaaa

SEQ ID NO: 3489280 - RNA, 14 nt, Human
accaaaucaaaauc

SEQ ID NO: 3489281 - RNA, 20 nt, Human
accaaaucaaaaucucucca

SEQ ID NO: 3489282 - RNA, 19 nt, Human
accaaaucagcugcuacua

SEQ ID NO: 3489283 - RNA, 13 nt, Human
accaaaucuggaa

SEQ ID NO: 3489284 - RNA, 13 nt, Human
accaaaugguaca

SEQ ID NO: 3489285 - RNA, 15 nt, Human
accaaauuaucuuga

SEQ ID NO: 3489286 - RNA, 13 nt, Human
accaaauuuuaau

SEQ ID NO: 3489287 - RNA, 22 nt, Human
accaacaagaauaaaggcagcu

SEQ ID NO: 3489288 - RNA, 20 nt, Human
accaacaaucuuccuguuua

SEQ ID NO: 3489289 - RNA, 22 nt, Human
accaacacccaaagcauggacu

SEQ ID NO: 3489290 - RNA, 20 nt, Human
accaacacguggccaagaga

SEQ ID NO: 3489291 - RNA, 17 nt, Human
accaacauacucccauc

SEQ ID NO: 3489292 - RNA, 19 nt, Human
accaacauacucccaucug

SEQ ID NO: 3489293 - RNA, 18 nt, Human
accaacaucccauugccc

SEQ ID NO: 3489294 - RNA, 15 nt, Human
accaacauggagaaa

SEQ ID NO: 3489295 - RNA, 16 nt, Human
accaacauggagaaac

SEQ ID NO: 3489296 - RNA, 12 nt, Human
accaacccagcc

SEQ ID NO: 3489297 - RNA, 13 nt, Human
accaacccagccg

SEQ ID NO: 3489298 - RNA, 14 nt, Human
accaacccagccgc

SEQ ID NO: 3489299 - RNA, 16 nt, Human
accaacccagccgcug

SEQ ID NO: 3489300 - RNA, 13 nt, Human
accaacccucagg

SEQ ID NO: 3489301 - RNA, 19 nt, Human
accaacccuggggaaggag

SEQ ID NO: 3489302 - RNA, 20 nt, Human
accaacguuacucagggcuc

SEQ ID NO: 3489303 - RNA, 19 nt, Human
accaacuagacauucuguc

SEQ ID NO: 3489304 - RNA, 20 nt, Human
accaacuagacauucugucg

SEQ ID NO: 3489305 - RNA, 17 nt, Human
accaacuccuaguucua

SEQ ID NO: 3489306 - RNA, 22 nt, Human
accaacuccuaguucuagaaaa

SEQ ID NO: 3489307 - RNA, 13 nt, Human
accaacuggaagc

SEQ ID NO: 3489308 - RNA, 18 nt, Human
accaacuggaagcacaga

SEQ ID NO: 3489309 - RNA, 19 nt, Human
accaacuggcccucuucuu

SEQ ID NO: 3489310 - RNA, 11 nt, Human
accaacugugu

SEQ ID NO: 3489311 - RNA, 15 nt, Human
accaacuguguugua

SEQ ID NO: 3489312 - RNA, 21 nt, Human
accaacuguguuguauuaaca

SEQ ID NO: 3489313 - RNA, 12 nt, Human
accaacuuucug

SEQ ID NO: 3489314 - RNA, 18 nt, Human
accaacuuucuguaaacu

SEQ ID NO: 3489315 - RNA, 12 nt, Human
accaagaacugc

SEQ ID NO: 3489316 - RNA, 14 nt, Human
accaagaacugcau

SEQ ID NO: 3489317 - RNA, 24 nt, Human
accaagaagccuuuccuguagccu

SEQ ID NO: 3489318 - RNA, 22 nt, Human
accaagaauucuccaaaacaau

SEQ ID NO: 3489319 - RNA, 16 nt, Human
accaagagauugcuaa

SEQ ID NO: 3489320 - RNA, 21 nt, Human
accaagagauugcuaauugcu

SEQ ID NO: 3489321 - RNA, 15 nt, Human
accaagaggcugguu

SEQ ID NO: 3489322 - RNA, 15 nt, Human
accaagauacuuaag

SEQ ID NO: 3489323 - RNA, 20 nt, Human
accaagauacuuaagugcug

SEQ ID NO: 3489324 - RNA, 20 nt, Human
accaagaucuauaaagcgau

SEQ ID NO: 3489325 - RNA, 16 nt, Human
accaagaugccaucug

SEQ ID NO: 3489326 - RNA, 22 nt, Human
accaagaugccaucuguguccu

SEQ ID NO: 3489327 - RNA, 13 nt, Human
accaagcaggaaa

SEQ ID NO: 3489328 - RNA, 14 nt, Human
accaagcaggaagc

SEQ ID NO: 3489329 - RNA, 16 nt, Human
accaagcaggaagcuc

SEQ ID NO: 3489330 - RNA, 24 nt, Human
accaagcaggaagcucagacuggu

SEQ ID NO: 3489331 - RNA, 16 nt, Human
accaagcaucaggggg

SEQ ID NO: 3489332 - RNA, 15 nt, Human
accaagccguggcuu

SEQ ID NO: 3489333 - RNA, 19 nt, Human
accaagccuggucagccca

SEQ ID NO: 3489334 - RNA, 20 nt, Human
accaagccuggucagcccaa

SEQ ID NO: 3489335 - RNA, 17 nt, Human
accaagcuauccuggcu

SEQ ID NO: 3489336 - RNA, 17 nt, Human
accaagcucacaguucc

SEQ ID NO: 3489337 - RNA, 14 nt, Human
accaagcucucugc

SEQ ID NO: 3489338 - RNA, 14 nt, Human
accaagcugaguuu

SEQ ID NO: 3489339 - RNA, 12 nt, Human
accaagcugugc

SEQ ID NO: 3489340 - RNA, 13 nt, Human
accaagcugugcc

SEQ ID NO: 3489341 - RNA, 13 nt, Human
accaaggaccccu

SEQ ID NO: 3489342 - RNA, 18 nt, Human
accaaggcaaggcaggug

SEQ ID NO: 3489343 - RNA, 20 nt, Human
accaaggcugauuaaaccaa

SEQ ID NO: 3489344 - RNA, 23 nt, Human
accaagguagaaugaccuuguaa

SEQ ID NO: 3489345 - RNA, 15 nt, Human
accaaggucuucagc

SEQ ID NO: 3489346 - RNA, 19 nt, Human
accaaggucuucagccauc

SEQ ID NO: 3489347 - RNA, 24 nt, Human
accaaguaaaacaaaaccacuggg

SEQ ID NO: 3489348 - RNA, 14 nt, Human
accaagucacacgc

SEQ ID NO: 3489349 - RNA, 12 nt, Human
accaagugaaau

SEQ ID NO: 3489350 - RNA, 18 nt, Human
accaagugugcuaaaaau

SEQ ID NO: 3489351 - RNA, 13 nt, Human
accaaguuauaua

SEQ ID NO: 3489352 - RNA, 23 nt, Human
accaaguuggaacauccuuggaa

SEQ ID NO: 3489353 - RNA, 23 nt, Human
accaaguuucagguauuaagaaa

SEQ ID NO: 3489354 - RNA, 17 nt, Human
accaauauuuaaucuuu

SEQ ID NO: 3489355 - RNA, 20 nt, Human
accaauauuuaaucuuuuau

SEQ ID NO: 3489356 - RNA, 23 nt, Human
accaauauuuaaucuuuuaugau

SEQ ID NO: 3489357 - RNA, 20 nt, Human
accaaucaagauaaaggaca

SEQ ID NO: 3489358 - RNA, 13 nt, Human
accaaucauuuua

SEQ ID NO: 3489359 - RNA, 20 nt, Human
accaaucauuuuaauuauua

SEQ ID NO: 3489360 - RNA, 17 nt, Human
accaaucuuacuuugua

SEQ ID NO: 3489361 - RNA, 19 nt, Human
accaaucuuacuuuguaaa

SEQ ID NO: 3489362 - RNA, 17 nt, Human
accaaugaaaaaaugua

SEQ ID NO: 3489363 - RNA, 12 nt, Human
accaaugcaugc

SEQ ID NO: 3489364 - RNA, 18 nt, Human
accaaugcaugcagccac

SEQ ID NO: 3489365 - RNA, 19 nt, Human
accaaugcuuuuaucaaac

SEQ ID NO: 3489366 - RNA, 21 nt, Human
accaauguacccaccgggcca

SEQ ID NO: 3489367 - RNA, 23 nt, Human
accaauuauugauauauauuaua

SEQ ID NO: 3489368 - RNA, 14 nt, Human
accaauuauuuuca

SEQ ID NO: 3489369 - RNA, 17 nt, Human
accaauugauuuuaaac

SEQ ID NO: 3489370 - RNA, 14 nt, Human
accaauugccaaag

SEQ ID NO: 3489371 - RNA, 14 nt, Human
accaauugugcugc

SEQ ID NO: 3489372 - RNA, 18 nt, Human
accaauugugcugccauu

SEQ ID NO: 3489373 - RNA, 17 nt, Human
aauguuuuuaaauauau

SEQ ID NO: 3489374 - RNA, 15 nt, Human
aauguuuuucuaaag

SEQ ID NO: 3489375 - RNA, 13 nt, Human
aauguuuuucuau

SEQ ID NO: 3489376 - RNA, 17 nt, Human
aauuaaaaaaaaauugu

SEQ ID NO: 3489377 - RNA, 13 nt, Human
aauuaaaaaagau

SEQ ID NO: 3489378 - RNA, 19 nt, Human
aauuaaaaaagauaaacac

SEQ ID NO: 3489379 - RNA, 20 nt, Human
aauuaaaaaagauaaacaca

SEQ ID NO: 3489380 - RNA, 21 nt, Human
aauuaaaaacuaguaguucuc

SEQ ID NO: 3489381 - RNA, 21 nt, Human
aauuaaaaagauucuuuuucu

SEQ ID NO: 3489382 - RNA, 21 nt, Human
aauuaaaacaaugucaaggug

SEQ ID NO: 3489383 - RNA, 13 nt, Human
aauuaaaacacuu

SEQ ID NO: 3489384 - RNA, 20 nt, Human
aauuaaaagcaaaucauuug

SEQ ID NO: 3489385 - RNA, 21 nt, Human
aauuaaaagcaaaucauuugu

SEQ ID NO: 3489386 - RNA, 12 nt, Human
aauuaaacggau

SEQ ID NO: 3489387 - RNA, 16 nt, Human
acauuuggaauacuuu

SEQ ID NO: 3489388 - RNA, 21 nt, Human
acauuugggagacaugugaca

SEQ ID NO: 3489389 - RNA, 21 nt, Human
acauuuggguuacuauuucuu

SEQ ID NO: 3489390 - RNA, 17 nt, Human
acauuugguaauguuuu

SEQ ID NO: 3489391 - RNA, 14 nt, Human
acauuuguaguuga

SEQ ID NO: 3489392 - RNA, 17 nt, Human
acauuuguaguuggagu

SEQ ID NO: 3489393 - RNA, 16 nt, Human
acauuuguauaaaaua

SEQ ID NO: 3489394 - RNA, 21 nt, Human
acauuuguauaaaauaauuuu

SEQ ID NO: 3489395 - RNA, 11 nt, Human
acauuugucau

SEQ ID NO: 3489396 - RNA, 17 nt, Human
acauuugucauuuucau

SEQ ID NO: 3489397 - RNA, 23 nt, Human
acauuugucauuuucauuagcaa

SEQ ID NO: 3489398 - RNA, 21 nt, Human
acauuuguguaaacaguguuu

SEQ ID NO: 3489399 - RNA, 20 nt, Human
acauuuuaaaaaauggucac

SEQ ID NO: 3489400 - RNA, 19 nt, Human
acauuuuaaaagugccauu

SEQ ID NO: 3489401 - RNA, 16 nt, Human
acauuuuaaacacauu

SEQ ID NO: 3489402 - RNA, 17 nt, Human
acauuuuaaauaaaaga

SEQ ID NO: 3489403 - RNA, 21 nt, Human
acauuuuaacaagaagaugaa

SEQ ID NO: 3489404 - RNA, 19 nt, Human
acauuuuaaugcaccugaa

SEQ ID NO: 3489405 - RNA, 15 nt, Human
acauuuuacauuaaa

SEQ ID NO: 3489406 - RNA, 15 nt, Human
acauuuuaguucuuu

SEQ ID NO: 3489407 - RNA, 13 nt, Human
acauuuuaugucu

SEQ ID NO: 3489408 - RNA, 15 nt, Human
acauuuuaugucuuu

SEQ ID NO: 3489409 - RNA, 19 nt, Human
acauuuuauuuuauuaugc

SEQ ID NO: 3489410 - RNA, 13 nt, Human
acauuuucacaca

SEQ ID NO: 3489411 - RNA, 15 nt, Human
acauuuucacacaau

SEQ ID NO: 3489412 - RNA, 12 nt, Human
acauuuucauuu

SEQ ID NO: 3489413 - RNA, 11 nt, Human
acauuuucucc

SEQ ID NO: 3489414 - RNA, 17 nt, Human
acauuuucucccuggau

SEQ ID NO: 3489415 - RNA, 16 nt, Human
acauuuucucuuagaa

SEQ ID NO: 3489416 - RNA, 17 nt, Human
acauuuucucuuagaaa

SEQ ID NO: 3489417 - RNA, 18 nt, Human
acauuuucucuuagaaaa

SEQ ID NO: 3489418 - RNA, 20 nt, Human
acauuuuguaacaaagaacu

SEQ ID NO: 3489419 - RNA, 19 nt, Human
acauuuuguauaauuguau

SEQ ID NO: 3489420 - RNA, 12 nt, Human
acauuuuguucu

SEQ ID NO: 3489421 - RNA, 14 nt, Human
acauuuuguuguaa

SEQ ID NO: 3489422 - RNA, 19 nt, Human
acauuuuguuguaaaaaga

SEQ ID NO: 3489423 - RNA, 15 nt, Human
acauuuuuaagugcu

SEQ ID NO: 3489424 - RNA, 15 nt, Human
acauuuuuauuuaug

SEQ ID NO: 3489425 - RNA, 21 nt, Human
accaguucucauggguggcac

SEQ ID NO: 3489426 - RNA, 15 nt, Human
accaguugcagucac

SEQ ID NO: 3489427 - RNA, 20 nt, Human
accaguugcagucacucuag

SEQ ID NO: 3489428 - RNA, 16 nt, Human
accaguugccuuuuau

SEQ ID NO: 3489429 - RNA, 18 nt, Human
accaguugggagcacugg

SEQ ID NO: 3489430 - RNA, 15 nt, Human
accauaaaaagcuga

SEQ ID NO: 3489431 - RNA, 18 nt, Human
accauaaaugaaucauca

SEQ ID NO: 3489432 - RNA, 22 nt, Human
accauaaauucaacuuuguaaa

SEQ ID NO: 3489433 - RNA, 23 nt, Human
accauaacccaggaaugaagaua

SEQ ID NO: 3489434 - RNA, 22 nt, Human
accauaagcuacugccauccug

SEQ ID NO: 3489435 - RNA, 13 nt, Human
accauaauguuac

SEQ ID NO: 3489436 - RNA, 14 nt, Human
accauacauuuaaa

SEQ ID NO: 3489437 - RNA, 16 nt, Human
accauacuaauuauac

SEQ ID NO: 3489438 - RNA, 12 nt, Human
accauacugaaa

SEQ ID NO: 3489439 - RNA, 15 nt, Human
accauacugagggac

SEQ ID NO: 3489440 - RNA, 20 nt, Human
accauaguaccauuuauaca

SEQ ID NO: 3489441 - RNA, 21 nt, Human
accauaguaccauuuauacaa

SEQ ID NO: 3489442 - RNA, 22 nt, Human
accauaguuacuguaaaaugca

SEQ ID NO: 3489443 - RNA, 23 nt, Human
accauauaaagggggagggaaau

SEQ ID NO: 3489444 - RNA, 17 nt, Human
accauauagcaaaacuu

SEQ ID NO: 3489445 - RNA, 19 nt, Human
accauaugaucuguuuugu

SEQ ID NO: 3489446 - RNA, 16 nt, Human
accauaugcccacauu

SEQ ID NO: 3489447 - RNA, 20 nt, Human
accauauggauauuagucau

SEQ ID NO: 3489448 - RNA, 16 nt, Human
accauauuaccacaga

SEQ ID NO: 3489449 - RNA, 15 nt, Human
accauauuuagcagu

SEQ ID NO: 3489450 - RNA, 16 nt, Human
accaucaauccugauu

SEQ ID NO: 3489451 - RNA, 22 nt, Human
accaucaccagaauuaauuuua

SEQ ID NO: 3489452 - RNA, 12 nt, Human
accaucauugaa

SEQ ID NO: 3489453 - RNA, 19 nt, Human
accaucauuggaaaugaaa

SEQ ID NO: 3489454 - RNA, 16 nt, Human
accaucccugaaggcc

SEQ ID NO: 3489455 - RNA, 22 nt, Human
accaucccugaaggccccgccc

SEQ ID NO: 3489456 - RNA, 20 nt, Human
accaucccuuuuugaagugu

SEQ ID NO: 3489457 - RNA, 21 nt, Human
accaucccuuuuugaagugua

SEQ ID NO: 3489458 - RNA, 13 nt, Human
accauccuauuua

SEQ ID NO: 3489459 - RNA, 15 nt, Human
accaucgcuggcccc

SEQ ID NO: 3489460 - RNA, 20 nt, Human
accaucgcuggccccuuugg

SEQ ID NO: 3489461 - RNA, 15 nt, Human
accaucgcuuuauug

SEQ ID NO: 3489462 - RNA, 14 nt, Human
accaucucaggcca

SEQ ID NO: 3489463 - RNA, 11 nt, Human
accaucucccu

SEQ ID NO: 3489464 - RNA, 16 nt, Human
accaucucccuggugc

SEQ ID NO: 3489465 - RNA, 18 nt, Human
accaucucccuggugcuu

SEQ ID NO: 3489466 - RNA, 20 nt, Human
accaucucccuggugcuuau

SEQ ID NO: 3489467 - RNA, 18 nt, Human
accaucugcugucuuuuc

SEQ ID NO: 3489468 - RNA, 18 nt, Human
accaucugcuuuuauuaa

SEQ ID NO: 3489469 - RNA, 15 nt, Human
accaucuggccuggc

SEQ ID NO: 3489470 - RNA, 22 nt, Human
accaucuggccuggccuggccc

SEQ ID NO: 3489471 - RNA, 14 nt, Human
accaugaaagacuu

SEQ ID NO: 3489472 - RNA, 23 nt, Human
accaugaacagaaaacauucuga

SEQ ID NO: 3489473 - RNA, 17 nt, Human
accaugaagaacauaaa

SEQ ID NO: 3489474 - RNA, 14 nt, Human
accaugaagacagg

SEQ ID NO: 3489475 - RNA, 19 nt, Human
accaugaagagauuuuuca

SEQ ID NO: 3489476 - RNA, 23 nt, Human
accaugagaauaagagaaagaaa

SEQ ID NO: 3489477 - RNA, 23 nt, Human
accaugauuaaccacuucagcug

SEQ ID NO: 3489478 - RNA, 18 nt, Human
accaugauuccuuuaaca

SEQ ID NO: 3489479 - RNA, 19 nt, Human
accaugccucacuaauuuu

SEQ ID NO: 3489480 - RNA, 22 nt, Human
accaugcucaaugaaaagguga

SEQ ID NO: 3489481 - RNA, 14 nt, Human
accaugcugcuggg

SEQ ID NO: 3489482 - RNA, 17 nt, Human
accaugcugcuggggaa

SEQ ID NO: 3489483 - RNA, 19 nt, Human
accaugcugcuggggaaga

SEQ ID NO: 3489484 - RNA, 21 nt, Human
accaugcugcuggggaagaca

SEQ ID NO: 3489485 - RNA, 15 nt, Human
accauggacuuuaua

SEQ ID NO: 3489486 - RNA, 22 nt, Human
accauggaguggcagcccagcc

SEQ ID NO: 3489487 - RNA, 15 nt, Human
accauggccagccaa

SEQ ID NO: 3489488 - RNA, 20 nt, Human
accauggccagcuaauuuuu

SEQ ID NO: 3489489 - RNA, 15 nt, Human
accauggcugaagga

SEQ ID NO: 3489490 - RNA, 12 nt, Human
accaugggacca

SEQ ID NO: 3489491 - RNA, 20 nt, Human
accaugggaccaggucuugg

SEQ ID NO: 3489492 - RNA, 22 nt, Human
accauggucggaaaacaugcua

SEQ ID NO: 3489493 - RNA, 17 nt, Human
accaugguuaagagucc

SEQ ID NO: 3489494 - RNA, 17 nt, Human
accauguacaugaagaa

SEQ ID NO: 3489495 - RNA, 17 nt, Human
accauguagaaaauuug

SEQ ID NO: 3489496 - RNA, 15 nt, Human
accaugucagcaaaa

SEQ ID NO: 3489497 - RNA, 22 nt, Human
accaugucuaugauucguguaa

SEQ ID NO: 3489498 - RNA, 14 nt, Human
accaugucuuucuc

SEQ ID NO: 3489499 - RNA, 16 nt, Human
accaugugccugaucc

SEQ ID NO: 3489500 - RNA, 22 nt, Human
accauguggauaacuuuacaga

SEQ ID NO: 3489501 - RNA, 12 nt, Human
accauguuugag

SEQ ID NO: 3489502 - RNA, 21 nt, Human
accauguuugagcucagaccc

SEQ ID NO: 3489503 - RNA, 12 nt, Human
accauuaaaacu

SEQ ID NO: 3489504 - RNA, 18 nt, Human
accauuaaaacugcuuuu

SEQ ID NO: 3489505 - RNA, 19 nt, Human
accauuaaaauaugcacua

SEQ ID NO: 3489506 - RNA, 19 nt, Human
accauuaaaccaucucccu

SEQ ID NO: 3489507 - RNA, 13 nt, Human
accauuaaccaga

SEQ ID NO: 3489508 - RNA, 16 nt, Human
accauuauaaugaauu

SEQ ID NO: 3489509 - RNA, 21 nt, Human
accauuccaagucuccacccc

SEQ ID NO: 3489510 - RNA, 12 nt, Human
accauuccccau

SEQ ID NO: 3489511 - RNA, 15 nt, Human
accauuccccauggg

SEQ ID NO: 3489512 - RNA, 18 nt, Human
accauucuccaccugcca

SEQ ID NO: 3489513 - RNA, 19 nt, Human
accauucuccaccugccag

SEQ ID NO: 3489514 - RNA, 20 nt, Human
accauucuccaccugccagg

SEQ ID NO: 3489515 - RNA, 16 nt, Human
accauugaaggcuuaa

SEQ ID NO: 3489516 - RNA, 18 nt, Human
accauugcaacaaaauac

SEQ ID NO: 3489517 - RNA, 13 nt, Human
accauugcuucac

SEQ ID NO: 3489518 - RNA, 14 nt, Human
accauuggaaauuu

SEQ ID NO: 3489519 - RNA, 18 nt, Human
accauuggggcucccagc

SEQ ID NO: 3489520 - RNA, 13 nt, Human
accauuuauacaa

SEQ ID NO: 3489521 - RNA, 16 nt, Human
accauuuauacaaauu

SEQ ID NO: 3489522 - RNA, 20 nt, Human
accauuucagagaggccuuu

SEQ ID NO: 3489523 - RNA, 17 nt, Human
accauuuccccagggca

SEQ ID NO: 3489524 - RNA, 18 nt, Human
accauuuccccagggcac

SEQ ID NO: 3489525 - RNA, 23 nt, Human
accauuucuugagguaaaagcau

SEQ ID NO: 3489526 - RNA, 16 nt, Human
accauuugcuacugua

SEQ ID NO: 3489527 - RNA, 19 nt, Human
accauuugcuacuguacau

SEQ ID NO: 3489528 - RNA, 23 nt, Human
accauuuggauccuguguggaga

SEQ ID NO: 3489529 - RNA, 15 nt, Human
accauuuuaaaguua

SEQ ID NO: 3489530 - RNA, 17 nt, Human
accauuuuauaaagugc

SEQ ID NO: 3489531 - RNA, 14 nt, Human
accauuuuccugca

SEQ ID NO: 3489532 - RNA, 20 nt, Human
acccaugaugagcuccucuu

SEQ ID NO: 3489533 - RNA, 23 nt, Human
acccaugccucccccuagccauu

SEQ ID NO: 3489534 - RNA, 13 nt, Human
acccaugcugccc

SEQ ID NO: 3489535 - RNA, 17 nt, Human
acccaugcugcccugug

SEQ ID NO: 3489536 - RNA, 14 nt, Human
acccaugggcagga

SEQ ID NO: 3489537 - RNA, 16 nt, Human
acccaugggcaggaga

SEQ ID NO: 3489538 - RNA, 24 nt, Human
acccauguaaauaccagacugcag

SEQ ID NO: 3489539 - RNA, 14 nt, Human
acccaugugccaag

SEQ ID NO: 3489540 - RNA, 17 nt, Human
acccaugugccaaggug

SEQ ID NO: 3489541 - RNA, 19 nt, Human
acccauuccauuuaucuuu

SEQ ID NO: 3489542 - RNA, 13 nt, Human
acccauuccuauu

SEQ ID NO: 3489543 - RNA, 13 nt, Human
acccauuccuucc

SEQ ID NO: 3489544 - RNA, 23 nt, Human
acccauuccuucccagaggggcc

SEQ ID NO: 3489545 - RNA, 22 nt, Human
accccaaaauuagccaguaauc

SEQ ID NO: 3489546 - RNA, 16 nt, Human
accccaaacaccuucc

SEQ ID NO: 3489547 - RNA, 19 nt, Human
accccaaacagugacugua

SEQ ID NO: 3489548 - RNA, 14 nt, Human
accccaaaccucca

SEQ ID NO: 3489549 - RNA, 14 nt, Human
accccaaagagccu

SEQ ID NO: 3489550 - RNA, 17 nt, Human
accccaaagcuuuccug

SEQ ID NO: 3489551 - RNA, 19 nt, Human
accccaaccugcucuccuc

SEQ ID NO: 3489552 - RNA, 18 nt, Human
accccaagacucccauga

SEQ ID NO: 3489553 - RNA, 19 nt, Human
accccaagauuucagauau

SEQ ID NO: 3489554 - RNA, 21 nt, Human
accccaagcgcccuggccccc

SEQ ID NO: 3489555 - RNA, 14 nt, Human
accccaaucccagc

SEQ ID NO: 3489556 - RNA, 15 nt, Human
accccaauuccuugu

SEQ ID NO: 3489557 - RNA, 16 nt, Human
accccacacacgccag

SEQ ID NO: 3489558 - RNA, 17 nt, Human
accccacacacgccaga

SEQ ID NO: 3489559 - RNA, 16 nt, Human
accccacaccaggccg

SEQ ID NO: 3489560 - RNA, 11 nt, Human
accccacacuu

SEQ ID NO: 3489561 - RNA, 22 nt, Human
accccaccacgauguggcccug

SEQ ID NO: 3489562 - RNA, 11 nt, Human
accccacccaa

SEQ ID NO: 3489563 - RNA, 22 nt, Human
accccacccccuucagugccca

SEQ ID NO: 3489564 - RNA, 21 nt, Human
accccacccuaguuucccuga

SEQ ID NO: 3489565 - RNA, 15 nt, Human
accccacccucagca

SEQ ID NO: 3489566 - RNA, 21 nt, Human
accccacccucagcaccccuu

SEQ ID NO: 3489567 - RNA, 16 nt, Human
accccacccucccugg

SEQ ID NO: 3489568 - RNA, 17 nt, Human
accccacccucccugga

SEQ ID NO: 3489569 - RNA, 14 nt, Human
accccaccucuucc

SEQ ID NO: 3489570 - RNA, 21 nt, Human
accccaccuuuauuccuucau

SEQ ID NO: 3489571 - RNA, 14 nt, Human
accccacuacacag

SEQ ID NO: 3489572 - RNA, 17 nt, Human
accccacuuaucccucu

SEQ ID NO: 3489573 - RNA, 18 nt, Human
accccacuuaucccucuc

SEQ ID NO: 3489574 - RNA, 14 nt, Human
accccagacacugg

SEQ ID NO: 3489575 - RNA, 10 nt, Human
accccagagc

SEQ ID NO: 3489576 - RNA, 17 nt, Human
accccagagccacacau

SEQ ID NO: 3489577 - RNA, 22 nt, Human
accccagcauucucaggcacca

SEQ ID NO: 3489578 - RNA, 23 nt, Human
accccagcauucucaggcaccag

SEQ ID NO: 3489579 - RNA, 13 nt, Human
accccagccccaa

SEQ ID NO: 3489580 - RNA, 22 nt, Human
accccagccccaaaacucuccu

SEQ ID NO: 3489581 - RNA, 12 nt, Human
accccagccuca

SEQ ID NO: 3489582 - RNA, 20 nt, Human
accccagccucaaauccagg

SEQ ID NO: 3489583 - RNA, 21 nt, Human
accccagccuggccacgcagc

SEQ ID NO: 3489584 - RNA, 13 nt, Human
accccagcggcug

SEQ ID NO: 3489585 - RNA, 11 nt, Human
accccagcucu

SEQ ID NO: 3489586 - RNA, 11 nt, Human
accccagcugg

SEQ ID NO: 3489587 - RNA, 17 nt, Human
accccagcugugagccu

SEQ ID NO: 3489588 - RNA, 11 nt, Human
accccaggacg

SEQ ID NO: 3489589 - RNA, 23 nt, Human
accccaggacgccacucauuuca

SEQ ID NO: 3489590 - RNA, 16 nt, Human
accacagcccugucag

SEQ ID NO: 3489591 - RNA, 12 nt, Human
accacagcuccu

SEQ ID NO: 3489592 - RNA, 22 nt, Human
accacaggaauuuuaaaaacaa

SEQ ID NO: 3489593 - RNA, 17 nt, Human
accacaggcucaggcag

SEQ ID NO: 3489594 - RNA, 23 nt, Human
accacaggguucaaaaugucugu

SEQ ID NO: 3489595 - RNA, 11 nt, Human
accacaguguc

SEQ ID NO: 3489596 - RNA, 14 nt, Human
accacauccuccgu

SEQ ID NO: 3489597 - RNA, 16 nt, Human
accacaucuaagccug

SEQ ID NO: 3489598 - RNA, 14 nt, Human
accacaucuugcuc

SEQ ID NO: 3489599 - RNA, 16 nt, Human
accacaucuugcucug

SEQ ID NO: 3489600 - RNA, 17 nt, Human
accacaucuuuaucugu

SEQ ID NO: 3489601 - RNA, 20 nt, Human
accacaugccaagcacugug

SEQ ID NO: 3489602 - RNA, 18 nt, Human
accacaugcggagaacaa

SEQ ID NO: 3489603 - RNA, 15 nt, Human
accacauugaagaau

SEQ ID NO: 3489604 - RNA, 15 nt, Human
accaccaaaaacaaa

SEQ ID NO: 3489605 - RNA, 19 nt, Human
accaccaacuacuaccugu

SEQ ID NO: 3489606 - RNA, 20 nt, Human
accaccacacccagcccacu

SEQ ID NO: 3489607 - RNA, 16 nt, Human
accaccacacccggcu

SEQ ID NO: 3489608 - RNA, 12 nt, Human
accaccaccccu

SEQ ID NO: 3489609 - RNA, 20 nt, Human
accaccacuggccaccaggc

SEQ ID NO: 3489610 - RNA, 22 nt, Human
accaccacuggccaccaggcug

SEQ ID NO: 3489611 - RNA, 23 nt, Human
accaccacuggccaccaggcugg

SEQ ID NO: 3489612 - RNA, 24 nt, Human
accaccacuggccaccaggcuggc

SEQ ID NO: 3489613 - RNA, 13 nt, Human
accaccagaagcc

SEQ ID NO: 3489614 - RNA, 15 nt, Human
accaccagaagccca

SEQ ID NO: 3489615 - RNA, 12 nt, Human
accaccagcugu

SEQ ID NO: 3489616 - RNA, 13 nt, Human
accaccagcugug

SEQ ID NO: 3489617 - RNA, 21 nt, Human
accaccagggcaucucugggc

SEQ ID NO: 3489618 - RNA, 13 nt, Human
accaccaggucuc

SEQ ID NO: 3489619 - RNA, 17 nt, Human
accaccauccaccgcug

SEQ ID NO: 3489620 - RNA, 19 nt, Human
accaccauccaccgcugcu

SEQ ID NO: 3489621 - RNA, 14 nt, Human
accacccauaucau

SEQ ID NO: 3489622 - RNA, 17 nt, Human
accacccauaucaugca

SEQ ID NO: 3489623 - RNA, 19 nt, Human
accaccccagcugcucccc

SEQ ID NO: 3489624 - RNA, 22 nt, Human
accaccccagcugcuccccucc

SEQ ID NO: 3489625 - RNA, 15 nt, Human
accaccccccacucu

SEQ ID NO: 3489626 - RNA, 22 nt, Human
accaccccgccugcccucaugg

SEQ ID NO: 3489627 - RNA, 20 nt, Human
accaccccugccuccacccu

SEQ ID NO: 3489628 - RNA, 13 nt, Human
accacccuccccu

SEQ ID NO: 3489629 - RNA, 14 nt, Human
accacccuccccuc

SEQ ID NO: 3489630 - RNA, 15 nt, Human
accacccuccccucu

SEQ ID NO: 3489631 - RNA, 16 nt, Human
accacccuccccucuc

SEQ ID NO: 3489632 - RNA, 21 nt, Human
accacccuccccucucuugca

SEQ ID NO: 3489633 - RNA, 14 nt, Human
accacccuccuucc

SEQ ID NO: 3489634 - RNA, 13 nt, Human
accacccugaggc

SEQ ID NO: 3489635 - RNA, 19 nt, Human
accaccgcuccccagccca

SEQ ID NO: 3489636 - RNA, 21 nt, Human
accaccgcuccccagcccagg

SEQ ID NO: 3489637 - RNA, 13 nt, Human
accaccuaccccu

SEQ ID NO: 3489638 - RNA, 17 nt, Human
accaccuaggccacucc

SEQ ID NO: 3489639 - RNA, 21 nt, Human
accaccuaggccacuccucca

SEQ ID NO: 3489640 - RNA, 23 nt, Human
accaccucucaauauucaauaaa

SEQ ID NO: 3489641 - RNA, 12 nt, Human
accaccugccca

SEQ ID NO: 3489642 - RNA, 16 nt, Human
accaccuucccagcuc

SEQ ID NO: 3489643 - RNA, 19 nt, Human
accaccuucccagcucucc

SEQ ID NO: 3489644 - RNA, 17 nt, Human
accacgauguggcccug

SEQ ID NO: 3489645 - RNA, 20 nt, Human
accacgauguggcccuggcc

SEQ ID NO: 3489646 - RNA, 18 nt, Human
accacgcccguccugccu

SEQ ID NO: 3489647 - RNA, 19 nt, Human
accacgcccguccugccug

SEQ ID NO: 3489648 - RNA, 18 nt, Human
accacgccucuugaccag

SEQ ID NO: 3489649 - RNA, 20 nt, Human
accacgccuggcuaauuuuu

SEQ ID NO: 3489650 - RNA, 14 nt, Human
accacgcuggaccu

SEQ ID NO: 3489651 - RNA, 18 nt, Human
accacgcuugacaggaca

SEQ ID NO: 3489652 - RNA, 20 nt, Human
accacggacguuuccaucag

SEQ ID NO: 3489653 - RNA, 18 nt, Human
accacggccacuggccau

SEQ ID NO: 3489654 - RNA, 22 nt, Human
accacggccacuggccaucucc

SEQ ID NO: 3489655 - RNA, 14 nt, Human
accacguccagcug

SEQ ID NO: 3489656 - RNA, 23 nt, Human
accacgucuauuucaucagaaca

SEQ ID NO: 3489657 - RNA, 17 nt, Human
accacgucugucuucac

SEQ ID NO: 3489658 - RNA, 18 nt, Human
accacgucugucuucaca

SEQ ID NO: 3489659 - RNA, 19 nt, Human
accacguuucuaaaggcua

SEQ ID NO: 3489660 - RNA, 17 nt, Human
accacuaacuccugaga

SEQ ID NO: 3489661 - RNA, 15 nt, Human
accacuacauucugu

SEQ ID NO: 3489662 - RNA, 13 nt, Human
accacuagaacuc

SEQ ID NO: 3489663 - RNA, 20 nt, Human
accacuagaacucuccaucu

SEQ ID NO: 3489664 - RNA, 17 nt, Human
accacuaggacucugag

SEQ ID NO: 3489665 - RNA, 15 nt, Human
accacuaugaagcua

SEQ ID NO: 3489666 - RNA, 16 nt, Human
accacucaagaccaaa

SEQ ID NO: 3489667 - RNA, 16 nt, Human
accacucagccccuag

SEQ ID NO: 3489668 - RNA, 12 nt, Human
accacuccauuc

SEQ ID NO: 3489669 - RNA, 21 nt, Human
accacucgugcaucccugaga

SEQ ID NO: 3489670 - RNA, 13 nt, Human
accacucuggcag

SEQ ID NO: 3489671 - RNA, 18 nt, Human
accacucuggcagccaca

SEQ ID NO: 3489672 - RNA, 12 nt, Human
accacucuguaa

SEQ ID NO: 3489673 - RNA, 14 nt, Human
accacugaaaaaau

SEQ ID NO: 3489674 - RNA, 15 nt, Human
accacugaaaaaaua

SEQ ID NO: 3489675 - RNA, 15 nt, Human
accacugcaaguccu

SEQ ID NO: 3489676 - RNA, 17 nt, Human
accacugcaaguccuuu

SEQ ID NO: 3489677 - RNA, 19 nt, Human
accacugcagaagacagua

SEQ ID NO: 3489678 - RNA, 14 nt, Human
accguguaaaccaa

SEQ ID NO: 3489679 - RNA, 19 nt, Human
accgugucaagcugcucug

SEQ ID NO: 3489680 - RNA, 17 nt, Human
accgugucugucuggca

SEQ ID NO: 3489681 - RNA, 13 nt, Human
accguuucuuccc

SEQ ID NO: 3489682 - RNA, 14 nt, Human
accguuucuucccu

SEQ ID NO: 3489683 - RNA, 21 nt, Human
accuaaaaggaaaucucaccc

SEQ ID NO: 3489684 - RNA, 23 nt, Human
accuaaacauagaaauugccuga

SEQ ID NO: 3489685 - RNA, 20 nt, Human
accuaaauaaacacauagau

SEQ ID NO: 3489686 - RNA, 20 nt, Human
accuaacaacauuguagccu

SEQ ID NO: 3489687 - RNA, 18 nt, Human
accuaacauuauuuauuc

SEQ ID NO: 3489688 - RNA, 16 nt, Human
accuaacccagaaaau

SEQ ID NO: 3489689 - RNA, 18 nt, Human
accuaaccccuuuccugc

SEQ ID NO: 3489690 - RNA, 14 nt, Human
accuaaccuguguc

SEQ ID NO: 3489691 - RNA, 16 nt, Human
accuaaccugugucug

SEQ ID NO: 3489692 - RNA, 16 nt, Human
accuaacuguaucuug

SEQ ID NO: 3489693 - RNA, 15 nt, Human
accuaagggacaugu

SEQ ID NO: 3489694 - RNA, 23 nt, Human
accuaagggacauguuuugauaa

SEQ ID NO: 3489695 - RNA, 23 nt, Human
accuaaguacuguaauaauaccu

SEQ ID NO: 3489696 - RNA, 18 nt, Human
accuaaguccuuuaugug

SEQ ID NO: 3489697 - RNA, 20 nt, Human
accuaaucaccauguaagca

SEQ ID NO: 3489698 - RNA, 21 nt, Human
accuaauccaggcagauccag

SEQ ID NO: 3489699 - RNA, 14 nt, Human
accuaauuaauuuc

SEQ ID NO: 3489700 - RNA, 15 nt, Human
accuaauuagagcag

SEQ ID NO: 3489701 - RNA, 16 nt, Human
accuaauuagagcaga

SEQ ID NO: 3489702 - RNA, 22 nt, Human
accuacagaauacuagccagag

SEQ ID NO: 3489703 - RNA, 20 nt, Human
accuacagagaugcuaagag

SEQ ID NO: 3489704 - RNA, 21 nt, Human
accuacagggggucuggcugg

SEQ ID NO: 3489705 - RNA, 16 nt, Human
accuacaguguacagu

SEQ ID NO: 3489706 - RNA, 16 nt, Human
accuacaguuuuaacu

SEQ ID NO: 3489707 - RNA, 17 nt, Human
accuacaguuuuaacug

SEQ ID NO: 3489708 - RNA, 20 nt, Human
accuacauauuccauguuug

SEQ ID NO: 3489709 - RNA, 14 nt, Human
accuaccaaaaaau

SEQ ID NO: 3489710 - RNA, 16 nt, Human
accuaccaccacgccc

SEQ ID NO: 3489711 - RNA, 20 nt, Human
accuaccaccacgcccggcu

SEQ ID NO: 3489712 - RNA, 18 nt, Human
accuaccaccccuuccug

SEQ ID NO: 3489713 - RNA, 21 nt, Human
accuaccaccccuuccugucc

SEQ ID NO: 3489714 - RNA, 14 nt, Human
accuaccaucaggg

SEQ ID NO: 3489715 - RNA, 15 nt, Human
accuacccauacacc

SEQ ID NO: 3489716 - RNA, 13 nt, Human
accuaccucaggu

SEQ ID NO: 3489717 - RNA, 16 nt, Human
accuaccucagguugc

SEQ ID NO: 3489718 - RNA, 20 nt, Human
accuaccucagguugcuggu

SEQ ID NO: 3489719 - RNA, 18 nt, Human
accuaccuguaacuuuuu

SEQ ID NO: 3489720 - RNA, 24 nt, Human
accuaccuguugagcaucacagaa

SEQ ID NO: 3489721 - RNA, 17 nt, Human
accuaccuucaaagcug

SEQ ID NO: 3489722 - RNA, 18 nt, Human
accuaccuucaaagcuga

SEQ ID NO: 3489723 - RNA, 16 nt, Human
accuacucacacaggc

SEQ ID NO: 3489724 - RNA, 18 nt, Human
accuacucuggcuagaag

SEQ ID NO: 3489725 - RNA, 16 nt, Human
accuacuguucuaaag

SEQ ID NO: 3489726 - RNA, 20 nt, Human
accuacuguucuaaagcucu

SEQ ID NO: 3489727 - RNA, 20 nt, Human
accuacuuugacuuuuugca

SEQ ID NO: 3489728 - RNA, 20 nt, Human
accuagaagaagcuauguca

SEQ ID NO: 3489729 - RNA, 14 nt, Human
accuagaagggcua

SEQ ID NO: 3489730 - RNA, 20 nt, Human
accuagagacuucacccggg

SEQ ID NO: 3489731 - RNA, 13 nt, Human
accuagagccaga

SEQ ID NO: 3489732 - RNA, 18 nt, Human
accuagcaauuccaucac

SEQ ID NO: 3489733 - RNA, 22 nt, Human
accuagcagcaccguucugugc

SEQ ID NO: 3489734 - RNA, 13 nt, Human
accuagccagcug

SEQ ID NO: 3489735 - RNA, 16 nt, Human
accuagcgucaguauu

SEQ ID NO: 3489736 - RNA, 23 nt, Human
accuagcugaauguuuuucuaaa

SEQ ID NO: 3489737 - RNA, 18 nt, Human
accuaggccacuccucca

SEQ ID NO: 3489738 - RNA, 14 nt, Human
accuagugaaacuu

SEQ ID NO: 3489739 - RNA, 21 nt, Human
accuaguggcuguccagugcc

SEQ ID NO: 3489740 - RNA, 14 nt, Human
accuaguuuuccau

SEQ ID NO: 3489741 - RNA, 18 nt, Human
accuauaaaguaaagcua

SEQ ID NO: 3489742 - RNA, 15 nt, Human
accuauaaugugugu

SEQ ID NO: 3489743 - RNA, 22 nt, Human
accuauaauguguguaugugua

SEQ ID NO: 3489744 - RNA, 13 nt, Human
accuauaugauuu

SEQ ID NO: 3489745 - RNA, 14 nt, Human
accuaucccaccuc

SEQ ID NO: 3489746 - RNA, 12 nt, Human
accuaugucauu

SEQ ID NO: 3489747 - RNA, 16 nt, Human
accuaugucauuucau

SEQ ID NO: 3489748 - RNA, 17 nt, Human
accuauguccuaaggac

SEQ ID NO: 3489749 - RNA, 23 nt, Human
accuauguccuaaggacacacua

SEQ ID NO: 3489750 - RNA, 16 nt, Human
accuauuccuccuggg

SEQ ID NO: 3489751 - RNA, 18 nt, Human
accuauuucaaaaauuug

SEQ ID NO: 3489752 - RNA, 20 nt, Human
accuauuucaaaaauuugga

SEQ ID NO: 3489753 - RNA, 14 nt, Human
accuauuucucuuu

SEQ ID NO: 3489754 - RNA, 22 nt, Human
accuauuucucuuucuuuacaa

SEQ ID NO: 3489755 - RNA, 18 nt, Human
accuauuucuuaaacacu

SEQ ID NO: 3489756 - RNA, 23 nt, Human
accuauuucuuaaacacuugcaa

SEQ ID NO: 3489757 - RNA, 14 nt, Human
accuauuugacaua

SEQ ID NO: 3489758 - RNA, 17 nt, Human
accuauuugacuuacca

SEQ ID NO: 3489759 - RNA, 21 nt, Human
accuauuuugaaaaauuccua

SEQ ID NO: 3489760 - RNA, 19 nt, Human
accucaaaaugucuaagau

SEQ ID NO: 3489761 - RNA, 22 nt, Human
accucaaagcaccugaacaguu

SEQ ID NO: 3489762 - RNA, 16 nt, Human
accucaacaagaagaa

SEQ ID NO: 3489763 - RNA, 16 nt, Human
accucaaccaaugcca

SEQ ID NO: 3489764 - RNA, 16 nt, Human
accucaaccuguaaau

SEQ ID NO: 3489765 - RNA, 16 nt, Human
accucaacugccuacu

SEQ ID NO: 3489766 - RNA, 16 nt, Human
accucaagcugcaucu

SEQ ID NO: 3489767 - RNA, 19 nt, Human
accucaagugaucugccca

SEQ ID NO: 3489768 - RNA, 21 nt, Human
accucaaucagucucagaaug

SEQ ID NO: 3489769 - RNA, 15 nt, Human
accucacagugaccc

SEQ ID NO: 3489770 - RNA, 19 nt, Human
accucaccaacuccuaguu

SEQ ID NO: 3489771 - RNA, 11 nt, Human
accucacccca

SEQ ID NO: 3489772 - RNA, 15 nt, Human
accucaccccacuua

SEQ ID NO: 3489773 - RNA, 21 nt, Human
accucaccccgaggcccugca

SEQ ID NO: 3489774 - RNA, 22 nt, Human
accucaccccgaggcccugcau

SEQ ID NO: 3489775 - RNA, 14 nt, Human
accucacccugcua

SEQ ID NO: 3489776 - RNA, 21 nt, Human
accucacgugcaaagccacca

SEQ ID NO: 3489777 - RNA, 14 nt, Human
accucacucagcac

SEQ ID NO: 3489778 - RNA, 15 nt, Human
accucacucagcacc

SEQ ID NO: 3489779 - RNA, 19 nt, Human
accucacucagcaccacuc

SEQ ID NO: 3489780 - RNA, 16 nt, Human
accucacucuuuauag

SEQ ID NO: 3489781 - RNA, 17 nt, Human
accucacucuuuauagu

SEQ ID NO: 3489782 - RNA, 20 nt, Human
accucacugaaaacaucugg

SEQ ID NO: 3489783 - RNA, 23 nt, Human
accucacugggguccuggggccu

SEQ ID NO: 3489784 - RNA, 20 nt, Human
accucagaaguaaaggaauu

SEQ ID NO: 3489785 - RNA, 20 nt, Human
accucagaguccaggcccca

SEQ ID NO: 3489786 - RNA, 12 nt, Human
accucagccugg

SEQ ID NO: 3489787 - RNA, 14 nt, Human
accucagccuggcc

SEQ ID NO: 3489788 - RNA, 17 nt, Human
accucagccugggcgcu

SEQ ID NO: 3489789 - RNA, 20 nt, Human
accucagccuuccccuugcc

SEQ ID NO: 3489790 - RNA, 17 nt, Human
accucagcucugggaga

SEQ ID NO: 3489791 - RNA, 18 nt, Human
accucagcucugggagag

SEQ ID NO: 3489792 - RNA, 22 nt, Human
acccagacggcuccacuaggac

SEQ ID NO: 3489793 - RNA, 18 nt, Human
acccagagaagccccuuc

SEQ ID NO: 3489794 - RNA, 24 nt, Human
acccagagcauuacgugagccagg

SEQ ID NO: 3489795 - RNA, 17 nt, Human
acccagcaacagaaaaa

SEQ ID NO: 3489796 - RNA, 17 nt, Human
acccagcaguucuguua

SEQ ID NO: 3489797 - RNA, 15 nt, Human
acccagccaucugcc

SEQ ID NO: 3489798 - RNA, 19 nt, Human
acccagccaucugcccagg

SEQ ID NO: 3489799 - RNA, 14 nt, Human
acccagcccauucu

SEQ ID NO: 3489800 - RNA, 17 nt, Human
acccagccccagccagg

SEQ ID NO: 3489801 - RNA, 14 nt, Human
acccagccccaggg

SEQ ID NO: 3489802 - RNA, 16 nt, Human
acccagccccuugaga

SEQ ID NO: 3489803 - RNA, 12 nt, Human
acccagcccugg

SEQ ID NO: 3489804 - RNA, 14 nt, Human
acccagcccugguc

SEQ ID NO: 3489805 - RNA, 15 nt, Human
acccagcccuggucu

SEQ ID NO: 3489806 - RNA, 21 nt, Human
acccagccgccaucagcccaa

SEQ ID NO: 3489807 - RNA, 22 nt, Human
acccagccucaguccuccccuc

SEQ ID NO: 3489808 - RNA, 23 nt, Human
acccagccucaguccuccccuca

SEQ ID NO: 3489809 - RNA, 13 nt, Human
acccagcgagccc

SEQ ID NO: 3489810 - RNA, 23 nt, Human
acccagcgagcccugguggcagu

SEQ ID NO: 3489811 - RNA, 24 nt, Human
acccagcgagcccugguggcagug

SEQ ID NO: 3489812 - RNA, 15 nt, Human
acccagcguggccuc

SEQ ID NO: 3489813 - RNA, 14 nt, Human
acccagcuaaauaa

SEQ ID NO: 3489814 - RNA, 14 nt, Human
acccagcugcaccc

SEQ ID NO: 3489815 - RNA, 20 nt, Human
acccagcugcaccccuuccu

SEQ ID NO: 3489816 - RNA, 17 nt, Human
acccagcugccaccucu

SEQ ID NO: 3489817 - RNA, 16 nt, Human
acccaggacaagcaug

SEQ ID NO: 3489818 - RNA, 20 nt, Human
acccaggacaggauccaggc

SEQ ID NO: 3489819 - RNA, 23 nt, Human
acccaggagauggaaguugcagu

SEQ ID NO: 3489820 - RNA, 23 nt, Human
acccaggagccccgaggccuucu

SEQ ID NO: 3489821 - RNA, 13 nt, Human
acccaggaggcag

SEQ ID NO: 3489822 - RNA, 13 nt, Human
acccccaccaagg

SEQ ID NO: 3489823 - RNA, 16 nt, Human
acccccacccccacca

SEQ ID NO: 3489824 - RNA, 14 nt, Human
acccccacccccag

SEQ ID NO: 3489825 - RNA, 15 nt, Human
acccccaccccuucc

SEQ ID NO: 3489826 - RNA, 17 nt, Human
acccccaccccuugcuc

SEQ ID NO: 3489827 - RNA, 12 nt, Human
acccccacccuu

SEQ ID NO: 3489828 - RNA, 15 nt, Human
acccccacuccagcu

SEQ ID NO: 3489829 - RNA, 13 nt, Human
acccccacucuca

SEQ ID NO: 3489830 - RNA, 17 nt, Human
acccccacucucauucc

SEQ ID NO: 3489831 - RNA, 22 nt, Human
acccccacucucauuccccagg

SEQ ID NO: 3489832 - RNA, 13 nt, Human
acccccagcaacc

SEQ ID NO: 3489833 - RNA, 13 nt, Human
acccccagcaccc

SEQ ID NO: 3489834 - RNA, 12 nt, Human
acccccagcacu

SEQ ID NO: 3489835 - RNA, 13 nt, Human
acccccagccccg

SEQ ID NO: 3489836 - RNA, 23 nt, Human
acccccagccccgacuccagcca

SEQ ID NO: 3489837 - RNA, 13 nt, Human
acccccagccugc

SEQ ID NO: 3489838 - RNA, 13 nt, Human
acccccagcucaa

SEQ ID NO: 3489839 - RNA, 18 nt, Human
acccccagcuccggccug

SEQ ID NO: 3489840 - RNA, 19 nt, Human
acccccagcugcuuguguc

SEQ ID NO: 3489841 - RNA, 16 nt, Human
acccccaggaccccug

SEQ ID NO: 3489842 - RNA, 17 nt, Human
acccccaucucucccuc

SEQ ID NO: 3489843 - RNA, 16 nt, Human
acccccauucucaucu

SEQ ID NO: 3489844 - RNA, 17 nt, Human
acccccauuucuauuua

SEQ ID NO: 3489845 - RNA, 22 nt, Human
acccccccagcuucacuucuga

SEQ ID NO: 3489846 - RNA, 13 nt, Human
accccccccccac

SEQ ID NO: 3489847 - RNA, 12 nt, Human
accccccugggc

SEQ ID NO: 3489848 - RNA, 15 nt, Human
accccccugggcuga

SEQ ID NO: 3489849 - RNA, 22 nt, Human
accccccuguacacaacucacu

SEQ ID NO: 3489850 - RNA, 12 nt, Human
accccccuguuc

SEQ ID NO: 3489851 - RNA, 15 nt, Human
accccccuguucuaa

SEQ ID NO: 3489852 - RNA, 17 nt, Human
accccccuguucuaagg

SEQ ID NO: 3489853 - RNA, 16 nt, Human
acccccgcccaggcug

SEQ ID NO: 3489854 - RNA, 18 nt, Human
acccccgcccccugcccu

SEQ ID NO: 3489855 - RNA, 13 nt, Human
acccccgcuggag

SEQ ID NO: 3489856 - RNA, 19 nt, Human
acccccucaagccaauccc

SEQ ID NO: 3489857 - RNA, 12 nt, Human
acccccucccca

SEQ ID NO: 3489858 - RNA, 14 nt, Human
acccccuccucucu

SEQ ID NO: 3489859 - RNA, 11 nt, Human
acccccuccuu

SEQ ID NO: 3489860 - RNA, 12 nt, Human
acccccuccuuc

SEQ ID NO: 3489861 - RNA, 18 nt, Human
acccccucgggucuccuc

SEQ ID NO: 3489862 - RNA, 15 nt, Human
acccccugcagcuug

SEQ ID NO: 3489863 - RNA, 16 nt, Human
acccccuucagugccc

SEQ ID NO: 3489864 - RNA, 20 nt, Human
acccccuucagugcccacca

SEQ ID NO: 3489865 - RNA, 12 nt, Human
acccccuucccc

SEQ ID NO: 3489866 - RNA, 18 nt, Human
acccccuucuacugagcc

SEQ ID NO: 3489867 - RNA, 19 nt, Human
acccccuucuacugagccu

SEQ ID NO: 3489868 - RNA, 21 nt, Human
acccccuucucugcccauucc

SEQ ID NO: 3489869 - RNA, 22 nt, Human
acccccuucucugcccauuccc

SEQ ID NO: 3489870 - RNA, 17 nt, Human
acccccuucucugcucc

SEQ ID NO: 3489871 - RNA, 15 nt, Human
acccccuucugggca

SEQ ID NO: 3489872 - RNA, 18 nt, Human
accccgaccaccugccca

SEQ ID NO: 3489873 - RNA, 15 nt, Human
accccgaggcccugc

SEQ ID NO: 3489874 - RNA, 20 nt, Human
accccgaggcccugcauggg

SEQ ID NO: 3489875 - RNA, 18 nt, Human
accccgcagacaccuugg

SEQ ID NO: 3489876 - RNA, 14 nt, Human
accccgccugcccu

SEQ ID NO: 3489877 - RNA, 20 nt, Human
accccggcaggcccugcagu

SEQ ID NO: 3489878 - RNA, 21 nt, Human
accccgggcucucugcuguac

SEQ ID NO: 3489879 - RNA, 16 nt, Human
accccggggacccugu

SEQ ID NO: 3489880 - RNA, 20 nt, Human
accccggggugcccacaggc

SEQ ID NO: 3489881 - RNA, 23 nt, Human
accccggggugcccacaggccgc

SEQ ID NO: 3489882 - RNA, 20 nt, Human
accccgucgaggggcucuca

SEQ ID NO: 3489883 - RNA, 22 nt, Human
accccgucugggguucagcccc

SEQ ID NO: 3489884 - RNA, 17 nt, Human
accccgugaagcaucca

SEQ ID NO: 3489885 - RNA, 18 nt, Human
accccguuacagcucccc

SEQ ID NO: 3489886 - RNA, 20 nt, Human
accccguuacagcuccccaa

SEQ ID NO: 3489887 - RNA, 15 nt, Human
accccucaccuugca

SEQ ID NO: 3489888 - RNA, 19 nt, Human
accccucaccuugcaacac

SEQ ID NO: 3489889 - RNA, 18 nt, Human
accccucacucuggccuc

SEQ ID NO: 3489890 - RNA, 17 nt, Human
accccuccacucuuucu

SEQ ID NO: 3489891 - RNA, 14 nt, Human
accccucccagcug

SEQ ID NO: 3489892 - RNA, 22 nt, Human
accccucccagcugacaguccu

SEQ ID NO: 3489893 - RNA, 19 nt, Human
accccuccccuccaucccu

SEQ ID NO: 3489894 - RNA, 20 nt, Human
accccucccggcccugccug

SEQ ID NO: 3489895 - RNA, 13 nt, Human
accccucccuuuc

SEQ ID NO: 3489896 - RNA, 13 nt, Human
accccuccucacu

SEQ ID NO: 3489897 - RNA, 18 nt, Human
accccuccucccuuuuuc

SEQ ID NO: 3489898 - RNA, 17 nt, Human
accccuccuggggccag

SEQ ID NO: 3489899 - RNA, 20 nt, Human
accccuccuggggccaggcc

SEQ ID NO: 3489900 - RNA, 16 nt, Human
accccuccuuccuuga

SEQ ID NO: 3489901 - RNA, 21 nt, Human
accccuccuuccuugaccagc

SEQ ID NO: 3489902 - RNA, 23 nt, Human
accccuccuuccuugaccagcag

SEQ ID NO: 3489903 - RNA, 14 nt, Human
accccucgcccagu

SEQ ID NO: 3489904 - RNA, 19 nt, Human
accccucgcccagucccag

SEQ ID NO: 3489905 - RNA, 14 nt, Human
accccucuggccag

SEQ ID NO: 3489906 - RNA, 13 nt, Human
accccucuguagc

SEQ ID NO: 3489907 - RNA, 16 nt, Human
accccugacucaucau

SEQ ID NO: 3489908 - RNA, 22 nt, Human
accccugcauuggaacuggagg

SEQ ID NO: 3489909 - RNA, 10 nt, Human
accccugccc

SEQ ID NO: 3489910 - RNA, 12 nt, Human
accccugccccc

SEQ ID NO: 3489911 - RNA, 17 nt, Human
accccugcccccagccc

SEQ ID NO: 3489912 - RNA, 12 nt, Human
accccugcccug

SEQ ID NO: 3489913 - RNA, 13 nt, Human
accccugcccugg

SEQ ID NO: 3489914 - RNA, 15 nt, Human
accccugcccuggga

SEQ ID NO: 3489915 - RNA, 22 nt, Human
accccugccuccacccucugag

SEQ ID NO: 3489916 - RNA, 23 nt, Human
accccugccuccacccucugagc

SEQ ID NO: 3489917 - RNA, 20 nt, Human
accccuggcuccaggccagg

SEQ ID NO: 3489918 - RNA, 22 nt, Human
accccuggcuccaggccagggg

SEQ ID NO: 3489919 - RNA, 11 nt, Human
accccuggcug

SEQ ID NO: 3489920 - RNA, 20 nt, Human
accccuggcuuuucacugcu

SEQ ID NO: 3489921 - RNA, 16 nt, Human
accccugggggcucuc

SEQ ID NO: 3489922 - RNA, 16 nt, Human
accccugguucucauc

SEQ ID NO: 3489923 - RNA, 22 nt, Human
accccugguucucaucuuucuu

SEQ ID NO: 3489924 - RNA, 17 nt, Human
accccuguaggccucag

SEQ ID NO: 3489925 - RNA, 21 nt, Human
accccugucccaugcaggccc

SEQ ID NO: 3489926 - RNA, 22 nt, Human
accccugucccaugcaggcccu

SEQ ID NO: 3489927 - RNA, 17 nt, Human
accccuguccucacugc

SEQ ID NO: 3489928 - RNA, 19 nt, Human
accccuguccucacugcuc

SEQ ID NO: 3489929 - RNA, 21 nt, Human
accccuguccucacugcuccc

SEQ ID NO: 3489930 - RNA, 13 nt, Human
accccuguggagc

SEQ ID NO: 3489931 - RNA, 16 nt, Human
accccuuagccucccu

SEQ ID NO: 3489932 - RNA, 18 nt, Human
accccuuagccucccuga

SEQ ID NO: 3489933 - RNA, 20 nt, Human
accccuuccagaucacugcc

SEQ ID NO: 3489934 - RNA, 21 nt, Human
accccuuccagaucacugcca

SEQ ID NO: 3489935 - RNA, 15 nt, Human
accccuuccaugugg

SEQ ID NO: 3489936 - RNA, 20 nt, Human
accccuuccccacugccugc

SEQ ID NO: 3489937 - RNA, 21 nt, Human
accccuuccccacugccugcc

SEQ ID NO: 3489938 - RNA, 22 nt, Human
accccuuccccacugccugccc

SEQ ID NO: 3489939 - RNA, 15 nt, Human
accccuuccugggca

SEQ ID NO: 3489940 - RNA, 22 nt, Human
accccuuccugggcacacgcug

SEQ ID NO: 3489941 - RNA, 23 nt, Human
accccuuccugggcacacgcugc

SEQ ID NO: 3489942 - RNA, 16 nt, Human
accccuucgcuccugu

SEQ ID NO: 3489943 - RNA, 19 nt, Human
accccuucgcuccuguguc

SEQ ID NO: 3489944 - RNA, 15 nt, Human
accccuucucuccuc

SEQ ID NO: 3489945 - RNA, 17 nt, Human
accccuucucuccuccc

SEQ ID NO: 3489946 - RNA, 23 nt, Human
accccuucucuccuccccaaauc

SEQ ID NO: 3489947 - RNA, 16 nt, Human
accccuucucugugac

SEQ ID NO: 3489948 - RNA, 18 nt, Human
accccuucucugugaccc

SEQ ID NO: 3489949 - RNA, 21 nt, Human
accccuucucugugacccacu

SEQ ID NO: 3489950 - RNA, 14 nt, Human
accccuuucccacc

SEQ ID NO: 3489951 - RNA, 17 nt, Human
accccuuucccacccca

SEQ ID NO: 3489952 - RNA, 12 nt, Human
accccuuuccug

SEQ ID NO: 3489953 - RNA, 17 nt, Human
accccuuuucagcuucu

SEQ ID NO: 3489954 - RNA, 19 nt, Human
accccuuuucagcuucugc

SEQ ID NO: 3489955 - RNA, 21 nt, Human
acccgaccccccgugggcucc

SEQ ID NO: 3489956 - RNA, 15 nt, Human
acccgagcugggacc

SEQ ID NO: 3489957 - RNA, 13 nt, Human
acccgaggaaacu

SEQ ID NO: 3489958 - RNA, 16 nt, Human
acacacagaaaauaua

SEQ ID NO: 3489959 - RNA, 13 nt, Human
acacacagaggaa

SEQ ID NO: 3489960 - RNA, 23 nt, Human
acacacagauuugagcucagccc

SEQ ID NO: 3489961 - RNA, 12 nt, Human
acacacagccac

SEQ ID NO: 3489962 - RNA, 13 nt, Human
acacacagccaca

SEQ ID NO: 3489963 - RNA, 17 nt, Human
acacacagccacacaca

SEQ ID NO: 3489964 - RNA, 18 nt, Human
acacacagccacacacac

SEQ ID NO: 3489965 - RNA, 12 nt, Human
acacacagcucc

SEQ ID NO: 3489966 - RNA, 13 nt, Human
acacacagcucug

SEQ ID NO: 3489967 - RNA, 17 nt, Human
acacacaggcaacugag

SEQ ID NO: 3489968 - RNA, 17 nt, Human
acccugggcucuguggg

SEQ ID NO: 3489969 - RNA, 11 nt, Human
accucugugug

SEQ ID NO: 3489970 - RNA, 12 nt, Human
accucugugugc

SEQ ID NO: 3489971 - RNA, 14 nt, Human
accucuguucagug

SEQ ID NO: 3489972 - RNA, 22 nt, Human
accucuguucaguguaaauagu

SEQ ID NO: 3489973 - RNA, 17 nt, Human
accucuguuguccuccc

SEQ ID NO: 3489974 - RNA, 15 nt, Human
accucuucagaggcc

SEQ ID NO: 3489975 - RNA, 17 nt, Human
accucuucagaggcccu

SEQ ID NO: 3489976 - RNA, 18 nt, Human
accucuucagaggcccuc

SEQ ID NO: 3489977 - RNA, 22 nt, Human
accucuuccgacucuuucugag

SEQ ID NO: 3489978 - RNA, 17 nt, Human
accucuuccuggccggu

SEQ ID NO: 3489979 - RNA, 16 nt, Human
accucuucuggcucaa

SEQ ID NO: 3489980 - RNA, 17 nt, Human
accucuugcugucucug

SEQ ID NO: 3489981 - RNA, 20 nt, Human
accucuugcugucucugcuc

SEQ ID NO: 3489982 - RNA, 12 nt, Human
accucuuguuuu

SEQ ID NO: 3489983 - RNA, 13 nt, Human
accucuuuggaaa

SEQ ID NO: 3489984 - RNA, 21 nt, Human
accucuuuuagucauuuugcu

SEQ ID NO: 3489985 - RNA, 18 nt, Human
accucuuuucugcaucau

SEQ ID NO: 3489986 - RNA, 22 nt, Human
accucuuuugcuugccaaagua

SEQ ID NO: 3489987 - RNA, 21 nt, Human
accugaaaaaaaguuuacaag

SEQ ID NO: 3489988 - RNA, 11 nt, Human
accugaaaaca

SEQ ID NO: 3489989 - RNA, 22 nt, Human
accugaaaagauguugugucuu

SEQ ID NO: 3489990 - RNA, 14 nt, Human
accugaaauuccaa

SEQ ID NO: 3489991 - RNA, 15 nt, Human
accugaaauuccaaa

SEQ ID NO: 3489992 - RNA, 19 nt, Human
accugaaauuccaaagucu

SEQ ID NO: 3489993 - RNA, 20 nt, Human
accugaaauuccaaagucuc

SEQ ID NO: 3489994 - RNA, 22 nt, Human
accugaaauuccaaagucucua

SEQ ID NO: 3489995 - RNA, 20 nt, Human
accugaacacuuauugcuuu

SEQ ID NO: 3489996 - RNA, 14 nt, Human
accugaagaaucac

SEQ ID NO: 3489997 - RNA, 19 nt, Human
accugaagaugggagccuu

SEQ ID NO: 3489998 - RNA, 15 nt, Human
accugaaggguugac

SEQ ID NO: 3489999 - RNA, 22 nt, Human
accugaagucuuuguacagaca

SEQ ID NO: 3490000 - RNA, 21 nt, Human
accugaaguuuuuuugcugcu

SEQ ID NO: 3490001 - RNA, 16 nt, Human
accugacaagcacugc

SEQ ID NO: 3490002 - RNA, 12 nt, Human
accugacacaag

SEQ ID NO: 3490003 - RNA, 16 nt, Human
accugacacaagagga

SEQ ID NO: 3490004 - RNA, 21 nt, Human
accugacacaccaggcgcuaa

SEQ ID NO: 3490005 - RNA, 17 nt, Human
accugacacucccuugg

SEQ ID NO: 3490006 - RNA, 19 nt, Human
accugacacucccuugggc

SEQ ID NO: 3490007 - RNA, 22 nt, Human
accugacagaugucagccgagc

SEQ ID NO: 3490008 - RNA, 17 nt, Human
accugaccccugcucag

SEQ ID NO: 3490009 - RNA, 23 nt, Human
accugaccccugcucaguaaagc

SEQ ID NO: 3490010 - RNA, 16 nt, Human
accugacuaagaaauu

SEQ ID NO: 3490011 - RNA, 20 nt, Human
accugacuauugaaguugca

SEQ ID NO: 3490012 - RNA, 14 nt, Human
accugacucugaaa

SEQ ID NO: 3490013 - RNA, 15 nt, Human
accugacucugaaau

SEQ ID NO: 3490014 - RNA, 15 nt, Human
accugagaccugaag

SEQ ID NO: 3490015 - RNA, 18 nt, Human
accugagauuuauuaaag

SEQ ID NO: 3490016 - RNA, 20 nt, Human
accugagauuuauuaaagaa

SEQ ID NO: 3490017 - RNA, 10 nt, Human
accugagccu

SEQ ID NO: 3490018 - RNA, 12 nt, Human
accugagccugc

SEQ ID NO: 3490019 - RNA, 16 nt, Human
accugagccugccgag

SEQ ID NO: 3490020 - RNA, 17 nt, Human
accugagccugccgagc

SEQ ID NO: 3490021 - RNA, 19 nt, Human
accugagcuagaagcugga

SEQ ID NO: 3490022 - RNA, 12 nt, Human
accugagcugcc

SEQ ID NO: 3490023 - RNA, 18 nt, Human
accugagcugccauccag

SEQ ID NO: 3490024 - RNA, 14 nt, Human
accugagcuuugga

SEQ ID NO: 3490025 - RNA, 23 nt, Human
accugagcuuuggacgcacacag

SEQ ID NO: 3490026 - RNA, 14 nt, Human
accugaggcccuuc

SEQ ID NO: 3490027 - RNA, 15 nt, Human
accugaggccugaag

SEQ ID NO: 3490028 - RNA, 16 nt, Human
accugaggcuccugug

SEQ ID NO: 3490029 - RNA, 14 nt, Human
accugagggucugu

SEQ ID NO: 3490030 - RNA, 19 nt, Human
accugagggucuguagguu

SEQ ID NO: 3490031 - RNA, 23 nt, Human
accugaggucgggaguuggagac

SEQ ID NO: 3490032 - RNA, 12 nt, Human
accugagguggg

SEQ ID NO: 3490033 - RNA, 17 nt, Human
accugaggugggcccag

SEQ ID NO: 3490034 - RNA, 24 nt, Human
accugaggugggcccaggaccagc

SEQ ID NO: 3490035 - RNA, 14 nt, Human
accugaguugaaga

SEQ ID NO: 3490036 - RNA, 16 nt, Human
accugaguugaagagg

SEQ ID NO: 3490037 - RNA, 16 nt, Human
accugauacggcuccc

SEQ ID NO: 3490038 - RNA, 14 nt, Human
accugaucaaugac

SEQ ID NO: 3490039 - RNA, 15 nt, Human
accugaucccacucc

SEQ ID NO: 3490040 - RNA, 13 nt, Human
accugauccugga

SEQ ID NO: 3490041 - RNA, 19 nt, Human
accugaugaaaauaaagaa

SEQ ID NO: 3490042 - RNA, 22 nt, Human
accugauguguacaucccaugu

SEQ ID NO: 3490043 - RNA, 17 nt, Human
accugauuaacugaggc

SEQ ID NO: 3490044 - RNA, 14 nt, Human
accugauuguaaac

SEQ ID NO: 3490045 - RNA, 16 nt, Human
accugauuguaaacuu

SEQ ID NO: 3490046 - RNA, 11 nt, Human
accugauuuuu

SEQ ID NO: 3490047 - RNA, 13 nt, Human
accugcaaaaaau

SEQ ID NO: 3490048 - RNA, 15 nt, Human
accugcaaaaaauac

SEQ ID NO: 3490049 - RNA, 22 nt, Human
accugcaaacgcuucaguuguu

SEQ ID NO: 3490050 - RNA, 17 nt, Human
accugcaaucccagcua

SEQ ID NO: 3490051 - RNA, 20 nt, Human
accugcacacuguccuauua

SEQ ID NO: 3490052 - RNA, 19 nt, Human
accugcaccuccccccacu

SEQ ID NO: 3490053 - RNA, 18 nt, Human
accugcacuaacagagug

SEQ ID NO: 3490054 - RNA, 14 nt, Human
accugcagccuccc

SEQ ID NO: 3490055 - RNA, 13 nt, Human
accugcagcuccc

SEQ ID NO: 3490056 - RNA, 17 nt, Human
accugcaggcugagcca

SEQ ID NO: 3490057 - RNA, 13 nt, Human
accugcagguugg

SEQ ID NO: 3490058 - RNA, 22 nt, Human
accugcagguugggccauacug

SEQ ID NO: 3490059 - RNA, 18 nt, Human
accugcaucuaagcccau

SEQ ID NO: 3490060 - RNA, 17 nt, Human
accugcaucuuuagugc

SEQ ID NO: 3490061 - RNA, 18 nt, Human
accugccacuaggcuggg

SEQ ID NO: 3490062 - RNA, 21 nt, Human
accugccacuaggcugggugc

SEQ ID NO: 3490063 - RNA, 14 nt, Human
accugccacucaca

SEQ ID NO: 3490064 - RNA, 20 nt, Human
accugccacucacacagcca

SEQ ID NO: 3490065 - RNA, 21 nt, Human
accugccagccuggcuucugg

SEQ ID NO: 3490066 - RNA, 17 nt, Human
accugccaggaagccag

SEQ ID NO: 3490067 - RNA, 21 nt, Human
accugccaggaagccagcagg

SEQ ID NO: 3490068 - RNA, 22 nt, Human
accugccaggaagccagcaggc

SEQ ID NO: 3490069 - RNA, 13 nt, Human
accugccaggcag

SEQ ID NO: 3490070 - RNA, 19 nt, Human
accugccaugccaggaacc

SEQ ID NO: 3490071 - RNA, 19 nt, Human
accugccauuugcacccuc

SEQ ID NO: 3490072 - RNA, 13 nt, Human
accugcccaaccu

SEQ ID NO: 3490073 - RNA, 19 nt, Human
accugccccacuuguccuu

SEQ ID NO: 3490074 - RNA, 16 nt, Human
accugcccccuucucc

SEQ ID NO: 3490075 - RNA, 23 nt, Human
accugcccccuucucccacacug

SEQ ID NO: 3490076 - RNA, 23 nt, Human
accugccccgcccagcugcaccu

SEQ ID NO: 3490077 - RNA, 12 nt, Human
accugccccuca

SEQ ID NO: 3490078 - RNA, 22 nt, Human
accugccccucaacucuccucc

SEQ ID NO: 3490079 - RNA, 23 nt, Human
accugccccucaacucuccucca

SEQ ID NO: 3490080 - RNA, 17 nt, Human
accugcccuaaacccug

SEQ ID NO: 3490081 - RNA, 17 nt, Human
accugcccucaagggug

SEQ ID NO: 3490082 - RNA, 12 nt, Human
accugcccugcc

SEQ ID NO: 3490083 - RNA, 16 nt, Human
accugcccugcccugc

SEQ ID NO: 3490084 - RNA, 18 nt, Human
accugcccugcccugcca

SEQ ID NO: 3490085 - RNA, 13 nt, Human
accugcccugccu

SEQ ID NO: 3490086 - RNA, 16 nt, Human
accugcccugccugag

SEQ ID NO: 3490087 - RNA, 19 nt, Human
accugcccugccugagggc

SEQ ID NO: 3490088 - RNA, 20 nt, Human
accugcccugcugaguccca

SEQ ID NO: 3490089 - RNA, 14 nt, Human
accugcccuggaac

SEQ ID NO: 3490090 - RNA, 23 nt, Human
accugcccuuuuuucugccuccu

SEQ ID NO: 3490091 - RNA, 23 nt, Human
accugccgagaguccaucagccu

SEQ ID NO: 3490092 - RNA, 13 nt, Human
accugccuccucg

SEQ ID NO: 3490093 - RNA, 20 nt, Human
accugccuccucguuccuuu

SEQ ID NO: 3490094 - RNA, 17 nt, Human
accugccucggccuccc

SEQ ID NO: 3490095 - RNA, 21 nt, Human
accugccucggccucccaaag

SEQ ID NO: 3490096 - RNA, 15 nt, Human
accugccucucacac

SEQ ID NO: 3490097 - RNA, 22 nt, Human
accugccucucacacacauaga

SEQ ID NO: 3490098 - RNA, 13 nt, Human
accugccugcguc

SEQ ID NO: 3490099 - RNA, 14 nt, Human
accugccuggccgg

SEQ ID NO: 3490100 - RNA, 18 nt, Human
accugccuggccggccag

SEQ ID NO: 3490101 - RNA, 20 nt, Human
accugccuggccggccagcc

SEQ ID NO: 3490102 - RNA, 21 nt, Human
accugccuggccggccagcca

SEQ ID NO: 3490103 - RNA, 14 nt, Human
accugccuguagcc

SEQ ID NO: 3490104 - RNA, 23 nt, Human
accugccuguugggccaggagcc

SEQ ID NO: 3490105 - RNA, 18 nt, Human
accugcggugcuaucucc

SEQ ID NO: 3490106 - RNA, 23 nt, Human
accugcggugcuaucucccccag

SEQ ID NO: 3490107 - RNA, 18 nt, Human
accugcuaggccagagcc

SEQ ID NO: 3490108 - RNA, 15 nt, Human
accugcuaucagcag

SEQ ID NO: 3490109 - RNA, 16 nt, Human
accugcuccgcugcuc

SEQ ID NO: 3490110 - RNA, 17 nt, Human
accugcuccgcugcucc

SEQ ID NO: 3490111 - RNA, 12 nt, Human
accugcucuccu

SEQ ID NO: 3490112 - RNA, 19 nt, Human
accugcucuccucuugcca

SEQ ID NO: 3490113 - RNA, 18 nt, Human
accuguuaccuacuuuga

SEQ ID NO: 3490114 - RNA, 19 nt, Human
accuguucagugucccggg

SEQ ID NO: 3490115 - RNA, 22 nt, Human
accuguucagugucccgggccc

SEQ ID NO: 3490116 - RNA, 22 nt, Human
accuguugagcaucacagaaug

SEQ ID NO: 3490117 - RNA, 18 nt, Human
accuguugcuguguuuaa

SEQ ID NO: 3490118 - RNA, 19 nt, Human
accuguugcuguguuuaau

SEQ ID NO: 3490119 - RNA, 22 nt, Human
accuguugcuguguuuaauuug

SEQ ID NO: 3490120 - RNA, 16 nt, Human
accuguugcuuacaau

SEQ ID NO: 3490121 - RNA, 16 nt, Human
accuguuuaaauugcu

SEQ ID NO: 3490122 - RNA, 21 nt, Human
accuguuuaugagaugcuggu

SEQ ID NO: 3490123 - RNA, 13 nt, Human
accuuaaaauuug

SEQ ID NO: 3490124 - RNA, 14 nt, Human
accuuaaaauuuga

SEQ ID NO: 3490125 - RNA, 13 nt, Human
accuuaaauuaaa

SEQ ID NO: 3490126 - RNA, 14 nt, Human
accuuaaauuaaac

SEQ ID NO: 3490127 - RNA, 16 nt, Human
accuuaaauuaaacaa

SEQ ID NO: 3490128 - RNA, 19 nt, Human
accuuaaauuaaacaauuu

SEQ ID NO: 3490129 - RNA, 21 nt, Human
accuuaaauuaaacaauuuau

SEQ ID NO: 3490130 - RNA, 20 nt, Human
accuuaaauuaguacagcac

SEQ ID NO: 3490131 - RNA, 12 nt, Human
accuuaagaccu

SEQ ID NO: 3490132 - RNA, 19 nt, Human
accuuaaguaaucaucuaa

SEQ ID NO: 3490133 - RNA, 15 nt, Human
accuuaauauuucuu

SEQ ID NO: 3490134 - RNA, 14 nt, Human
accuuaauuuauua

SEQ ID NO: 3490135 - RNA, 21 nt, Human
accuuacgaucaggcacaggu

SEQ ID NO: 3490136 - RNA, 13 nt, Human
accuuacuaauua

SEQ ID NO: 3490137 - RNA, 15 nt, Human
accuuacuguggagg

SEQ ID NO: 3490138 - RNA, 16 nt, Human
accuuacuuacagcau

SEQ ID NO: 3490139 - RNA, 18 nt, Human
accuuagacagucccugc

SEQ ID NO: 3490140 - RNA, 18 nt, Human
accuuagaccaccaagcc

SEQ ID NO: 3490141 - RNA, 22 nt, Human
accuuagauguucuaagucuuu

SEQ ID NO: 3490142 - RNA, 14 nt, Human
accuuagccugccc

SEQ ID NO: 3490143 - RNA, 19 nt, Human
accuuagcucccucccgca

SEQ ID NO: 3490144 - RNA, 21 nt, Human
accuuagcuggcauuacagcu

SEQ ID NO: 3490145 - RNA, 15 nt, Human
accuuaggcagggaa

SEQ ID NO: 3490146 - RNA, 13 nt, Human
accuuaggccuuc

SEQ ID NO: 3490147 - RNA, 14 nt, Human
accuuaggccuucc

SEQ ID NO: 3490148 - RNA, 20 nt, Human
accuuaggccuuccucucuc

SEQ ID NO: 3490149 - RNA, 12 nt, Human
accuuauaguua

SEQ ID NO: 3490150 - RNA, 23 nt, Human
accuuaucacugcauuauucucu

SEQ ID NO: 3490151 - RNA, 15 nt, Human
accuuauccugcauu

SEQ ID NO: 3490152 - RNA, 22 nt, Human
accuuaucugugcgugaaacac

SEQ ID NO: 3490153 - RNA, 17 nt, Human
accuuauuguaccucuc

SEQ ID NO: 3490154 - RNA, 18 nt, Human
accuuauuguaccucucu

SEQ ID NO: 3490155 - RNA, 20 nt, Human
accuuauuguaccucucuua

SEQ ID NO: 3490156 - RNA, 22 nt, Human
accuuauuguaccucucuuaua

SEQ ID NO: 3490157 - RNA, 17 nt, Human
accuuauuuaaguaacu

SEQ ID NO: 3490158 - RNA, 18 nt, Human
accuuauuuuuucccaaa

SEQ ID NO: 3490159 - RNA, 12 nt, Human
accuucaauaaa

SEQ ID NO: 3490160 - RNA, 15 nt, Human
accuucaauaaagua

SEQ ID NO: 3490161 - RNA, 23 nt, Human
accuucaauaaaguaucuacaug

SEQ ID NO: 3490162 - RNA, 16 nt, Human
accuucaauuccuggg

SEQ ID NO: 3490163 - RNA, 17 nt, Human
accuucacacacagacu

SEQ ID NO: 3490164 - RNA, 15 nt, Human
accuucagauccuac

SEQ ID NO: 3490165 - RNA, 18 nt, Human
accuucagauccuacccc

SEQ ID NO: 3490166 - RNA, 17 nt, Human
accuucagcucacgcuu

SEQ ID NO: 3490167 - RNA, 15 nt, Human
accuucauaagaucu

SEQ ID NO: 3490168 - RNA, 18 nt, Human
accuucauuucaggaggg

SEQ ID NO: 3490169 - RNA, 13 nt, Human
accuucauuuuga

SEQ ID NO: 3490170 - RNA, 20 nt, Human
acgacacggguggggaaagg

SEQ ID NO: 3490171 - RNA, 13 nt, Human
acgaccuuuaccu

SEQ ID NO: 3490172 - RNA, 14 nt, Human
acgacgcugcagag

SEQ ID NO: 3490173 - RNA, 22 nt, Human
acgacuucagggcagggcucug

SEQ ID NO: 3490174 - RNA, 21 nt, Human
acgagaaccugaaggggaagg

SEQ ID NO: 3490175 - RNA, 14 nt, Human
acgagaccccggcu

SEQ ID NO: 3490176 - RNA, 20 nt, Human
acgagacccuacaggagagg

SEQ ID NO: 3490177 - RNA, 14 nt, Human
acgagacuuuccau

SEQ ID NO: 3490178 - RNA, 20 nt, Human
acgagaugggaaggcacagg

SEQ ID NO: 3490179 - RNA, 12 nt, Human
acgaggaagccc

SEQ ID NO: 3490180 - RNA, 22 nt, Human
acgaggaaucugugggucuggg

SEQ ID NO: 3490181 - RNA, 18 nt, Human
acgaggcccucgggccca

SEQ ID NO: 3490182 - RNA, 19 nt, Human
acgagggauguggagcaca

SEQ ID NO: 3490183 - RNA, 20 nt, Human
acgagggcuggcuggccuca

SEQ ID NO: 3490184 - RNA, 18 nt, Human
acgaggggugucuugggc

SEQ ID NO: 3490185 - RNA, 16 nt, Human
acgaguaauuuauugu

SEQ ID NO: 3490186 - RNA, 16 nt, Human
acgagucaccuuccag

SEQ ID NO: 3490187 - RNA, 17 nt, Human
acgagugggaaggacuu

SEQ ID NO: 3490188 - RNA, 14 nt, Human
acgauaaggaagaa

SEQ ID NO: 3490189 - RNA, 17 nt, Human
acgauaaggaagaaaca

SEQ ID NO: 3490190 - RNA, 14 nt, Human
acgaucaggcacag

SEQ ID NO: 3490191 - RNA, 19 nt, Human
acgauccugccacccugua

SEQ ID NO: 3490192 - RNA, 20 nt, Human
acgauucauuuuugaaacug

SEQ ID NO: 3490193 - RNA, 13 nt, Human
acgauuccuucuc

SEQ ID NO: 3490194 - RNA, 19 nt, Human
acgauuuaauucucuugaa

SEQ ID NO: 3490195 - RNA, 14 nt, Human
acgauuuaauuuau

SEQ ID NO: 3490196 - RNA, 17 nt, Human
acgauuucuguuuagau

SEQ ID NO: 3490197 - RNA, 18 nt, Human
acgauuuuuaaaauguac

SEQ ID NO: 3490198 - RNA, 17 nt, Human
acgcaaagggcugaaag

SEQ ID NO: 3490199 - RNA, 21 nt, Human
acgcaaagggcugaaagccau

SEQ ID NO: 3490200 - RNA, 12 nt, Human
acgcacacacac

SEQ ID NO: 3490201 - RNA, 14 nt, Human
acgcacacacacaa

SEQ ID NO: 3490202 - RNA, 14 nt, Human
acgcacacugucug

SEQ ID NO: 3490203 - RNA, 14 nt, Human
acgcacagacaggu

SEQ ID NO: 3490204 - RNA, 15 nt, Human
acgcacaugcgaccc

SEQ ID NO: 3490205 - RNA, 14 nt, Human
acgcaccacaucuc

SEQ ID NO: 3490206 - RNA, 13 nt, Human
acgcaccucccau

SEQ ID NO: 3490207 - RNA, 15 nt, Human
acgcaccugccucag

SEQ ID NO: 3490208 - RNA, 13 nt, Human
acgcacgcacaca

SEQ ID NO: 3490209 - RNA, 16 nt, Human
acgcacgcacacacac

SEQ ID NO: 3490210 - RNA, 20 nt, Human
acgcacgugggucuucaggg

SEQ ID NO: 3490211 - RNA, 16 nt, Human
acgcacuccaugagca

SEQ ID NO: 3490212 - RNA, 17 nt, Human
acgcacuccaugagcac

SEQ ID NO: 3490213 - RNA, 19 nt, Human
acgcagaugauccaugagu

SEQ ID NO: 3490214 - RNA, 14 nt, Human
acgcagcaggaggc

SEQ ID NO: 3490215 - RNA, 15 nt, Human
acgcagccaggacac

SEQ ID NO: 3490216 - RNA, 23 nt, Human
acgcagcccugcuuugggcugcc

SEQ ID NO: 3490217 - RNA, 14 nt, Human
acgcaguggccuuc

SEQ ID NO: 3490218 - RNA, 18 nt, Human
acgcauggucaacccuca

SEQ ID NO: 3490219 - RNA, 19 nt, Human
acgcauggucaacccucag

SEQ ID NO: 3490220 - RNA, 12 nt, Human
acgccacagccc

SEQ ID NO: 3490221 - RNA, 14 nt, Human
acgccacagcccag

SEQ ID NO: 3490222 - RNA, 20 nt, Human
acgccacagcccagccacgg

SEQ ID NO: 3490223 - RNA, 17 nt, Human
acgccacagcccuuuug

SEQ ID NO: 3490224 - RNA, 13 nt, Human
acgccaccucgcc

SEQ ID NO: 3490225 - RNA, 15 nt, Human
acgccacucauuuca

SEQ ID NO: 3490226 - RNA, 16 nt, Human
acgccacucauuucau

SEQ ID NO: 3490227 - RNA, 17 nt, Human
acgccacucauuucauc

SEQ ID NO: 3490228 - RNA, 20 nt, Human
acgccacugcacuccagccu

SEQ ID NO: 3490229 - RNA, 22 nt, Human
acgccagauucuuuccugaggc

SEQ ID NO: 3490230 - RNA, 23 nt, Human
acgccagauucuuuccugaggcu

SEQ ID NO: 3490231 - RNA, 11 nt, Human
acgccagggac

SEQ ID NO: 3490232 - RNA, 23 nt, Human
acgccaggggaaaaucagccugc

SEQ ID NO: 3490233 - RNA, 20 nt, Human
acgcccacccaaccccaagc

SEQ ID NO: 3490234 - RNA, 21 nt, Human
acgccccagauaccagccccu

SEQ ID NO: 3490235 - RNA, 14 nt, Human
acgcccccacuggu

SEQ ID NO: 3490236 - RNA, 23 nt, Human
acgcccccccccaccccuggggg

SEQ ID NO: 3490237 - RNA, 13 nt, Human
acgcccuccccuc

SEQ ID NO: 3490238 - RNA, 18 nt, Human
acgcccuccccuccccug

SEQ ID NO: 3490239 - RNA, 15 nt, Human
acgcccucuccccac

SEQ ID NO: 3490240 - RNA, 18 nt, Human
acgcccucuccccacccc

SEQ ID NO: 3490241 - RNA, 23 nt, Human
acgcccucuccccaccccuaccc

SEQ ID NO: 3490242 - RNA, 17 nt, Human
acgcccuuuccuccuca

SEQ ID NO: 3490243 - RNA, 20 nt, Human
acgccggggacagaggccug

SEQ ID NO: 3490244 - RNA, 18 nt, Human
acgccgucuccauggcau

SEQ ID NO: 3490245 - RNA, 23 nt, Human
acgccucucccuaggagaagagu

SEQ ID NO: 3490246 - RNA, 15 nt, Human
acgccucuugaccag

SEQ ID NO: 3490247 - RNA, 16 nt, Human
acgccucuugaccagg

SEQ ID NO: 3490248 - RNA, 11 nt, Human
acgccugagcc

SEQ ID NO: 3490249 - RNA, 13 nt, Human
acgccugagccca

SEQ ID NO: 3490250 - RNA, 19 nt, Human
acgccugagcccagggagg

SEQ ID NO: 3490251 - RNA, 21 nt, Human
acgccugaggaacccuuacag

SEQ ID NO: 3490252 - RNA, 14 nt, Human
acgccugcaaacgc

SEQ ID NO: 3490253 - RNA, 17 nt, Human
acgccugcaaacgcugc

SEQ ID NO: 3490254 - RNA, 19 nt, Human
acgccugcccuccccagag

SEQ ID NO: 3490255 - RNA, 22 nt, Human
acgccugcccuccccagagcac

SEQ ID NO: 3490256 - RNA, 21 nt, Human
acgccugcuugucccugccca

SEQ ID NO: 3490257 - RNA, 17 nt, Human
acgccuguaaucccagc

SEQ ID NO: 3490258 - RNA, 15 nt, Human
acgguuuccagggag

SEQ ID NO: 3490259 - RNA, 21 nt, Human
acgguuuuuuauuauuguggu

SEQ ID NO: 3490260 - RNA, 22 nt, Human
acguaaaucuguucaaggaauc

SEQ ID NO: 3490261 - RNA, 18 nt, Human
acguaaccacggaaaaga

SEQ ID NO: 3490262 - RNA, 18 nt, Human
acguaaugaaacuuggau

SEQ ID NO: 3490263 - RNA, 16 nt, Human
acguacaaguaguucu

SEQ ID NO: 3490264 - RNA, 19 nt, Human
acguacaaguaguucugua

SEQ ID NO: 3490265 - RNA, 16 nt, Human
acguacuuagcagcua

SEQ ID NO: 3490266 - RNA, 18 nt, Human
acguacuuagcagcuauc

SEQ ID NO: 3490267 - RNA, 16 nt, Human
acguagcugcaaagga

SEQ ID NO: 3490268 - RNA, 17 nt, Human
acguaugucugguucuc

SEQ ID NO: 3490269 - RNA, 13 nt, Human
acguauuauuguc

SEQ ID NO: 3490270 - RNA, 15 nt, Human
acguauuuaauagca

SEQ ID NO: 3490271 - RNA, 16 nt, Human
acguauuuaauagcaa

SEQ ID NO: 3490272 - RNA, 16 nt, Human
acgucaaacaugaagu

SEQ ID NO: 3490273 - RNA, 17 nt, Human
acgucaaacaugaagug

SEQ ID NO: 3490274 - RNA, 17 nt, Human
acgucagauguuuaaaa

SEQ ID NO: 3490275 - RNA, 12 nt, Human
acgucauguauu

SEQ ID NO: 3490276 - RNA, 21 nt, Human
acguccagguucaacccacag

SEQ ID NO: 3490277 - RNA, 19 nt, Human
acgucgucuucuguauacu

SEQ ID NO: 3490278 - RNA, 19 nt, Human
acgucuagcuaugcuguau

SEQ ID NO: 3490279 - RNA, 22 nt, Human
acgucuauuucaucagaacagc

SEQ ID NO: 3490280 - RNA, 16 nt, Human
acgucucgccaagcag

SEQ ID NO: 3490281 - RNA, 20 nt, Human
acgucugaagcuugacuccc

SEQ ID NO: 3490282 - RNA, 15 nt, Human
acgucugacaggcaa

SEQ ID NO: 3490283 - RNA, 23 nt, Human
acgucugggagaaauugacagau

SEQ ID NO: 3490284 - RNA, 17 nt, Human
acgucuggguggcccuu

SEQ ID NO: 3490285 - RNA, 13 nt, Human
acgucugucuuca

SEQ ID NO: 3490286 - RNA, 13 nt, Human
acgucuuaaauau

SEQ ID NO: 3490287 - RNA, 23 nt, Human
acgucuuccuucugccugagcuu

SEQ ID NO: 3490288 - RNA, 13 nt, Human
acgugacacaaac

SEQ ID NO: 3490289 - RNA, 16 nt, Human
acgugacagugccugg

SEQ ID NO: 3490290 - RNA, 20 nt, Human
acgugacugccccaacuccu

SEQ ID NO: 3490291 - RNA, 15 nt, Human
acgugagccagguaa

SEQ ID NO: 3490292 - RNA, 22 nt, Human
acgugauuagugaaaggaagau

SEQ ID NO: 3490293 - RNA, 19 nt, Human
acgugcaacugacacuccc

SEQ ID NO: 3490294 - RNA, 20 nt, Human
acgugcaauuuguuugugcu

SEQ ID NO: 3490295 - RNA, 21 nt, Human
acgugcaauuuguuugugcuu

SEQ ID NO: 3490296 - RNA, 19 nt, Human
acgugcacaaauucaugug

SEQ ID NO: 3490297 - RNA, 21 nt, Human
acgugcaccuguacucaggag

SEQ ID NO: 3490298 - RNA, 14 nt, Human
acgugcauugugcu

SEQ ID NO: 3490299 - RNA, 16 nt, Human
acgugcauugugcuuc

SEQ ID NO: 3490300 - RNA, 13 nt, Human
acgugccaggccc

SEQ ID NO: 3490301 - RNA, 19 nt, Human
acgugccaggcccggggcu

SEQ ID NO: 3490302 - RNA, 19 nt, Human
acgugccuuuugcaccccu

SEQ ID NO: 3490303 - RNA, 20 nt, Human
acgugccuuuugcaccccuc

SEQ ID NO: 3490304 - RNA, 23 nt, Human
acgugcgcugggcacuucccugc

SEQ ID NO: 3490305 - RNA, 19 nt, Human
acgugcucuuuguuuugug

SEQ ID NO: 3490306 - RNA, 23 nt, Human
acgugcucuuuguuuugugucuc

SEQ ID NO: 3490307 - RNA, 16 nt, Human
acguggaaccucuguc

SEQ ID NO: 3490308 - RNA, 17 nt, Human
acguggaaccucugucu

SEQ ID NO: 3490309 - RNA, 22 nt, Human
acguggagaaucacaggcuggg

SEQ ID NO: 3490310 - RNA, 15 nt, Human
acguggagagcuggu

SEQ ID NO: 3490311 - RNA, 12 nt, Human
acguggagaggg

SEQ ID NO: 3490312 - RNA, 13 nt, Human
acguggagaggga

SEQ ID NO: 3490313 - RNA, 15 nt, Human
acguggcauguggcc

SEQ ID NO: 3490314 - RNA, 14 nt, Human
acguggcucagcca

SEQ ID NO: 3490315 - RNA, 11 nt, Human
acguggcugcu

SEQ ID NO: 3490316 - RNA, 21 nt, Human
acgugggaguucagcugcuuc

SEQ ID NO: 3490317 - RNA, 11 nt, Human
acguguauguu

SEQ ID NO: 3490318 - RNA, 23 nt, Human
acguguauguuuuucaguucaaa

SEQ ID NO: 3490319 - RNA, 15 nt, Human
acgugugcauguguc

SEQ ID NO: 3490320 - RNA, 22 nt, Human
acguguguuucuagagccugcu

SEQ ID NO: 3490321 - RNA, 23 nt, Human
acguguguuuuucuauuaaaaga

SEQ ID NO: 3490322 - RNA, 19 nt, Human
acguuacucagggcuccuc

SEQ ID NO: 3490323 - RNA, 20 nt, Human
acguuagaggaaaaauauuu

SEQ ID NO: 3490324 - RNA, 16 nt, Human
acguuaugguguuucu

SEQ ID NO: 3490325 - RNA, 17 nt, Human
acguuaugguguuucuc

SEQ ID NO: 3490326 - RNA, 18 nt, Human
acguucacccaucuuauc

SEQ ID NO: 3490327 - RNA, 16 nt, Human
acguucaccccuccac

SEQ ID NO: 3490328 - RNA, 13 nt, Human
acguuccacaguu

SEQ ID NO: 3490329 - RNA, 14 nt, Human
acguuccagccggc

SEQ ID NO: 3490330 - RNA, 17 nt, Human
accuucauuuugagggg

SEQ ID NO: 3490331 - RNA, 14 nt, Human
accuuccagcuccu

SEQ ID NO: 3490332 - RNA, 17 nt, Human
accuuccagcuccugua

SEQ ID NO: 3490333 - RNA, 20 nt, Human
accuuccaugucaagauuca

SEQ ID NO: 3490334 - RNA, 17 nt, Human
accuucccccuccccca

SEQ ID NO: 3490335 - RNA, 13 nt, Human
accuuccugucuu

SEQ ID NO: 3490336 - RNA, 22 nt, Human
accuuccuucccugggcugugc

SEQ ID NO: 3490337 - RNA, 16 nt, Human
accuuccuuccugcuu

SEQ ID NO: 3490338 - RNA, 13 nt, Human
accuuccuuuuac

SEQ ID NO: 3490339 - RNA, 20 nt, Human
accuuccuuuuacuuuucuu

SEQ ID NO: 3490340 - RNA, 21 nt, Human
accuucguuuacuaugccugu

SEQ ID NO: 3490341 - RNA, 16 nt, Human
accuucuagaauuaua

SEQ ID NO: 3490342 - RNA, 17 nt, Human
accuucuagaauuauaa

SEQ ID NO: 3490343 - RNA, 22 nt, Human
accuucuaggacgccacccagc

SEQ ID NO: 3490344 - RNA, 18 nt, Human
accuucuauagcaucacu

SEQ ID NO: 3490345 - RNA, 14 nt, Human
accuucuccccagc

SEQ ID NO: 3490346 - RNA, 19 nt, Human
accuucuccccagcuccca

SEQ ID NO: 3490347 - RNA, 21 nt, Human
accuucuccccagcucccagg

SEQ ID NO: 3490348 - RNA, 23 nt, Human
accuucucccucauuucaggagc

SEQ ID NO: 3490349 - RNA, 12 nt, Human
accuucuccuuc

SEQ ID NO: 3490350 - RNA, 13 nt, Human
accuucuccuuca

SEQ ID NO: 3490351 - RNA, 18 nt, Human
accuucuggccucccaca

SEQ ID NO: 3490352 - RNA, 13 nt, Human
accuucuguaguu

SEQ ID NO: 3490353 - RNA, 12 nt, Human
accuucuguggc

SEQ ID NO: 3490354 - RNA, 19 nt, Human
accuucuuauuauauauau

SEQ ID NO: 3490355 - RNA, 18 nt, Human
accuucuuauuuaaucuu

SEQ ID NO: 3490356 - RNA, 20 nt, Human
accuucuucagccaccucuc

SEQ ID NO: 3490357 - RNA, 17 nt, Human
accuucuuucacucugu

SEQ ID NO: 3490358 - RNA, 23 nt, Human
accuugaaaaaaaacaguggauc

SEQ ID NO: 3490359 - RNA, 20 nt, Human
accuugaaaauaagaauaga

SEQ ID NO: 3490360 - RNA, 20 nt, Human
accuugaacuggguacuugu

SEQ ID NO: 3490361 - RNA, 16 nt, Human
accuugaaugcugcca

SEQ ID NO: 3490362 - RNA, 14 nt, Human
accuugacagggca

SEQ ID NO: 3490363 - RNA, 16 nt, Human
accuugacuguugaug

SEQ ID NO: 3490364 - RNA, 15 nt, Human
accuugcaacacaca

SEQ ID NO: 3490365 - RNA, 17 nt, Human
accuugcaacacacaga

SEQ ID NO: 3490366 - RNA, 14 nt, Human
accuugcacacauc

SEQ ID NO: 3490367 - RNA, 16 nt, Human
accuugcacacaucau

SEQ ID NO: 3490368 - RNA, 21 nt, Human
accuugcauuuuagcuaauuu

SEQ ID NO: 3490369 - RNA, 14 nt, Human
accuugccccaacc

SEQ ID NO: 3490370 - RNA, 21 nt, Human
accuugccccaacccuucuuc

SEQ ID NO: 3490371 - RNA, 21 nt, Human
accuugccugaacauccuucc

SEQ ID NO: 3490372 - RNA, 23 nt, Human
accuugccugaacauccuuccuu

SEQ ID NO: 3490373 - RNA, 13 nt, Human
accuugcuaauuu

SEQ ID NO: 3490374 - RNA, 19 nt, Human
accuugcuguccugaucug

SEQ ID NO: 3490375 - RNA, 19 nt, Human
accuugcuuugauggaaua

SEQ ID NO: 3490376 - RNA, 17 nt, Human
accuugcuuuugcuucu

SEQ ID NO: 3490377 - RNA, 17 nt, Human
accuuggagagacacag

SEQ ID NO: 3490378 - RNA, 17 nt, Human
accuuggcaccagacac

SEQ ID NO: 3490379 - RNA, 14 nt, Human
accuuggccugggc

SEQ ID NO: 3490380 - RNA, 14 nt, Human
accuuggcucaagu

SEQ ID NO: 3490381 - RNA, 17 nt, Human
accuuggcugcagggag

SEQ ID NO: 3490382 - RNA, 15 nt, Human
accuugguuccuggg

SEQ ID NO: 3490383 - RNA, 15 nt, Human
accuugguuggaagg

SEQ ID NO: 3490384 - RNA, 17 nt, Human
accuuguaauguaacug

SEQ ID NO: 3490385 - RNA, 22 nt, Human
accuuguaauguaacugcucuu

SEQ ID NO: 3490386 - RNA, 14 nt, Human
accuugugccuggg

SEQ ID NO: 3490387 - RNA, 18 nt, Human
accuugugucuguacacg

SEQ ID NO: 3490388 - RNA, 18 nt, Human
accuuguguguaugugua

SEQ ID NO: 3490389 - RNA, 17 nt, Human
accuuguuacuucugag

SEQ ID NO: 3490390 - RNA, 22 nt, Human
accuuguuauuucucagacuuu

SEQ ID NO: 3490391 - RNA, 15 nt, Human
accuuguuggagccu

SEQ ID NO: 3490392 - RNA, 17 nt, Human
accuuguuggagccugc

SEQ ID NO: 3490393 - RNA, 20 nt, Human
accuuguuuauuaaauugca

SEQ ID NO: 3490394 - RNA, 16 nt, Human
accuuuaaucuguuuu

SEQ ID NO: 3490395 - RNA, 14 nt, Human
accuuuagggcagc

SEQ ID NO: 3490396 - RNA, 21 nt, Human
accuuuagggcagcuugcccc

SEQ ID NO: 3490397 - RNA, 14 nt, Human
accuuuagguucuu

SEQ ID NO: 3490398 - RNA, 20 nt, Human
accuuuagugguggccauuu

SEQ ID NO: 3490399 - RNA, 16 nt, Human
accuuuauuaaaaucu

SEQ ID NO: 3490400 - RNA, 16 nt, Human
accuuucaauaggaaa

SEQ ID NO: 3490401 - RNA, 17 nt, Human
accuuucaauaggaaaa

SEQ ID NO: 3490402 - RNA, 21 nt, Human
accuuucaauaggaaaaacug

SEQ ID NO: 3490403 - RNA, 21 nt, Human
acucagcccugggccccacca

SEQ ID NO: 3490404 - RNA, 23 nt, Human
acucagccggcguggcaaauaua

SEQ ID NO: 3490405 - RNA, 22 nt, Human
acucagccucaauaagccuugu

SEQ ID NO: 3490406 - RNA, 12 nt, Human
acucagccugcu

SEQ ID NO: 3490407 - RNA, 22 nt, Human
acucagccugcugcccaggcug

SEQ ID NO: 3490408 - RNA, 14 nt, Human
acucagcuccguga

SEQ ID NO: 3490409 - RNA, 17 nt, Human
acucaggacuccagccc

SEQ ID NO: 3490410 - RNA, 19 nt, Human
acucaggaggcugaggcag

SEQ ID NO: 3490411 - RNA, 16 nt, Human
acucaggaugcccagg

SEQ ID NO: 3490412 - RNA, 17 nt, Human
acucagggacagagcca

SEQ ID NO: 3490413 - RNA, 18 nt, Human
acucagggacagagccau

SEQ ID NO: 3490414 - RNA, 20 nt, Human
acucagggaggcuaaaucag

SEQ ID NO: 3490415 - RNA, 18 nt, Human
acucagggccaugccugc

SEQ ID NO: 3490416 - RNA, 18 nt, Human
acucagggccccagcacu

SEQ ID NO: 3490417 - RNA, 14 nt, Human
acucagggcuccuc

SEQ ID NO: 3490418 - RNA, 16 nt, Human
acucagggcuccuggg

SEQ ID NO: 3490419 - RNA, 13 nt, Human
acucaggugggcc

SEQ ID NO: 3490420 - RNA, 20 nt, Human
acucagguuguaguaaagaa

SEQ ID NO: 3490421 - RNA, 23 nt, Human
acucagguuguaguaaagaaauu

SEQ ID NO: 3490422 - RNA, 14 nt, Human
acucaguggggagg

SEQ ID NO: 3490423 - RNA, 13 nt, Human
acucaguuuucuu

SEQ ID NO: 3490424 - RNA, 21 nt, Human
acucauaaaaagccugcaauu

SEQ ID NO: 3490425 - RNA, 17 nt, Human
acucauaccuuuaaagg

SEQ ID NO: 3490426 - RNA, 20 nt, Human
acucauacugugcuggagcc

SEQ ID NO: 3490427 - RNA, 21 nt, Human
acucauacugugcuggagcca

SEQ ID NO: 3490428 - RNA, 23 nt, Human
acucauacugugcuggagccacu

SEQ ID NO: 3490429 - RNA, 22 nt, Human
acucauauccccuauuuaacag

SEQ ID NO: 3490430 - RNA, 15 nt, Human
acucauauuacuggu

SEQ ID NO: 3490431 - RNA, 20 nt, Human
acucaucaauggggccaguc

SEQ ID NO: 3490432 - RNA, 16 nt, Human
acucaucacuguggcu

SEQ ID NO: 3490433 - RNA, 9 nt, Human
acucaucau

SEQ ID NO: 3490434 - RNA, 15 nt, Human
acucaucauaaaaua

SEQ ID NO: 3490435 - RNA, 17 nt, Human
acucaucauaaaauaaa

SEQ ID NO: 3490436 - RNA, 19 nt, Human
acucaucccuaaugcugca

SEQ ID NO: 3490437 - RNA, 17 nt, Human
acucauccugaacagca

SEQ ID NO: 3490438 - RNA, 18 nt, Human
acucauccugaacagcau

SEQ ID NO: 3490439 - RNA, 16 nt, Human
acucaucuagguaaau

SEQ ID NO: 3490440 - RNA, 15 nt, Human
acucaucugaaaugu

SEQ ID NO: 3490441 - RNA, 12 nt, Human
acucaucuuaua

SEQ ID NO: 3490442 - RNA, 13 nt, Human
acucaucuuuccc

SEQ ID NO: 3490443 - RNA, 17 nt, Human
acucaucuuucccuccu

SEQ ID NO: 3490444 - RNA, 21 nt, Human
acucaucuuucccuccuuggu

SEQ ID NO: 3490445 - RNA, 14 nt, Human
acucaugaggaggg

SEQ ID NO: 3490446 - RNA, 15 nt, Human
acucaugaucuugug

SEQ ID NO: 3490447 - RNA, 17 nt, Human
acucaugcaugcaaauu

SEQ ID NO: 3490448 - RNA, 17 nt, Human
acucaugcauuguccuc

SEQ ID NO: 3490449 - RNA, 13 nt, Human
acucaugcugaaa

SEQ ID NO: 3490450 - RNA, 16 nt, Human
acucaugcugaaagcc

SEQ ID NO: 3490451 - RNA, 16 nt, Human
acucaugugacucuuu

SEQ ID NO: 3490452 - RNA, 12 nt, Human
acucauguguau

SEQ ID NO: 3490453 - RNA, 21 nt, Human
acucauguguaugggcaaaaa

SEQ ID NO: 3490454 - RNA, 17 nt, Human
acucauuagaauuacca

SEQ ID NO: 3490455 - RNA, 21 nt, Human
acucauucaaaaguugaaauu

SEQ ID NO: 3490456 - RNA, 15 nt, Human
acucauucugaagga

SEQ ID NO: 3490457 - RNA, 19 nt, Human
acucauucugaauuaauua

SEQ ID NO: 3490458 - RNA, 18 nt, Human
acucauugaccugaggcc

SEQ ID NO: 3490459 - RNA, 20 nt, Human
acucauugcaucauuuacaa

SEQ ID NO: 3490460 - RNA, 15 nt, Human
acucauugcugagcc

SEQ ID NO: 3490461 - RNA, 20 nt, Human
acucauugcugagccucugc

SEQ ID NO: 3490462 - RNA, 23 nt, Human
acucauugcugagccucugcucc

SEQ ID NO: 3490463 - RNA, 19 nt, Human
acucauugcuucacaaccc

SEQ ID NO: 3490464 - RNA, 23 nt, Human
acucauugcuucacaacccaucu

SEQ ID NO: 3490465 - RNA, 21 nt, Human
acucauuuauaaagcuaaaau

SEQ ID NO: 3490466 - RNA, 14 nt, Human
acucauuucaucuc

SEQ ID NO: 3490467 - RNA, 16 nt, Human
acucauuuccuaugua

SEQ ID NO: 3490468 - RNA, 18 nt, Human
acucauuucuaaaagaau

SEQ ID NO: 3490469 - RNA, 19 nt, Human
acucauuucuaaaagaaua

SEQ ID NO: 3490470 - RNA, 15 nt, Human
acucauuuucuauaa

SEQ ID NO: 3490471 - RNA, 14 nt, Human
acucauuuugcuug

SEQ ID NO: 3490472 - RNA, 19 nt, Human
acucauuuuucaugauaau

SEQ ID NO: 3490473 - RNA, 20 nt, Human
acucauuuuucaugauaaug

SEQ ID NO: 3490474 - RNA, 15 nt, Human
acucauuuuugccau

SEQ ID NO: 3490475 - RNA, 19 nt, Human
acucauuuuugccauacau

SEQ ID NO: 3490476 - RNA, 21 nt, Human
acucauuuuugccauacauca

SEQ ID NO: 3490477 - RNA, 22 nt, Human
acuccaaaauguuggucauuuu

SEQ ID NO: 3490478 - RNA, 21 nt, Human
acuccaaagaaauguaaggga

SEQ ID NO: 3490479 - RNA, 18 nt, Human
acuccaacagaagaacug

SEQ ID NO: 3490480 - RNA, 19 nt, Human
acuccaacagaagaacugu

SEQ ID NO: 3490481 - RNA, 20 nt, Human
acuccaaccuaaccuguguc

SEQ ID NO: 3490482 - RNA, 23 nt, Human
acuccaaccuaaccugugucugc

SEQ ID NO: 3490483 - RNA, 15 nt, Human
acuccaagcccagcc

SEQ ID NO: 3490484 - RNA, 17 nt, Human
acuccaagguucccuug

SEQ ID NO: 3490485 - RNA, 21 nt, Human
acuccaauuaaggauuuuaug

SEQ ID NO: 3490486 - RNA, 17 nt, Human
acuccacacugcacaau

SEQ ID NO: 3490487 - RNA, 13 nt, Human
acuccacaucugc

SEQ ID NO: 3490488 - RNA, 16 nt, Human
acuccacaucugccuu

SEQ ID NO: 3490489 - RNA, 13 nt, Human
acuccaccaccca

SEQ ID NO: 3490490 - RNA, 15 nt, Human
acuccacccauccua

SEQ ID NO: 3490491 - RNA, 18 nt, Human
acuccagaaagugacaag

SEQ ID NO: 3490492 - RNA, 17 nt, Human
acuccagaauuucccaa

SEQ ID NO: 3490493 - RNA, 23 nt, Human
acuccagaauuucccaaagcagu

SEQ ID NO: 3490494 - RNA, 18 nt, Human
acuccagaccccuggcuu

SEQ ID NO: 3490495 - RNA, 15 nt, Human
acuccagcaacuucu

SEQ ID NO: 3490496 - RNA, 11 nt, Human
acuccagccag

SEQ ID NO: 3490497 - RNA, 13 nt, Human
acuccagccagcg

SEQ ID NO: 3490498 - RNA, 21 nt, Human
acuccagccagcgccucccuc

SEQ ID NO: 3490499 - RNA, 15 nt, Human
acuccagccugagca

SEQ ID NO: 3490500 - RNA, 15 nt, Human
acuccagccugggcg

SEQ ID NO: 3490501 - RNA, 20 nt, Human
acuccaggaaggggcuggac

SEQ ID NO: 3490502 - RNA, 20 nt, Human
acuccaggcagcagacacau

SEQ ID NO: 3490503 - RNA, 13 nt, Human
acuccaggcccaa

SEQ ID NO: 3490504 - RNA, 19 nt, Human
acuccaggcccaaggcucc

SEQ ID NO: 3490505 - RNA, 15 nt, Human
acuccaggcccuccu

SEQ ID NO: 3490506 - RNA, 20 nt, Human
acuccagggacacacagccu

SEQ ID NO: 3490507 - RNA, 24 nt, Human
acuccagggacacacagccuagca

SEQ ID NO: 3490508 - RNA, 17 nt, Human
acuccaguacuggagcu

SEQ ID NO: 3490509 - RNA, 19 nt, Human
acuccagugagacagcucu

SEQ ID NO: 3490510 - RNA, 20 nt, Human
acuccagugauguucuucaa

SEQ ID NO: 3490511 - RNA, 21 nt, Human
acuccagugccaacaauccua

SEQ ID NO: 3490512 - RNA, 19 nt, Human
acuccagugccagcaauga

SEQ ID NO: 3490513 - RNA, 22 nt, Human
acuccaguggggcaagauuuuc

SEQ ID NO: 3490514 - RNA, 16 nt, Human
acuccaguggugaaga

SEQ ID NO: 3490515 - RNA, 14 nt, Human
acuccaguguacau

SEQ ID NO: 3490516 - RNA, 18 nt, Human
acuccaguuaaaaaaaau

SEQ ID NO: 3490517 - RNA, 20 nt, Human
acuccaguuaaaaaaaauuu

SEQ ID NO: 3490518 - RNA, 14 nt, Human
acuccaucagcuua

SEQ ID NO: 3490519 - RNA, 14 nt, Human
acuccaugagaagc

SEQ ID NO: 3490520 - RNA, 17 nt, Human
acuccaugagaagccgu

SEQ ID NO: 3490521 - RNA, 17 nt, Human
acuccaugagcacccca

SEQ ID NO: 3490522 - RNA, 18 nt, Human
acuccauucccaacuaga

SEQ ID NO: 3490523 - RNA, 16 nt, Human
acucccaacccuggcu

SEQ ID NO: 3490524 - RNA, 22 nt, Human
acucccaagaacagcaggccca

SEQ ID NO: 3490525 - RNA, 19 nt, Human
acucccaagguuggagccc

SEQ ID NO: 3490526 - RNA, 19 nt, Human
acucccaagucuacagagu

SEQ ID NO: 3490527 - RNA, 14 nt, Human
acucccacuucccu

SEQ ID NO: 3490528 - RNA, 16 nt, Human
acucccacuucccuga

SEQ ID NO: 3490529 - RNA, 22 nt, Human
acucccaguccaaauguccucc

SEQ ID NO: 3490530 - RNA, 23 nt, Human
acuagagaucugguuuugcuauu

SEQ ID NO: 3490531 - RNA, 16 nt, Human
acuagagaugugcaau

SEQ ID NO: 3490532 - RNA, 16 nt, Human
acuagagcagcccugg

SEQ ID NO: 3490533 - RNA, 14 nt, Human
acuagaggcaggga

SEQ ID NO: 3490534 - RNA, 20 nt, Human
acuagagggaccucucccag

SEQ ID NO: 3490535 - RNA, 21 nt, Human
acuagagggaccucucccagg

SEQ ID NO: 3490536 - RNA, 22 nt, Human
acuagagggaccucucccaggg

SEQ ID NO: 3490537 - RNA, 19 nt, Human
acuagagguuuuaugauau

SEQ ID NO: 3490538 - RNA, 17 nt, Human
acuagaugaccucauua

SEQ ID NO: 3490539 - RNA, 18 nt, Human
acuagauggaccugccug

SEQ ID NO: 3490540 - RNA, 20 nt, Human
acuagauggaccugccugca

SEQ ID NO: 3490541 - RNA, 16 nt, Human
acuagauggugcugag

SEQ ID NO: 3490542 - RNA, 18 nt, Human
acuagauggugcugagaa

SEQ ID NO: 3490543 - RNA, 15 nt, Human
acuagauuugggaga

SEQ ID NO: 3490544 - RNA, 14 nt, Human
acuagcaaaauaaa

SEQ ID NO: 3490545 - RNA, 15 nt, Human
acuagcaaaauaaaa

SEQ ID NO: 3490546 - RNA, 23 nt, Human
acuagcaaucucuucauuauucu

SEQ ID NO: 3490547 - RNA, 21 nt, Human
acucccccuaaaccccugucc

SEQ ID NO: 3490548 - RNA, 22 nt, Human
acucccccuaaaccccuguccc

SEQ ID NO: 3490549 - RNA, 14 nt, Human
acuccccgaagucu

SEQ ID NO: 3490550 - RNA, 22 nt, Human
acuccccugcacuggaguccag

SEQ ID NO: 3490551 - RNA, 14 nt, Human
acuccccuguuuca

SEQ ID NO: 3490552 - RNA, 20 nt, Human
acuccccuugagcugagaug

SEQ ID NO: 3490553 - RNA, 13 nt, Human
acucccuccucac

SEQ ID NO: 3490554 - RNA, 20 nt, Human
acucccuccucaccucugga

SEQ ID NO: 3490555 - RNA, 18 nt, Human
acucccuucuaccugcca

SEQ ID NO: 3490556 - RNA, 19 nt, Human
acucccuucuaccugccac

SEQ ID NO: 3490557 - RNA, 21 nt, Human
acucccuugcuggccccagcc

SEQ ID NO: 3490558 - RNA, 22 nt, Human
acucccuugcuggccccagccc

SEQ ID NO: 3490559 - RNA, 14 nt, Human
acucccuuucaaca

SEQ ID NO: 3490560 - RNA, 14 nt, Human
acucccuuucagug

SEQ ID NO: 3490561 - RNA, 23 nt, Human
acuccgagaggugggccagucug

SEQ ID NO: 3490562 - RNA, 16 nt, Human
acuccgcccccagccu

SEQ ID NO: 3490563 - RNA, 17 nt, Human
acuccgcccccagccua

SEQ ID NO: 3490564 - RNA, 16 nt, Human
acuccggagacagggu

SEQ ID NO: 3490565 - RNA, 14 nt, Human
acuccggcccuccu

SEQ ID NO: 3490566 - RNA, 23 nt, Human
acuccggccugaugacagagcga

SEQ ID NO: 3490567 - RNA, 15 nt, Human
acuccggcugugcug

SEQ ID NO: 3490568 - RNA, 18 nt, Human
acuccggcugugcuggga

SEQ ID NO: 3490569 - RNA, 17 nt, Human
acuccggggagcgcccg

SEQ ID NO: 3490570 - RNA, 15 nt, Human
acuccggugugccug

SEQ ID NO: 3490571 - RNA, 16 nt, Human
acuccgucucaaggaa

SEQ ID NO: 3490572 - RNA, 17 nt, Human
acuccguuggccacucc

SEQ ID NO: 3490573 - RNA, 17 nt, Human
acuccuaaaccuuugcc

SEQ ID NO: 3490574 - RNA, 18 nt, Human
acuccuaaccucaaguga

SEQ ID NO: 3490575 - RNA, 22 nt, Human
acuccuacaagauuuagaaaaa

SEQ ID NO: 3490576 - RNA, 14 nt, Human
acuccuaccucagc

SEQ ID NO: 3490577 - RNA, 15 nt, Human
acuccuaccucagcc

SEQ ID NO: 3490578 - RNA, 17 nt, Human
acuccuaccugcccugg

SEQ ID NO: 3490579 - RNA, 16 nt, Human
acuccuaggcaggaca

SEQ ID NO: 3490580 - RNA, 21 nt, Human
acuccuaggcaggacaugcug

SEQ ID NO: 3490581 - RNA, 18 nt, Human
acuccuaguucuagaaaa

SEQ ID NO: 3490582 - RNA, 20 nt, Human
acuccuaguucuagaaaaac

SEQ ID NO: 3490583 - RNA, 18 nt, Human
acuccuaugaucucaggu

SEQ ID NO: 3490584 - RNA, 17 nt, Human
acuccuauuuuuguaaa

SEQ ID NO: 3490585 - RNA, 18 nt, Human
acuccucagggcagccuc

SEQ ID NO: 3490586 - RNA, 19 nt, Human
acuccucauuguaaacaaa

SEQ ID NO: 3490587 - RNA, 21 nt, Human
acuccucccaggguuuuaacu

SEQ ID NO: 3490588 - RNA, 11 nt, Human
acuccucccau

SEQ ID NO: 3490589 - RNA, 19 nt, Human
acuccuccccacccuccug

SEQ ID NO: 3490590 - RNA, 20 nt, Human
acuccuccccacccuccugg

SEQ ID NO: 3490591 - RNA, 21 nt, Human
acuccuccccacccuccuggc

SEQ ID NO: 3490592 - RNA, 17 nt, Human
acuccucccugauguac

SEQ ID NO: 3490593 - RNA, 20 nt, Human
acuccucccugauguacagu

SEQ ID NO: 3490594 - RNA, 21 nt, Human
acuccucccuuuccuuccuaa

SEQ ID NO: 3490595 - RNA, 21 nt, Human
acuccuccuccaaaggccccc

SEQ ID NO: 3490596 - RNA, 22 nt, Human
acuccuccuccaaaggcccccu

SEQ ID NO: 3490597 - RNA, 11 nt, Human
acuccuccucu

SEQ ID NO: 3490598 - RNA, 12 nt, Human
acuccuccucuu

SEQ ID NO: 3490599 - RNA, 16 nt, Human
acuccuccucuuucuc

SEQ ID NO: 3490600 - RNA, 18 nt, Human
acuccuccucuuucucuc

SEQ ID NO: 3490601 - RNA, 22 nt, Human
acuccuccucuuucucucccca

SEQ ID NO: 3490602 - RNA, 17 nt, Human
acuccucggccuggcuc

SEQ ID NO: 3490603 - RNA, 21 nt, Human
acuccucuaagccacucuucc

SEQ ID NO: 3490604 - RNA, 14 nt, Human
acuccucugacuca

SEQ ID NO: 3490605 - RNA, 13 nt, Human
acuccucugucca

SEQ ID NO: 3490606 - RNA, 13 nt, Human
acuccugaaaaaa

SEQ ID NO: 3490607 - RNA, 19 nt, Human
acuccugacagucuugugc

SEQ ID NO: 3490608 - RNA, 21 nt, Human
acuccugacagucuugugcuu

SEQ ID NO: 3490609 - RNA, 15 nt, Human
acuccugaccucaag

SEQ ID NO: 3490610 - RNA, 18 nt, Human
acuccugaccucaaguga

SEQ ID NO: 3490611 - RNA, 21 nt, Human
acuccugacgucugaagcuug

SEQ ID NO: 3490612 - RNA, 12 nt, Human
acuccugacucc

SEQ ID NO: 3490613 - RNA, 18 nt, Human
acuccugacuccuaccug

SEQ ID NO: 3490614 - RNA, 17 nt, Human
acuccugagaccccugg

SEQ ID NO: 3490615 - RNA, 23 nt, Human
acuccugcacacgcuccuuccuc

SEQ ID NO: 3490616 - RNA, 12 nt, Human
acuccugcaggc

SEQ ID NO: 3490617 - RNA, 16 nt, Human
acuccugcaggcagcc

SEQ ID NO: 3490618 - RNA, 21 nt, Human
acuccugcaggcagccaggcc

SEQ ID NO: 3490619 - RNA, 10 nt, Human
acuccugcuc

SEQ ID NO: 3490620 - RNA, 13 nt, Human
acuccugcucugc

SEQ ID NO: 3490621 - RNA, 14 nt, Human
acuccugcuguaaa

SEQ ID NO: 3490622 - RNA, 16 nt, Human
acuccuggggccucuu

SEQ ID NO: 3490623 - RNA, 21 nt, Human
acuccuggggccucuuggguc

SEQ ID NO: 3490624 - RNA, 14 nt, Human
acuccuggguugag

SEQ ID NO: 3490625 - RNA, 16 nt, Human
acuccugguccuaggc

SEQ ID NO: 3490626 - RNA, 16 nt, Human
acuccuguacacugaa

SEQ ID NO: 3490627 - RNA, 17 nt, Human
acuccugucuucugcuu

SEQ ID NO: 3490628 - RNA, 20 nt, Human
acuccugucuucugcuuugu

SEQ ID NO: 3490629 - RNA, 15 nt, Human
acuccugugggagcc

SEQ ID NO: 3490630 - RNA, 20 nt, Human
acuccuguuacuuaccuaaa

SEQ ID NO: 3490631 - RNA, 22 nt, Human
acuccuucaacaauucuaaaau

SEQ ID NO: 3490632 - RNA, 12 nt, Human
acuccuuccugc

SEQ ID NO: 3490633 - RNA, 20 nt, Human
acuccuuccugccaccugcu

SEQ ID NO: 3490634 - RNA, 15 nt, Human
acuccuuccugcccc

SEQ ID NO: 3490635 - RNA, 24 nt, Human
acuccuugaaaacacuguucucug

SEQ ID NO: 3490636 - RNA, 18 nt, Human
acuccuugagagaccagg

SEQ ID NO: 3490637 - RNA, 18 nt, Human
acuccuugugguuuaugu

SEQ ID NO: 3490638 - RNA, 19 nt, Human
acuccuugugguuuauguc

SEQ ID NO: 3490639 - RNA, 21 nt, Human
acuccuugugguuuaugucau

SEQ ID NO: 3490640 - RNA, 23 nt, Human
acuccuuuuaaagaaaaaaauug

SEQ ID NO: 3490641 - RNA, 15 nt, Human
acucgacucugugcc

SEQ ID NO: 3490642 - RNA, 13 nt, Human
acucgagaacuuu

SEQ ID NO: 3490643 - RNA, 23 nt, Human
acucgagaccuuuucaacuuggc

SEQ ID NO: 3490644 - RNA, 19 nt, Human
acucgauucauauugaaua

SEQ ID NO: 3490645 - RNA, 20 nt, Human
acucgcccgcccacuguccu

SEQ ID NO: 3490646 - RNA, 17 nt, Human
acucgcgacaaugcaaa

SEQ ID NO: 3490647 - RNA, 16 nt, Human
acucgcuagcaguggc

SEQ ID NO: 3490648 - RNA, 17 nt, Human
acucgcuugcuagaagu

SEQ ID NO: 3490649 - RNA, 14 nt, Human
acucgcuuguaaau

SEQ ID NO: 3490650 - RNA, 17 nt, Human
acucgcuuguaaauacc

SEQ ID NO: 3490651 - RNA, 18 nt, Human
acucgcuuguaaauacca

SEQ ID NO: 3490652 - RNA, 15 nt, Human
acucgcuugugcaga

SEQ ID NO: 3490653 - RNA, 16 nt, Human
acucggcacccugcaa

SEQ ID NO: 3490654 - RNA, 22 nt, Human
acucggcuuuggagacuuucuu

SEQ ID NO: 3490655 - RNA, 14 nt, Human
acucgggcuccugu

SEQ ID NO: 3490656 - RNA, 17 nt, Human
acucgggcuccugugcc

SEQ ID NO: 3490657 - RNA, 18 nt, Human
acucgggcuccugugccc

SEQ ID NO: 3490658 - RNA, 19 nt, Human
acucgggcuccugugcccu

SEQ ID NO: 3490659 - RNA, 16 nt, Human
acucggggugcuuccu

SEQ ID NO: 3490660 - RNA, 20 nt, Human
acucggggugcuuccuugua

SEQ ID NO: 3490661 - RNA, 22 nt, Human
acucgguguccccaccaucugc

SEQ ID NO: 3490662 - RNA, 12 nt, Human
acucgguuucuc

SEQ ID NO: 3490663 - RNA, 14 nt, Human
acucgguuucucca

SEQ ID NO: 3490664 - RNA, 16 nt, Human
acucgguuucuccaaa

SEQ ID NO: 3490665 - RNA, 23 nt, Human
acucguauaagcauggagaacag

SEQ ID NO: 3490666 - RNA, 15 nt, Human
acucgugagcgccag

SEQ ID NO: 3490667 - RNA, 16 nt, Human
acucgugugcaacaga

SEQ ID NO: 3490668 - RNA, 23 nt, Human
acucguguguuucuauuuuuuga

SEQ ID NO: 3490669 - RNA, 12 nt, Human
acucuaaaagau

SEQ ID NO: 3490670 - RNA, 21 nt, Human
acucuaagaucuuagauucuc

SEQ ID NO: 3490671 - RNA, 13 nt, Human
acucuaagauguu

SEQ ID NO: 3490672 - RNA, 19 nt, Human
acucuaagucauguauguu

SEQ ID NO: 3490673 - RNA, 22 nt, Human
acucuaagucauguauguuucu

SEQ ID NO: 3490674 - RNA, 20 nt, Human
acucuaauucccauuuugca

SEQ ID NO: 3490675 - RNA, 21 nt, Human
acucuaauucccauuuugcaa

SEQ ID NO: 3490676 - RNA, 14 nt, Human
acucuaauucuaac

SEQ ID NO: 3490677 - RNA, 18 nt, Human
acucuaccagugcaggcu

SEQ ID NO: 3490678 - RNA, 15 nt, Human
acucuacuguguaau

SEQ ID NO: 3490679 - RNA, 20 nt, Human
acucuacuuagcaugucccu

SEQ ID NO: 3490680 - RNA, 19 nt, Human
acucuagacaagauauugu

SEQ ID NO: 3490681 - RNA, 21 nt, Human
acucuagaugaaguuuuacau

SEQ ID NO: 3490682 - RNA, 13 nt, Human
acucuagauucca

SEQ ID NO: 3490683 - RNA, 19 nt, Human
acucuagauuuuguuuugc

SEQ ID NO: 3490684 - RNA, 20 nt, Human
acucuaggauguauauuuua

SEQ ID NO: 3490685 - RNA, 13 nt, Human
acucuagucaaug

SEQ ID NO: 3490686 - RNA, 15 nt, Human
acucuagucaaugac

SEQ ID NO: 3490687 - RNA, 22 nt, Human
acucuagucaaugacaugaauu

SEQ ID NO: 3490688 - RNA, 22 nt, Human
acucuauaacaaaggauacuua

SEQ ID NO: 3490689 - RNA, 19 nt, Human
acauagccuauauuuacag

SEQ ID NO: 3490690 - RNA, 21 nt, Human
acauagcuacccaaaagagaa

SEQ ID NO: 3490691 - RNA, 13 nt, Human
acucagggacaga

SEQ ID NO: 3490692 - RNA, 15 nt, Human
acucagggacagagc

SEQ ID NO: 3490693 - RNA, 22 nt, Human
acucagggcagcgccaggcuga

SEQ ID NO: 3490694 - RNA, 13 nt, Human
acucagggcccca

SEQ ID NO: 3490695 - RNA, 14 nt, Human
acucagggccccag

SEQ ID NO: 3490696 - RNA, 18 nt, Human
acucagggcuccucccag

SEQ ID NO: 3490697 - RNA, 20 nt, Human
acucagggcuccucccagcu

SEQ ID NO: 3490698 - RNA, 19 nt, Human
acucaggggucacugaggc

SEQ ID NO: 3490699 - RNA, 15 nt, Human
acucaggugggcccu

SEQ ID NO: 3490700 - RNA, 21 nt, Human
acucagguuguaguaaagaaa

SEQ ID NO: 3490701 - RNA, 19 nt, Human
acucaguccauagcagaga

SEQ ID NO: 3490702 - RNA, 23 nt, Human
acucagucucucuucucuccagc

SEQ ID NO: 3490703 - RNA, 13 nt, Human
acucagucuuuaa

SEQ ID NO: 3490704 - RNA, 22 nt, Human
acucaguuugucagacuuuaaa

SEQ ID NO: 3490705 - RNA, 15 nt, Human
acucaguuuuaacua

SEQ ID NO: 3490706 - RNA, 23 nt, Human
acucauaaucuauaaacaaugaa

SEQ ID NO: 3490707 - RNA, 14 nt, Human
acucauaaugugaa

SEQ ID NO: 3490708 - RNA, 16 nt, Human
acucauaaugugaagu

SEQ ID NO: 3490709 - RNA, 19 nt, Human
acucauaaugugaaguguu

SEQ ID NO: 3490710 - RNA, 23 nt, Human
acucauacacucguaugauacuu

SEQ ID NO: 3490711 - RNA, 15 nt, Human
acucauacugugcug

SEQ ID NO: 3490712 - RNA, 17 nt, Human
acucauacugugcugga

SEQ ID NO: 3490713 - RNA, 19 nt, Human
acucauacugugcuggagc

SEQ ID NO: 3490714 - RNA, 18 nt, Human
acucauagauguuaugca

SEQ ID NO: 3490715 - RNA, 17 nt, Human
acucauauaauuauaug

SEQ ID NO: 3490716 - RNA, 15 nt, Human
acucauauauaucua

SEQ ID NO: 3490717 - RNA, 19 nt, Human
acucauauuacaaaaacaa

SEQ ID NO: 3490718 - RNA, 22 nt, Human
acucauauuacugguaggaacu

SEQ ID NO: 3490719 - RNA, 15 nt, Human
acucauauuuucaug

SEQ ID NO: 3490720 - RNA, 20 nt, Human
acucaucaaucaaauaagua

SEQ ID NO: 3490721 - RNA, 13 nt, Human
acucaucacugug

SEQ ID NO: 3490722 - RNA, 13 nt, Human
acucaucauaaaa

SEQ ID NO: 3490723 - RNA, 13 nt, Human
acucaucauuugu

SEQ ID NO: 3490724 - RNA, 16 nt, Human
acucauccugaacagc

SEQ ID NO: 3490725 - RNA, 13 nt, Human
acucaucugaaau

SEQ ID NO: 3490726 - RNA, 17 nt, Human
acucaucugaaauguua

SEQ ID NO: 3490727 - RNA, 19 nt, Human
acucaucugaaauguuaca

SEQ ID NO: 3490728 - RNA, 23 nt, Human
acucaucugaaauguuacaaaaa

SEQ ID NO: 3490729 - RNA, 19 nt, Human
acucaucuggaguucucaa

SEQ ID NO: 3490730 - RNA, 22 nt, Human
acucaucuggaguucucaaaga

SEQ ID NO: 3490731 - RNA, 20 nt, Human
acucaucuuucccuccuugg

SEQ ID NO: 3490732 - RNA, 14 nt, Human
acucaugagaaguu

SEQ ID NO: 3490733 - RNA, 14 nt, Human
acucaugcugaaag

SEQ ID NO: 3490734 - RNA, 15 nt, Human
acucauggguaauaa

SEQ ID NO: 3490735 - RNA, 17 nt, Human
acucaugugacucuuuc

SEQ ID NO: 3490736 - RNA, 13 nt, Human
acucaugugauuu

SEQ ID NO: 3490737 - RNA, 10 nt, Human
acucaugugu

SEQ ID NO: 3490738 - RNA, 14 nt, Human
acucauuagacugg

SEQ ID NO: 3490739 - RNA, 15 nt, Human
acucauuagacugga

SEQ ID NO: 3490740 - RNA, 19 nt, Human
acucauuccagaucccagg

SEQ ID NO: 3490741 - RNA, 13 nt, Human
acucauuccugua

SEQ ID NO: 3490742 - RNA, 15 nt, Human
acucauucugaauua

SEQ ID NO: 3490743 - RNA, 15 nt, Human
acucauucuucugua

SEQ ID NO: 3490744 - RNA, 13 nt, Human
acucauugaaaug

SEQ ID NO: 3490745 - RNA, 15 nt, Human
acucauugaaauguc

SEQ ID NO: 3490746 - RNA, 17 nt, Human
acucauugaccugaggc

SEQ ID NO: 3490747 - RNA, 22 nt, Human
acucauugaccugaggcccuuc

SEQ ID NO: 3490748 - RNA, 14 nt, Human
acucauuucuaaaa

SEQ ID NO: 3490749 - RNA, 15 nt, Human
acucauuucuaaaag

SEQ ID NO: 3490750 - RNA, 16 nt, Human
acucauuuuuuuaauu

SEQ ID NO: 3490751 - RNA, 19 nt, Human
acucauuuuuuuaauuuau

SEQ ID NO: 3490752 - RNA, 19 nt, Human
acuccaaacagaccccugu

SEQ ID NO: 3490753 - RNA, 17 nt, Human
acuccaacauccacucu

SEQ ID NO: 3490754 - RNA, 19 nt, Human
acuccaacauccacucucu

SEQ ID NO: 3490755 - RNA, 18 nt, Human
acuccaaccuaaccugug

SEQ ID NO: 3490756 - RNA, 14 nt, Human
acuccaacucuucc

SEQ ID NO: 3490757 - RNA, 15 nt, Human
acuccaagguucccu

SEQ ID NO: 3490758 - RNA, 20 nt, Human
acuccaaugucugcugagga

SEQ ID NO: 3490759 - RNA, 21 nt, Human
acuccaaugucugcugaggag

SEQ ID NO: 3490760 - RNA, 14 nt, Human
acuccacacugcac

SEQ ID NO: 3490761 - RNA, 16 nt, Human
acuccacacugcacaa

SEQ ID NO: 3490762 - RNA, 14 nt, Human
acuccacaucugcc

SEQ ID NO: 3490763 - RNA, 15 nt, Human
acuccaccaacccau

SEQ ID NO: 3490764 - RNA, 15 nt, Human
acuccacuuucauag

SEQ ID NO: 3490765 - RNA, 23 nt, Human
acuccagaaaugucccuuucuuc

SEQ ID NO: 3490766 - RNA, 15 nt, Human
acuccagaccccugg

SEQ ID NO: 3490767 - RNA, 22 nt, Human
agaggaaauaagaaaaaucaug

SEQ ID NO: 3490768 - RNA, 19 nt, Human
agaggaaauauugcugggg

SEQ ID NO: 3490769 - RNA, 15 nt, Human
agaggaacuguccag

SEQ ID NO: 3490770 - RNA, 13 nt, Human
agaggaagagaca

SEQ ID NO: 3490771 - RNA, 17 nt, Human
agaggaagagugcaaaa

SEQ ID NO: 3490772 - RNA, 15 nt, Human
agaggaaguucagau

SEQ ID NO: 3490773 - RNA, 14 nt, Human
agaggaauaagaau

SEQ ID NO: 3490774 - RNA, 17 nt, Human
agaggaauccuggcagc

SEQ ID NO: 3490775 - RNA, 18 nt, Human
agaggaauuacgugcucu

SEQ ID NO: 3490776 - RNA, 13 nt, Human
agaggaauuuaua

SEQ ID NO: 3490777 - RNA, 21 nt, Human
agaggacaccuguacuggaga

SEQ ID NO: 3490778 - RNA, 18 nt, Human
agaggacagaucaauggc

SEQ ID NO: 3490779 - RNA, 19 nt, Human
agaggacaguggauuguuu

SEQ ID NO: 3490780 - RNA, 14 nt, Human
agaggaccagggcc

SEQ ID NO: 3490781 - RNA, 23 nt, Human
agaggaccuguauuuaagcaaau

SEQ ID NO: 3490782 - RNA, 22 nt, Human
agaggacgagcgauugaggugu

SEQ ID NO: 3490783 - RNA, 19 nt, Human
agaggagaacuugcugccu

SEQ ID NO: 3490784 - RNA, 14 nt, Human
agaggagagccaga

SEQ ID NO: 3490785 - RNA, 16 nt, Human
agaggagagccagaga

SEQ ID NO: 3490786 - RNA, 17 nt, Human
agaggagagccagagaa

SEQ ID NO: 3490787 - RNA, 21 nt, Human
agaggagagccagagaaguga

SEQ ID NO: 3490788 - RNA, 17 nt, Human
agaggagaggagagagg

SEQ ID NO: 3490789 - RNA, 12 nt, Human
agaggagcccug

SEQ ID NO: 3490790 - RNA, 12 nt, Human
agaggaggcagc

SEQ ID NO: 3490791 - RNA, 17 nt, Human
agaggagggaugcugcc

SEQ ID NO: 3490792 - RNA, 12 nt, Human
agaggaggggcc

SEQ ID NO: 3490793 - RNA, 18 nt, Human
agaggaggggccgcugcc

SEQ ID NO: 3490794 - RNA, 20 nt, Human
agaggaggggccgcugccac

SEQ ID NO: 3490795 - RNA, 16 nt, Human
agaggagugacugagc

SEQ ID NO: 3490796 - RNA, 13 nt, Human
agaggaguucaau

SEQ ID NO: 3490797 - RNA, 16 nt, Human
agaggaguucaaugau

SEQ ID NO: 3490798 - RNA, 21 nt, Human
agaggaugaauguaugugcac

SEQ ID NO: 3490799 - RNA, 22 nt, Human
agaggaugaauguaugugcacu

SEQ ID NO: 3490800 - RNA, 18 nt, Human
agaggaugagagcccaga

SEQ ID NO: 3490801 - RNA, 22 nt, Human
agaggaugagagcccagaggua

SEQ ID NO: 3490802 - RNA, 20 nt, Human
agaggaugagcucuacccag

SEQ ID NO: 3490803 - RNA, 18 nt, Human
agaggaugcugugaaauu

SEQ ID NO: 3490804 - RNA, 15 nt, Human
agaggauggccagug

SEQ ID NO: 3490805 - RNA, 22 nt, Human
agaggauggccagugucugucc

SEQ ID NO: 3490806 - RNA, 19 nt, Human
agaggauuaguaagaucuc

SEQ ID NO: 3490807 - RNA, 22 nt, Human
agaggauuggcucccaucuuuu

SEQ ID NO: 3490808 - RNA, 14 nt, Human
agaggauuuugcgu

SEQ ID NO: 3490809 - RNA, 19 nt, Human
agaggauuuuuuucugagc

SEQ ID NO: 3490810 - RNA, 18 nt, Human
agaggcaagcugaaauuu

SEQ ID NO: 3490811 - RNA, 14 nt, Human
agaggcaccaggaa

SEQ ID NO: 3490812 - RNA, 20 nt, Human
agaggcagaaaauugcacaa

SEQ ID NO: 3490813 - RNA, 15 nt, Human
agaggcagaacccug

SEQ ID NO: 3490814 - RNA, 19 nt, Human
agaggcagaacccugguga

SEQ ID NO: 3490815 - RNA, 14 nt, Human
agaggcagagagcg

SEQ ID NO: 3490816 - RNA, 11 nt, Human
agaggcagccc

SEQ ID NO: 3490817 - RNA, 13 nt, Human
agaggcagcccca

SEQ ID NO: 3490818 - RNA, 23 nt, Human
agaggcagccccauucugccugc

SEQ ID NO: 3490819 - RNA, 24 nt, Human
agaggcagccccauucugccugcc

SEQ ID NO: 3490820 - RNA, 17 nt, Human
agaggcagcuucuuugc

SEQ ID NO: 3490821 - RNA, 10 nt, Human
agaggcaggg

SEQ ID NO: 3490822 - RNA, 19 nt, Human
agaggccaaacaggcccuc

SEQ ID NO: 3490823 - RNA, 21 nt, Human
agaggccagccccacccagga

SEQ ID NO: 3490824 - RNA, 15 nt, Human
agaggccauggcaga

SEQ ID NO: 3490825 - RNA, 19 nt, Human
agaggccaugggccuccug

SEQ ID NO: 3490826 - RNA, 18 nt, Human
agaggcccaggcugccgu

SEQ ID NO: 3490827 - RNA, 16 nt, Human
agaggccccagccucc

SEQ ID NO: 3490828 - RNA, 17 nt, Human
agaggcccccagcccag

SEQ ID NO: 3490829 - RNA, 22 nt, Human
agaggcccccagcccagggcuc

SEQ ID NO: 3490830 - RNA, 24 nt, Human
agaggcccuggaucagcguggccu

SEQ ID NO: 3490831 - RNA, 14 nt, Human
agaggccguggcug

SEQ ID NO: 3490832 - RNA, 20 nt, Human
agaggccugaaauccugguu

SEQ ID NO: 3490833 - RNA, 22 nt, Human
agaggccugccuccagggcugg

SEQ ID NO: 3490834 - RNA, 19 nt, Human
agaggccuuuuggaaugug

SEQ ID NO: 3490835 - RNA, 19 nt, Human
agaggcgggccagccaggc

SEQ ID NO: 3490836 - RNA, 14 nt, Human
agaggcuaaaaugu

SEQ ID NO: 3490837 - RNA, 17 nt, Human
agaggcuaaaauguuuu

SEQ ID NO: 3490838 - RNA, 15 nt, Human
agaggcuacagggcc

SEQ ID NO: 3490839 - RNA, 16 nt, Human
agaggcuacagggcca

SEQ ID NO: 3490840 - RNA, 10 nt, Human
agaggcucag

SEQ ID NO: 3490841 - RNA, 16 nt, Human
agaggcugagacagga

SEQ ID NO: 3490842 - RNA, 14 nt, Human
agaggcugaggccu

SEQ ID NO: 3490843 - RNA, 18 nt, Human
agaggcugaggccuggac

SEQ ID NO: 3490844 - RNA, 19 nt, Human
agaggcugaggccuggacu

SEQ ID NO: 3490845 - RNA, 21 nt, Human
agaggcugcagaaggccaaga

SEQ ID NO: 3490846 - RNA, 22 nt, Human
agaggcugcagaaggccaagaa

SEQ ID NO: 3490847 - RNA, 14 nt, Human
agaggcugccccuc

SEQ ID NO: 3490848 - RNA, 16 nt, Human
agaggcugccccucuc

SEQ ID NO: 3490849 - RNA, 17 nt, Human
agaggcuggaggcaggg

SEQ ID NO: 3490850 - RNA, 22 nt, Human
agaggcuggaggcagggccuug

SEQ ID NO: 3490851 - RNA, 10 nt, Human
agaggcuggu

SEQ ID NO: 3490852 - RNA, 16 nt, Human
agaggcugguuccaga

SEQ ID NO: 3490853 - RNA, 14 nt, Human
agaggcugucuguu

SEQ ID NO: 3490854 - RNA, 16 nt, Human
agaggcuguggcuggu

SEQ ID NO: 3490855 - RNA, 17 nt, Human
agaggcuucuccgccag

SEQ ID NO: 3490856 - RNA, 21 nt, Human
agaggcuucuccgccagccuc

SEQ ID NO: 3490857 - RNA, 22 nt, Human
agaggcuucuccgccagccucc

SEQ ID NO: 3490858 - RNA, 14 nt, Human
agaggcuucuucag

SEQ ID NO: 3490859 - RNA, 15 nt, Human
agagggaacagggcg

SEQ ID NO: 3490860 - RNA, 13 nt, Human
agagggaauguga

SEQ ID NO: 3490861 - RNA, 14 nt, Human
agagggaaugugaa

SEQ ID NO: 3490862 - RNA, 18 nt, Human
agagggaaugugaaauuu

SEQ ID NO: 3490863 - RNA, 12 nt, Human
agagggacagau

SEQ ID NO: 3490864 - RNA, 17 nt, Human
agagggaccauguguca

SEQ ID NO: 3490865 - RNA, 15 nt, Human
agagggaccucuccc

SEQ ID NO: 3490866 - RNA, 19 nt, Human
agagggaccucucccaggg

SEQ ID NO: 3490867 - RNA, 22 nt, Human
agagggacggccaagaauguac

SEQ ID NO: 3490868 - RNA, 13 nt, Human
agagggagagaga

SEQ ID NO: 3490869 - RNA, 21 nt, Human
agagggagggagggcuccaga

SEQ ID NO: 3490870 - RNA, 14 nt, Human
agagggaggggccu

SEQ ID NO: 3490871 - RNA, 20 nt, Human
agagggaggucacuggaaag

SEQ ID NO: 3490872 - RNA, 14 nt, Human
agagggagguguuu

SEQ ID NO: 3490873 - RNA, 16 nt, Human
agagggcacacacugu

SEQ ID NO: 3490874 - RNA, 16 nt, Human
agagggcacucugcuu

SEQ ID NO: 3490875 - RNA, 19 nt, Human
agagggccaugcaauucau

SEQ ID NO: 3490876 - RNA, 22 nt, Human
agagggccauugaacucugaga

SEQ ID NO: 3490877 - RNA, 21 nt, Human
agagggcccaggcaggccacc

SEQ ID NO: 3490878 - RNA, 15 nt, Human
agagggccgggcaga

SEQ ID NO: 3490879 - RNA, 14 nt, Human
agagggcgcaggcc

SEQ ID NO: 3490880 - RNA, 16 nt, Human
agagggcgcaggccgu

SEQ ID NO: 3490881 - RNA, 11 nt, Human
agagggcugga

SEQ ID NO: 3490882 - RNA, 13 nt, Human
agagggcuuccuc

SEQ ID NO: 3490883 - RNA, 16 nt, Human
agaggggaaaagagau

SEQ ID NO: 3490884 - RNA, 22 nt, Human
agaggggaacagacuggaagca

SEQ ID NO: 3490885 - RNA, 22 nt, Human
agaggggaagaguguacugggg

SEQ ID NO: 3490886 - RNA, 12 nt, Human
agaggggaagga

SEQ ID NO: 3490887 - RNA, 16 nt, Human
agaggggaagggccag

SEQ ID NO: 3490888 - RNA, 18 nt, Human
agaggggagagcugaaca

SEQ ID NO: 3490889 - RNA, 18 nt, Human
agaggggcagauggaaag

SEQ ID NO: 3490890 - RNA, 13 nt, Human
agaggggcagccc

SEQ ID NO: 3490891 - RNA, 16 nt, Human
agaggggcagcccuug

SEQ ID NO: 3490892 - RNA, 19 nt, Human
agaggggcagcccuugcuu

SEQ ID NO: 3490893 - RNA, 15 nt, Human
agaggggcaggcccu

SEQ ID NO: 3490894 - RNA, 13 nt, Human
agaggggccugcc

SEQ ID NO: 3490895 - RNA, 22 nt, Human
agaggggccugccaccuggacc

SEQ ID NO: 3490896 - RNA, 23 nt, Human
agaggggccugccaccuggaccc

SEQ ID NO: 3490897 - RNA, 21 nt, Human
agaggggcugaauagcagaag

SEQ ID NO: 3490898 - RNA, 12 nt, Human
agagggggccac

SEQ ID NO: 3490899 - RNA, 12 nt, Human
agagggggccug

SEQ ID NO: 3490900 - RNA, 14 nt, Human
agagggggcuggug

SEQ ID NO: 3490901 - RNA, 19 nt, Human
agagggggcuggugggugc

SEQ ID NO: 3490902 - RNA, 19 nt, Human
agaggggguggaggggugu

SEQ ID NO: 3490903 - RNA, 19 nt, Human
agagggugaguccuccaga

SEQ ID NO: 3490904 - RNA, 22 nt, Human
agaggguggugaccucugccug

SEQ ID NO: 3490905 - RNA, 16 nt, Human
agaggguguccugcac

SEQ ID NO: 3490906 - RNA, 13 nt, Human
agaggguuccugu

SEQ ID NO: 3490907 - RNA, 19 nt, Human
agagguaaaagugugagca

SEQ ID NO: 3490908 - RNA, 20 nt, Human
agagguaaaagugugagcag

SEQ ID NO: 3490909 - RNA, 21 nt, Human
agagguacaggguuuuuaccu

SEQ ID NO: 3490910 - RNA, 17 nt, Human
agagguacccugggugu

SEQ ID NO: 3490911 - RNA, 13 nt, Human
agagguauaauug

SEQ ID NO: 3490912 - RNA, 17 nt, Human
agagguauuuaucuuua

SEQ ID NO: 3490913 - RNA, 12 nt, Human
agagguccagcc

SEQ ID NO: 3490914 - RNA, 16 nt, Human
agagguccagcccauc

SEQ ID NO: 3490915 - RNA, 18 nt, Human
agagguccagcccaucuc

SEQ ID NO: 3490916 - RNA, 21 nt, Human
agaggucccaagguucugggu

SEQ ID NO: 3490917 - RNA, 22 nt, Human
agagggaugaggugcugggagg

SEQ ID NO: 3490918 - RNA, 17 nt, Human
agagggaugcauggaga

SEQ ID NO: 3490919 - RNA, 18 nt, Human
agagggccaagacuuggc

SEQ ID NO: 3490920 - RNA, 18 nt, Human
agagggcccugguguuuc

SEQ ID NO: 3490921 - RNA, 23 nt, Human
agagggcccugguguuucuagca

SEQ ID NO: 3490922 - RNA, 16 nt, Human
agagggccugugggag

SEQ ID NO: 3490923 - RNA, 17 nt, Human
agagggcucugugcuga

SEQ ID NO: 3490924 - RNA, 19 nt, Human
agagggcucugugcugaca

SEQ ID NO: 3490925 - RNA, 10 nt, Human
agagggcugc

SEQ ID NO: 3490926 - RNA, 18 nt, Human
agagggcuugugaacaga

SEQ ID NO: 3490927 - RNA, 19 nt, Human
agaggggaauaauagaaga

SEQ ID NO: 3490928 - RNA, 14 nt, Human
agaggggacucugg

SEQ ID NO: 3490929 - RNA, 12 nt, Human
agaggggcagcc

SEQ ID NO: 3490930 - RNA, 20 nt, Human
agaggggccgaugcccagag

SEQ ID NO: 3490931 - RNA, 21 nt, Human
agaggggccugccaccuggac

SEQ ID NO: 3490932 - RNA, 18 nt, Human
agaggggcuuucuggaga

SEQ ID NO: 3490933 - RNA, 16 nt, Human
agagggggacugcugc

SEQ ID NO: 3490934 - RNA, 19 nt, Human
agagggggccugggacuuc

SEQ ID NO: 3490935 - RNA, 22 nt, Human
agagggggccugggacuuccau

SEQ ID NO: 3490936 - RNA, 19 nt, Human
agagggguacauuucccug

SEQ ID NO: 3490937 - RNA, 21 nt, Human
agaggguaauaaccagacaca

SEQ ID NO: 3490938 - RNA, 15 nt, Human
agagggucacagugu

SEQ ID NO: 3490939 - RNA, 18 nt, Human
agagggucuggagaagca

SEQ ID NO: 3490940 - RNA, 22 nt, Human
agagggucuggagaagcaguga

SEQ ID NO: 3490941 - RNA, 18 nt, Human
agagggucugggggcaca

SEQ ID NO: 3490942 - RNA, 21 nt, Human
agagggugaguccuccagaac

SEQ ID NO: 3490943 - RNA, 19 nt, Human
agaggguggugaccucugc

SEQ ID NO: 3490944 - RNA, 23 nt, Human
agaggguggugaccucugccuga

SEQ ID NO: 3490945 - RNA, 15 nt, Human
agagggugucaucua

SEQ ID NO: 3490946 - RNA, 18 nt, Human
agagguaaaagugugagc

SEQ ID NO: 3490947 - RNA, 22 nt, Human
agagguaaaagugugagcagug

SEQ ID NO: 3490948 - RNA, 17 nt, Human
agagguaacagaacagc

SEQ ID NO: 3490949 - RNA, 18 nt, Human
agagguaacagaacagcu

SEQ ID NO: 3490950 - RNA, 20 nt, Human
agagguaacagaacagcuuc

SEQ ID NO: 3490951 - RNA, 22 nt, Human
agagguaacagaacagcuucag

SEQ ID NO: 3490952 - RNA, 17 nt, Human
agagguacaggguuuuu

SEQ ID NO: 3490953 - RNA, 16 nt, Human
agagguauuaaaacua

SEQ ID NO: 3490954 - RNA, 20 nt, Human
agaggucaagcccaggagga

SEQ ID NO: 3490955 - RNA, 14 nt, Human
agaggucagacuaa

SEQ ID NO: 3490956 - RNA, 18 nt, Human
agagguccucuggagccc

SEQ ID NO: 3490957 - RNA, 16 nt, Human
agaggucugugcugag

SEQ ID NO: 3490958 - RNA, 17 nt, Human
agaggugaccccagggc

SEQ ID NO: 3490959 - RNA, 18 nt, Human
agaggugaccccagggca

SEQ ID NO: 3490960 - RNA, 16 nt, Human
agaggugagaaauuua

SEQ ID NO: 3490961 - RNA, 17 nt, Human
agaggugagaaauuuaa

SEQ ID NO: 3490962 - RNA, 19 nt, Human
agaggugccagcaacugaa

SEQ ID NO: 3490963 - RNA, 21 nt, Human
agaggugccagcaacugaaua

SEQ ID NO: 3490964 - RNA, 18 nt, Human
agagguggccagagcugg

SEQ ID NO: 3490965 - RNA, 14 nt, Human
agaggugggagggc

SEQ ID NO: 3490966 - RNA, 17 nt, Human
agaggugggcagguggu

SEQ ID NO: 3490967 - RNA, 19 nt, Human
agaggugggcagguggugg

SEQ ID NO: 3490968 - RNA, 16 nt, Human
agagguuaaggugcaa

SEQ ID NO: 3490969 - RNA, 15 nt, Human
agagguuaagguggg

SEQ ID NO: 3490970 - RNA, 20 nt, Human
agagguuaucugucccaggu

SEQ ID NO: 3490971 - RNA, 19 nt, Human
agagguucaaagauauuuu

SEQ ID NO: 3490972 - RNA, 20 nt, Human
agagguuguagugagcccag

SEQ ID NO: 3490973 - RNA, 14 nt, Human
agagguugucugug

SEQ ID NO: 3490974 - RNA, 15 nt, Human
agagguuugcagucc

SEQ ID NO: 3490975 - RNA, 17 nt, Human
agagguuuuaugauauu

SEQ ID NO: 3490976 - RNA, 18 nt, Human
agaguaaaggaaaugauu

SEQ ID NO: 3490977 - RNA, 16 nt, Human
agaguaagaaauuuca

SEQ ID NO: 3490978 - RNA, 14 nt, Human
agaguaagacauug

SEQ ID NO: 3490979 - RNA, 15 nt, Human
agaguaagcugcuuu

SEQ ID NO: 3490980 - RNA, 22 nt, Human
agaguaauccaagcaaauguga

SEQ ID NO: 3490981 - RNA, 16 nt, Human
agaguacagugagcca

SEQ ID NO: 3490982 - RNA, 19 nt, Human
agaguacagugagccaaga

SEQ ID NO: 3490983 - RNA, 12 nt, Human
agaguacuuugg

SEQ ID NO: 3490984 - RNA, 16 nt, Human
agaguagaauugcauu

SEQ ID NO: 3490985 - RNA, 22 nt, Human
agaguagauggugaaauuuauu

SEQ ID NO: 3490986 - RNA, 15 nt, Human
agaguagcauuucau

SEQ ID NO: 3490987 - RNA, 23 nt, Human
agaguagccgagagccugcuccc

SEQ ID NO: 3490988 - RNA, 14 nt, Human
agaguaguccaggu

SEQ ID NO: 3490989 - RNA, 23 nt, Human
agaguaguuauauaauuguugaa

SEQ ID NO: 3490990 - RNA, 13 nt, Human
agaguauggagcu

SEQ ID NO: 3490991 - RNA, 14 nt, Human
agaguauggagcuc

SEQ ID NO: 3490992 - RNA, 21 nt, Human
agaguauggagcucagagagg

SEQ ID NO: 3490993 - RNA, 15 nt, Human
agaguauggauugaa

SEQ ID NO: 3490994 - RNA, 23 nt, Human
agaguauuggucuccucucagcc

SEQ ID NO: 3490995 - RNA, 14 nt, Human
agaguauuuuugac

SEQ ID NO: 3490996 - RNA, 17 nt, Human
agaguauuuuugacaga

SEQ ID NO: 3490997 - RNA, 20 nt, Human
agaguauuuuugacagaaua

SEQ ID NO: 3490998 - RNA, 18 nt, Human
agagucagccaggaccau

SEQ ID NO: 3490999 - RNA, 18 nt, Human
agagucagccuucccccu

SEQ ID NO: 3491000 - RNA, 16 nt, Human
agagucagcucucugc

SEQ ID NO: 3491001 - RNA, 21 nt, Human
agagucagcucucugcccugu

SEQ ID NO: 3491002 - RNA, 13 nt, Human
agagucaucucca

SEQ ID NO: 3491003 - RNA, 14 nt, Human
agagucaucuccau

SEQ ID NO: 3491004 - RNA, 19 nt, Human
agagucaucuccaucagcu

SEQ ID NO: 3491005 - RNA, 16 nt, Human
agagucauuguaaugu

SEQ ID NO: 3491006 - RNA, 22 nt, Human
agagucauuguaauguugugaa

SEQ ID NO: 3491007 - RNA, 23 nt, Human
agagucauuguaauguugugaau

SEQ ID NO: 3491008 - RNA, 16 nt, Human
agaguccaggccccaa

SEQ ID NO: 3491009 - RNA, 14 nt, Human
agagucccacugcc

SEQ ID NO: 3491010 - RNA, 20 nt, Human
agagucccagguuggcucug

SEQ ID NO: 3491011 - RNA, 21 nt, Human
agaguccccccacucccagca

SEQ ID NO: 3491012 - RNA, 14 nt, Human
agagucccugccug

SEQ ID NO: 3491013 - RNA, 17 nt, Human
agagucccugccuggac

SEQ ID NO: 3491014 - RNA, 13 nt, Human
agaguccucacuc

SEQ ID NO: 3491015 - RNA, 21 nt, Human
agaguccugcacaguuuucug

SEQ ID NO: 3491016 - RNA, 14 nt, Human
agagucgcugugcc

SEQ ID NO: 3491017 - RNA, 13 nt, Human
agagucuaaagau

SEQ ID NO: 3491018 - RNA, 22 nt, Human
agagucuaaagauggaguuucu

SEQ ID NO: 3491019 - RNA, 21 nt, Human
agagucuaauagucuuugcca

SEQ ID NO: 3491020 - RNA, 12 nt, Human
agagucuagauu

SEQ ID NO: 3491021 - RNA, 19 nt, Human
agagucuagauucaaaggu

SEQ ID NO: 3491022 - RNA, 14 nt, Human
agagucuagauucu

SEQ ID NO: 3491023 - RNA, 20 nt, Human
agagucucacuguugcccag

SEQ ID NO: 3491024 - RNA, 15 nt, Human
agagucucccaggga

SEQ ID NO: 3491025 - RNA, 16 nt, Human
agagucugaacagcug

SEQ ID NO: 3491026 - RNA, 14 nt, Human
agagucugagggcu

SEQ ID NO: 3491027 - RNA, 21 nt, Human
agagucugagggcuuguaguu

SEQ ID NO: 3491028 - RNA, 15 nt, Human
agagucuggcccuag

SEQ ID NO: 3491029 - RNA, 18 nt, Human
agagucuggugaagcuca

SEQ ID NO: 3491030 - RNA, 16 nt, Human
agagugaaaaagagaa

SEQ ID NO: 3491031 - RNA, 17 nt, Human
agagugaauucccucac

SEQ ID NO: 3491032 - RNA, 16 nt, Human
agagugagacucuguc

SEQ ID NO: 3491033 - RNA, 21 nt, Human
agagugagagggcaugcgcac

SEQ ID NO: 3491034 - RNA, 22 nt, Human
agagugagcuacagagccgagc

SEQ ID NO: 3491035 - RNA, 22 nt, Human
agagugauagucuuuugcuuuu

SEQ ID NO: 3491036 - RNA, 13 nt, Human
agagugcaacagu

SEQ ID NO: 3491037 - RNA, 17 nt, Human
agagugcaacaguagca

SEQ ID NO: 3491038 - RNA, 14 nt, Human
agaguggccccacc

SEQ ID NO: 3491039 - RNA, 15 nt, Human
agaguggccccaccu

SEQ ID NO: 3491040 - RNA, 17 nt, Human
agaguggccuggccagg

SEQ ID NO: 3491041 - RNA, 13 nt, Human
agaguggcugggg

SEQ ID NO: 3491042 - RNA, 11 nt, Human
agagugggagc

SEQ ID NO: 3491043 - RNA, 18 nt, Human
agagugggcugcaucugg

SEQ ID NO: 3491044 - RNA, 18 nt, Human
agagugggggagagcagg

SEQ ID NO: 3491045 - RNA, 20 nt, Human
agagugggggagagcaggcu

SEQ ID NO: 3491046 - RNA, 18 nt, Human
agagugguauuugcagac

SEQ ID NO: 3491047 - RNA, 13 nt, Human
agagugguggggg

SEQ ID NO: 3491048 - RNA, 15 nt, Human
agaguguagaagcau

SEQ ID NO: 3491049 - RNA, 17 nt, Human
agaguguagaagcauuc

SEQ ID NO: 3491050 - RNA, 18 nt, Human
agaguguagaagcauucc

SEQ ID NO: 3491051 - RNA, 22 nt, Human
agaguguagaagcauuccuucu

SEQ ID NO: 3491052 - RNA, 14 nt, Human
agagugucucugau

SEQ ID NO: 3491053 - RNA, 20 nt, Human
agagugucuucacggcagga

SEQ ID NO: 3491054 - RNA, 15 nt, Human
agagugucuuuccac

SEQ ID NO: 3491055 - RNA, 20 nt, Human
agaguguggagucauucuca

SEQ ID NO: 3491056 - RNA, 15 nt, Human
agaguuaagaagcug

SEQ ID NO: 3491057 - RNA, 17 nt, Human
agaguuacaguucugug

SEQ ID NO: 3491058 - RNA, 14 nt, Human
agaguuagacuguu

SEQ ID NO: 3491059 - RNA, 20 nt, Human
agaguuagguuuaacauaaa

SEQ ID NO: 3491060 - RNA, 23 nt, Human
agaguuagguuuaacauaaaggu

SEQ ID NO: 3491061 - RNA, 17 nt, Human
agaguuauuuaggcuuu

SEQ ID NO: 3491062 - RNA, 14 nt, Human
agaguucaagaaau

SEQ ID NO: 3491063 - RNA, 21 nt, Human
agaguucaauggcugcugaag

SEQ ID NO: 3491064 - RNA, 22 nt, Human
agaguucaguaagaccggaagc

SEQ ID NO: 3491065 - RNA, 14 nt, Human
agaguucaucccag

SEQ ID NO: 3491066 - RNA, 22 nt, Human
agaggucucugccggcucuuuc

SEQ ID NO: 3491067 - RNA, 13 nt, Human
agaggucugugcu

SEQ ID NO: 3491068 - RNA, 18 nt, Human
agaggucugugcugaggc

SEQ ID NO: 3491069 - RNA, 12 nt, Human
agaggucuuuuu

SEQ ID NO: 3491070 - RNA, 19 nt, Human
agaggucuuuuuuaaaagg

SEQ ID NO: 3491071 - RNA, 14 nt, Human
agaggugagggaag

SEQ ID NO: 3491072 - RNA, 14 nt, Human
agaggugccagcaa

SEQ ID NO: 3491073 - RNA, 16 nt, Human
agaggugccagcaacu

SEQ ID NO: 3491074 - RNA, 16 nt, Human
agaggugcuucacccu

SEQ ID NO: 3491075 - RNA, 13 nt, Human
agagguggccaga

SEQ ID NO: 3491076 - RNA, 13 nt, Human
agaggugggcagg

SEQ ID NO: 3491077 - RNA, 21 nt, Human
agaggugggccagucugugga

SEQ ID NO: 3491078 - RNA, 16 nt, Human
agagguggggagcaga

SEQ ID NO: 3491079 - RNA, 23 nt, Human
agaggugugcaagagagggaugc

SEQ ID NO: 3491080 - RNA, 16 nt, Human
agagguguuauuugga

SEQ ID NO: 3491081 - RNA, 17 nt, Human
agagguuaucuguccca

SEQ ID NO: 3491082 - RNA, 20 nt, Human
agagguucaaagauauuuug

SEQ ID NO: 3491083 - RNA, 22 nt, Human
agagguuugacuagaugaugga

SEQ ID NO: 3491084 - RNA, 18 nt, Human
agagguuuggcuccugcc

SEQ ID NO: 3491085 - RNA, 18 nt, Human
agagguuuuaaagugauu

SEQ ID NO: 3491086 - RNA, 12 nt, Human
agagguuuuguu

SEQ ID NO: 3491087 - RNA, 15 nt, Human
agaguaaaaacugaa

SEQ ID NO: 3491088 - RNA, 18 nt, Human
agaguaauccaagcaaau

SEQ ID NO: 3491089 - RNA, 18 nt, Human
agaguaaucuuguugguu

SEQ ID NO: 3491090 - RNA, 18 nt, Human
agaguaauggguuucaua

SEQ ID NO: 3491091 - RNA, 12 nt, Human
agaguacacugc

SEQ ID NO: 3491092 - RNA, 19 nt, Human
agaguacuuugguuucuga

SEQ ID NO: 3491093 - RNA, 15 nt, Human
agaguagaaauaaaa

SEQ ID NO: 3491094 - RNA, 18 nt, Human
agaguagagguauaauug

SEQ ID NO: 3491095 - RNA, 21 nt, Human
agaguagauggugaaauuuau

SEQ ID NO: 3491096 - RNA, 18 nt, Human
agaguagcauuucauucu

SEQ ID NO: 3491097 - RNA, 23 nt, Human
agaguagccaggguguggcccug

SEQ ID NO: 3491098 - RNA, 13 nt, Human
agaguagccgaga

SEQ ID NO: 3491099 - RNA, 18 nt, Human
agaguagccgagagccug

SEQ ID NO: 3491100 - RNA, 13 nt, Human
agaguauaugcac

SEQ ID NO: 3491101 - RNA, 14 nt, Human
agaguaugaacacc

SEQ ID NO: 3491102 - RNA, 18 nt, Human
agaguauuuuugacagaa

SEQ ID NO: 3491103 - RNA, 17 nt, Human
agaguauuuuuguauuc

SEQ ID NO: 3491104 - RNA, 21 nt, Human
agagucaacuacacaaagcag

SEQ ID NO: 3491105 - RNA, 22 nt, Human
agagucaacuacacaaagcagg

SEQ ID NO: 3491106 - RNA, 16 nt, Human
agagucaaggccugcu

SEQ ID NO: 3491107 - RNA, 21 nt, Human
agagucacacgggggcagcug

SEQ ID NO: 3491108 - RNA, 22 nt, Human
agagucagaaguuucugccgca

SEQ ID NO: 3491109 - RNA, 14 nt, Human
agagucagaucuuu

SEQ ID NO: 3491110 - RNA, 20 nt, Human
agagucagcucucugcccug

SEQ ID NO: 3491111 - RNA, 15 nt, Human
agagucauauuuuga

SEQ ID NO: 3491112 - RNA, 17 nt, Human
agagucauauuuugauu

SEQ ID NO: 3491113 - RNA, 14 nt, Human
agagucauuguaau

SEQ ID NO: 3491114 - RNA, 21 nt, Human
agagucauuguaauguuguga

SEQ ID NO: 3491115 - RNA, 20 nt, Human
agagucccacugccucaggu

SEQ ID NO: 3491116 - RNA, 21 nt, Human
agagucccagagcaggaggcc

SEQ ID NO: 3491117 - RNA, 22 nt, Human
agaguccccccucccaccucca

SEQ ID NO: 3491118 - RNA, 14 nt, Human
agaguccucacucc

SEQ ID NO: 3491119 - RNA, 13 nt, Human
agaguccucugaa

SEQ ID NO: 3491120 - RNA, 14 nt, Human
agaguccucugaau

SEQ ID NO: 3491121 - RNA, 14 nt, Human
agaguccucuggau

SEQ ID NO: 3491122 - RNA, 17 nt, Human
agaguccugugcugaau

SEQ ID NO: 3491123 - RNA, 22 nt, Human
agagucggaacggagaaaggug

SEQ ID NO: 3491124 - RNA, 12 nt, Human
agagucuaaaga

SEQ ID NO: 3491125 - RNA, 14 nt, Human
agagucuaaagaug

SEQ ID NO: 3491126 - RNA, 21 nt, Human
acucccuugguggcaagagcc

SEQ ID NO: 3491127 - RNA, 22 nt, Human
acuccgagaggugggccagucu

SEQ ID NO: 3491128 - RNA, 13 nt, Human
acuccgcccccag

SEQ ID NO: 3491129 - RNA, 14 nt, Human
acuccggagacagg

SEQ ID NO: 3491130 - RNA, 15 nt, Human
acuccggagacaggg

SEQ ID NO: 3491131 - RNA, 18 nt, Human
acuccggagugagaagcu

SEQ ID NO: 3491132 - RNA, 20 nt, Human
acuccggauugcguuccucc

SEQ ID NO: 3491133 - RNA, 13 nt, Human
acuccggcugugc

SEQ ID NO: 3491134 - RNA, 19 nt, Human
acuccggugugccugcagc

SEQ ID NO: 3491135 - RNA, 20 nt, Human
acuccggugugccugcagcc

SEQ ID NO: 3491136 - RNA, 19 nt, Human
acuccguaacagauuuugu

SEQ ID NO: 3491137 - RNA, 15 nt, Human
acuccgucucaagga

SEQ ID NO: 3491138 - RNA, 15 nt, Human
acuccguuggccacu

SEQ ID NO: 3491139 - RNA, 18 nt, Human
acuccguuggccacuccg

SEQ ID NO: 3491140 - RNA, 16 nt, Human
acuccuacaccuaacu

SEQ ID NO: 3491141 - RNA, 16 nt, Human
acuccuaccugcccug

SEQ ID NO: 3491142 - RNA, 18 nt, Human
acuccuaccugcccugga

SEQ ID NO: 3491143 - RNA, 14 nt, Human
acuccuaccuggua

SEQ ID NO: 3491144 - RNA, 22 nt, Human
acuccuagagaacgcagcccua

SEQ ID NO: 3491145 - RNA, 23 nt, Human
acuccuagagaacgcagcccuag

SEQ ID NO: 3491146 - RNA, 16 nt, Human
acuccuagcuguccuu

SEQ ID NO: 3491147 - RNA, 16 nt, Human
acuccuaggaaaauac

SEQ ID NO: 3491148 - RNA, 13 nt, Human
acuccuaggcagg

SEQ ID NO: 3491149 - RNA, 20 nt, Human
acuccuaggcaggacaugcu

SEQ ID NO: 3491150 - RNA, 19 nt, Human
acuccuaguucuagaaaaa

SEQ ID NO: 3491151 - RNA, 14 nt, Human
acuccuauuuuugu

SEQ ID NO: 3491152 - RNA, 16 nt, Human
acuccuauuuuuguaa

SEQ ID NO: 3491153 - RNA, 20 nt, Human
acuccuauuuuuguaaacug

SEQ ID NO: 3491154 - RNA, 21 nt, Human
acuccucaaaagcaaaugaga

SEQ ID NO: 3491155 - RNA, 13 nt, Human
acuccucacacuu

SEQ ID NO: 3491156 - RNA, 17 nt, Human
acuccucaguucuugcc

SEQ ID NO: 3491157 - RNA, 15 nt, Human
acuccucccaggguu

SEQ ID NO: 3491158 - RNA, 15 nt, Human
acuccuccccacccu

SEQ ID NO: 3491159 - RNA, 18 nt, Human
acuccuccccacccuccu

SEQ ID NO: 3491160 - RNA, 14 nt, Human
acuccuccuagcca

SEQ ID NO: 3491161 - RNA, 15 nt, Human
acuccuccuagccac

SEQ ID NO: 3491162 - RNA, 18 nt, Human
acuccuccuagccaccca

SEQ ID NO: 3491163 - RNA, 23 nt, Human
acuccuccuccaaaggcccccua

SEQ ID NO: 3491164 - RNA, 19 nt, Human
acuccuccucuuucucucc

SEQ ID NO: 3491165 - RNA, 21 nt, Human
acuccuccucuuucucucccc

SEQ ID NO: 3491166 - RNA, 16 nt, Human
acuccucggccuggcu

SEQ ID NO: 3491167 - RNA, 19 nt, Human
acuccucggccuggcuccu

SEQ ID NO: 3491168 - RNA, 23 nt, Human
acuccucuaagccacucuuccaa

SEQ ID NO: 3491169 - RNA, 13 nt, Human
acuccucugcuga

SEQ ID NO: 3491170 - RNA, 16 nt, Human
acuccucugcugaccu

SEQ ID NO: 3491171 - RNA, 14 nt, Human
acuccucuguccag

SEQ ID NO: 3491172 - RNA, 14 nt, Human
acuccugaaaaaaa

SEQ ID NO: 3491173 - RNA, 19 nt, Human
acuccugaaaaaaaaccug

SEQ ID NO: 3491174 - RNA, 15 nt, Human
acuccugaccucagg

SEQ ID NO: 3491175 - RNA, 18 nt, Human
acuccugagaccccuggc

SEQ ID NO: 3491176 - RNA, 20 nt, Human
acuccugagaccccuggccu

SEQ ID NO: 3491177 - RNA, 21 nt, Human
acuccugagaccccuggccuc

SEQ ID NO: 3491178 - RNA, 17 nt, Human
acuccugaggacagcug

SEQ ID NO: 3491179 - RNA, 20 nt, Human
acuccugaggacagcugucc

SEQ ID NO: 3491180 - RNA, 13 nt, Human
acuccugcaaaau

SEQ ID NO: 3491181 - RNA, 14 nt, Human
acuccugcaggcag

SEQ ID NO: 3491182 - RNA, 15 nt, Human
acuccugcaggcagc

SEQ ID NO: 3491183 - RNA, 17 nt, Human
acuccugcaggcagcca

SEQ ID NO: 3491184 - RNA, 22 nt, Human
acuccugcaggcagccaggcca

SEQ ID NO: 3491185 - RNA, 14 nt, Human
acuccugcccuguu

SEQ ID NO: 3491186 - RNA, 11 nt, Human
acuccuggccu

SEQ ID NO: 3491187 - RNA, 14 nt, Human
acuccuggccucaa

SEQ ID NO: 3491188 - RNA, 21 nt, Human
acuccugggcucaagcagucu

SEQ ID NO: 3491189 - RNA, 23 nt, Human
acuccugguccuaggcuggaagg

SEQ ID NO: 3491190 - RNA, 15 nt, Human
acuccuguaauuccu

SEQ ID NO: 3491191 - RNA, 18 nt, Human
acuccuguacacugaaua

SEQ ID NO: 3491192 - RNA, 16 nt, Human
acuccugugggagccu

SEQ ID NO: 3491193 - RNA, 20 nt, Human
acuccugugggagccucgca

SEQ ID NO: 3491194 - RNA, 16 nt, Human
acuccuguuacuuacc

SEQ ID NO: 3491195 - RNA, 22 nt, Human
acuccuuauuuggcgugacccg

SEQ ID NO: 3491196 - RNA, 12 nt, Human
acuccuuccagc

SEQ ID NO: 3491197 - RNA, 13 nt, Human
acuccuuccagcu

SEQ ID NO: 3491198 - RNA, 11 nt, Human
acuccuuccug

SEQ ID NO: 3491199 - RNA, 13 nt, Human
acuccuuccugcc

SEQ ID NO: 3491200 - RNA, 14 nt, Human
acuccuuccugccc

SEQ ID NO: 3491201 - RNA, 23 nt, Human
acuccuugaaaacacuguucucu

SEQ ID NO: 3491202 - RNA, 17 nt, Human
acuccuugagagaccag

SEQ ID NO: 3491203 - RNA, 20 nt, Human
acuccuugcaucaagggguc

SEQ ID NO: 3491204 - RNA, 11 nt, Human
acuccuuggcc

SEQ ID NO: 3491205 - RNA, 14 nt, Human
acuccuuucucauc

SEQ ID NO: 3491206 - RNA, 14 nt, Human
acuccuuuuaaaga

SEQ ID NO: 3491207 - RNA, 17 nt, Human
acucgagaccuuuucaa

SEQ ID NO: 3491208 - RNA, 21 nt, Human
acucgaggacuguauuuguga

SEQ ID NO: 3491209 - RNA, 15 nt, Human
acucgagucugaggc

SEQ ID NO: 3491210 - RNA, 14 nt, Human
acucgcccgcccac

SEQ ID NO: 3491211 - RNA, 19 nt, Human
acucgcccgcccacugucc

SEQ ID NO: 3491212 - RNA, 18 nt, Human
acucgcgacaaugcaaac

SEQ ID NO: 3491213 - RNA, 15 nt, Human
acucgcgcucaguaa

SEQ ID NO: 3491214 - RNA, 16 nt, Human
acucgcgcucaguaaa

SEQ ID NO: 3491215 - RNA, 15 nt, Human
acucgcuucccccau

SEQ ID NO: 3491216 - RNA, 20 nt, Human
acucgcuucccccauagcca

SEQ ID NO: 3491217 - RNA, 16 nt, Human
acucgcuucucuguga

SEQ ID NO: 3491218 - RNA, 22 nt, Human
acucggccucccaaagugcugg

SEQ ID NO: 3491219 - RNA, 16 nt, Human
acucggcucugcaguc

SEQ ID NO: 3491220 - RNA, 20 nt, Human
acucggguuucucuguggcu

SEQ ID NO: 3491221 - RNA, 22 nt, Human
acucgugucuggcacagccugg

SEQ ID NO: 3491222 - RNA, 20 nt, Human
agaguucccuugaaacuuug

SEQ ID NO: 3491223 - RNA, 20 nt, Human
agaguucuauacuguaaagc

SEQ ID NO: 3491224 - RNA, 20 nt, Human
agaguucuuuuugaaguauu

SEQ ID NO: 3491225 - RNA, 12 nt, Human
agaguugaaccu

SEQ ID NO: 3491226 - RNA, 19 nt, Human
agaguugaggaacuguaca

SEQ ID NO: 3491227 - RNA, 20 nt, Human
agaguugaugguuguacaua

SEQ ID NO: 3491228 - RNA, 19 nt, Human
agaguugggacaauugcuu

SEQ ID NO: 3491229 - RNA, 13 nt, Human
agaguuguaaaua

SEQ ID NO: 3491230 - RNA, 21 nt, Human
agaguuguaaauauauaaaua

SEQ ID NO: 3491231 - RNA, 12 nt, Human
agaguuguuaca

SEQ ID NO: 3491232 - RNA, 19 nt, Human
agaguuguuacauuuuuaa

SEQ ID NO: 3491233 - RNA, 21 nt, Human
agaguuguuacauuuuuaagu

SEQ ID NO: 3491234 - RNA, 22 nt, Human
agaguuuaacacaaguccugug

SEQ ID NO: 3491235 - RNA, 15 nt, Human
agaguuuagcccuga

SEQ ID NO: 3491236 - RNA, 16 nt, Human
agaguuuagcuggaaa

SEQ ID NO: 3491237 - RNA, 23 nt, Human
agaguuuagcuguaacaguucuu

SEQ ID NO: 3491238 - RNA, 16 nt, Human
agaguuucaaccauga

SEQ ID NO: 3491239 - RNA, 13 nt, Human
agaguuuccugaa

SEQ ID NO: 3491240 - RNA, 19 nt, Human
agaguuucguggcuucagg

SEQ ID NO: 3491241 - RNA, 23 nt, Human
agaguuugaugaggcccuccaca

SEQ ID NO: 3491242 - RNA, 17 nt, Human
agaguuugccuuauaaa

SEQ ID NO: 3491243 - RNA, 16 nt, Human
agaguuugguuugguc

SEQ ID NO: 3491244 - RNA, 19 nt, Human
agaguuuguguguugucuu

SEQ ID NO: 3491245 - RNA, 17 nt, Human
agaguuuuggaugcagu

SEQ ID NO: 3491246 - RNA, 20 nt, Human
agaguuuuggaugcagugcu

SEQ ID NO: 3491247 - RNA, 21 nt, Human
agaguuuuggaugcagugcuc

SEQ ID NO: 3491248 - RNA, 12 nt, Human
agaguuuuggga

SEQ ID NO: 3491249 - RNA, 17 nt, Human
agauaaaaaaacagcuu

SEQ ID NO: 3491250 - RNA, 21 nt, Human
agauaaaaagauggccuuugc

SEQ ID NO: 3491251 - RNA, 16 nt, Human
agauaaaaaguggaau

SEQ ID NO: 3491252 - RNA, 17 nt, Human
agauaaaaaguggaauu

SEQ ID NO: 3491253 - RNA, 22 nt, Human
agauaaaauuauagaugggaau

SEQ ID NO: 3491254 - RNA, 14 nt, Human
agauaaacacaaga

SEQ ID NO: 3491255 - RNA, 15 nt, Human
agauaaacacaagau

SEQ ID NO: 3491256 - RNA, 21 nt, Human
agauaaacacagcugcuuucu

SEQ ID NO: 3491257 - RNA, 11 nt, Human
agauaaagaug

SEQ ID NO: 3491258 - RNA, 15 nt, Human
agauaaagaugaucu

SEQ ID NO: 3491259 - RNA, 12 nt, Human
agauaaauauua

SEQ ID NO: 3491260 - RNA, 21 nt, Human
agauaacaaugcagcaaggcc

SEQ ID NO: 3491261 - RNA, 13 nt, Human
agauaacuaggaa

SEQ ID NO: 3491262 - RNA, 20 nt, Human
agauaacuguuauuuauaau

SEQ ID NO: 3491263 - RNA, 12 nt, Human
agauaagacaua

SEQ ID NO: 3491264 - RNA, 13 nt, Human
agauaagcaagag

SEQ ID NO: 3491265 - RNA, 16 nt, Human
agauaagcaagagaga

SEQ ID NO: 3491266 - RNA, 16 nt, Human
agauaaguguauuuuu

SEQ ID NO: 3491267 - RNA, 18 nt, Human
agauaaguguauuuuuca

SEQ ID NO: 3491268 - RNA, 16 nt, Human
agauaaguuggaaaca

SEQ ID NO: 3491269 - RNA, 19 nt, Human
agauaaguuggaaacacua

SEQ ID NO: 3491270 - RNA, 21 nt, Human
agauaaguuggaaacacuaaa

SEQ ID NO: 3491271 - RNA, 16 nt, Human
agauaauaauauaugu

SEQ ID NO: 3491272 - RNA, 14 nt, Human
agauaaucagccuc

SEQ ID NO: 3491273 - RNA, 13 nt, Human
agauaaucccugu

SEQ ID NO: 3491274 - RNA, 23 nt, Human
agauaaucuagaacacaggcaaa

SEQ ID NO: 3491275 - RNA, 19 nt, Human
agauaaucuuagcugccaa

SEQ ID NO: 3491276 - RNA, 18 nt, Human
agauaaugugaaaauggu

SEQ ID NO: 3491277 - RNA, 19 nt, Human
agauaauuacugccuugaa

SEQ ID NO: 3491278 - RNA, 14 nt, Human
agauaauugcuauu

SEQ ID NO: 3491279 - RNA, 19 nt, Human
agauacaggaaaagcugcu

SEQ ID NO: 3491280 - RNA, 22 nt, Human
agauacaguuacucagaauucu

SEQ ID NO: 3491281 - RNA, 14 nt, Human
agauacauacagaa

SEQ ID NO: 3491282 - RNA, 17 nt, Human
agauacaucacagucac

SEQ ID NO: 3491283 - RNA, 15 nt, Human
agauaccaucagcaa

SEQ ID NO: 3491284 - RNA, 14 nt, Human
agauaccuaaaaca

SEQ ID NO: 3491285 - RNA, 14 nt, Human
agauaccucacccu

SEQ ID NO: 3491286 - RNA, 20 nt, Human
agauaccuuaaaauuugaaa

SEQ ID NO: 3491287 - RNA, 22 nt, Human
agauaccuuaucuuacaauauu

SEQ ID NO: 3491288 - RNA, 19 nt, Human
agauacugcuacuguaauu

SEQ ID NO: 3491289 - RNA, 16 nt, Human
agauacugcuguguaa

SEQ ID NO: 3491290 - RNA, 22 nt, Human
agauacugcuguguaaugguua

SEQ ID NO: 3491291 - RNA, 16 nt, Human
agauacuguaucauga

SEQ ID NO: 3491292 - RNA, 16 nt, Human
agauacuuaagugcug

SEQ ID NO: 3491293 - RNA, 22 nt, Human
agauacuuggucacagccaggc

SEQ ID NO: 3491294 - RNA, 22 nt, Human
agauacuuuguauuguccuauu

SEQ ID NO: 3491295 - RNA, 14 nt, Human
agauagaagaacug

SEQ ID NO: 3491296 - RNA, 16 nt, Human
agauagaagaacugca

SEQ ID NO: 3491297 - RNA, 12 nt, Human
agauagaaugac

SEQ ID NO: 3491298 - RNA, 14 nt, Human
agauagacaggucc

SEQ ID NO: 3491299 - RNA, 15 nt, Human
agauagacagguccu

SEQ ID NO: 3491300 - RNA, 18 nt, Human
agauagagaguuguugug

SEQ ID NO: 3491301 - RNA, 17 nt, Human
agauagcauugugaacu

SEQ ID NO: 3491302 - RNA, 20 nt, Human
agauagccaaggccaaagga

SEQ ID NO: 3491303 - RNA, 19 nt, Human
agauagccccacaggaggu

SEQ ID NO: 3491304 - RNA, 15 nt, Human
agauagcccuguccu

SEQ ID NO: 3491305 - RNA, 17 nt, Human
agauagcccuguccugg

SEQ ID NO: 3491306 - RNA, 18 nt, Human
agauagcccuguccuggu

SEQ ID NO: 3491307 - RNA, 18 nt, Human
agauagccuguggcccug

SEQ ID NO: 3491308 - RNA, 14 nt, Human
agauagcugcaugu

SEQ ID NO: 3491309 - RNA, 21 nt, Human
agauagcugcauguggcuuuu

SEQ ID NO: 3491310 - RNA, 14 nt, Human
agauagcugugacu

SEQ ID NO: 3491311 - RNA, 14 nt, Human
agauaggaccuugg

SEQ ID NO: 3491312 - RNA, 12 nt, Human
agauaggccugu

SEQ ID NO: 3491313 - RNA, 22 nt, Human
agauaggcucugcacagaugga

SEQ ID NO: 3491314 - RNA, 15 nt, Human
agauagggcugggca

SEQ ID NO: 3491315 - RNA, 14 nt, Human
agauaguacauaaa

SEQ ID NO: 3491316 - RNA, 19 nt, Human
agauaguaucuagcaauca

SEQ ID NO: 3491317 - RNA, 21 nt, Human
agauaguaugcacuauauaca

SEQ ID NO: 3491318 - RNA, 21 nt, Human
agauaguccauaauguucugc

SEQ ID NO: 3491319 - RNA, 21 nt, Human
agauagucuuggaagcuguuu

SEQ ID NO: 3491320 - RNA, 23 nt, Human
agauaguuuugccagaacaguuu

SEQ ID NO: 3491321 - RNA, 16 nt, Human
agauauaagugcugua

SEQ ID NO: 3491322 - RNA, 17 nt, Human
agauauaagugcuguau

SEQ ID NO: 3491323 - RNA, 21 nt, Human
agauauaagugcuguauaaaa

SEQ ID NO: 3491324 - RNA, 19 nt, Human
agauauaaugaacaaaauu

SEQ ID NO: 3491325 - RNA, 19 nt, Human
agauauacuggaacccuuu

SEQ ID NO: 3491326 - RNA, 15 nt, Human
agauauacuuguuuu

SEQ ID NO: 3491327 - RNA, 13 nt, Human
agauauauaucau

SEQ ID NO: 3491328 - RNA, 14 nt, Human
agauauauauucau

SEQ ID NO: 3491329 - RNA, 18 nt, Human
agauauaucugaaaacug

SEQ ID NO: 3491330 - RNA, 18 nt, Human
agauauauuaaaaauaua

SEQ ID NO: 3491331 - RNA, 19 nt, Human
agauauauuaaaaauauaa

SEQ ID NO: 3491332 - RNA, 17 nt, Human
agauauauuuuuaagau

SEQ ID NO: 3491333 - RNA, 20 nt, Human
agauauauuuuuaagauaau

SEQ ID NO: 3491334 - RNA, 23 nt, Human
agauauauuuuuaagauaauaau

SEQ ID NO: 3491335 - RNA, 14 nt, Human
agauauauuuuuca

SEQ ID NO: 3491336 - RNA, 17 nt, Human
agauauccucugcuuaa

SEQ ID NO: 3491337 - RNA, 17 nt, Human
agauaucugagggagga

SEQ ID NO: 3491338 - RNA, 23 nt, Human
agauaucuugaaaugaaaguaua

SEQ ID NO: 3491339 - RNA, 14 nt, Human
agauaucuuuucuu

SEQ ID NO: 3491340 - RNA, 18 nt, Human
agauaucuuuucuuuaga

SEQ ID NO: 3491341 - RNA, 14 nt, Human
agauaucuuuuuau

SEQ ID NO: 3491342 - RNA, 22 nt, Human
agauaucuuuuuauugaugugc

SEQ ID NO: 3491343 - RNA, 14 nt, Human
agauaugaauauau

SEQ ID NO: 3491344 - RNA, 14 nt, Human
agauaugauucaaa

SEQ ID NO: 3491345 - RNA, 15 nt, Human
agauaugauucaaau

SEQ ID NO: 3491346 - RNA, 13 nt, Human
agauaugcaaaag

SEQ ID NO: 3491347 - RNA, 16 nt, Human
agauaugugaagaaaa

SEQ ID NO: 3491348 - RNA, 22 nt, Human
agauauuaaaugauguuuuauu

SEQ ID NO: 3491349 - RNA, 21 nt, Human
agauauuacuacuuaccauuu

SEQ ID NO: 3491350 - RNA, 15 nt, Human
agauauuacuuuauc

SEQ ID NO: 3491351 - RNA, 17 nt, Human
agauauuacuuuaucac

SEQ ID NO: 3491352 - RNA, 12 nt, Human
agauauuauuca

SEQ ID NO: 3491353 - RNA, 18 nt, Human
agauauuccuauugugca

SEQ ID NO: 3491354 - RNA, 20 nt, Human
agauauugaggccaagaaua

SEQ ID NO: 3491355 - RNA, 17 nt, Human
agauauuggacaaagaa

SEQ ID NO: 3491356 - RNA, 22 nt, Human
agauauugucagaguucugcuc

SEQ ID NO: 3491357 - RNA, 18 nt, Human
agauauugugaaguacau

SEQ ID NO: 3491358 - RNA, 19 nt, Human
agauauuguucaaacaaua

SEQ ID NO: 3491359 - RNA, 13 nt, Human
agauauuuauaua

SEQ ID NO: 3491360 - RNA, 13 nt, Human
agauauuugcacc

SEQ ID NO: 3491361 - RNA, 11 nt, Human
agauauuuggc

SEQ ID NO: 3491362 - RNA, 12 nt, Human
agauauuuggcu

SEQ ID NO: 3491363 - RNA, 16 nt, Human
agauauuuggcuuaaa

SEQ ID NO: 3491364 - RNA, 20 nt, Human
agauauuuggcuuaaauaua

SEQ ID NO: 3491365 - RNA, 20 nt, Human
agauauuuugcuuugugauu

SEQ ID NO: 3491366 - RNA, 19 nt, Human
agauauuuugggcaugugg

SEQ ID NO: 3491367 - RNA, 20 nt, Human
agauauuuuguaaaauguau

SEQ ID NO: 3491368 - RNA, 21 nt, Human
agauauuuuguaaaauguauu

SEQ ID NO: 3491369 - RNA, 16 nt, Human
agauauuuuucauaaa

SEQ ID NO: 3491370 - RNA, 18 nt, Human
agauauuuuuucagaaau

SEQ ID NO: 3491371 - RNA, 22 nt, Human
agauauuuuuucagaaauaugu

SEQ ID NO: 3491372 - RNA, 19 nt, Human
agauaaagaccagaaauuc

SEQ ID NO: 3491373 - RNA, 13 nt, Human
agauaaagaugau

SEQ ID NO: 3491374 - RNA, 13 nt, Human
agauaaagccaga

SEQ ID NO: 3491375 - RNA, 13 nt, Human
agauaaaggacag

SEQ ID NO: 3491376 - RNA, 14 nt, Human
agauaaaucuagua

SEQ ID NO: 3491377 - RNA, 16 nt, Human
agauaaaugauucaaa

SEQ ID NO: 3491378 - RNA, 13 nt, Human
agauaaauuauaa

SEQ ID NO: 3491379 - RNA, 18 nt, Human
agauaacugaaaauuauu

SEQ ID NO: 3491380 - RNA, 14 nt, Human
agauaacugagaau

SEQ ID NO: 3491381 - RNA, 16 nt, Human
agauaacuguuauuua

SEQ ID NO: 3491382 - RNA, 17 nt, Human
agauaagcaagagagau

SEQ ID NO: 3491383 - RNA, 22 nt, Human
agauaagcaagagagauguuuu

SEQ ID NO: 3491384 - RNA, 19 nt, Human
agauaaggguaucugguga

SEQ ID NO: 3491385 - RNA, 18 nt, Human
agauaagguaaaaugcca

SEQ ID NO: 3491386 - RNA, 15 nt, Human
agauaaguuggaaac

SEQ ID NO: 3491387 - RNA, 18 nt, Human
agauaaguuggaaacacu

SEQ ID NO: 3491388 - RNA, 18 nt, Human
agauaauacaccacuaca

SEQ ID NO: 3491389 - RNA, 15 nt, Human
agauaauaugagaau

SEQ ID NO: 3491390 - RNA, 15 nt, Human
agauaauauuacugu

SEQ ID NO: 3491391 - RNA, 16 nt, Human
agauaauauuacuguu

SEQ ID NO: 3491392 - RNA, 14 nt, Human
agauaauauuguuu

SEQ ID NO: 3491393 - RNA, 17 nt, Human
agauaauauuguuuggu

SEQ ID NO: 3491394 - RNA, 15 nt, Human
agauaaucagccucu

SEQ ID NO: 3491395 - RNA, 16 nt, Human
agauaaucagccucuu

SEQ ID NO: 3491396 - RNA, 12 nt, Human
agauaaugugaa

SEQ ID NO: 3491397 - RNA, 13 nt, Human
agauaaugugaaa

SEQ ID NO: 3491398 - RNA, 19 nt, Human
agauaaugugauauuauac

SEQ ID NO: 3491399 - RNA, 15 nt, Human
agauaauuaaaaaga

SEQ ID NO: 3491400 - RNA, 19 nt, Human
agauaauuaccuacucugg

SEQ ID NO: 3491401 - RNA, 17 nt, Human
agauaauuacugccuug

SEQ ID NO: 3491402 - RNA, 12 nt, Human
agauaauuauaa

SEQ ID NO: 3491403 - RNA, 18 nt, Human
agauaauucuagcuuuga

SEQ ID NO: 3491404 - RNA, 14 nt, Human
agauacaaauuaau

SEQ ID NO: 3491405 - RNA, 18 nt, Human
agauacaaauuaauuuua

SEQ ID NO: 3491406 - RNA, 13 nt, Human
agauacaauaaau

SEQ ID NO: 3491407 - RNA, 21 nt, Human
agauacaaucagcugcuuugu

SEQ ID NO: 3491408 - RNA, 20 nt, Human
agauacaggaaaagcugcug

SEQ ID NO: 3491409 - RNA, 21 nt, Human
agauacaggaaaagcugcuga

SEQ ID NO: 3491410 - RNA, 21 nt, Human
agauacaugguugugaccuga

SEQ ID NO: 3491411 - RNA, 15 nt, Human
agauaccaagcaugu

SEQ ID NO: 3491412 - RNA, 14 nt, Human
agauaccagcgagg

SEQ ID NO: 3491413 - RNA, 19 nt, Human
agauaccagcgaggaggcu

SEQ ID NO: 3491414 - RNA, 23 nt, Human
agauaccagcgaggaggcuccag

SEQ ID NO: 3491415 - RNA, 18 nt, Human
agauaccagguugaaaga

SEQ ID NO: 3491416 - RNA, 20 nt, Human
agcaaugacaucucaggggc

SEQ ID NO: 3491417 - RNA, 20 nt, Human
agcaaugauguccagaagaa

SEQ ID NO: 3491418 - RNA, 13 nt, Human
agcaaugcauuuu

SEQ ID NO: 3491419 - RNA, 21 nt, Human
agcaaugcccguaaugcuuag

SEQ ID NO: 3491420 - RNA, 22 nt, Human
agcaaugcugaugaaucacugu

SEQ ID NO: 3491421 - RNA, 15 nt, Human
agcaaugucugugcu

SEQ ID NO: 3491422 - RNA, 23 nt, Human
agcaauuccaugcuauaaaaacu

SEQ ID NO: 3491423 - RNA, 13 nt, Human
agauuuuccuucc

SEQ ID NO: 3491424 - RNA, 16 nt, Human
agauuuucugguucua

SEQ ID NO: 3491425 - RNA, 14 nt, Human
agauuuucuuuaaa

SEQ ID NO: 3491426 - RNA, 18 nt, Human
agauuuucuuuaaaagaa

SEQ ID NO: 3491427 - RNA, 22 nt, Human
agauuuucuuuugccuuuugca

SEQ ID NO: 3491428 - RNA, 12 nt, Human
agauuuugaaaa

SEQ ID NO: 3491429 - RNA, 17 nt, Human
agauuuugaaaacuaca

SEQ ID NO: 3491430 - RNA, 19 nt, Human
agauuuugagguaaagaua

SEQ ID NO: 3491431 - RNA, 18 nt, Human
agauuuugauaacuguuu

SEQ ID NO: 3491432 - RNA, 19 nt, Human
agauuuugauagcaaagcg

SEQ ID NO: 3491433 - RNA, 16 nt, Human
agauuuugcuuuucca

SEQ ID NO: 3491434 - RNA, 18 nt, Human
agauuuuguguuuauucu

SEQ ID NO: 3491435 - RNA, 19 nt, Human
agauuuuguguuuauucuu

SEQ ID NO: 3491436 - RNA, 22 nt, Human
agauuuuguguuuauucuugau

SEQ ID NO: 3491437 - RNA, 23 nt, Human
agauuuuguguuuauucuugaug

SEQ ID NO: 3491438 - RNA, 22 nt, Human
agauuuuguuuugcuuuuucug

SEQ ID NO: 3491439 - RNA, 17 nt, Human
agauuuuucaugauuuu

SEQ ID NO: 3491440 - RNA, 21 nt, Human
agauuuuucggaggccccacu

SEQ ID NO: 3491441 - RNA, 13 nt, Human
agauuuuucucaa

SEQ ID NO: 3491442 - RNA, 13 nt, Human
agauuuuugcaau

SEQ ID NO: 3491443 - RNA, 16 nt, Human
agauuuuuuaauaauu

SEQ ID NO: 3491444 - RNA, 17 nt, Human
agauuuuuuaauuguuu

SEQ ID NO: 3491445 - RNA, 23 nt, Human
agauuuuuuaauuguuuaaaaac

SEQ ID NO: 3491446 - RNA, 13 nt, Human
agauuuuuuauug

SEQ ID NO: 3491447 - RNA, 16 nt, Human
agauuuuuucagacuu

SEQ ID NO: 3491448 - RNA, 23 nt, Human
agcaaaaaaaaaaaaaagcaucu

SEQ ID NO: 3491449 - RNA, 23 nt, Human
agcaaaaaaaacccaugugguga

SEQ ID NO: 3491450 - RNA, 14 nt, Human
agcaaaaaagaguu

SEQ ID NO: 3491451 - RNA, 14 nt, Human
agcaaaaacaugua

SEQ ID NO: 3491452 - RNA, 22 nt, Human
agcaaaaaguggggcagagccu

SEQ ID NO: 3491453 - RNA, 16 nt, Human
agcaaaaauauaaaau

SEQ ID NO: 3491454 - RNA, 15 nt, Human
agcaaaaauauuuua

SEQ ID NO: 3491455 - RNA, 20 nt, Human
agcaaaaaugcuaauauuaa

SEQ ID NO: 3491456 - RNA, 17 nt, Human
agcaaaaccauugcuuc

SEQ ID NO: 3491457 - RNA, 22 nt, Human
agcaaaaccauugcuucacuac

SEQ ID NO: 3491458 - RNA, 12 nt, Human
agcaaaagaaaa

SEQ ID NO: 3491459 - RNA, 11 nt, Human
agcaaaaggca

SEQ ID NO: 3491460 - RNA, 15 nt, Human
agcaaaaucaagaga

SEQ ID NO: 3491461 - RNA, 20 nt, Human
agcaaaaucaagcaagccuc

SEQ ID NO: 3491462 - RNA, 15 nt, Human
agcaaaaucuaccag

SEQ ID NO: 3491463 - RNA, 20 nt, Human
agcaaaaugcauguaaucaa

SEQ ID NO: 3491464 - RNA, 14 nt, Human
agcaaaaugugaau

SEQ ID NO: 3491465 - RNA, 13 nt, Human
agcaaacagagga

SEQ ID NO: 3491466 - RNA, 15 nt, Human
agcaaaccaagagau

SEQ ID NO: 3491467 - RNA, 19 nt, Human
agcaaaccaagagauugcu

SEQ ID NO: 3491468 - RNA, 17 nt, Human
agcaaacccugucaaac

SEQ ID NO: 3491469 - RNA, 13 nt, Human
agcaaaccuguaa

SEQ ID NO: 3491470 - RNA, 19 nt, Human
agcaaacuaacuugacuuu

SEQ ID NO: 3491471 - RNA, 13 nt, Human
agcaaacucugcu

SEQ ID NO: 3491472 - RNA, 15 nt, Human
agcaaacucugcugu

SEQ ID NO: 3491473 - RNA, 13 nt, Human
agcaaacucuuuu

SEQ ID NO: 3491474 - RNA, 22 nt, Human
agcaaacugcaugcccagagac

SEQ ID NO: 3491475 - RNA, 18 nt, Human
agcaaagaggacucgcuu

SEQ ID NO: 3491476 - RNA, 12 nt, Human
agcaaagagugg

SEQ ID NO: 3491477 - RNA, 13 nt, Human
agcaaagcacaga

SEQ ID NO: 3491478 - RNA, 15 nt, Human
agcaaagcaccagcu

SEQ ID NO: 3491479 - RNA, 19 nt, Human
agcaaagcacccauuucaa

SEQ ID NO: 3491480 - RNA, 20 nt, Human
agcaaagcacccauuucaau

SEQ ID NO: 3491481 - RNA, 19 nt, Human
agcaaagccccaugcugga

SEQ ID NO: 3491482 - RNA, 21 nt, Human
agcaaagccccaugcuggagc

SEQ ID NO: 3491483 - RNA, 12 nt, Human
agcaaagccugu

SEQ ID NO: 3491484 - RNA, 20 nt, Human
agcaaagcggguuauaauga

SEQ ID NO: 3491485 - RNA, 21 nt, Human
agcaaaggagauuggaaggaa

SEQ ID NO: 3491486 - RNA, 19 nt, Human
agcaaaggcugagaacacu

SEQ ID NO: 3491487 - RNA, 20 nt, Human
agcaaaguagaucaugcaua

SEQ ID NO: 3491488 - RNA, 22 nt, Human
agcaaagucuaaaguuuacagu

SEQ ID NO: 3491489 - RNA, 15 nt, Human
agcaaauacuuagca

SEQ ID NO: 3491490 - RNA, 21 nt, Human
agcaaauaucauacuguucaa

SEQ ID NO: 3491491 - RNA, 23 nt, Human
agcaaaucaccacaaacuguaau

SEQ ID NO: 3491492 - RNA, 19 nt, Human
agcaaaucauuuguuuaaa

SEQ ID NO: 3491493 - RNA, 20 nt, Human
agcaaaucgaaugaaauuaa

SEQ ID NO: 3491494 - RNA, 22 nt, Human
agcaaaugcaaaaacucuuuga

SEQ ID NO: 3491495 - RNA, 20 nt, Human
agcaaaugucaugcugccuu

SEQ ID NO: 3491496 - RNA, 20 nt, Human
agcaaauguuacauagugua

SEQ ID NO: 3491497 - RNA, 18 nt, Human
agcaaauguuucugcagu

SEQ ID NO: 3491498 - RNA, 15 nt, Human
agcaaauuaauuggc

SEQ ID NO: 3491499 - RNA, 22 nt, Human
agcaaauuaauuggcagcagau

SEQ ID NO: 3491500 - RNA, 19 nt, Human
agcaaauucuguuuuucua

SEQ ID NO: 3491501 - RNA, 11 nt, Human
agcaaauugau

SEQ ID NO: 3491502 - RNA, 19 nt, Human
agcaaauuucaaaagacau

SEQ ID NO: 3491503 - RNA, 12 nt, Human
agcaaauuuggg

SEQ ID NO: 3491504 - RNA, 13 nt, Human
agcaacaaagaaa

SEQ ID NO: 3491505 - RNA, 12 nt, Human
agcaacaauaaa

SEQ ID NO: 3491506 - RNA, 14 nt, Human
agcaacaauuuuca

SEQ ID NO: 3491507 - RNA, 17 nt, Human
agcaacaauuuucagau

SEQ ID NO: 3491508 - RNA, 16 nt, Human
agcaacacaaagcuuu

SEQ ID NO: 3491509 - RNA, 21 nt, Human
agcaacacaaagcuuuugcau

SEQ ID NO: 3491510 - RNA, 14 nt, Human
agcaacacaagcug

SEQ ID NO: 3491511 - RNA, 17 nt, Human
agcaacacaagcuggaa

SEQ ID NO: 3491512 - RNA, 22 nt, Human
agcaacacagaggaauuuauac

SEQ ID NO: 3491513 - RNA, 13 nt, Human
agcaacagaaaaa

SEQ ID NO: 3491514 - RNA, 16 nt, Human
agcaacagaaaaaugg

SEQ ID NO: 3491515 - RNA, 23 nt, Human
agcaacagagugagacccugucu

SEQ ID NO: 3491516 - RNA, 14 nt, Human
agcaacaggaaaaa

SEQ ID NO: 3491517 - RNA, 22 nt, Human
agcaacaggaaucaagagcugc

SEQ ID NO: 3491518 - RNA, 18 nt, Human
agcaacagguuuuauaau

SEQ ID NO: 3491519 - RNA, 20 nt, Human
agcaacauuuuacccacaca

SEQ ID NO: 3491520 - RNA, 17 nt, Human
agcaaccagagcacugu

SEQ ID NO: 3491521 - RNA, 15 nt, Human
agcaaccccaggcug

SEQ ID NO: 3491522 - RNA, 21 nt, Human
agcaaccccuggaccccagcc

SEQ ID NO: 3491523 - RNA, 23 nt, Human
agcaaccccuggaccccagccuc

SEQ ID NO: 3491524 - RNA, 19 nt, Human
agcaaccgccucaaaaugu

SEQ ID NO: 3491525 - RNA, 18 nt, Human
agcaaccgguggauccuc

SEQ ID NO: 3491526 - RNA, 20 nt, Human
agcaaccguggcccuuccug

SEQ ID NO: 3491527 - RNA, 23 nt, Human
agcaaccguggcccuuccuggac

SEQ ID NO: 3491528 - RNA, 15 nt, Human
agcaaccucaguaau

SEQ ID NO: 3491529 - RNA, 18 nt, Human
agcaaccuggguccaaau

SEQ ID NO: 3491530 - RNA, 22 nt, Human
agcaaccuggguccaaauaaaa

SEQ ID NO: 3491531 - RNA, 15 nt, Human
agcaaccuguagagu

SEQ ID NO: 3491532 - RNA, 22 nt, Human
agcaaccuuucaccuuugugua

SEQ ID NO: 3491533 - RNA, 18 nt, Human
agcaacgaucacaaauga

SEQ ID NO: 3491534 - RNA, 21 nt, Human
agcaacgaucacaaaugacuu

SEQ ID NO: 3491535 - RNA, 14 nt, Human
agcaacgcaggccc

SEQ ID NO: 3491536 - RNA, 23 nt, Human
agcaacucuaagacuacagcaca

SEQ ID NO: 3491537 - RNA, 14 nt, Human
agcaacucuugauu

SEQ ID NO: 3491538 - RNA, 20 nt, Human
agcaacucuugauuauccau

SEQ ID NO: 3491539 - RNA, 23 nt, Human
agcaacugaauaaauaccucuua

SEQ ID NO: 3491540 - RNA, 15 nt, Human
agcaacuucuucucc

SEQ ID NO: 3491541 - RNA, 16 nt, Human
agcaacuucuucucca

SEQ ID NO: 3491542 - RNA, 18 nt, Human
agcaacuucuucuccauc

SEQ ID NO: 3491543 - RNA, 14 nt, Human
agcaacuuguccua

SEQ ID NO: 3491544 - RNA, 21 nt, Human
agcaacuugucuuuuucugga

SEQ ID NO: 3491545 - RNA, 16 nt, Human
agcaagaaaaaaaaau

SEQ ID NO: 3491546 - RNA, 19 nt, Human
agcaagaaaaaaaaaugcc

SEQ ID NO: 3491547 - RNA, 12 nt, Human
agcaagaaagaa

SEQ ID NO: 3491548 - RNA, 18 nt, Human
agcaagaagggaguucca

SEQ ID NO: 3491549 - RNA, 21 nt, Human
agcaagaauaaaaaagaaauc

SEQ ID NO: 3491550 - RNA, 14 nt, Human
agcaagacauuaua

SEQ ID NO: 3491551 - RNA, 22 nt, Human
agcaagacgcugugcugcccug

SEQ ID NO: 3491552 - RNA, 12 nt, Human
agcaagacucug

SEQ ID NO: 3491553 - RNA, 17 nt, Human
agcaagacuguuagccc

SEQ ID NO: 3491554 - RNA, 22 nt, Human
agcaagacuucucuuugccuca

SEQ ID NO: 3491555 - RNA, 23 nt, Human
agcaagacuucucuuugccucaa

SEQ ID NO: 3491556 - RNA, 23 nt, Human
agcaagagagaaccuaacuguau

SEQ ID NO: 3491557 - RNA, 23 nt, Human
agcaagagagcagcaaggucuug

SEQ ID NO: 3491558 - RNA, 19 nt, Human
agcaagaggccguggcugc

SEQ ID NO: 3491559 - RNA, 19 nt, Human
agcacuagccaaaccucac

SEQ ID NO: 3491560 - RNA, 14 nt, Human
agcacuauacagau

SEQ ID NO: 3491561 - RNA, 18 nt, Human
agcacuaugcuuuccuuc

SEQ ID NO: 3491562 - RNA, 14 nt, Human
agcacucacacagg

SEQ ID NO: 3491563 - RNA, 14 nt, Human
agcacucccaaguc

SEQ ID NO: 3491564 - RNA, 20 nt, Human
agcacuccucccugauguac

SEQ ID NO: 3491565 - RNA, 16 nt, Human
agcacuccugcuuaau

SEQ ID NO: 3491566 - RNA, 14 nt, Human
agcacucgugugca

SEQ ID NO: 3491567 - RNA, 10 nt, Human
agcacugaaa

SEQ ID NO: 3491568 - RNA, 11 nt, Human
agcacugaaaa

SEQ ID NO: 3491569 - RNA, 16 nt, Human
agcacugacuucuaag

SEQ ID NO: 3491570 - RNA, 19 nt, Human
agcacugacuucuaaguaa

SEQ ID NO: 3491571 - RNA, 12 nt, Human
agcacugagcaa

SEQ ID NO: 3491572 - RNA, 16 nt, Human
agcacugagcaaagca

SEQ ID NO: 3491573 - RNA, 14 nt, Human
agcacugaggaaga

SEQ ID NO: 3491574 - RNA, 14 nt, Human
agcacugccaggag

SEQ ID NO: 3491575 - RNA, 13 nt, Human
agcacugccugcu

SEQ ID NO: 3491576 - RNA, 12 nt, Human
agcacugcucca

SEQ ID NO: 3491577 - RNA, 19 nt, Human
agcacuggagugcagggag

SEQ ID NO: 3491578 - RNA, 13 nt, Human
agcacuggccugc

SEQ ID NO: 3491579 - RNA, 15 nt, Human
agcacuggccugcac

SEQ ID NO: 3491580 - RNA, 17 nt, Human
agcacuggccugcacgg

SEQ ID NO: 3491581 - RNA, 13 nt, Human
agcacuggcucuc

SEQ ID NO: 3491582 - RNA, 14 nt, Human
agcacuggcucucu

SEQ ID NO: 3491583 - RNA, 17 nt, Human
agcacuggcucucucca

SEQ ID NO: 3491584 - RNA, 18 nt, Human
acuguuagaacacuauuu

SEQ ID NO: 3491585 - RNA, 13 nt, Human
acuguuagaaugu

SEQ ID NO: 3491586 - RNA, 14 nt, Human
acuguuagaaugua

SEQ ID NO: 3491587 - RNA, 16 nt, Human
acuguuagcacuguug

SEQ ID NO: 3491588 - RNA, 13 nt, Human
acuguuaucauuu

SEQ ID NO: 3491589 - RNA, 19 nt, Human
acuguuauucuuugcacuu

SEQ ID NO: 3491590 - RNA, 21 nt, Human
acuguuauuuauaaucacuuu

SEQ ID NO: 3491591 - RNA, 16 nt, Human
acuguucaagagcaca

SEQ ID NO: 3491592 - RNA, 20 nt, Human
acuguucaaugguucugaaa

SEQ ID NO: 3491593 - RNA, 18 nt, Human
acuguucccaccugcugg

SEQ ID NO: 3491594 - RNA, 16 nt, Human
acuguucccccugugc

SEQ ID NO: 3491595 - RNA, 16 nt, Human
acuguucccucugcuc

SEQ ID NO: 3491596 - RNA, 19 nt, Human
acuguucccugagguggga

SEQ ID NO: 3491597 - RNA, 23 nt, Human
acuguucggaagggguuccucaa

SEQ ID NO: 3491598 - RNA, 13 nt, Human
acuguucuaaagc

SEQ ID NO: 3491599 - RNA, 18 nt, Human
acuguucuaaagcucuga

SEQ ID NO: 3491600 - RNA, 18 nt, Human
acuguucucccuucggug

SEQ ID NO: 3491601 - RNA, 14 nt, Human
acuguucucugccc

SEQ ID NO: 3491602 - RNA, 18 nt, Human
acuguucucugcccucca

SEQ ID NO: 3491603 - RNA, 20 nt, Human
acuguucucugcccuccaag

SEQ ID NO: 3491604 - RNA, 13 nt, Human
acuguucuugaau

SEQ ID NO: 3491605 - RNA, 16 nt, Human
acuguucuugcugcua

SEQ ID NO: 3491606 - RNA, 20 nt, Human
acuguucuugcugcuagaac

SEQ ID NO: 3491607 - RNA, 21 nt, Human
acuguucuugcugcuagaacu

SEQ ID NO: 3491608 - RNA, 23 nt, Human
acuguucuugcugcuagaacuuu

SEQ ID NO: 3491609 - RNA, 13 nt, Human
acuguugaaaauu

SEQ ID NO: 3491610 - RNA, 14 nt, Human
acuguugaaaauua

SEQ ID NO: 3491611 - RNA, 21 nt, Human
acuguugaaaauuauuuuaaa

SEQ ID NO: 3491612 - RNA, 16 nt, Human
acuguugauaauucuu

SEQ ID NO: 3491613 - RNA, 17 nt, Human
acuguugauaauucuua

SEQ ID NO: 3491614 - RNA, 20 nt, Human
acuguugauaauucuuauuu

SEQ ID NO: 3491615 - RNA, 15 nt, Human
acuguugauguacug

SEQ ID NO: 3491616 - RNA, 13 nt, Human
acuguugauguau

SEQ ID NO: 3491617 - RNA, 10 nt, Human
acuguugcac

SEQ ID NO: 3491618 - RNA, 13 nt, Human
acuguugcacgug

SEQ ID NO: 3491619 - RNA, 22 nt, Human
acuguugcacguguguuuuucu

SEQ ID NO: 3491620 - RNA, 12 nt, Human
acuguugcccag

SEQ ID NO: 3491621 - RNA, 14 nt, Human
acuguugcccaggc

SEQ ID NO: 3491622 - RNA, 12 nt, Human
acuguugcucaa

SEQ ID NO: 3491623 - RNA, 12 nt, Human
acuguuggaaug

SEQ ID NO: 3491624 - RNA, 15 nt, Human
acuguuguaagaauu

SEQ ID NO: 3491625 - RNA, 21 nt, Human
acuguuguaagaauucugauu

SEQ ID NO: 3491626 - RNA, 22 nt, Human
acuguuguaagaauucugauug

SEQ ID NO: 3491627 - RNA, 19 nt, Human
acuguuguagaagacaaaa

SEQ ID NO: 3491628 - RNA, 15 nt, Human
acuguugucccugca

SEQ ID NO: 3491629 - RNA, 16 nt, Human
acuguugugaccugaa

SEQ ID NO: 3491630 - RNA, 22 nt, Human
acuguuuaaucauaguuacugu

SEQ ID NO: 3491631 - RNA, 19 nt, Human
acuguuuagauuugccaua

SEQ ID NO: 3491632 - RNA, 21 nt, Human
acuguuuauauguguugaaaa

SEQ ID NO: 3491633 - RNA, 20 nt, Human
acuguuuauuacuuccauga

SEQ ID NO: 3491634 - RNA, 16 nt, Human
acuguuuauucaacaa

SEQ ID NO: 3491635 - RNA, 19 nt, Human
acuguuucaaacuuuacua

SEQ ID NO: 3491636 - RNA, 17 nt, Human
acuguuuccugggcacg

SEQ ID NO: 3491637 - RNA, 13 nt, Human
acuguuuccuuca

SEQ ID NO: 3491638 - RNA, 23 nt, Human
acuguuucucuugagcuggccuc

SEQ ID NO: 3491639 - RNA, 19 nt, Human
acuguuucuugcuuguacc

SEQ ID NO: 3491640 - RNA, 21 nt, Human
acuguuucuugcuuguaccuc

SEQ ID NO: 3491641 - RNA, 23 nt, Human
acuguuugauauaccaaauuaaa

SEQ ID NO: 3491642 - RNA, 22 nt, Human
acuguuuggacuuuuauuuugg

SEQ ID NO: 3491643 - RNA, 15 nt, Human
acuguuugucuucuc

SEQ ID NO: 3491644 - RNA, 12 nt, Human
acuguuuguuau

SEQ ID NO: 3491645 - RNA, 13 nt, Human
acuguuuucaaau

SEQ ID NO: 3491646 - RNA, 17 nt, Human
acuguuuuccaguucau

SEQ ID NO: 3491647 - RNA, 17 nt, Human
acuguuuucuaguguau

SEQ ID NO: 3491648 - RNA, 18 nt, Human
acuguuuucuaguguauc

SEQ ID NO: 3491649 - RNA, 20 nt, Human
acuguuuucuaguguaucaa

SEQ ID NO: 3491650 - RNA, 12 nt, Human
acuguuuugaau

SEQ ID NO: 3491651 - RNA, 13 nt, Human
acuguuuuuaccc

SEQ ID NO: 3491652 - RNA, 23 nt, Human
acuguuuuuacccauauccccuc

SEQ ID NO: 3491653 - RNA, 19 nt, Human
acuguuuuuccauaguuuu

SEQ ID NO: 3491654 - RNA, 19 nt, Human
acuguuuuucggacaguuu

SEQ ID NO: 3491655 - RNA, 18 nt, Human
acuguuuuuuccugagcu

SEQ ID NO: 3491656 - RNA, 19 nt, Human
acuuaaaaaaaaaaaaaag

SEQ ID NO: 3491657 - RNA, 21 nt, Human
acuuaaaaaaaaaaaaaagcu

SEQ ID NO: 3491658 - RNA, 15 nt, Human
acuuaaaaaaugucc

SEQ ID NO: 3491659 - RNA, 16 nt, Human
acuuaaaaaaugucca

SEQ ID NO: 3491660 - RNA, 20 nt, Human
acuuaaaaagucugcauuac

SEQ ID NO: 3491661 - RNA, 14 nt, Human
acuuaaaaaugguu

SEQ ID NO: 3491662 - RNA, 23 nt, Human
acugaaguuugauaaauaguguu

SEQ ID NO: 3491663 - RNA, 23 nt, Human
acugaauaaauuguacagccggc

SEQ ID NO: 3491664 - RNA, 17 nt, Human
acugaauaccacucugu

SEQ ID NO: 3491665 - RNA, 20 nt, Human
acugaauaccacucuguaau

SEQ ID NO: 3491666 - RNA, 13 nt, Human
acugaaucuguac

SEQ ID NO: 3491667 - RNA, 12 nt, Human
acugaaugaggu

SEQ ID NO: 3491668 - RNA, 16 nt, Human
acugaaugcucugugc

SEQ ID NO: 3491669 - RNA, 22 nt, Human
acugaauuaaugacagagccag

SEQ ID NO: 3491670 - RNA, 13 nt, Human
acugaauuaugaa

SEQ ID NO: 3491671 - RNA, 15 nt, Human
acugaauuaugaaac

SEQ ID NO: 3491672 - RNA, 20 nt, Human
acugaauuaugaaacuuuug

SEQ ID NO: 3491673 - RNA, 12 nt, Human
acugaauuccaa

SEQ ID NO: 3491674 - RNA, 12 nt, Human
acugaauuucuu

SEQ ID NO: 3491675 - RNA, 23 nt, Human
acugaauuucuuuugccguuauu

SEQ ID NO: 3491676 - RNA, 16 nt, Human
acugaauuuuuaugug

SEQ ID NO: 3491677 - RNA, 17 nt, Human
acugaauuuuuuuguaa

SEQ ID NO: 3491678 - RNA, 20 nt, Human
acugaauuuuuuuguaauaa

SEQ ID NO: 3491679 - RNA, 16 nt, Human
acugacaaaucaaguu

SEQ ID NO: 3491680 - RNA, 13 nt, Human
acugacacaaagg

SEQ ID NO: 3491681 - RNA, 13 nt, Human
acugacacaggaa

SEQ ID NO: 3491682 - RNA, 22 nt, Human
acugacacccauguuucucugg

SEQ ID NO: 3491683 - RNA, 20 nt, Human
acugacacucccacccaguc

SEQ ID NO: 3491684 - RNA, 16 nt, Human
acugacagauuuccau

SEQ ID NO: 3491685 - RNA, 21 nt, Human
acugacaugcccucccuucuc

SEQ ID NO: 3491686 - RNA, 18 nt, Human
acugacauguggggccag

SEQ ID NO: 3491687 - RNA, 22 nt, Human
acugacauguggggccagguca

SEQ ID NO: 3491688 - RNA, 18 nt, Human
acugacauuguuggccaa

SEQ ID NO: 3491689 - RNA, 22 nt, Human
acugacauuguuggccaaagcc

SEQ ID NO: 3491690 - RNA, 13 nt, Human
acugacauuucuu

SEQ ID NO: 3491691 - RNA, 21 nt, Human
acugaccaauauuguacaguu

SEQ ID NO: 3491692 - RNA, 15 nt, Human
acugaccagcagcuu

SEQ ID NO: 3491693 - RNA, 23 nt, Human
acugaccagccuccaugcugccu

SEQ ID NO: 3491694 - RNA, 20 nt, Human
acugacccacagccucugcc

SEQ ID NO: 3491695 - RNA, 17 nt, Human
acugacccuuccagaca

SEQ ID NO: 3491696 - RNA, 17 nt, Human
acugaccggaggcaaaa

SEQ ID NO: 3491697 - RNA, 17 nt, Human
acugaccugguccacag

SEQ ID NO: 3491698 - RNA, 19 nt, Human
acugaccuugaugagcugu

SEQ ID NO: 3491699 - RNA, 21 nt, Human
acugaccuuggagagacacag

SEQ ID NO: 3491700 - RNA, 15 nt, Human
acugaccuuguaaaa

SEQ ID NO: 3491701 - RNA, 20 nt, Human
acugacuauucuugauguaa

SEQ ID NO: 3491702 - RNA, 22 nt, Human
acugacuauucuugauguaaaa

SEQ ID NO: 3491703 - RNA, 14 nt, Human
acugacuccuuaga

SEQ ID NO: 3491704 - RNA, 18 nt, Human
acugacucuuaagaagac

SEQ ID NO: 3491705 - RNA, 22 nt, Human
acugacuucuaaguaaaaccac

SEQ ID NO: 3491706 - RNA, 15 nt, Human
acugacuuuauccuc

SEQ ID NO: 3491707 - RNA, 13 nt, Human
acugacuuugcuu

SEQ ID NO: 3491708 - RNA, 15 nt, Human
acugacuuugcuugc

SEQ ID NO: 3491709 - RNA, 15 nt, Human
acugagaaaaccugu

SEQ ID NO: 3491710 - RNA, 21 nt, Human
acugagaaauuuauaaacuuu

SEQ ID NO: 3491711 - RNA, 19 nt, Human
acugagaauguaagaacua

SEQ ID NO: 3491712 - RNA, 21 nt, Human
acugagaggacagagagaaau

SEQ ID NO: 3491713 - RNA, 21 nt, Human
acugagcacccucuggauucu

SEQ ID NO: 3491714 - RNA, 16 nt, Human
acugagcacuguuuuc

SEQ ID NO: 3491715 - RNA, 17 nt, Human
acugagcacuguuuucu

SEQ ID NO: 3491716 - RNA, 13 nt, Human
acugagcagacug

SEQ ID NO: 3491717 - RNA, 14 nt, Human
acugagcagacugg

SEQ ID NO: 3491718 - RNA, 23 nt, Human
acugagcagacuggugagcagac

SEQ ID NO: 3491719 - RNA, 14 nt, Human
acugagccccgcag

SEQ ID NO: 3491720 - RNA, 20 nt, Human
acugagccccgcagaccucc

SEQ ID NO: 3491721 - RNA, 14 nt, Human
acugagccuuguaa

SEQ ID NO: 3491722 - RNA, 17 nt, Human
acugagcuucucuguga

SEQ ID NO: 3491723 - RNA, 16 nt, Human
acugagcuuggaagcu

SEQ ID NO: 3491724 - RNA, 22 nt, Human
acugaggaagaacggggcucuu

SEQ ID NO: 3491725 - RNA, 18 nt, Human
acugaggaaugaugaagc

SEQ ID NO: 3491726 - RNA, 20 nt, Human
acugaggaauuuucuuugug

SEQ ID NO: 3491727 - RNA, 15 nt, Human
acugaggcagacagc

SEQ ID NO: 3491728 - RNA, 15 nt, Human
acuuuuaaacugugu

SEQ ID NO: 3491729 - RNA, 17 nt, Human
acuuuuaaacuguguac

SEQ ID NO: 3491730 - RNA, 20 nt, Human
acuuuuaaacuguguacaua

SEQ ID NO: 3491731 - RNA, 18 nt, Human
acuuuuaaggauaaauca

SEQ ID NO: 3491732 - RNA, 19 nt, Human
acuuuuaaggauaaaucau

SEQ ID NO: 3491733 - RNA, 17 nt, Human
acuuuuaauaaacuuuu

SEQ ID NO: 3491734 - RNA, 13 nt, Human
acuuuuacaagua

SEQ ID NO: 3491735 - RNA, 13 nt, Human
acuuuuagaaacu

SEQ ID NO: 3491736 - RNA, 12 nt, Human
acuuuuagaugu

SEQ ID NO: 3491737 - RNA, 16 nt, Human
acuuuuaguaaaguca

SEQ ID NO: 3491738 - RNA, 22 nt, Human
acuuuuauaaacuuuaccuuuu

SEQ ID NO: 3491739 - RNA, 16 nt, Human
acuuuuauaaagcaug

SEQ ID NO: 3491740 - RNA, 15 nt, Human
acuuuuauaaauuaa

SEQ ID NO: 3491741 - RNA, 17 nt, Human
acuuuuauaaauuaaau

SEQ ID NO: 3491742 - RNA, 18 nt, Human
acuuuuauaaauuaaaua

SEQ ID NO: 3491743 - RNA, 15 nt, Human
acuuuuaugagcuuc

SEQ ID NO: 3491744 - RNA, 19 nt, Human
acuuuuaugauguauauuu

SEQ ID NO: 3491745 - RNA, 18 nt, Human
acuuuuauuugcaacauu

SEQ ID NO: 3491746 - RNA, 18 nt, Human
acuuuuauuuuacacaga

SEQ ID NO: 3491747 - RNA, 20 nt, Human
acuuuuauuuuacacagaaa

SEQ ID NO: 3491748 - RNA, 22 nt, Human
acuuuuauuuuacacagaaaca

SEQ ID NO: 3491749 - RNA, 16 nt, Human
acuuuucaaguauuua

SEQ ID NO: 3491750 - RNA, 12 nt, Human
acuuuucaguga

SEQ ID NO: 3491751 - RNA, 18 nt, Human
acuuuucauaucauuucu

SEQ ID NO: 3491752 - RNA, 10 nt, Human
acuuuucauu

SEQ ID NO: 3491753 - RNA, 14 nt, Human
acuuuuccaguauu

SEQ ID NO: 3491754 - RNA, 16 nt, Human
acuuuuccaguauuuu

SEQ ID NO: 3491755 - RNA, 14 nt, Human
acuuuucccacucc

SEQ ID NO: 3491756 - RNA, 15 nt, Human
acuuuucccacucca

SEQ ID NO: 3491757 - RNA, 17 nt, Human
acuuuuccucccucagu

SEQ ID NO: 3491758 - RNA, 13 nt, Human
acuuuuccuuccc

SEQ ID NO: 3491759 - RNA, 14 nt, Human
acuuuucuuugaag

SEQ ID NO: 3491760 - RNA, 14 nt, Human
acuuuucuuugugg

SEQ ID NO: 3491761 - RNA, 21 nt, Human
acuuuugagugugugugugca

SEQ ID NO: 3491762 - RNA, 14 nt, Human
acuuuugcaaauaa

SEQ ID NO: 3491763 - RNA, 15 nt, Human
acuuuugcaaauaag

SEQ ID NO: 3491764 - RNA, 22 nt, Human
acuuuugcuguaauguuaauau

SEQ ID NO: 3491765 - RNA, 13 nt, Human
acuuuugcuuuaa

SEQ ID NO: 3491766 - RNA, 21 nt, Human
acuuuuggaaccaugccuucc

SEQ ID NO: 3491767 - RNA, 14 nt, Human
acuuuuggaaggua

SEQ ID NO: 3491768 - RNA, 14 nt, Human
acuuuuggaaucua

SEQ ID NO: 3491769 - RNA, 14 nt, Human
acuuuuguacaucu

SEQ ID NO: 3491770 - RNA, 20 nt, Human
acuuuuguacaucuggcuua

SEQ ID NO: 3491771 - RNA, 22 nt, Human
acuuuugugaauuaggcuguaa

SEQ ID NO: 3491772 - RNA, 14 nt, Human
acuuuugugugaaa

SEQ ID NO: 3491773 - RNA, 23 nt, Human
acuuuuguucuugguuuguaaau

SEQ ID NO: 3491774 - RNA, 18 nt, Human
acuuuuuaaauguaaaga

SEQ ID NO: 3491775 - RNA, 17 nt, Human
acuuuuuauauuuuaua

SEQ ID NO: 3491776 - RNA, 22 nt, Human
acuuuuuauggcacuaguauuu

SEQ ID NO: 3491777 - RNA, 14 nt, Human
acuuuuuauugccu

SEQ ID NO: 3491778 - RNA, 14 nt, Human
acuuuuucuuuugu

SEQ ID NO: 3491779 - RNA, 20 nt, Human
acuuuuugaacuaagaaacu

SEQ ID NO: 3491780 - RNA, 15 nt, Human
acuuuuugaggcaaa

SEQ ID NO: 3491781 - RNA, 19 nt, Human
acuuuuugaggcaaaagaa

SEQ ID NO: 3491782 - RNA, 13 nt, Human
acuuuuugcagcu

SEQ ID NO: 3491783 - RNA, 14 nt, Human
acuuuuugguggau

SEQ ID NO: 3491784 - RNA, 21 nt, Human
acuuuuugguggauguaaaua

SEQ ID NO: 3491785 - RNA, 18 nt, Human
acuuuuugugaagacggc

SEQ ID NO: 3491786 - RNA, 23 nt, Human
acuuuuugugaagacggcacggu

SEQ ID NO: 3491787 - RNA, 18 nt, Human
acuuuuuuaaauauuuuc

SEQ ID NO: 3491788 - RNA, 21 nt, Human
acuuuuuucuaguacacuuuu

SEQ ID NO: 3491789 - RNA, 16 nt, Human
acuuuuuugaaaucag

SEQ ID NO: 3491790 - RNA, 22 nt, Human
acuuuuuugaguggaugauguu

SEQ ID NO: 3491791 - RNA, 23 nt, Human
acuuuuuuggggauaugcuuagu

SEQ ID NO: 3491792 - RNA, 13 nt, Human
acuuuuuuuagua

SEQ ID NO: 3491793 - RNA, 16 nt, Human
acuuuuuuuugagaau

SEQ ID NO: 3491794 - RNA, 17 nt, Human
acuuuuuuuuguauguu

SEQ ID NO: 3491795 - RNA, 20 nt, Human
agaaaaaaaaaaagaaagaa

SEQ ID NO: 3491796 - RNA, 18 nt, Human
agaaaaaaaaaagaagaa

SEQ ID NO: 3491797 - RNA, 19 nt, Human
agaaaaaaaaaagaagaag

SEQ ID NO: 3491798 - RNA, 14 nt, Human
agaaaaaaaaagaa

SEQ ID NO: 3491799 - RNA, 19 nt, Human
agaaaaaaaaagaaaaaag

SEQ ID NO: 3491800 - RNA, 13 nt, Human
agaaaaaaaacac

SEQ ID NO: 3491801 - RNA, 14 nt, Human
agaaaaaaaagaaa

SEQ ID NO: 3491802 - RNA, 18 nt, Human
agaaaaaaaauagacuuu

SEQ ID NO: 3491803 - RNA, 22 nt, Human
agaaaaaaacauucuaucuacu

SEQ ID NO: 3491804 - RNA, 18 nt, Human
agaaaaaaaccacacaaa

SEQ ID NO: 3491805 - RNA, 21 nt, Human
agaaaaaaaguuugccagaag

SEQ ID NO: 3491806 - RNA, 14 nt, Human
agaaaaaaauaauu

SEQ ID NO: 3491807 - RNA, 16 nt, Human
agaaaaaaauacuauu

SEQ ID NO: 3491808 - RNA, 14 nt, Human
agaaaaaaaucuuc

SEQ ID NO: 3491809 - RNA, 21 nt, Human
agaaaaaaaucuucuccagau

SEQ ID NO: 3491810 - RNA, 18 nt, Human
agaaaaaaauguauuuua

SEQ ID NO: 3491811 - RNA, 20 nt, Human
agaaaaaaaugucaaaagua

SEQ ID NO: 3491812 - RNA, 14 nt, Human
agaaaaaaauugaa

SEQ ID NO: 3491813 - RNA, 10 nt, Human
agaaaaaaga

SEQ ID NO: 3491814 - RNA, 22 nt, Human
agaaaaaagaaugucagaaaaa

SEQ ID NO: 3491815 - RNA, 17 nt, Human
agaaaaaagagaaaaga

SEQ ID NO: 3491816 - RNA, 22 nt, Human
agaaaaaagguucuuuguguau

SEQ ID NO: 3491817 - RNA, 14 nt, Human
agaaaaaauaaaug

SEQ ID NO: 3491818 - RNA, 18 nt, Human
agaaaaaauacauuuuau

SEQ ID NO: 3491819 - RNA, 17 nt, Human
agaaaaaauauuuuccc

SEQ ID NO: 3491820 - RNA, 17 nt, Human
agaaaaaauauuuuccu

SEQ ID NO: 3491821 - RNA, 13 nt, Human
agaaaaacaggca

SEQ ID NO: 3491822 - RNA, 15 nt, Human
agaaaaacaggcacu

SEQ ID NO: 3491823 - RNA, 19 nt, Human
agaaaaaccagaggcagcu

SEQ ID NO: 3491824 - RNA, 13 nt, Human
agaaaaagaaaug

SEQ ID NO: 3491825 - RNA, 12 nt, Human
agaaaaagaaca

SEQ ID NO: 3491826 - RNA, 17 nt, Human
agaaaaagcaaaaggca

SEQ ID NO: 3491827 - RNA, 20 nt, Human
agaaaaagcuccuguccucc

SEQ ID NO: 3491828 - RNA, 17 nt, Human
agaaaaaggaugcacag

SEQ ID NO: 3491829 - RNA, 19 nt, Human
agaaaaauaaaaaucucuu

SEQ ID NO: 3491830 - RNA, 12 nt, Human
agaaaaauauuu

SEQ ID NO: 3491831 - RNA, 13 nt, Human
agaaaaauauuua

SEQ ID NO: 3491832 - RNA, 12 nt, Human
agaaaaaucagu

SEQ ID NO: 3491833 - RNA, 21 nt, Human
agaaaaaucauguuugcucuc

SEQ ID NO: 3491834 - RNA, 12 nt, Human
agaaaaaucuug

SEQ ID NO: 3491835 - RNA, 13 nt, Human
agaaaaaugcuuu

SEQ ID NO: 3491836 - RNA, 16 nt, Human
agaaaaaugugaauuu

SEQ ID NO: 3491837 - RNA, 19 nt, Human
agaaaaauguguauuuuaa

SEQ ID NO: 3491838 - RNA, 19 nt, Human
agaaaaauuuacauggcaa

SEQ ID NO: 3491839 - RNA, 16 nt, Human
agaaaaauuucacgau

SEQ ID NO: 3491840 - RNA, 16 nt, Human
agaaaacaagcaaguu

SEQ ID NO: 3491841 - RNA, 16 nt, Human
agaaaacaaggaugaa

SEQ ID NO: 3491842 - RNA, 13 nt, Human
agaaaacacuguu

SEQ ID NO: 3491843 - RNA, 14 nt, Human
agaaaacacuguua

SEQ ID NO: 3491844 - RNA, 23 nt, Human
agaaaacacuuaaaaugaucauu

SEQ ID NO: 3491845 - RNA, 12 nt, Human
agaaaacagaaa

SEQ ID NO: 3491846 - RNA, 14 nt, Human
agaaaacagaaaaa

SEQ ID NO: 3491847 - RNA, 22 nt, Human
agaaaacaggaaaaaaacuuuu

SEQ ID NO: 3491848 - RNA, 22 nt, Human
agaaaacaggcacugcccuggu

SEQ ID NO: 3491849 - RNA, 15 nt, Human
agaaaacaugccucu

SEQ ID NO: 3491850 - RNA, 17 nt, Human
agaaaaccaaaaugaua

SEQ ID NO: 3491851 - RNA, 21 nt, Human
agaaaaccagcucagcacugc

SEQ ID NO: 3491852 - RNA, 22 nt, Human
agaaaacccuugggccagaagu

SEQ ID NO: 3491853 - RNA, 20 nt, Human
agaaaacgguuaaaacuguc

SEQ ID NO: 3491854 - RNA, 19 nt, Human
agaaaacuagaauuucauu

SEQ ID NO: 3491855 - RNA, 19 nt, Human
agaaaacuuguauuaugug

SEQ ID NO: 3491856 - RNA, 20 nt, Human
agaaaacuuuaaaaaauauu

SEQ ID NO: 3491857 - RNA, 22 nt, Human
agaaaacuuuaaaaaauauuua

SEQ ID NO: 3491858 - RNA, 12 nt, Human
agaaaagaaaaa

SEQ ID NO: 3491859 - RNA, 17 nt, Human
agaaaagacaugaauau

SEQ ID NO: 3491860 - RNA, 14 nt, Human
agaaaagagaagaa

SEQ ID NO: 3491861 - RNA, 17 nt, Human
agaaaagagaagaagaa

SEQ ID NO: 3491862 - RNA, 20 nt, Human
agaaaagagaagaagaaaaa

SEQ ID NO: 3491863 - RNA, 19 nt, Human
agaaaagagauauuuuaaa

SEQ ID NO: 3491864 - RNA, 16 nt, Human
agaaaagauaaagaug

SEQ ID NO: 3491865 - RNA, 13 nt, Human
agaaaagaugaaa

SEQ ID NO: 3491866 - RNA, 19 nt, Human
agaaaagccuaaucacagu

SEQ ID NO: 3491867 - RNA, 15 nt, Human
agaaaaggaaaagaa

SEQ ID NO: 3491868 - RNA, 14 nt, Human
agaaaaggacagaa

SEQ ID NO: 3491869 - RNA, 19 nt, Human
agaaaaguagacaaucauu

SEQ ID NO: 3491870 - RNA, 15 nt, Human
agaaaaguauguucu

SEQ ID NO: 3491871 - RNA, 21 nt, Human
agaaaaguauguucuaaccuu

SEQ ID NO: 3491872 - RNA, 17 nt, Human
acccaucuaccccugga

SEQ ID NO: 3491873 - RNA, 13 nt, Human
acccaucugcacc

SEQ ID NO: 3491874 - RNA, 15 nt, Human
agaaagccuucuuuu

SEQ ID NO: 3491875 - RNA, 15 nt, Human
agaaagcugacuugg

SEQ ID NO: 3491876 - RNA, 13 nt, Human
agaaagcugccug

SEQ ID NO: 3491877 - RNA, 20 nt, Human
agaaaggaaaaccugaagac

SEQ ID NO: 3491878 - RNA, 14 nt, Human
agaaaggaaaagaa

SEQ ID NO: 3491879 - RNA, 21 nt, Human
agaaaggaaaccuuuucuugu

SEQ ID NO: 3491880 - RNA, 22 nt, Human
agaaaggaagcauuguaaaaua

SEQ ID NO: 3491881 - RNA, 19 nt, Human
agaaaggagagucuugcag

SEQ ID NO: 3491882 - RNA, 16 nt, Human
agaaaggauaaaguug

SEQ ID NO: 3491883 - RNA, 16 nt, Human
agaaaggccugcacac

SEQ ID NO: 3491884 - RNA, 16 nt, Human
agaaaggccuuuaaaa

SEQ ID NO: 3491885 - RNA, 18 nt, Human
agaaagggagcagagaag

SEQ ID NO: 3491886 - RNA, 17 nt, Human
agaaagggagggcucug

SEQ ID NO: 3491887 - RNA, 16 nt, Human
accccgucucuacuaa

SEQ ID NO: 3491888 - RNA, 21 nt, Human
accccguguccccggccucag

SEQ ID NO: 3491889 - RNA, 15 nt, Human
accccguuacagcuc

SEQ ID NO: 3491890 - RNA, 14 nt, Human
accccuaaacucca

SEQ ID NO: 3491891 - RNA, 16 nt, Human
accccuaaacuccagg

SEQ ID NO: 3491892 - RNA, 17 nt, Human
accccuaaacuccaggg

SEQ ID NO: 3491893 - RNA, 14 nt, Human
accccuaagagacu

SEQ ID NO: 3491894 - RNA, 16 nt, Human
accccuacaugaaaca

SEQ ID NO: 3491895 - RNA, 14 nt, Human
accccuaguucccu

SEQ ID NO: 3491896 - RNA, 21 nt, Human
accccuaguucccucugcuca

SEQ ID NO: 3491897 - RNA, 20 nt, Human
accccucacaggagcuuacu

SEQ ID NO: 3491898 - RNA, 16 nt, Human
accccucaccuugcaa

SEQ ID NO: 3491899 - RNA, 20 nt, Human
accccucaguugugcagcuu

SEQ ID NO: 3491900 - RNA, 16 nt, Human
accccuccaugugggc

SEQ ID NO: 3491901 - RNA, 19 nt, Human
accccuccaugugggcuag

SEQ ID NO: 3491902 - RNA, 12 nt, Human
accccucccagc

SEQ ID NO: 3491903 - RNA, 15 nt, Human
accccucccagcuga

SEQ ID NO: 3491904 - RNA, 12 nt, Human
accccuccccau

SEQ ID NO: 3491905 - RNA, 20 nt, Human
accccuccccuccaucccug

SEQ ID NO: 3491906 - RNA, 18 nt, Human
accccucccggcccugcc

SEQ ID NO: 3491907 - RNA, 18 nt, Human
accccucccucuguccac

SEQ ID NO: 3491908 - RNA, 16 nt, Human
accccucccuuucucc

SEQ ID NO: 3491909 - RNA, 19 nt, Human
accccucccuuucuccccu

SEQ ID NO: 3491910 - RNA, 23 nt, Human
accccucccuuucuccccugccc

SEQ ID NO: 3491911 - RNA, 14 nt, Human
accccuccucacug

SEQ ID NO: 3491912 - RNA, 18 nt, Human
accccuccucacuggcca

SEQ ID NO: 3491913 - RNA, 15 nt, Human
accccuccucccuuu

SEQ ID NO: 3491914 - RNA, 23 nt, Human
accccuccucccuuuuuccuugu

SEQ ID NO: 3491915 - RNA, 11 nt, Human
accccuccugg

SEQ ID NO: 3491916 - RNA, 12 nt, Human
accccuccuggg

SEQ ID NO: 3491917 - RNA, 15 nt, Human
accccuccuggggcc

SEQ ID NO: 3491918 - RNA, 21 nt, Human
accccuccuggggccaggccg

SEQ ID NO: 3491919 - RNA, 20 nt, Human
accccuccuuccuugaccag

SEQ ID NO: 3491920 - RNA, 13 nt, Human
accccucucugca

SEQ ID NO: 3491921 - RNA, 22 nt, Human
accccugcagauagcaccgguc

SEQ ID NO: 3491922 - RNA, 22 nt, Human
accccugcaguuccccuggaag

SEQ ID NO: 3491923 - RNA, 18 nt, Human
accccugccuccacccuc

SEQ ID NO: 3491924 - RNA, 20 nt, Human
accccugccuuugggagcag

SEQ ID NO: 3491925 - RNA, 14 nt, Human
accccuggacccca

SEQ ID NO: 3491926 - RNA, 15 nt, Human
accccuggaccccag

SEQ ID NO: 3491927 - RNA, 13 nt, Human
accccuggccucc

SEQ ID NO: 3491928 - RNA, 19 nt, Human
accccuggcuccaggccag

SEQ ID NO: 3491929 - RNA, 15 nt, Human
accccugggggcucu

SEQ ID NO: 3491930 - RNA, 16 nt, Human
accccuggugguucac

SEQ ID NO: 3491931 - RNA, 15 nt, Human
accccugguucucau

SEQ ID NO: 3491932 - RNA, 16 nt, Human
accccuguccucacug

SEQ ID NO: 3491933 - RNA, 18 nt, Human
accccuguccucacugcu

SEQ ID NO: 3491934 - RNA, 14 nt, Human
accccugugcuccg

SEQ ID NO: 3491935 - RNA, 22 nt, Human
accccugugcuccgugccucca

SEQ ID NO: 3491936 - RNA, 18 nt, Human
accccuguggagcccgca

SEQ ID NO: 3491937 - RNA, 19 nt, Human
accccuguggagcccgcac

SEQ ID NO: 3491938 - RNA, 18 nt, Human
accccuuaagcccuggcc

SEQ ID NO: 3491939 - RNA, 16 nt, Human
accccuuacuuagcau

SEQ ID NO: 3491940 - RNA, 15 nt, Human
accccuuagccuccc

SEQ ID NO: 3491941 - RNA, 16 nt, Human
accccuuccagaucac

SEQ ID NO: 3491942 - RNA, 18 nt, Human
accccuuccauguggaga

SEQ ID NO: 3491943 - RNA, 17 nt, Human
accccuucccauuccau

SEQ ID NO: 3491944 - RNA, 14 nt, Human
accccuuccccacu

SEQ ID NO: 3491945 - RNA, 15 nt, Human
accccuuccccacug

SEQ ID NO: 3491946 - RNA, 18 nt, Human
accccuuccccacugccu

SEQ ID NO: 3491947 - RNA, 23 nt, Human
accccuuccccacugccugccca

SEQ ID NO: 3491948 - RNA, 14 nt, Human
accccuucgcuccu

SEQ ID NO: 3491949 - RNA, 14 nt, Human
accccuucucugug

SEQ ID NO: 3491950 - RNA, 20 nt, Human
accccuucucugugacccac

SEQ ID NO: 3491951 - RNA, 16 nt, Human
accccuuucccacccc

SEQ ID NO: 3491952 - RNA, 19 nt, Human
accccuuucuagaccaaua

SEQ ID NO: 3491953 - RNA, 17 nt, Human
accccuuucuggcucuc

SEQ ID NO: 3491954 - RNA, 20 nt, Human
accccuuuucagcuucugcu

SEQ ID NO: 3491955 - RNA, 23 nt, Human
accccuuuucagcuucugcuggg

SEQ ID NO: 3491956 - RNA, 16 nt, Human
acccgaggcugagaau

SEQ ID NO: 3491957 - RNA, 15 nt, Human
acccgaggguugauu

SEQ ID NO: 3491958 - RNA, 23 nt, Human
acccgaggguugauuaaggcagu

SEQ ID NO: 3491959 - RNA, 18 nt, Human
acccgccuagcugcuguc

SEQ ID NO: 3491960 - RNA, 13 nt, Human
acccgccucuccc

SEQ ID NO: 3491961 - RNA, 16 nt, Human
acccgcuuucuugcug

SEQ ID NO: 3491962 - RNA, 12 nt, Human
acccggaggcca

SEQ ID NO: 3491963 - RNA, 15 nt, Human
acccggaggggccug

SEQ ID NO: 3491964 - RNA, 18 nt, Human
acccggcacccccugcag

SEQ ID NO: 3491965 - RNA, 20 nt, Human
acccggcacccccugcagcu

SEQ ID NO: 3491966 - RNA, 15 nt, Human
acccggccccugcug

SEQ ID NO: 3491967 - RNA, 21 nt, Human
acccggcgguccccuccgcca

SEQ ID NO: 3491968 - RNA, 14 nt, Human
acccggcugcagag

SEQ ID NO: 3491969 - RNA, 13 nt, Human
acccgggaagggg

SEQ ID NO: 3491970 - RNA, 19 nt, Human
acccgggaagggggcuggg

SEQ ID NO: 3491971 - RNA, 16 nt, Human
acccgguuucuuuuua

SEQ ID NO: 3491972 - RNA, 17 nt, Human
acccgugagcgccugug

SEQ ID NO: 3491973 - RNA, 21 nt, Human
acccgugccaaguccaggucc

SEQ ID NO: 3491974 - RNA, 22 nt, Human
acccgugccaaguccagguccu

SEQ ID NO: 3491975 - RNA, 23 nt, Human
acccgugccaaguccagguccug

SEQ ID NO: 3491976 - RNA, 21 nt, Human
acccguucaacuuuuccuuug

SEQ ID NO: 3491977 - RNA, 16 nt, Human
acccguucauggggga

SEQ ID NO: 3491978 - RNA, 12 nt, Human
acccguuccaaa

SEQ ID NO: 3491979 - RNA, 19 nt, Human
acccuaaaaagcagagcuu

SEQ ID NO: 3491980 - RNA, 15 nt, Human
acccuaaaucugagg

SEQ ID NO: 3491981 - RNA, 15 nt, Human
acccuaccccaccac

SEQ ID NO: 3491982 - RNA, 13 nt, Human
acccuaccugugc

SEQ ID NO: 3491983 - RNA, 13 nt, Human
acccuaccuguuc

SEQ ID NO: 3491984 - RNA, 16 nt, Human
acccuagccaaugucu

SEQ ID NO: 3491985 - RNA, 16 nt, Human
acccuagccauuccug

SEQ ID NO: 3491986 - RNA, 19 nt, Human
acccuagccauuccuggua

SEQ ID NO: 3491987 - RNA, 23 nt, Human
acccuagccauuccugguaccca

SEQ ID NO: 3491988 - RNA, 18 nt, Human
acccuagcccucucccuc

SEQ ID NO: 3491989 - RNA, 12 nt, Human
acccuagccuug

SEQ ID NO: 3491990 - RNA, 15 nt, Human
acccuagccuugcuu

SEQ ID NO: 3491991 - RNA, 21 nt, Human
acccuaggccucucaccucug

SEQ ID NO: 3491992 - RNA, 22 nt, Human
acccuagucccuuccccucccu

SEQ ID NO: 3491993 - RNA, 15 nt, Human
acccuauaucuauaa

SEQ ID NO: 3491994 - RNA, 23 nt, Human
acccuauauuuugcauaguacca

SEQ ID NO: 3491995 - RNA, 16 nt, Human
acccuaugggucuagg

SEQ ID NO: 3491996 - RNA, 14 nt, Human
acccuauugcugcu

SEQ ID NO: 3491997 - RNA, 19 nt, Human
acccuauugcugcuugagg

SEQ ID NO: 3491998 - RNA, 19 nt, Human
acccucacuggcucuccug

SEQ ID NO: 3491999 - RNA, 18 nt, Human
acccucagaaacacuggg

SEQ ID NO: 3492000 - RNA, 21 nt, Human
acccucagaaacacuggggcu

SEQ ID NO: 3492001 - RNA, 13 nt, Human
acccucagagccu

SEQ ID NO: 3492002 - RNA, 14 nt, Human
acccucagagccuc

SEQ ID NO: 3492003 - RNA, 15 nt, Human
acccucaggacaaug

SEQ ID NO: 3492004 - RNA, 14 nt, Human
acccucaggcaggu

SEQ ID NO: 3492005 - RNA, 20 nt, Human
acccucaggcauaggccugg

SEQ ID NO: 3492006 - RNA, 18 nt, Human
acccucagggcaaagcca

SEQ ID NO: 3492007 - RNA, 19 nt, Human
acccucagggcaaagccag

SEQ ID NO: 3492008 - RNA, 21 nt, Human
acccucagggcaaagccaggu

SEQ ID NO: 3492009 - RNA, 18 nt, Human
acccucauacacagaaac

SEQ ID NO: 3492010 - RNA, 23 nt, Human
acccucaucaccaacgucugugc

SEQ ID NO: 3492011 - RNA, 16 nt, Human
acccucaucuuucuuc

SEQ ID NO: 3492012 - RNA, 12 nt, Human
acccucaugcug

SEQ ID NO: 3492013 - RNA, 20 nt, Human
acccucaugcugugugacuc

SEQ ID NO: 3492014 - RNA, 23 nt, Human
acccuccaaauggagaagcugca

SEQ ID NO: 3492015 - RNA, 18 nt, Human
acccuccaccgcagaagg

SEQ ID NO: 3492016 - RNA, 12 nt, Human
acccuccaccuu

SEQ ID NO: 3492017 - RNA, 15 nt, Human
acccuccaccuucca

SEQ ID NO: 3492018 - RNA, 23 nt, Human
acccucccacccccuucucugcu

SEQ ID NO: 3492019 - RNA, 17 nt, Human
accucauugacaagaac

SEQ ID NO: 3492020 - RNA, 19 nt, Human
accuccaacagaacuaaau

SEQ ID NO: 3492021 - RNA, 11 nt, Human
accuccacagc

SEQ ID NO: 3492022 - RNA, 16 nt, Human
accuccacauccucca

SEQ ID NO: 3492023 - RNA, 16 nt, Human
accuccagcccgggag

SEQ ID NO: 3492024 - RNA, 13 nt, Human
accuccagccuga

SEQ ID NO: 3492025 - RNA, 17 nt, Human
accuccagcuuuccugu

SEQ ID NO: 3492026 - RNA, 14 nt, Human
accuccaggccugu

SEQ ID NO: 3492027 - RNA, 13 nt, Human
accuccaugacag

SEQ ID NO: 3492028 - RNA, 22 nt, Human
accuccauguggacuuaggaag

SEQ ID NO: 3492029 - RNA, 14 nt, Human
accucccaccuuug

SEQ ID NO: 3492030 - RNA, 15 nt, Human
accucccaccuuugg

SEQ ID NO: 3492031 - RNA, 16 nt, Human
accucccaccuuuggu

SEQ ID NO: 3492032 - RNA, 17 nt, Human
accucccagagguccag

SEQ ID NO: 3492033 - RNA, 20 nt, Human
accucccagagguccagccc

SEQ ID NO: 3492034 - RNA, 15 nt, Human
accucccagcccuau

SEQ ID NO: 3492035 - RNA, 22 nt, Human
accucccagcccuauggaugug

SEQ ID NO: 3492036 - RNA, 15 nt, Human
accucccauccuaau

SEQ ID NO: 3492037 - RNA, 11 nt, Human
accuccccacg

SEQ ID NO: 3492038 - RNA, 21 nt, Human
accuccccacgcccuccccuc

SEQ ID NO: 3492039 - RNA, 15 nt, Human
accuccccagccccu

SEQ ID NO: 3492040 - RNA, 19 nt, Human
accuccccagccccuagcc

SEQ ID NO: 3492041 - RNA, 16 nt, Human
accuccccagccugcg

SEQ ID NO: 3492042 - RNA, 19 nt, Human
accuccccaggccguggcu

SEQ ID NO: 3492043 - RNA, 20 nt, Human
accuccccaggccguggcug

SEQ ID NO: 3492044 - RNA, 16 nt, Human
accucccccacuccca

SEQ ID NO: 3492045 - RNA, 16 nt, Human
accuccccccacugca

SEQ ID NO: 3492046 - RNA, 17 nt, Human
accuccccccacugcag

SEQ ID NO: 3492047 - RNA, 20 nt, Human
accuccccugccuugcuguu

SEQ ID NO: 3492048 - RNA, 12 nt, Human
accuccccuugg

SEQ ID NO: 3492049 - RNA, 17 nt, Human
accucccuauacugcuu

SEQ ID NO: 3492050 - RNA, 15 nt, Human
accucccucccggca

SEQ ID NO: 3492051 - RNA, 22 nt, Human
accucccucuuguuuuguuugu

SEQ ID NO: 3492052 - RNA, 12 nt, Human
accucccugccc

SEQ ID NO: 3492053 - RNA, 15 nt, Human
accucccugcccagg

SEQ ID NO: 3492054 - RNA, 18 nt, Human
accucccugcccaggccg

SEQ ID NO: 3492055 - RNA, 21 nt, Human
accucccugcccaggccggcc

SEQ ID NO: 3492056 - RNA, 13 nt, Human
accucccugccuc

SEQ ID NO: 3492057 - RNA, 22 nt, Human
accucccuguucaaggccccug

SEQ ID NO: 3492058 - RNA, 16 nt, Human
accuccgccucccggg

SEQ ID NO: 3492059 - RNA, 20 nt, Human
accuccggccaggugccucc

SEQ ID NO: 3492060 - RNA, 15 nt, Human
accuccucagccuga

SEQ ID NO: 3492061 - RNA, 13 nt, Human
accuccucaggga

SEQ ID NO: 3492062 - RNA, 23 nt, Human
accuccucagggauggccguugg

SEQ ID NO: 3492063 - RNA, 15 nt, Human
accuccucccacugc

SEQ ID NO: 3492064 - RNA, 16 nt, Human
accuccucccacugcc

SEQ ID NO: 3492065 - RNA, 14 nt, Human
accuccucuccuga

SEQ ID NO: 3492066 - RNA, 18 nt, Human
accuccugacacccuucu

SEQ ID NO: 3492067 - RNA, 22 nt, Human
accuccugacacccuucuccca

SEQ ID NO: 3492068 - RNA, 13 nt, Human
accuccugagaaa

SEQ ID NO: 3492069 - RNA, 12 nt, Human
accuccugccca

SEQ ID NO: 3492070 - RNA, 20 nt, Human
accuccugcccaggagagcc

SEQ ID NO: 3492071 - RNA, 12 nt, Human
accuccugccuc

SEQ ID NO: 3492072 - RNA, 15 nt, Human
accuccugucucugg

SEQ ID NO: 3492073 - RNA, 14 nt, Human
accuccuguggaac

SEQ ID NO: 3492074 - RNA, 15 nt, Human
accuccuguggaacc

SEQ ID NO: 3492075 - RNA, 21 nt, Human
accuccuguggaacccagcag

SEQ ID NO: 3492076 - RNA, 14 nt, Human
accuccuucccucu

SEQ ID NO: 3492077 - RNA, 18 nt, Human
accuccuuucucuucucu

SEQ ID NO: 3492078 - RNA, 20 nt, Human
accuccuuucucuucucugu

SEQ ID NO: 3492079 - RNA, 17 nt, Human
accucgcccucuccuuu

SEQ ID NO: 3492080 - RNA, 18 nt, Human
accucgcuccaacuccaa

SEQ ID NO: 3492081 - RNA, 19 nt, Human
accucgcuccaacuccaac

SEQ ID NO: 3492082 - RNA, 14 nt, Human
accucgcuggacuc

SEQ ID NO: 3492083 - RNA, 16 nt, Human
accucgcuggacucuc

SEQ ID NO: 3492084 - RNA, 19 nt, Human
accucggugccuuccucuu

SEQ ID NO: 3492085 - RNA, 20 nt, Human
accucguccucccccugcca

SEQ ID NO: 3492086 - RNA, 21 nt, Human
accucguccucccccugccag

SEQ ID NO: 3492087 - RNA, 22 nt, Human
accucguccucccccugccagu

SEQ ID NO: 3492088 - RNA, 15 nt, Human
agaaaauauauguau

SEQ ID NO: 3492089 - RNA, 18 nt, Human
agaaaauauauucuuuca

SEQ ID NO: 3492090 - RNA, 22 nt, Human
agaaaauaucugaaaugugaua

SEQ ID NO: 3492091 - RNA, 22 nt, Human
agaaaauaugucccagaaaugu

SEQ ID NO: 3492092 - RNA, 23 nt, Human
agaaaaucaagcagguuagagaa

SEQ ID NO: 3492093 - RNA, 15 nt, Human
agaaaaucuuuauaa

SEQ ID NO: 3492094 - RNA, 21 nt, Human
agaaaaugaaaugcauauuug

SEQ ID NO: 3492095 - RNA, 16 nt, Human
agaaaaugauacagca

SEQ ID NO: 3492096 - RNA, 16 nt, Human
agaaaaugcuagaaga

SEQ ID NO: 3492097 - RNA, 22 nt, Human
agaaaauggaaccaggcuugga

SEQ ID NO: 3492098 - RNA, 15 nt, Human
agaaaauggacgugu

SEQ ID NO: 3492099 - RNA, 22 nt, Human
agaaaauggacguguuaugacu

SEQ ID NO: 3492100 - RNA, 18 nt, Human
agaaaauguuauuuaaca

SEQ ID NO: 3492101 - RNA, 19 nt, Human
agaaaauguuauuuaacag

SEQ ID NO: 3492102 - RNA, 17 nt, Human
agaaaauguugagaauc

SEQ ID NO: 3492103 - RNA, 18 nt, Human
agaaaauuaaacacaaag

SEQ ID NO: 3492104 - RNA, 13 nt, Human
agaaaauucaauu

SEQ ID NO: 3492105 - RNA, 17 nt, Human
agaaaauucaauuguaa

SEQ ID NO: 3492106 - RNA, 16 nt, Human
agaaaauuccuauaag

SEQ ID NO: 3492107 - RNA, 14 nt, Human
agaaaauucuccug

SEQ ID NO: 3492108 - RNA, 16 nt, Human
agaaaauucugugccu

SEQ ID NO: 3492109 - RNA, 17 nt, Human
agaaaauugaauuuaac

SEQ ID NO: 3492110 - RNA, 18 nt, Human
agaaaauugaauuuaaca

SEQ ID NO: 3492111 - RNA, 14 nt, Human
agaaaauugcugug

SEQ ID NO: 3492112 - RNA, 12 nt, Human
agaaacaaacuu

SEQ ID NO: 3492113 - RNA, 22 nt, Human
agaaacaaacuuuucaaggcuu

SEQ ID NO: 3492114 - RNA, 15 nt, Human
agaaacaacacugua

SEQ ID NO: 3492115 - RNA, 16 nt, Human
agaaacaacacuguag

SEQ ID NO: 3492116 - RNA, 17 nt, Human
agaaacaauaaagagau

SEQ ID NO: 3492117 - RNA, 17 nt, Human
agaaacacacugaggca

SEQ ID NO: 3492118 - RNA, 20 nt, Human
agaaacacacugaggcaggg

SEQ ID NO: 3492119 - RNA, 20 nt, Human
agaaacacauaauuaacacu

SEQ ID NO: 3492120 - RNA, 17 nt, Human
agaaacacccucacacu

SEQ ID NO: 3492121 - RNA, 23 nt, Human
agaaacacgaacuuuagcugcau

SEQ ID NO: 3492122 - RNA, 13 nt, Human
agaaacacucaag

SEQ ID NO: 3492123 - RNA, 15 nt, Human
agaaacacugaaaag

SEQ ID NO: 3492124 - RNA, 19 nt, Human
agaaacacugaaaagaagg

SEQ ID NO: 3492125 - RNA, 11 nt, Human
agaaacacugc

SEQ ID NO: 3492126 - RNA, 12 nt, Human
agaaacacugcc

SEQ ID NO: 3492127 - RNA, 14 nt, Human
agaaacacuugaac

SEQ ID NO: 3492128 - RNA, 12 nt, Human
agaaacagaaga

SEQ ID NO: 3492129 - RNA, 14 nt, Human
agaaacagagacag

SEQ ID NO: 3492130 - RNA, 16 nt, Human
agaaacagauaccaua

SEQ ID NO: 3492131 - RNA, 13 nt, Human
agaaacagccagc

SEQ ID NO: 3492132 - RNA, 13 nt, Human
agaaacaggaccg

SEQ ID NO: 3492133 - RNA, 12 nt, Human
agaaacagugag

SEQ ID NO: 3492134 - RNA, 13 nt, Human
agaaacagugagu

SEQ ID NO: 3492135 - RNA, 13 nt, Human
agaaacaguuaac

SEQ ID NO: 3492136 - RNA, 21 nt, Human
agaaacaguugguaacuuuug

SEQ ID NO: 3492137 - RNA, 22 nt, Human
agaaacaguugguaacuuuugu

SEQ ID NO: 3492138 - RNA, 16 nt, Human
agaaacauaaauaaaa

SEQ ID NO: 3492139 - RNA, 14 nt, Human
agaaacaugacacu

SEQ ID NO: 3492140 - RNA, 17 nt, Human
agaaacaugacacugac

SEQ ID NO: 3492141 - RNA, 15 nt, Human
agaaacauugaagau

SEQ ID NO: 3492142 - RNA, 13 nt, Human
agaaacauuggaa

SEQ ID NO: 3492143 - RNA, 15 nt, Human
agaaacauuuauauu

SEQ ID NO: 3492144 - RNA, 15 nt, Human
agaaaccagcuuccu

SEQ ID NO: 3492145 - RNA, 16 nt, Human
agaaaccagcuuccuu

SEQ ID NO: 3492146 - RNA, 20 nt, Human
agaaaccagcuuccuucaga

SEQ ID NO: 3492147 - RNA, 21 nt, Human
agaaaccagcuuccuucagag

SEQ ID NO: 3492148 - RNA, 17 nt, Human
agaaacccaagcuccuc

SEQ ID NO: 3492149 - RNA, 18 nt, Human
agaaacccaagcuccucc

SEQ ID NO: 3492150 - RNA, 20 nt, Human
agaaacccaagcuccuccuc

SEQ ID NO: 3492151 - RNA, 15 nt, Human
agaaacccagacuga

SEQ ID NO: 3492152 - RNA, 20 nt, Human
agaaaccuacagaauacuag

SEQ ID NO: 3492153 - RNA, 19 nt, Human
agaaaccuguaucuuucua

SEQ ID NO: 3492154 - RNA, 20 nt, Human
agaaaccuguaucuuucuau

SEQ ID NO: 3492155 - RNA, 15 nt, Human
agaaacgcauccagc

SEQ ID NO: 3492156 - RNA, 18 nt, Human
agaaacgcauccagcaag

SEQ ID NO: 3492157 - RNA, 21 nt, Human
agaaacgucuucuaaacuucc

SEQ ID NO: 3492158 - RNA, 22 nt, Human
agaaacucacccccaaggggca

SEQ ID NO: 3492159 - RNA, 23 nt, Human
agaaacucacccccaaggggcag

SEQ ID NO: 3492160 - RNA, 16 nt, Human
agaaacugagaccaaa

SEQ ID NO: 3492161 - RNA, 13 nt, Human
agaaacugaggaa

SEQ ID NO: 3492162 - RNA, 22 nt, Human
agaaacuggcaaagcagaaugu

SEQ ID NO: 3492163 - RNA, 22 nt, Human
agaaacugucuagcacuuccuu

SEQ ID NO: 3492164 - RNA, 21 nt, Human
agaaacuguucccaccugcug

SEQ ID NO: 3492165 - RNA, 16 nt, Human
agaaaugaacauucca

SEQ ID NO: 3492166 - RNA, 23 nt, Human
agaaaugaccaauauuauacuaa

SEQ ID NO: 3492167 - RNA, 14 nt, Human
agaaaugacuaauu

SEQ ID NO: 3492168 - RNA, 17 nt, Human
agaaaugacuaauuagg

SEQ ID NO: 3492169 - RNA, 20 nt, Human
agaaaugagaucaggcucug

SEQ ID NO: 3492170 - RNA, 16 nt, Human
agaaaugcaaaaaucu

SEQ ID NO: 3492171 - RNA, 19 nt, Human
agaaaugcacaaugucuug

SEQ ID NO: 3492172 - RNA, 18 nt, Human
agaaaugcauccauuccu

SEQ ID NO: 3492173 - RNA, 11 nt, Human
agaaaugccaa

SEQ ID NO: 3492174 - RNA, 21 nt, Human
agaaaugccaagcacuucuuu

SEQ ID NO: 3492175 - RNA, 13 nt, Human
agaaaugcugccu

SEQ ID NO: 3492176 - RNA, 20 nt, Human
agaaaugcugguuuuucagu

SEQ ID NO: 3492177 - RNA, 12 nt, Human
agaaaugcuuug

SEQ ID NO: 3492178 - RNA, 19 nt, Human
agaaauggugagauuguuu

SEQ ID NO: 3492179 - RNA, 17 nt, Human
agaaaugguuguauuag

SEQ ID NO: 3492180 - RNA, 13 nt, Human
agaaauguaaugc

SEQ ID NO: 3492181 - RNA, 20 nt, Human
agaaauguauaaacuuuaga

SEQ ID NO: 3492182 - RNA, 21 nt, Human
agaaaugucuuaauuuuugaa

SEQ ID NO: 3492183 - RNA, 21 nt, Human
agaaauguguagcugcaaaaa

SEQ ID NO: 3492184 - RNA, 22 nt, Human
agaaauguugagucuguacuaa

SEQ ID NO: 3492185 - RNA, 17 nt, Human
agaaauuaaguaucuga

SEQ ID NO: 3492186 - RNA, 18 nt, Human
agaaauuacacccaaaga

SEQ ID NO: 3492187 - RNA, 20 nt, Human
agaaauuacuaauuuuacuu

SEQ ID NO: 3492188 - RNA, 21 nt, Human
agaaauuagaaaaaaauuacu

SEQ ID NO: 3492189 - RNA, 19 nt, Human
agaaauuagggcucuaauu

SEQ ID NO: 3492190 - RNA, 23 nt, Human
agaaauuagggcucuaauuuccu

SEQ ID NO: 3492191 - RNA, 21 nt, Human
agaaauuaugugccagauuua

SEQ ID NO: 3492192 - RNA, 17 nt, Human
agaaauucccuggacca

SEQ ID NO: 3492193 - RNA, 23 nt, Human
agaaauucugucauagaaagugc

SEQ ID NO: 3492194 - RNA, 14 nt, Human
agaaauucuguuaa

SEQ ID NO: 3492195 - RNA, 22 nt, Human
agaaauucuguuaaaaucuauu

SEQ ID NO: 3492196 - RNA, 12 nt, Human
agaaauucuugu

SEQ ID NO: 3492197 - RNA, 15 nt, Human
agaaauugaauacuu

SEQ ID NO: 3492198 - RNA, 16 nt, Human
agaaauugaauacuuu

SEQ ID NO: 3492199 - RNA, 17 nt, Human
agaaauugaauacuuug

SEQ ID NO: 3492200 - RNA, 18 nt, Human
agaaauugaauacuuuga

SEQ ID NO: 3492201 - RNA, 14 nt, Human
agaaauugccuauc

SEQ ID NO: 3492202 - RNA, 22 nt, Human
agaaauuggaacagaauguuuu

SEQ ID NO: 3492203 - RNA, 16 nt, Human
agaaauugguaccuug

SEQ ID NO: 3492204 - RNA, 20 nt, Human
agaaauugguaccuugcaca

SEQ ID NO: 3492205 - RNA, 17 nt, Human
agaaauuguauauugua

SEQ ID NO: 3492206 - RNA, 20 nt, Human
agaaauuguauauuguaauu

SEQ ID NO: 3492207 - RNA, 18 nt, Human
agaaauuuaaaagacacu

SEQ ID NO: 3492208 - RNA, 24 nt, Human
agaaauuuaaacuauaagcaagaa

SEQ ID NO: 3492209 - RNA, 14 nt, Human
agaaauuucacaua

SEQ ID NO: 3492210 - RNA, 16 nt, Human
agaaauuuccagagaa

SEQ ID NO: 3492211 - RNA, 11 nt, Human
agaaauuuuca

SEQ ID NO: 3492212 - RNA, 14 nt, Human
agaaauuuuuauca

SEQ ID NO: 3492213 - RNA, 16 nt, Human
agaaauuuuuaucagu

SEQ ID NO: 3492214 - RNA, 14 nt, Human
agaaauuuuucaga

SEQ ID NO: 3492215 - RNA, 10 nt, Human
agaacaaaaa

SEQ ID NO: 3492216 - RNA, 20 nt, Human
agaacaaaaaaaucugcaga

SEQ ID NO: 3492217 - RNA, 21 nt, Human
agaacaaaaaaaucugcagaa

SEQ ID NO: 3492218 - RNA, 16 nt, Human
agaacaaagcuguuaa

SEQ ID NO: 3492219 - RNA, 14 nt, Human
agaacaaaggacag

SEQ ID NO: 3492220 - RNA, 21 nt, Human
agaacaaaggacagaguauga

SEQ ID NO: 3492221 - RNA, 22 nt, Human
agaacaaaggacagaguaugaa

SEQ ID NO: 3492222 - RNA, 16 nt, Human
agaacaaagugagaca

SEQ ID NO: 3492223 - RNA, 14 nt, Human
agaacaaauauuca

SEQ ID NO: 3492224 - RNA, 10 nt, Human
agaacaaggc

SEQ ID NO: 3492225 - RNA, 17 nt, Human
agaacaagguaguuuuu

SEQ ID NO: 3492226 - RNA, 19 nt, Human
agaacaauagguaaagcua

SEQ ID NO: 3492227 - RNA, 21 nt, Human
agaacaauauugacuuugucu

SEQ ID NO: 3492228 - RNA, 15 nt, Human
agaacaaugugcuau

SEQ ID NO: 3492229 - RNA, 11 nt, Human
agaacacaguu

SEQ ID NO: 3492230 - RNA, 17 nt, Human
agaacaccuaugcaaag

SEQ ID NO: 3492231 - RNA, 14 nt, Human
agaacacuaaccug

SEQ ID NO: 3492232 - RNA, 16 nt, Human
agaacacuaauucaua

SEQ ID NO: 3492233 - RNA, 14 nt, Human
agaacacuauuuuc

SEQ ID NO: 3492234 - RNA, 17 nt, Human
agaacacuauuuucaga

SEQ ID NO: 3492235 - RNA, 20 nt, Human
agaacacuauuuucagaauc

SEQ ID NO: 3492236 - RNA, 12 nt, Human
agaacacuuaug

SEQ ID NO: 3492237 - RNA, 15 nt, Human
agaacagaaaacaac

SEQ ID NO: 3492238 - RNA, 21 nt, Human
agaacagaaaacaacaaaaaa

SEQ ID NO: 3492239 - RNA, 20 nt, Human
agaacagacuggccugagga

SEQ ID NO: 3492240 - RNA, 16 nt, Human
agaacagauaaagauu

SEQ ID NO: 3492241 - RNA, 19 nt, Human
agaacagauaaucagugug

SEQ ID NO: 3492242 - RNA, 18 nt, Human
agaacagaucuccaaagc

SEQ ID NO: 3492243 - RNA, 19 nt, Human
agaacagcaggcccaccua

SEQ ID NO: 3492244 - RNA, 15 nt, Human
agaacagcauugucc

SEQ ID NO: 3492245 - RNA, 19 nt, Human
agaacagccgcuccugucu

SEQ ID NO: 3492246 - RNA, 22 nt, Human
agaacagccgcuccugucugcc

SEQ ID NO: 3492247 - RNA, 23 nt, Human
agaacagccgcuccugucugcca

SEQ ID NO: 3492248 - RNA, 12 nt, Human
agaacagcuguu

SEQ ID NO: 3492249 - RNA, 18 nt, Human
agaaucccuguguuaauu

SEQ ID NO: 3492250 - RNA, 15 nt, Human
agaaucccuguucau

SEQ ID NO: 3492251 - RNA, 16 nt, Human
agaaucccuguucauu

SEQ ID NO: 3492252 - RNA, 20 nt, Human
agaaucccuuaacaguugua

SEQ ID NO: 3492253 - RNA, 21 nt, Human
agaaucgaugggggaugcuuc

SEQ ID NO: 3492254 - RNA, 23 nt, Human
agaaucgaugggggaugcuucau

SEQ ID NO: 3492255 - RNA, 15 nt, Human
agaaucuaaagccag

SEQ ID NO: 3492256 - RNA, 22 nt, Human
agaaucuaacugguggacaugg

SEQ ID NO: 3492257 - RNA, 14 nt, Human
agaaucuauuuucu

SEQ ID NO: 3492258 - RNA, 16 nt, Human
agaaucuauuuucuau

SEQ ID NO: 3492259 - RNA, 13 nt, Human
agaaucugaaugu

SEQ ID NO: 3492260 - RNA, 13 nt, Human
agaaucuggagag

SEQ ID NO: 3492261 - RNA, 19 nt, Human
agaaucuuguuuugaaaau

SEQ ID NO: 3492262 - RNA, 14 nt, Human
agaaucuuuagaga

SEQ ID NO: 3492263 - RNA, 23 nt, Human
agaaucuuuagagaaguauacau

SEQ ID NO: 3492264 - RNA, 21 nt, Human
agaaucuuuauugagaaagag

SEQ ID NO: 3492265 - RNA, 24 nt, Human
agaaucuuuauugagaaagagcac

SEQ ID NO: 3492266 - RNA, 17 nt, Human
agaaugaaaauuguaug

SEQ ID NO: 3492267 - RNA, 16 nt, Human
agaaugaaagggccca

SEQ ID NO: 3492268 - RNA, 17 nt, Human
agaaugaaauguaugug

SEQ ID NO: 3492269 - RNA, 20 nt, Human
agaaugaaauugcugaaaga

SEQ ID NO: 3492270 - RNA, 22 nt, Human
agaaugaacaaagaccaauuuu

SEQ ID NO: 3492271 - RNA, 15 nt, Human
agaaugaacaaauug

SEQ ID NO: 3492272 - RNA, 16 nt, Human
agaaugaccuuguaau

SEQ ID NO: 3492273 - RNA, 20 nt, Human
agaaugaccuuguaauguaa

SEQ ID NO: 3492274 - RNA, 21 nt, Human
agaaugaccuuguaauguaac

SEQ ID NO: 3492275 - RNA, 22 nt, Human
agaaugaccuuguaauguaacu

SEQ ID NO: 3492276 - RNA, 22 nt, Human
agaaugagagacacacugaaga

SEQ ID NO: 3492277 - RNA, 16 nt, Human
agaaugagcacccauu

SEQ ID NO: 3492278 - RNA, 21 nt, Human
agaaugagccuacgcugaaga

SEQ ID NO: 3492279 - RNA, 16 nt, Human
agaaugaggaggaagg

SEQ ID NO: 3492280 - RNA, 17 nt, Human
agaaugaggaggaagga

SEQ ID NO: 3492281 - RNA, 12 nt, Human
agaaugaggcug

SEQ ID NO: 3492282 - RNA, 13 nt, Human
agaaugaugguuu

SEQ ID NO: 3492283 - RNA, 13 nt, Human
agaaugauuucau

SEQ ID NO: 3492284 - RNA, 20 nt, Human
agaaugcaaccaagucacac

SEQ ID NO: 3492285 - RNA, 16 nt, Human
agaaugcacaagaaug

SEQ ID NO: 3492286 - RNA, 17 nt, Human
agaaugcacaagaaugg

SEQ ID NO: 3492287 - RNA, 18 nt, Human
agaaugcacagauauacu

SEQ ID NO: 3492288 - RNA, 18 nt, Human
agaaugcaccauacucau

SEQ ID NO: 3492289 - RNA, 18 nt, Human
agaaugcaugcuuuccau

SEQ ID NO: 3492290 - RNA, 13 nt, Human
agaaugcauugau

SEQ ID NO: 3492291 - RNA, 18 nt, Human
agaaugccuugaagauau

SEQ ID NO: 3492292 - RNA, 18 nt, Human
agaaugcucuuuacuuca

SEQ ID NO: 3492293 - RNA, 13 nt, Human
agaaugcuguaca

SEQ ID NO: 3492294 - RNA, 22 nt, Human
agaauggcccaguccucuccca

SEQ ID NO: 3492295 - RNA, 17 nt, Human
agaauggggcugggccc

SEQ ID NO: 3492296 - RNA, 23 nt, Human
agaaugguccgugcuaaggacuu

SEQ ID NO: 3492297 - RNA, 19 nt, Human
agaauggugauuuuaaaug

SEQ ID NO: 3492298 - RNA, 20 nt, Human
agaauggugauuuuaaaugu

SEQ ID NO: 3492299 - RNA, 23 nt, Human
agaauguauauuaagguguggcu

SEQ ID NO: 3492300 - RNA, 22 nt, Human
agaauguaucugugaaguaguu

SEQ ID NO: 3492301 - RNA, 12 nt, Human
agaauguauugu

SEQ ID NO: 3492302 - RNA, 15 nt, Human
agaauguauuguacc

SEQ ID NO: 3492303 - RNA, 22 nt, Human
agaauguauuguaccuuuuaac

SEQ ID NO: 3492304 - RNA, 16 nt, Human
agaauguauuugcuga

SEQ ID NO: 3492305 - RNA, 15 nt, Human
agaaugucagauucc

SEQ ID NO: 3492306 - RNA, 13 nt, Human
agaaugucaguau

SEQ ID NO: 3492307 - RNA, 16 nt, Human
agaaugucaguaugug

SEQ ID NO: 3492308 - RNA, 19 nt, Human
agaaugucaguauguggaa

SEQ ID NO: 3492309 - RNA, 19 nt, Human
agaccuauuccuccugggc

SEQ ID NO: 3492310 - RNA, 14 nt, Human
agaccucagccaug

SEQ ID NO: 3492311 - RNA, 15 nt, Human
agaccucagccugug

SEQ ID NO: 3492312 - RNA, 17 nt, Human
agaccucagccugugcu

SEQ ID NO: 3492313 - RNA, 14 nt, Human
agaccucagggcac

SEQ ID NO: 3492314 - RNA, 20 nt, Human
agaccucagugccuuccugu

SEQ ID NO: 3492315 - RNA, 19 nt, Human
agaccucaucaggaugaac

SEQ ID NO: 3492316 - RNA, 20 nt, Human
agaccuccccagccccuagc

SEQ ID NO: 3492317 - RNA, 19 nt, Human
agaccucuauauuugcucu

SEQ ID NO: 3492318 - RNA, 15 nt, Human
agaccucuccuuccu

SEQ ID NO: 3492319 - RNA, 12 nt, Human
agaccucuggau

SEQ ID NO: 3492320 - RNA, 23 nt, Human
agaccucuggauuaggucucugu

SEQ ID NO: 3492321 - RNA, 17 nt, Human
agaccugacaagcacug

SEQ ID NO: 3492322 - RNA, 19 nt, Human
agaccugacaagcacugcu

SEQ ID NO: 3492323 - RNA, 14 nt, Human
agaccugacucagg

SEQ ID NO: 3492324 - RNA, 16 nt, Human
agaccugagaauguau

SEQ ID NO: 3492325 - RNA, 15 nt, Human
agaccugauccugga

SEQ ID NO: 3492326 - RNA, 18 nt, Human
agaccugauccuggaggc

SEQ ID NO: 3492327 - RNA, 13 nt, Human
agaccuggagccc

SEQ ID NO: 3492328 - RNA, 16 nt, Human
agaccuggagccccug

SEQ ID NO: 3492329 - RNA, 11 nt, Human
agaccuggcag

SEQ ID NO: 3492330 - RNA, 18 nt, Human
agaccuggcagcucugga

SEQ ID NO: 3492331 - RNA, 17 nt, Human
agaccuguccuccuggu

SEQ ID NO: 3492332 - RNA, 21 nt, Human
agaccuguugguuccaagccc

SEQ ID NO: 3492333 - RNA, 16 nt, Human
agaccuucaccaaaca

SEQ ID NO: 3492334 - RNA, 23 nt, Human
agaccuuggaucagaugaacucu

SEQ ID NO: 3492335 - RNA, 18 nt, Human
agaccuuguguguaugug

SEQ ID NO: 3492336 - RNA, 20 nt, Human
agaccuuguucacacucuca

SEQ ID NO: 3492337 - RNA, 20 nt, Human
agaccuuugaggauaucaaa

SEQ ID NO: 3492338 - RNA, 18 nt, Human
agaccuuuuucugcacua

SEQ ID NO: 3492339 - RNA, 20 nt, Human
agaccuuuuucugcacuaua

SEQ ID NO: 3492340 - RNA, 22 nt, Human
agaccuuuuuuuuuuuuccaau

SEQ ID NO: 3492341 - RNA, 15 nt, Human
agacgacagccccug

SEQ ID NO: 3492342 - RNA, 15 nt, Human
agacgagaggacgag

SEQ ID NO: 3492343 - RNA, 17 nt, Human
agacgaggcccucgggc

SEQ ID NO: 3492344 - RNA, 22 nt, Human
agacgaggcccucgggcccagc

SEQ ID NO: 3492345 - RNA, 14 nt, Human
agacgcauuucggu

SEQ ID NO: 3492346 - RNA, 20 nt, Human
agacgccggggacagaggcc

SEQ ID NO: 3492347 - RNA, 15 nt, Human
agacgccugaggaac

SEQ ID NO: 3492348 - RNA, 18 nt, Human
agacgccuuucuccucca

SEQ ID NO: 3492349 - RNA, 16 nt, Human
agacggcacccaccca

SEQ ID NO: 3492350 - RNA, 20 nt, Human
agacggcacggucuucccuc

SEQ ID NO: 3492351 - RNA, 21 nt, Human
agacgguguuuugccauguug

SEQ ID NO: 3492352 - RNA, 16 nt, Human
agacgguuuccaggga

SEQ ID NO: 3492353 - RNA, 19 nt, Human
agacgguuuccagggaggg

SEQ ID NO: 3492354 - RNA, 19 nt, Human
agacgugaugccaggacca

SEQ ID NO: 3492355 - RNA, 18 nt, Human
agacguggaaccucuguc

SEQ ID NO: 3492356 - RNA, 13 nt, Human
agacguguacaua

SEQ ID NO: 3492357 - RNA, 19 nt, Human
agacguguggcaauagugg

SEQ ID NO: 3492358 - RNA, 13 nt, Human
agacguuuauaaa

SEQ ID NO: 3492359 - RNA, 22 nt, Human
agacguuuuauaagcaucauua

SEQ ID NO: 3492360 - RNA, 16 nt, Human
agacuaaaaguugcau

SEQ ID NO: 3492361 - RNA, 13 nt, Human
agacuaaaugaaa

SEQ ID NO: 3492362 - RNA, 15 nt, Human
agacuaagccagcac

SEQ ID NO: 3492363 - RNA, 15 nt, Human
agacuaagcccuguc

SEQ ID NO: 3492364 - RNA, 16 nt, Human
agacuacacaggauga

SEQ ID NO: 3492365 - RNA, 23 nt, Human
agacuacaggcacacaccaccac

SEQ ID NO: 3492366 - RNA, 18 nt, Human
agacuacuauuuucuuuu

SEQ ID NO: 3492367 - RNA, 22 nt, Human
agacuacuguucagcuuuuauu

SEQ ID NO: 3492368 - RNA, 13 nt, Human
agacuagagaaac

SEQ ID NO: 3492369 - RNA, 14 nt, Human
agacuagagaaacc

SEQ ID NO: 3492370 - RNA, 13 nt, Human
agacuagauguag

SEQ ID NO: 3492371 - RNA, 16 nt, Human
agacuagauugccuuu

SEQ ID NO: 3492372 - RNA, 17 nt, Human
agacuagcaaucucuuc

SEQ ID NO: 3492373 - RNA, 12 nt, Human
agacuauauaca

SEQ ID NO: 3492374 - RNA, 18 nt, Human
agacuauauacaugugug

SEQ ID NO: 3492375 - RNA, 19 nt, Human
agacuauauauauaaaugu

SEQ ID NO: 3492376 - RNA, 21 nt, Human
agacuauauauauaaauguau

SEQ ID NO: 3492377 - RNA, 19 nt, Human
agacuaucuaaauguugaa

SEQ ID NO: 3492378 - RNA, 20 nt, Human
agacuaucuuacuauuucac

SEQ ID NO: 3492379 - RNA, 15 nt, Human
agacuaugaaaaugc

SEQ ID NO: 3492380 - RNA, 15 nt, Human
agacuauggagccug

SEQ ID NO: 3492381 - RNA, 21 nt, Human
agacuauucaaacagucucag

SEQ ID NO: 3492382 - RNA, 17 nt, Human
agacuauuuaacuugag

SEQ ID NO: 3492383 - RNA, 21 nt, Human
agacuauuuuuagauuuucuu

SEQ ID NO: 3492384 - RNA, 13 nt, Human
agacucaaaugcu

SEQ ID NO: 3492385 - RNA, 17 nt, Human
agacucaaauguucuaa

SEQ ID NO: 3492386 - RNA, 20 nt, Human
agacucaaauguucuaaguu

SEQ ID NO: 3492387 - RNA, 22 nt, Human
agacucaagguggucaguaaau

SEQ ID NO: 3492388 - RNA, 14 nt, Human
agacucaccucugc

SEQ ID NO: 3492389 - RNA, 18 nt, Human
agacucagagcucucucu

SEQ ID NO: 3492390 - RNA, 19 nt, Human
agacucaggccaagaaacg

SEQ ID NO: 3492391 - RNA, 12 nt, Human
agacucagggcc

SEQ ID NO: 3492392 - RNA, 12 nt, Human
agacucaguuug

SEQ ID NO: 3492393 - RNA, 17 nt, Human
agacucaguuugucaga

SEQ ID NO: 3492394 - RNA, 15 nt, Human
agacucauucuucug

SEQ ID NO: 3492395 - RNA, 17 nt, Human
agacucauucuucugua

SEQ ID NO: 3492396 - RNA, 18 nt, Human
agacucauucuucuguac

SEQ ID NO: 3492397 - RNA, 16 nt, Human
agacuccaaagaaaug

SEQ ID NO: 3492398 - RNA, 22 nt, Human
agacuccaaagaaauguaaggg

SEQ ID NO: 3492399 - RNA, 16 nt, Human
agacucccaagcugga

SEQ ID NO: 3492400 - RNA, 18 nt, Human
agacuccgucucaaggaa

SEQ ID NO: 3492401 - RNA, 11 nt, Human
agacuccucag

SEQ ID NO: 3492402 - RNA, 17 nt, Human
agacuccucaguucuug

SEQ ID NO: 3492403 - RNA, 15 nt, Human
agacuccugaggaca

SEQ ID NO: 3492404 - RNA, 20 nt, Human
agacuccugaggacagcugu

SEQ ID NO: 3492405 - RNA, 17 nt, Human
agacuccugcaggcagc

SEQ ID NO: 3492406 - RNA, 14 nt, Human
agacuccugcccug

SEQ ID NO: 3492407 - RNA, 17 nt, Human
agacucgacucugugcc

SEQ ID NO: 3492408 - RNA, 21 nt, Human
agacucgauagugguggugaa

SEQ ID NO: 3492409 - RNA, 19 nt, Human
agacucgccaacaugguga

SEQ ID NO: 3492410 - RNA, 15 nt, Human
agacucgcgacaaug

SEQ ID NO: 3492411 - RNA, 17 nt, Human
agacucuaagaaagaac

SEQ ID NO: 3492412 - RNA, 18 nt, Human
agacucuagacaagauau

SEQ ID NO: 3492413 - RNA, 17 nt, Human
agacucuaguauuuaug

SEQ ID NO: 3492414 - RNA, 15 nt, Human
agacucuauucucaa

SEQ ID NO: 3492415 - RNA, 20 nt, Human
agacucucgcaucuucccaa

SEQ ID NO: 3492416 - RNA, 14 nt, Human
agacucuggucuuc

SEQ ID NO: 3492417 - RNA, 20 nt, Human
agacucugucuaaaaaacaa

SEQ ID NO: 3492418 - RNA, 21 nt, Human
agacucugucuaaaaaacaaa

SEQ ID NO: 3492419 - RNA, 13 nt, Human
agacucugucuca

SEQ ID NO: 3492420 - RNA, 18 nt, Human
agacucugucucaaaaaa

SEQ ID NO: 3492421 - RNA, 18 nt, Human
agacucuugccuguuucc

SEQ ID NO: 3492422 - RNA, 16 nt, Human
agacucuuuggacacu

SEQ ID NO: 3492423 - RNA, 22 nt, Human
agacucuuuuuguaccugguga

SEQ ID NO: 3492424 - RNA, 23 nt, Human
agacugaaaauauauaagcucag

SEQ ID NO: 3492425 - RNA, 24 nt, Human
agacugaauagauaugaaagcuga

SEQ ID NO: 3492426 - RNA, 19 nt, Human
agacugacaaccucaucca

SEQ ID NO: 3492427 - RNA, 14 nt, Human
agacugacgccagg

SEQ ID NO: 3492428 - RNA, 16 nt, Human
agacugagcaccugcu

SEQ ID NO: 3492429 - RNA, 20 nt, Human
agacugaguacguugugcau

SEQ ID NO: 3492430 - RNA, 20 nt, Human
agacugcacccaggagggga

SEQ ID NO: 3492431 - RNA, 21 nt, Human
agacugcagguuggaccccag

SEQ ID NO: 3492432 - RNA, 17 nt, Human
agacugcauuauauuua

SEQ ID NO: 3492433 - RNA, 21 nt, Human
agacugcauuauauuuauuac

SEQ ID NO: 3492434 - RNA, 15 nt, Human
agacugccacaagga

SEQ ID NO: 3492435 - RNA, 11 nt, Human
agacugccagc

SEQ ID NO: 3492436 - RNA, 18 nt, Human
agacugccagcucuuccu

SEQ ID NO: 3492437 - RNA, 20 nt, Human
agacugccauauuaaauuuu

SEQ ID NO: 3492438 - RNA, 17 nt, Human
agacugcuccugagccc

SEQ ID NO: 3492439 - RNA, 15 nt, Human
agacugcugggacug

SEQ ID NO: 3492440 - RNA, 16 nt, Human
agacugcuguggccag

SEQ ID NO: 3492441 - RNA, 17 nt, Human
agacugcuguggccagg

SEQ ID NO: 3492442 - RNA, 18 nt, Human
agacugcuguggccagga

SEQ ID NO: 3492443 - RNA, 19 nt, Human
agacugcuuccaauuuucu

SEQ ID NO: 3492444 - RNA, 16 nt, Human
agacuggaaaaaauga

SEQ ID NO: 3492445 - RNA, 15 nt, Human
agacuggaacacuag

SEQ ID NO: 3492446 - RNA, 18 nt, Human
agacuggaacuugaacug

SEQ ID NO: 3492447 - RNA, 16 nt, Human
agacuggaagcacagc

SEQ ID NO: 3492448 - RNA, 14 nt, Human
agacuggaagcuaa

SEQ ID NO: 3492449 - RNA, 11 nt, Human
agacuggaagg

SEQ ID NO: 3492450 - RNA, 14 nt, Human
agacuggacagcuu

SEQ ID NO: 3492451 - RNA, 16 nt, Human
agacuggacagcuugu

SEQ ID NO: 3492452 - RNA, 15 nt, Human
agacuggagcaucug

SEQ ID NO: 3492453 - RNA, 16 nt, Human
agacuggauacugccc

SEQ ID NO: 3492454 - RNA, 18 nt, Human
agagaagugacagggaag

SEQ ID NO: 3492455 - RNA, 14 nt, Human
agagaagugccccu

SEQ ID NO: 3492456 - RNA, 15 nt, Human
agagaagugccccug

SEQ ID NO: 3492457 - RNA, 13 nt, Human
agagaauaaauug

SEQ ID NO: 3492458 - RNA, 16 nt, Human
agagaauauaacauga

SEQ ID NO: 3492459 - RNA, 22 nt, Human
agagaauauaacaugaaaugau

SEQ ID NO: 3492460 - RNA, 13 nt, Human
agagaauauuuua

SEQ ID NO: 3492461 - RNA, 15 nt, Human
agagaaucaacauuu

SEQ ID NO: 3492462 - RNA, 22 nt, Human
agagaaugaaauugcugaaaga

SEQ ID NO: 3492463 - RNA, 15 nt, Human
agagaaugagagaca

SEQ ID NO: 3492464 - RNA, 19 nt, Human
agagaaugcacagauauac

SEQ ID NO: 3492465 - RNA, 15 nt, Human
agagaauggaaaaca

SEQ ID NO: 3492466 - RNA, 14 nt, Human
agagaauguauuug

SEQ ID NO: 3492467 - RNA, 20 nt, Human
agagaauguuauagugaauu

SEQ ID NO: 3492468 - RNA, 22 nt, Human
agagaauguuauagugaauuau

SEQ ID NO: 3492469 - RNA, 18 nt, Human
acgcuugacaggacagca

SEQ ID NO: 3492470 - RNA, 21 nt, Human
acgcuugacaggacagcaugg

SEQ ID NO: 3492471 - RNA, 22 nt, Human
acgcuugcucuguuuguggggu

SEQ ID NO: 3492472 - RNA, 18 nt, Human
acgcuuuccugaauccaa

SEQ ID NO: 3492473 - RNA, 14 nt, Human
acgcuuugauucau

SEQ ID NO: 3492474 - RNA, 20 nt, Human
acgcuuuuaaugaaaaggaa

SEQ ID NO: 3492475 - RNA, 14 nt, Human
acgcuuuugugaug

SEQ ID NO: 3492476 - RNA, 17 nt, Human
acggaacguuggacuuu

SEQ ID NO: 3492477 - RNA, 14 nt, Human
acggaacucaaaua

SEQ ID NO: 3492478 - RNA, 16 nt, Human
acggaagagccuugcg

SEQ ID NO: 3492479 - RNA, 16 nt, Human
acggaaggguaaacaa

SEQ ID NO: 3492480 - RNA, 20 nt, Human
acggaaguuuucaaugaugg

SEQ ID NO: 3492481 - RNA, 15 nt, Human
acggacacccccucg

SEQ ID NO: 3492482 - RNA, 16 nt, Human
acggacacccccucgc

SEQ ID NO: 3492483 - RNA, 21 nt, Human
acggacaguuccagaagugug

SEQ ID NO: 3492484 - RNA, 19 nt, Human
acggacgaaccuugaaaac

SEQ ID NO: 3492485 - RNA, 16 nt, Human
acggacguuuccauca

SEQ ID NO: 3492486 - RNA, 14 nt, Human
acggagagaaaaaa

SEQ ID NO: 3492487 - RNA, 20 nt, Human
acggagcggauugcaaagca

SEQ ID NO: 3492488 - RNA, 23 nt, Human
acggaggcaaagcuggcucaccu

SEQ ID NO: 3492489 - RNA, 18 nt, Human
acggaggcauccuacccu

SEQ ID NO: 3492490 - RNA, 21 nt, Human
acggaggccugcgacccuggg

SEQ ID NO: 3492491 - RNA, 19 nt, Human
acggagucccaccuuggcu

SEQ ID NO: 3492492 - RNA, 23 nt, Human
acggagucccaccuuggcugcag

SEQ ID NO: 3492493 - RNA, 21 nt, Human
acggagucucacucugucacc

SEQ ID NO: 3492494 - RNA, 22 nt, Human
acggauccugcacugacucugg

SEQ ID NO: 3492495 - RNA, 17 nt, Human
acggaucugagaaucuu

SEQ ID NO: 3492496 - RNA, 22 nt, Human
acggaugccuuccccugggccc

SEQ ID NO: 3492497 - RNA, 13 nt, Human
acggcacccaccc

SEQ ID NO: 3492498 - RNA, 22 nt, Human
acggcacugagagagcgcagcc

SEQ ID NO: 3492499 - RNA, 16 nt, Human
acggccacacagcugc

SEQ ID NO: 3492500 - RNA, 18 nt, Human
acggccacacagcugccg

SEQ ID NO: 3492501 - RNA, 18 nt, Human
acggccagggagaagcuc

SEQ ID NO: 3492502 - RNA, 13 nt, Human
acggccccagcuu

SEQ ID NO: 3492503 - RNA, 18 nt, Human
acggccccagcuucucag

SEQ ID NO: 3492504 - RNA, 15 nt, Human
acggccugaugcucc

SEQ ID NO: 3492505 - RNA, 22 nt, Human
acggccugaugcucccuccccu

SEQ ID NO: 3492506 - RNA, 21 nt, Human
acggccuucaacugaaaagac

SEQ ID NO: 3492507 - RNA, 14 nt, Human
acggccuuucuagc

SEQ ID NO: 3492508 - RNA, 19 nt, Human
acggcguuguaccuguagg

SEQ ID NO: 3492509 - RNA, 15 nt, Human
acggcuaagaggcug

SEQ ID NO: 3492510 - RNA, 17 nt, Human
acggcuaagaggcugcu

SEQ ID NO: 3492511 - RNA, 18 nt, Human
acggcuaagaggcugcug

SEQ ID NO: 3492512 - RNA, 14 nt, Human
acggcucacugcag

SEQ ID NO: 3492513 - RNA, 15 nt, Human
acggcucacugcagc

SEQ ID NO: 3492514 - RNA, 17 nt, Human
acggcucacugcagccu

SEQ ID NO: 3492515 - RNA, 22 nt, Human
acggcuccacuaggacuucaaa

SEQ ID NO: 3492516 - RNA, 17 nt, Human
acggcucuagguggggc

SEQ ID NO: 3492517 - RNA, 18 nt, Human
acggcugcgcacuguguc

SEQ ID NO: 3492518 - RNA, 19 nt, Human
acgggaagcaaccucccaa

SEQ ID NO: 3492519 - RNA, 19 nt, Human
acgggacaucacagggugg

SEQ ID NO: 3492520 - RNA, 18 nt, Human
acgggcaugggcacuccc

SEQ ID NO: 3492521 - RNA, 16 nt, Human
acgggcccggguuggg

SEQ ID NO: 3492522 - RNA, 17 nt, Human
acgggcccggguugggu

SEQ ID NO: 3492523 - RNA, 20 nt, Human
acgggcccggguugggucac

SEQ ID NO: 3492524 - RNA, 14 nt, Human
acggggaggccaag

SEQ ID NO: 3492525 - RNA, 23 nt, Human
acggggaggccaagugcaggcug

SEQ ID NO: 3492526 - RNA, 14 nt, Human
acgggguccuucaa

SEQ ID NO: 3492527 - RNA, 15 nt, Human
acgggguuucaccau

SEQ ID NO: 3492528 - RNA, 14 nt, Human
acggguggggaaag

SEQ ID NO: 3492529 - RNA, 15 nt, Human
acggguuggggccgg

SEQ ID NO: 3492530 - RNA, 15 nt, Human
acggucagguuuaac

SEQ ID NO: 3492531 - RNA, 21 nt, Human
acggucccacacuggugacug

SEQ ID NO: 3492532 - RNA, 22 nt, Human
acggucggggcaucuggccugg

SEQ ID NO: 3492533 - RNA, 20 nt, Human
acggucuguucuugaagcag

SEQ ID NO: 3492534 - RNA, 16 nt, Human
acggugaaggugacag

SEQ ID NO: 3492535 - RNA, 19 nt, Human
acggugaauggcuuuguau

SEQ ID NO: 3492536 - RNA, 14 nt, Human
acggugcccaagcc

SEQ ID NO: 3492537 - RNA, 21 nt, Human
acggugccuuuuuucacggaa

SEQ ID NO: 3492538 - RNA, 15 nt, Human
acggugcuccaggca

SEQ ID NO: 3492539 - RNA, 20 nt, Human
acggugcugugagggagggg

SEQ ID NO: 3492540 - RNA, 19 nt, Human
acggugggcauuugugagg

SEQ ID NO: 3492541 - RNA, 17 nt, Human
acggugggccuugcugg

SEQ ID NO: 3492542 - RNA, 21 nt, Human
acgguggucggugggacccug

SEQ ID NO: 3492543 - RNA, 17 nt, Human
acgguguuuugccaugu

SEQ ID NO: 3492544 - RNA, 14 nt, Human
acgguuaacuguaa

SEQ ID NO: 3492545 - RNA, 17 nt, Human
acgguuccuacacagga

SEQ ID NO: 3492546 - RNA, 18 nt, Human
acgguuccuacacaggac

SEQ ID NO: 3492547 - RNA, 15 nt, Human
acgguuuuacugcag

SEQ ID NO: 3492548 - RNA, 17 nt, Human
acgguuuuacugcagcu

SEQ ID NO: 3492549 - RNA, 17 nt, Human
acguaagcacuguuuuu

SEQ ID NO: 3492550 - RNA, 13 nt, Human
acguacacacaca

SEQ ID NO: 3492551 - RNA, 13 nt, Human
acguacacauuuu

SEQ ID NO: 3492552 - RNA, 13 nt, Human
acguacauguuua

SEQ ID NO: 3492553 - RNA, 20 nt, Human
acguacguaucagcggcccc

SEQ ID NO: 3492554 - RNA, 20 nt, Human
acguacugcagccuccagag

SEQ ID NO: 3492555 - RNA, 14 nt, Human
acguacugucugau

SEQ ID NO: 3492556 - RNA, 13 nt, Human
acguauuuaauag

SEQ ID NO: 3492557 - RNA, 17 nt, Human
acgucaagucuccuucc

SEQ ID NO: 3492558 - RNA, 21 nt, Human
acgucacguguaguguccauu

SEQ ID NO: 3492559 - RNA, 17 nt, Human
acgucagacuuggcuca

SEQ ID NO: 3492560 - RNA, 18 nt, Human
acgucagacuuggcucag

SEQ ID NO: 3492561 - RNA, 15 nt, Human
acgucagauguuuaa

SEQ ID NO: 3492562 - RNA, 23 nt, Human
acguccaccaugggguccuacca

SEQ ID NO: 3492563 - RNA, 22 nt, Human
acgucccuccacguucaccccu

SEQ ID NO: 3492564 - RNA, 15 nt, Human
acguccugucagugc

SEQ ID NO: 3492565 - RNA, 23 nt, Human
acgucuagcuaugcuguaucugu

SEQ ID NO: 3492566 - RNA, 18 nt, Human
acgucuauuucaucagaa

SEQ ID NO: 3492567 - RNA, 14 nt, Human
acgucugacaggca

SEQ ID NO: 3492568 - RNA, 23 nt, Human
acgucugacaggcaaugcuggcu

SEQ ID NO: 3492569 - RNA, 22 nt, Human
acgucugggagaaauugacaga

SEQ ID NO: 3492570 - RNA, 19 nt, Human
acgucugucuucacagcuc

SEQ ID NO: 3492571 - RNA, 17 nt, Human
acgugaagauaccauaa

SEQ ID NO: 3492572 - RNA, 21 nt, Human
acgugaccggacuuuucugca

SEQ ID NO: 3492573 - RNA, 14 nt, Human
acgugagagugucu

SEQ ID NO: 3492574 - RNA, 14 nt, Human
acgugagccaggua

SEQ ID NO: 3492575 - RNA, 18 nt, Human
acgugauggucugagacu

SEQ ID NO: 3492576 - RNA, 21 nt, Human
acgugaugugcucaucagaaa

SEQ ID NO: 3492577 - RNA, 22 nt, Human
acgugauucaauucaacacucc

SEQ ID NO: 3492578 - RNA, 23 nt, Human
acgugcaacugacacucccaccc

SEQ ID NO: 3492579 - RNA, 15 nt, Human
acgugcauugugcuu

SEQ ID NO: 3492580 - RNA, 22 nt, Human
acgugcauugugcuucuuucuu

SEQ ID NO: 3492581 - RNA, 21 nt, Human
acgugccuuuugcaccccucc

SEQ ID NO: 3492582 - RNA, 22 nt, Human
acgugcgcugggcacuucccug

SEQ ID NO: 3492583 - RNA, 19 nt, Human
acguggagaaucacaggcu

SEQ ID NO: 3492584 - RNA, 15 nt, Human
acguggagagggaug

SEQ ID NO: 3492585 - RNA, 13 nt, Human
acguggaggagca

SEQ ID NO: 3492586 - RNA, 18 nt, Human
acguggaggagcagugca

SEQ ID NO: 3492587 - RNA, 14 nt, Human
acguggcaccuccu

SEQ ID NO: 3492588 - RNA, 13 nt, Human
acguggcacuggu

SEQ ID NO: 3492589 - RNA, 20 nt, Human
acguggccaagagaaacuuc

SEQ ID NO: 3492590 - RNA, 15 nt, Human
acguggcccagagaa

SEQ ID NO: 3492591 - RNA, 21 nt, Human
acguggcugcgugccccugcu

SEQ ID NO: 3492592 - RNA, 15 nt, Human
acguggcugcuucaa

SEQ ID NO: 3492593 - RNA, 18 nt, Human
acguggcugcuucaagga

SEQ ID NO: 3492594 - RNA, 15 nt, Human
acguggcuucugaug

SEQ ID NO: 3492595 - RNA, 20 nt, Human
acguggcuucugaugaaucu

SEQ ID NO: 3492596 - RNA, 18 nt, Human
acguggcuuuuagacaga

SEQ ID NO: 3492597 - RNA, 17 nt, Human
acgugggcauucaaaug

SEQ ID NO: 3492598 - RNA, 22 nt, Human
caguaagucucauagguuaaaa

SEQ ID NO: 3492599 - RNA, 14 nt, Human
caguaagucuuuuu

SEQ ID NO: 3492600 - RNA, 14 nt, Human
caguaauaaaacau

SEQ ID NO: 3492601 - RNA, 19 nt, Human
caguaauaacucuacccug

SEQ ID NO: 3492602 - RNA, 21 nt, Human
caguaauugguccgaucuuug

SEQ ID NO: 3492603 - RNA, 14 nt, Human
caguaauugugaaa

SEQ ID NO: 3492604 - RNA, 17 nt, Human
caguaauuguguuuaca

SEQ ID NO: 3492605 - RNA, 20 nt, Human
caguaauuguguuuacauuu

SEQ ID NO: 3492606 - RNA, 14 nt, Human
caguaauuuagaaa

SEQ ID NO: 3492607 - RNA, 15 nt, Human
caguacagcaugugc

SEQ ID NO: 3492608 - RNA, 16 nt, Human
caguacaggcagcaca

SEQ ID NO: 3492609 - RNA, 21 nt, Human
caguacauucucaguuuuucu

SEQ ID NO: 3492610 - RNA, 16 nt, Human
caguacauuuaaauuu

SEQ ID NO: 3492611 - RNA, 17 nt, Human
caguacauuuaaauuuu

SEQ ID NO: 3492612 - RNA, 23 nt, Human
caguaccauuuaauggggaggac

SEQ ID NO: 3492613 - RNA, 16 nt, Human
caguacccaccaccuu

SEQ ID NO: 3492614 - RNA, 19 nt, Human
caguacccaccugagcuuu

SEQ ID NO: 3492615 - RNA, 17 nt, Human
caguaccccauggagcu

SEQ ID NO: 3492616 - RNA, 15 nt, Human
caguacccucucagc

SEQ ID NO: 3492617 - RNA, 19 nt, Human
caguacccucucagcucca

SEQ ID NO: 3492618 - RNA, 22 nt, Human
caguaccuauaaaguaaagcua

SEQ ID NO: 3492619 - RNA, 20 nt, Human
caguaccuccugucucuggc

SEQ ID NO: 3492620 - RNA, 22 nt, Human
caguaccugagggucuguaggu

SEQ ID NO: 3492621 - RNA, 12 nt, Human
caguaccuggag

SEQ ID NO: 3492622 - RNA, 14 nt, Human
caguaccuggagga

SEQ ID NO: 3492623 - RNA, 15 nt, Human
caguaccuggaggag

SEQ ID NO: 3492624 - RNA, 21 nt, Human
caguaccuggaggaggagcag

SEQ ID NO: 3492625 - RNA, 23 nt, Human
caguaccuucaaacuagggccaa

SEQ ID NO: 3492626 - RNA, 15 nt, Human
caguaccuuugucac

SEQ ID NO: 3492627 - RNA, 16 nt, Human
caguaccuuugucaca

SEQ ID NO: 3492628 - RNA, 17 nt, Human
caguaccuuugucacaa

SEQ ID NO: 3492629 - RNA, 22 nt, Human
caguacuauucagguaacacua

SEQ ID NO: 3492630 - RNA, 24 nt, Human
caguacuucagcaagagagaaccu

SEQ ID NO: 3492631 - RNA, 13 nt, Human
caguacuugucau

SEQ ID NO: 3492632 - RNA, 21 nt, Human
caguacuugugaaacacagcu

SEQ ID NO: 3492633 - RNA, 22 nt, Human
caguacuugugaaacacagcug

SEQ ID NO: 3492634 - RNA, 16 nt, Human
caguacuuuggaggcc

SEQ ID NO: 3492635 - RNA, 19 nt, Human
caguacuuuggaggccccu

SEQ ID NO: 3492636 - RNA, 18 nt, Human
caguagaaauaauaugca

SEQ ID NO: 3492637 - RNA, 19 nt, Human
caguagacauuuuaacaag

SEQ ID NO: 3492638 - RNA, 21 nt, Human
caguagacauuuuaacaagaa

SEQ ID NO: 3492639 - RNA, 14 nt, Human
caguagagccagcu

SEQ ID NO: 3492640 - RNA, 16 nt, Human
caguagagccagcuug

SEQ ID NO: 3492641 - RNA, 21 nt, Human
ccuccccggcccuaccagcgc

SEQ ID NO: 3492642 - RNA, 13 nt, Human
ccuccccuaucca

SEQ ID NO: 3492643 - RNA, 15 nt, Human
ccuccccuauccacc

SEQ ID NO: 3492644 - RNA, 14 nt, Human
ccuccccucaagga

SEQ ID NO: 3492645 - RNA, 19 nt, Human
ccuccccucacagccucug

SEQ ID NO: 3492646 - RNA, 21 nt, Human
ccuccccucacagccucugac

SEQ ID NO: 3492647 - RNA, 14 nt, Human
ccuccccuccccug

SEQ ID NO: 3492648 - RNA, 15 nt, Human
ccuccccucccgucu

SEQ ID NO: 3492649 - RNA, 18 nt, Human
ccuccccuccuccuggac

SEQ ID NO: 3492650 - RNA, 15 nt, Human
ccuccccuccucugc

SEQ ID NO: 3492651 - RNA, 16 nt, Human
ccuccccucucugcac

SEQ ID NO: 3492652 - RNA, 16 nt, Human
ccuccccucucuugca

SEQ ID NO: 3492653 - RNA, 14 nt, Human
ccuccccugccacc

SEQ ID NO: 3492654 - RNA, 18 nt, Human
ccuccccugccagggcag

SEQ ID NO: 3492655 - RNA, 14 nt, Human
ccuccccugccauu

SEQ ID NO: 3492656 - RNA, 14 nt, Human
ccuccccugcccua

SEQ ID NO: 3492657 - RNA, 15 nt, Human
ccuccccugcccucg

SEQ ID NO: 3492658 - RNA, 16 nt, Human
ccuccccugcugaagg

SEQ ID NO: 3492659 - RNA, 20 nt, Human
ccuccccugcugcaggggcu

SEQ ID NO: 3492660 - RNA, 12 nt, Human
ccuccccuggag

SEQ ID NO: 3492661 - RNA, 13 nt, Human
ccuccccugggga

SEQ ID NO: 3492662 - RNA, 14 nt, Human
ccuccccuggggac

SEQ ID NO: 3492663 - RNA, 18 nt, Human
ccuccccuuaaaggggag

SEQ ID NO: 3492664 - RNA, 22 nt, Human
ccuccccuugccagcugcugag

SEQ ID NO: 3492665 - RNA, 13 nt, Human
ccuccccuugggc

SEQ ID NO: 3492666 - RNA, 24 nt, Human
ccuccccuugggcccacaccuccu

SEQ ID NO: 3492667 - RNA, 23 nt, Human
ccuccccuugggcggcugagagc

SEQ ID NO: 3492668 - RNA, 19 nt, Human
ccucccgaauagcugggac

SEQ ID NO: 3492669 - RNA, 20 nt, Human
ccucccgaauagcugggacu

SEQ ID NO: 3492670 - RNA, 20 nt, Human
ccucccgagcuccucuucca

SEQ ID NO: 3492671 - RNA, 17 nt, Human
ccucccgaguagcuggg

SEQ ID NO: 3492672 - RNA, 19 nt, Human
ccucccgaguagcugggac

SEQ ID NO: 3492673 - RNA, 15 nt, Human
ccucccggcccugcc

SEQ ID NO: 3492674 - RNA, 17 nt, Human
ccucccggcccugccug

SEQ ID NO: 3492675 - RNA, 13 nt, Human
ccucccggugccc

SEQ ID NO: 3492676 - RNA, 20 nt, Human
ccucccgucuacucauuccc

SEQ ID NO: 3492677 - RNA, 13 nt, Human
ccucccuaccuca

SEQ ID NO: 3492678 - RNA, 19 nt, Human
ccucccuaccucaaccugu

SEQ ID NO: 3492679 - RNA, 22 nt, Human
ccucccuaccucaaccuguaaa

SEQ ID NO: 3492680 - RNA, 15 nt, Human
ccucccuagccagca

SEQ ID NO: 3492681 - RNA, 18 nt, Human
ccucccuagugacccgga

SEQ ID NO: 3492682 - RNA, 17 nt, Human
ccucccucaaccucauc

SEQ ID NO: 3492683 - RNA, 22 nt, Human
ccucccucacccugagccccuu

SEQ ID NO: 3492684 - RNA, 20 nt, Human
ccucccucagccccucuugc

SEQ ID NO: 3492685 - RNA, 13 nt, Human
ccucccuccaccc

SEQ ID NO: 3492686 - RNA, 15 nt, Human
ccucccuccacccca

SEQ ID NO: 3492687 - RNA, 20 nt, Human
ccucccuccaccucccugca

SEQ ID NO: 3492688 - RNA, 15 nt, Human
ccucccuccccuugc

SEQ ID NO: 3492689 - RNA, 16 nt, Human
ccucccuccucugucc

SEQ ID NO: 3492690 - RNA, 13 nt, Human
ccucccucuccag

SEQ ID NO: 3492691 - RNA, 18 nt, Human
ccucccucucucuucugc

SEQ ID NO: 3492692 - RNA, 20 nt, Human
ccucccucucucuucugcuc

SEQ ID NO: 3492693 - RNA, 18 nt, Human
ccucccucugauuuuuca

SEQ ID NO: 3492694 - RNA, 22 nt, Human
ccucccugacccugcagagaug

SEQ ID NO: 3492695 - RNA, 16 nt, Human
ccucccugcaauaaaa

SEQ ID NO: 3492696 - RNA, 14 nt, Human
ccucccugcaucug

SEQ ID NO: 3492697 - RNA, 13 nt, Human
ccucccugcccag

SEQ ID NO: 3492698 - RNA, 14 nt, Human
ccucccugcccagg

SEQ ID NO: 3492699 - RNA, 15 nt, Human
ccucccugccucagg

SEQ ID NO: 3492700 - RNA, 12 nt, Human
ccucccugcugu

SEQ ID NO: 3492701 - RNA, 22 nt, Human
ccucccugcugucauugcuucu

SEQ ID NO: 3492702 - RNA, 23 nt, Human
ccucccugcuguccccucuugcc

SEQ ID NO: 3492703 - RNA, 12 nt, Human
ccucccuggcuc

SEQ ID NO: 3492704 - RNA, 20 nt, Human
ccucccuggcucccaugacc

SEQ ID NO: 3492705 - RNA, 15 nt, Human
ccucccuggcugccc

SEQ ID NO: 3492706 - RNA, 21 nt, Human
ccucccuggcugcccuggccc

SEQ ID NO: 3492707 - RNA, 23 nt, Human
ccucccuggcugcccuggcccug

SEQ ID NO: 3492708 - RNA, 10 nt, Human
ccucccuggg

SEQ ID NO: 3492709 - RNA, 20 nt, Human
ccucccuggugagagggccg

SEQ ID NO: 3492710 - RNA, 14 nt, Human
ccucccuguaacuu

SEQ ID NO: 3492711 - RNA, 19 nt, Human
ccucccuguucaaggcccc

SEQ ID NO: 3492712 - RNA, 20 nt, Human
ccucccuguuccccagagaa

SEQ ID NO: 3492713 - RNA, 21 nt, Human
ccucccuguugaagcucuggu

SEQ ID NO: 3492714 - RNA, 15 nt, Human
ccucccuuccgaccc

SEQ ID NO: 3492715 - RNA, 13 nt, Human
ccucccuuccuuu

SEQ ID NO: 3492716 - RNA, 15 nt, Human
ccucccuuccuuuuc

SEQ ID NO: 3492717 - RNA, 17 nt, Human
ccucccuuccuuuuccc

SEQ ID NO: 3492718 - RNA, 16 nt, Human
ccucccuucucccugg

SEQ ID NO: 3492719 - RNA, 16 nt, Human
ccucccuucugcuacu

SEQ ID NO: 3492720 - RNA, 13 nt, Human
ccucccuugccuu

SEQ ID NO: 3492721 - RNA, 22 nt, Human
ccucccuuggaaaccugcccug

SEQ ID NO: 3492722 - RNA, 15 nt, Human
ccucccuuucucccc

SEQ ID NO: 3492723 - RNA, 14 nt, Human
ccuccgagagggag

SEQ ID NO: 3492724 - RNA, 19 nt, Human
ccuccgagagggagagaga

SEQ ID NO: 3492725 - RNA, 21 nt, Human
ccuccgagccggggaguuucu

SEQ ID NO: 3492726 - RNA, 14 nt, Human
ccuccgaggccagu

SEQ ID NO: 3492727 - RNA, 21 nt, Human
ccuccgccaaugcacggccuc

SEQ ID NO: 3492728 - RNA, 15 nt, Human
ccuccgccauccacc

SEQ ID NO: 3492729 - RNA, 23 nt, Human
ccuccgccauucucaagcccugc

SEQ ID NO: 3492730 - RNA, 16 nt, Human
ccuccgcccugccacu

SEQ ID NO: 3492731 - RNA, 18 nt, Human
ccuccgccuucacauucc

SEQ ID NO: 3492732 - RNA, 18 nt, Human
ccuccgcggcgggcccug

SEQ ID NO: 3492733 - RNA, 14 nt, Human
ccuccgcuucccug

SEQ ID NO: 3492734 - RNA, 18 nt, Human
ccuccgggacccccagga

SEQ ID NO: 3492735 - RNA, 19 nt, Human
ccuccgggacccccaggac

SEQ ID NO: 3492736 - RNA, 19 nt, Human
ccuccgguugcauacugga

SEQ ID NO: 3492737 - RNA, 20 nt, Human
ccuccgucacuaccuggcug

SEQ ID NO: 3492738 - RNA, 15 nt, Human
ccuccguccccugcc

SEQ ID NO: 3492739 - RNA, 16 nt, Human
ccuccguugggcccca

SEQ ID NO: 3492740 - RNA, 16 nt, Human
ccuccuaaaaggccca

SEQ ID NO: 3492741 - RNA, 17 nt, Human
ccuccuaaaaggcccag

SEQ ID NO: 3492742 - RNA, 18 nt, Human
ccuccuaaaaggcccaga

SEQ ID NO: 3492743 - RNA, 12 nt, Human
ccuaaccccuuu

SEQ ID NO: 3492744 - RNA, 18 nt, Human
ccuaaccucgggccugcu

SEQ ID NO: 3492745 - RNA, 20 nt, Human
ccuaacgaaguauccuucag

SEQ ID NO: 3492746 - RNA, 15 nt, Human
ccuaacucauacugu

SEQ ID NO: 3492747 - RNA, 17 nt, Human
ccuaacucuucuuucau

SEQ ID NO: 3492748 - RNA, 16 nt, Human
ccuaacuguaucuuga

SEQ ID NO: 3492749 - RNA, 20 nt, Human
ccuaagaaauaugugagauu

SEQ ID NO: 3492750 - RNA, 15 nt, Human
ccuaagaauaaacau

SEQ ID NO: 3492751 - RNA, 14 nt, Human
ccuaagaaucagag

SEQ ID NO: 3492752 - RNA, 22 nt, Human
ccuaagagacugcguucugcaa

SEQ ID NO: 3492753 - RNA, 12 nt, Human
ccuaagaggcug

SEQ ID NO: 3492754 - RNA, 23 nt, Human
ccuaagcaaacccagugucagga

SEQ ID NO: 3492755 - RNA, 14 nt, Human
ccuaagcagaaagu

SEQ ID NO: 3492756 - RNA, 19 nt, Human
ccuaagcagaaagugccuu

SEQ ID NO: 3492757 - RNA, 13 nt, Human
ccuaagcaucuaa

SEQ ID NO: 3492758 - RNA, 21 nt, Human
ccuaagccaagggccucuugc

SEQ ID NO: 3492759 - RNA, 13 nt, Human
ccuaagccagccu

SEQ ID NO: 3492760 - RNA, 17 nt, Human
ccuaagccagccugguc

SEQ ID NO: 3492761 - RNA, 18 nt, Human
ccuaagccagcugccccc

SEQ ID NO: 3492762 - RNA, 15 nt, Human
ccuaagccuguggcu

SEQ ID NO: 3492763 - RNA, 19 nt, Human
ccuaagcuggagugcagug

SEQ ID NO: 3492764 - RNA, 22 nt, Human
ccuaaggaaaggaauuggcaug

SEQ ID NO: 3492765 - RNA, 13 nt, Human
ccuaaggaaccuu

SEQ ID NO: 3492766 - RNA, 17 nt, Human
ccuaaggacacacuaau

SEQ ID NO: 3492767 - RNA, 12 nt, Human
ccuaaggacuuc

SEQ ID NO: 3492768 - RNA, 17 nt, Human
ccuaaggacuucuuuaa

SEQ ID NO: 3492769 - RNA, 18 nt, Human
ccuaaggacuucuuuaau

SEQ ID NO: 3492770 - RNA, 22 nt, Human
ccuaaggaucucucaggagcac

SEQ ID NO: 3492771 - RNA, 22 nt, Human
ccuaaggcugcaagguuuaggc

SEQ ID NO: 3492772 - RNA, 19 nt, Human
ccuaagggcucaccguggc

SEQ ID NO: 3492773 - RNA, 13 nt, Human
ccuaaguauuaaa

SEQ ID NO: 3492774 - RNA, 18 nt, Human
ccuaaguauuaaaacauu

SEQ ID NO: 3492775 - RNA, 16 nt, Human
ccuaaguggcugcuga

SEQ ID NO: 3492776 - RNA, 17 nt, Human
ccuaagugucaccccgc

SEQ ID NO: 3492777 - RNA, 16 nt, Human
ccuaauaaaaagguga

SEQ ID NO: 3492778 - RNA, 18 nt, Human
ccuaauaaaacugaugug

SEQ ID NO: 3492779 - RNA, 19 nt, Human
ccuaauaaaacugauguga

SEQ ID NO: 3492780 - RNA, 20 nt, Human
ccuaauccaggcagauccag

SEQ ID NO: 3492781 - RNA, 12 nt, Human
ccuaaugaaagu

SEQ ID NO: 3492782 - RNA, 22 nt, Human
ccuaaugaaagugaugacauau

SEQ ID NO: 3492783 - RNA, 18 nt, Human
ccuaaugagaagucaaca

SEQ ID NO: 3492784 - RNA, 19 nt, Human
ccuaaugcuccuuguuccu

SEQ ID NO: 3492785 - RNA, 18 nt, Human
ccuaauguuuaugagcca

SEQ ID NO: 3492786 - RNA, 17 nt, Human
ccuaauuaauuucagua

SEQ ID NO: 3492787 - RNA, 14 nt, Human
ccuaauuagagcag

SEQ ID NO: 3492788 - RNA, 12 nt, Human
ccuaauucagcc

SEQ ID NO: 3492789 - RNA, 13 nt, Human
ccuaauuccacag

SEQ ID NO: 3492790 - RNA, 17 nt, Human
ccuaauucuaugccugu

SEQ ID NO: 3492791 - RNA, 14 nt, Human
ccuacaaaucagua

SEQ ID NO: 3492792 - RNA, 15 nt, Human
ccuacaaaucaguaa

SEQ ID NO: 3492793 - RNA, 14 nt, Human
ccuacaaggccuau

SEQ ID NO: 3492794 - RNA, 22 nt, Human
ccuacacacugucaugcuucau

SEQ ID NO: 3492795 - RNA, 17 nt, Human
ccuacacaggacagggg

SEQ ID NO: 3492796 - RNA, 21 nt, Human
ccuacaccauuaucuuggaaa

SEQ ID NO: 3492797 - RNA, 17 nt, Human
ccuacacccagacccca

SEQ ID NO: 3492798 - RNA, 13 nt, Human
ccuacagaaaaac

SEQ ID NO: 3492799 - RNA, 14 nt, Human
ccuacagaugaacu

SEQ ID NO: 3492800 - RNA, 19 nt, Human
ccuacagcacuacugggug

SEQ ID NO: 3492801 - RNA, 22 nt, Human
ccuacagcacuacuggguguca

SEQ ID NO: 3492802 - RNA, 13 nt, Human
ccuccugcccagg

SEQ ID NO: 3492803 - RNA, 19 nt, Human
ccuccugcccaguccccca

SEQ ID NO: 3492804 - RNA, 19 nt, Human
ccuccugccggcuccuugg

SEQ ID NO: 3492805 - RNA, 12 nt, Human
ccuccugccucc

SEQ ID NO: 3492806 - RNA, 12 nt, Human
ccuccugccucu

SEQ ID NO: 3492807 - RNA, 15 nt, Human
ccuccugcuacucug

SEQ ID NO: 3492808 - RNA, 11 nt, Human
ccuccugcuca

SEQ ID NO: 3492809 - RNA, 12 nt, Human
ccuccugcugca

SEQ ID NO: 3492810 - RNA, 17 nt, Human
ccuccugcugcagaggg

SEQ ID NO: 3492811 - RNA, 21 nt, Human
ccuccugcugcagaggggcag

SEQ ID NO: 3492812 - RNA, 14 nt, Human
ccuccugcugccag

SEQ ID NO: 3492813 - RNA, 16 nt, Human
ccuccugcugccagua

SEQ ID NO: 3492814 - RNA, 19 nt, Human
ccuccugcugccaguacca

SEQ ID NO: 3492815 - RNA, 13 nt, Human
ccuccugcugggc

SEQ ID NO: 3492816 - RNA, 12 nt, Human
ccuccugcuuug

SEQ ID NO: 3492817 - RNA, 20 nt, Human
ccuccuggaaccuugcuguc

SEQ ID NO: 3492818 - RNA, 18 nt, Human
ccuccuggccucagacug

SEQ ID NO: 3492819 - RNA, 19 nt, Human
ccuccuggccucagacugc

SEQ ID NO: 3492820 - RNA, 18 nt, Human
ccuccugggaucugcucg

SEQ ID NO: 3492821 - RNA, 20 nt, Human
ccuccugggauuggcuguga

SEQ ID NO: 3492822 - RNA, 14 nt, Human
ccuccugggccccu

SEQ ID NO: 3492823 - RNA, 14 nt, Human
ccuccuggggccag

SEQ ID NO: 3492824 - RNA, 15 nt, Human
ccuccuggggccagg

SEQ ID NO: 3492825 - RNA, 18 nt, Human
ccuccuggggccaggccg

SEQ ID NO: 3492826 - RNA, 22 nt, Human
ccuccuggggcgcgugaggccc

SEQ ID NO: 3492827 - RNA, 20 nt, Human
ccuccugguggguccagggg

SEQ ID NO: 3492828 - RNA, 16 nt, Human
ccuccugucuucccag

SEQ ID NO: 3492829 - RNA, 17 nt, Human
ccuccugucuucccagg

SEQ ID NO: 3492830 - RNA, 18 nt, Human
ccuccugucuucccaggg

SEQ ID NO: 3492831 - RNA, 21 nt, Human
ccuccugugcucagcccugag

SEQ ID NO: 3492832 - RNA, 18 nt, Human
ccuccuguguacuguguc

SEQ ID NO: 3492833 - RNA, 15 nt, Human
ccuccuguugcaccc

SEQ ID NO: 3492834 - RNA, 18 nt, Human
ccuccuuaucaaaggaca

SEQ ID NO: 3492835 - RNA, 20 nt, Human
ccuccuuaucaaaggacacc

SEQ ID NO: 3492836 - RNA, 12 nt, Human
ccuccuucagac

SEQ ID NO: 3492837 - RNA, 22 nt, Human
ccuccuucagacacccucaacc

SEQ ID NO: 3492838 - RNA, 18 nt, Human
ccuccuuccaccucccuc

SEQ ID NO: 3492839 - RNA, 16 nt, Human
ccuccuucucccuuuu

SEQ ID NO: 3492840 - RNA, 22 nt, Human
ccuccuucucugucucaugugu

SEQ ID NO: 3492841 - RNA, 19 nt, Human
ccuccuucugagcuccugu

SEQ ID NO: 3492842 - RNA, 17 nt, Human
ccuccuugccuccugug

SEQ ID NO: 3492843 - RNA, 20 nt, Human
ccuccuugccuccuguguaa

SEQ ID NO: 3492844 - RNA, 15 nt, Human
ccuccuuuccuccuc

SEQ ID NO: 3492845 - RNA, 12 nt, Human
ccuccuuucucc

SEQ ID NO: 3492846 - RNA, 14 nt, Human
ccuccuuucuccuc

SEQ ID NO: 3492847 - RNA, 22 nt, Human
ccuccuuucugugcccuacuca

SEQ ID NO: 3492848 - RNA, 20 nt, Human
ccuccuuugugaggaagccg

SEQ ID NO: 3492849 - RNA, 18 nt, Human
ccuccuuuuuauguugcc

SEQ ID NO: 3492850 - RNA, 16 nt, Human
ccucgaaacacagaaa

SEQ ID NO: 3492851 - RNA, 14 nt, Human
ccucgaacuccugg

SEQ ID NO: 3492852 - RNA, 16 nt, Human
ccucgaacuccuggca

SEQ ID NO: 3492853 - RNA, 16 nt, Human
ccucgaacuccugggc

SEQ ID NO: 3492854 - RNA, 22 nt, Human
ccucgaacuccugggcucaagc

SEQ ID NO: 3492855 - RNA, 15 nt, Human
ccucgaacuggcugc

SEQ ID NO: 3492856 - RNA, 16 nt, Human
ccucgaacuggcugca

SEQ ID NO: 3492857 - RNA, 13 nt, Human
ccucgaauuuugu

SEQ ID NO: 3492858 - RNA, 23 nt, Human
ccucgacacgugggcuccccucu

SEQ ID NO: 3492859 - RNA, 15 nt, Human
ccucgacaucacugu

SEQ ID NO: 3492860 - RNA, 17 nt, Human
ccucgagggcagggacu

SEQ ID NO: 3492861 - RNA, 18 nt, Human
ccucgaggugccuucuuc

SEQ ID NO: 3492862 - RNA, 13 nt, Human
ccucgaguacugu

SEQ ID NO: 3492863 - RNA, 21 nt, Human
ccucgaguacugugggcaauu

SEQ ID NO: 3492864 - RNA, 21 nt, Human
ccucgaugggagggauggccc

SEQ ID NO: 3492865 - RNA, 23 nt, Human
ccucgcaacccgugccaagucca

SEQ ID NO: 3492866 - RNA, 22 nt, Human
ccucgcaggccucccugccagu

SEQ ID NO: 3492867 - RNA, 12 nt, Human
ccucgcccaccg

SEQ ID NO: 3492868 - RNA, 13 nt, Human
ccucgcccaccgc

SEQ ID NO: 3492869 - RNA, 13 nt, Human
ccucgcccagucc

SEQ ID NO: 3492870 - RNA, 19 nt, Human
ccucgcccagucccagcag

SEQ ID NO: 3492871 - RNA, 20 nt, Human
ccucgcccagucccagcagc

SEQ ID NO: 3492872 - RNA, 12 nt, Human
ccucgcccuggg

SEQ ID NO: 3492873 - RNA, 13 nt, Human
ccucgcccugggu

SEQ ID NO: 3492874 - RNA, 15 nt, Human
ccucgcccuuucuua

SEQ ID NO: 3492875 - RNA, 19 nt, Human
ccucgccggaucugaggga

SEQ ID NO: 3492876 - RNA, 13 nt, Human
ccucgccugacaa

SEQ ID NO: 3492877 - RNA, 18 nt, Human
ccucgccuggccugaggu

SEQ ID NO: 3492878 - RNA, 17 nt, Human
ccucgcgcuugcuggcc

SEQ ID NO: 3492879 - RNA, 14 nt, Human
ccucgcuccaacuc

SEQ ID NO: 3492880 - RNA, 22 nt, Human
ccucgcuccccacucugcucug

SEQ ID NO: 3492881 - RNA, 23 nt, Human
ccucgcuccccacucugcucuga

SEQ ID NO: 3492882 - RNA, 19 nt, Human
ccucgcugccagcucugua

SEQ ID NO: 3492883 - RNA, 14 nt, Human
ccucgcuggccccc

SEQ ID NO: 3492884 - RNA, 23 nt, Human
ccucgcuggcccccacuggcugu

SEQ ID NO: 3492885 - RNA, 14 nt, Human
ccucgcuucuuuca

SEQ ID NO: 3492886 - RNA, 12 nt, Human
ccucgcuuggac

SEQ ID NO: 3492887 - RNA, 18 nt, Human
ccucggaaccgcucaccu

SEQ ID NO: 3492888 - RNA, 23 nt, Human
ccucggaaccgcucaccuagagc

SEQ ID NO: 3492889 - RNA, 20 nt, Human
caguuaagccuuuggaaaca

SEQ ID NO: 3492890 - RNA, 17 nt, Human
caguuaaggaauauaau

SEQ ID NO: 3492891 - RNA, 21 nt, Human
caguuaaggaccguggcccug

SEQ ID NO: 3492892 - RNA, 13 nt, Human
caguuaauuacau

SEQ ID NO: 3492893 - RNA, 12 nt, Human
caguuaauuuuu

SEQ ID NO: 3492894 - RNA, 13 nt, Human
caguuaauuuuuc

SEQ ID NO: 3492895 - RNA, 22 nt, Human
caguuacauaauucacucugag

SEQ ID NO: 3492896 - RNA, 19 nt, Human
caguuaccauuaaaccauc

SEQ ID NO: 3492897 - RNA, 23 nt, Human
caguuaccauuaaaccaucuccc

SEQ ID NO: 3492898 - RNA, 21 nt, Human
caguuacccacucggucccag

SEQ ID NO: 3492899 - RNA, 22 nt, Human
caguuacuaagaagaaaauugc

SEQ ID NO: 3492900 - RNA, 20 nt, Human
caguuacucagaauucucua

SEQ ID NO: 3492901 - RNA, 16 nt, Human
caguuacucagcccug

SEQ ID NO: 3492902 - RNA, 18 nt, Human
caguuacucagcccuggg

SEQ ID NO: 3492903 - RNA, 14 nt, Human
caguuacuuuuccu

SEQ ID NO: 3492904 - RNA, 16 nt, Human
caguuacuuuuccuug

SEQ ID NO: 3492905 - RNA, 15 nt, Human
caguuagagaugccu

SEQ ID NO: 3492906 - RNA, 16 nt, Human
caguuagcaaacuuug

SEQ ID NO: 3492907 - RNA, 17 nt, Human
caguuauaaaauuaaaa

SEQ ID NO: 3492908 - RNA, 19 nt, Human
caguuauaaaauuaaaagu

SEQ ID NO: 3492909 - RNA, 15 nt, Human
caguuauaagaagaa

SEQ ID NO: 3492910 - RNA, 21 nt, Human
caguuauaaguagcaggccaa

SEQ ID NO: 3492911 - RNA, 19 nt, Human
caguuauacaguuauaaaa

SEQ ID NO: 3492912 - RNA, 20 nt, Human
caguuauacaguuauaaaau

SEQ ID NO: 3492913 - RNA, 16 nt, Human
caguuauauuuugcag

SEQ ID NO: 3492914 - RNA, 18 nt, Human
caguuaugugaaugaucu

SEQ ID NO: 3492915 - RNA, 13 nt, Human
caguuaugugacc

SEQ ID NO: 3492916 - RNA, 15 nt, Human
caguuauuacaugua

SEQ ID NO: 3492917 - RNA, 21 nt, Human
caguuauucauucugugauca

SEQ ID NO: 3492918 - RNA, 18 nt, Human
caguuauugguggaaucu

SEQ ID NO: 3492919 - RNA, 23 nt, Human
caguucaaagucaugauguuuuu

SEQ ID NO: 3492920 - RNA, 22 nt, Human
caguucaccuauuucaaaaauu

SEQ ID NO: 3492921 - RNA, 23 nt, Human
caguucagaaucacuucugagaa

SEQ ID NO: 3492922 - RNA, 18 nt, Human
caguucagagcugcccuc

SEQ ID NO: 3492923 - RNA, 19 nt, Human
caguucagagcugcccucu

SEQ ID NO: 3492924 - RNA, 22 nt, Human
caguucagagcugcccucuccu

SEQ ID NO: 3492925 - RNA, 24 nt, Human
caguucagagcugcccucuccugg

SEQ ID NO: 3492926 - RNA, 23 nt, Human
caguucaggagucccaaggaaag

SEQ ID NO: 3492927 - RNA, 16 nt, Human
caguucaguaccugga

SEQ ID NO: 3492928 - RNA, 21 nt, Human
caguucaguggcagggcucag

SEQ ID NO: 3492929 - RNA, 23 nt, Human
caguucauauguaccauguacau

SEQ ID NO: 3492930 - RNA, 15 nt, Human
caguucauugcacuu

SEQ ID NO: 3492931 - RNA, 18 nt, Human
caguucauugcacuuuga

SEQ ID NO: 3492932 - RNA, 13 nt, Human
caguuccaagaaa

SEQ ID NO: 3492933 - RNA, 19 nt, Human
caguucccacauuaaagaa

SEQ ID NO: 3492934 - RNA, 13 nt, Human
caguucccagaau

SEQ ID NO: 3492935 - RNA, 19 nt, Human
caguucccccaaccucaga

SEQ ID NO: 3492936 - RNA, 21 nt, Human
caguuccccuggaagcagugc

SEQ ID NO: 3492937 - RNA, 15 nt, Human
caguucccuuggccu

SEQ ID NO: 3492938 - RNA, 17 nt, Human
caguucccuuggccuca

SEQ ID NO: 3492939 - RNA, 19 nt, Human
caguucccuuggccucaga

SEQ ID NO: 3492940 - RNA, 22 nt, Human
caguuccggauuggcuugugug

SEQ ID NO: 3492941 - RNA, 22 nt, Human
caguuccucccaggaagcccag

SEQ ID NO: 3492942 - RNA, 18 nt, Human
caguuccucuuugcaugg

SEQ ID NO: 3492943 - RNA, 14 nt, Human
caguuccugcagca

SEQ ID NO: 3492944 - RNA, 16 nt, Human
caguuccugcagcaga

SEQ ID NO: 3492945 - RNA, 21 nt, Human
caguuccugcagcagagccug

SEQ ID NO: 3492946 - RNA, 18 nt, Human
caguuccuguggcucccu

SEQ ID NO: 3492947 - RNA, 15 nt, Human
caguuccuuucaaug

SEQ ID NO: 3492948 - RNA, 21 nt, Human
caguucgcagccacccugagg

SEQ ID NO: 3492949 - RNA, 22 nt, Human
caguucgcagccacccugagga

SEQ ID NO: 3492950 - RNA, 18 nt, Human
caguucuaaccuccuaag

SEQ ID NO: 3492951 - RNA, 15 nt, Human
caguucuaggaaaau

SEQ ID NO: 3492952 - RNA, 20 nt, Human
caguucucauggguggcacu

SEQ ID NO: 3492953 - RNA, 22 nt, Human
caguucucuccuucuucccccc

SEQ ID NO: 3492954 - RNA, 13 nt, Human
caguucugaagaa

SEQ ID NO: 3492955 - RNA, 15 nt, Human
caguucugaagaaga

SEQ ID NO: 3492956 - RNA, 21 nt, Human
caguucugaauaugcugcuca

SEQ ID NO: 3492957 - RNA, 12 nt, Human
caguucugcaaa

SEQ ID NO: 3492958 - RNA, 13 nt, Human
caguucugcaaau

SEQ ID NO: 3492959 - RNA, 17 nt, Human
caguucugcaaauagaa

SEQ ID NO: 3492960 - RNA, 14 nt, Human
caguucugcuccuc

SEQ ID NO: 3492961 - RNA, 19 nt, Human
caguucugcuccucuccag

SEQ ID NO: 3492962 - RNA, 22 nt, Human
caguucuggauggugugccuuc

SEQ ID NO: 3492963 - RNA, 18 nt, Human
caguucugucauauguua

SEQ ID NO: 3492964 - RNA, 20 nt, Human
caguucuucgggaagagagg

SEQ ID NO: 3492965 - RNA, 18 nt, Human
caguucuuugggccagac

SEQ ID NO: 3492966 - RNA, 19 nt, Human
caguucuuugggccagaca

SEQ ID NO: 3492967 - RNA, 12 nt, Human
caguugaaaaac

SEQ ID NO: 3492968 - RNA, 21 nt, Human
caguugaaaagacuccaaaga

SEQ ID NO: 3492969 - RNA, 21 nt, Human
caguugaaugacaacagaagc

SEQ ID NO: 3492970 - RNA, 16 nt, Human
caguugacagcaggug

SEQ ID NO: 3492971 - RNA, 20 nt, Human
caguugagaaaauuugaaug

SEQ ID NO: 3492972 - RNA, 19 nt, Human
caguugagaggacacuccc

SEQ ID NO: 3492973 - RNA, 20 nt, Human
caguugagaggacacucccg

SEQ ID NO: 3492974 - RNA, 17 nt, Human
caguugauuuucuggau

SEQ ID NO: 3492975 - RNA, 16 nt, Human
caguugcacagcaucu

SEQ ID NO: 3492976 - RNA, 16 nt, Human
caguugcacuuggccu

SEQ ID NO: 3492977 - RNA, 19 nt, Human
caguugcacuuggccucug

SEQ ID NO: 3492978 - RNA, 16 nt, Human
caguugcauguaguaa

SEQ ID NO: 3492979 - RNA, 20 nt, Human
caguugcauguaguaacacu

SEQ ID NO: 3492980 - RNA, 21 nt, Human
caguugcauguaguaacacua

SEQ ID NO: 3492981 - RNA, 23 nt, Human
caguugcauguaguaacacuaau

SEQ ID NO: 3492982 - RNA, 16 nt, Human
caguugcccagccucu

SEQ ID NO: 3492983 - RNA, 22 nt, Human
caguugccuuuuaucccaaagu

SEQ ID NO: 3492984 - RNA, 22 nt, Human
caguugcgcguucugaaauauu

SEQ ID NO: 3492985 - RNA, 17 nt, Human
caguugcucaaaaagaa

SEQ ID NO: 3492986 - RNA, 19 nt, Human
caguugcucaaaaagaaau

SEQ ID NO: 3492987 - RNA, 19 nt, Human
caguugcugcuucaauuua

SEQ ID NO: 3492988 - RNA, 20 nt, Human
caguugcugguaaaaugaag

SEQ ID NO: 3492989 - RNA, 22 nt, Human
caguugcugguaaaaugaagaa

SEQ ID NO: 3492990 - RNA, 21 nt, Human
caguuggaaauaauaaaagau

SEQ ID NO: 3492991 - RNA, 18 nt, Human
caguuggaaauccaucca

SEQ ID NO: 3492992 - RNA, 15 nt, Human
caguuggacuuuuua

SEQ ID NO: 3492993 - RNA, 20 nt, Human
caguuggacuuuuuaaaaau

SEQ ID NO: 3492994 - RNA, 16 nt, Human
caguuggccagagagc

SEQ ID NO: 3492995 - RNA, 18 nt, Human
caguugggaaaauauguc

SEQ ID NO: 3492996 - RNA, 18 nt, Human
caguugggagcacuggag

SEQ ID NO: 3492997 - RNA, 16 nt, Human
caguuggguggaugcc

SEQ ID NO: 3492998 - RNA, 19 nt, Human
ccucuuuuuucguuuguuu

SEQ ID NO: 3492999 - RNA, 21 nt, Human
ccugaaaaaaaaccugagauu

SEQ ID NO: 3493000 - RNA, 17 nt, Human
ccugaaaacccagagag

SEQ ID NO: 3493001 - RNA, 12 nt, Human
ccugaaaauauc

SEQ ID NO: 3493002 - RNA, 22 nt, Human
ccugaaaauguuuuucugccag

SEQ ID NO: 3493003 - RNA, 19 nt, Human
ccugaaacgcuccuuugug

SEQ ID NO: 3493004 - RNA, 14 nt, Human
ccugaaacuauauu

SEQ ID NO: 3493005 - RNA, 19 nt, Human
ccugaaacuauauuuuguc

SEQ ID NO: 3493006 - RNA, 18 nt, Human
ccugaaagaggaaugaag

SEQ ID NO: 3493007 - RNA, 15 nt, Human
ccugaaauccugguu

SEQ ID NO: 3493008 - RNA, 17 nt, Human
ccugaaaugugugugau

SEQ ID NO: 3493009 - RNA, 18 nt, Human
ccugaaaugugugugaug

SEQ ID NO: 3493010 - RNA, 18 nt, Human
ccugaaauuccaaagucu

SEQ ID NO: 3493011 - RNA, 22 nt, Human
ccugaacagcauggcacucccu

SEQ ID NO: 3493012 - RNA, 20 nt, Human
ccugaacaggauauucucac

SEQ ID NO: 3493013 - RNA, 20 nt, Human
ccugaacauccuuccuuccc

SEQ ID NO: 3493014 - RNA, 21 nt, Human
ccugaacauccuuccuuccca

SEQ ID NO: 3493015 - RNA, 23 nt, Human
ccugaaccacaggagaggauggc

SEQ ID NO: 3493016 - RNA, 17 nt, Human
ccugaaccccagggcug

SEQ ID NO: 3493017 - RNA, 18 nt, Human
ccugaaccccagggcugu

SEQ ID NO: 3493018 - RNA, 19 nt, Human
ccugaacugggaccuuuag

SEQ ID NO: 3493019 - RNA, 16 nt, Human
ccugaagaaccagucc

SEQ ID NO: 3493020 - RNA, 16 nt, Human
ccugaagaacuauuuu

SEQ ID NO: 3493021 - RNA, 14 nt, Human
ccugaagacugagg

SEQ ID NO: 3493022 - RNA, 13 nt, Human
ccugaagagcauu

SEQ ID NO: 3493023 - RNA, 15 nt, Human
ccugaagccagccuu

SEQ ID NO: 3493024 - RNA, 18 nt, Human
ccugaagccagcugcccu

SEQ ID NO: 3493025 - RNA, 18 nt, Human
ccugaaggccccgcccag

SEQ ID NO: 3493026 - RNA, 22 nt, Human
ccugaaggggcgucuguucccc

SEQ ID NO: 3493027 - RNA, 16 nt, Human
ccugaagggguuuucu

SEQ ID NO: 3493028 - RNA, 17 nt, Human
ccugaagggguuuucuu

SEQ ID NO: 3493029 - RNA, 19 nt, Human
ccugaaguaagcaaagacu

SEQ ID NO: 3493030 - RNA, 12 nt, Human
ccugaaguauuu

SEQ ID NO: 3493031 - RNA, 19 nt, Human
ccugaagucacacagugag

SEQ ID NO: 3493032 - RNA, 12 nt, Human
ccucccagcuga

SEQ ID NO: 3493033 - RNA, 20 nt, Human
ccucccagcuuguaggagcu

SEQ ID NO: 3493034 - RNA, 17 nt, Human
ccucccaggaagcccag

SEQ ID NO: 3493035 - RNA, 20 nt, Human
ccucccaggaagcccaggag

SEQ ID NO: 3493036 - RNA, 21 nt, Human
ccucccaggaagcccaggagc

SEQ ID NO: 3493037 - RNA, 17 nt, Human
ccucccaggacucugac

SEQ ID NO: 3493038 - RNA, 14 nt, Human
ccucccagggccag

SEQ ID NO: 3493039 - RNA, 21 nt, Human
ccucccagggccagggcccug

SEQ ID NO: 3493040 - RNA, 21 nt, Human
ccucccaggguuuuaacuuug

SEQ ID NO: 3493041 - RNA, 17 nt, Human
ccucccaguaccuccug

SEQ ID NO: 3493042 - RNA, 16 nt, Human
ccucccagucaccuug

SEQ ID NO: 3493043 - RNA, 14 nt, Human
ccucccauccccug

SEQ ID NO: 3493044 - RNA, 17 nt, Human
ccucccauccccuggac

SEQ ID NO: 3493045 - RNA, 16 nt, Human
ccucccaugucacugc

SEQ ID NO: 3493046 - RNA, 18 nt, Human
ccucccaugucacugcag

SEQ ID NO: 3493047 - RNA, 18 nt, Human
ccucccauguucaagcga

SEQ ID NO: 3493048 - RNA, 21 nt, Human
ccuccccaaggcccccugccu

SEQ ID NO: 3493049 - RNA, 18 nt, Human
ccuccccacccuccuggc

SEQ ID NO: 3493050 - RNA, 13 nt, Human
ccuccccacgccc

SEQ ID NO: 3493051 - RNA, 15 nt, Human
ccuccccacgcccuc

SEQ ID NO: 3493052 - RNA, 17 nt, Human
ccuccccagcagguggg

SEQ ID NO: 3493053 - RNA, 14 nt, Human
ccuccccagccccu

SEQ ID NO: 3493054 - RNA, 22 nt, Human
ccuccccagccccuagcccagg

SEQ ID NO: 3493055 - RNA, 15 nt, Human
ccuccccagccugcg

SEQ ID NO: 3493056 - RNA, 12 nt, Human
ccuccccagcuc

SEQ ID NO: 3493057 - RNA, 20 nt, Human
ccuccccauuagagucagcc

SEQ ID NO: 3493058 - RNA, 13 nt, Human
ccucccccacuuu

SEQ ID NO: 3493059 - RNA, 19 nt, Human
ccucccccaucucccaccc

SEQ ID NO: 3493060 - RNA, 13 nt, Human
ccuccccccacug

SEQ ID NO: 3493061 - RNA, 15 nt, Human
ccuccccccacugca

SEQ ID NO: 3493062 - RNA, 18 nt, Human
ccuccccccacugcaggc

SEQ ID NO: 3493063 - RNA, 12 nt, Human
ccucccccuccu

SEQ ID NO: 3493064 - RNA, 15 nt, Human
ccucccccuccucuc

SEQ ID NO: 3493065 - RNA, 13 nt, Human
ccucccccugcca

SEQ ID NO: 3493066 - RNA, 14 nt, Human
ccucccccugccag

SEQ ID NO: 3493067 - RNA, 16 nt, Human
ccucccccugccagga

SEQ ID NO: 3493068 - RNA, 16 nt, Human
ccucccccuggcacug

SEQ ID NO: 3493069 - RNA, 17 nt, Human
ccuccccggcacccucu

SEQ ID NO: 3493070 - RNA, 20 nt, Human
ccuccccggcacccucuggc

SEQ ID NO: 3493071 - RNA, 15 nt, Human
ccuccccucacagcc

SEQ ID NO: 3493072 - RNA, 16 nt, Human
ccuccccucacagccu

SEQ ID NO: 3493073 - RNA, 16 nt, Human
ccuccccuccaucccu

SEQ ID NO: 3493074 - RNA, 12 nt, Human
ccuccccuccuc

SEQ ID NO: 3493075 - RNA, 13 nt, Human
ccuccccuccucu

SEQ ID NO: 3493076 - RNA, 17 nt, Human
ccuccccucuccuuccu

SEQ ID NO: 3493077 - RNA, 13 nt, Human
ccuccccucucuu

SEQ ID NO: 3493078 - RNA, 23 nt, Human
ccuccccucucuugcacccgccu

SEQ ID NO: 3493079 - RNA, 15 nt, Human
ccuccccugcccugg

SEQ ID NO: 3493080 - RNA, 13 nt, Human
ccuccccugcugc

SEQ ID NO: 3493081 - RNA, 14 nt, Human
ccuccccugcugca

SEQ ID NO: 3493082 - RNA, 16 nt, Human
ccuccccugcugcagg

SEQ ID NO: 3493083 - RNA, 14 nt, Human
ccuccccuggaggg

SEQ ID NO: 3493084 - RNA, 20 nt, Human
ccuccccuggggacagcaag

SEQ ID NO: 3493085 - RNA, 14 nt, Human
ccuccccuucccag

SEQ ID NO: 3493086 - RNA, 14 nt, Human
ccuccccuugccug

SEQ ID NO: 3493087 - RNA, 12 nt, Human
ccuccccuuggg

SEQ ID NO: 3493088 - RNA, 21 nt, Human
ccuccccuugggcccacaccu

SEQ ID NO: 3493089 - RNA, 17 nt, Human
ccucccgaauagcuggg

SEQ ID NO: 3493090 - RNA, 20 nt, Human
ccucccgaguagcugggacu

SEQ ID NO: 3493091 - RNA, 16 nt, Human
ccucccgccccuuccc

SEQ ID NO: 3493092 - RNA, 18 nt, Human
ccucccgccccuucccac

SEQ ID NO: 3493093 - RNA, 14 nt, Human
ccucccggcccugc

SEQ ID NO: 3493094 - RNA, 18 nt, Human
ccucccggcccugccugc

SEQ ID NO: 3493095 - RNA, 14 nt, Human
ccucccgggcccuc

SEQ ID NO: 3493096 - RNA, 19 nt, Human
ccucccgggcccucccuug

SEQ ID NO: 3493097 - RNA, 22 nt, Human
ccucccuacccuaaccaaguuc

SEQ ID NO: 3493098 - RNA, 21 nt, Human
ccucccuagccagcacuugua

SEQ ID NO: 3493099 - RNA, 14 nt, Human
ccucccucacccug

SEQ ID NO: 3493100 - RNA, 19 nt, Human
ccucccucacccugagccc

SEQ ID NO: 3493101 - RNA, 16 nt, Human
ccucccucagccccuc

SEQ ID NO: 3493102 - RNA, 17 nt, Human
ccucccuccaccccagg

SEQ ID NO: 3493103 - RNA, 20 nt, Human
ccucccuccaccccaggacg

SEQ ID NO: 3493104 - RNA, 10 nt, Human
ccucccuccc

SEQ ID NO: 3493105 - RNA, 17 nt, Human
ccucccuccccugcccu

SEQ ID NO: 3493106 - RNA, 19 nt, Human
ccucccucccggcauggga

SEQ ID NO: 3493107 - RNA, 14 nt, Human
ccucccucccucuc

SEQ ID NO: 3493108 - RNA, 15 nt, Human
ccucccucccucucc

SEQ ID NO: 3493109 - RNA, 13 nt, Human
ccucccuccucug

SEQ ID NO: 3493110 - RNA, 15 nt, Human
ccucccuccugccga

SEQ ID NO: 3493111 - RNA, 21 nt, Human
ccucccuccugccgacuccug

SEQ ID NO: 3493112 - RNA, 13 nt, Human
ccucccucuaauu

SEQ ID NO: 3493113 - RNA, 18 nt, Human
ccucccucuccagcaggc

SEQ ID NO: 3493114 - RNA, 22 nt, Human
ccucccucucguaagauuuccu

SEQ ID NO: 3493115 - RNA, 19 nt, Human
ccucccucugaccugcagg

SEQ ID NO: 3493116 - RNA, 21 nt, Human
ccucccucugaggcuguagga

SEQ ID NO: 3493117 - RNA, 14 nt, Human
ccucccucugcugu

SEQ ID NO: 3493118 - RNA, 21 nt, Human
ccucccucugcugucaccuug

SEQ ID NO: 3493119 - RNA, 13 nt, Human
ccucccucuuucc

SEQ ID NO: 3493120 - RNA, 20 nt, Human
ccucccugaaaauguuuuuc

SEQ ID NO: 3493121 - RNA, 13 nt, Human
ccucccugaacca

SEQ ID NO: 3493122 - RNA, 19 nt, Human
ccucccugaagccuuugca

SEQ ID NO: 3493123 - RNA, 22 nt, Human
ccucccugagcuagaacccucu

SEQ ID NO: 3493124 - RNA, 12 nt, Human
ccucccugcaau

SEQ ID NO: 3493125 - RNA, 13 nt, Human
ccucccugccccu

SEQ ID NO: 3493126 - RNA, 24 nt, Human
ccucccugccccucccuucaacca

SEQ ID NO: 3493127 - RNA, 14 nt, Human
ccucccugcuguca

SEQ ID NO: 3493128 - RNA, 15 nt, Human
ccucccugcuguccc

SEQ ID NO: 3493129 - RNA, 21 nt, Human
ccucccugcuguccccucuug

SEQ ID NO: 3493130 - RNA, 22 nt, Human
ccucccugcuguccccucuugc

SEQ ID NO: 3493131 - RNA, 12 nt, Human
ccucccuggagu

SEQ ID NO: 3493132 - RNA, 15 nt, Human
ccucccuggccuguu

SEQ ID NO: 3493133 - RNA, 14 nt, Human
ccucccuggcuccc

SEQ ID NO: 3493134 - RNA, 15 nt, Human
ccucccuggcuccca

SEQ ID NO: 3493135 - RNA, 17 nt, Human
ccucccuggcugcccug

SEQ ID NO: 3493136 - RNA, 18 nt, Human
ccucccuggcugcccugg

SEQ ID NO: 3493137 - RNA, 15 nt, Human
ccucccuggguucag

SEQ ID NO: 3493138 - RNA, 12 nt, Human
ccucccuguccu

SEQ ID NO: 3493139 - RNA, 14 nt, Human
ccucccuguccucc

SEQ ID NO: 3493140 - RNA, 23 nt, Human
ccucccuuccgacccucugggaa

SEQ ID NO: 3493141 - RNA, 21 nt, Human
ccucccuuccuuuucccugcu

SEQ ID NO: 3493142 - RNA, 16 nt, Human
ccucccuucuacugcu

SEQ ID NO: 3493143 - RNA, 17 nt, Human
ccucccuucuacugcuu

SEQ ID NO: 3493144 - RNA, 19 nt, Human
ccucccuucuacugcuucu

SEQ ID NO: 3493145 - RNA, 15 nt, Human
ccucccuucugcuac

SEQ ID NO: 3493146 - RNA, 19 nt, Human
ccucccuuggaaaccugcc

SEQ ID NO: 3493147 - RNA, 21 nt, Human
ccucccuuggaaaccugcccu

SEQ ID NO: 3493148 - RNA, 19 nt, Human
ccucccuuggguucugaua

SEQ ID NO: 3493149 - RNA, 14 nt, Human
ccucccuuucuccc

SEQ ID NO: 3493150 - RNA, 22 nt, Human
ccuccgacagcccccucugccg

SEQ ID NO: 3493151 - RNA, 16 nt, Human
ccuccgagagggagag

SEQ ID NO: 3493152 - RNA, 16 nt, Human
ccuccgauccuuccuc

SEQ ID NO: 3493153 - RNA, 13 nt, Human
ccuccgccucuug

SEQ ID NO: 3493154 - RNA, 18 nt, Human
caguuggguggaugccug

SEQ ID NO: 3493155 - RNA, 19 nt, Human
caguuggguggaugccugg

SEQ ID NO: 3493156 - RNA, 23 nt, Human
caguugguaagcuuccaggaaaa

SEQ ID NO: 3493157 - RNA, 19 nt, Human
caguuggucccccuuccau

SEQ ID NO: 3493158 - RNA, 16 nt, Human
caguugguguguuuuu

SEQ ID NO: 3493159 - RNA, 14 nt, Human
caguugguuguguc

SEQ ID NO: 3493160 - RNA, 20 nt, Human
caguugucccgauuguaacu

SEQ ID NO: 3493161 - RNA, 15 nt, Human
caguuguccuccuuc

SEQ ID NO: 3493162 - RNA, 11 nt, Human
caguugucucu

SEQ ID NO: 3493163 - RNA, 14 nt, Human
caguugucucugau

SEQ ID NO: 3493164 - RNA, 21 nt, Human
caguugucucugaugcagcuu

SEQ ID NO: 3493165 - RNA, 15 nt, Human
caguugucucuguuu

SEQ ID NO: 3493166 - RNA, 17 nt, Human
caguuguggugugagua

SEQ ID NO: 3493167 - RNA, 22 nt, Human
caguuguguuuguugcuggcuu

SEQ ID NO: 3493168 - RNA, 19 nt, Human
caguuguucuuuuuagaaa

SEQ ID NO: 3493169 - RNA, 18 nt, Human
caguuuaaaaaaauuggu

SEQ ID NO: 3493170 - RNA, 20 nt, Human
caguuuaaccugaugcaguc

SEQ ID NO: 3493171 - RNA, 20 nt, Human
caguuuaagagcagaacaga

SEQ ID NO: 3493172 - RNA, 16 nt, Human
caguuuaauccuucua

SEQ ID NO: 3493173 - RNA, 21 nt, Human
caguuuaauccuucuaguuuc

SEQ ID NO: 3493174 - RNA, 15 nt, Human
caguuuacugguuua

SEQ ID NO: 3493175 - RNA, 17 nt, Human
caguuuaucaugaagcc

SEQ ID NO: 3493176 - RNA, 15 nt, Human
caguuuaucauucaa

SEQ ID NO: 3493177 - RNA, 19 nt, Human
caguuuaucauucaagugu

SEQ ID NO: 3493178 - RNA, 14 nt, Human
ccuccucaccccca

SEQ ID NO: 3493179 - RNA, 15 nt, Human
ccuccucaccccguc

SEQ ID NO: 3493180 - RNA, 22 nt, Human
ccuccucaccucaugcccaccc

SEQ ID NO: 3493181 - RNA, 22 nt, Human
ccuccucaccucuggacuggcu

SEQ ID NO: 3493182 - RNA, 15 nt, Human
ccuccucacuggcca

SEQ ID NO: 3493183 - RNA, 20 nt, Human
ccuccucacuggccaucccu

SEQ ID NO: 3493184 - RNA, 13 nt, Human
ccuccucagccug

SEQ ID NO: 3493185 - RNA, 14 nt, Human
ccuccucagccuga

SEQ ID NO: 3493186 - RNA, 17 nt, Human
ccuccucaggcacacag

SEQ ID NO: 3493187 - RNA, 19 nt, Human
ccuccucaggcacacagcu

SEQ ID NO: 3493188 - RNA, 20 nt, Human
ccuccucaucccguguucuc

SEQ ID NO: 3493189 - RNA, 23 nt, Human
ccuccucaucugggggaguggaa

SEQ ID NO: 3493190 - RNA, 20 nt, Human
ccuccucauguacauacccu

SEQ ID NO: 3493191 - RNA, 16 nt, Human
ccuccuccacucuccc

SEQ ID NO: 3493192 - RNA, 12 nt, Human
ccuccuccaggg

SEQ ID NO: 3493193 - RNA, 13 nt, Human
ccuccuccaggga

SEQ ID NO: 3493194 - RNA, 14 nt, Human
ccuccuccagggac

SEQ ID NO: 3493195 - RNA, 15 nt, Human
ccuccuccagggaca

SEQ ID NO: 3493196 - RNA, 15 nt, Human
ccuccucccacugcc

SEQ ID NO: 3493197 - RNA, 22 nt, Human
ccuccucccacugcccacuggc

SEQ ID NO: 3493198 - RNA, 22 nt, Human
ccuccucccaugucacugcaga

SEQ ID NO: 3493199 - RNA, 18 nt, Human
ccuccucccuccugccga

SEQ ID NO: 3493200 - RNA, 13 nt, Human
ccuccucccugca

SEQ ID NO: 3493201 - RNA, 15 nt, Human
ccuccucccuguuau

SEQ ID NO: 3493202 - RNA, 19 nt, Human
ccuccucccuguuauuuuc

SEQ ID NO: 3493203 - RNA, 12 nt, Human
ccuccucccuua

SEQ ID NO: 3493204 - RNA, 16 nt, Human
ccuccucccuuagcuc

SEQ ID NO: 3493205 - RNA, 15 nt, Human
ccuccucccuuuuuc

SEQ ID NO: 3493206 - RNA, 22 nt, Human
ccuccucccuuuuuccuugucc

SEQ ID NO: 3493207 - RNA, 14 nt, Human
ccuccuccuggacu

SEQ ID NO: 3493208 - RNA, 21 nt, Human
ccuccuccuucccaaaggacu

SEQ ID NO: 3493209 - RNA, 13 nt, Human
ccuccuccuuccu

SEQ ID NO: 3493210 - RNA, 13 nt, Human
ccuccucucagug

SEQ ID NO: 3493211 - RNA, 13 nt, Human
ccuccucucccau

SEQ ID NO: 3493212 - RNA, 16 nt, Human
ccuccucucccauccc

SEQ ID NO: 3493213 - RNA, 15 nt, Human
ccuccucucugcccu

SEQ ID NO: 3493214 - RNA, 16 nt, Human
ccuccucucugcccua

SEQ ID NO: 3493215 - RNA, 12 nt, Human
ccuccucugaaa

SEQ ID NO: 3493216 - RNA, 18 nt, Human
ccuccucugaaacagcug

SEQ ID NO: 3493217 - RNA, 19 nt, Human
ccuccucugaaacagcugc

SEQ ID NO: 3493218 - RNA, 12 nt, Human
ccuccucugcca

SEQ ID NO: 3493219 - RNA, 14 nt, Human
ccuccucugccacc

SEQ ID NO: 3493220 - RNA, 20 nt, Human
ccuccucugccaccuccccu

SEQ ID NO: 3493221 - RNA, 21 nt, Human
ccuccucugccaccuccccua

SEQ ID NO: 3493222 - RNA, 14 nt, Human
ccuccucugcccgg

SEQ ID NO: 3493223 - RNA, 15 nt, Human
ccuccucugcccggg

SEQ ID NO: 3493224 - RNA, 16 nt, Human
ccuccucugcuugcca

SEQ ID NO: 3493225 - RNA, 12 nt, Human
ccuccucugucc

SEQ ID NO: 3493226 - RNA, 15 nt, Human
ccuccucuguccagg

SEQ ID NO: 3493227 - RNA, 14 nt, Human
ccuccucuucaccc

SEQ ID NO: 3493228 - RNA, 20 nt, Human
ccuccucuucaccccggcag

SEQ ID NO: 3493229 - RNA, 12 nt, Human
ccuccucuuucu

SEQ ID NO: 3493230 - RNA, 18 nt, Human
ccuccucuuucucucccc

SEQ ID NO: 3493231 - RNA, 21 nt, Human
ccuccugaaacuuacacacaa

SEQ ID NO: 3493232 - RNA, 15 nt, Human
ccuccugacacccuu

SEQ ID NO: 3493233 - RNA, 18 nt, Human
ccuccugaccugaggcuc

SEQ ID NO: 3493234 - RNA, 18 nt, Human
ccuccugaguagcuggga

SEQ ID NO: 3493235 - RNA, 14 nt, Human
ccuccugcccagga

SEQ ID NO: 3493236 - RNA, 13 nt, Human
ccuccugccucga

SEQ ID NO: 3493237 - RNA, 13 nt, Human
ccuccugccucua

SEQ ID NO: 3493238 - RNA, 18 nt, Human
ccuccugccucuacuggg

SEQ ID NO: 3493239 - RNA, 18 nt, Human
ccuccugcugcagagggg

SEQ ID NO: 3493240 - RNA, 21 nt, Human
ccuccuggaaccuugcugucc

SEQ ID NO: 3493241 - RNA, 13 nt, Human
ccuccuggacucc

SEQ ID NO: 3493242 - RNA, 15 nt, Human
ccuccuggccucaga

SEQ ID NO: 3493243 - RNA, 21 nt, Human
ccuccugggcccucucugcuc

SEQ ID NO: 3493244 - RNA, 17 nt, Human
ccuccuggugucacccc

SEQ ID NO: 3493245 - RNA, 19 nt, Human
ccuccuggugucaccccag

SEQ ID NO: 3493246 - RNA, 22 nt, Human
ccuccuggugucaccccagagc

SEQ ID NO: 3493247 - RNA, 19 nt, Human
ccuccugucuucccagggu

SEQ ID NO: 3493248 - RNA, 16 nt, Human
ccuccugugcucagcc

SEQ ID NO: 3493249 - RNA, 18 nt, Human
ccuccugugcucagcccu

SEQ ID NO: 3493250 - RNA, 19 nt, Human
ccuccuguggaacccagca

SEQ ID NO: 3493251 - RNA, 17 nt, Human
ccuccuguggccugcca

SEQ ID NO: 3493252 - RNA, 18 nt, Human
ccuccuguggggaaaggg

SEQ ID NO: 3493253 - RNA, 16 nt, Human
ccuccuguugcaccca

SEQ ID NO: 3493254 - RNA, 17 nt, Human
ccuccuguugcacccag

SEQ ID NO: 3493255 - RNA, 19 nt, Human
ccuccuguugcacccagcc

SEQ ID NO: 3493256 - RNA, 13 nt, Human
ccuccuucagaca

SEQ ID NO: 3493257 - RNA, 14 nt, Human
ccuccuucagacac

SEQ ID NO: 3493258 - RNA, 16 nt, Human
ccuccuuccaccuccc

SEQ ID NO: 3493259 - RNA, 19 nt, Human
ccuccuuccaccucccucc

SEQ ID NO: 3493260 - RNA, 14 nt, Human
ccuccuucccaaag

SEQ ID NO: 3493261 - RNA, 14 nt, Human
ccuccuucccagcu

SEQ ID NO: 3493262 - RNA, 16 nt, Human
ccuccuucccagcugc

SEQ ID NO: 3493263 - RNA, 18 nt, Human
ccuccuucccagcugccc

SEQ ID NO: 3493264 - RNA, 21 nt, Human
ccuccuucccagcugccccuc

SEQ ID NO: 3493265 - RNA, 20 nt, Human
ccuccuucccucucuggaga

SEQ ID NO: 3493266 - RNA, 23 nt, Human
ccuccuuccucuuuuccuuccca

SEQ ID NO: 3493267 - RNA, 17 nt, Human
ccuccuucucugucuca

SEQ ID NO: 3493268 - RNA, 17 nt, Human
ccuccuucugagcuccu

SEQ ID NO: 3493269 - RNA, 20 nt, Human
ccuccuucugagcuccuguc

SEQ ID NO: 3493270 - RNA, 14 nt, Human
ccuccuucugcugc

SEQ ID NO: 3493271 - RNA, 15 nt, Human
ccuccuugcucugca

SEQ ID NO: 3493272 - RNA, 18 nt, Human
ccuccuugcucugcaggc

SEQ ID NO: 3493273 - RNA, 16 nt, Human
ccuccuuggugauucc

SEQ ID NO: 3493274 - RNA, 15 nt, Human
ccuccuuggugccug

SEQ ID NO: 3493275 - RNA, 17 nt, Human
ccuccuuggugccuggc

SEQ ID NO: 3493276 - RNA, 20 nt, Human
ccuccuugucuuggcagccu

SEQ ID NO: 3493277 - RNA, 16 nt, Human
ccuccuuuacccucau

SEQ ID NO: 3493278 - RNA, 17 nt, Human
ccuccuuuacccucauc

SEQ ID NO: 3493279 - RNA, 19 nt, Human
ccuccuuucaucacacugg

SEQ ID NO: 3493280 - RNA, 20 nt, Human
ccuccuuucucuucucuguu

SEQ ID NO: 3493281 - RNA, 21 nt, Human
ccuccuuucucuucucuguuc

SEQ ID NO: 3493282 - RNA, 18 nt, Human
ccuccuuucugugcccua

SEQ ID NO: 3493283 - RNA, 23 nt, Human
ccuccuuugugaggaagccgcug

SEQ ID NO: 3493284 - RNA, 18 nt, Human
ccuccuuuucacaguucu

SEQ ID NO: 3493285 - RNA, 20 nt, Human
ccucgaaacacagaaaccuu

SEQ ID NO: 3493286 - RNA, 15 nt, Human
ccucgaacccacacu

SEQ ID NO: 3493287 - RNA, 21 nt, Human
ccucgaacccacacugcaaca

SEQ ID NO: 3493288 - RNA, 16 nt, Human
ccucgagcagaugaug

SEQ ID NO: 3493289 - RNA, 16 nt, Human
ccucgaggugccuucu

SEQ ID NO: 3493290 - RNA, 23 nt, Human
ccucgaggugccuucuucagggc

SEQ ID NO: 3493291 - RNA, 17 nt, Human
ccucgaguacugugggc

SEQ ID NO: 3493292 - RNA, 18 nt, Human
ccucgaguacugugggca

SEQ ID NO: 3493293 - RNA, 14 nt, Human
ccucgcaagcuggg

SEQ ID NO: 3493294 - RNA, 14 nt, Human
ccucgcagagaggc

SEQ ID NO: 3493295 - RNA, 23 nt, Human
ccucgcaggccucccugccagua

SEQ ID NO: 3493296 - RNA, 21 nt, Human
ccucgcccaccgcaugccccc

SEQ ID NO: 3493297 - RNA, 21 nt, Human
ccucgcccagcggcaucaggc

SEQ ID NO: 3493298 - RNA, 16 nt, Human
ccucgcccagucccag

SEQ ID NO: 3493299 - RNA, 14 nt, Human
ccucgcccucuccu

SEQ ID NO: 3493300 - RNA, 14 nt, Human
ccucgcccuggguc

SEQ ID NO: 3493301 - RNA, 12 nt, Human
ccucgccugugg

SEQ ID NO: 3493302 - RNA, 17 nt, Human
ccucgcuccccacucug

SEQ ID NO: 3493303 - RNA, 18 nt, Human
ccucgcuccccacucugc

SEQ ID NO: 3493304 - RNA, 15 nt, Human
ccucgcucuguuacc

SEQ ID NO: 3493305 - RNA, 19 nt, Human
ccucgcucuguuacccagg

SEQ ID NO: 3493306 - RNA, 21 nt, Human
ccucgcucuguuacccagggu

SEQ ID NO: 3493307 - RNA, 13 nt, Human
ccucgcugccagc

SEQ ID NO: 3493308 - RNA, 14 nt, Human
ccucgcugccagcu

SEQ ID NO: 3493309 - RNA, 12 nt, Human
ccucgcugcuuc

SEQ ID NO: 3493310 - RNA, 21 nt, Human
ccugagcgcuccugccgcaga

SEQ ID NO: 3493311 - RNA, 18 nt, Human
ccugagcuagaagcugga

SEQ ID NO: 3493312 - RNA, 14 nt, Human
ccugagcucagcgu

SEQ ID NO: 3493313 - RNA, 15 nt, Human
ccugagcuccccacc

SEQ ID NO: 3493314 - RNA, 14 nt, Human
ccugagcucugaua

SEQ ID NO: 3493315 - RNA, 15 nt, Human
ccugagcugaggcag

SEQ ID NO: 3493316 - RNA, 16 nt, Human
ccugagcugaggcagc

SEQ ID NO: 3493317 - RNA, 17 nt, Human
ccugagcugccauccag

SEQ ID NO: 3493318 - RNA, 15 nt, Human
ccugagcugggauga

SEQ ID NO: 3493319 - RNA, 17 nt, Human
ccugagcuuggccagaa

SEQ ID NO: 3493320 - RNA, 23 nt, Human
ccugagcuuuggacacacacagc

SEQ ID NO: 3493321 - RNA, 15 nt, Human
ccugagcuuuggacg

SEQ ID NO: 3493322 - RNA, 13 nt, Human
ccugaggaacugu

SEQ ID NO: 3493323 - RNA, 18 nt, Human
ccugaggaagaugggggc

SEQ ID NO: 3493324 - RNA, 21 nt, Human
cauaaucuucugccuucucau

SEQ ID NO: 3493325 - RNA, 20 nt, Human
cauaaugcuaauuuaaagag

SEQ ID NO: 3493326 - RNA, 22 nt, Human
cauaaugcuaauuuaaagagac

SEQ ID NO: 3493327 - RNA, 15 nt, Human
cauaaugcuacuguc

SEQ ID NO: 3493328 - RNA, 16 nt, Human
cauaaugcuacugucu

SEQ ID NO: 3493329 - RNA, 19 nt, Human
cauaaugggccacugaaau

SEQ ID NO: 3493330 - RNA, 21 nt, Human
cauaaugggccacugaaaucu

SEQ ID NO: 3493331 - RNA, 14 nt, Human
cauaaugggguccu

SEQ ID NO: 3493332 - RNA, 22 nt, Human
cauaaugggguccuggccaucc

SEQ ID NO: 3493333 - RNA, 15 nt, Human
cauaauguauaaaga

SEQ ID NO: 3493334 - RNA, 11 nt, Human
cauaaugugaa

SEQ ID NO: 3493335 - RNA, 15 nt, Human
cauaaugugaagugu

SEQ ID NO: 3493336 - RNA, 16 nt, Human
cauaaugugaaguguu

SEQ ID NO: 3493337 - RNA, 17 nt, Human
cauaaugugaaguguua

SEQ ID NO: 3493338 - RNA, 18 nt, Human
cauaauguuacauuauua

SEQ ID NO: 3493339 - RNA, 16 nt, Human
cauaauuaaagugucc

SEQ ID NO: 3493340 - RNA, 19 nt, Human
cauaauuagauccauuaau

SEQ ID NO: 3493341 - RNA, 21 nt, Human
cauaauucacucugaguguuu

SEQ ID NO: 3493342 - RNA, 16 nt, Human
cauaauuccuacagca

SEQ ID NO: 3493343 - RNA, 21 nt, Human
cauaauucuaaucuaacaaug

SEQ ID NO: 3493344 - RNA, 13 nt, Human
cauaauucuuauu

SEQ ID NO: 3493345 - RNA, 14 nt, Human
cauaauugaagugu

SEQ ID NO: 3493346 - RNA, 12 nt, Human
cauaauugcauu

SEQ ID NO: 3493347 - RNA, 19 nt, Human
cauaauugccaauugaaac

SEQ ID NO: 3493348 - RNA, 15 nt, Human
cauaauuuaaaaaua

SEQ ID NO: 3493349 - RNA, 20 nt, Human
cauaauuuaaaaauauauuu

SEQ ID NO: 3493350 - RNA, 19 nt, Human
cauaauuuaguuguuucua

SEQ ID NO: 3493351 - RNA, 22 nt, Human
cauaauuuaguuucauauaaag

SEQ ID NO: 3493352 - RNA, 13 nt, Human
cauaauuucagcu

SEQ ID NO: 3493353 - RNA, 21 nt, Human
cauaauuuguacauauguaaa

SEQ ID NO: 3493354 - RNA, 23 nt, Human
cauaauuuguacauauguaaaau

SEQ ID NO: 3493355 - RNA, 17 nt, Human
cauacaaacaagcauau

SEQ ID NO: 3493356 - RNA, 15 nt, Human
cauacaauuccaaac

SEQ ID NO: 3493357 - RNA, 14 nt, Human
cauacacacacaca

SEQ ID NO: 3493358 - RNA, 16 nt, Human
cauacacacacacaca

SEQ ID NO: 3493359 - RNA, 20 nt, Human
cauacacacacacacacagc

SEQ ID NO: 3493360 - RNA, 22 nt, Human
cauacacacacacacacagcca

SEQ ID NO: 3493361 - RNA, 13 nt, Human
cauacacacgcug

SEQ ID NO: 3493362 - RNA, 16 nt, Human
cauacacacgcugccu

SEQ ID NO: 3493363 - RNA, 17 nt, Human
cauacacacgcugccuu

SEQ ID NO: 3493364 - RNA, 18 nt, Human
cauacaccagcauuccuu

SEQ ID NO: 3493365 - RNA, 20 nt, Human
cauacaccagcauuccuuuu

SEQ ID NO: 3493366 - RNA, 22 nt, Human
cauacacccccaccuccugcaa

SEQ ID NO: 3493367 - RNA, 17 nt, Human
cauacacgaaagagaga

SEQ ID NO: 3493368 - RNA, 19 nt, Human
cauacacuaaccaaaucuc

SEQ ID NO: 3493369 - RNA, 21 nt, Human
cauacacuguauguuauagaa

SEQ ID NO: 3493370 - RNA, 18 nt, Human
cauacacuuguauaaaug

SEQ ID NO: 3493371 - RNA, 19 nt, Human
cauacacuuguauaaaugu

SEQ ID NO: 3493372 - RNA, 20 nt, Human
cauacacuuuguugcaagau

SEQ ID NO: 3493373 - RNA, 23 nt, Human
cauacagaauuacuguaacugau

SEQ ID NO: 3493374 - RNA, 11 nt, Human
cauacagagaa

SEQ ID NO: 3493375 - RNA, 12 nt, Human
cauacagagaag

SEQ ID NO: 3493376 - RNA, 17 nt, Human
cauacagagaagucaca

SEQ ID NO: 3493377 - RNA, 13 nt, Human
cauacaguuuuau

SEQ ID NO: 3493378 - RNA, 20 nt, Human
cauacaguuuuaugcucuuu

SEQ ID NO: 3493379 - RNA, 13 nt, Human
cauacauaaaaga

SEQ ID NO: 3493380 - RNA, 11 nt, Human
cauacauauuu

SEQ ID NO: 3493381 - RNA, 18 nt, Human
cauacauucuucaagauc

SEQ ID NO: 3493382 - RNA, 21 nt, Human
cauacauuuauaauguuugcu

SEQ ID NO: 3493383 - RNA, 16 nt, Human
cauacauuuucuaaga

SEQ ID NO: 3493384 - RNA, 13 nt, Human
cauaccacuuuug

SEQ ID NO: 3493385 - RNA, 14 nt, Human
cauaccacuuuugu

SEQ ID NO: 3493386 - RNA, 22 nt, Human
cauaccaggccgccccagccuc

SEQ ID NO: 3493387 - RNA, 18 nt, Human
cauaccauggaggaaggc

SEQ ID NO: 3493388 - RNA, 18 nt, Human
cauacccaaaccaggugg

SEQ ID NO: 3493389 - RNA, 15 nt, Human
cauacccccuccccc

SEQ ID NO: 3493390 - RNA, 19 nt, Human
cauacccgccuagcugcug

SEQ ID NO: 3493391 - RNA, 15 nt, Human
cauacccugaccugg

SEQ ID NO: 3493392 - RNA, 22 nt, Human
cauacccuggccgcccccugcc

SEQ ID NO: 3493393 - RNA, 17 nt, Human
cauaccuaaguacugua

SEQ ID NO: 3493394 - RNA, 15 nt, Human
cauaccuuccuuccc

SEQ ID NO: 3493395 - RNA, 18 nt, Human
cauaccuuccuucccugg

SEQ ID NO: 3493396 - RNA, 23 nt, Human
cauaccuuccuucccugggcugu

SEQ ID NO: 3493397 - RNA, 17 nt, Human
cauaccuuggccagcaa

SEQ ID NO: 3493398 - RNA, 21 nt, Human
cauaccuuucacagcuuuuau

SEQ ID NO: 3493399 - RNA, 22 nt, Human
cauaccuuuuauuuuuuuuaau

SEQ ID NO: 3493400 - RNA, 18 nt, Human
cauacgcaccacaucucu

SEQ ID NO: 3493401 - RNA, 15 nt, Human
cauacguacacauuu

SEQ ID NO: 3493402 - RNA, 18 nt, Human
cauacguacacauuuuau

SEQ ID NO: 3493403 - RNA, 14 nt, Human
cauacuaaccagca

SEQ ID NO: 3493404 - RNA, 22 nt, Human
cauacuacugaaacagauuuca

SEQ ID NO: 3493405 - RNA, 18 nt, Human
cauacuaucuacucuccu

SEQ ID NO: 3493406 - RNA, 15 nt, Human
cauacuaugaaauau

SEQ ID NO: 3493407 - RNA, 18 nt, Human
cauacuaugaaauaugua

SEQ ID NO: 3493408 - RNA, 19 nt, Human
cauacucagccugcugccc

SEQ ID NO: 3493409 - RNA, 17 nt, Human
cauacuccuaugcuuua

SEQ ID NO: 3493410 - RNA, 18 nt, Human
cauacuccuaugcuuuag

SEQ ID NO: 3493411 - RNA, 16 nt, Human
cauacucgagucugag

SEQ ID NO: 3493412 - RNA, 18 nt, Human
cauacucgagucugaggc

SEQ ID NO: 3493413 - RNA, 19 nt, Human
cauacucgagucugaggcc

SEQ ID NO: 3493414 - RNA, 17 nt, Human
cauacucuagauuuugu

SEQ ID NO: 3493415 - RNA, 23 nt, Human
cauacucuagauuuuguuuugcu

SEQ ID NO: 3493416 - RNA, 16 nt, Human
cauacucugucucccu

SEQ ID NO: 3493417 - RNA, 19 nt, Human
cauacugagccaaguauaa

SEQ ID NO: 3493418 - RNA, 19 nt, Human
cauacugagggaccaacug

SEQ ID NO: 3493419 - RNA, 13 nt, Human
cauacuggccucg

SEQ ID NO: 3493420 - RNA, 15 nt, Human
cauacuggccucgcc

SEQ ID NO: 3493421 - RNA, 19 nt, Human
cauacuggccucgccuggc

SEQ ID NO: 3493422 - RNA, 22 nt, Human
cauacuggccuggacuguuuuc

SEQ ID NO: 3493423 - RNA, 17 nt, Human
cauacuguaacauucag

SEQ ID NO: 3493424 - RNA, 22 nt, Human
cauacuuaccuagugaaacuuu

SEQ ID NO: 3493425 - RNA, 13 nt, Human
cauacuuaucucu

SEQ ID NO: 3493426 - RNA, 22 nt, Human
cauacuuaucucucugugcugu

SEQ ID NO: 3493427 - RNA, 15 nt, Human
cauacuucaaaagua

SEQ ID NO: 3493428 - RNA, 16 nt, Human
cauacuucaaaaguau

SEQ ID NO: 3493429 - RNA, 19 nt, Human
cauacuucaaaaguauuuu

SEQ ID NO: 3493430 - RNA, 22 nt, Human
cauacuugaagggccagagcca

SEQ ID NO: 3493431 - RNA, 17 nt, Human
cauacuuuaucaaugug

SEQ ID NO: 3493432 - RNA, 17 nt, Human
cauacuuucauccugac

SEQ ID NO: 3493433 - RNA, 22 nt, Human
cauacuuucauccugacucugc

SEQ ID NO: 3493434 - RNA, 14 nt, Human
cauacuuuguaaau

SEQ ID NO: 3493435 - RNA, 14 nt, Human
cauacuuugucuga

SEQ ID NO: 3493436 - RNA, 16 nt, Human
cauacuuuuuggguuu

SEQ ID NO: 3493437 - RNA, 18 nt, Human
cauacuuuuuggguuuau

SEQ ID NO: 3493438 - RNA, 11 nt, Human
cauagaaaaau

SEQ ID NO: 3493439 - RNA, 17 nt, Human
cauagaaacaugacacu

SEQ ID NO: 3493440 - RNA, 18 nt, Human
cauagaaacaugacacug

SEQ ID NO: 3493441 - RNA, 18 nt, Human
cauagaaaccacuagaaa

SEQ ID NO: 3493442 - RNA, 20 nt, Human
cauagaaacugucuagcacu

SEQ ID NO: 3493443 - RNA, 23 nt, Human
cauagaaaguaaauaaaaggacu

SEQ ID NO: 3493444 - RNA, 22 nt, Human
cauagaaauguagguccucaga

SEQ ID NO: 3493445 - RNA, 14 nt, Human
cauagaacugggua

SEQ ID NO: 3493446 - RNA, 15 nt, Human
cauagaacuggguaa

SEQ ID NO: 3493447 - RNA, 16 nt, Human
cauagaacuggguaaa

SEQ ID NO: 3493448 - RNA, 20 nt, Human
cauagaauaaaauuuuuaau

SEQ ID NO: 3493449 - RNA, 14 nt, Human
cauagaauagcaug

SEQ ID NO: 3493450 - RNA, 13 nt, Human
cauagacaugaaa

SEQ ID NO: 3493451 - RNA, 19 nt, Human
cauagagagcaagacgcug

SEQ ID NO: 3493452 - RNA, 19 nt, Human
cauagagagggagaagaag

SEQ ID NO: 3493453 - RNA, 22 nt, Human
cauagagagggagaagaaguca

SEQ ID NO: 3493454 - RNA, 17 nt, Human
cauagagaucauccuuu

SEQ ID NO: 3493455 - RNA, 12 nt, Human
cauagaggcuuc

SEQ ID NO: 3493456 - RNA, 21 nt, Human
cauagaggcuucuccgccagc

SEQ ID NO: 3493457 - RNA, 22 nt, Human
cauagaggcuucuccgccagcc

SEQ ID NO: 3493458 - RNA, 17 nt, Human
cauagaggugagggaag

SEQ ID NO: 3493459 - RNA, 15 nt, Human
cauagaguacacugc

SEQ ID NO: 3493460 - RNA, 17 nt, Human
cauagaguacacugccu

SEQ ID NO: 3493461 - RNA, 19 nt, Human
cauagaguacacugccugc

SEQ ID NO: 3493462 - RNA, 17 nt, Human
cauagaguccccccucc

SEQ ID NO: 3493463 - RNA, 14 nt, Human
cauagaguuuaaca

SEQ ID NO: 3493464 - RNA, 15 nt, Human
cauagaguuuaacac

SEQ ID NO: 3493465 - RNA, 15 nt, Human
aaaguuauuaaaauu

SEQ ID NO: 3493466 - RNA, 21 nt, Human
aaaguuauuaauauuuuaauu

SEQ ID NO: 3493467 - RNA, 20 nt, Human
aaaguuauuucccuuuagcu

SEQ ID NO: 3493468 - RNA, 21 nt, Human
ccugaaggaacauuccuuagu

SEQ ID NO: 3493469 - RNA, 19 nt, Human
ccugaaggccccgcccagg

SEQ ID NO: 3493470 - RNA, 20 nt, Human
ccugaaggccccgcccaggc

SEQ ID NO: 3493471 - RNA, 21 nt, Human
ccugaaggccccgcccaggcu

SEQ ID NO: 3493472 - RNA, 16 nt, Human
ccugaaggccugaggu

SEQ ID NO: 3493473 - RNA, 20 nt, Human
ccugaaggggccaugauggc

SEQ ID NO: 3493474 - RNA, 22 nt, Human
ccugaagucuuuguacagacaa

SEQ ID NO: 3493475 - RNA, 16 nt, Human
ccugaaucaugagccu

SEQ ID NO: 3493476 - RNA, 19 nt, Human
ccugaauccaaaagaaaaa

SEQ ID NO: 3493477 - RNA, 21 nt, Human
ccugaauccaaacuaauccau

SEQ ID NO: 3493478 - RNA, 19 nt, Human
ccugaaucccccuugccac

SEQ ID NO: 3493479 - RNA, 22 nt, Human
ccugaaucccccuugccacccc

SEQ ID NO: 3493480 - RNA, 20 nt, Human
ccugaaugguuccaugccug

SEQ ID NO: 3493481 - RNA, 21 nt, Human
ccugaaugguuccaugccuga

SEQ ID NO: 3493482 - RNA, 16 nt, Human
ccugacaacacucauu

SEQ ID NO: 3493483 - RNA, 14 nt, Human
ccugacaagcacug

SEQ ID NO: 3493484 - RNA, 19 nt, Human
ccugacaagcacugcuagg

SEQ ID NO: 3493485 - RNA, 20 nt, Human
ccugacaagcacugcuaggc

SEQ ID NO: 3493486 - RNA, 18 nt, Human
ccugacacccuucuccca

SEQ ID NO: 3493487 - RNA, 23 nt, Human
ccugacacccuucucccacucuc

SEQ ID NO: 3493488 - RNA, 13 nt, Human
ccugacacucccu

SEQ ID NO: 3493489 - RNA, 15 nt, Human
ccugacacuuuaauu

SEQ ID NO: 3493490 - RNA, 20 nt, Human
ccugacagaugucagccgag

SEQ ID NO: 3493491 - RNA, 14 nt, Human
ccugacagccagaa

SEQ ID NO: 3493492 - RNA, 18 nt, Human
ccugacagucuugugcuu

SEQ ID NO: 3493493 - RNA, 13 nt, Human
ccugacaucacag

SEQ ID NO: 3493494 - RNA, 19 nt, Human
ccugacaucacagcagccu

SEQ ID NO: 3493495 - RNA, 12 nt, Human
ccugaccacccu

SEQ ID NO: 3493496 - RNA, 15 nt, Human
ccugaccacccuccc

SEQ ID NO: 3493497 - RNA, 18 nt, Human
ccugaccacccuccccuc

SEQ ID NO: 3493498 - RNA, 20 nt, Human
ccugaccacccuccccucuc

SEQ ID NO: 3493499 - RNA, 18 nt, Human
ccugaccacucagagaca

SEQ ID NO: 3493500 - RNA, 20 nt, Human
ccugaccacucagagacaug

SEQ ID NO: 3493501 - RNA, 14 nt, Human
ccugaccagcuccc

SEQ ID NO: 3493502 - RNA, 20 nt, Human
ccugaccagcugcuccgagg

SEQ ID NO: 3493503 - RNA, 12 nt, Human
ccugaccaguug

SEQ ID NO: 3493504 - RNA, 16 nt, Human
ccugacccaggccgca

SEQ ID NO: 3493505 - RNA, 23 nt, Human
ccugaccccaaguuauccaccug

SEQ ID NO: 3493506 - RNA, 18 nt, Human
ccugaccccucauagccc

SEQ ID NO: 3493507 - RNA, 15 nt, Human
ccugaccccugcuca

SEQ ID NO: 3493508 - RNA, 12 nt, Human
ccugacccgucu

SEQ ID NO: 3493509 - RNA, 12 nt, Human
ccugaccuccca

SEQ ID NO: 3493510 - RNA, 12 nt, Human
ccugaccucuug

SEQ ID NO: 3493511 - RNA, 14 nt, Human
ccugaccucuugcu

SEQ ID NO: 3493512 - RNA, 14 nt, Human
ccugcgccugugau

SEQ ID NO: 3493513 - RNA, 17 nt, Human
ccugcggagugaagagg

SEQ ID NO: 3493514 - RNA, 18 nt, Human
ccugcggagugaagaggg

SEQ ID NO: 3493515 - RNA, 23 nt, Human
ccugcggagugaagaggggcagc

SEQ ID NO: 3493516 - RNA, 16 nt, Human
ccugcggccugcugga

SEQ ID NO: 3493517 - RNA, 21 nt, Human
ccugcggcugcugugugccuu

SEQ ID NO: 3493518 - RNA, 19 nt, Human
ccugcgggcuuuuccccgg

SEQ ID NO: 3493519 - RNA, 21 nt, Human
ccugcgggcuuuuccccgguc

SEQ ID NO: 3493520 - RNA, 24 nt, Human
ccugcggguggggcuuggggcuca

SEQ ID NO: 3493521 - RNA, 16 nt, Human
ccugcggucaaggcca

SEQ ID NO: 3493522 - RNA, 18 nt, Human
ccugcggucaaggccagc

SEQ ID NO: 3493523 - RNA, 13 nt, Human
ccugcguccuccu

SEQ ID NO: 3493524 - RNA, 17 nt, Human
ccugcguccuccucacc

SEQ ID NO: 3493525 - RNA, 15 nt, Human
ccugcguggggacag

SEQ ID NO: 3493526 - RNA, 19 nt, Human
ccugcguucuugugacaga

SEQ ID NO: 3493527 - RNA, 18 nt, Human
ccugcguugguccagagc

SEQ ID NO: 3493528 - RNA, 17 nt, Human
ccugcuaauuccccaga

SEQ ID NO: 3493529 - RNA, 21 nt, Human
ccugcuaauuccccagauugc

SEQ ID NO: 3493530 - RNA, 18 nt, Human
ccugcuacugccaaccuc

SEQ ID NO: 3493531 - RNA, 13 nt, Human
ccugcuagaaaug

SEQ ID NO: 3493532 - RNA, 14 nt, Human
ccugcuagaaaugg

SEQ ID NO: 3493533 - RNA, 18 nt, Human
ccugcuagacacauuuuu

SEQ ID NO: 3493534 - RNA, 13 nt, Human
ccugcuaggccag

SEQ ID NO: 3493535 - RNA, 14 nt, Human
ccugcuaggccaga

SEQ ID NO: 3493536 - RNA, 18 nt, Human
ccugcuaggccagagccc

SEQ ID NO: 3493537 - RNA, 19 nt, Human
ccugcucaaucccugagga

SEQ ID NO: 3493538 - RNA, 19 nt, Human
ccugcucacgucaaaugca

SEQ ID NO: 3493539 - RNA, 21 nt, Human
ccugcucagcagugagagcag

SEQ ID NO: 3493540 - RNA, 19 nt, Human
ccugcucagcccugcacca

SEQ ID NO: 3493541 - RNA, 17 nt, Human
ccugcucauuaugccac

SEQ ID NO: 3493542 - RNA, 19 nt, Human
ccugcuccacagccauccc

SEQ ID NO: 3493543 - RNA, 20 nt, Human
ccugcuccacagccauccca

SEQ ID NO: 3493544 - RNA, 13 nt, Human
ccugcuccacagu

SEQ ID NO: 3493545 - RNA, 14 nt, Human
ccugcuccacagug

SEQ ID NO: 3493546 - RNA, 15 nt, Human
ccugcuccacagugu

SEQ ID NO: 3493547 - RNA, 12 nt, Human
ccugcuccagac

SEQ ID NO: 3493548 - RNA, 13 nt, Human
ccugcucccagca

SEQ ID NO: 3493549 - RNA, 16 nt, Human
ccugcucccagcagcc

SEQ ID NO: 3493550 - RNA, 20 nt, Human
ccugcucccucucccccuua

SEQ ID NO: 3493551 - RNA, 16 nt, Human
ccugcuccucccuggc

SEQ ID NO: 3493552 - RNA, 20 nt, Human
ccugcuccucccuggcugcc

SEQ ID NO: 3493553 - RNA, 13 nt, Human
ccugcuccugcag

SEQ ID NO: 3493554 - RNA, 16 nt, Human
ccugcuccuucccuug

SEQ ID NO: 3493555 - RNA, 18 nt, Human
ccugcuccuucccuugcu

SEQ ID NO: 3493556 - RNA, 22 nt, Human
ccugcucuagugggacagccca

SEQ ID NO: 3493557 - RNA, 16 nt, Human
ccugcucuccucuugc

SEQ ID NO: 3493558 - RNA, 19 nt, Human
ccugcucuccucuugccac

SEQ ID NO: 3493559 - RNA, 15 nt, Human
ccugcucucuaccca

SEQ ID NO: 3493560 - RNA, 21 nt, Human
ccugcucucuacccagcccau

SEQ ID NO: 3493561 - RNA, 14 nt, Human
ccugcugaccugug

SEQ ID NO: 3493562 - RNA, 16 nt, Human
ccugcugaccugugca

SEQ ID NO: 3493563 - RNA, 12 nt, Human
ccugcugagcuc

SEQ ID NO: 3493564 - RNA, 22 nt, Human
ccugcugagcucugagaggccc

SEQ ID NO: 3493565 - RNA, 17 nt, Human
ccugcugagggaccagc

SEQ ID NO: 3493566 - RNA, 15 nt, Human
ccugcugagucccag

SEQ ID NO: 3493567 - RNA, 17 nt, Human
ccugcugcaccaaccca

SEQ ID NO: 3493568 - RNA, 23 nt, Human
ccugcugcagaggggcaggcccu

SEQ ID NO: 3493569 - RNA, 12 nt, Human
ccugcugcaggg

SEQ ID NO: 3493570 - RNA, 22 nt, Human
ccugcugcaguugccagucacc

SEQ ID NO: 3493571 - RNA, 10 nt, Human
ccugcugcau

SEQ ID NO: 3493572 - RNA, 20 nt, Human
ccugcugcaugcccucucag

SEQ ID NO: 3493573 - RNA, 21 nt, Human
ccugcugcaugcccucucagg

SEQ ID NO: 3493574 - RNA, 15 nt, Human
ccugcugcccaggcu

SEQ ID NO: 3493575 - RNA, 12 nt, Human
ccugcugcccuc

SEQ ID NO: 3493576 - RNA, 14 nt, Human
ccugcugcccuccc

SEQ ID NO: 3493577 - RNA, 16 nt, Human
ccugcugccuccccaa

SEQ ID NO: 3493578 - RNA, 21 nt, Human
ccugcugccuccccaacccug

SEQ ID NO: 3493579 - RNA, 14 nt, Human
ccugcugcucccuc

SEQ ID NO: 3493580 - RNA, 16 nt, Human
ccugcugcucccucag

SEQ ID NO: 3493581 - RNA, 16 nt, Human
ccugcugcuccuagga

SEQ ID NO: 3493582 - RNA, 17 nt, Human
ccugcugcuccuaggac

SEQ ID NO: 3493583 - RNA, 18 nt, Human
ccugcugcugacccagcc

SEQ ID NO: 3493584 - RNA, 14 nt, Human
ccugcugcugagaa

SEQ ID NO: 3493585 - RNA, 23 nt, Human
ccugcugcugagaaccuggccuu

SEQ ID NO: 3493586 - RNA, 24 nt, Human
ccugcugcugagaaccuggccuuc

SEQ ID NO: 3493587 - RNA, 15 nt, Human
ccugcugcugccugc

SEQ ID NO: 3493588 - RNA, 16 nt, Human
ccugcugcugccugcc

SEQ ID NO: 3493589 - RNA, 18 nt, Human
ccugcugcuggugcacag

SEQ ID NO: 3493590 - RNA, 17 nt, Human
ccugcugcugucugggu

SEQ ID NO: 3493591 - RNA, 15 nt, Human
ccugcugcuucucca

SEQ ID NO: 3493592 - RNA, 17 nt, Human
ccugcuggaagcccagc

SEQ ID NO: 3493593 - RNA, 22 nt, Human
ccugcuggaggccucaggugcu

SEQ ID NO: 3493594 - RNA, 21 nt, Human
ccugcuggaucucccagggcu

SEQ ID NO: 3493595 - RNA, 19 nt, Human
ccugcuggcacccaccgug

SEQ ID NO: 3493596 - RNA, 17 nt, Human
ccugcuggccccucacc

SEQ ID NO: 3493597 - RNA, 14 nt, Human
ccugcuggccgccu

SEQ ID NO: 3493598 - RNA, 15 nt, Human
ccugcuggccgccuc

SEQ ID NO: 3493599 - RNA, 16 nt, Human
ccugcuggccgccuca

SEQ ID NO: 3493600 - RNA, 13 nt, Human
ccugcuggcucuu

SEQ ID NO: 3493601 - RNA, 16 nt, Human
ccugcugggcucucca

SEQ ID NO: 3493602 - RNA, 20 nt, Human
ccugcugggcucuccaccuc

SEQ ID NO: 3493603 - RNA, 23 nt, Human
ccugcugggcucuccaccucagc

SEQ ID NO: 3493604 - RNA, 14 nt, Human
ccugcugggugugg

SEQ ID NO: 3493605 - RNA, 20 nt, Human
ccugcuggucacagccuccu

SEQ ID NO: 3493606 - RNA, 13 nt, Human
ccugcugguucag

SEQ ID NO: 3493607 - RNA, 21 nt, Human
ccugcuguaaauuuggcuucu

SEQ ID NO: 3493608 - RNA, 22 nt, Human
ccugcugucauugcuucuucug

SEQ ID NO: 3493609 - RNA, 21 nt, Human
ccugcuguuuaucccuuaaga

SEQ ID NO: 3493610 - RNA, 22 nt, Human
ccugcuuaaucuucaaagccuu

SEQ ID NO: 3493611 - RNA, 23 nt, Human
ccugcuuaaucuucaaagccuuc

SEQ ID NO: 3493612 - RNA, 21 nt, Human
ccugaggcugggcucccuucc

SEQ ID NO: 3493613 - RNA, 21 nt, Human
ccugagggaaaggccagcacu

SEQ ID NO: 3493614 - RNA, 16 nt, Human
ccugagggaggaccug

SEQ ID NO: 3493615 - RNA, 22 nt, Human
ccugagggaucuauacuugcuu

SEQ ID NO: 3493616 - RNA, 18 nt, Human
ccugagggccccucugcc

SEQ ID NO: 3493617 - RNA, 22 nt, Human
ccugagggccccucugcccagc

SEQ ID NO: 3493618 - RNA, 22 nt, Human
ccugagggcggggugucugucu

SEQ ID NO: 3493619 - RNA, 15 nt, Human
ccugaggggagacag

SEQ ID NO: 3493620 - RNA, 18 nt, Human
ccugaggggagacagagc

SEQ ID NO: 3493621 - RNA, 20 nt, Human
ccugaggggcagccugccuu

SEQ ID NO: 3493622 - RNA, 20 nt, Human
ccugaggggcaucugccccu

SEQ ID NO: 3493623 - RNA, 23 nt, Human
ccugaggggcaucugccccuccc

SEQ ID NO: 3493624 - RNA, 12 nt, Human
ccugaggggccu

SEQ ID NO: 3493625 - RNA, 16 nt, Human
ccugaggggccucuua

SEQ ID NO: 3493626 - RNA, 12 nt, Human
ccugagggucug

SEQ ID NO: 3493627 - RNA, 18 nt, Human
ccugagggucuguagguu

SEQ ID NO: 3493628 - RNA, 16 nt, Human
ccugaggguggagacu

SEQ ID NO: 3493629 - RNA, 12 nt, Human
ccugaggucugg

SEQ ID NO: 3493630 - RNA, 15 nt, Human
ccugaggucuggcug

SEQ ID NO: 3493631 - RNA, 17 nt, Human
ccugaggucuggcugcu

SEQ ID NO: 3493632 - RNA, 21 nt, Human
ccugaggugggcccaggacca

SEQ ID NO: 3493633 - RNA, 17 nt, Human
ccugaggugugggggcu

SEQ ID NO: 3493634 - RNA, 20 nt, Human
ccugaggugugggggcugca

SEQ ID NO: 3493635 - RNA, 21 nt, Human
ccugaggugugggggcugcag

SEQ ID NO: 3493636 - RNA, 14 nt, Human
ccugagguuacugg

SEQ ID NO: 3493637 - RNA, 21 nt, Human
ccugaguacuccacacugcac

SEQ ID NO: 3493638 - RNA, 20 nt, Human
ccugaguagaaaggccuuua

SEQ ID NO: 3493639 - RNA, 21 nt, Human
ccugaguagaaaggccuuuaa

SEQ ID NO: 3493640 - RNA, 19 nt, Human
ccugaguagcuggauuaca

SEQ ID NO: 3493641 - RNA, 20 nt, Human
ccugaguagcuggauuacag

SEQ ID NO: 3493642 - RNA, 14 nt, Human
ccugagucaccagg

SEQ ID NO: 3493643 - RNA, 23 nt, Human
ccugagucacccuaccugugccu

SEQ ID NO: 3493644 - RNA, 21 nt, Human
ccugagucagggcccagaggc

SEQ ID NO: 3493645 - RNA, 11 nt, Human
ccugaguccca

SEQ ID NO: 3493646 - RNA, 22 nt, Human
ccugagucgugaccugcuaggc

SEQ ID NO: 3493647 - RNA, 13 nt, Human
ccugagucugggc

SEQ ID NO: 3493648 - RNA, 16 nt, Human
ccugagucugggcagc

SEQ ID NO: 3493649 - RNA, 17 nt, Human
ccugagucugggcagcu

SEQ ID NO: 3493650 - RNA, 14 nt, Human
ccugagugcuugcu

SEQ ID NO: 3493651 - RNA, 18 nt, Human
ccugaguggaucuccaag

SEQ ID NO: 3493652 - RNA, 19 nt, Human
ccugaguggaucuccaagg

SEQ ID NO: 3493653 - RNA, 19 nt, Human
ccugaguuaggcuuucucu

SEQ ID NO: 3493654 - RNA, 20 nt, Human
ccugaguucauccaggccca

SEQ ID NO: 3493655 - RNA, 14 nt, Human
ccugaguuccuagc

SEQ ID NO: 3493656 - RNA, 18 nt, Human
ccugaguuccuagccacc

SEQ ID NO: 3493657 - RNA, 19 nt, Human
ccugaguuccuagccaccg

SEQ ID NO: 3493658 - RNA, 20 nt, Human
ccugaguuccuagccaccgc

SEQ ID NO: 3493659 - RNA, 13 nt, Human
ccugaguugaaga

SEQ ID NO: 3493660 - RNA, 18 nt, Human
ccugauaaagcacagcug

SEQ ID NO: 3493661 - RNA, 19 nt, Human
ccugauaacaaccuggaga

SEQ ID NO: 3493662 - RNA, 21 nt, Human
ccugauauagaucacauaaca

SEQ ID NO: 3493663 - RNA, 14 nt, Human
ccugauaugauuua

SEQ ID NO: 3493664 - RNA, 21 nt, Human
ccugauauuucccuccccugg

SEQ ID NO: 3493665 - RNA, 14 nt, Human
ccugaucccacucc

SEQ ID NO: 3493666 - RNA, 22 nt, Human
ccugaucccuuccaccugcucu

SEQ ID NO: 3493667 - RNA, 20 nt, Human
ccuggacacaggccugcucu

SEQ ID NO: 3493668 - RNA, 17 nt, Human
ccuggacagcugugccu

SEQ ID NO: 3493669 - RNA, 19 nt, Human
ccuggacagcugugccucg

SEQ ID NO: 3493670 - RNA, 21 nt, Human
ccuggacagcugugccucgcu

SEQ ID NO: 3493671 - RNA, 21 nt, Human
ccuggacauuugccuugcugg

SEQ ID NO: 3493672 - RNA, 15 nt, Human
ccuggaccaaagcug

SEQ ID NO: 3493673 - RNA, 13 nt, Human
ccuggaccccagc

SEQ ID NO: 3493674 - RNA, 17 nt, Human
ccuggaccccagccuca

SEQ ID NO: 3493675 - RNA, 24 nt, Human
ccuggaccccccuuucacaggcag

SEQ ID NO: 3493676 - RNA, 13 nt, Human
ccuggacccugug

SEQ ID NO: 3493677 - RNA, 13 nt, Human
ccuggaccugccu

SEQ ID NO: 3493678 - RNA, 14 nt, Human
ccuggaccugccuc

SEQ ID NO: 3493679 - RNA, 20 nt, Human
ccuggaccuuuuguuuucug

SEQ ID NO: 3493680 - RNA, 15 nt, Human
ccuggacucauugcu

SEQ ID NO: 3493681 - RNA, 16 nt, Human
ccuggacucauugcuu

SEQ ID NO: 3493682 - RNA, 21 nt, Human
ccuggacugagggggccugga

SEQ ID NO: 3493683 - RNA, 22 nt, Human
ccuggacugagggggccuggau

SEQ ID NO: 3493684 - RNA, 23 nt, Human
ccuggacugagggggccuggaug

SEQ ID NO: 3493685 - RNA, 14 nt, Human
ccuggacugggagg

SEQ ID NO: 3493686 - RNA, 19 nt, Human
ccuggacuuggccccugcc

SEQ ID NO: 3493687 - RNA, 16 nt, Human
ccuggacuuuccugca

SEQ ID NO: 3493688 - RNA, 11 nt, Human
ccuggagaagc

SEQ ID NO: 3493689 - RNA, 17 nt, Human
ccuggagaagcugaugc

SEQ ID NO: 3493690 - RNA, 16 nt, Human
ccuggagacccacccc

SEQ ID NO: 3493691 - RNA, 22 nt, Human
ccuggagacccaccccaccugc

SEQ ID NO: 3493692 - RNA, 23 nt, Human
ccuggagagccagaaccuggagg

SEQ ID NO: 3493693 - RNA, 21 nt, Human
ccuggagagcuagaaccugga

SEQ ID NO: 3493694 - RNA, 22 nt, Human
ccuggagagcuagaaccuggag

SEQ ID NO: 3493695 - RNA, 23 nt, Human
ccuggagaguucaauggcugcug

SEQ ID NO: 3493696 - RNA, 15 nt, Human
ccuggagauccuccu

SEQ ID NO: 3493697 - RNA, 17 nt, Human
ccuggagauccuccugc

SEQ ID NO: 3493698 - RNA, 18 nt, Human
ccuggagauccuccugca

SEQ ID NO: 3493699 - RNA, 19 nt, Human
ccuggagauccuccugcag

SEQ ID NO: 3493700 - RNA, 20 nt, Human
ccuggagcaaucacagauga

SEQ ID NO: 3493701 - RNA, 15 nt, Human
ccuggagcaggccuu

SEQ ID NO: 3493702 - RNA, 16 nt, Human
ccuggagccagacucu

SEQ ID NO: 3493703 - RNA, 22 nt, Human
ccuggagccagacucuggucuu

SEQ ID NO: 3493704 - RNA, 11 nt, Human
ccuggagcccc

SEQ ID NO: 3493705 - RNA, 17 nt, Human
ccuggagccccacugcc

SEQ ID NO: 3493706 - RNA, 18 nt, Human
ccuggagccccacugccc

SEQ ID NO: 3493707 - RNA, 12 nt, Human
ccuggagccccu

SEQ ID NO: 3493708 - RNA, 13 nt, Human
ccuggagccccug

SEQ ID NO: 3493709 - RNA, 14 nt, Human
ccuggagccccugg

SEQ ID NO: 3493710 - RNA, 14 nt, Human
ccuggagcccgagg

SEQ ID NO: 3493711 - RNA, 13 nt, Human
ccuggaggaccug

SEQ ID NO: 3493712 - RNA, 14 nt, Human
ccuggaggaccuga

SEQ ID NO: 3493713 - RNA, 15 nt, Human
ccuggaggaccugag

SEQ ID NO: 3493714 - RNA, 21 nt, Human
ccuggaggaccugagccugcc

SEQ ID NO: 3493715 - RNA, 15 nt, Human
ccuggaggagcagag

SEQ ID NO: 3493716 - RNA, 16 nt, Human
ccuggaggauuucauc

SEQ ID NO: 3493717 - RNA, 14 nt, Human
ccuggaggcacuga

SEQ ID NO: 3493718 - RNA, 22 nt, Human
ccuggaggcacugaagugcuua

SEQ ID NO: 3493719 - RNA, 18 nt, Human
ccuggaggcugccuccca

SEQ ID NO: 3493720 - RNA, 19 nt, Human
ccuggaggcugccucccaa

SEQ ID NO: 3493721 - RNA, 21 nt, Human
ccuggaggcugccucccaaca

SEQ ID NO: 3493722 - RNA, 22 nt, Human
ccuggagggaagaguggaggug

SEQ ID NO: 3493723 - RNA, 21 nt, Human
ccuggagggaaugaaccugga

SEQ ID NO: 3493724 - RNA, 21 nt, Human
ccuggagggcuagaaccuaga

SEQ ID NO: 3493725 - RNA, 22 nt, Human
ccuggagggcuagaaccuggag

SEQ ID NO: 3493726 - RNA, 22 nt, Human
ccuggagggggaauggcagcag

SEQ ID NO: 3493727 - RNA, 13 nt, Human
ccuggaggugcca

SEQ ID NO: 3493728 - RNA, 16 nt, Human
ccuggaggugccagca

SEQ ID NO: 3493729 - RNA, 23 nt, Human
ccuggagguggcugagccccugu

SEQ ID NO: 3493730 - RNA, 17 nt, Human
ccuggagguuccccagc

SEQ ID NO: 3493731 - RNA, 19 nt, Human
ccuggagugcccacccugg

SEQ ID NO: 3493732 - RNA, 15 nt, Human
ccuggaguuugggau

SEQ ID NO: 3493733 - RNA, 19 nt, Human
ccuggaucacgacgcugca

SEQ ID NO: 3493734 - RNA, 22 nt, Human
ccuggaucacgacgcugcagag

SEQ ID NO: 3493735 - RNA, 14 nt, Human
ccuggaucagcgug

SEQ ID NO: 3493736 - RNA, 16 nt, Human
ccuggaucagcguggc

SEQ ID NO: 3493737 - RNA, 21 nt, Human
ccuggauccaucaggccacuu

SEQ ID NO: 3493738 - RNA, 16 nt, Human
ccuggaucuaccagca

SEQ ID NO: 3493739 - RNA, 19 nt, Human
ccuggaucuccccacucua

SEQ ID NO: 3493740 - RNA, 14 nt, Human
ccuggaugcagccu

SEQ ID NO: 3493741 - RNA, 14 nt, Human
ccuggaugcccagg

SEQ ID NO: 3493742 - RNA, 19 nt, Human
ccuggaugcccccugugga

SEQ ID NO: 3493743 - RNA, 12 nt, Human
ccuggaugucug

SEQ ID NO: 3493744 - RNA, 14 nt, Human
ccuggauguugcug

SEQ ID NO: 3493745 - RNA, 14 nt, Human
ccuggauucauuuc

SEQ ID NO: 3493746 - RNA, 15 nt, Human
ccuggauucauuucc

SEQ ID NO: 3493747 - RNA, 14 nt, Human
ccuggauuucuggu

SEQ ID NO: 3493748 - RNA, 22 nt, Human
ccuggcaagcuagaaccuggag

SEQ ID NO: 3493749 - RNA, 15 nt, Human
ccuggcacacaucag

SEQ ID NO: 3493750 - RNA, 21 nt, Human
ccuggcacacaucaggaguuc

SEQ ID NO: 3493751 - RNA, 16 nt, Human
ccuggcacaggacuga

SEQ ID NO: 3493752 - RNA, 24 nt, Human
ccuggcacaggacugauucuggga

SEQ ID NO: 3493753 - RNA, 12 nt, Human
ccuggcacagug

SEQ ID NO: 3493754 - RNA, 19 nt, Human
ccuggcacagugucugggc

SEQ ID NO: 3493755 - RNA, 18 nt, Human
ccuggcacccggccccug

SEQ ID NO: 3493756 - RNA, 15 nt, Human
caucggcguggccca

SEQ ID NO: 3493757 - RNA, 13 nt, Human
caucgggcugagg

SEQ ID NO: 3493758 - RNA, 17 nt, Human
caucgguguccauuuau

SEQ ID NO: 3493759 - RNA, 18 nt, Human
caucgguguccauuuaua

SEQ ID NO: 3493760 - RNA, 21 nt, Human
caucguauaacacaauaugaa

SEQ ID NO: 3493761 - RNA, 18 nt, Human
caucuaaaaauauacaug

SEQ ID NO: 3493762 - RNA, 22 nt, Human
caucuaaacuuuaauauguauu

SEQ ID NO: 3493763 - RNA, 18 nt, Human
caucuaaauaccugcccu

SEQ ID NO: 3493764 - RNA, 15 nt, Human
caucuaaccucaucu

SEQ ID NO: 3493765 - RNA, 12 nt, Human
caucuaagccug

SEQ ID NO: 3493766 - RNA, 14 nt, Human
caucuaagcugcag

SEQ ID NO: 3493767 - RNA, 17 nt, Human
caucuaagcugcagcuu

SEQ ID NO: 3493768 - RNA, 14 nt, Human
caucuaauaaaaaa

SEQ ID NO: 3493769 - RNA, 14 nt, Human
caucuaauucugau

SEQ ID NO: 3493770 - RNA, 16 nt, Human
caucuacaaaacauua

SEQ ID NO: 3493771 - RNA, 23 nt, Human
caucuagaggcuuccuucauuuc

SEQ ID NO: 3493772 - RNA, 12 nt, Human
caucuagccagc

SEQ ID NO: 3493773 - RNA, 22 nt, Human
caucuagccagccccucuuccc

SEQ ID NO: 3493774 - RNA, 18 nt, Human
caucuaggggagccuuga

SEQ ID NO: 3493775 - RNA, 20 nt, Human
caucuaguuccccuguuuau

SEQ ID NO: 3493776 - RNA, 21 nt, Human
caucuaguuccccuguuuauu

SEQ ID NO: 3493777 - RNA, 14 nt, Human
caucuauaaauugu

SEQ ID NO: 3493778 - RNA, 17 nt, Human
caucuauagaaagcuau

SEQ ID NO: 3493779 - RNA, 16 nt, Human
caucuaucucaauccu

SEQ ID NO: 3493780 - RNA, 20 nt, Human
caucuaucucaucuaucuca

SEQ ID NO: 3493781 - RNA, 19 nt, Human
caucuaucuggugauuucu

SEQ ID NO: 3493782 - RNA, 13 nt, Human
caucuauuuugau

SEQ ID NO: 3493783 - RNA, 22 nt, Human
caucuauuuugaugcagcauuu

SEQ ID NO: 3493784 - RNA, 14 nt, Human
caucuauuuuggau

SEQ ID NO: 3493785 - RNA, 15 nt, Human
caucucaacaggccu

SEQ ID NO: 3493786 - RNA, 19 nt, Human
caucucaacaggccucagg

SEQ ID NO: 3493787 - RNA, 14 nt, Human
caucucaaccaucc

SEQ ID NO: 3493788 - RNA, 16 nt, Human
caucucaaccaucccc

SEQ ID NO: 3493789 - RNA, 17 nt, Human
caucucacacaugagca

SEQ ID NO: 3493790 - RNA, 19 nt, Human
caucucacacaugagcauc

SEQ ID NO: 3493791 - RNA, 19 nt, Human
caucucagcucacugcaac

SEQ ID NO: 3493792 - RNA, 14 nt, Human
caucucaggccacc

SEQ ID NO: 3493793 - RNA, 20 nt, Human
caucucaggccaccugcccc

SEQ ID NO: 3493794 - RNA, 15 nt, Human
caucucaggggccag

SEQ ID NO: 3493795 - RNA, 22 nt, Human
caucucagguuaagugugagua

SEQ ID NO: 3493796 - RNA, 22 nt, Human
caucucaguccucaaagcuuuu

SEQ ID NO: 3493797 - RNA, 21 nt, Human
caucucagugaagaauacuuc

SEQ ID NO: 3493798 - RNA, 22 nt, Human
caucucagugaagaauacuucu

SEQ ID NO: 3493799 - RNA, 22 nt, Human
caucucaugccccuggcuggga

SEQ ID NO: 3493800 - RNA, 19 nt, Human
caucucauuuaagggaaaa

SEQ ID NO: 3493801 - RNA, 20 nt, Human
caucucauuuaagggaaaaa

SEQ ID NO: 3493802 - RNA, 18 nt, Human
caucuccaagaaugcuga

SEQ ID NO: 3493803 - RNA, 23 nt, Human
caucuccaagaaugcugaaacca

SEQ ID NO: 3493804 - RNA, 20 nt, Human
caucuccaccugcucccagg

SEQ ID NO: 3493805 - RNA, 14 nt, Human
caucuccagggagu

SEQ ID NO: 3493806 - RNA, 19 nt, Human
caucuccagggaguccccu

SEQ ID NO: 3493807 - RNA, 22 nt, Human
caucuccagggaguccccuccc

SEQ ID NO: 3493808 - RNA, 17 nt, Human
caucuccaucuugaagg

SEQ ID NO: 3493809 - RNA, 21 nt, Human
caucucccaccuagcagcacc

SEQ ID NO: 3493810 - RNA, 15 nt, Human
caucuccccucagcu

SEQ ID NO: 3493811 - RNA, 17 nt, Human
caucuccccucagcucg

SEQ ID NO: 3493812 - RNA, 21 nt, Human
caucuccccucagcucggcuc

SEQ ID NO: 3493813 - RNA, 24 nt, Human
caucucccucgaacccacacugca

SEQ ID NO: 3493814 - RNA, 16 nt, Human
caucucccugccuggc

SEQ ID NO: 3493815 - RNA, 17 nt, Human
caucucccugccuggcc

SEQ ID NO: 3493816 - RNA, 19 nt, Human
caucucccugccuggcccc

SEQ ID NO: 3493817 - RNA, 21 nt, Human
caucucccugccuggccccca

SEQ ID NO: 3493818 - RNA, 12 nt, Human
caucucccugcu

SEQ ID NO: 3493819 - RNA, 14 nt, Human
caucucccuggugc

SEQ ID NO: 3493820 - RNA, 15 nt, Human
caucucccuggugcu

SEQ ID NO: 3493821 - RNA, 23 nt, Human
ccugaucccuuccaccugcucug

SEQ ID NO: 3493822 - RNA, 15 nt, Human
ccugaucucuuccug

SEQ ID NO: 3493823 - RNA, 17 nt, Human
ccugaucucuuccuguu

SEQ ID NO: 3493824 - RNA, 15 nt, Human
ccugaucugcccauc

SEQ ID NO: 3493825 - RNA, 15 nt, Human
ccugaugaaaauaaa

SEQ ID NO: 3493826 - RNA, 19 nt, Human
ccugaugaaaauaaagaau

SEQ ID NO: 3493827 - RNA, 21 nt, Human
ccugaugaaaauaaagaaugg

SEQ ID NO: 3493828 - RNA, 16 nt, Human
ccugaugacagagcga

SEQ ID NO: 3493829 - RNA, 19 nt, Human
ccugaugacccaggcugcc

SEQ ID NO: 3493830 - RNA, 15 nt, Human
ccugaugcagucacg

SEQ ID NO: 3493831 - RNA, 16 nt, Human
ccugaugcucccuccc

SEQ ID NO: 3493832 - RNA, 19 nt, Human
ccugaugcucccuccccug

SEQ ID NO: 3493833 - RNA, 21 nt, Human
ccugaugcugacauucaccug

SEQ ID NO: 3493834 - RNA, 13 nt, Human
ccugaugcugacu

SEQ ID NO: 3493835 - RNA, 21 nt, Human
ccugauggaaguaaagccuca

SEQ ID NO: 3493836 - RNA, 23 nt, Human
ccugauggcaggauggccuggcc

SEQ ID NO: 3493837 - RNA, 21 nt, Human
ccugaugguacaggaaagcuc

SEQ ID NO: 3493838 - RNA, 18 nt, Human
ccugauggucagcucccu

SEQ ID NO: 3493839 - RNA, 21 nt, Human
ccugauggucagcucccuucu

SEQ ID NO: 3493840 - RNA, 23 nt, Human
ccugauggucagcucccuucucu

SEQ ID NO: 3493841 - RNA, 13 nt, Human
ccugauuccucuc

SEQ ID NO: 3493842 - RNA, 17 nt, Human
ccugauugccaagcuca

SEQ ID NO: 3493843 - RNA, 13 nt, Human
ccugauuguaaac

SEQ ID NO: 3493844 - RNA, 17 nt, Human
ccugauugugucucuug

SEQ ID NO: 3493845 - RNA, 22 nt, Human
ccugauuuaauaugcaaagucu

SEQ ID NO: 3493846 - RNA, 19 nt, Human
ccugauuuaggagaagcca

SEQ ID NO: 3493847 - RNA, 21 nt, Human
ccugauuuaggagaagccagg

SEQ ID NO: 3493848 - RNA, 15 nt, Human
ccugauuucuccugc

SEQ ID NO: 3493849 - RNA, 17 nt, Human
ccugauuugcugggcag

SEQ ID NO: 3493850 - RNA, 22 nt, Human
ccugauuugcugggcaguuuuu

SEQ ID NO: 3493851 - RNA, 18 nt, Human
ccugauuugguacuuuug

SEQ ID NO: 3493852 - RNA, 16 nt, Human
ccugauuuuuuuuccu

SEQ ID NO: 3493853 - RNA, 15 nt, Human
ccugcaaaaaauacu

SEQ ID NO: 3493854 - RNA, 19 nt, Human
ccugcaaacgcugccugcc

SEQ ID NO: 3493855 - RNA, 22 nt, Human
ccugcaaacgcugccugcccac

SEQ ID NO: 3493856 - RNA, 22 nt, Human
ccugcaaacgcugccugcccgu

SEQ ID NO: 3493857 - RNA, 15 nt, Human
ccugcaaacucacug

SEQ ID NO: 3493858 - RNA, 16 nt, Human
ccugcaaacucacugc

SEQ ID NO: 3493859 - RNA, 17 nt, Human
ccugcaaacucacugcu

SEQ ID NO: 3493860 - RNA, 20 nt, Human
ccugcaaacucacugcucaa

SEQ ID NO: 3493861 - RNA, 14 nt, Human
ccugcaaagcccag

SEQ ID NO: 3493862 - RNA, 16 nt, Human
ccugcaaagcccagcu

SEQ ID NO: 3493863 - RNA, 22 nt, Human
ccugcaaccaaacucccaucag

SEQ ID NO: 3493864 - RNA, 22 nt, Human
ccugcaaccugauugugucucu

SEQ ID NO: 3493865 - RNA, 18 nt, Human
ccugcaacucaaggacuu

SEQ ID NO: 3493866 - RNA, 12 nt, Human
ccugcaacucau

SEQ ID NO: 3493867 - RNA, 14 nt, Human
ccugcaagaacaag

SEQ ID NO: 3493868 - RNA, 12 nt, Human
ccugcaaggacu

SEQ ID NO: 3493869 - RNA, 16 nt, Human
ccugcaaggcccacag

SEQ ID NO: 3493870 - RNA, 21 nt, Human
ccugcaaggcccacaggaggc

SEQ ID NO: 3493871 - RNA, 13 nt, Human
ccugcaauauuug

SEQ ID NO: 3493872 - RNA, 16 nt, Human
ccugcaauauuugaau

SEQ ID NO: 3493873 - RNA, 22 nt, Human
ccugcaaugaaagguacuauau

SEQ ID NO: 3493874 - RNA, 20 nt, Human
ccugcacaaagcccuuccau

SEQ ID NO: 3493875 - RNA, 15 nt, Human
ccugcacaagccagg

SEQ ID NO: 3493876 - RNA, 16 nt, Human
ccugcacaagccaggg

SEQ ID NO: 3493877 - RNA, 19 nt, Human
ccugcacaauaaaaauguu

SEQ ID NO: 3493878 - RNA, 12 nt, Human
ccugcacacaag

SEQ ID NO: 3493879 - RNA, 14 nt, Human
ccugcacagcaggc

SEQ ID NO: 3493880 - RNA, 21 nt, Human
ccugcacagugacuucugaga

SEQ ID NO: 3493881 - RNA, 12 nt, Human
ccugcaccagga

SEQ ID NO: 3493882 - RNA, 15 nt, Human
ccugcaccggggccu

SEQ ID NO: 3493883 - RNA, 14 nt, Human
ccugcaccuccccc

SEQ ID NO: 3493884 - RNA, 20 nt, Human
ccugcaccuccccccacugc

SEQ ID NO: 3493885 - RNA, 21 nt, Human
ccugcaccuccccccacugca

SEQ ID NO: 3493886 - RNA, 19 nt, Human
ccugcacggugggccuugc

SEQ ID NO: 3493887 - RNA, 22 nt, Human
ccugcacggugggccuugcugg

SEQ ID NO: 3493888 - RNA, 17 nt, Human
ccugcacuaacagagug

SEQ ID NO: 3493889 - RNA, 23 nt, Human
ccugcacuccucagggcagccuc

SEQ ID NO: 3493890 - RNA, 19 nt, Human
ccugcacucuuuaagggag

SEQ ID NO: 3493891 - RNA, 16 nt, Human
ccugcacugacucugg

SEQ ID NO: 3493892 - RNA, 17 nt, Human
ccugcacuggaguccag

SEQ ID NO: 3493893 - RNA, 20 nt, Human
ccugcacuggaguccagucu

SEQ ID NO: 3493894 - RNA, 21 nt, Human
ccugcacuggggagcccgucu

SEQ ID NO: 3493895 - RNA, 13 nt, Human
ccugcacuguaaa

SEQ ID NO: 3493896 - RNA, 20 nt, Human
ccugcacuguccugcuccac

SEQ ID NO: 3493897 - RNA, 21 nt, Human
ccugcacuguccugcuccaca

SEQ ID NO: 3493898 - RNA, 16 nt, Human
ccugcacuugcagacu

SEQ ID NO: 3493899 - RNA, 21 nt, Human
ccugcacuugggggcucagca

SEQ ID NO: 3493900 - RNA, 21 nt, Human
caucugggaacuugucacaga

SEQ ID NO: 3493901 - RNA, 18 nt, Human
caucugggaguccccuuu

SEQ ID NO: 3493902 - RNA, 20 nt, Human
caucugggccuuggccugga

SEQ ID NO: 3493903 - RNA, 16 nt, Human
caucugggcuccucca

SEQ ID NO: 3493904 - RNA, 21 nt, Human
caucuggggcccauacugguu

SEQ ID NO: 3493905 - RNA, 16 nt, Human
caucugggggagugga

SEQ ID NO: 3493906 - RNA, 18 nt, Human
caucugggggaguggaau

SEQ ID NO: 3493907 - RNA, 18 nt, Human
caucuggguagcuguaag

SEQ ID NO: 3493908 - RNA, 17 nt, Human
caucugguuaggauggc

SEQ ID NO: 3493909 - RNA, 14 nt, Human
caucugguuuucuc

SEQ ID NO: 3493910 - RNA, 15 nt, Human
caucugguuuucucu

SEQ ID NO: 3493911 - RNA, 19 nt, Human
caucuguaacucuaaaaga

SEQ ID NO: 3493912 - RNA, 15 nt, Human
caucuguacuugguc

SEQ ID NO: 3493913 - RNA, 20 nt, Human
caucuguauaaguaagaaaa

SEQ ID NO: 3493914 - RNA, 21 nt, Human
caucuguauaaguaagaaaau

SEQ ID NO: 3493915 - RNA, 18 nt, Human
caucuguauacccucugu

SEQ ID NO: 3493916 - RNA, 14 nt, Human
caucugucaacagg

SEQ ID NO: 3493917 - RNA, 12 nt, Human
caucuguccccc

SEQ ID NO: 3493918 - RNA, 16 nt, Human
caucugucccuccggg

SEQ ID NO: 3493919 - RNA, 19 nt, Human
caucugugaaaggaaagag

SEQ ID NO: 3493920 - RNA, 11 nt, Human
caucugugaau

SEQ ID NO: 3493921 - RNA, 13 nt, Human
caucugugaauaa

SEQ ID NO: 3493922 - RNA, 15 nt, Human
caucugugauucccu

SEQ ID NO: 3493923 - RNA, 11 nt, Human
caucugugcau

SEQ ID NO: 3493924 - RNA, 17 nt, Human
caucugugggcacgcug

SEQ ID NO: 3493925 - RNA, 11 nt, Human
caucuguuuuu

SEQ ID NO: 3493926 - RNA, 14 nt, Human
caucuuaaaaacaa

SEQ ID NO: 3493927 - RNA, 13 nt, Human
caucuuaaaagcu

SEQ ID NO: 3493928 - RNA, 16 nt, Human
caucuuaacucuuugc

SEQ ID NO: 3493929 - RNA, 14 nt, Human
caucuuacugaagg

SEQ ID NO: 3493930 - RNA, 22 nt, Human
caucuuacuguaccuguuccuu

SEQ ID NO: 3493931 - RNA, 19 nt, Human
caucuuaguauuugcauau

SEQ ID NO: 3493932 - RNA, 14 nt, Human
caucuuagugccug

SEQ ID NO: 3493933 - RNA, 19 nt, Human
caucuuauagcacuuugaa

SEQ ID NO: 3493934 - RNA, 20 nt, Human
caucuuauuuucauguauau

SEQ ID NO: 3493935 - RNA, 20 nt, Human
caucuucaguugucucugau

SEQ ID NO: 3493936 - RNA, 20 nt, Human
caucuuccagaagugugauu

SEQ ID NO: 3493937 - RNA, 16 nt, Human
caucuuccaggugggg

SEQ ID NO: 3493938 - RNA, 10 nt, Human
caucuuccca

SEQ ID NO: 3493939 - RNA, 21 nt, Human
caucuucccagcagggccacu

SEQ ID NO: 3493940 - RNA, 13 nt, Human
caucuucccgaga

SEQ ID NO: 3493941 - RNA, 13 nt, Human
caucuuccugugu

SEQ ID NO: 3493942 - RNA, 15 nt, Human
caucuucgggaccag

SEQ ID NO: 3493943 - RNA, 23 nt, Human
caucuucgucuucacucuuaggc

SEQ ID NO: 3493944 - RNA, 21 nt, Human
caucuucuaaacccaauccaa

SEQ ID NO: 3493945 - RNA, 13 nt, Human
caucuucucagcu

SEQ ID NO: 3493946 - RNA, 21 nt, Human
caucuucucagcucccauuuc

SEQ ID NO: 3493947 - RNA, 17 nt, Human
caucuucuccaucuggc

SEQ ID NO: 3493948 - RNA, 20 nt, Human
caucuucuguugcucucugu

SEQ ID NO: 3493949 - RNA, 15 nt, Human
caucuugacagagcc

SEQ ID NO: 3493950 - RNA, 23 nt, Human
caucuugaccaagcaggaagcuc

SEQ ID NO: 3493951 - RNA, 19 nt, Human
caucuugaucugcucagcc

SEQ ID NO: 3493952 - RNA, 20 nt, Human
caucuugaucugcucagccc

SEQ ID NO: 3493953 - RNA, 17 nt, Human
caucuugcauuaugcaa

SEQ ID NO: 3493954 - RNA, 18 nt, Human
caucuugcccgcucaggc

SEQ ID NO: 3493955 - RNA, 19 nt, Human
caucuugcccgcucaggcu

SEQ ID NO: 3493956 - RNA, 15 nt, Human
caucuugccuccagg

SEQ ID NO: 3493957 - RNA, 18 nt, Human
caucuugccuccaggugc

SEQ ID NO: 3493958 - RNA, 21 nt, Human
caucuugccuccaggugcaga

SEQ ID NO: 3493959 - RNA, 22 nt, Human
caucuugccuccaggugcagag

SEQ ID NO: 3493960 - RNA, 14 nt, Human
caucuugcuaccag

SEQ ID NO: 3493961 - RNA, 16 nt, Human
caucuugcuaccagua

SEQ ID NO: 3493962 - RNA, 22 nt, Human
caucuugcuaccaguauuuaga

SEQ ID NO: 3493963 - RNA, 15 nt, Human
caucuugcucugcug

SEQ ID NO: 3493964 - RNA, 17 nt, Human
caucuugcucugcugac

SEQ ID NO: 3493965 - RNA, 14 nt, Human
caucuugcuucccu

SEQ ID NO: 3493966 - RNA, 15 nt, Human
caucuuggggacauc

SEQ ID NO: 3493967 - RNA, 13 nt, Human
caucuugguaaau

SEQ ID NO: 3493968 - RNA, 23 nt, Human
caucuuguaauuuccagcuuucu

SEQ ID NO: 3493969 - RNA, 19 nt, Human
caucuuuaaacaguauuuc

SEQ ID NO: 3493970 - RNA, 10 nt, Human
caucuuuaag

SEQ ID NO: 3493971 - RNA, 17 nt, Human
caucuuuauugaaauuc

SEQ ID NO: 3493972 - RNA, 21 nt, Human
caucuuuauugaaauucuauu

SEQ ID NO: 3493973 - RNA, 12 nt, Human
caucuuucacau

SEQ ID NO: 3493974 - RNA, 17 nt, Human
caucuuucaucaaucau

SEQ ID NO: 3493975 - RNA, 21 nt, Human
caucuuucaucaaucauugua

SEQ ID NO: 3493976 - RNA, 14 nt, Human
caucuuucccuccu

SEQ ID NO: 3493977 - RNA, 16 nt, Human
caucuuucccuccuug

SEQ ID NO: 3493978 - RNA, 17 nt, Human
caucuuucccuccuugg

SEQ ID NO: 3493979 - RNA, 21 nt, Human
caucuuucccuccuuggugau

SEQ ID NO: 3493980 - RNA, 17 nt, Human
ccugccaccuggacccc

SEQ ID NO: 3493981 - RNA, 21 nt, Human
ccugccaccuggaccccugca

SEQ ID NO: 3493982 - RNA, 22 nt, Human
ccugccaccuggaccccugcau

SEQ ID NO: 3493983 - RNA, 17 nt, Human
ccugccaccugucuguc

SEQ ID NO: 3493984 - RNA, 12 nt, Human
ccugccacucac

SEQ ID NO: 3493985 - RNA, 17 nt, Human
ccugccacucacacagc

SEQ ID NO: 3493986 - RNA, 15 nt, Human
ccugccacucacuag

SEQ ID NO: 3493987 - RNA, 14 nt, Human
ccugccacucaggc

SEQ ID NO: 3493988 - RNA, 19 nt, Human
ccugccagacggcacccac

SEQ ID NO: 3493989 - RNA, 14 nt, Human
ccugccagagggga

SEQ ID NO: 3493990 - RNA, 18 nt, Human
ccugccagaggggaagga

SEQ ID NO: 3493991 - RNA, 13 nt, Human
ccugccagcaccc

SEQ ID NO: 3493992 - RNA, 12 nt, Human
ccugccagcccc

SEQ ID NO: 3493993 - RNA, 18 nt, Human
ccugccagccccacacag

SEQ ID NO: 3493994 - RNA, 16 nt, Human
ccugccagccccugcc

SEQ ID NO: 3493995 - RNA, 15 nt, Human
ccugccagccuggcu

SEQ ID NO: 3493996 - RNA, 23 nt, Human
ccugccagcugcacugaugcugc

SEQ ID NO: 3493997 - RNA, 14 nt, Human
ccugccaggaagcc

SEQ ID NO: 3493998 - RNA, 18 nt, Human
ccugccaggaagccagca

SEQ ID NO: 3493999 - RNA, 15 nt, Human
ccugccaggaggacc

SEQ ID NO: 3494000 - RNA, 13 nt, Human
ccugccaggcaca

SEQ ID NO: 3494001 - RNA, 15 nt, Human
ccugccaggcagggg

SEQ ID NO: 3494002 - RNA, 22 nt, Human
ccugccaggcaggggugggggu

SEQ ID NO: 3494003 - RNA, 14 nt, Human
ccugccagggacag

SEQ ID NO: 3494004 - RNA, 16 nt, Human
ccugccagggagacag

SEQ ID NO: 3494005 - RNA, 13 nt, Human
ccugccagggcag

SEQ ID NO: 3494006 - RNA, 15 nt, Human
ccugccaguccuagc

SEQ ID NO: 3494007 - RNA, 16 nt, Human
ccugccaguccuagcu

SEQ ID NO: 3494008 - RNA, 19 nt, Human
ccugccaguccuagcugca

SEQ ID NO: 3494009 - RNA, 20 nt, Human
ccugccaguccuagcugcac

SEQ ID NO: 3494010 - RNA, 20 nt, Human
ccugccaucauguuuacaga

SEQ ID NO: 3494011 - RNA, 18 nt, Human
ccugccaucuucccagca

SEQ ID NO: 3494012 - RNA, 16 nt, Human
ccugccaugcaagaac

SEQ ID NO: 3494013 - RNA, 21 nt, Human
ccugccauguaccuccccugc

SEQ ID NO: 3494014 - RNA, 22 nt, Human
ccugccauuguagcgucuuucu

SEQ ID NO: 3494015 - RNA, 14 nt, Human
ccugccauuuaaaa

SEQ ID NO: 3494016 - RNA, 23 nt, Human
ccugccauuugcacccuccgccu

SEQ ID NO: 3494017 - RNA, 16 nt, Human
ccugcccaagcccagg

SEQ ID NO: 3494018 - RNA, 14 nt, Human
ccugcccacacagg

SEQ ID NO: 3494019 - RNA, 22 nt, Human
ccugcccacacagguucacgug

SEQ ID NO: 3494020 - RNA, 14 nt, Human
ccugcccaccugcc

SEQ ID NO: 3494021 - RNA, 19 nt, Human
ccugcccaccugccuggcc

SEQ ID NO: 3494022 - RNA, 14 nt, Human
ccugcccaccuggc

SEQ ID NO: 3494023 - RNA, 20 nt, Human
ccugcccaccuggccucugc

SEQ ID NO: 3494024 - RNA, 19 nt, Human
ccugcccagaucagccaga

SEQ ID NO: 3494025 - RNA, 18 nt, Human
ccugcccagaucccagaa

SEQ ID NO: 3494026 - RNA, 20 nt, Human
ccugcccaggagagccagcc

SEQ ID NO: 3494027 - RNA, 14 nt, Human
ccugcccaggcccc

SEQ ID NO: 3494028 - RNA, 16 nt, Human
ccugcccaggccccug

SEQ ID NO: 3494029 - RNA, 22 nt, Human
ccugcccaggccccugccaccc

SEQ ID NO: 3494030 - RNA, 13 nt, Human
ccugcccaggccg

SEQ ID NO: 3494031 - RNA, 19 nt, Human
ccugcccagucccccaacc

SEQ ID NO: 3494032 - RNA, 22 nt, Human
ccugcccagugcacuugcugga

SEQ ID NO: 3494033 - RNA, 22 nt, Human
ccugcccaguugcacucaggug

SEQ ID NO: 3494034 - RNA, 16 nt, Human
ccugcccaugggagcu

SEQ ID NO: 3494035 - RNA, 22 nt, Human
ccugcccaugucgcgcucagca

SEQ ID NO: 3494036 - RNA, 15 nt, Human
ccugccccaacuccu

SEQ ID NO: 3494037 - RNA, 22 nt, Human
ccugccccaacuccuuccagcu

SEQ ID NO: 3494038 - RNA, 11 nt, Human
ccugccccaca

SEQ ID NO: 3494039 - RNA, 15 nt, Human
ccugccccagcccaa

SEQ ID NO: 3494040 - RNA, 17 nt, Human
ccugccccagcccaagu

SEQ ID NO: 3494041 - RNA, 12 nt, Human
ccugccccagcg

SEQ ID NO: 3494042 - RNA, 13 nt, Human
ccugccccagcgc

SEQ ID NO: 3494043 - RNA, 14 nt, Human
ccugccccaggccu

SEQ ID NO: 3494044 - RNA, 16 nt, Human
ccugccccaggccuga

SEQ ID NO: 3494045 - RNA, 16 nt, Human
ccugcccccaauccau

SEQ ID NO: 3494046 - RNA, 13 nt, Human
ccuuacuccugug

SEQ ID NO: 3494047 - RNA, 23 nt, Human
ccuuacugaccucaccuaggaag

SEQ ID NO: 3494048 - RNA, 12 nt, Human
ccuuacugcaga

SEQ ID NO: 3494049 - RNA, 18 nt, Human
ccuuacuggcuuaccucc

SEQ ID NO: 3494050 - RNA, 14 nt, Human
ccuuacuuagcaug

SEQ ID NO: 3494051 - RNA, 20 nt, Human
ccuuacuugcuucucuagcu

SEQ ID NO: 3494052 - RNA, 22 nt, Human
ccuuacuuuacugccugaauaa

SEQ ID NO: 3494053 - RNA, 19 nt, Human
ccuuacuuuguaugauauu

SEQ ID NO: 3494054 - RNA, 20 nt, Human
ccuuacuuuguaugauauuc

SEQ ID NO: 3494055 - RNA, 15 nt, Human
ccuuacuuuuuauau

SEQ ID NO: 3494056 - RNA, 20 nt, Human
ccuuagaacauuuuaauuca

SEQ ID NO: 3494057 - RNA, 20 nt, Human
ccuuagacagaggcccucaa

SEQ ID NO: 3494058 - RNA, 14 nt, Human
ccuuagacaguccc

SEQ ID NO: 3494059 - RNA, 19 nt, Human
ccuuagacagucccugcca

SEQ ID NO: 3494060 - RNA, 16 nt, Human
ccuuagaccaccaagc

SEQ ID NO: 3494061 - RNA, 16 nt, Human
ccuuagaccuuccaua

SEQ ID NO: 3494062 - RNA, 20 nt, Human
ccuuagacucuuuuccuucc

SEQ ID NO: 3494063 - RNA, 18 nt, Human
ccuuagagccaggcacac

SEQ ID NO: 3494064 - RNA, 20 nt, Human
ccuuagagguccucuggagc

SEQ ID NO: 3494065 - RNA, 20 nt, Human
ccuuagcacuaccacuccug

SEQ ID NO: 3494066 - RNA, 19 nt, Human
ccuuagcagggaaacagcu

SEQ ID NO: 3494067 - RNA, 16 nt, Human
ccuuagcauguuugcu

SEQ ID NO: 3494068 - RNA, 19 nt, Human
ccuuagcauguuugcugaa

SEQ ID NO: 3494069 - RNA, 10 nt, Human
ccuuagccag

SEQ ID NO: 3494070 - RNA, 15 nt, Human
ccuuagcccccaccc

SEQ ID NO: 3494071 - RNA, 18 nt, Human
ccuuagcccccacccacu

SEQ ID NO: 3494072 - RNA, 15 nt, Human
ccuuagccucccuga

SEQ ID NO: 3494073 - RNA, 21 nt, Human
ccuuagccuggaccucugaca

SEQ ID NO: 3494074 - RNA, 11 nt, Human
ccuuagcugcc

SEQ ID NO: 3494075 - RNA, 18 nt, Human
ccuuagcuuagaccucag

SEQ ID NO: 3494076 - RNA, 19 nt, Human
ccuuagcuuagaccucagc

SEQ ID NO: 3494077 - RNA, 20 nt, Human
ccuuagcuuagaccucagcc

SEQ ID NO: 3494078 - RNA, 16 nt, Human
ccuuagcuucaggaac

SEQ ID NO: 3494079 - RNA, 17 nt, Human
ccuuagcuucaggaacc

SEQ ID NO: 3494080 - RNA, 19 nt, Human
ccuuagcuucaggaaccuc

SEQ ID NO: 3494081 - RNA, 22 nt, Human
ccuuaggccacaugggagcagu

SEQ ID NO: 3494082 - RNA, 14 nt, Human
ccuuaggccuuccu

SEQ ID NO: 3494083 - RNA, 23 nt, Human
ccuuaggccuuccucucuccaga

SEQ ID NO: 3494084 - RNA, 20 nt, Human
ccuuagguuuuuuuccuucu

SEQ ID NO: 3494085 - RNA, 14 nt, Human
ccuuaguacugagu

SEQ ID NO: 3494086 - RNA, 22 nt, Human
ccuuagucccccaacucugagc

SEQ ID NO: 3494087 - RNA, 14 nt, Human
ccuuagucucaguu

SEQ ID NO: 3494088 - RNA, 19 nt, Human
ccuuagugggccagggcug

SEQ ID NO: 3494089 - RNA, 19 nt, Human
ccuuauaguuugggcuuca

SEQ ID NO: 3494090 - RNA, 13 nt, Human
ccuuaucaaagga

SEQ ID NO: 3494091 - RNA, 12 nt, Human
ccuuaucaagug

SEQ ID NO: 3494092 - RNA, 13 nt, Human
ccuuaucaagugu

SEQ ID NO: 3494093 - RNA, 17 nt, Human
ccuuaucaccagcugcc

SEQ ID NO: 3494094 - RNA, 20 nt, Human
ccuuaucaccagcugccucu

SEQ ID NO: 3494095 - RNA, 17 nt, Human
ccuuaucauucauucuu

SEQ ID NO: 3494096 - RNA, 17 nt, Human
ccuuauccucccuguaa

SEQ ID NO: 3494097 - RNA, 19 nt, Human
ccuuauccucccuguaacu

SEQ ID NO: 3494098 - RNA, 15 nt, Human
ccuuauccucugauc

SEQ ID NO: 3494099 - RNA, 16 nt, Human
ccuuauccuucaucuu

SEQ ID NO: 3494100 - RNA, 14 nt, Human
ccuuauccuuccuc

SEQ ID NO: 3494101 - RNA, 16 nt, Human
ccuuaucuccaagacc

SEQ ID NO: 3494102 - RNA, 22 nt, Human
ccuuaucuccaagaccagagau

SEQ ID NO: 3494103 - RNA, 21 nt, Human
ccuuaucugugcgugaaacac

SEQ ID NO: 3494104 - RNA, 17 nt, Human
ccuuaugacugccaaga

SEQ ID NO: 3494105 - RNA, 18 nt, Human
ccuuauggaacacucuga

SEQ ID NO: 3494106 - RNA, 20 nt, Human
ccuuauggaacacucugaga

SEQ ID NO: 3494107 - RNA, 22 nt, Human
ccuuauuacacggaaaacggug

SEQ ID NO: 3494108 - RNA, 16 nt, Human
ccuuauuagagugucu

SEQ ID NO: 3494109 - RNA, 21 nt, Human
ccuuauuagagugucuuucca

SEQ ID NO: 3494110 - RNA, 19 nt, Human
ccuuauugcuguccuggag

SEQ ID NO: 3494111 - RNA, 16 nt, Human
ccuuauuguacguuua

SEQ ID NO: 3494112 - RNA, 22 nt, Human
ccuuauuugcuaaucaaagcca

SEQ ID NO: 3494113 - RNA, 15 nt, Human
ccuuauuuuuuccca

SEQ ID NO: 3494114 - RNA, 14 nt, Human
ccuucaacaaggcu

SEQ ID NO: 3494115 - RNA, 19 nt, Human
ccuucaacaaggcuugcug

SEQ ID NO: 3494116 - RNA, 23 nt, Human
ccuucaacaaggcuugcugcaga

SEQ ID NO: 3494117 - RNA, 18 nt, Human
ccuucaagaaaacaggca

SEQ ID NO: 3494118 - RNA, 19 nt, Human
ccuucaagaacucugggcu

SEQ ID NO: 3494119 - RNA, 23 nt, Human
ccuucaagaucauguaccccaau

SEQ ID NO: 3494120 - RNA, 16 nt, Human
ccuucaagcucugagg

SEQ ID NO: 3494121 - RNA, 21 nt, Human
ccuucaagcucugagggaaag

SEQ ID NO: 3494122 - RNA, 14 nt, Human
ccuucaauuccugg

SEQ ID NO: 3494123 - RNA, 20 nt, Human
ccuucaauuccugggcccca

SEQ ID NO: 3494124 - RNA, 21 nt, Human
ccuucacauuccccuggggac

SEQ ID NO: 3494125 - RNA, 16 nt, Human
ccuucacauuuuuuau

SEQ ID NO: 3494126 - RNA, 14 nt, Human
ccuucaccucugaa

SEQ ID NO: 3494127 - RNA, 20 nt, Human
ccuucacuccggugugccug

SEQ ID NO: 3494128 - RNA, 14 nt, Human
ccuucacuuaggaa

SEQ ID NO: 3494129 - RNA, 10 nt, Human
ccuucagaca

SEQ ID NO: 3494130 - RNA, 13 nt, Human
ccuucagagagca

SEQ ID NO: 3494131 - RNA, 11 nt, Human
ccuucagaggc

SEQ ID NO: 3494132 - RNA, 13 nt, Human
ccuucagauccua

SEQ ID NO: 3494133 - RNA, 14 nt, Human
ccuucagauccuac

SEQ ID NO: 3494134 - RNA, 17 nt, Human
ccuucagcccccagccc

SEQ ID NO: 3494135 - RNA, 13 nt, Human
ccuucagcccuca

SEQ ID NO: 3494136 - RNA, 18 nt, Human
ccuucagcccucaccccu

SEQ ID NO: 3494137 - RNA, 12 nt, Human
ccuucagccuga

SEQ ID NO: 3494138 - RNA, 12 nt, Human
ccuucagcucca

SEQ ID NO: 3494139 - RNA, 23 nt, Human
ccuucaguacccucucagcucca

SEQ ID NO: 3494140 - RNA, 12 nt, Human
ccuucagugccc

SEQ ID NO: 3494141 - RNA, 15 nt, Human
ccuucagugcccacc

SEQ ID NO: 3494142 - RNA, 12 nt, Human
ccuucagugccu

SEQ ID NO: 3494143 - RNA, 17 nt, Human
ccuucaguuuuuguguu

SEQ ID NO: 3494144 - RNA, 18 nt, Human
ccuucauaucauccacac

SEQ ID NO: 3494145 - RNA, 23 nt, Human
ccuucauaugaaaggugccaugg

SEQ ID NO: 3494146 - RNA, 14 nt, Human
ccuucaucuccagg

SEQ ID NO: 3494147 - RNA, 13 nt, Human
ccuucaucuggaa

SEQ ID NO: 3494148 - RNA, 17 nt, Human
ccuucaucuuccugugu

SEQ ID NO: 3494149 - RNA, 18 nt, Human
ccuucaugacagccucca

SEQ ID NO: 3494150 - RNA, 23 nt, Human
ccuucauucugcaaguauacuag

SEQ ID NO: 3494151 - RNA, 21 nt, Human
ccuucauugauuuccuguguc

SEQ ID NO: 3494152 - RNA, 22 nt, Human
ccuucauugauuuccuguguca

SEQ ID NO: 3494153 - RNA, 14 nt, Human
ccuucauuuccucc

SEQ ID NO: 3494154 - RNA, 15 nt, Human
ccuucauuuccuccg

SEQ ID NO: 3494155 - RNA, 22 nt, Human
ccuucauuuggcauuccccacu

SEQ ID NO: 3494156 - RNA, 17 nt, Human
ccuuccaaauaauaaag

SEQ ID NO: 3494157 - RNA, 17 nt, Human
ccuuccaagagccugag

SEQ ID NO: 3494158 - RNA, 20 nt, Human
ccuuccaaugucuggagacc

SEQ ID NO: 3494159 - RNA, 17 nt, Human
ccuuccaccugcucugc

SEQ ID NO: 3494160 - RNA, 19 nt, Human
ccuuccaccugcucugcug

SEQ ID NO: 3494161 - RNA, 17 nt, Human
ccuuccacugagggcag

SEQ ID NO: 3494162 - RNA, 13 nt, Human
ccuuccacugccu

SEQ ID NO: 3494163 - RNA, 17 nt, Human
ccuuccacugccucugc

SEQ ID NO: 3494164 - RNA, 14 nt, Human
ccuuccagaaaaca

SEQ ID NO: 3494165 - RNA, 20 nt, Human
ccuuccagaucacugccaca

SEQ ID NO: 3494166 - RNA, 19 nt, Human
ccuuccagauccucucugg

SEQ ID NO: 3494167 - RNA, 16 nt, Human
ccuuccagcacccugc

SEQ ID NO: 3494168 - RNA, 23 nt, Human
ccuuccagcuagugacccacaug

SEQ ID NO: 3494169 - RNA, 12 nt, Human
ccuuccagcucc

SEQ ID NO: 3494170 - RNA, 16 nt, Human
ccuuccagcuccugua

SEQ ID NO: 3494171 - RNA, 14 nt, Human
ccuuccagcugcug

SEQ ID NO: 3494172 - RNA, 13 nt, Human
ccuuccaggccau

SEQ ID NO: 3494173 - RNA, 15 nt, Human
ccuuccagggguggg

SEQ ID NO: 3494174 - RNA, 15 nt, Human
ccuuccauaauuaug

SEQ ID NO: 3494175 - RNA, 18 nt, Human
ccuuccaugucgccucug

SEQ ID NO: 3494176 - RNA, 13 nt, Human
ccuuccauuccac

SEQ ID NO: 3494177 - RNA, 10 nt, Human
ccuucccaaa

SEQ ID NO: 3494178 - RNA, 18 nt, Human
ccuucccaaaggacucca

SEQ ID NO: 3494179 - RNA, 23 nt, Human
ccuucccaagugagucucucugg

SEQ ID NO: 3494180 - RNA, 16 nt, Human
ccuggcugcccuggcc

SEQ ID NO: 3494181 - RNA, 17 nt, Human
ccuggcugcccuggccc

SEQ ID NO: 3494182 - RNA, 19 nt, Human
ccuggcugcccuggcccug

SEQ ID NO: 3494183 - RNA, 13 nt, Human
ccuggcugcugcc

SEQ ID NO: 3494184 - RNA, 15 nt, Human
ccuggcugcugcccc

SEQ ID NO: 3494185 - RNA, 21 nt, Human
ccuggcugcugcccccacccc

SEQ ID NO: 3494186 - RNA, 17 nt, Human
ccuggcuggcugagggc

SEQ ID NO: 3494187 - RNA, 20 nt, Human
ccuggcuggcugagggcagu

SEQ ID NO: 3494188 - RNA, 21 nt, Human
ccuggcugggacguggcucag

SEQ ID NO: 3494189 - RNA, 22 nt, Human
ccuggcugggacguggcucagc

SEQ ID NO: 3494190 - RNA, 21 nt, Human
ccuggcuguucugugguuccu

SEQ ID NO: 3494191 - RNA, 22 nt, Human
cauggcugccaaugggagcuca

SEQ ID NO: 3494192 - RNA, 23 nt, Human
cauggcugggaacugcagaccug

SEQ ID NO: 3494193 - RNA, 17 nt, Human
cauggcuuaauguuuau

SEQ ID NO: 3494194 - RNA, 16 nt, Human
cauggcuuccuccucc

SEQ ID NO: 3494195 - RNA, 18 nt, Human
cauggcuuccuccucccu

SEQ ID NO: 3494196 - RNA, 15 nt, Human
cauggcuuccuccug

SEQ ID NO: 3494197 - RNA, 13 nt, Human
cauggcuucugaa

SEQ ID NO: 3494198 - RNA, 19 nt, Human
cauggcuucugaaccuguc

SEQ ID NO: 3494199 - RNA, 22 nt, Human
cauggcuucugaaccugucuuu

SEQ ID NO: 3494200 - RNA, 15 nt, Human
cauggcuugccacag

SEQ ID NO: 3494201 - RNA, 19 nt, Human
cauggcuugccacagcucu

SEQ ID NO: 3494202 - RNA, 22 nt, Human
cauggcuuucagaaaacgggaa

SEQ ID NO: 3494203 - RNA, 18 nt, Human
caugggaaagccaccucu

SEQ ID NO: 3494204 - RNA, 13 nt, Human
caugggaaaggag

SEQ ID NO: 3494205 - RNA, 22 nt, Human
caugggaaaggaggcaugccuc

SEQ ID NO: 3494206 - RNA, 18 nt, Human
caugggaaaggggaaguu

SEQ ID NO: 3494207 - RNA, 18 nt, Human
caugggaaaguauucucu

SEQ ID NO: 3494208 - RNA, 15 nt, Human
caugggaaugaaugu

SEQ ID NO: 3494209 - RNA, 16 nt, Human
caugggaaugaauguc

SEQ ID NO: 3494210 - RNA, 19 nt, Human
caugggaggccuuucccua

SEQ ID NO: 3494211 - RNA, 14 nt, Human
caugggaggcucac

SEQ ID NO: 3494212 - RNA, 20 nt, Human
caugggagggagcugagaag

SEQ ID NO: 3494213 - RNA, 18 nt, Human
caugggauacaaccuccc

SEQ ID NO: 3494214 - RNA, 21 nt, Human
caugggauacaaccucccucu

SEQ ID NO: 3494215 - RNA, 16 nt, Human
caugggcacugcuggg

SEQ ID NO: 3494216 - RNA, 17 nt, Human
caugggcccaggaaugc

SEQ ID NO: 3494217 - RNA, 16 nt, Human
caugggccccucugac

SEQ ID NO: 3494218 - RNA, 19 nt, Human
caugggccccucugacucc

SEQ ID NO: 3494219 - RNA, 15 nt, Human
caugggccuccugug

SEQ ID NO: 3494220 - RNA, 16 nt, Human
caugggccuccugugu

SEQ ID NO: 3494221 - RNA, 13 nt, Human
caugggccuggcc

SEQ ID NO: 3494222 - RNA, 13 nt, Human
caugggcucugac

SEQ ID NO: 3494223 - RNA, 13 nt, Human
caugggcucuuca

SEQ ID NO: 3494224 - RNA, 13 nt, Human
caugggcuucacu

SEQ ID NO: 3494225 - RNA, 14 nt, Human
caugggcuucacug

SEQ ID NO: 3494226 - RNA, 23 nt, Human
caugggcuucacuguauaaauag

SEQ ID NO: 3494227 - RNA, 18 nt, Human
cauggggaaaaaaaucau

SEQ ID NO: 3494228 - RNA, 20 nt, Human
cauggggaaaaaaaucaucu

SEQ ID NO: 3494229 - RNA, 21 nt, Human
cauggggaaaaaaaucaucua

SEQ ID NO: 3494230 - RNA, 18 nt, Human
cauggggaggaggagggu

SEQ ID NO: 3494231 - RNA, 23 nt, Human
cauggggagggauucugguucca

SEQ ID NO: 3494232 - RNA, 19 nt, Human
caugggggagggggcagaa

SEQ ID NO: 3494233 - RNA, 19 nt, Human
caugggggcagggcaugac

SEQ ID NO: 3494234 - RNA, 23 nt, Human
cauggggggagcacccugagggc

SEQ ID NO: 3494235 - RNA, 20 nt, Human
cauggggguauuauccauuc

SEQ ID NO: 3494236 - RNA, 15 nt, Human
caugggguaggagga

SEQ ID NO: 3494237 - RNA, 20 nt, Human
caugggguuggcugggccca

SEQ ID NO: 3494238 - RNA, 16 nt, Human
cauggguagccugggu

SEQ ID NO: 3494239 - RNA, 16 nt, Human
caugggucagugccca

SEQ ID NO: 3494240 - RNA, 19 nt, Human
caugggucgcccaugagag

SEQ ID NO: 3494241 - RNA, 19 nt, Human
caugggugaagggagagcc

SEQ ID NO: 3494242 - RNA, 22 nt, Human
caugggugaagggagagccagc

SEQ ID NO: 3494243 - RNA, 23 nt, Human
caugggugaagggagagccagcu

SEQ ID NO: 3494244 - RNA, 23 nt, Human
cauggguuauguguaugugccau

SEQ ID NO: 3494245 - RNA, 21 nt, Human
cauggguuuuguagguacuuu

SEQ ID NO: 3494246 - RNA, 15 nt, Human
caugguaccagcccu

SEQ ID NO: 3494247 - RNA, 16 nt, Human
caugguaccagcccug

SEQ ID NO: 3494248 - RNA, 17 nt, Human
cauggucaacccucagg

SEQ ID NO: 3494249 - RNA, 14 nt, Human
cauggucacacacu

SEQ ID NO: 3494250 - RNA, 17 nt, Human
cauggucacacacugau

SEQ ID NO: 3494251 - RNA, 21 nt, Human
cauggucacacacugaugcuu

SEQ ID NO: 3494252 - RNA, 14 nt, Human
cauggucacagaga

SEQ ID NO: 3494253 - RNA, 14 nt, Human
caugguccauucuc

SEQ ID NO: 3494254 - RNA, 16 nt, Human
cauggucccacauccc

SEQ ID NO: 3494255 - RNA, 18 nt, Human
cauggucccacaucccug

SEQ ID NO: 3494256 - RNA, 21 nt, Human
cauggucccacaucccugggc

SEQ ID NO: 3494257 - RNA, 16 nt, Human
cauggucugcccucug

SEQ ID NO: 3494258 - RNA, 16 nt, Human
cauggugaauuaauca

SEQ ID NO: 3494259 - RNA, 15 nt, Human
cauggugcugggaga

SEQ ID NO: 3494260 - RNA, 22 nt, Human
cauggugcugggagaggcagcc

SEQ ID NO: 3494261 - RNA, 12 nt, Human
caugguggcgca

SEQ ID NO: 3494262 - RNA, 20 nt, Human
caugguggcgcaagccugua

SEQ ID NO: 3494263 - RNA, 23 nt, Human
caugguggggucuccucaggacc

SEQ ID NO: 3494264 - RNA, 19 nt, Human
caugguggguucaggggac

SEQ ID NO: 3494265 - RNA, 15 nt, Human
caugguguaauaaga

SEQ ID NO: 3494266 - RNA, 16 nt, Human
caugguguaauaagac

SEQ ID NO: 3494267 - RNA, 22 nt, Human
cauggugugaaagucagaugcc

SEQ ID NO: 3494268 - RNA, 14 nt, Human
caugguguguuaca

SEQ ID NO: 3494269 - RNA, 13 nt, Human
caugguuaagagu

SEQ ID NO: 3494270 - RNA, 19 nt, Human
caugguuaagaguccaaga

SEQ ID NO: 3494271 - RNA, 16 nt, Human
caugguuugacucugg

SEQ ID NO: 3494272 - RNA, 16 nt, Human
caugguuuggagcuga

SEQ ID NO: 3494273 - RNA, 19 nt, Human
caugguuuugugccaucug

SEQ ID NO: 3494274 - RNA, 13 nt, Human
cauguaaaacaaa

SEQ ID NO: 3494275 - RNA, 15 nt, Human
cauguaaaacaaaaa

SEQ ID NO: 3494276 - RNA, 18 nt, Human
cauguaaaacaaaaaaca

SEQ ID NO: 3494277 - RNA, 19 nt, Human
cauguaaaacaaaaaacaa

SEQ ID NO: 3494278 - RNA, 15 nt, Human
cauguaaaacagaaa

SEQ ID NO: 3494279 - RNA, 18 nt, Human
cauguaaacaaaauuuag

SEQ ID NO: 3494280 - RNA, 15 nt, Human
cauguaaacugugca

SEQ ID NO: 3494281 - RNA, 16 nt, Human
cauguaaacugugcac

SEQ ID NO: 3494282 - RNA, 21 nt, Human
cauguaaagaaaugucuuaau

SEQ ID NO: 3494283 - RNA, 17 nt, Human
cauguaaagugucagaa

SEQ ID NO: 3494284 - RNA, 21 nt, Human
cauguaaauccccacugggac

SEQ ID NO: 3494285 - RNA, 16 nt, Human
cauguaaauuaccagu

SEQ ID NO: 3494286 - RNA, 15 nt, Human
cauguaacagaaagg

SEQ ID NO: 3494287 - RNA, 19 nt, Human
cauguaacgaaacacuuca

SEQ ID NO: 3494288 - RNA, 19 nt, Human
cauguaacgcaaguuccca

SEQ ID NO: 3494289 - RNA, 20 nt, Human
cauguaacgcaaguucccag

SEQ ID NO: 3494290 - RNA, 15 nt, Human
cauguaacugccuag

SEQ ID NO: 3494291 - RNA, 16 nt, Human
cauguaacugccuaga

SEQ ID NO: 3494292 - RNA, 20 nt, Human
cauguaacugccuagaaaca

SEQ ID NO: 3494293 - RNA, 18 nt, Human
cauguaagcugaaaauau

SEQ ID NO: 3494294 - RNA, 21 nt, Human
cauguaauaaaaaguauaugu

SEQ ID NO: 3494295 - RNA, 21 nt, Human
cauguaauuaaguacuaugua

SEQ ID NO: 3494296 - RNA, 23 nt, Human
cauguacaaaaucgauuggcuuu

SEQ ID NO: 3494297 - RNA, 13 nt, Human
cauguacagagaa

SEQ ID NO: 3494298 - RNA, 15 nt, Human
cauguacaguguucu

SEQ ID NO: 3494299 - RNA, 15 nt, Human
cauguacaugaagaa

SEQ ID NO: 3494300 - RNA, 17 nt, Human
cauguacauuuggaacu

SEQ ID NO: 3494301 - RNA, 13 nt, Human
cauguaccccaau

SEQ ID NO: 3494302 - RNA, 19 nt, Human
cauguaccuccccugccuu

SEQ ID NO: 3494303 - RNA, 20 nt, Human
cauguaccuccccugccuug

SEQ ID NO: 3494304 - RNA, 15 nt, Human
cauguacuaucuuau

SEQ ID NO: 3494305 - RNA, 21 nt, Human
cauguacuaucuuaucucaga

SEQ ID NO: 3494306 - RNA, 23 nt, Human
cauguacugagccuuguaauucu

SEQ ID NO: 3494307 - RNA, 15 nt, Human
cauguacugcauuau

SEQ ID NO: 3494308 - RNA, 16 nt, Human
cauguacugcauuauu

SEQ ID NO: 3494309 - RNA, 22 nt, Human
cauguacugcauuauuugagaa

SEQ ID NO: 3494310 - RNA, 23 nt, Human
cauguacugcauuauuugagaag

SEQ ID NO: 3494311 - RNA, 12 nt, Human
cauguagagaaa

SEQ ID NO: 3494312 - RNA, 16 nt, Human
cauguagagaaaagca

SEQ ID NO: 3494313 - RNA, 23 nt, Human
cauguagcaaucagauuuuccug

SEQ ID NO: 3494314 - RNA, 20 nt, Human
cauguagcaggacugaauug

SEQ ID NO: 3494315 - RNA, 15 nt, Human
cauguagcagugagu

SEQ ID NO: 3494316 - RNA, 19 nt, Human
cauguagcagugagucaua

SEQ ID NO: 3494317 - RNA, 20 nt, Human
cauguagcccccuggccucu

SEQ ID NO: 3494318 - RNA, 21 nt, Human
cauguagcccccuggccucug

SEQ ID NO: 3494319 - RNA, 22 nt, Human
cauguagcccccuggccucugu

SEQ ID NO: 3494320 - RNA, 14 nt, Human
cauguagcugaguu

SEQ ID NO: 3494321 - RNA, 16 nt, Human
cauguaguaacacuaa

SEQ ID NO: 3494322 - RNA, 20 nt, Human
cauguaguaucaaauauuag

SEQ ID NO: 3494323 - RNA, 17 nt, Human
cauguauaguugcuuuu

SEQ ID NO: 3494324 - RNA, 15 nt, Human
cauguaucauaauua

SEQ ID NO: 3494325 - RNA, 21 nt, Human
cauguaucccaacuccuauaa

SEQ ID NO: 3494326 - RNA, 23 nt, Human
cauguaucuaugcauuuucugga

SEQ ID NO: 3494327 - RNA, 22 nt, Human
cauguaugucagaagugcagaa

SEQ ID NO: 3494328 - RNA, 17 nt, Human
cauguaugucuuggaca

SEQ ID NO: 3494329 - RNA, 15 nt, Human
cauguauuauuucau

SEQ ID NO: 3494330 - RNA, 15 nt, Human
cauguauugugucuu

SEQ ID NO: 3494331 - RNA, 21 nt, Human
cauguauugugucuuuugcau

SEQ ID NO: 3494332 - RNA, 15 nt, Human
cauguauuuaucucu

SEQ ID NO: 3494333 - RNA, 23 nt, Human
cauguauuuaucucuauuuaaua

SEQ ID NO: 3494334 - RNA, 13 nt, Human
cucagauggcagc

SEQ ID NO: 3494335 - RNA, 16 nt, Human
cucagauggcagcuuu

SEQ ID NO: 3494336 - RNA, 17 nt, Human
cucagauggcagcuuuu

SEQ ID NO: 3494337 - RNA, 21 nt, Human
cucagauggcagcuuuuaaaa

SEQ ID NO: 3494338 - RNA, 17 nt, Human
cucagauuauuuuuccu

SEQ ID NO: 3494339 - RNA, 16 nt, Human
cucagauuccuuccca

SEQ ID NO: 3494340 - RNA, 17 nt, Human
cucagauuccuucccau

SEQ ID NO: 3494341 - RNA, 24 nt, Human
cucagauuccuucccauggaggga

SEQ ID NO: 3494342 - RNA, 17 nt, Human
cucagauuucugaggaa

SEQ ID NO: 3494343 - RNA, 17 nt, Human
cucagauuuuauuaugu

SEQ ID NO: 3494344 - RNA, 18 nt, Human
cucagauuuuauuaugua

SEQ ID NO: 3494345 - RNA, 15 nt, Human
cucagcaaccuguaa

SEQ ID NO: 3494346 - RNA, 18 nt, Human
cucagcaaggccaccucu

SEQ ID NO: 3494347 - RNA, 21 nt, Human
cucagcaaggccaccucuucc

SEQ ID NO: 3494348 - RNA, 14 nt, Human
cucagcacaaggcc

SEQ ID NO: 3494349 - RNA, 20 nt, Human
cucagcacaaggccaucugg

SEQ ID NO: 3494350 - RNA, 16 nt, Human
cucagcaccacucaag

SEQ ID NO: 3494351 - RNA, 17 nt, Human
cucagcaccacucaaga

SEQ ID NO: 3494352 - RNA, 18 nt, Human
cucagcacccccuucucu

SEQ ID NO: 3494353 - RNA, 15 nt, Human
cucagcaccccuucc

SEQ ID NO: 3494354 - RNA, 17 nt, Human
cucagcaccccuuccau

SEQ ID NO: 3494355 - RNA, 15 nt, Human
cucagcacugccugc

SEQ ID NO: 3494356 - RNA, 19 nt, Human
cucagcacugccugcuccc

SEQ ID NO: 3494357 - RNA, 12 nt, Human
cucagcacuugg

SEQ ID NO: 3494358 - RNA, 13 nt, Human
cucagcacuuggc

SEQ ID NO: 3494359 - RNA, 15 nt, Human
cucagcacuuggccc

SEQ ID NO: 3494360 - RNA, 17 nt, Human
cucagcagcccuccuca

SEQ ID NO: 3494361 - RNA, 18 nt, Human
cucagcagcgaccacccc

SEQ ID NO: 3494362 - RNA, 21 nt, Human
cucagcagcgaccaccccugc

SEQ ID NO: 3494363 - RNA, 12 nt, Human
cucagcauaccu

SEQ ID NO: 3494364 - RNA, 16 nt, Human
cucagcauauuuguau

SEQ ID NO: 3494365 - RNA, 18 nt, Human
cucagcauauuuguauag

SEQ ID NO: 3494366 - RNA, 20 nt, Human
cucagcaucaaaauauuuca

SEQ ID NO: 3494367 - RNA, 13 nt, Human
cucagcauccugg

SEQ ID NO: 3494368 - RNA, 21 nt, Human
cucagcauccuggcacccggc

SEQ ID NO: 3494369 - RNA, 20 nt, Human
cucagccaagcacaguggug

SEQ ID NO: 3494370 - RNA, 23 nt, Human
cucagccaagcacagugguggca

SEQ ID NO: 3494371 - RNA, 13 nt, Human
cucagccaagcuu

SEQ ID NO: 3494372 - RNA, 18 nt, Human
cucagccacccugaguug

SEQ ID NO: 3494373 - RNA, 16 nt, Human
cucagccagccccauc

SEQ ID NO: 3494374 - RNA, 11 nt, Human
cucagcccacc

SEQ ID NO: 3494375 - RNA, 17 nt, Human
cucagcccaccccccuc

SEQ ID NO: 3494376 - RNA, 18 nt, Human
cucagccccagcccagcc

SEQ ID NO: 3494377 - RNA, 19 nt, Human
cucagccccucuugccccc

SEQ ID NO: 3494378 - RNA, 20 nt, Human
cucagccccugauccuguga

SEQ ID NO: 3494379 - RNA, 18 nt, Human
cucagcccucacacaccc

SEQ ID NO: 3494380 - RNA, 21 nt, Human
cucagcccucccugccccucc

SEQ ID NO: 3494381 - RNA, 18 nt, Human
cucagcccugacuggugc

SEQ ID NO: 3494382 - RNA, 12 nt, Human
cucagcccugag

SEQ ID NO: 3494383 - RNA, 13 nt, Human
cucagcccugagg

SEQ ID NO: 3494384 - RNA, 16 nt, Human
cucagcccugaggaca

SEQ ID NO: 3494385 - RNA, 15 nt, Human
cucagcccugaggug

SEQ ID NO: 3494386 - RNA, 20 nt, Human
cucagcccugcaccaugcug

SEQ ID NO: 3494387 - RNA, 14 nt, Human
cucagcccuggagg

SEQ ID NO: 3494388 - RNA, 19 nt, Human
cucagcccuggaggugcca

SEQ ID NO: 3494389 - RNA, 15 nt, Human
cucagcccugggccc

SEQ ID NO: 3494390 - RNA, 19 nt, Human
cucagccucccgaauagcu

SEQ ID NO: 3494391 - RNA, 21 nt, Human
cucagccucccgaauagcugg

SEQ ID NO: 3494392 - RNA, 22 nt, Human
cucagccucccgaauagcuggg

SEQ ID NO: 3494393 - RNA, 17 nt, Human
cucagccuccucaucug

SEQ ID NO: 3494394 - RNA, 13 nt, Human
cucagccuccuga

SEQ ID NO: 3494395 - RNA, 14 nt, Human
cucagccuccugag

SEQ ID NO: 3494396 - RNA, 22 nt, Human
cucagccuccugaguagcugga

SEQ ID NO: 3494397 - RNA, 15 nt, Human
cucagccuccugugu

SEQ ID NO: 3494398 - RNA, 21 nt, Human
cucagccucuccccugccugc

SEQ ID NO: 3494399 - RNA, 19 nt, Human
cucagccugaaccccaggg

SEQ ID NO: 3494400 - RNA, 11 nt, Human
cucagccugca

SEQ ID NO: 3494401 - RNA, 16 nt, Human
cucagccugcugccca

SEQ ID NO: 3494402 - RNA, 19 nt, Human
cucagccugcugcccaggc

SEQ ID NO: 3494403 - RNA, 15 nt, Human
cucagccugggcgcu

SEQ ID NO: 3494404 - RNA, 21 nt, Human
cucagccugggcgcugguccu

SEQ ID NO: 3494405 - RNA, 12 nt, Human
cucagccuggug

SEQ ID NO: 3494406 - RNA, 16 nt, Human
cucagccuuacauuug

SEQ ID NO: 3494407 - RNA, 16 nt, Human
cucagccuucagacag

SEQ ID NO: 3494408 - RNA, 17 nt, Human
cucagccuucagacaga

SEQ ID NO: 3494409 - RNA, 19 nt, Human
cucagccuucagacagaga

SEQ ID NO: 3494410 - RNA, 19 nt, Human
cucagccuugccagagauc

SEQ ID NO: 3494411 - RNA, 15 nt, Human
cucagccuuggauaa

SEQ ID NO: 3494412 - RNA, 15 nt, Human
cucagcggggacagc

SEQ ID NO: 3494413 - RNA, 16 nt, Human
cucagcggggacagcu

SEQ ID NO: 3494414 - RNA, 23 nt, Human
cucagcguuuuuuuguuuuuaau

SEQ ID NO: 3494415 - RNA, 21 nt, Human
cucagcuacccacuauccuuc

SEQ ID NO: 3494416 - RNA, 13 nt, Human
cucagcucagcgc

SEQ ID NO: 3494417 - RNA, 15 nt, Human
cucagcucagcgcca

SEQ ID NO: 3494418 - RNA, 15 nt, Human
cucagcucccaaggc

SEQ ID NO: 3494419 - RNA, 13 nt, Human
cucagcucccaca

SEQ ID NO: 3494420 - RNA, 20 nt, Human
cucagcucccacaagccucu

SEQ ID NO: 3494421 - RNA, 22 nt, Human
cucagcucccacaagccucugc

SEQ ID NO: 3494422 - RNA, 17 nt, Human
cucagcucccauuucua

SEQ ID NO: 3494423 - RNA, 14 nt, Human
cucagcuccccaga

SEQ ID NO: 3494424 - RNA, 12 nt, Human
cucagcuccccc

SEQ ID NO: 3494425 - RNA, 17 nt, Human
cucagcucccccugucc

SEQ ID NO: 3494426 - RNA, 15 nt, Human
cucagcucggcucag

SEQ ID NO: 3494427 - RNA, 19 nt, Human
cuaugcauggugccccagg

SEQ ID NO: 3494428 - RNA, 15 nt, Human
cuaugcaugguuuca

SEQ ID NO: 3494429 - RNA, 21 nt, Human
cuaugcaugguuucagcacua

SEQ ID NO: 3494430 - RNA, 12 nt, Human
cuaugcauuuga

SEQ ID NO: 3494431 - RNA, 14 nt, Human
cuaugcauuugaaa

SEQ ID NO: 3494432 - RNA, 15 nt, Human
cuaugccaaagauca

SEQ ID NO: 3494433 - RNA, 22 nt, Human
cuaugccaaagaucacuuguug

SEQ ID NO: 3494434 - RNA, 19 nt, Human
cuaugccagcucaguccca

SEQ ID NO: 3494435 - RNA, 16 nt, Human
cuaugccucucuacag

SEQ ID NO: 3494436 - RNA, 19 nt, Human
cuaugcuauugacaauaaa

SEQ ID NO: 3494437 - RNA, 20 nt, Human
cuaugcuauugacaauaaaa

SEQ ID NO: 3494438 - RNA, 21 nt, Human
cuaugcuauugacaauaaaau

SEQ ID NO: 3494439 - RNA, 18 nt, Human
cuaugcugaguuugugcu

SEQ ID NO: 3494440 - RNA, 15 nt, Human
cuaugcugcuuuuau

SEQ ID NO: 3494441 - RNA, 15 nt, Human
cuaugcuguaucugu

SEQ ID NO: 3494442 - RNA, 17 nt, Human
cuauggaagcauauugu

SEQ ID NO: 3494443 - RNA, 14 nt, Human
cuauggacacaggg

SEQ ID NO: 3494444 - RNA, 19 nt, Human
cuauggagagcccugggac

SEQ ID NO: 3494445 - RNA, 21 nt, Human
cuauggagagcccugggaccg

SEQ ID NO: 3494446 - RNA, 10 nt, Human
cuauggaugu

SEQ ID NO: 3494447 - RNA, 23 nt, Human
cuauggcagaaaaaaugucugua

SEQ ID NO: 3494448 - RNA, 13 nt, Human
cuauggccugugg

SEQ ID NO: 3494449 - RNA, 17 nt, Human
cuauggcugaguucugg

SEQ ID NO: 3494450 - RNA, 23 nt, Human
cuaugggagagugucaaccagac

SEQ ID NO: 3494451 - RNA, 17 nt, Human
cuaugggagccccaggg

SEQ ID NO: 3494452 - RNA, 19 nt, Human
cuaugggagccccaggguc

SEQ ID NO: 3494453 - RNA, 23 nt, Human
cuauggggaagguuaucagugcu

SEQ ID NO: 3494454 - RNA, 15 nt, Human
cuauggggauggucc

SEQ ID NO: 3494455 - RNA, 18 nt, Human
cuauggggaugguccacu

SEQ ID NO: 3494456 - RNA, 19 nt, Human
cuaugggucuaggacacag

SEQ ID NO: 3494457 - RNA, 12 nt, Human
cuauggucaucu

SEQ ID NO: 3494458 - RNA, 17 nt, Human
cuauggucgggagacag

SEQ ID NO: 3494459 - RNA, 20 nt, Human
cuauggugagaugcagcugg

SEQ ID NO: 3494460 - RNA, 21 nt, Human
cuauggugagaugcagcugga

SEQ ID NO: 3494461 - RNA, 14 nt, Human
cuauggugccaaug

SEQ ID NO: 3494462 - RNA, 22 nt, Human
cuauguaaaugcaucuguccuc

SEQ ID NO: 3494463 - RNA, 16 nt, Human
cuauguacaauauuuu

SEQ ID NO: 3494464 - RNA, 19 nt, Human
cuauguacaauauuuuaag

SEQ ID NO: 3494465 - RNA, 17 nt, Human
cuauguacuaguacugu

SEQ ID NO: 3494466 - RNA, 18 nt, Human
cuauguacuaguacugug

SEQ ID NO: 3494467 - RNA, 19 nt, Human
cuauguacuaguacugugu

SEQ ID NO: 3494468 - RNA, 15 nt, Human
cuauguaggaaaaaa

SEQ ID NO: 3494469 - RNA, 20 nt, Human
cuauguaguccgugcugaca

SEQ ID NO: 3494470 - RNA, 18 nt, Human
cuauguagugccgcucuu

SEQ ID NO: 3494471 - RNA, 19 nt, Human
cuauguaucaaugaguaac

SEQ ID NO: 3494472 - RNA, 22 nt, Human
cuauguauggaauacaguguua

SEQ ID NO: 3494473 - RNA, 22 nt, Human
cuauguauuugcaguucaccug

SEQ ID NO: 3494474 - RNA, 14 nt, Human
cuaugucauuucau

SEQ ID NO: 3494475 - RNA, 16 nt, Human
cuaugucauuucauuu

SEQ ID NO: 3494476 - RNA, 23 nt, Human
cuaugucauuugcuggagcucug

SEQ ID NO: 3494477 - RNA, 13 nt, Human
cuaugucccuugc

SEQ ID NO: 3494478 - RNA, 22 nt, Human
cuauguccuaaggacacacuaa

SEQ ID NO: 3494479 - RNA, 16 nt, Human
cuauuugauguaauac

SEQ ID NO: 3494480 - RNA, 19 nt, Human
cuauuugauguaauacuuc

SEQ ID NO: 3494481 - RNA, 23 nt, Human
cuauuugccaugggcuucacugu

SEQ ID NO: 3494482 - RNA, 12 nt, Human
cuauuuggaauu

SEQ ID NO: 3494483 - RNA, 16 nt, Human
cuauuuggaauuuaua

SEQ ID NO: 3494484 - RNA, 14 nt, Human
cuauuuguaaaucu

SEQ ID NO: 3494485 - RNA, 19 nt, Human
cuauuuguaaaucugccac

SEQ ID NO: 3494486 - RNA, 17 nt, Human
cuauuugucuuucagga

SEQ ID NO: 3494487 - RNA, 13 nt, Human
cuauuuuaaaaua

SEQ ID NO: 3494488 - RNA, 11 nt, Human
cuauuuuaaga

SEQ ID NO: 3494489 - RNA, 22 nt, Human
cuauuuuaauaaacacucuuga

SEQ ID NO: 3494490 - RNA, 14 nt, Human
cuauuuuaaucuug

SEQ ID NO: 3494491 - RNA, 16 nt, Human
cuauuuuauuaugaag

SEQ ID NO: 3494492 - RNA, 12 nt, Human
cuauuuuauucc

SEQ ID NO: 3494493 - RNA, 23 nt, Human
cuauuuuauucuaaacagacuca

SEQ ID NO: 3494494 - RNA, 18 nt, Human
cuauuuucagaaucugaa

SEQ ID NO: 3494495 - RNA, 22 nt, Human
cuauuuucucugauacuuuuuu

SEQ ID NO: 3494496 - RNA, 17 nt, Human
cuauuuuuaaauaauuu

SEQ ID NO: 3494497 - RNA, 16 nt, Human
cuauuuuuacugccac

SEQ ID NO: 3494498 - RNA, 19 nt, Human
cuauuuuuacugccacucu

SEQ ID NO: 3494499 - RNA, 16 nt, Human
cuauuuuuauuuauau

SEQ ID NO: 3494500 - RNA, 18 nt, Human
cuauuuuuauuuauauuu

SEQ ID NO: 3494501 - RNA, 14 nt, Human
cuauuuuucccccu

SEQ ID NO: 3494502 - RNA, 22 nt, Human
cuauuuuugacauggaaaugaa

SEQ ID NO: 3494503 - RNA, 13 nt, Human
cuauuuuuggagg

SEQ ID NO: 3494504 - RNA, 14 nt, Human
cuauuuuuguaaag

SEQ ID NO: 3494505 - RNA, 20 nt, Human
cuauuuuuuauuuuacuuuu

SEQ ID NO: 3494506 - RNA, 19 nt, Human
cuauuuuuuuaaaaucacu

SEQ ID NO: 3494507 - RNA, 13 nt, Human
cuauuuuuuuaga

SEQ ID NO: 3494508 - RNA, 17 nt, Human
cuauuuuuuuagauuga

SEQ ID NO: 3494509 - RNA, 22 nt, Human
cuauuuuuuuagauugagaaau

SEQ ID NO: 3494510 - RNA, 21 nt, Human
cuauuuuuuuucuguuauaua

SEQ ID NO: 3494511 - RNA, 19 nt, Human
cucaaaaagcugccuggga

SEQ ID NO: 3494512 - RNA, 13 nt, Human
cucaaaacugcac

SEQ ID NO: 3494513 - RNA, 19 nt, Human
cucaaaagaacuuaccccc

SEQ ID NO: 3494514 - RNA, 20 nt, Human
cucaaaagagaaaaacaaaa

SEQ ID NO: 3494515 - RNA, 18 nt, Human
cucaaaauauuuguacau

SEQ ID NO: 3494516 - RNA, 16 nt, Human
cucaaacaacacuggu

SEQ ID NO: 3494517 - RNA, 17 nt, Human
cucaaacaacacuggug

SEQ ID NO: 3494518 - RNA, 13 nt, Human
cucaaacaaugac

SEQ ID NO: 3494519 - RNA, 21 nt, Human
cucaaacaaugacaaagcaga

SEQ ID NO: 3494520 - RNA, 15 nt, Human
cucaaacacaguuac

SEQ ID NO: 3494521 - RNA, 12 nt, Human
cucaaacacugc

SEQ ID NO: 3494522 - RNA, 13 nt, Human
cucaaacacugca

SEQ ID NO: 3494523 - RNA, 16 nt, Human
cucaaacacugcaggc

SEQ ID NO: 3494524 - RNA, 18 nt, Human
cucaaacacugcaggcau

SEQ ID NO: 3494525 - RNA, 12 nt, Human
cucaaaccccug

SEQ ID NO: 3494526 - RNA, 18 nt, Human
cucaaaccuccaaaagcc

SEQ ID NO: 3494527 - RNA, 15 nt, Human
cucaaaccuccucuu

SEQ ID NO: 3494528 - RNA, 22 nt, Human
cucaaacuaaaagacauuuguu

SEQ ID NO: 3494529 - RNA, 20 nt, Human
cucaaacucuugaccucagg

SEQ ID NO: 3494530 - RNA, 14 nt, Human
cucaaacuucuggc

SEQ ID NO: 3494531 - RNA, 20 nt, Human
cucaaacuuuuccccugucc

SEQ ID NO: 3494532 - RNA, 14 nt, Human
cucaaagaggcagu

SEQ ID NO: 3494533 - RNA, 19 nt, Human
cucaaagcaagcauucaga

SEQ ID NO: 3494534 - RNA, 20 nt, Human
cucaaagcaugggauuauua

SEQ ID NO: 3494535 - RNA, 22 nt, Human
cucaaagccccauuaacugcuu

SEQ ID NO: 3494536 - RNA, 13 nt, Human
cucaaaggccaga

SEQ ID NO: 3494537 - RNA, 22 nt, Human
cucaaaggccagaccugcagac

SEQ ID NO: 3494538 - RNA, 22 nt, Human
cucaaagguuuggaaggagcag

SEQ ID NO: 3494539 - RNA, 13 nt, Human
cucaaagucugca

SEQ ID NO: 3494540 - RNA, 18 nt, Human
cucaaaguuuugaaaagc

SEQ ID NO: 3494541 - RNA, 19 nt, Human
cucaaauaaaaagugcuuu

SEQ ID NO: 3494542 - RNA, 13 nt, Human
cucaaauaaaaua

SEQ ID NO: 3494543 - RNA, 23 nt, Human
cucaaauacgugggcauucaaau

SEQ ID NO: 3494544 - RNA, 20 nt, Human
cucaaaugaguaacauuugc

SEQ ID NO: 3494545 - RNA, 21 nt, Human
cucaaaugaguaacauuugcu

SEQ ID NO: 3494546 - RNA, 20 nt, Human
cucaaaugaugugccugcuu

SEQ ID NO: 3494547 - RNA, 16 nt, Human
cucaaaugcucagacc

SEQ ID NO: 3494548 - RNA, 21 nt, Human
cucaaauggggccagauccag

SEQ ID NO: 3494549 - RNA, 21 nt, Human
cucaaauguucuaaguuucua

SEQ ID NO: 3494550 - RNA, 16 nt, Human
cucaaauuaaucuuuc

SEQ ID NO: 3494551 - RNA, 23 nt, Human
cucaaauuaaucuuucuuuaccu

SEQ ID NO: 3494552 - RNA, 13 nt, Human
cucaaauuucuaa

SEQ ID NO: 3494553 - RNA, 17 nt, Human
cucaaauuucuaaaucu

SEQ ID NO: 3494554 - RNA, 13 nt, Human
cucaaauuuuuug

SEQ ID NO: 3494555 - RNA, 15 nt, Human
cucaacaaagcacag

SEQ ID NO: 3494556 - RNA, 20 nt, Human
cucaacaaggcaaaaacaaa

SEQ ID NO: 3494557 - RNA, 22 nt, Human
cucaacaagggagagaccucau

SEQ ID NO: 3494558 - RNA, 23 nt, Human
cucaacaagggagagaccucauc

SEQ ID NO: 3494559 - RNA, 16 nt, Human
cucaacaccaugauuc

SEQ ID NO: 3494560 - RNA, 23 nt, Human
cucaacaccaugauuccuuuaac

SEQ ID NO: 3494561 - RNA, 20 nt, Human
cucaacacccaacugucucg

SEQ ID NO: 3494562 - RNA, 13 nt, Human
cucaacacccagu

SEQ ID NO: 3494563 - RNA, 15 nt, Human
cucaacaggccucag

SEQ ID NO: 3494564 - RNA, 17 nt, Human
cucaacaggccucaggg

SEQ ID NO: 3494565 - RNA, 22 nt, Human
cucaacaggccucagggcuccu

SEQ ID NO: 3494566 - RNA, 20 nt, Human
cucaacauguuacugaccag

SEQ ID NO: 3494567 - RNA, 15 nt, Human
cucaaccauccccuc

SEQ ID NO: 3494568 - RNA, 18 nt, Human
cucaaccccaccacuucu

SEQ ID NO: 3494569 - RNA, 22 nt, Human
cucaacccccauuucuauuuau

SEQ ID NO: 3494570 - RNA, 23 nt, Human
cucaaccccuccccuccaucccu

SEQ ID NO: 3494571 - RNA, 20 nt, Human
cucaaccuaccaccccuucc

SEQ ID NO: 3494572 - RNA, 22 nt, Human
cucaaccuaccaccccuuccug

SEQ ID NO: 3494573 - RNA, 15 nt, Human
cucaaccuccugggc

SEQ ID NO: 3494574 - RNA, 14 nt, Human
cucaaccucuacag

SEQ ID NO: 3494575 - RNA, 13 nt, Human
cucaaccucuucu

SEQ ID NO: 3494576 - RNA, 19 nt, Human
cucaaccuguaaauuauuu

SEQ ID NO: 3494577 - RNA, 16 nt, Human
cucaaccuuaagaccu

SEQ ID NO: 3494578 - RNA, 15 nt, Human
cucaacguauuguuu

SEQ ID NO: 3494579 - RNA, 17 nt, Human
cucaacguuacauuuuu

SEQ ID NO: 3494580 - RNA, 14 nt, Human
cucaacucuccucc

SEQ ID NO: 3494581 - RNA, 18 nt, Human
cucaacucuccuccagag

SEQ ID NO: 3494582 - RNA, 20 nt, Human
cucaacucuccuccagaguc

SEQ ID NO: 3494583 - RNA, 14 nt, Human
cucaacucugcuga

SEQ ID NO: 3494584 - RNA, 13 nt, Human
cucaacugccuac

SEQ ID NO: 3494585 - RNA, 15 nt, Human
cucaacugccuacuc

SEQ ID NO: 3494586 - RNA, 23 nt, Human
cucaacugccuacuccaaaaugu

SEQ ID NO: 3494587 - RNA, 16 nt, Human
cucaacuuucuguugg

SEQ ID NO: 3494588 - RNA, 15 nt, Human
cucaagaaauuccca

SEQ ID NO: 3494589 - RNA, 20 nt, Human
cucaagaagacauggagacu

SEQ ID NO: 3494590 - RNA, 21 nt, Human
cucaagaagacauggagacuc

SEQ ID NO: 3494591 - RNA, 16 nt, Human
ccagucuccaccagga

SEQ ID NO: 3494592 - RNA, 23 nt, Human
ccagucuccaccaggaaccucuu

SEQ ID NO: 3494593 - RNA, 14 nt, Human
ccagucugaaguuu

SEQ ID NO: 3494594 - RNA, 16 nt, Human
ccagucugcugcccuc

SEQ ID NO: 3494595 - RNA, 18 nt, Human
ccagucugggcugccggg

SEQ ID NO: 3494596 - RNA, 12 nt, Human
ccagucugugga

SEQ ID NO: 3494597 - RNA, 21 nt, Human
ccagucuguggaucagagaug

SEQ ID NO: 3494598 - RNA, 16 nt, Human
ccagucuguuccccau

SEQ ID NO: 3494599 - RNA, 18 nt, Human
ccagucuuccaccuggaa

SEQ ID NO: 3494600 - RNA, 17 nt, Human
ccagucuuccugacacu

SEQ ID NO: 3494601 - RNA, 18 nt, Human
ccagucuuuaaaggccca

SEQ ID NO: 3494602 - RNA, 22 nt, Human
ccagucuuuaaaggcccagccc

SEQ ID NO: 3494603 - RNA, 23 nt, Human
ccagucuuuaaaggcccagcccc

SEQ ID NO: 3494604 - RNA, 15 nt, Human
ccagugaagauauuu

SEQ ID NO: 3494605 - RNA, 16 nt, Human
ccagugaauucuugaa

SEQ ID NO: 3494606 - RNA, 12 nt, Human
ccagugaauuuu

SEQ ID NO: 3494607 - RNA, 19 nt, Human
ccagugaauuuuugcaaua

SEQ ID NO: 3494608 - RNA, 20 nt, Human
ccagugaauuuuugcaauaa

SEQ ID NO: 3494609 - RNA, 22 nt, Human
ccagugaauuuuugcaauaaug

SEQ ID NO: 3494610 - RNA, 19 nt, Human
ccagugacacuucagagag

SEQ ID NO: 3494611 - RNA, 18 nt, Human
ccagugacagacaggcuc

SEQ ID NO: 3494612 - RNA, 19 nt, Human
ccagugacagacaggcucu

SEQ ID NO: 3494613 - RNA, 12 nt, Human
ccagugacagcu

SEQ ID NO: 3494614 - RNA, 16 nt, Human
ccagugaccaaccuuu

SEQ ID NO: 3494615 - RNA, 17 nt, Human
ccagugaccccugaccu

SEQ ID NO: 3494616 - RNA, 15 nt, Human
ccagugaccugagga

SEQ ID NO: 3494617 - RNA, 17 nt, Human
ccagugaccugaggaag

SEQ ID NO: 3494618 - RNA, 19 nt, Human
ccagugaccugaggaagcg

SEQ ID NO: 3494619 - RNA, 21 nt, Human
ccagugagaugcauucuuggu

SEQ ID NO: 3494620 - RNA, 20 nt, Human
ccagugagcacucccaaguc

SEQ ID NO: 3494621 - RNA, 14 nt, Human
ccagugaggcucug

SEQ ID NO: 3494622 - RNA, 17 nt, Human
ccagugaggcucugccc

SEQ ID NO: 3494623 - RNA, 23 nt, Human
cucagcuggaugauggucuucag

SEQ ID NO: 3494624 - RNA, 19 nt, Human
cucagcuguccugcagcaa

SEQ ID NO: 3494625 - RNA, 16 nt, Human
cucagcugucuguggc

SEQ ID NO: 3494626 - RNA, 19 nt, Human
cucagcuguucagauugga

SEQ ID NO: 3494627 - RNA, 22 nt, Human
cucagcuguucagauuggacau

SEQ ID NO: 3494628 - RNA, 22 nt, Human
cucagcuuccccaacacgcagg

SEQ ID NO: 3494629 - RNA, 14 nt, Human
cucagcuuccccag

SEQ ID NO: 3494630 - RNA, 18 nt, Human
cucagcuuccccaguagc

SEQ ID NO: 3494631 - RNA, 22 nt, Human
cucagcuuccuacccacaccuc

SEQ ID NO: 3494632 - RNA, 14 nt, Human
cucagcuuucuaag

SEQ ID NO: 3494633 - RNA, 13 nt, Human
cucagcuuugaga

SEQ ID NO: 3494634 - RNA, 22 nt, Human
cucagcuuugagaagccuucag

SEQ ID NO: 3494635 - RNA, 12 nt, Human
cucaggaaaacg

SEQ ID NO: 3494636 - RNA, 17 nt, Human
cucaggaaaacgggacc

SEQ ID NO: 3494637 - RNA, 15 nt, Human
cucaggaaagaauag

SEQ ID NO: 3494638 - RNA, 22 nt, Human
cucaggaaaugcugacccaugg

SEQ ID NO: 3494639 - RNA, 23 nt, Human
cucaggaaaugcugacccauggg

SEQ ID NO: 3494640 - RNA, 18 nt, Human
cucaggaaccgaggcagg

SEQ ID NO: 3494641 - RNA, 11 nt, Human
cuccauccuga

SEQ ID NO: 3494642 - RNA, 13 nt, Human
cuccauccugcug

SEQ ID NO: 3494643 - RNA, 19 nt, Human
cuccauccuuucugccucu

SEQ ID NO: 3494644 - RNA, 17 nt, Human
cuccaucuaaacugccc

SEQ ID NO: 3494645 - RNA, 14 nt, Human
cuccaucucaugua

SEQ ID NO: 3494646 - RNA, 22 nt, Human
cuccaucuccaagaaugcugaa

SEQ ID NO: 3494647 - RNA, 19 nt, Human
cuccaucucucauccucca

SEQ ID NO: 3494648 - RNA, 16 nt, Human
cuccaucuucuuugca

SEQ ID NO: 3494649 - RNA, 21 nt, Human
cuccaugagacacaucuccuc

SEQ ID NO: 3494650 - RNA, 13 nt, Human
cuccaugagcacc

SEQ ID NO: 3494651 - RNA, 18 nt, Human
cuccaugcuccucacugc

SEQ ID NO: 3494652 - RNA, 14 nt, Human
cuccaugcugccuc

SEQ ID NO: 3494653 - RNA, 17 nt, Human
cuccaugcugccuccag

SEQ ID NO: 3494654 - RNA, 21 nt, Human
cuccaugcuuagucacugccu

SEQ ID NO: 3494655 - RNA, 15 nt, Human
cuccauggcccugcc

SEQ ID NO: 3494656 - RNA, 20 nt, Human
cuccauggcccugccaugcu

SEQ ID NO: 3494657 - RNA, 16 nt, Human
cuccauggcuuccucc

SEQ ID NO: 3494658 - RNA, 17 nt, Human
cuccauggcuuccuccu

SEQ ID NO: 3494659 - RNA, 16 nt, Human
cuccauggugccucug

SEQ ID NO: 3494660 - RNA, 15 nt, Human
cuccaugugccucuu

SEQ ID NO: 3494661 - RNA, 21 nt, Human
cuccauguuggucaggcuggu

SEQ ID NO: 3494662 - RNA, 15 nt, Human
cuccauuaaagucug

SEQ ID NO: 3494663 - RNA, 17 nt, Human
cuccauucaauuucagg

SEQ ID NO: 3494664 - RNA, 15 nt, Human
cuccauuccagucuc

SEQ ID NO: 3494665 - RNA, 16 nt, Human
cuccauuccuggagcc

SEQ ID NO: 3494666 - RNA, 21 nt, Human
cuccauuccuggagcccgagg

SEQ ID NO: 3494667 - RNA, 13 nt, Human
cuccauucuauuu

SEQ ID NO: 3494668 - RNA, 17 nt, Human
cuccauugguguugaca

SEQ ID NO: 3494669 - RNA, 13 nt, Human
cuccauuuaauaa

SEQ ID NO: 3494670 - RNA, 22 nt, Human
cucccaaaagcuagaacacugc

SEQ ID NO: 3494671 - RNA, 18 nt, Human
cucccaaacgcccuuucc

SEQ ID NO: 3494672 - RNA, 21 nt, Human
cucccaaagugcugggauuaa

SEQ ID NO: 3494673 - RNA, 15 nt, Human
cucccaaaugagcca

SEQ ID NO: 3494674 - RNA, 14 nt, Human
cucccaacccuggc

SEQ ID NO: 3494675 - RNA, 14 nt, Human
cucccaacucaccc

SEQ ID NO: 3494676 - RNA, 16 nt, Human
cucccaacucacccca

SEQ ID NO: 3494677 - RNA, 23 nt, Human
cucccaagaacagcaggcccacc

SEQ ID NO: 3494678 - RNA, 21 nt, Human
cucccaagacuucauuguccc

SEQ ID NO: 3494679 - RNA, 17 nt, Human
cucccaagcuggcuggg

SEQ ID NO: 3494680 - RNA, 18 nt, Human
cucccaagcuggcugggg

SEQ ID NO: 3494681 - RNA, 18 nt, Human
cucccaaggcugcgucug

SEQ ID NO: 3494682 - RNA, 23 nt, Human
cucccaaggcugcgucuggaggg

SEQ ID NO: 3494683 - RNA, 18 nt, Human
cucccaagggauggugcc

SEQ ID NO: 3494684 - RNA, 21 nt, Human
cucccaagguuggagcccagg

SEQ ID NO: 3494685 - RNA, 15 nt, Human
cucccacaagccucu

SEQ ID NO: 3494686 - RNA, 15 nt, Human
cucccacacucccaa

SEQ ID NO: 3494687 - RNA, 15 nt, Human
cucccacacugcuag

SEQ ID NO: 3494688 - RNA, 23 nt, Human
cucccacagcgcuggccgggacc

SEQ ID NO: 3494689 - RNA, 15 nt, Human
cucccacaggcccuu

SEQ ID NO: 3494690 - RNA, 16 nt, Human
cucccacaggcccuuc

SEQ ID NO: 3494691 - RNA, 21 nt, Human
cucccacaggcccuuccucuc

SEQ ID NO: 3494692 - RNA, 14 nt, Human
cucccaccaggcua

SEQ ID NO: 3494693 - RNA, 12 nt, Human
cucccacccagu

SEQ ID NO: 3494694 - RNA, 12 nt, Human
cucccaccccac

SEQ ID NO: 3494695 - RNA, 22 nt, Human
cucccaccccacccccuucagu

SEQ ID NO: 3494696 - RNA, 14 nt, Human
cucccacccccagc

SEQ ID NO: 3494697 - RNA, 15 nt, Human
cucccacccccaucu

SEQ ID NO: 3494698 - RNA, 22 nt, Human
cucccacccccaucucucccuc

SEQ ID NO: 3494699 - RNA, 15 nt, Human
cucccacccgaugcu

SEQ ID NO: 3494700 - RNA, 21 nt, Human
cucccacccgaugcugcuuuc

SEQ ID NO: 3494701 - RNA, 23 nt, Human
cucccacccgaugcugcuuuccc

SEQ ID NO: 3494702 - RNA, 14 nt, Human
cucccacccucuuc

SEQ ID NO: 3494703 - RNA, 13 nt, Human
cucccacccugua

SEQ ID NO: 3494704 - RNA, 18 nt, Human
cucccacccuguaccuca

SEQ ID NO: 3494705 - RNA, 23 nt, Human
cucccacccuguaccucauccca

SEQ ID NO: 3494706 - RNA, 12 nt, Human
cucccaccucag

SEQ ID NO: 3494707 - RNA, 15 nt, Human
cucccaccuccugac

SEQ ID NO: 3494708 - RNA, 14 nt, Human
cucccaccucugug

SEQ ID NO: 3494709 - RNA, 17 nt, Human
cucccaccucugugacc

SEQ ID NO: 3494710 - RNA, 21 nt, Human
cucccaccucugugaccucag

SEQ ID NO: 3494711 - RNA, 20 nt, Human
cucccaccugacacaccagg

SEQ ID NO: 3494712 - RNA, 21 nt, Human
cucccaccugacacaccaggc

SEQ ID NO: 3494713 - RNA, 15 nt, Human
cucccaccuuuaauc

SEQ ID NO: 3494714 - RNA, 22 nt, Human
cucccacgggaccuggggcuuu

SEQ ID NO: 3494715 - RNA, 14 nt, Human
cucccacgugggag

SEQ ID NO: 3494716 - RNA, 21 nt, Human
cucccacgugggagacaagaa

SEQ ID NO: 3494717 - RNA, 15 nt, Human
cucccacugcccacu

SEQ ID NO: 3494718 - RNA, 17 nt, Human
cucccacugcccacugg

SEQ ID NO: 3494719 - RNA, 18 nt, Human
cucccacuucccugacac

SEQ ID NO: 3494720 - RNA, 17 nt, Human
cucccacuucugccaga

SEQ ID NO: 3494721 - RNA, 15 nt, Human
cucccacuuggccaa

SEQ ID NO: 3494722 - RNA, 12 nt, Human
cucccacuuugc

SEQ ID NO: 3494723 - RNA, 17 nt, Human
cucccagagcuggugga

SEQ ID NO: 3494724 - RNA, 15 nt, Human
cucccagagguccag

SEQ ID NO: 3494725 - RNA, 19 nt, Human
cucccagagguccagccca

SEQ ID NO: 3494726 - RNA, 21 nt, Human
cucccagagguccagcccauc

SEQ ID NO: 3494727 - RNA, 23 nt, Human
cucccagagguccagcccaucuc

SEQ ID NO: 3494728 - RNA, 11 nt, Human
cucccagccag

SEQ ID NO: 3494729 - RNA, 16 nt, Human
cucccagccaggcccu

SEQ ID NO: 3494730 - RNA, 19 nt, Human
cucccagcccuauggaugu

SEQ ID NO: 3494731 - RNA, 23 nt, Human
cucccagcugacaguccucucca

SEQ ID NO: 3494732 - RNA, 18 nt, Human
cucccagcuuguaggagc

SEQ ID NO: 3494733 - RNA, 19 nt, Human
cucccagcuuguaggagcu

SEQ ID NO: 3494734 - RNA, 15 nt, Human
cucccaggaccacag

SEQ ID NO: 3494735 - RNA, 20 nt, Human
cucccaggagccugcccagc

SEQ ID NO: 3494736 - RNA, 21 nt, Human
cucccaggagccugcccagcc

SEQ ID NO: 3494737 - RNA, 15 nt, Human
cucccaggcauuccc

SEQ ID NO: 3494738 - RNA, 21 nt, Human
cucccaggcauuccccaggag

SEQ ID NO: 3494739 - RNA, 21 nt, Human
cucccaggccaggcuccuucc

SEQ ID NO: 3494740 - RNA, 22 nt, Human
cucccaggccaggcuccuuccu

SEQ ID NO: 3494741 - RNA, 21 nt, Human
cucccaggccgagaagccagu

SEQ ID NO: 3494742 - RNA, 17 nt, Human
cucccaggcgccccuuc

SEQ ID NO: 3494743 - RNA, 13 nt, Human
cucccaggcucuc

SEQ ID NO: 3494744 - RNA, 19 nt, Human
cucccagggccagggcccu

SEQ ID NO: 3494745 - RNA, 22 nt, Human
cucccagggccagggcccugca

SEQ ID NO: 3494746 - RNA, 16 nt, Human
cucccaggggcucccu

SEQ ID NO: 3494747 - RNA, 13 nt, Human
cucccaggggucu

SEQ ID NO: 3494748 - RNA, 23 nt, Human
cucccaggggucucccuggcucc

SEQ ID NO: 3494749 - RNA, 22 nt, Human
cucccaggguuuuaacuuuguu

SEQ ID NO: 3494750 - RNA, 17 nt, Human
cucccaggugcagccag

SEQ ID NO: 3494751 - RNA, 17 nt, Human
cucccagucauuuaaua

SEQ ID NO: 3494752 - RNA, 20 nt, Human
cucccaguccccagcccuuc

SEQ ID NO: 3494753 - RNA, 16 nt, Human
cucccagucuacccag

SEQ ID NO: 3494754 - RNA, 18 nt, Human
cucccaguucucuaggga

SEQ ID NO: 3494755 - RNA, 17 nt, Human
cucccauaaccgcugau

SEQ ID NO: 3494756 - RNA, 20 nt, Human
cucccauaaccgcugauucu

SEQ ID NO: 3494757 - RNA, 22 nt, Human
cucccauccagggcccccaucu

SEQ ID NO: 3494758 - RNA, 16 nt, Human
cucccaucccccugcc

SEQ ID NO: 3494759 - RNA, 19 nt, Human
cucccaucccccugcccuc

SEQ ID NO: 3494760 - RNA, 24 nt, Human
cucccaucccccugcccucguggc

SEQ ID NO: 3494761 - RNA, 13 nt, Human
cucccauccugug

SEQ ID NO: 3494762 - RNA, 15 nt, Human
cucccauccugugug

SEQ ID NO: 3494763 - RNA, 19 nt, Human
cucccauccuguguguuaa

SEQ ID NO: 3494764 - RNA, 18 nt, Human
cucccaucugugaaagga

SEQ ID NO: 3494765 - RNA, 23 nt, Human
cucccaucugugaaaggaaagag

SEQ ID NO: 3494766 - RNA, 12 nt, Human
cucccaugaagc

SEQ ID NO: 3494767 - RNA, 15 nt, Human
cucccaugaagccuu

SEQ ID NO: 3494768 - RNA, 16 nt, Human
cucccaugaagccuuu

SEQ ID NO: 3494769 - RNA, 19 nt, Human
cucccaugaagccuuuuga

SEQ ID NO: 3494770 - RNA, 16 nt, Human
cucccaugaccauacu

SEQ ID NO: 3494771 - RNA, 14 nt, Human
cucccauggagccc

SEQ ID NO: 3494772 - RNA, 16 nt, Human
cucccauggagcccca

SEQ ID NO: 3494773 - RNA, 17 nt, Human
cucccauggagccccag

SEQ ID NO: 3494774 - RNA, 16 nt, Human
cucccaugucacugca

SEQ ID NO: 3494775 - RNA, 20 nt, Human
cucccauucacucuuccaga

SEQ ID NO: 3494776 - RNA, 14 nt, Human
cucccauuccugaa

SEQ ID NO: 3494777 - RNA, 19 nt, Human
cucccauugucccucugcc

SEQ ID NO: 3494778 - RNA, 22 nt, Human
cucccauugucccucugcccca

SEQ ID NO: 3494779 - RNA, 14 nt, Human
cucccauuucuacu

SEQ ID NO: 3494780 - RNA, 16 nt, Human
cucccauuucuacucu

SEQ ID NO: 3494781 - RNA, 20 nt, Human
cuccccaaaggcuuugcccu

SEQ ID NO: 3494782 - RNA, 22 nt, Human
cuccccaacccccauucucauc

SEQ ID NO: 3494783 - RNA, 23 nt, Human
cuccccaacccuagguucccugu

SEQ ID NO: 3494784 - RNA, 14 nt, Human
cuccccaacccugc

SEQ ID NO: 3494785 - RNA, 20 nt, Human
cuccccaacccugccccugc

SEQ ID NO: 3494786 - RNA, 23 nt, Human
cuccccaacugaccaccuuuguu

SEQ ID NO: 3494787 - RNA, 22 nt, Human
cuccccaaggcccccugccugc

SEQ ID NO: 3494788 - RNA, 23 nt, Human
cuccccaagugguuuccacaugc

SEQ ID NO: 3494789 - RNA, 21 nt, Human
cuccccaaugagacuugccuu

SEQ ID NO: 3494790 - RNA, 15 nt, Human
ccauggcuucccaga

SEQ ID NO: 3494791 - RNA, 21 nt, Human
ccaugggaagacgaggcccuc

SEQ ID NO: 3494792 - RNA, 11 nt, Human
ccaugggacca

SEQ ID NO: 3494793 - RNA, 11 nt, Human
ccaugggaggg

SEQ ID NO: 3494794 - RNA, 14 nt, Human
ccaugggagggagc

SEQ ID NO: 3494795 - RNA, 17 nt, Human
ccaugggagggagcuga

SEQ ID NO: 3494796 - RNA, 19 nt, Human
ccaugggauaaaugccauc

SEQ ID NO: 3494797 - RNA, 16 nt, Human
ccaugggauacaaccu

SEQ ID NO: 3494798 - RNA, 24 nt, Human
ccaugggauacaaccucccucuug

SEQ ID NO: 3494799 - RNA, 14 nt, Human
ccaugggcacugcu

SEQ ID NO: 3494800 - RNA, 16 nt, Human
ccaugggcagagccca

SEQ ID NO: 3494801 - RNA, 13 nt, Human
ccaugggcaggag

SEQ ID NO: 3494802 - RNA, 16 nt, Human
ccaugggcuucacugu

SEQ ID NO: 3494803 - RNA, 20 nt, Human
ccauggggagggauucuggu

SEQ ID NO: 3494804 - RNA, 14 nt, Human
ccaugggggcaggg

SEQ ID NO: 3494805 - RNA, 16 nt, Human
ccauggguagccuggg

SEQ ID NO: 3494806 - RNA, 14 nt, Human
ccaugguacccccu

SEQ ID NO: 3494807 - RNA, 20 nt, Human
ccauggugaauuaaucacuu

SEQ ID NO: 3494808 - RNA, 16 nt, Human
ccauggugccucugga

SEQ ID NO: 3494809 - RNA, 17 nt, Human
ccauggugcuaggaaga

SEQ ID NO: 3494810 - RNA, 19 nt, Human
ccauggugugaucgucuga

SEQ ID NO: 3494811 - RNA, 20 nt, Human
ccauguaaauaccagacugc

SEQ ID NO: 3494812 - RNA, 23 nt, Human
ccauguaaauccccacugggacc

SEQ ID NO: 3494813 - RNA, 15 nt, Human
ccauguaacagaaag

SEQ ID NO: 3494814 - RNA, 15 nt, Human
ccauguaagcacucu

SEQ ID NO: 3494815 - RNA, 20 nt, Human
ccauguaauggcaguuauau

SEQ ID NO: 3494816 - RNA, 13 nt, Human
ccauguaccuccc

SEQ ID NO: 3494817 - RNA, 17 nt, Human
ccauguaccuccccugc

SEQ ID NO: 3494818 - RNA, 15 nt, Human
ccauguagaaaauuu

SEQ ID NO: 3494819 - RNA, 19 nt, Human
ccauguagaagcugcaucu

SEQ ID NO: 3494820 - RNA, 14 nt, Human
ccauguagcccccu

SEQ ID NO: 3494821 - RNA, 20 nt, Human
ccauguagcccccuggccuc

SEQ ID NO: 3494822 - RNA, 15 nt, Human
ccauguaucuaccuc

SEQ ID NO: 3494823 - RNA, 18 nt, Human
ccauguauggccaggaag

SEQ ID NO: 3494824 - RNA, 23 nt, Human
ccauguauuuaucucuauuuaau

SEQ ID NO: 3494825 - RNA, 22 nt, Human
ccaugucaccggauccugggug

SEQ ID NO: 3494826 - RNA, 15 nt, Human
ccaugucacugcaga

SEQ ID NO: 3494827 - RNA, 18 nt, Human
ccaugucagcaaaaagca

SEQ ID NO: 3494828 - RNA, 20 nt, Human
ccauguccaaagaggcugcc

SEQ ID NO: 3494829 - RNA, 23 nt, Human
ccauguccaaagaggcugccccu

SEQ ID NO: 3494830 - RNA, 16 nt, Human
ccauguccccucccag

SEQ ID NO: 3494831 - RNA, 17 nt, Human
ccauguccuauguguga

SEQ ID NO: 3494832 - RNA, 15 nt, Human
ccauguccucagcau

SEQ ID NO: 3494833 - RNA, 18 nt, Human
ccaugucgcgcucagcau

SEQ ID NO: 3494834 - RNA, 13 nt, Human
ccaugucggccuc

SEQ ID NO: 3494835 - RNA, 15 nt, Human
ccaugucucgacuca

SEQ ID NO: 3494836 - RNA, 16 nt, Human
ccaugucucucagaau

SEQ ID NO: 3494837 - RNA, 15 nt, Human
ccaugucuucucccu

SEQ ID NO: 3494838 - RNA, 19 nt, Human
ccaugucuucucccuggaa

SEQ ID NO: 3494839 - RNA, 22 nt, Human
ccaugugacucuggcuuggccu

SEQ ID NO: 3494840 - RNA, 20 nt, Human
ccaugugagcugcugccaug

SEQ ID NO: 3494841 - RNA, 21 nt, Human
ccaugugagcugcugccauga

SEQ ID NO: 3494842 - RNA, 22 nt, Human
ccaugugagcugcugccaugaa

SEQ ID NO: 3494843 - RNA, 20 nt, Human
ccaugugauggacacuccag

SEQ ID NO: 3494844 - RNA, 19 nt, Human
ccaugugcauaguuucuuu

SEQ ID NO: 3494845 - RNA, 21 nt, Human
ccaugugcauaguuucuuuau

SEQ ID NO: 3494846 - RNA, 13 nt, Human
ccaugugccaggu

SEQ ID NO: 3494847 - RNA, 13 nt, Human
ccaugugcccagu

SEQ ID NO: 3494848 - RNA, 16 nt, Human
ccaugugccugaucca

SEQ ID NO: 3494849 - RNA, 18 nt, Human
ccaugugccugcaccagg

SEQ ID NO: 3494850 - RNA, 19 nt, Human
ccaugugccugcaccagga

SEQ ID NO: 3494851 - RNA, 12 nt, Human
ccauguggccac

SEQ ID NO: 3494852 - RNA, 18 nt, Human
ccaugugguggcacaggc

SEQ ID NO: 3494853 - RNA, 15 nt, Human
ccauguguggacuca

SEQ ID NO: 3494854 - RNA, 10 nt, Human
ccaugugugu

SEQ ID NO: 3494855 - RNA, 15 nt, Human
ccauguuaacaugac

SEQ ID NO: 3494856 - RNA, 20 nt, Human
ccauguuaaccccuccacuc

SEQ ID NO: 3494857 - RNA, 20 nt, Human
ccauguuaaguccucccuga

SEQ ID NO: 3494858 - RNA, 18 nt, Human
ccauguuaguuuuuacuu

SEQ ID NO: 3494859 - RNA, 18 nt, Human
ccauguuccaauaaacag

SEQ ID NO: 3494860 - RNA, 18 nt, Human
ccauguucugcccccagc

SEQ ID NO: 3494861 - RNA, 19 nt, Human
ccauguucugcccccagcc

SEQ ID NO: 3494862 - RNA, 20 nt, Human
ccauguuggccaggaugguc

SEQ ID NO: 3494863 - RNA, 16 nt, Human
ccauguuggccaggcu

SEQ ID NO: 3494864 - RNA, 21 nt, Human
ccauguuggccaggcugcucu

SEQ ID NO: 3494865 - RNA, 23 nt, Human
ccauguuggccaggcugcucuca

SEQ ID NO: 3494866 - RNA, 17 nt, Human
ccauguugugccucccu

SEQ ID NO: 3494867 - RNA, 20 nt, Human
ccauguugugccucccuggu

SEQ ID NO: 3494868 - RNA, 13 nt, Human
ccauguuucaaau

SEQ ID NO: 3494869 - RNA, 22 nt, Human
ccauuaaaacugaagucugaaa

SEQ ID NO: 3494870 - RNA, 12 nt, Human
ccauuaaaccau

SEQ ID NO: 3494871 - RNA, 16 nt, Human
ccauuaaagaauauga

SEQ ID NO: 3494872 - RNA, 14 nt, Human
ccauuaaagucaga

SEQ ID NO: 3494873 - RNA, 19 nt, Human
ccauuaaagucagaaguuu

SEQ ID NO: 3494874 - RNA, 22 nt, Human
ccauuaaccagaucuagucaau

SEQ ID NO: 3494875 - RNA, 17 nt, Human
ccauuaaucaguucauu

SEQ ID NO: 3494876 - RNA, 15 nt, Human
ccauuaauuuaaaug

SEQ ID NO: 3494877 - RNA, 23 nt, Human
ccauuagaagauauuagucuugg

SEQ ID NO: 3494878 - RNA, 16 nt, Human
ccauuagagucagccu

SEQ ID NO: 3494879 - RNA, 22 nt, Human
ccauuaggacaaucaguccccu

SEQ ID NO: 3494880 - RNA, 15 nt, Human
ccauuaggcuccuga

SEQ ID NO: 3494881 - RNA, 20 nt, Human
ccauuauaaccuuaauuuau

SEQ ID NO: 3494882 - RNA, 21 nt, Human
ccauuauuaucaaguagacua

SEQ ID NO: 3494883 - RNA, 16 nt, Human
ccauuauuuucuguca

SEQ ID NO: 3494884 - RNA, 19 nt, Human
ccauuauuuucugucagau

SEQ ID NO: 3494885 - RNA, 20 nt, Human
ccauucacaauaaaagcuua

SEQ ID NO: 3494886 - RNA, 19 nt, Human
ccauucacucuuccagaau

SEQ ID NO: 3494887 - RNA, 12 nt, Human
ccauucaggaac

SEQ ID NO: 3494888 - RNA, 14 nt, Human
ccauuccaaagcuu

SEQ ID NO: 3494889 - RNA, 16 nt, Human
ccauuccaaagcuuua

SEQ ID NO: 3494890 - RNA, 22 nt, Human
ccauuccaaagcuuuauuacca

SEQ ID NO: 3494891 - RNA, 13 nt, Human
ccauuccacaucc

SEQ ID NO: 3494892 - RNA, 21 nt, Human
ccauucccaagaaaugcuuug

SEQ ID NO: 3494893 - RNA, 15 nt, Human
ccauucccugccugg

SEQ ID NO: 3494894 - RNA, 13 nt, Human
ccauuccucaggg

SEQ ID NO: 3494895 - RNA, 16 nt, Human
ccauuccucagggaca

SEQ ID NO: 3494896 - RNA, 24 nt, Human
ccauuccugguacccagccaucug

SEQ ID NO: 3494897 - RNA, 21 nt, Human
ccauucguacauaauacugaa

SEQ ID NO: 3494898 - RNA, 17 nt, Human
ccauucuacuugcucug

SEQ ID NO: 3494899 - RNA, 20 nt, Human
ccauucuacuugcucuggac

SEQ ID NO: 3494900 - RNA, 17 nt, Human
ccauucucaagcccugc

SEQ ID NO: 3494901 - RNA, 19 nt, Human
ccauucucaccuauccaca

SEQ ID NO: 3494902 - RNA, 15 nt, Human
ccauucucaucugca

SEQ ID NO: 3494903 - RNA, 18 nt, Human
ccauucucaucugcaccc

SEQ ID NO: 3494904 - RNA, 13 nt, Human
ccauucuccacag

SEQ ID NO: 3494905 - RNA, 14 nt, Human
ccauucuccaccug

SEQ ID NO: 3494906 - RNA, 12 nt, Human
ccauucucccag

SEQ ID NO: 3494907 - RNA, 15 nt, Human
ccauucucccaggua

SEQ ID NO: 3494908 - RNA, 14 nt, Human
ccauucucucuccu

SEQ ID NO: 3494909 - RNA, 13 nt, Human
ccauucugacucg

SEQ ID NO: 3494910 - RNA, 15 nt, Human
ccauucugcccugug

SEQ ID NO: 3494911 - RNA, 22 nt, Human
ccauucugccgcccccuccuga

SEQ ID NO: 3494912 - RNA, 20 nt, Human
cucagguggggucacucugg

SEQ ID NO: 3494913 - RNA, 23 nt, Human
cucagguggggucacucuggcag

SEQ ID NO: 3494914 - RNA, 16 nt, Human
cucaggugucccugca

SEQ ID NO: 3494915 - RNA, 18 nt, Human
cucaggugucccugcacu

SEQ ID NO: 3494916 - RNA, 23 nt, Human
cucaggugucccugcacuugcag

SEQ ID NO: 3494917 - RNA, 20 nt, Human
cucagguugcugguugcugu

SEQ ID NO: 3494918 - RNA, 23 nt, Human
cucagguugcugguugcugugug

SEQ ID NO: 3494919 - RNA, 19 nt, Human
cucagguuguaguaaagaa

SEQ ID NO: 3494920 - RNA, 22 nt, Human
cucagguuguaguaaagaaauu

SEQ ID NO: 3494921 - RNA, 22 nt, Human
cucagguugucugaagucacug

SEQ ID NO: 3494922 - RNA, 15 nt, Human
cucagguuuguuuug

SEQ ID NO: 3494923 - RNA, 14 nt, Human
cucaguaaaaugaa

SEQ ID NO: 3494924 - RNA, 20 nt, Human
cucaguaaauguacaacugc

SEQ ID NO: 3494925 - RNA, 20 nt, Human
cucaguaaguaucuggagga

SEQ ID NO: 3494926 - RNA, 17 nt, Human
cucaguacuuuggaggc

SEQ ID NO: 3494927 - RNA, 18 nt, Human
cucaguagucagacugga

SEQ ID NO: 3494928 - RNA, 15 nt, Human
cucaguauauuuaaa

SEQ ID NO: 3494929 - RNA, 18 nt, Human
cucaguaugcugccccug

SEQ ID NO: 3494930 - RNA, 13 nt, Human
cucagucaguauu

SEQ ID NO: 3494931 - RNA, 14 nt, Human
cucagucaugcaua

SEQ ID NO: 3494932 - RNA, 16 nt, Human
cucaguccaugaagau

SEQ ID NO: 3494933 - RNA, 19 nt, Human
cucaguccauuuauauaug

SEQ ID NO: 3494934 - RNA, 17 nt, Human
cucaguccuccccucac

SEQ ID NO: 3494935 - RNA, 18 nt, Human
cucaguccuccccucaca

SEQ ID NO: 3494936 - RNA, 20 nt, Human
cucaguccuccccucacagc

SEQ ID NO: 3494937 - RNA, 21 nt, Human
cucaguccuccccucacagcc

SEQ ID NO: 3494938 - RNA, 14 nt, Human
cucagucucacauu

SEQ ID NO: 3494939 - RNA, 14 nt, Human
cucagucucaggag

SEQ ID NO: 3494940 - RNA, 15 nt, Human
cucagucucaggagc

SEQ ID NO: 3494941 - RNA, 15 nt, Human
cucagucucccuccc

SEQ ID NO: 3494942 - RNA, 16 nt, Human
cucagucucccucccu

SEQ ID NO: 3494943 - RNA, 12 nt, Human
cucagucucucu

SEQ ID NO: 3494944 - RNA, 16 nt, Human
cucagugaaguugcug

SEQ ID NO: 3494945 - RNA, 16 nt, Human
cucagugagcuggaga

SEQ ID NO: 3494946 - RNA, 15 nt, Human
cucagugcaaccucu

SEQ ID NO: 3494947 - RNA, 10 nt, Human
cucagugcag

SEQ ID NO: 3494948 - RNA, 17 nt, Human
cucagugcauuugugcu

SEQ ID NO: 3494949 - RNA, 22 nt, Human
cucagugcauuugugcuagaaa

SEQ ID NO: 3494950 - RNA, 22 nt, Human
ccauuguggucacaggaaguag

SEQ ID NO: 3494951 - RNA, 21 nt, Human
ccauuguucaggauucuaaua

SEQ ID NO: 3494952 - RNA, 12 nt, Human
ccauuguucuga

SEQ ID NO: 3494953 - RNA, 23 nt, Human
ccauuguuuaaaaaucuuaaugu

SEQ ID NO: 3494954 - RNA, 19 nt, Human
ccauuuaaauuuuuuuccu

SEQ ID NO: 3494955 - RNA, 23 nt, Human
ccauuuacuuaagacuuaaugag

SEQ ID NO: 3494956 - RNA, 14 nt, Human
ccauuuauagaaua

SEQ ID NO: 3494957 - RNA, 16 nt, Human
ccauuuauauaugaaa

SEQ ID NO: 3494958 - RNA, 12 nt, Human
ccauuuauuuau

SEQ ID NO: 3494959 - RNA, 13 nt, Human
ccauuucagagag

SEQ ID NO: 3494960 - RNA, 21 nt, Human
ccauuucaucuauuucugaga

SEQ ID NO: 3494961 - RNA, 19 nt, Human
ccauuuccucagcuuaucu

SEQ ID NO: 3494962 - RNA, 12 nt, Human
ccauuucuaauu

SEQ ID NO: 3494963 - RNA, 21 nt, Human
ccauuucuaccaaggcauauc

SEQ ID NO: 3494964 - RNA, 22 nt, Human
ccauuucuacucuuaaguuucu

SEQ ID NO: 3494965 - RNA, 23 nt, Human
ccauuucuagaacaucccugcca

SEQ ID NO: 3494966 - RNA, 12 nt, Human
ccauuucuauuu

SEQ ID NO: 3494967 - RNA, 13 nt, Human
ccauuucuauuua

SEQ ID NO: 3494968 - RNA, 17 nt, Human
ccauuucuauuuauuua

SEQ ID NO: 3494969 - RNA, 14 nt, Human
ccauuucucacuga

SEQ ID NO: 3494970 - RNA, 14 nt, Human
ccauuucuccagaa

SEQ ID NO: 3494971 - RNA, 11 nt, Human
ccauuucucuc

SEQ ID NO: 3494972 - RNA, 13 nt, Human
ccauuugaagugu

SEQ ID NO: 3494973 - RNA, 20 nt, Human
ccauuugaggauuuagaagu

SEQ ID NO: 3494974 - RNA, 21 nt, Human
ccauuugauaccccuggggaa

SEQ ID NO: 3494975 - RNA, 19 nt, Human
ccauuugcaauaacagcug

SEQ ID NO: 3494976 - RNA, 21 nt, Human
ccauuugcaauaacagcugca

SEQ ID NO: 3494977 - RNA, 20 nt, Human
ccauuugcagaguccugcac

SEQ ID NO: 3494978 - RNA, 19 nt, Human
ccauuugcucuucagaugc

SEQ ID NO: 3494979 - RNA, 22 nt, Human
ccauuugcucuucagaugccac

SEQ ID NO: 3494980 - RNA, 13 nt, Human
ccauuuggaaauc

SEQ ID NO: 3494981 - RNA, 23 nt, Human
ccauuuggauccuguguggagag

SEQ ID NO: 3494982 - RNA, 19 nt, Human
ccauuuggcagagcuucuu

SEQ ID NO: 3494983 - RNA, 17 nt, Human
ccauuugggcagagagg

SEQ ID NO: 3494984 - RNA, 13 nt, Human
ccauuuguaaaac

SEQ ID NO: 3494985 - RNA, 15 nt, Human
ccauuuguaauaaag

SEQ ID NO: 3494986 - RNA, 16 nt, Human
ccauuuguaauuaaau

SEQ ID NO: 3494987 - RNA, 15 nt, Human
ccauuuguucauauu

SEQ ID NO: 3494988 - RNA, 22 nt, Human
ccauuuucccccacuacugcag

SEQ ID NO: 3494989 - RNA, 14 nt, Human
ccauuuucugguuc

SEQ ID NO: 3494990 - RNA, 21 nt, Human
ccauuuugcaaaauuuccagu

SEQ ID NO: 3494991 - RNA, 20 nt, Human
ccauuuugggguacccacug

SEQ ID NO: 3494992 - RNA, 14 nt, Human
ccauuuugugaaug

SEQ ID NO: 3494993 - RNA, 22 nt, Human
ccauuuuguuauugacuaacag

SEQ ID NO: 3494994 - RNA, 16 nt, Human
ccauuuuucaaagcaa

SEQ ID NO: 3494995 - RNA, 17 nt, Human
ccauuuuucaaagcaau

SEQ ID NO: 3494996 - RNA, 18 nt, Human
ccauuuuuuaauuuacuu

SEQ ID NO: 3494997 - RNA, 12 nt, Human
ccauuuuuuccu

SEQ ID NO: 3494998 - RNA, 17 nt, Human
cccaaaacaaagucuuu

SEQ ID NO: 3494999 - RNA, 18 nt, Human
cccaaaacucuccucugc

SEQ ID NO: 3495000 - RNA, 23 nt, Human
cccaaaagaaacugacaugcccu

SEQ ID NO: 3495001 - RNA, 20 nt, Human
cccaaaauuagccaguaauc

SEQ ID NO: 3495002 - RNA, 16 nt, Human
cccaaacaccuuccag

SEQ ID NO: 3495003 - RNA, 22 nt, Human
cccaaacaccuuccagcuccug

SEQ ID NO: 3495004 - RNA, 22 nt, Human
cccaaaccaccagaagcccaga

SEQ ID NO: 3495005 - RNA, 12 nt, Human
cccaaaccucca

SEQ ID NO: 3495006 - RNA, 23 nt, Human
cccaaacgcccuuuccuccucag

SEQ ID NO: 3495007 - RNA, 12 nt, Human
cccaaagaagga

SEQ ID NO: 3495008 - RNA, 19 nt, Human
cccaaagagccuggagaag

SEQ ID NO: 3495009 - RNA, 12 nt, Human
cccaaagagcug

SEQ ID NO: 3495010 - RNA, 14 nt, Human
cccaaagccagaca

SEQ ID NO: 3495011 - RNA, 13 nt, Human
cccaaagcugagc

SEQ ID NO: 3495012 - RNA, 14 nt, Human
cccaaagcugagcc

SEQ ID NO: 3495013 - RNA, 15 nt, Human
cccaaagcuuuccug

SEQ ID NO: 3495014 - RNA, 19 nt, Human
cccaaaggacgcacugagc

SEQ ID NO: 3495015 - RNA, 16 nt, Human
cccaaagugcugggau

SEQ ID NO: 3495016 - RNA, 20 nt, Human
cccaaagugguauagaaaug

SEQ ID NO: 3495017 - RNA, 17 nt, Human
cccaaauaagaagggau

SEQ ID NO: 3495018 - RNA, 14 nt, Human
cccaaaucaauaca

SEQ ID NO: 3495019 - RNA, 15 nt, Human
cccaaauccgaaccu

SEQ ID NO: 3495020 - RNA, 23 nt, Human
cccaaauccgaaccuccucugug

SEQ ID NO: 3495021 - RNA, 14 nt, Human
cccaaaugcuggcu

SEQ ID NO: 3495022 - RNA, 18 nt, Human
cccaaauggaaaugggca

SEQ ID NO: 3495023 - RNA, 22 nt, Human
cccaaauggaaaugggcagagc

SEQ ID NO: 3495024 - RNA, 14 nt, Human
cccaaauggcccug

SEQ ID NO: 3495025 - RNA, 18 nt, Human
cccaaaugugugcccagc

SEQ ID NO: 3495026 - RNA, 23 nt, Human
cccaaauuagggcaauuggaaca

SEQ ID NO: 3495027 - RNA, 20 nt, Human
cccaaauuaucaagcuaaua

SEQ ID NO: 3495028 - RNA, 21 nt, Human
cccaaauuaucaagcuaauaa

SEQ ID NO: 3495029 - RNA, 13 nt, Human
cccaaauuuaauu

SEQ ID NO: 3495030 - RNA, 19 nt, Human
cccaacagaugcuuuucug

SEQ ID NO: 3495031 - RNA, 23 nt, Human
cccaacagcuggacccugaccag

SEQ ID NO: 3495032 - RNA, 12 nt, Human
cccaacagugug

SEQ ID NO: 3495033 - RNA, 14 nt, Human
cccaacagugugaa

SEQ ID NO: 3495034 - RNA, 15 nt, Human
cccaacagugugaag

SEQ ID NO: 3495035 - RNA, 19 nt, Human
cccaacagugugaaguuag

SEQ ID NO: 3495036 - RNA, 19 nt, Human
cccaacauauaaaauaaug

SEQ ID NO: 3495037 - RNA, 17 nt, Human
cccaaccagugccaagg

SEQ ID NO: 3495038 - RNA, 17 nt, Human
cccaaccauuuccucag

SEQ ID NO: 3495039 - RNA, 18 nt, Human
cccaaccauuuccucaga

SEQ ID NO: 3495040 - RNA, 13 nt, Human
cccaaccccugag

SEQ ID NO: 3495041 - RNA, 13 nt, Human
cccaacccgugga

SEQ ID NO: 3495042 - RNA, 17 nt, Human
cccaacccguggaggcu

SEQ ID NO: 3495043 - RNA, 18 nt, Human
cccaacccguggaggcug

SEQ ID NO: 3495044 - RNA, 20 nt, Human
cccaacccuaucuccugaca

SEQ ID NO: 3495045 - RNA, 17 nt, Human
cccaacccuucccucac

SEQ ID NO: 3495046 - RNA, 12 nt, Human
cccaaccucaga

SEQ ID NO: 3495047 - RNA, 14 nt, Human
cccaaccugcucuc

SEQ ID NO: 3495048 - RNA, 16 nt, Human
cccaaccugcucuccu

SEQ ID NO: 3495049 - RNA, 17 nt, Human
cccaaccugcucuccuc

SEQ ID NO: 3495050 - RNA, 21 nt, Human
cccaaccugcucuccucuugc

SEQ ID NO: 3495051 - RNA, 23 nt, Human
cccaaccugcucuccucuugcca

SEQ ID NO: 3495052 - RNA, 20 nt, Human
cccaaccuuucccucacccc

SEQ ID NO: 3495053 - RNA, 12 nt, Human
cccaacgcucca

SEQ ID NO: 3495054 - RNA, 14 nt, Human
cccaacgggaagca

SEQ ID NO: 3495055 - RNA, 16 nt, Human
cccaacucaccccagc

SEQ ID NO: 3495056 - RNA, 20 nt, Human
cccaacucaccccagcccca

SEQ ID NO: 3495057 - RNA, 16 nt, Human
cuccuuccugccaccu

SEQ ID NO: 3495058 - RNA, 16 nt, Human
cuccuuccuggccuga

SEQ ID NO: 3495059 - RNA, 13 nt, Human
cuccuuccugucu

SEQ ID NO: 3495060 - RNA, 14 nt, Human
cuccuuccugucuu

SEQ ID NO: 3495061 - RNA, 15 nt, Human
cuccuuccugugugu

SEQ ID NO: 3495062 - RNA, 14 nt, Human
cuccuuccuuaccc

SEQ ID NO: 3495063 - RNA, 19 nt, Human
cuccuuccuuacccaaacu

SEQ ID NO: 3495064 - RNA, 18 nt, Human
cuccuucguaucccgagu

SEQ ID NO: 3495065 - RNA, 14 nt, Human
cuccuucugagcuc

SEQ ID NO: 3495066 - RNA, 20 nt, Human
cuccuucugagcuccugucc

SEQ ID NO: 3495067 - RNA, 20 nt, Human
cuccuugaauaucuuucgau

SEQ ID NO: 3495068 - RNA, 19 nt, Human
cuccuugacuccuuguggu

SEQ ID NO: 3495069 - RNA, 20 nt, Human
cuccuugagagaccaggcaa

SEQ ID NO: 3495070 - RNA, 15 nt, Human
cuccuugauauuugu

SEQ ID NO: 3495071 - RNA, 17 nt, Human
cuccuugccuccugugu

SEQ ID NO: 3495072 - RNA, 13 nt, Human
cuccuugcucugc

SEQ ID NO: 3495073 - RNA, 17 nt, Human
cuccuugcuuguuacau

SEQ ID NO: 3495074 - RNA, 12 nt, Human
cuccuuggccua

SEQ ID NO: 3495075 - RNA, 17 nt, Human
cuccuuggccuagccca

SEQ ID NO: 3495076 - RNA, 22 nt, Human
cuccuuggccuagcccacccug

SEQ ID NO: 3495077 - RNA, 16 nt, Human
cuccuuggcuuaccug

SEQ ID NO: 3495078 - RNA, 19 nt, Human
cuccuuggcuuaccugacc

SEQ ID NO: 3495079 - RNA, 21 nt, Human
cuccuuggcuuaccugaccuc

SEQ ID NO: 3495080 - RNA, 20 nt, Human
cuccuugggaggaagcagaa

SEQ ID NO: 3495081 - RNA, 22 nt, Human
cuccuugggaggccccacuggg

SEQ ID NO: 3495082 - RNA, 13 nt, Human
cuccuugggcccu

SEQ ID NO: 3495083 - RNA, 19 nt, Human
cuccuugggcccuuugagu

SEQ ID NO: 3495084 - RNA, 21 nt, Human
cuccuuggugauuccgcagug

SEQ ID NO: 3495085 - RNA, 19 nt, Human
cuccuuggugccuggccug

SEQ ID NO: 3495086 - RNA, 17 nt, Human
cuccuugguuauauuuu

SEQ ID NO: 3495087 - RNA, 15 nt, Human
cuccuuguccaccca

SEQ ID NO: 3495088 - RNA, 16 nt, Human
cuccuuguccacccac

SEQ ID NO: 3495089 - RNA, 14 nt, Human
cuccuugugccaga

SEQ ID NO: 3495090 - RNA, 18 nt, Human
cuccuugugggccugggc

SEQ ID NO: 3495091 - RNA, 21 nt, Human
cuccuugugggccugggcucc

SEQ ID NO: 3495092 - RNA, 18 nt, Human
cuccuugugguuuauguc

SEQ ID NO: 3495093 - RNA, 13 nt, Human
cuccuuuaauugu

SEQ ID NO: 3495094 - RNA, 20 nt, Human
cuccuuuacccucaucuguc

SEQ ID NO: 3495095 - RNA, 17 nt, Human
cuccuuuagcgcccagu

SEQ ID NO: 3495096 - RNA, 18 nt, Human
cuccuuucaucacacugg

SEQ ID NO: 3495097 - RNA, 10 nt, Human
cuccuuucca

SEQ ID NO: 3495098 - RNA, 18 nt, Human
cuccuuuccauaaauccu

SEQ ID NO: 3495099 - RNA, 22 nt, Human
cuccuuuccccuuccuuuuaag

SEQ ID NO: 3495100 - RNA, 21 nt, Human
cuccuuucuccagccagcaau

SEQ ID NO: 3495101 - RNA, 16 nt, Human
cuccuuucucuucucu

SEQ ID NO: 3495102 - RNA, 14 nt, Human
cuccuuucuggcuu

SEQ ID NO: 3495103 - RNA, 13 nt, Human
cuccuuucuuuuu

SEQ ID NO: 3495104 - RNA, 19 nt, Human
cuccuuugaaaccugcucu

SEQ ID NO: 3495105 - RNA, 22 nt, Human
cuccuuugcacugagggccaca

SEQ ID NO: 3495106 - RNA, 23 nt, Human
cuccuuugcugaggccuccagcu

SEQ ID NO: 3495107 - RNA, 13 nt, Human
cuccuuuguacuu

SEQ ID NO: 3495108 - RNA, 14 nt, Human
cuccuuuguacuuu

SEQ ID NO: 3495109 - RNA, 18 nt, Human
cuccuuugugaggaagcc

SEQ ID NO: 3495110 - RNA, 12 nt, Human
cuccuuugugug

SEQ ID NO: 3495111 - RNA, 15 nt, Human
cuccuuugugugugu

SEQ ID NO: 3495112 - RNA, 16 nt, Human
cuccuuuguucccggc

SEQ ID NO: 3495113 - RNA, 24 nt, Human
cuccuuuucacaguucucuccuuc

SEQ ID NO: 3495114 - RNA, 17 nt, Human
cuccuuuuccagagcau

SEQ ID NO: 3495115 - RNA, 17 nt, Human
cuccuuuucuuuuguua

SEQ ID NO: 3495116 - RNA, 21 nt, Human
cuccuuuuucucccucuggau

SEQ ID NO: 3495117 - RNA, 20 nt, Human
cucgaaacacagaaaccuuu

SEQ ID NO: 3495118 - RNA, 15 nt, Human
cucgaacccacacug

SEQ ID NO: 3495119 - RNA, 21 nt, Human
cucgaacuauuuucaaagacu

SEQ ID NO: 3495120 - RNA, 14 nt, Human
cucgaacuccuggg

SEQ ID NO: 3495121 - RNA, 12 nt, Human
cucgaagcgcgc

SEQ ID NO: 3495122 - RNA, 13 nt, Human
cucgaagcgcgcc

SEQ ID NO: 3495123 - RNA, 20 nt, Human
cucgaagcgcgccacucgcu

SEQ ID NO: 3495124 - RNA, 13 nt, Human
cucgaaucucugu

SEQ ID NO: 3495125 - RNA, 16 nt, Human
cucgaaucucugugcc

SEQ ID NO: 3495126 - RNA, 14 nt, Human
cucgaaucugugug

SEQ ID NO: 3495127 - RNA, 23 nt, Human
cucgacguuuacaagcccccccu

SEQ ID NO: 3495128 - RNA, 13 nt, Human
cucgacucugugc

SEQ ID NO: 3495129 - RNA, 23 nt, Human
cucgagcaguccugccucagccu

SEQ ID NO: 3495130 - RNA, 15 nt, Human
cucgagcgcccugca

SEQ ID NO: 3495131 - RNA, 19 nt, Human
cucgagcgcccugcagacc

SEQ ID NO: 3495132 - RNA, 15 nt, Human
cucgagcuuggggca

SEQ ID NO: 3495133 - RNA, 23 nt, Human
cucgagggcagggaccacacccu

SEQ ID NO: 3495134 - RNA, 21 nt, Human
cucgaggugccuucuucaggg

SEQ ID NO: 3495135 - RNA, 22 nt, Human
cucgaguacugugggcaauuua

SEQ ID NO: 3495136 - RNA, 20 nt, Human
cucgauguggucacagcugu

SEQ ID NO: 3495137 - RNA, 19 nt, Human
cucgauuuuguaucugcag

SEQ ID NO: 3495138 - RNA, 20 nt, Human
cucgauuuuguaucugcagg

SEQ ID NO: 3495139 - RNA, 13 nt, Human
cucgcaagcuggg

SEQ ID NO: 3495140 - RNA, 14 nt, Human
cucgcaagcugggu

SEQ ID NO: 3495141 - RNA, 20 nt, Human
cucgcaccccccuguucuaa

SEQ ID NO: 3495142 - RNA, 21 nt, Human
cucgcaccccccuguucuaag

SEQ ID NO: 3495143 - RNA, 14 nt, Human
cucgcaccuuucca

SEQ ID NO: 3495144 - RNA, 17 nt, Human
cucgcacggccccgaag

SEQ ID NO: 3495145 - RNA, 14 nt, Human
cucgcagagaggcc

SEQ ID NO: 3495146 - RNA, 16 nt, Human
cucgcaucauugcaga

SEQ ID NO: 3495147 - RNA, 17 nt, Human
cucgcaucauugcagau

SEQ ID NO: 3495148 - RNA, 14 nt, Human
cucgcauugacaca

SEQ ID NO: 3495149 - RNA, 13 nt, Human
cucgccaugccgg

SEQ ID NO: 3495150 - RNA, 17 nt, Human
cucgccaugccgggggu

SEQ ID NO: 3495151 - RNA, 18 nt, Human
cucgcccaccgcaugccc

SEQ ID NO: 3495152 - RNA, 22 nt, Human
cuccaucacccucuuccuguga

SEQ ID NO: 3495153 - RNA, 18 nt, Human
cuccaucaguuagagcug

SEQ ID NO: 3495154 - RNA, 14 nt, Human
cuccaucccuggcc

SEQ ID NO: 3495155 - RNA, 16 nt, Human
cuccaucccuggcccc

SEQ ID NO: 3495156 - RNA, 20 nt, Human
cuccauccgugccucuuuuu

SEQ ID NO: 3495157 - RNA, 18 nt, Human
cuccauccuacccccugu

SEQ ID NO: 3495158 - RNA, 22 nt, Human
cuccauccuacccccugugccu

SEQ ID NO: 3495159 - RNA, 17 nt, Human
cuccauccuccuccuuc

SEQ ID NO: 3495160 - RNA, 16 nt, Human
cuccauccugaggcuc

SEQ ID NO: 3495161 - RNA, 18 nt, Human
cuccauccugaggcucca

SEQ ID NO: 3495162 - RNA, 21 nt, Human
cuccauccugaggcuccacuu

SEQ ID NO: 3495163 - RNA, 22 nt, Human
cuccauccuuucugccucucaa

SEQ ID NO: 3495164 - RNA, 20 nt, Human
cuccaucgcugucaucucag

SEQ ID NO: 3495165 - RNA, 18 nt, Human
cuccaucuaaacugcccc

SEQ ID NO: 3495166 - RNA, 23 nt, Human
cuccaucucauguaucaucugga

SEQ ID NO: 3495167 - RNA, 14 nt, Human
cuccaucuccacuc

SEQ ID NO: 3495168 - RNA, 16 nt, Human
cuccaucucucuggcc

SEQ ID NO: 3495169 - RNA, 18 nt, Human
cuccaucucucuggcccu

SEQ ID NO: 3495170 - RNA, 12 nt, Human
cuccaucuuauu

SEQ ID NO: 3495171 - RNA, 17 nt, Human
cuccaucuucuuugcag

SEQ ID NO: 3495172 - RNA, 16 nt, Human
cuccaugaauaucagu

SEQ ID NO: 3495173 - RNA, 13 nt, Human
cuccaugcugccu

SEQ ID NO: 3495174 - RNA, 16 nt, Human
cuccaugcugccucca

SEQ ID NO: 3495175 - RNA, 20 nt, Human
cuccaugcuuagucacugcc

SEQ ID NO: 3495176 - RNA, 19 nt, Human
cuccauggcuuccuccucc

SEQ ID NO: 3495177 - RNA, 20 nt, Human
cuccauggcuuccuccuccc

SEQ ID NO: 3495178 - RNA, 14 nt, Human
cuccauuaaagucu

SEQ ID NO: 3495179 - RNA, 16 nt, Human
cuccauuaaagucuga

SEQ ID NO: 3495180 - RNA, 21 nt, Human
cuccauucaauuucaggcucc

SEQ ID NO: 3495181 - RNA, 14 nt, Human
cuccauucuauuuu

SEQ ID NO: 3495182 - RNA, 18 nt, Human
cuccauuuaaacagaugu

SEQ ID NO: 3495183 - RNA, 20 nt, Human
cuccauuuaauaauuauaug

SEQ ID NO: 3495184 - RNA, 15 nt, Human
cuccauuuaguucuu

SEQ ID NO: 3495185 - RNA, 18 nt, Human
cuccauuugcucuucaga

SEQ ID NO: 3495186 - RNA, 21 nt, Human
cuccauuuuggugucuuucuc

SEQ ID NO: 3495187 - RNA, 16 nt, Human
cucccaaaagcuagaa

SEQ ID NO: 3495188 - RNA, 17 nt, Human
cucccaaagagcugccu

SEQ ID NO: 3495189 - RNA, 21 nt, Human
cucccaaagagcugccuaaga

SEQ ID NO: 3495190 - RNA, 18 nt, Human
cucccaaagugcugggau

SEQ ID NO: 3495191 - RNA, 16 nt, Human
cucccaacccuggcuu

SEQ ID NO: 3495192 - RNA, 17 nt, Human
cucccaagaacagcagg

SEQ ID NO: 3495193 - RNA, 18 nt, Human
cucccaagaacagcaggc

SEQ ID NO: 3495194 - RNA, 22 nt, Human
cucccaagcaccugggauuaca

SEQ ID NO: 3495195 - RNA, 15 nt, Human
cucccaagcuggcug

SEQ ID NO: 3495196 - RNA, 19 nt, Human
cucccaagcuggcuggggu

SEQ ID NO: 3495197 - RNA, 17 nt, Human
cucccaaggagaacaaa

SEQ ID NO: 3495198 - RNA, 18 nt, Human
cucccaaggagaacaaau

SEQ ID NO: 3495199 - RNA, 21 nt, Human
cucccaaggggcccaaauucu

SEQ ID NO: 3495200 - RNA, 22 nt, Human
cucccaaggggcccaaauucuu

SEQ ID NO: 3495201 - RNA, 18 nt, Human
cucccaagguuggagccc

SEQ ID NO: 3495202 - RNA, 22 nt, Human
cucccaaguagcugggauuaca

SEQ ID NO: 3495203 - RNA, 17 nt, Human
cucccaagucuacagag

SEQ ID NO: 3495204 - RNA, 19 nt, Human
cucccaaguuuccauagca

SEQ ID NO: 3495205 - RNA, 19 nt, Human
cucccaauuucagacuccc

SEQ ID NO: 3495206 - RNA, 21 nt, Human
cucccaauuucagacucccau

SEQ ID NO: 3495207 - RNA, 21 nt, Human
cucccacaagccucugcccag

SEQ ID NO: 3495208 - RNA, 23 nt, Human
cucccacaagccucugcccaggc

SEQ ID NO: 3495209 - RNA, 16 nt, Human
cucccacaagccugag

SEQ ID NO: 3495210 - RNA, 17 nt, Human
cucccacaagccugagg

SEQ ID NO: 3495211 - RNA, 14 nt, Human
cucccacacugcua

SEQ ID NO: 3495212 - RNA, 17 nt, Human
cucccacaggcagcuuu

SEQ ID NO: 3495213 - RNA, 18 nt, Human
cucccacaggcagcuuua

SEQ ID NO: 3495214 - RNA, 14 nt, Human
cucccacaggcccu

SEQ ID NO: 3495215 - RNA, 22 nt, Human
cucccacaugggcccaggccuc

SEQ ID NO: 3495216 - RNA, 23 nt, Human
cucccacaugggcccaggccuca

SEQ ID NO: 3495217 - RNA, 19 nt, Human
cucccaccacagcaggugu

SEQ ID NO: 3495218 - RNA, 13 nt, Human
cucccacccaccg

SEQ ID NO: 3495219 - RNA, 18 nt, Human
cucccacccagucucugc

SEQ ID NO: 3495220 - RNA, 22 nt, Human
cucccacccagucucugcucca

SEQ ID NO: 3495221 - RNA, 18 nt, Human
cucccaccccaugcauua

SEQ ID NO: 3495222 - RNA, 11 nt, Human
cucccaccccc

SEQ ID NO: 3495223 - RNA, 16 nt, Human
cucccacccccagccc

SEQ ID NO: 3495224 - RNA, 19 nt, Human
cucccacccccaucucucc

SEQ ID NO: 3495225 - RNA, 23 nt, Human
cucccacccccuucucugcucca

SEQ ID NO: 3495226 - RNA, 18 nt, Human
cucccacccgaugcugcu

SEQ ID NO: 3495227 - RNA, 20 nt, Human
cucccacccgaugcugcuuu

SEQ ID NO: 3495228 - RNA, 17 nt, Human
cucccacccggcugcag

SEQ ID NO: 3495229 - RNA, 15 nt, Human
cucccacccucuucc

SEQ ID NO: 3495230 - RNA, 21 nt, Human
cucccacccucuuccuacugg

SEQ ID NO: 3495231 - RNA, 13 nt, Human
cucccaccucagc

SEQ ID NO: 3495232 - RNA, 14 nt, Human
cucccaccucagcc

SEQ ID NO: 3495233 - RNA, 13 nt, Human
cucccaccuccag

SEQ ID NO: 3495234 - RNA, 16 nt, Human
cucccacucuccuagg

SEQ ID NO: 3495235 - RNA, 17 nt, Human
cucccacucuccuaggc

SEQ ID NO: 3495236 - RNA, 12 nt, Human
cucccacugccc

SEQ ID NO: 3495237 - RNA, 23 nt, Human
cucccacugggguccagggagca

SEQ ID NO: 3495238 - RNA, 15 nt, Human
cucccagaaucccag

SEQ ID NO: 3495239 - RNA, 20 nt, Human
cucccagaaucccagccggc

SEQ ID NO: 3495240 - RNA, 15 nt, Human
cucccagaccugccu

SEQ ID NO: 3495241 - RNA, 15 nt, Human
cucccagagcaccug

SEQ ID NO: 3495242 - RNA, 19 nt, Human
cucccagagcaccugcugu

SEQ ID NO: 3495243 - RNA, 22 nt, Human
cucccagaggagccaccaguuc

SEQ ID NO: 3495244 - RNA, 18 nt, Human
cucccagagguccagccc

SEQ ID NO: 3495245 - RNA, 21 nt, Human
cucccagaucagucagagccc

SEQ ID NO: 3495246 - RNA, 22 nt, Human
cucccagauuucagucuuuucc

SEQ ID NO: 3495247 - RNA, 21 nt, Human
cucccagcaacacaagcugga

SEQ ID NO: 3495248 - RNA, 19 nt, Human
cucccagcagcccuaagga

SEQ ID NO: 3495249 - RNA, 13 nt, Human
cucccagcaucgc

SEQ ID NO: 3495250 - RNA, 18 nt, Human
cucccagccccugccccu

SEQ ID NO: 3495251 - RNA, 19 nt, Human
cucccagccccugccccuc

SEQ ID NO: 3495252 - RNA, 16 nt, Human
cucccagcccuaugga

SEQ ID NO: 3495253 - RNA, 18 nt, Human
cucccagcucuagacaac

SEQ ID NO: 3495254 - RNA, 20 nt, Human
cucccagcucuagacaaccc

SEQ ID NO: 3495255 - RNA, 23 nt, Human
cucccagcucuagacaacccugc

SEQ ID NO: 3495256 - RNA, 16 nt, Human
cucccagcucugagga

SEQ ID NO: 3495257 - RNA, 20 nt, Human
cucccagcugacaguccucu

SEQ ID NO: 3495258 - RNA, 18 nt, Human
cucccaggaacugggcca

SEQ ID NO: 3495259 - RNA, 11 nt, Human
cucccaggaag

SEQ ID NO: 3495260 - RNA, 16 nt, Human
cucccaggagacaguu

SEQ ID NO: 3495261 - RNA, 19 nt, Human
cucccaggagccugcccag

SEQ ID NO: 3495262 - RNA, 15 nt, Human
cucccaggcaaggcu

SEQ ID NO: 3495263 - RNA, 22 nt, Human
cucccaggcaaggcuguggacc

SEQ ID NO: 3495264 - RNA, 19 nt, Human
cucccaggcauuccccagg

SEQ ID NO: 3495265 - RNA, 20 nt, Human
cucccaggcauuccccagga

SEQ ID NO: 3495266 - RNA, 22 nt, Human
cucccaggccaguaagggaaau

SEQ ID NO: 3495267 - RNA, 15 nt, Human
cucccaggccccaug

SEQ ID NO: 3495268 - RNA, 21 nt, Human
cucccaggccccaugaccucc

SEQ ID NO: 3495269 - RNA, 19 nt, Human
cucccaggcgccccuuccc

SEQ ID NO: 3495270 - RNA, 20 nt, Human
cucccaggcgccccuucccc

SEQ ID NO: 3495271 - RNA, 22 nt, Human
cucccaggcgccccuucccccu

SEQ ID NO: 3495272 - RNA, 20 nt, Human
cucccagggagcaagggcag

SEQ ID NO: 3495273 - RNA, 22 nt, Human
cucccagggagcaugagaggag

SEQ ID NO: 3495274 - RNA, 21 nt, Human
cucccagggccaugaacuuug

SEQ ID NO: 3495275 - RNA, 18 nt, Human
cucccaggggcucccucc

SEQ ID NO: 3495276 - RNA, 22 nt, Human
cucccaggggcucccuccgccc

SEQ ID NO: 3495277 - RNA, 19 nt, Human
cucccaggggcuggcuuca

SEQ ID NO: 3495278 - RNA, 16 nt, Human
cucccaggggucuccc

SEQ ID NO: 3495279 - RNA, 18 nt, Human
cucccaggggucucccug

SEQ ID NO: 3495280 - RNA, 22 nt, Human
cucccaggggucucccuggcuc

SEQ ID NO: 3495281 - RNA, 20 nt, Human
cucccaggguuuuaacuuug

SEQ ID NO: 3495282 - RNA, 17 nt, Human
cucccagguaccagcug

SEQ ID NO: 3495283 - RNA, 18 nt, Human
cucccagguaccagcugc

SEQ ID NO: 3495284 - RNA, 24 nt, Human
cucccagguaccagcugcgcuugc

SEQ ID NO: 3495285 - RNA, 21 nt, Human
cucccagguguuaacauucca

SEQ ID NO: 3495286 - RNA, 11 nt, Human
cucccaguccc

SEQ ID NO: 3495287 - RNA, 18 nt, Human
cucccagucuacccagag

SEQ ID NO: 3495288 - RNA, 17 nt, Human
cucccagugucuuccug

SEQ ID NO: 3495289 - RNA, 20 nt, Human
cucccaguucucuagggaag

SEQ ID NO: 3495290 - RNA, 21 nt, Human
cucccaguucucuagggaagg

SEQ ID NO: 3495291 - RNA, 23 nt, Human
cucccauagauacucucuucuuc

SEQ ID NO: 3495292 - RNA, 15 nt, Human
cucccaucaccucua

SEQ ID NO: 3495293 - RNA, 19 nt, Human
cucccaucaugcccggucc

SEQ ID NO: 3495294 - RNA, 23 nt, Human
cucccaucauuacccuucccugc

SEQ ID NO: 3495295 - RNA, 17 nt, Human
cucccaucccccugccc

SEQ ID NO: 3495296 - RNA, 14 nt, Human
cucccaucucacac

SEQ ID NO: 3495297 - RNA, 21 nt, Human
cucccaucucacacaugagca

SEQ ID NO: 3495298 - RNA, 11 nt, Human
cucccaucugg

SEQ ID NO: 3495299 - RNA, 22 nt, Human
cucgcccaccgcaugcccccuc

SEQ ID NO: 3495300 - RNA, 17 nt, Human
cucgccccuggcagaga

SEQ ID NO: 3495301 - RNA, 22 nt, Human
cucgcccgcccacuguccuggg

SEQ ID NO: 3495302 - RNA, 23 nt, Human
cucgcccgcccacuguccugggc

SEQ ID NO: 3495303 - RNA, 12 nt, Human
cucgcccugggu

SEQ ID NO: 3495304 - RNA, 16 nt, Human
cucgccgucugugaau

SEQ ID NO: 3495305 - RNA, 15 nt, Human
cucgccuucaucucc

SEQ ID NO: 3495306 - RNA, 17 nt, Human
cucgccuucccuccugc

SEQ ID NO: 3495307 - RNA, 13 nt, Human
cucgcgacaaugc

SEQ ID NO: 3495308 - RNA, 21 nt, Human
cucgcuccccacucugcucug

SEQ ID NO: 3495309 - RNA, 15 nt, Human
cucgcucccucccag

SEQ ID NO: 3495310 - RNA, 12 nt, Human
cucgcucuguca

SEQ ID NO: 3495311 - RNA, 22 nt, Human
cucgcucuguugcccaggcugg

SEQ ID NO: 3495312 - RNA, 22 nt, Human
cucgcugagggcagacuggggc

SEQ ID NO: 3495313 - RNA, 17 nt, Human
cucgcugaugcugggcu

SEQ ID NO: 3495314 - RNA, 15 nt, Human
cucgcuggcccccac

SEQ ID NO: 3495315 - RNA, 20 nt, Human
cucgcuggcccccacuggcu

SEQ ID NO: 3495316 - RNA, 18 nt, Human
cucgcuguccuuucuaga

SEQ ID NO: 3495317 - RNA, 15 nt, Human
cucgcuguugcugaa

SEQ ID NO: 3495318 - RNA, 20 nt, Human
cucgcuuguaaauaccagga

SEQ ID NO: 3495319 - RNA, 17 nt, Human
cucgcuuuguugcccag

SEQ ID NO: 3495320 - RNA, 23 nt, Human
cucggaaccgcucaccuagagcc

SEQ ID NO: 3495321 - RNA, 21 nt, Human
cucggaacugcaugcugcugg

SEQ ID NO: 3495322 - RNA, 20 nt, Human
cucggaaggcuggcugggca

SEQ ID NO: 3495323 - RNA, 21 nt, Human
cucggaccccacuccggcccu

SEQ ID NO: 3495324 - RNA, 16 nt, Human
cucggagccucauccg

SEQ ID NO: 3495325 - RNA, 17 nt, Human
cucggaggaagccccca

SEQ ID NO: 3495326 - RNA, 12 nt, Human
cucggaggcugc

SEQ ID NO: 3495327 - RNA, 13 nt, Human
cucggaggcugcc

SEQ ID NO: 3495328 - RNA, 17 nt, Human
cucggagggauuccccu

SEQ ID NO: 3495329 - RNA, 22 nt, Human
cucggauaguugcuauuuuugu

SEQ ID NO: 3495330 - RNA, 18 nt, Human
cucggaucaggcucccag

SEQ ID NO: 3495331 - RNA, 15 nt, Human
cucggauccccuucc

SEQ ID NO: 3495332 - RNA, 14 nt, Human
cucggaucucuccu

SEQ ID NO: 3495333 - RNA, 15 nt, Human
cucggccccucccac

SEQ ID NO: 3495334 - RNA, 11 nt, Human
cucggccugcc

SEQ ID NO: 3495335 - RNA, 17 nt, Human
cucggcuccugcugcac

SEQ ID NO: 3495336 - RNA, 18 nt, Human
cucggcuccuggacucau

SEQ ID NO: 3495337 - RNA, 13 nt, Human
cucggcuggcucc

SEQ ID NO: 3495338 - RNA, 14 nt, Human
cucggcuggcuccc

SEQ ID NO: 3495339 - RNA, 21 nt, Human
cucggcuggcuccccugcagc

SEQ ID NO: 3495340 - RNA, 23 nt, Human
cucggcuggcuccccugcagccc

SEQ ID NO: 3495341 - RNA, 17 nt, Human
cucggcuuuucucagcu

SEQ ID NO: 3495342 - RNA, 12 nt, Human
cucgggaaccuc

SEQ ID NO: 3495343 - RNA, 16 nt, Human
cucgggaaccucacuc

SEQ ID NO: 3495344 - RNA, 22 nt, Human
cuccccagcauuccagccccuc

SEQ ID NO: 3495345 - RNA, 21 nt, Human
cuccccagccccuagcccagg

SEQ ID NO: 3495346 - RNA, 13 nt, Human
cuccccagcccug

SEQ ID NO: 3495347 - RNA, 15 nt, Human
cuccccagcccuggc

SEQ ID NO: 3495348 - RNA, 17 nt, Human
cuccccaggccaggcca

SEQ ID NO: 3495349 - RNA, 20 nt, Human
cuccccagggaagcagcagc

SEQ ID NO: 3495350 - RNA, 11 nt, Human
cuccccagggg

SEQ ID NO: 3495351 - RNA, 23 nt, Human
cuccccagguccagcucuggagg

SEQ ID NO: 3495352 - RNA, 20 nt, Human
cuccccaugcaggugguguc

SEQ ID NO: 3495353 - RNA, 16 nt, Human
cuccccaugugccugc

SEQ ID NO: 3495354 - RNA, 20 nt, Human
cuccccaugugccugcacca

SEQ ID NO: 3495355 - RNA, 21 nt, Human
cuccccauuagagucagccuu

SEQ ID NO: 3495356 - RNA, 16 nt, Human
cuccccauuagcuuuc

SEQ ID NO: 3495357 - RNA, 17 nt, Human
cuccccauuucccaucu

SEQ ID NO: 3495358 - RNA, 16 nt, Human
cucccccaacagcugg

SEQ ID NO: 3495359 - RNA, 21 nt, Human
cucccccaacagcuggacccu

SEQ ID NO: 3495360 - RNA, 23 nt, Human
cucccccaacccccaccccacac

SEQ ID NO: 3495361 - RNA, 19 nt, Human
cucccccacccccucccca

SEQ ID NO: 3495362 - RNA, 20 nt, Human
cucccccagcaaagccccca

SEQ ID NO: 3495363 - RNA, 13 nt, Human
cucccccagccac

SEQ ID NO: 3495364 - RNA, 14 nt, Human
cucccccagccacu

SEQ ID NO: 3495365 - RNA, 20 nt, Human
cucccccagccccauccucu

SEQ ID NO: 3495366 - RNA, 22 nt, Human
cucccccaguuccucccaggaa

SEQ ID NO: 3495367 - RNA, 12 nt, Human
cucccccauccu

SEQ ID NO: 3495368 - RNA, 16 nt, Human
cucccccaucucccac

SEQ ID NO: 3495369 - RNA, 13 nt, Human
cucccccccgggg

SEQ ID NO: 3495370 - RNA, 18 nt, Human
cuccccccuccucugaaa

SEQ ID NO: 3495371 - RNA, 12 nt, Human
cucccccgccac

SEQ ID NO: 3495372 - RNA, 14 nt, Human
cucccccgccacuc

SEQ ID NO: 3495373 - RNA, 15 nt, Human
cucccccgccacucc

SEQ ID NO: 3495374 - RNA, 13 nt, Human
cucccccgggagg

SEQ ID NO: 3495375 - RNA, 22 nt, Human
cucccccuaaaccccuguccca

SEQ ID NO: 3495376 - RNA, 17 nt, Human
cucccccucccccuucu

SEQ ID NO: 3495377 - RNA, 15 nt, Human
cucccccuccuuccc

SEQ ID NO: 3495378 - RNA, 11 nt, Human
cucccccugcc

SEQ ID NO: 3495379 - RNA, 13 nt, Human
cucccccugccag

SEQ ID NO: 3495380 - RNA, 16 nt, Human
cucccccugccagugc

SEQ ID NO: 3495381 - RNA, 19 nt, Human
cucccccugccagugccuu

SEQ ID NO: 3495382 - RNA, 13 nt, Human
cucccccugggcu

SEQ ID NO: 3495383 - RNA, 23 nt, Human
cucccccugggcucugccccagc

SEQ ID NO: 3495384 - RNA, 11 nt, Human
cucccccuucu

SEQ ID NO: 3495385 - RNA, 15 nt, Human
cucccccuuuucccu

SEQ ID NO: 3495386 - RNA, 20 nt, Human
cuccccgcaguguuugugug

SEQ ID NO: 3495387 - RNA, 23 nt, Human
cuccccgccguacaguucuccag

SEQ ID NO: 3495388 - RNA, 15 nt, Human
cuccccgccuguucc

SEQ ID NO: 3495389 - RNA, 17 nt, Human
cuccccggcacccucug

SEQ ID NO: 3495390 - RNA, 13 nt, Human
cuccccggcccua

SEQ ID NO: 3495391 - RNA, 15 nt, Human
cuccccuaaugccug

SEQ ID NO: 3495392 - RNA, 17 nt, Human
cuccccuauccacccag

SEQ ID NO: 3495393 - RNA, 19 nt, Human
cuccccuauccacccagcc

SEQ ID NO: 3495394 - RNA, 13 nt, Human
cuccccucacagc

SEQ ID NO: 3495395 - RNA, 15 nt, Human
cuccccucacagccu

SEQ ID NO: 3495396 - RNA, 19 nt, Human
cuccccucacagccucuga

SEQ ID NO: 3495397 - RNA, 13 nt, Human
cuccccucagagu

SEQ ID NO: 3495398 - RNA, 16 nt, Human
cuccccucagagugca

SEQ ID NO: 3495399 - RNA, 15 nt, Human
cuccccuccaucccu

SEQ ID NO: 3495400 - RNA, 19 nt, Human
cuccccuccaucccuggcc

SEQ ID NO: 3495401 - RNA, 16 nt, Human
cuccccuccccaacug

SEQ ID NO: 3495402 - RNA, 14 nt, Human
cuccccucccuccu

SEQ ID NO: 3495403 - RNA, 24 nt, Human
cuccccuccggacuggugcccucc

SEQ ID NO: 3495404 - RNA, 12 nt, Human
cuccccuccucu

SEQ ID NO: 3495405 - RNA, 20 nt, Human
cuccccuccucugcuugcca

SEQ ID NO: 3495406 - RNA, 20 nt, Human
cuccccuccuugccuccugu

SEQ ID NO: 3495407 - RNA, 12 nt, Human
cuccccucucuu

SEQ ID NO: 3495408 - RNA, 14 nt, Human
cuccccucugcugg

SEQ ID NO: 3495409 - RNA, 16 nt, Human
cuccccucugcuggcc

SEQ ID NO: 3495410 - RNA, 15 nt, Human
cuccccucuuccucu

SEQ ID NO: 3495411 - RNA, 16 nt, Human
cuccccucuuccucuu

SEQ ID NO: 3495412 - RNA, 11 nt, Human
cuccccugagg

SEQ ID NO: 3495413 - RNA, 22 nt, Human
cuccccugaggcucagggaaag

SEQ ID NO: 3495414 - RNA, 18 nt, Human
cuccccugcacuguaaaa

SEQ ID NO: 3495415 - RNA, 21 nt, Human
cuccccugcacuguaaaaugu

SEQ ID NO: 3495416 - RNA, 21 nt, Human
cuccccugccagggcagggcc

SEQ ID NO: 3495417 - RNA, 14 nt, Human
cuccccugccauuu

SEQ ID NO: 3495418 - RNA, 13 nt, Human
cuccccugccccc

SEQ ID NO: 3495419 - RNA, 14 nt, Human
cuccccugccccca

SEQ ID NO: 3495420 - RNA, 20 nt, Human
cuccccugcccccaggacug

SEQ ID NO: 3495421 - RNA, 23 nt, Human
cuccccugcccccaggacugggc

SEQ ID NO: 3495422 - RNA, 13 nt, Human
cuccccugcccug

SEQ ID NO: 3495423 - RNA, 14 nt, Human
cuccccugccuugc

SEQ ID NO: 3495424 - RNA, 18 nt, Human
cuccccugcugcaggggc

SEQ ID NO: 3495425 - RNA, 13 nt, Human
cuccccugcuggg

SEQ ID NO: 3495426 - RNA, 23 nt, Human
cuccccugcuggguguggcgcag

SEQ ID NO: 3495427 - RNA, 22 nt, Human
cuccccuggaacugucucucau

SEQ ID NO: 3495428 - RNA, 14 nt, Human
cuccccugugccag

SEQ ID NO: 3495429 - RNA, 16 nt, Human
cuccccugugccagcc

SEQ ID NO: 3495430 - RNA, 22 nt, Human
cuccccuguuccccucucccuu

SEQ ID NO: 3495431 - RNA, 16 nt, Human
cuccccuucacuccca

SEQ ID NO: 3495432 - RNA, 19 nt, Human
cuccccuuccucacugccc

SEQ ID NO: 3495433 - RNA, 23 nt, Human
cuccccuugauuuaaacacacag

SEQ ID NO: 3495434 - RNA, 15 nt, Human
cuccccuugccagcu

SEQ ID NO: 3495435 - RNA, 16 nt, Human
cuccccuugccagcug

SEQ ID NO: 3495436 - RNA, 12 nt, Human
cuccccuugggc

SEQ ID NO: 3495437 - RNA, 20 nt, Human
cucccgaauagcugggacua

SEQ ID NO: 3495438 - RNA, 18 nt, Human
cucccgagcuccucuucc

SEQ ID NO: 3495439 - RNA, 16 nt, Human
cucccgaguagcuggg

SEQ ID NO: 3495440 - RNA, 17 nt, Human
cucccgaguagcuggga

SEQ ID NO: 3495441 - RNA, 21 nt, Human
cucccgccccccacacuuccc

SEQ ID NO: 3495442 - RNA, 22 nt, Human
cucccgccccccacacuucccu

SEQ ID NO: 3495443 - RNA, 23 nt, Human
cucccgccuccaaccccucgccc

SEQ ID NO: 3495444 - RNA, 11 nt, Human
cucccgcggug

SEQ ID NO: 3495445 - RNA, 15 nt, Human
cucccgcugcugcug

SEQ ID NO: 3495446 - RNA, 16 nt, Human
cucccgcugcugcugc

SEQ ID NO: 3495447 - RNA, 22 nt, Human
cucccggaauuccgucaccacg

SEQ ID NO: 3495448 - RNA, 15 nt, Human
cucccggagggcccu

SEQ ID NO: 3495449 - RNA, 16 nt, Human
cucccggcccugccug

SEQ ID NO: 3495450 - RNA, 18 nt, Human
cucccggcccugccugcu

SEQ ID NO: 3495451 - RNA, 16 nt, Human
cucccggcguggugga

SEQ ID NO: 3495452 - RNA, 20 nt, Human
cucccggcuaugggggcacu

SEQ ID NO: 3495453 - RNA, 16 nt, Human
cucccgggacucacug

SEQ ID NO: 3495454 - RNA, 16 nt, Human
cucccgggcccucccu

SEQ ID NO: 3495455 - RNA, 19 nt, Human
cucccgggcccucccuugg

SEQ ID NO: 3495456 - RNA, 15 nt, Human
cucccggggcagggc

SEQ ID NO: 3495457 - RNA, 16 nt, Human
cucccggggcagggca

SEQ ID NO: 3495458 - RNA, 18 nt, Human
cucccggggcagggcagc

SEQ ID NO: 3495459 - RNA, 17 nt, Human
cucuacugaaugucauu

SEQ ID NO: 3495460 - RNA, 19 nt, Human
cucuacugggaaggcuacu

SEQ ID NO: 3495461 - RNA, 20 nt, Human
cucuacuuagcaugucccua

SEQ ID NO: 3495462 - RNA, 13 nt, Human
cucuacuucagga

SEQ ID NO: 3495463 - RNA, 15 nt, Human
cucuacuuuccaggc

SEQ ID NO: 3495464 - RNA, 13 nt, Human
cucuacuuugagg

SEQ ID NO: 3495465 - RNA, 15 nt, Human
cucuagaauuuuaag

SEQ ID NO: 3495466 - RNA, 16 nt, Human
cucuagacacugccac

SEQ ID NO: 3495467 - RNA, 22 nt, Human
cucuagagcagacuacagcugg

SEQ ID NO: 3495468 - RNA, 23 nt, Human
cucuagaguagagguauaauugu

SEQ ID NO: 3495469 - RNA, 13 nt, Human
cucuagaguccaa

SEQ ID NO: 3495470 - RNA, 19 nt, Human
cucuagauaccuaaaacau

SEQ ID NO: 3495471 - RNA, 21 nt, Human
cucuagauaccuaaaacauaa

SEQ ID NO: 3495472 - RNA, 16 nt, Human
cucuagaugagcuggg

SEQ ID NO: 3495473 - RNA, 12 nt, Human
cucuagauucca

SEQ ID NO: 3495474 - RNA, 19 nt, Human
cucuagcagcaccuccugu

SEQ ID NO: 3495475 - RNA, 21 nt, Human
cucuagccggagugacagagu

SEQ ID NO: 3495476 - RNA, 11 nt, Human
cucuagcugaa

SEQ ID NO: 3495477 - RNA, 18 nt, Human
cucuagcuggugguuuca

SEQ ID NO: 3495478 - RNA, 17 nt, Human
cucuaggaaauauuuau

SEQ ID NO: 3495479 - RNA, 18 nt, Human
cucuagggaaggccaccu

SEQ ID NO: 3495480 - RNA, 19 nt, Human
cucuagggaaggccaccug

SEQ ID NO: 3495481 - RNA, 20 nt, Human
cucuagggaaggccaccugc

SEQ ID NO: 3495482 - RNA, 22 nt, Human
cucuagggaaggccaccugcag

SEQ ID NO: 3495483 - RNA, 18 nt, Human
cucuagggaccagaacca

SEQ ID NO: 3495484 - RNA, 16 nt, Human
cucuagggaccccucc

SEQ ID NO: 3495485 - RNA, 19 nt, Human
cucuagggaccccuccucc

SEQ ID NO: 3495486 - RNA, 17 nt, Human
cucuaggggucaggcuc

SEQ ID NO: 3495487 - RNA, 12 nt, Human
cucuagggucca

SEQ ID NO: 3495488 - RNA, 17 nt, Human
cucuaguaguuaaaaaa

SEQ ID NO: 3495489 - RNA, 16 nt, Human
ccccaggacugggcca

SEQ ID NO: 3495490 - RNA, 22 nt, Human
ccccaggacugggccacuucug

SEQ ID NO: 3495491 - RNA, 13 nt, Human
ccccaggaggcca

SEQ ID NO: 3495492 - RNA, 14 nt, Human
ccccaggcaggcug

SEQ ID NO: 3495493 - RNA, 12 nt, Human
ccccaggccagg

SEQ ID NO: 3495494 - RNA, 13 nt, Human
ccccaggccaggc

SEQ ID NO: 3495495 - RNA, 15 nt, Human
ccccaggccaggcca

SEQ ID NO: 3495496 - RNA, 22 nt, Human
ccccaggccaggccaccaggau

SEQ ID NO: 3495497 - RNA, 11 nt, Human
ccccaggccca

SEQ ID NO: 3495498 - RNA, 17 nt, Human
ccccaggcccacucagg

SEQ ID NO: 3495499 - RNA, 12 nt, Human
ccccaggcccca

SEQ ID NO: 3495500 - RNA, 18 nt, Human
ccccaggccccaggaagc

SEQ ID NO: 3495501 - RNA, 13 nt, Human
ccccaggccccga

SEQ ID NO: 3495502 - RNA, 23 nt, Human
ccccaggccugaaagaggcugag

SEQ ID NO: 3495503 - RNA, 15 nt, Human
ccccaggcucgugga

SEQ ID NO: 3495504 - RNA, 11 nt, Human
ccccagggcac

SEQ ID NO: 3495505 - RNA, 15 nt, Human
ccccagggcacagga

SEQ ID NO: 3495506 - RNA, 22 nt, Human
ccccagggcacaggagcuaccu

SEQ ID NO: 3495507 - RNA, 14 nt, Human
ccccagggcacccu

SEQ ID NO: 3495508 - RNA, 15 nt, Human
ccccagggcacccug

SEQ ID NO: 3495509 - RNA, 12 nt, Human
ccccagggcacu

SEQ ID NO: 3495510 - RNA, 22 nt, Human
ccccagggcagccagggagagc

SEQ ID NO: 3495511 - RNA, 13 nt, Human
cuccuucccucuc

SEQ ID NO: 3495512 - RNA, 17 nt, Human
cuccuucccucucugga

SEQ ID NO: 3495513 - RNA, 18 nt, Human
cuccuucccucucuggag

SEQ ID NO: 3495514 - RNA, 14 nt, Human
cuccuucccuuccu

SEQ ID NO: 3495515 - RNA, 21 nt, Human
cuccuuccugccaccugcugc

SEQ ID NO: 3495516 - RNA, 13 nt, Human
cuccuuccugccc

SEQ ID NO: 3495517 - RNA, 23 nt, Human
cuccuuccuggagcccagaggag

SEQ ID NO: 3495518 - RNA, 12 nt, Human
cuccuuccuggc

SEQ ID NO: 3495519 - RNA, 12 nt, Human
cuccuuccuguc

SEQ ID NO: 3495520 - RNA, 16 nt, Human
cuccuuccugucuucc

SEQ ID NO: 3495521 - RNA, 13 nt, Human
cuccuuccugugu

SEQ ID NO: 3495522 - RNA, 23 nt, Human
cuccuuccuuacccaaacuguuc

SEQ ID NO: 3495523 - RNA, 17 nt, Human
cuccuuccuugaccagc

SEQ ID NO: 3495524 - RNA, 19 nt, Human
cuccuucguaucccgaguc

SEQ ID NO: 3495525 - RNA, 22 nt, Human
cuccuucguaucccgagucugg

SEQ ID NO: 3495526 - RNA, 20 nt, Human
cuccuucucugucucaugug

SEQ ID NO: 3495527 - RNA, 23 nt, Human
cuccuucugagcuccuguccccu

SEQ ID NO: 3495528 - RNA, 15 nt, Human
cuccuucuguccuac

SEQ ID NO: 3495529 - RNA, 19 nt, Human
cuccuugaguguaugagua

SEQ ID NO: 3495530 - RNA, 18 nt, Human
cuccuugauaacagcuac

SEQ ID NO: 3495531 - RNA, 22 nt, Human
cuccuugauauuuguauuuauu

SEQ ID NO: 3495532 - RNA, 21 nt, Human
cuccuugauuuuagccuucuc

SEQ ID NO: 3495533 - RNA, 13 nt, Human
cuccuugcaguuc

SEQ ID NO: 3495534 - RNA, 18 nt, Human
cuccuugccuccugugua

SEQ ID NO: 3495535 - RNA, 17 nt, Human
cuccuugcucugcaggc

SEQ ID NO: 3495536 - RNA, 13 nt, Human
cuccuuggaaauc

SEQ ID NO: 3495537 - RNA, 10 nt, Human
cuccuuggcc

SEQ ID NO: 3495538 - RNA, 17 nt, Human
cuccuuggcuuaccuga

SEQ ID NO: 3495539 - RNA, 14 nt, Human
cuccuugggaggaa

SEQ ID NO: 3495540 - RNA, 19 nt, Human
cuccuugggaggaagcaga

SEQ ID NO: 3495541 - RNA, 23 nt, Human
cuccuugggaggaagcagaauaa

SEQ ID NO: 3495542 - RNA, 16 nt, Human
cuccuugggaggcccc

SEQ ID NO: 3495543 - RNA, 17 nt, Human
cuccuugggaggcccca

SEQ ID NO: 3495544 - RNA, 21 nt, Human
cuccuugggcacuuuuuaauu

SEQ ID NO: 3495545 - RNA, 12 nt, Human
cuccuugggccc

SEQ ID NO: 3495546 - RNA, 17 nt, Human
cuccuugggcccuuuga

SEQ ID NO: 3495547 - RNA, 14 nt, Human
cuccuuggugccug

SEQ ID NO: 3495548 - RNA, 16 nt, Human
cuccuuguaaagacug

SEQ ID NO: 3495549 - RNA, 19 nt, Human
cuccuugugggccugggcu

SEQ ID NO: 3495550 - RNA, 14 nt, Human
cuccuuguuccuag

SEQ ID NO: 3495551 - RNA, 15 nt, Human
cuccuuguuccuaga

SEQ ID NO: 3495552 - RNA, 15 nt, Human
cuccuuuacccucau

SEQ ID NO: 3495553 - RNA, 17 nt, Human
cuccuuuacccucaucu

SEQ ID NO: 3495554 - RNA, 17 nt, Human
cuccuuucacaaccuuc

SEQ ID NO: 3495555 - RNA, 16 nt, Human
cuccuuucugugcccu

SEQ ID NO: 3495556 - RNA, 17 nt, Human
cuccuuucugugcccua

SEQ ID NO: 3495557 - RNA, 14 nt, Human
cuccuuucuuucua

SEQ ID NO: 3495558 - RNA, 19 nt, Human
cuccuuucuuuuucuucuu

SEQ ID NO: 3495559 - RNA, 21 nt, Human
cuccuuucuuuuucuucuucc

SEQ ID NO: 3495560 - RNA, 15 nt, Human
cuccuuugcacugag

SEQ ID NO: 3495561 - RNA, 16 nt, Human
cuccuuugcacugagg

SEQ ID NO: 3495562 - RNA, 20 nt, Human
cuccuuugcacugagggcca

SEQ ID NO: 3495563 - RNA, 17 nt, Human
cuccuuuggccauucca

SEQ ID NO: 3495564 - RNA, 17 nt, Human
cuccuuuguacuuugug

SEQ ID NO: 3495565 - RNA, 20 nt, Human
cuccuuuguacuuugugcuu

SEQ ID NO: 3495566 - RNA, 13 nt, Human
cuccuuuguauau

SEQ ID NO: 3495567 - RNA, 17 nt, Human
cuccuuuguauucuguc

SEQ ID NO: 3495568 - RNA, 19 nt, Human
cuccuuuguauucugucuu

SEQ ID NO: 3495569 - RNA, 12 nt, Human
cuccuuuuaugu

SEQ ID NO: 3495570 - RNA, 15 nt, Human
cuccuuuuaugugua

SEQ ID NO: 3495571 - RNA, 13 nt, Human
cuccuuuucccaa

SEQ ID NO: 3495572 - RNA, 11 nt, Human
cuccuuuucuu

SEQ ID NO: 3495573 - RNA, 15 nt, Human
cuccuuuuucucccu

SEQ ID NO: 3495574 - RNA, 18 nt, Human
cuccuuuuucucccucug

SEQ ID NO: 3495575 - RNA, 19 nt, Human
cuccuuuuucucccucugg

SEQ ID NO: 3495576 - RNA, 17 nt, Human
cucgaacuccugaccuu

SEQ ID NO: 3495577 - RNA, 17 nt, Human
cucgaacuccugggcuc

SEQ ID NO: 3495578 - RNA, 13 nt, Human
cucgaacuggcug

SEQ ID NO: 3495579 - RNA, 12 nt, Human
cucgaauuuugu

SEQ ID NO: 3495580 - RNA, 21 nt, Human
cucgagacacagugaagcaaa

SEQ ID NO: 3495581 - RNA, 16 nt, Human
cucgagcaugccugga

SEQ ID NO: 3495582 - RNA, 17 nt, Human
cucgagcgcccugcaga

SEQ ID NO: 3495583 - RNA, 23 nt, Human
cucgagcgcccugcagacccugc

SEQ ID NO: 3495584 - RNA, 16 nt, Human
cucgaggacuguauuu

SEQ ID NO: 3495585 - RNA, 22 nt, Human
cucgaggacuguauuugugacu

SEQ ID NO: 3495586 - RNA, 14 nt, Human
cucgaggggugggc

SEQ ID NO: 3495587 - RNA, 16 nt, Human
cucgaggggugggcug

SEQ ID NO: 3495588 - RNA, 17 nt, Human
cucgaggggugggcugg

SEQ ID NO: 3495589 - RNA, 13 nt, Human
cucgaggugccuu

SEQ ID NO: 3495590 - RNA, 14 nt, Human
cucgaggugccuuc

SEQ ID NO: 3495591 - RNA, 15 nt, Human
cucgaggugccuucu

SEQ ID NO: 3495592 - RNA, 17 nt, Human
cucgaguacugugggca

SEQ ID NO: 3495593 - RNA, 18 nt, Human
cucgaguacugugggcaa

SEQ ID NO: 3495594 - RNA, 20 nt, Human
cucgaguuacagacaaagcg

SEQ ID NO: 3495595 - RNA, 14 nt, Human
cucgauccaaauug

SEQ ID NO: 3495596 - RNA, 24 nt, Human
cucgauguggucacagcuguauag

SEQ ID NO: 3495597 - RNA, 19 nt, Human
cucgauguguacucuaacu

SEQ ID NO: 3495598 - RNA, 14 nt, Human
cucgauuucuccag

SEQ ID NO: 3495599 - RNA, 14 nt, Human
cucgauuuuguauc

SEQ ID NO: 3495600 - RNA, 15 nt, Human
cucgauuuuguaucu

SEQ ID NO: 3495601 - RNA, 16 nt, Human
cucgauuuuguaucug

SEQ ID NO: 3495602 - RNA, 23 nt, Human
cucgcaaaaacguaucuccuaau

SEQ ID NO: 3495603 - RNA, 12 nt, Human
cucgcaggaaga

SEQ ID NO: 3495604 - RNA, 13 nt, Human
cucgcaggaagac

SEQ ID NO: 3495605 - RNA, 18 nt, Human
cucgcaggccucccugcc

SEQ ID NO: 3495606 - RNA, 18 nt, Human
cucgcauaggaccuuucc

SEQ ID NO: 3495607 - RNA, 14 nt, Human
cucgcaucauugca

SEQ ID NO: 3495608 - RNA, 21 nt, Human
cucgcauuugucaaugacagu

SEQ ID NO: 3495609 - RNA, 22 nt, Human
cucgcauuugucaaugacaguu

SEQ ID NO: 3495610 - RNA, 22 nt, Human
cucgccaagcaggacagugcuu

SEQ ID NO: 3495611 - RNA, 19 nt, Human
cucgccaccccuccuuccu

SEQ ID NO: 3495612 - RNA, 23 nt, Human
cucgcccaccgcaugcccccucg

SEQ ID NO: 3495613 - RNA, 16 nt, Human
cucgcccagucccagc

SEQ ID NO: 3495614 - RNA, 14 nt, Human
cucgcccgcccacu

SEQ ID NO: 3495615 - RNA, 15 nt, Human
cucgcccgcccacug

SEQ ID NO: 3495616 - RNA, 16 nt, Human
cucgcccgcccacugu

SEQ ID NO: 3495617 - RNA, 20 nt, Human
cucgcccgcccacuguccug

SEQ ID NO: 3495618 - RNA, 14 nt, Human
cucgcccggaaccc

SEQ ID NO: 3495619 - RNA, 15 nt, Human
cucgcccuccuuucu

SEQ ID NO: 3495620 - RNA, 17 nt, Human
cucgcccuccuuucugu

SEQ ID NO: 3495621 - RNA, 20 nt, Human
cucgcccugcgguagauggg

SEQ ID NO: 3495622 - RNA, 13 nt, Human
cucgcccuggguc

SEQ ID NO: 3495623 - RNA, 20 nt, Human
cucgccggacccucuaaccu

SEQ ID NO: 3495624 - RNA, 23 nt, Human
cucgccugacaaccacuggucug

SEQ ID NO: 3495625 - RNA, 16 nt, Human
cucgccuggccugagg

SEQ ID NO: 3495626 - RNA, 20 nt, Human
cucgccuggccugaggucuc

SEQ ID NO: 3495627 - RNA, 13 nt, Human
cucgccuucccuc

SEQ ID NO: 3495628 - RNA, 16 nt, Human
cucgccuucccuccug

SEQ ID NO: 3495629 - RNA, 20 nt, Human
cucgccuucccuccugcuuu

SEQ ID NO: 3495630 - RNA, 16 nt, Human
cucgcgcuugcuggcc

SEQ ID NO: 3495631 - RNA, 21 nt, Human
cucgcggccucuucucucaga

SEQ ID NO: 3495632 - RNA, 22 nt, Human
cucgcuagcaguggcaggcaga

SEQ ID NO: 3495633 - RNA, 17 nt, Human
cucgcuccaacuccaac

SEQ ID NO: 3495634 - RNA, 24 nt, Human
cucgcuccaacuccaacauccacu

SEQ ID NO: 3495635 - RNA, 22 nt, Human
cucuguauuugaaucagccuac

SEQ ID NO: 3495636 - RNA, 15 nt, Human
cucuguauuuuuucu

SEQ ID NO: 3495637 - RNA, 20 nt, Human
cucuguauuuuuucuugcau

SEQ ID NO: 3495638 - RNA, 13 nt, Human
cucugucaggccu

SEQ ID NO: 3495639 - RNA, 17 nt, Human
cucugucagucacagcc

SEQ ID NO: 3495640 - RNA, 19 nt, Human
cucugucagucacagccac

SEQ ID NO: 3495641 - RNA, 14 nt, Human
cucuguccagggcc

SEQ ID NO: 3495642 - RNA, 17 nt, Human
cucuguccauuuaucca

SEQ ID NO: 3495643 - RNA, 21 nt, Human
cucuguccauuuauccacagg

SEQ ID NO: 3495644 - RNA, 22 nt, Human
cucugucccacuuggcaucagc

SEQ ID NO: 3495645 - RNA, 14 nt, Human
cucuguccccagcc

SEQ ID NO: 3495646 - RNA, 16 nt, Human
cucuguccccagccug

SEQ ID NO: 3495647 - RNA, 21 nt, Human
cucuguccccuucucucaucu

SEQ ID NO: 3495648 - RNA, 11 nt, Human
cucuguccuga

SEQ ID NO: 3495649 - RNA, 22 nt, Human
cucuguccugaaggccugaggu

SEQ ID NO: 3495650 - RNA, 15 nt, Human
cucuguccugcuucu

SEQ ID NO: 3495651 - RNA, 14 nt, Human
cucuguccugggag

SEQ ID NO: 3495652 - RNA, 19 nt, Human
cucugucgcccagucugga

SEQ ID NO: 3495653 - RNA, 20 nt, Human
cucugucuaccaucucccuc

SEQ ID NO: 3495654 - RNA, 21 nt, Human
cucugucuaccaucucccucg

SEQ ID NO: 3495655 - RNA, 15 nt, Human
cucugucuagcaugc

SEQ ID NO: 3495656 - RNA, 20 nt, Human
cucugucuagcaugccaaca

SEQ ID NO: 3495657 - RNA, 23 nt, Human
cucugucucagacuuuuguacau

SEQ ID NO: 3495658 - RNA, 14 nt, Human
cucugucucaucca

SEQ ID NO: 3495659 - RNA, 14 nt, Human
cucugucucaugug

SEQ ID NO: 3495660 - RNA, 22 nt, Human
cucugucuccuaagcuggagug

SEQ ID NO: 3495661 - RNA, 13 nt, Human
cucugucucgagc

SEQ ID NO: 3495662 - RNA, 20 nt, Human
cucugucucgagcgcccugc

SEQ ID NO: 3495663 - RNA, 21 nt, Human
cucugucucgagcgcccugca

SEQ ID NO: 3495664 - RNA, 23 nt, Human
cucugucucgagcgcccugcaga

SEQ ID NO: 3495665 - RNA, 14 nt, Human
cucugucugcccuu

SEQ ID NO: 3495666 - RNA, 15 nt, Human
ccccagggccugagc

SEQ ID NO: 3495667 - RNA, 19 nt, Human
ccccagggccugagccugg

SEQ ID NO: 3495668 - RNA, 20 nt, Human
ccccaggggaaagaugagcu

SEQ ID NO: 3495669 - RNA, 22 nt, Human
ccccagggggucucacccaugc

SEQ ID NO: 3495670 - RNA, 17 nt, Human
ccccaggggucccagcc

SEQ ID NO: 3495671 - RNA, 19 nt, Human
ccccaggggucccagccac

SEQ ID NO: 3495672 - RNA, 19 nt, Human
ccccagggucuucccuacc

SEQ ID NO: 3495673 - RNA, 17 nt, Human
ccccagguccagcucug

SEQ ID NO: 3495674 - RNA, 22 nt, Human
ccccagguccagcucuggaggg

SEQ ID NO: 3495675 - RNA, 14 nt, Human
ccccaggugccagu

SEQ ID NO: 3495676 - RNA, 23 nt, Human
ccccagguggcugacccaguccc

SEQ ID NO: 3495677 - RNA, 17 nt, Human
ccccaguagcugggacc

SEQ ID NO: 3495678 - RNA, 14 nt, Human
ccccagucagccuc

SEQ ID NO: 3495679 - RNA, 21 nt, Human
ccccagucagccucucuccca

SEQ ID NO: 3495680 - RNA, 23 nt, Human
ccccagucagccucucucccagu

SEQ ID NO: 3495681 - RNA, 19 nt, Human
ccccaguccccaccccugc

SEQ ID NO: 3495682 - RNA, 14 nt, Human
ccccagugcccaca

SEQ ID NO: 3495683 - RNA, 15 nt, Human
ccccaguucugcucc

SEQ ID NO: 3495684 - RNA, 16 nt, Human
ccccaguucugcuccu

SEQ ID NO: 3495685 - RNA, 23 nt, Human
ccccaguuugcagaaaagcaccu

SEQ ID NO: 3495686 - RNA, 22 nt, Human
ccccauaauuuuuuuuuuccuu

SEQ ID NO: 3495687 - RNA, 12 nt, Human
ccccauagccac

SEQ ID NO: 3495688 - RNA, 14 nt, Human
ccccauauggucau

SEQ ID NO: 3495689 - RNA, 14 nt, Human
ccccaucagugcuc

SEQ ID NO: 3495690 - RNA, 14 nt, Human
ccccaucccaugcu

SEQ ID NO: 3495691 - RNA, 15 nt, Human
ccccauccuggccca

SEQ ID NO: 3495692 - RNA, 22 nt, Human
ccccaucgccagcugaugacuc

SEQ ID NO: 3495693 - RNA, 21 nt, Human
ccccaucucaugccccuggcu

SEQ ID NO: 3495694 - RNA, 13 nt, Human
ccccaucucccug

SEQ ID NO: 3495695 - RNA, 12 nt, Human
ccccaucucucc

SEQ ID NO: 3495696 - RNA, 16 nt, Human
ccccaucucucccucc

SEQ ID NO: 3495697 - RNA, 19 nt, Human
ccccaucucucccuccccu

SEQ ID NO: 3495698 - RNA, 24 nt, Human
ccccaucugcgggggcagugcuca

SEQ ID NO: 3495699 - RNA, 14 nt, Human
ccccaucugggucc

SEQ ID NO: 3495700 - RNA, 16 nt, Human
ccccaucuucacccag

SEQ ID NO: 3495701 - RNA, 18 nt, Human
ccccaucuucgggaccag

SEQ ID NO: 3495702 - RNA, 18 nt, Human
ccccaugaggaaggaaca

SEQ ID NO: 3495703 - RNA, 18 nt, Human
ccccaugccuguccagcc

SEQ ID NO: 3495704 - RNA, 24 nt, Human
ccccaugccuguccagccugggca

SEQ ID NO: 3495705 - RNA, 18 nt, Human
ccccaugccuguggcugc

SEQ ID NO: 3495706 - RNA, 13 nt, Human
ccccaugcuggcc

SEQ ID NO: 3495707 - RNA, 17 nt, Human
ccccaugcuuccuugcc

SEQ ID NO: 3495708 - RNA, 24 nt, Human
ccccaugcuuccuugccugaugac

SEQ ID NO: 3495709 - RNA, 17 nt, Human
ccccaugucucucagaa

SEQ ID NO: 3495710 - RNA, 14 nt, Human
ccccaugugccugc

SEQ ID NO: 3495711 - RNA, 18 nt, Human
ccccauguguccugguuc

SEQ ID NO: 3495712 - RNA, 19 nt, Human
ccccauguuguaaugcugc

SEQ ID NO: 3495713 - RNA, 20 nt, Human
ccccauguuguaaugcugca

SEQ ID NO: 3495714 - RNA, 23 nt, Human
ccccauguuguaaugcugcacuu

SEQ ID NO: 3495715 - RNA, 13 nt, Human
ccccauucccgca

SEQ ID NO: 3495716 - RNA, 22 nt, Human
ccccauucgcgcucugcucagu

SEQ ID NO: 3495717 - RNA, 21 nt, Human
ccccauucuuccuaguuuucu

SEQ ID NO: 3495718 - RNA, 21 nt, Human
ccccauucuuugcuugaacac

SEQ ID NO: 3495719 - RNA, 15 nt, Human
ccccauuguggucac

SEQ ID NO: 3495720 - RNA, 18 nt, Human
ccccauuuagguuucuga

SEQ ID NO: 3495721 - RNA, 14 nt, Human
ccccauuucugagg

SEQ ID NO: 3495722 - RNA, 24 nt, Human
cccccaaagauagacagguccuga

SEQ ID NO: 3495723 - RNA, 22 nt, Human
cccccaaagcagcccuuccccc

SEQ ID NO: 3495724 - RNA, 12 nt, Human
cccccaaagugg

SEQ ID NO: 3495725 - RNA, 21 nt, Human
cccccaacacugugcccuggu

SEQ ID NO: 3495726 - RNA, 20 nt, Human
cccccaacucugagcccaug

SEQ ID NO: 3495727 - RNA, 19 nt, Human
cccccaagcuguuuucuuc

SEQ ID NO: 3495728 - RNA, 19 nt, Human
cccccacacacacacacau

SEQ ID NO: 3495729 - RNA, 17 nt, Human
cccccacaccucaguuc

SEQ ID NO: 3495730 - RNA, 14 nt, Human
cccccacaccuggc

SEQ ID NO: 3495731 - RNA, 18 nt, Human
cccccacaccuggcccug

SEQ ID NO: 3495732 - RNA, 16 nt, Human
cccccacagugcuguc

SEQ ID NO: 3495733 - RNA, 16 nt, Human
cccccacauggugaug

SEQ ID NO: 3495734 - RNA, 24 nt, Human
cccccacccaagggccuggccuga

SEQ ID NO: 3495735 - RNA, 12 nt, Human
cccccacccccu

SEQ ID NO: 3495736 - RNA, 15 nt, Human
cccccaccccuuccc

SEQ ID NO: 3495737 - RNA, 18 nt, Human
cccccacccuguuccugc

SEQ ID NO: 3495738 - RNA, 12 nt, Human
cccccacccuuu

SEQ ID NO: 3495739 - RNA, 20 nt, Human
cccccaccucugcugccucc

SEQ ID NO: 3495740 - RNA, 20 nt, Human
cccccaccuggcucaccuug

SEQ ID NO: 3495741 - RNA, 14 nt, Human
cccccacuccagcu

SEQ ID NO: 3495742 - RNA, 14 nt, Human
cccccacucccuca

SEQ ID NO: 3495743 - RNA, 21 nt, Human
cccccacucucauuccccagg

SEQ ID NO: 3495744 - RNA, 22 nt, Human
cccccagaaccuguccuugcac

SEQ ID NO: 3495745 - RNA, 15 nt, Human
cccccagagccacag

SEQ ID NO: 3495746 - RNA, 16 nt, Human
cccccagagcccaggc

SEQ ID NO: 3495747 - RNA, 23 nt, Human
cccccagagcccaggcucggccu

SEQ ID NO: 3495748 - RNA, 20 nt, Human
cccccagccaugccagcugg

SEQ ID NO: 3495749 - RNA, 23 nt, Human
cccccagccaugccagcuggccu

SEQ ID NO: 3495750 - RNA, 14 nt, Human
cccccagcccaggg

SEQ ID NO: 3495751 - RNA, 12 nt, Human
cccccagcccca

SEQ ID NO: 3495752 - RNA, 14 nt, Human
cccccagcccugug

SEQ ID NO: 3495753 - RNA, 12 nt, Human
cccccagccuau

SEQ ID NO: 3495754 - RNA, 20 nt, Human
cccccagccuaugagcaucc

SEQ ID NO: 3495755 - RNA, 15 nt, Human
cccccagccugggcc

SEQ ID NO: 3495756 - RNA, 13 nt, Human
cccccagccuguc

SEQ ID NO: 3495757 - RNA, 12 nt, Human
cccccagcuccc

SEQ ID NO: 3495758 - RNA, 12 nt, Human
cccccagcucug

SEQ ID NO: 3495759 - RNA, 19 nt, Human
cccccagcuucacuucuga

SEQ ID NO: 3495760 - RNA, 18 nt, Human
cccccaggguccugggag

SEQ ID NO: 3495761 - RNA, 20 nt, Human
cccccagguuccgaagaaga

SEQ ID NO: 3495762 - RNA, 15 nt, Human
cccccaguccccacc

SEQ ID NO: 3495763 - RNA, 16 nt, Human
cccccaucauccucug

SEQ ID NO: 3495764 - RNA, 17 nt, Human
cccccauccuggcccau

SEQ ID NO: 3495765 - RNA, 16 nt, Human
cccccaucuucgggac

SEQ ID NO: 3495766 - RNA, 22 nt, Human
cccccauguuguaaugcugcac

SEQ ID NO: 3495767 - RNA, 20 nt, Human
cccccauucucaucugcacc

SEQ ID NO: 3495768 - RNA, 21 nt, Human
ccccccaagggaggcugcugc

SEQ ID NO: 3495769 - RNA, 17 nt, Human
ccccccacacuucccug

SEQ ID NO: 3495770 - RNA, 12 nt, Human
ccccccaccccu

SEQ ID NO: 3495771 - RNA, 13 nt, Human
ccccccaccccug

SEQ ID NO: 3495772 - RNA, 12 nt, Human
ccccccagccuc

SEQ ID NO: 3495773 - RNA, 13 nt, Human
ccccccagccucu

SEQ ID NO: 3495774 - RNA, 12 nt, Human
ccccccagcuca

SEQ ID NO: 3495775 - RNA, 13 nt, Human
cccccccuuccac

SEQ ID NO: 3495776 - RNA, 12 nt, Human
ccccccucccag

SEQ ID NO: 3495777 - RNA, 12 nt, Human
ccccccugucac

SEQ ID NO: 3495778 - RNA, 11 nt, Human
ccccccuucca

SEQ ID NO: 3495779 - RNA, 13 nt, Human
ccccccuuccacu

SEQ ID NO: 3495780 - RNA, 14 nt, Human
cucuucccuucaac

SEQ ID NO: 3495781 - RNA, 14 nt, Human
cucuucccuuuccc

SEQ ID NO: 3495782 - RNA, 22 nt, Human
cucuuccgaaaaauccucuucc

SEQ ID NO: 3495783 - RNA, 19 nt, Human
cucuuccggagauguagca

SEQ ID NO: 3495784 - RNA, 23 nt, Human
cucuuccggagauguagcaaaac

SEQ ID NO: 3495785 - RNA, 20 nt, Human
cucuuccuacccaaccacuc

SEQ ID NO: 3495786 - RNA, 19 nt, Human
cucuuccuacccugccucc

SEQ ID NO: 3495787 - RNA, 16 nt, Human
cucuuccuacuggucu

SEQ ID NO: 3495788 - RNA, 17 nt, Human
cucuuccuaucccaucc

SEQ ID NO: 3495789 - RNA, 20 nt, Human
cucuuccuaucccucuccua

SEQ ID NO: 3495790 - RNA, 12 nt, Human
cucuuccucuga

SEQ ID NO: 3495791 - RNA, 13 nt, Human
cucuuccucugag

SEQ ID NO: 3495792 - RNA, 14 nt, Human
cucuuccucuugac

SEQ ID NO: 3495793 - RNA, 17 nt, Human
cucuuccucuugacccu

SEQ ID NO: 3495794 - RNA, 19 nt, Human
cucuuccucuugacccugc

SEQ ID NO: 3495795 - RNA, 14 nt, Human
cucuuccugcaagg

SEQ ID NO: 3495796 - RNA, 14 nt, Human
cucuuccugccccu

SEQ ID NO: 3495797 - RNA, 16 nt, Human
cucuuccugccccucu

SEQ ID NO: 3495798 - RNA, 15 nt, Human
cucuuccuucccugc

SEQ ID NO: 3495799 - RNA, 16 nt, Human
cucuuccuuuuaucag

SEQ ID NO: 3495800 - RNA, 16 nt, Human
cucuucgaagccuugc

SEQ ID NO: 3495801 - RNA, 21 nt, Human
cucuucgcgcccgccccugca

SEQ ID NO: 3495802 - RNA, 14 nt, Human
cucuucuacucacu

SEQ ID NO: 3495803 - RNA, 21 nt, Human
cucuucuagaugauuuuuuga

SEQ ID NO: 3495804 - RNA, 15 nt, Human
cucuucucaagugcc

SEQ ID NO: 3495805 - RNA, 18 nt, Human
cucuucucauuacuuguu

SEQ ID NO: 3495806 - RNA, 12 nt, Human
cucuucucauuu

SEQ ID NO: 3495807 - RNA, 19 nt, Human
cucuucucauuucaccccu

SEQ ID NO: 3495808 - RNA, 14 nt, Human
cucuucuccacugg

SEQ ID NO: 3495809 - RNA, 12 nt, Human
cucuucuccagg

SEQ ID NO: 3495810 - RNA, 12 nt, Human
cucuucucccag

SEQ ID NO: 3495811 - RNA, 21 nt, Human
cucuucuccccuuccauuucu

SEQ ID NO: 3495812 - RNA, 16 nt, Human
cucuucuccuuucaca

SEQ ID NO: 3495813 - RNA, 13 nt, Human
cucuucucucaga

SEQ ID NO: 3495814 - RNA, 14 nt, Human
cucuucucucagac

SEQ ID NO: 3495815 - RNA, 14 nt, Human
cucuucucuccagc

SEQ ID NO: 3495816 - RNA, 22 nt, Human
cucuucucuccagcugacuaaa

SEQ ID NO: 3495817 - RNA, 17 nt, Human
cucuucucucugcucug

SEQ ID NO: 3495818 - RNA, 16 nt, Human
cucuucugaauaaagc

SEQ ID NO: 3495819 - RNA, 16 nt, Human
cucuucugacgugccu

SEQ ID NO: 3495820 - RNA, 15 nt, Human
cucuucugagcuauu

SEQ ID NO: 3495821 - RNA, 16 nt, Human
cucuucugcaucuugg

SEQ ID NO: 3495822 - RNA, 13 nt, Human
cucggagccucau

SEQ ID NO: 3495823 - RNA, 12 nt, Human
cucggaggcccc

SEQ ID NO: 3495824 - RNA, 15 nt, Human
cucggaggcugcccc

SEQ ID NO: 3495825 - RNA, 17 nt, Human
cucggaguaucugggaa

SEQ ID NO: 3495826 - RNA, 15 nt, Human
cucggaguucuucuu

SEQ ID NO: 3495827 - RNA, 18 nt, Human
cucggauaguugcuauuu

SEQ ID NO: 3495828 - RNA, 21 nt, Human
cucggcaacuaagcagucccu

SEQ ID NO: 3495829 - RNA, 16 nt, Human
cucggcccccuccauc

SEQ ID NO: 3495830 - RNA, 17 nt, Human
cucggcccccuccaucg

SEQ ID NO: 3495831 - RNA, 21 nt, Human
cucggccgucuucacucgccc

SEQ ID NO: 3495832 - RNA, 20 nt, Human
cucggccucccaaagugcug

SEQ ID NO: 3495833 - RNA, 13 nt, Human
cucggccugcccc

SEQ ID NO: 3495834 - RNA, 15 nt, Human
cucggccuggcuccu

SEQ ID NO: 3495835 - RNA, 22 nt, Human
cucggccuggucaggcccuggu

SEQ ID NO: 3495836 - RNA, 14 nt, Human
cucggcucacugca

SEQ ID NO: 3495837 - RNA, 13 nt, Human
cucggcucagcuc

SEQ ID NO: 3495838 - RNA, 22 nt, Human
cucggcucagugcaaccucugc

SEQ ID NO: 3495839 - RNA, 23 nt, Human
cucggcucagugcaaccucugcu

SEQ ID NO: 3495840 - RNA, 13 nt, Human
cucggcuccugcu

SEQ ID NO: 3495841 - RNA, 14 nt, Human
cucggcuccugcug

SEQ ID NO: 3495842 - RNA, 16 nt, Human
cucggcuccugcugca

SEQ ID NO: 3495843 - RNA, 17 nt, Human
cucggcuccuggacuca

SEQ ID NO: 3495844 - RNA, 22 nt, Human
cucggcuggcuccccugcagcc

SEQ ID NO: 3495845 - RNA, 13 nt, Human
cucgggcccaccu

SEQ ID NO: 3495846 - RNA, 17 nt, Human
cucgggcccaccuggcc

SEQ ID NO: 3495847 - RNA, 12 nt, Human
cucgggcccagc

SEQ ID NO: 3495848 - RNA, 14 nt, Human
cucgggcccagccc

SEQ ID NO: 3495849 - RNA, 16 nt, Human
cucgggcccagccccc

SEQ ID NO: 3495850 - RNA, 19 nt, Human
cucgggcgagucacugccu

SEQ ID NO: 3495851 - RNA, 21 nt, Human
cucgggcgagucacugccucu

SEQ ID NO: 3495852 - RNA, 22 nt, Human
cucgggcgagucacugccucuc

SEQ ID NO: 3495853 - RNA, 23 nt, Human
cucgggcugagaacccugcgugg

SEQ ID NO: 3495854 - RNA, 13 nt, Human
cucggggagccuu

SEQ ID NO: 3495855 - RNA, 16 nt, Human
cucggggauguguccu

SEQ ID NO: 3495856 - RNA, 16 nt, Human
cucggggugcacagga

SEQ ID NO: 3495857 - RNA, 17 nt, Human
cucggggugcacaggag

SEQ ID NO: 3495858 - RNA, 19 nt, Human
cucggggugcacaggaggg

SEQ ID NO: 3495859 - RNA, 14 nt, Human
cucggugggagcca

SEQ ID NO: 3495860 - RNA, 19 nt, Human
cucggugguaccaggucuc

SEQ ID NO: 3495861 - RNA, 16 nt, Human
cucgguguccccacca

SEQ ID NO: 3495862 - RNA, 15 nt, Human
cucgguuugccaaaa

SEQ ID NO: 3495863 - RNA, 13 nt, Human
cucguauagcaug

SEQ ID NO: 3495864 - RNA, 14 nt, Human
cucguauagcaugc

SEQ ID NO: 3495865 - RNA, 12 nt, Human
cucguccucccc

SEQ ID NO: 3495866 - RNA, 14 nt, Human
cucguccucccccu

SEQ ID NO: 3495867 - RNA, 15 nt, Human
cucguccucccccug

SEQ ID NO: 3495868 - RNA, 17 nt, Human
cucguccucccccugcc

SEQ ID NO: 3495869 - RNA, 18 nt, Human
cucguccucccccugcca

SEQ ID NO: 3495870 - RNA, 14 nt, Human
cucguccucguuug

SEQ ID NO: 3495871 - RNA, 19 nt, Human
cucguccucguuuguguuc

SEQ ID NO: 3495872 - RNA, 17 nt, Human
cucgucucuuuuacccu

SEQ ID NO: 3495873 - RNA, 14 nt, Human
cucgucuucauuaa

SEQ ID NO: 3495874 - RNA, 18 nt, Human
cucgugauuggcauauaa

SEQ ID NO: 3495875 - RNA, 16 nt, Human
cucgugcaucccugag

SEQ ID NO: 3495876 - RNA, 17 nt, Human
cucgugcaucccugaga

SEQ ID NO: 3495877 - RNA, 21 nt, Human
cucgugccaccccgagggcug

SEQ ID NO: 3495878 - RNA, 24 nt, Human
cucgugccagucgcgcugccugug

SEQ ID NO: 3495879 - RNA, 15 nt, Human
cucgugcuuuaagug

SEQ ID NO: 3495880 - RNA, 14 nt, Human
cucguggacaccug

SEQ ID NO: 3495881 - RNA, 12 nt, Human
cucguggccagc

SEQ ID NO: 3495882 - RNA, 17 nt, Human
cucguggccagcccggc

SEQ ID NO: 3495883 - RNA, 18 nt, Human
cucguggccuuccccagc

SEQ ID NO: 3495884 - RNA, 15 nt, Human
cucgugggagagcca

SEQ ID NO: 3495885 - RNA, 15 nt, Human
cucgugguaggacug

SEQ ID NO: 3495886 - RNA, 16 nt, Human
cucgugguaggacugu

SEQ ID NO: 3495887 - RNA, 17 nt, Human
cucgugguaggacugua

SEQ ID NO: 3495888 - RNA, 17 nt, Human
cucguguauccuggggc

SEQ ID NO: 3495889 - RNA, 14 nt, Human
cucguuccuuucuc

SEQ ID NO: 3495890 - RNA, 16 nt, Human
cucguucucccuggga

SEQ ID NO: 3495891 - RNA, 19 nt, Human
cucguuuguguucuguuuu

SEQ ID NO: 3495892 - RNA, 17 nt, Human
cucuaaaauagccacuu

SEQ ID NO: 3495893 - RNA, 21 nt, Human
cucuaaaauauuuaugaagaa

SEQ ID NO: 3495894 - RNA, 13 nt, Human
cucuaaaaucugc

SEQ ID NO: 3495895 - RNA, 15 nt, Human
cucuaaaauuauaaa

SEQ ID NO: 3495896 - RNA, 17 nt, Human
cucuaaagaccaaacuu

SEQ ID NO: 3495897 - RNA, 20 nt, Human
cucuaaagaccaaacuucac

SEQ ID NO: 3495898 - RNA, 18 nt, Human
cucuaaagcaauaauggu

SEQ ID NO: 3495899 - RNA, 23 nt, Human
cucuaaagcaauaauggucccau

SEQ ID NO: 3495900 - RNA, 14 nt, Human
cucuaacagcacca

SEQ ID NO: 3495901 - RNA, 22 nt, Human
cucuaacagcucaggaucucuu

SEQ ID NO: 3495902 - RNA, 14 nt, Human
cucuaacaggggcu

SEQ ID NO: 3495903 - RNA, 19 nt, Human
cucuaacaguggacaaagu

SEQ ID NO: 3495904 - RNA, 15 nt, Human
cucuaaccacacagc

SEQ ID NO: 3495905 - RNA, 14 nt, Human
cucuaaccucgccc

SEQ ID NO: 3495906 - RNA, 19 nt, Human
cucuaaccucgcccucucc

SEQ ID NO: 3495907 - RNA, 13 nt, Human
cucuaacgccuga

SEQ ID NO: 3495908 - RNA, 17 nt, Human
cucuaacgccugagccc

SEQ ID NO: 3495909 - RNA, 21 nt, Human
cucuaacuguauauuuguaug

SEQ ID NO: 3495910 - RNA, 12 nt, Human
cucuaagaaaga

SEQ ID NO: 3495911 - RNA, 16 nt, Human
cucuaagaucuuagau

SEQ ID NO: 3495912 - RNA, 15 nt, Human
cucuaagauguuaua

SEQ ID NO: 3495913 - RNA, 14 nt, Human
cucuaagcacacgg

SEQ ID NO: 3495914 - RNA, 18 nt, Human
cucuaagucauguauguu

SEQ ID NO: 3495915 - RNA, 15 nt, Human
cucuaauaauaaaua

SEQ ID NO: 3495916 - RNA, 15 nt, Human
cucuaauacauucca

SEQ ID NO: 3495917 - RNA, 22 nt, Human
cucuaaucugugcuguuucaaa

SEQ ID NO: 3495918 - RNA, 15 nt, Human
cucuaauguuugcau

SEQ ID NO: 3495919 - RNA, 17 nt, Human
cucuaauguuugcauau

SEQ ID NO: 3495920 - RNA, 17 nt, Human
cucuaauucacagugcu

SEQ ID NO: 3495921 - RNA, 22 nt, Human
cucuaauucuaaccagagcaag

SEQ ID NO: 3495922 - RNA, 18 nt, Human
cucuaauucuauuaaagu

SEQ ID NO: 3495923 - RNA, 17 nt, Human
cucuaauucuuccuuug

SEQ ID NO: 3495924 - RNA, 15 nt, Human
cucuacacucuugua

SEQ ID NO: 3495925 - RNA, 20 nt, Human
cucuacagagcuucccugac

SEQ ID NO: 3495926 - RNA, 13 nt, Human
cucuacagaggcc

SEQ ID NO: 3495927 - RNA, 20 nt, Human
cucuuuaagggcaugccuug

SEQ ID NO: 3495928 - RNA, 21 nt, Human
cucuuuaagggcaugccuugu

SEQ ID NO: 3495929 - RNA, 18 nt, Human
cucuuuagaguuagacug

SEQ ID NO: 3495930 - RNA, 19 nt, Human
cucuuuagaguuagacugu

SEQ ID NO: 3495931 - RNA, 17 nt, Human
cucuuuaugacuguuuu

SEQ ID NO: 3495932 - RNA, 21 nt, Human
cucuuuaugcuugcaaaaacu

SEQ ID NO: 3495933 - RNA, 12 nt, Human
cucuuucaaaac

SEQ ID NO: 3495934 - RNA, 22 nt, Human
cucuuucaagcagucgugccug

SEQ ID NO: 3495935 - RNA, 13 nt, Human
cucuuucagcucc

SEQ ID NO: 3495936 - RNA, 12 nt, Human
cucuuucaucca

SEQ ID NO: 3495937 - RNA, 20 nt, Human
cucuuucccacccagccugg

SEQ ID NO: 3495938 - RNA, 14 nt, Human
cucuuucccugguc

SEQ ID NO: 3495939 - RNA, 19 nt, Human
cucuuuccuauuucagugu

SEQ ID NO: 3495940 - RNA, 20 nt, Human
cucuuuccuuggcucccauu

SEQ ID NO: 3495941 - RNA, 19 nt, Human
cucuuucgucacccuugga

SEQ ID NO: 3495942 - RNA, 12 nt, Human
cucuuucucucc

SEQ ID NO: 3495943 - RNA, 13 nt, Human
cucuuucucuccc

SEQ ID NO: 3495944 - RNA, 16 nt, Human
cucuuucucugccagu

SEQ ID NO: 3495945 - RNA, 18 nt, Human
cucuuucucuuucuuccu

SEQ ID NO: 3495946 - RNA, 17 nt, Human
cucuuucuggccugccu

SEQ ID NO: 3495947 - RNA, 21 nt, Human
cucuuucuuauaauacucugu

SEQ ID NO: 3495948 - RNA, 23 nt, Human
cucuuucuuauaauacucuguug

SEQ ID NO: 3495949 - RNA, 17 nt, Human
cucuuucuuccuuuacu

SEQ ID NO: 3495950 - RNA, 12 nt, Human
cucuuugaauuu

SEQ ID NO: 3495951 - RNA, 10 nt, Human
cucuuugaga

SEQ ID NO: 3495952 - RNA, 11 nt, Human
cucuuugauua

SEQ ID NO: 3495953 - RNA, 13 nt, Human
cucuuugauuauu

SEQ ID NO: 3495954 - RNA, 12 nt, Human
cucuuugcacua

SEQ ID NO: 3495955 - RNA, 15 nt, Human
cucuuugcuuugcuu

SEQ ID NO: 3495956 - RNA, 16 nt, Human
cucuuugcuuugcuuu

SEQ ID NO: 3495957 - RNA, 12 nt, Human
cucuuuggaaaa

SEQ ID NO: 3495958 - RNA, 15 nt, Human
cucuuuggacacuca

SEQ ID NO: 3495959 - RNA, 19 nt, Human
cucuuuggggucagccagg

SEQ ID NO: 3495960 - RNA, 20 nt, Human
cucuuuggggucagccaggg

SEQ ID NO: 3495961 - RNA, 19 nt, Human
cucuuuggucuacacugug

SEQ ID NO: 3495962 - RNA, 21 nt, Human
cucuuuggucuacacugugcu

SEQ ID NO: 3495963 - RNA, 23 nt, Human
cucuuuggucuacacugugcuga

SEQ ID NO: 3495964 - RNA, 12 nt, Human
cucuuuguaaga

SEQ ID NO: 3495965 - RNA, 18 nt, Human
cucuuugucuaaaacaau

SEQ ID NO: 3495966 - RNA, 22 nt, Human
cucuuugucuaaaacaauaaaa

SEQ ID NO: 3495967 - RNA, 20 nt, Human
cucuuuguucuaaagaugga

SEQ ID NO: 3495968 - RNA, 16 nt, Human
cucuuuuaccugcugc

SEQ ID NO: 3495969 - RNA, 16 nt, Human
cucuuuuagauauugu

SEQ ID NO: 3495970 - RNA, 22 nt, Human
cucuuuuauauuuguaggagaa

SEQ ID NO: 3495971 - RNA, 22 nt, Human
cucuuuuaucuccugaaaaaag

SEQ ID NO: 3495972 - RNA, 20 nt, Human
cucuuuuccaaacacaggca

SEQ ID NO: 3495973 - RNA, 11 nt, Human
cucuuuuccua

SEQ ID NO: 3495974 - RNA, 23 nt, Human
cucuuuuccuacuuuuccuuccc

SEQ ID NO: 3495975 - RNA, 14 nt, Human
cucuuuucugcauc

SEQ ID NO: 3495976 - RNA, 21 nt, Human
cucuuuucuuacuccuccucu

SEQ ID NO: 3495977 - RNA, 22 nt, Human
cucuuuucuuacuccuccucuu

SEQ ID NO: 3495978 - RNA, 18 nt, Human
cucuuuuuagggccaggc

SEQ ID NO: 3495979 - RNA, 22 nt, Human
cucuuuuuagggccaggcaggu

SEQ ID NO: 3495980 - RNA, 12 nt, Human
cucuuuuuccaa

SEQ ID NO: 3495981 - RNA, 21 nt, Human
cucuuuuuccaacuuggcugc

SEQ ID NO: 3495982 - RNA, 19 nt, Human
cucuuuuugguuguccuca

SEQ ID NO: 3495983 - RNA, 13 nt, Human
cucuuuuuuaagu

SEQ ID NO: 3495984 - RNA, 15 nt, Human
cucuaggaaauauuu

SEQ ID NO: 3495985 - RNA, 16 nt, Human
cucuaggccucuccag

SEQ ID NO: 3495986 - RNA, 16 nt, Human
cucuaggcucugccuu

SEQ ID NO: 3495987 - RNA, 12 nt, Human
cucuaggcuggg

SEQ ID NO: 3495988 - RNA, 22 nt, Human
cucuagggagggacauggcccc

SEQ ID NO: 3495989 - RNA, 20 nt, Human
cucuaggggucaggcuccau

SEQ ID NO: 3495990 - RNA, 19 nt, Human
cucuaggguugcuggagcc

SEQ ID NO: 3495991 - RNA, 21 nt, Human
cucuaggguugcuggagccug

SEQ ID NO: 3495992 - RNA, 13 nt, Human
cucuagguggggc

SEQ ID NO: 3495993 - RNA, 15 nt, Human
cucuagguggggcgg

SEQ ID NO: 3495994 - RNA, 16 nt, Human
cucuaguacugugaau

SEQ ID NO: 3495995 - RNA, 15 nt, Human
cucuagucaaugaca

SEQ ID NO: 3495996 - RNA, 21 nt, Human
cucuagugcccuccacagccg

SEQ ID NO: 3495997 - RNA, 15 nt, Human
cucuagugcugugaa

SEQ ID NO: 3495998 - RNA, 19 nt, Human
cucuagugcugugaaaaaa

SEQ ID NO: 3495999 - RNA, 16 nt, Human
cucuagugggacagcc

SEQ ID NO: 3496000 - RNA, 19 nt, Human
cucuagugggacagcccag

SEQ ID NO: 3496001 - RNA, 13 nt, Human
cucuaguucuuug

SEQ ID NO: 3496002 - RNA, 18 nt, Human
cucuaguucuuuguucau

SEQ ID NO: 3496003 - RNA, 15 nt, Human
cucuaguuugauuaa

SEQ ID NO: 3496004 - RNA, 22 nt, Human
cucuauaagcaaauugcuuuuu

SEQ ID NO: 3496005 - RNA, 17 nt, Human
cucuauaauugccacug

SEQ ID NO: 3496006 - RNA, 15 nt, Human
cucuauacaucucuc

SEQ ID NO: 3496007 - RNA, 19 nt, Human
cucuauaccaauaaaguga

SEQ ID NO: 3496008 - RNA, 17 nt, Human
cucuauauaaaaacaaa

SEQ ID NO: 3496009 - RNA, 18 nt, Human
cucuauccucucuuccuc

SEQ ID NO: 3496010 - RNA, 16 nt, Human
cucuaucuugcucugu

SEQ ID NO: 3496011 - RNA, 18 nt, Human
cucuaucuugcucuguaa

SEQ ID NO: 3496012 - RNA, 13 nt, Human
cucuaugagucua

SEQ ID NO: 3496013 - RNA, 19 nt, Human
cucuaugagucuagauguu

SEQ ID NO: 3496014 - RNA, 17 nt, Human
cucuaugccagcucagu

SEQ ID NO: 3496015 - RNA, 16 nt, Human
cucuaugccccaaaua

SEQ ID NO: 3496016 - RNA, 14 nt, Human
cucuaugcuuucca

SEQ ID NO: 3496017 - RNA, 17 nt, Human
cucuauguaucaaaugu

SEQ ID NO: 3496018 - RNA, 19 nt, Human
cucuauguucuaagaagug

SEQ ID NO: 3496019 - RNA, 23 nt, Human
cucuauuaccacugaagauagaa

SEQ ID NO: 3496020 - RNA, 24 nt, Human
cucuauuagacuuuagaaauaaau

SEQ ID NO: 3496021 - RNA, 14 nt, Human
cucuauuaugaaug

SEQ ID NO: 3496022 - RNA, 21 nt, Human
cucuauuaugaaugugaagcc

SEQ ID NO: 3496023 - RNA, 23 nt, Human
cucuauuaugaaugugaagccuu

SEQ ID NO: 3496024 - RNA, 20 nt, Human
cucuauucgccacacaguau

SEQ ID NO: 3496025 - RNA, 13 nt, Human
cucuauucuuuaa

SEQ ID NO: 3496026 - RNA, 20 nt, Human
cucuauuguagcauuucuug

SEQ ID NO: 3496027 - RNA, 12 nt, Human
cucuauuuaaau

SEQ ID NO: 3496028 - RNA, 12 nt, Human
cucuauuuaaua

SEQ ID NO: 3496029 - RNA, 17 nt, Human
cucuauuuaauauuuau

SEQ ID NO: 3496030 - RNA, 18 nt, Human
cucuauuucccccuuucu

SEQ ID NO: 3496031 - RNA, 18 nt, Human
cucucaacaccaugauuc

SEQ ID NO: 3496032 - RNA, 22 nt, Human
cucucaacaccaugauuccuuu

SEQ ID NO: 3496033 - RNA, 17 nt, Human
cucucaacacccaguuu

SEQ ID NO: 3496034 - RNA, 14 nt, Human
cucucaaguaauau

SEQ ID NO: 3496035 - RNA, 18 nt, Human
cucucaauauucaauaaa

SEQ ID NO: 3496036 - RNA, 13 nt, Human
cucucaauuuuug

SEQ ID NO: 3496037 - RNA, 22 nt, Human
cucucaauuuuugguugaauaa

SEQ ID NO: 3496038 - RNA, 14 nt, Human
cucucacacacaua

SEQ ID NO: 3496039 - RNA, 20 nt, Human
cucucacacugguucucaau

SEQ ID NO: 3496040 - RNA, 14 nt, Human
cucucacagacagg

SEQ ID NO: 3496041 - RNA, 18 nt, Human
cucucacagacaggaccc

SEQ ID NO: 3496042 - RNA, 13 nt, Human
cucucaccucagc

SEQ ID NO: 3496043 - RNA, 18 nt, Human
cucucaccuugguuccug

SEQ ID NO: 3496044 - RNA, 23 nt, Human
cucucacggccacacagcugccg

SEQ ID NO: 3496045 - RNA, 14 nt, Human
cucucacuccccau

SEQ ID NO: 3496046 - RNA, 19 nt, Human
cucucacuccccaugccac

SEQ ID NO: 3496047 - RNA, 14 nt, Human
cucucacuccuuga

SEQ ID NO: 3496048 - RNA, 12 nt, Human
cucucacugucu

SEQ ID NO: 3496049 - RNA, 15 nt, Human
cucucagaggcccca

SEQ ID NO: 3496050 - RNA, 23 nt, Human
cucucagccaacgaguaauuuau

SEQ ID NO: 3496051 - RNA, 13 nt, Human
cucucagcccaga

SEQ ID NO: 3496052 - RNA, 18 nt, Human
cucucagcccagaagaaa

SEQ ID NO: 3496053 - RNA, 13 nt, Human
cucucagcccuca

SEQ ID NO: 3496054 - RNA, 15 nt, Human
cucucagcuccaggu

SEQ ID NO: 3496055 - RNA, 18 nt, Human
cucucaggagcacaggca

SEQ ID NO: 3496056 - RNA, 20 nt, Human
cucucaggagcacaggcagc

SEQ ID NO: 3496057 - RNA, 21 nt, Human
cucucaggcaugccuguguga

SEQ ID NO: 3496058 - RNA, 21 nt, Human
cucucaggccaaacucaccug

SEQ ID NO: 3496059 - RNA, 23 nt, Human
cucucaggccaaacucaccugcc

SEQ ID NO: 3496060 - RNA, 15 nt, Human
cucucaggccagcug

SEQ ID NO: 3496061 - RNA, 18 nt, Human
cucucaggccagcugcuu

SEQ ID NO: 3496062 - RNA, 21 nt, Human
cucucaggccagcugcuuggg

SEQ ID NO: 3496063 - RNA, 22 nt, Human
cucucaggccagcugcuugggc

SEQ ID NO: 3496064 - RNA, 21 nt, Human
cucucaggccggcagccccag

SEQ ID NO: 3496065 - RNA, 18 nt, Human
cucucagggccaggccuc

SEQ ID NO: 3496066 - RNA, 14 nt, Human
cucucagucucuga

SEQ ID NO: 3496067 - RNA, 18 nt, Human
cucucagucucugagcag

SEQ ID NO: 3496068 - RNA, 17 nt, Human
cucucagugcccuccag

SEQ ID NO: 3496069 - RNA, 22 nt, Human
cucucaguugcagcccugcugc

SEQ ID NO: 3496070 - RNA, 16 nt, Human
cucucaucaacugaau

SEQ ID NO: 3496071 - RNA, 18 nt, Human
cucucaucgccagacaac

SEQ ID NO: 3496072 - RNA, 15 nt, Human
cauucuaucuacuga

SEQ ID NO: 3496073 - RNA, 18 nt, Human
cauucuaucuacugauuu

SEQ ID NO: 3496074 - RNA, 19 nt, Human
cauucuauugccuucuuug

SEQ ID NO: 3496075 - RNA, 23 nt, Human
cauucuauugccuucuuugaaga

SEQ ID NO: 3496076 - RNA, 16 nt, Human
cauucuauuuuagaau

SEQ ID NO: 3496077 - RNA, 14 nt, Human
cauucucaagggac

SEQ ID NO: 3496078 - RNA, 16 nt, Human
cauucucaagggacgu

SEQ ID NO: 3496079 - RNA, 22 nt, Human
cauucucaagggacguccucca

SEQ ID NO: 3496080 - RNA, 13 nt, Human
cauucucaggcac

SEQ ID NO: 3496081 - RNA, 16 nt, Human
cauucucauaauuccu

SEQ ID NO: 3496082 - RNA, 18 nt, Human
cauucucauaauuccuac

SEQ ID NO: 3496083 - RNA, 13 nt, Human
cauucucaucugc

SEQ ID NO: 3496084 - RNA, 23 nt, Human
cauucucaucugcacccuucuuu

SEQ ID NO: 3496085 - RNA, 17 nt, Human
cauucucauuggaaauu

SEQ ID NO: 3496086 - RNA, 14 nt, Human
cauucuccacagca

SEQ ID NO: 3496087 - RNA, 14 nt, Human
cauucuccaccugc

SEQ ID NO: 3496088 - RNA, 17 nt, Human
cauucuccaccugccag

SEQ ID NO: 3496089 - RNA, 12 nt, Human
cauucucccagg

SEQ ID NO: 3496090 - RNA, 22 nt, Human
cauucuccugccuguagcagug

SEQ ID NO: 3496091 - RNA, 23 nt, Human
cauucuccugccuguagcaguga

SEQ ID NO: 3496092 - RNA, 16 nt, Human
cauucucgcuucccug

SEQ ID NO: 3496093 - RNA, 15 nt, Human
cauucucucuccugu

SEQ ID NO: 3496094 - RNA, 16 nt, Human
cauucucucuccugua

SEQ ID NO: 3496095 - RNA, 23 nt, Human
cauucucugucucauccaucauc

SEQ ID NO: 3496096 - RNA, 16 nt, Human
cauucugaaggagccc

SEQ ID NO: 3496097 - RNA, 15 nt, Human
cauucugaauuaauu

SEQ ID NO: 3496098 - RNA, 20 nt, Human
cauucugaauuaauuaauuu

SEQ ID NO: 3496099 - RNA, 23 nt, Human
cauucugaauuaauuaauuugga

SEQ ID NO: 3496100 - RNA, 16 nt, Human
cauucugaccauuuca

SEQ ID NO: 3496101 - RNA, 17 nt, Human
cauucugaccauuucag

SEQ ID NO: 3496102 - RNA, 15 nt, Human
cauucugacucauau

SEQ ID NO: 3496103 - RNA, 12 nt, Human
cauucugacucg

SEQ ID NO: 3496104 - RNA, 20 nt, Human
cauucugauuuggaaaaaga

SEQ ID NO: 3496105 - RNA, 15 nt, Human
cauucugcauugcua

SEQ ID NO: 3496106 - RNA, 20 nt, Human
cauucugcauugcuagauaa

SEQ ID NO: 3496107 - RNA, 22 nt, Human
cauucugccaggcccccaagcc

SEQ ID NO: 3496108 - RNA, 17 nt, Human
cauucugcccuguggga

SEQ ID NO: 3496109 - RNA, 21 nt, Human
cauucugccgcccccuccuga

SEQ ID NO: 3496110 - RNA, 17 nt, Human
cauucugccugcccagg

SEQ ID NO: 3496111 - RNA, 13 nt, Human
cauucuggaauaa

SEQ ID NO: 3496112 - RNA, 12 nt, Human
cauucuggucuc

SEQ ID NO: 3496113 - RNA, 22 nt, Human
cauucuggucucgucuuccguc

SEQ ID NO: 3496114 - RNA, 18 nt, Human
cauucuggucucucuauu

SEQ ID NO: 3496115 - RNA, 21 nt, Human
cauucugucgccuuagcaugu

SEQ ID NO: 3496116 - RNA, 17 nt, Human
cauucugugaucauuua

SEQ ID NO: 3496117 - RNA, 17 nt, Human
cauucuguuaaucauua

SEQ ID NO: 3496118 - RNA, 13 nt, Human
cauucuuaaaaaa

SEQ ID NO: 3496119 - RNA, 14 nt, Human
cauucuuagcucuu

SEQ ID NO: 3496120 - RNA, 14 nt, Human
cauucuuauaaaua

SEQ ID NO: 3496121 - RNA, 15 nt, Human
cauucuuauaaauau

SEQ ID NO: 3496122 - RNA, 16 nt, Human
cauucuuauaaauaug

SEQ ID NO: 3496123 - RNA, 22 nt, Human
cauucuuauaaauaugaagcuc

SEQ ID NO: 3496124 - RNA, 17 nt, Human
cauucuucaagauccca

SEQ ID NO: 3496125 - RNA, 18 nt, Human
cauucuuccuaguuuucu

SEQ ID NO: 3496126 - RNA, 19 nt, Human
cauucuucucuagcuggug

SEQ ID NO: 3496127 - RNA, 20 nt, Human
cauucuucucuagcuggugg

SEQ ID NO: 3496128 - RNA, 16 nt, Human
cauucuucucuguugu

SEQ ID NO: 3496129 - RNA, 19 nt, Human
cauucuucugaucacugaa

SEQ ID NO: 3496130 - RNA, 23 nt, Human
cauucuucuguacgucugacagg

SEQ ID NO: 3496131 - RNA, 17 nt, Human
ccuuccugccaccaguc

SEQ ID NO: 3496132 - RNA, 17 nt, Human
ccuuccugccaccugcu

SEQ ID NO: 3496133 - RNA, 16 nt, Human
ccuuccuggacagcug

SEQ ID NO: 3496134 - RNA, 19 nt, Human
ccuuccuggacagcugugc

SEQ ID NO: 3496135 - RNA, 20 nt, Human
ccuuccuggacagcugugcc

SEQ ID NO: 3496136 - RNA, 20 nt, Human
ccuuccuggagacugcccag

SEQ ID NO: 3496137 - RNA, 21 nt, Human
ccuuccuggagcccagaggag

SEQ ID NO: 3496138 - RNA, 13 nt, Human
ccuuccuggccug

SEQ ID NO: 3496139 - RNA, 13 nt, Human
ccuuccugucuuc

SEQ ID NO: 3496140 - RNA, 19 nt, Human
ccuuccugucuuccugcau

SEQ ID NO: 3496141 - RNA, 15 nt, Human
ccuuccuguucugaa

SEQ ID NO: 3496142 - RNA, 17 nt, Human
ccuuccuguuuuucaca

SEQ ID NO: 3496143 - RNA, 22 nt, Human
ccuuccuguuuuucacauuuuc

SEQ ID NO: 3496144 - RNA, 14 nt, Human
ccuuccuucccugg

SEQ ID NO: 3496145 - RNA, 13 nt, Human
ccuuccuuccugu

SEQ ID NO: 3496146 - RNA, 23 nt, Human
ccuuccuugaccagcagauccca

SEQ ID NO: 3496147 - RNA, 13 nt, Human
ccuuccuugaccu

SEQ ID NO: 3496148 - RNA, 14 nt, Human
ccuuccuugaccuu

SEQ ID NO: 3496149 - RNA, 18 nt, Human
ccuuccuuguagccuuuu

SEQ ID NO: 3496150 - RNA, 14 nt, Human
ccuuccuuucucca

SEQ ID NO: 3496151 - RNA, 17 nt, Human
ccuuccuuucuccagga

SEQ ID NO: 3496152 - RNA, 19 nt, Human
ccuuccuuuuacuuuucuu

SEQ ID NO: 3496153 - RNA, 23 nt, Human
ccuucgauacaccgggccuggag

SEQ ID NO: 3496154 - RNA, 20 nt, Human
ccuucgcgguggaaggcccg

SEQ ID NO: 3496155 - RNA, 13 nt, Human
ccuucgcuccugu

SEQ ID NO: 3496156 - RNA, 14 nt, Human
ccuucgcuccugug

SEQ ID NO: 3496157 - RNA, 16 nt, Human
ccuucgcuucuugccu

SEQ ID NO: 3496158 - RNA, 16 nt, Human
ccuucggccuccaucc

SEQ ID NO: 3496159 - RNA, 18 nt, Human
ccuucgggcgucugugug

SEQ ID NO: 3496160 - RNA, 14 nt, Human
ccuucgggcugugc

SEQ ID NO: 3496161 - RNA, 15 nt, Human
ccuucgguacccacc

SEQ ID NO: 3496162 - RNA, 17 nt, Human
ccuucgguacccaccac

SEQ ID NO: 3496163 - RNA, 19 nt, Human
ccuucgguggaagagcuca

SEQ ID NO: 3496164 - RNA, 17 nt, Human
ccuucgugaacaucccc

SEQ ID NO: 3496165 - RNA, 19 nt, Human
ccuucgugacaauguuuac

SEQ ID NO: 3496166 - RNA, 22 nt, Human
ccuucuaaucugcuaugcuuga

SEQ ID NO: 3496167 - RNA, 14 nt, Human
ccuucuacacucuc

SEQ ID NO: 3496168 - RNA, 15 nt, Human
ccuucuacacucucc

SEQ ID NO: 3496169 - RNA, 17 nt, Human
ccuucuacacucuccug

SEQ ID NO: 3496170 - RNA, 19 nt, Human
ccuucuacacucuccuggg

SEQ ID NO: 3496171 - RNA, 22 nt, Human
ccuucuacacucuccugggccc

SEQ ID NO: 3496172 - RNA, 15 nt, Human
ccuucuaccugccac

SEQ ID NO: 3496173 - RNA, 18 nt, Human
ccuucuaccugccacuca

SEQ ID NO: 3496174 - RNA, 20 nt, Human
ccuucuaccugccacucaca

SEQ ID NO: 3496175 - RNA, 22 nt, Human
ccuucuagucuuggccagccaa

SEQ ID NO: 3496176 - RNA, 19 nt, Human
ccuucuauagcaucacuua

SEQ ID NO: 3496177 - RNA, 15 nt, Human
ccuucuauucuagcc

SEQ ID NO: 3496178 - RNA, 14 nt, Human
ccuucuauuugggg

SEQ ID NO: 3496179 - RNA, 16 nt, Human
ccuucuauuuggggcu

SEQ ID NO: 3496180 - RNA, 15 nt, Human
ccuucucagaagcac

SEQ ID NO: 3496181 - RNA, 17 nt, Human
ccuucucaucacucccc

SEQ ID NO: 3496182 - RNA, 21 nt, Human
ccuucucaucacuccccucca

SEQ ID NO: 3496183 - RNA, 11 nt, Human
ccuucuccauc

SEQ ID NO: 3496184 - RNA, 16 nt, Human
ccuucuccauccacau

SEQ ID NO: 3496185 - RNA, 22 nt, Human
ccuucuccauccacaugggagc

SEQ ID NO: 3496186 - RNA, 22 nt, Human
ccuucuccaucucucuggcccu

SEQ ID NO: 3496187 - RNA, 19 nt, Human
ccuucuccauggcccugcc

SEQ ID NO: 3496188 - RNA, 18 nt, Human
ccuucucccacucuccua

SEQ ID NO: 3496189 - RNA, 14 nt, Human
ccuucuccccagcu

SEQ ID NO: 3496190 - RNA, 21 nt, Human
ccuucuccccagcucccagga

SEQ ID NO: 3496191 - RNA, 16 nt, Human
ccuucucccccccggg

SEQ ID NO: 3496192 - RNA, 17 nt, Human
ccuucuccccugcacug

SEQ ID NO: 3496193 - RNA, 22 nt, Human
ccuucuccccugcacuguaaaa

SEQ ID NO: 3496194 - RNA, 15 nt, Human
ccuucuccucuugua

SEQ ID NO: 3496195 - RNA, 16 nt, Human
ccuucuccucuuguaa

SEQ ID NO: 3496196 - RNA, 17 nt, Human
ccuucuccuuccaacug

SEQ ID NO: 3496197 - RNA, 19 nt, Human
ccuucuccuuccaacugcu

SEQ ID NO: 3496198 - RNA, 20 nt, Human
ccuucucuacacucuuguaa

SEQ ID NO: 3496199 - RNA, 16 nt, Human
ccuucucucaucucuu

SEQ ID NO: 3496200 - RNA, 21 nt, Human
ccuucucucaucucuuagcuc

SEQ ID NO: 3496201 - RNA, 16 nt, Human
ccuucucuccagcccc

SEQ ID NO: 3496202 - RNA, 18 nt, Human
ccuucucuccagccccug

SEQ ID NO: 3496203 - RNA, 19 nt, Human
ccuucucuccagccccugg

SEQ ID NO: 3496204 - RNA, 15 nt, Human
ccuucucuccucccc

SEQ ID NO: 3496205 - RNA, 20 nt, Human
ccuucucucucaauuuuugg

SEQ ID NO: 3496206 - RNA, 17 nt, Human
ccuucucugaacacagg

SEQ ID NO: 3496207 - RNA, 18 nt, Human
ccuucucugaacacaggc

SEQ ID NO: 3496208 - RNA, 20 nt, Human
ccuucucugaacacaggcag

SEQ ID NO: 3496209 - RNA, 14 nt, Human
ccuucucugaagga

SEQ ID NO: 3496210 - RNA, 18 nt, Human
ccuucucugcccauuccc

SEQ ID NO: 3496211 - RNA, 19 nt, Human
ccuucucugcccauucccc

SEQ ID NO: 3496212 - RNA, 21 nt, Human
ccuucucuguagggaacucug

SEQ ID NO: 3496213 - RNA, 17 nt, Human
ccuucucuguucauuuc

SEQ ID NO: 3496214 - RNA, 17 nt, Human
ccuucucuucacaguca

SEQ ID NO: 3496215 - RNA, 12 nt, Human
ccuucucuucca

SEQ ID NO: 3496216 - RNA, 14 nt, Human
ccuucucuuccagg

SEQ ID NO: 3496217 - RNA, 22 nt, Human
cauugcuguaggaucuaaggcu

SEQ ID NO: 3496218 - RNA, 14 nt, Human
cauugcugugaaca

SEQ ID NO: 3496219 - RNA, 17 nt, Human
cauugcuguuaugucug

SEQ ID NO: 3496220 - RNA, 20 nt, Human
cauugcuguuaugucuguuu

SEQ ID NO: 3496221 - RNA, 21 nt, Human
cauugcuguuguccaacuauu

SEQ ID NO: 3496222 - RNA, 22 nt, Human
cauugcuguuguccaacuauuu

SEQ ID NO: 3496223 - RNA, 21 nt, Human
cauugcuguugucccucugcu

SEQ ID NO: 3496224 - RNA, 14 nt, Human
cauugcuuaccuug

SEQ ID NO: 3496225 - RNA, 17 nt, Human
cauugcuuaccuugguu

SEQ ID NO: 3496226 - RNA, 15 nt, Human
cauugcuucacuacc

SEQ ID NO: 3496227 - RNA, 22 nt, Human
cauugcuugugccacacccucc

SEQ ID NO: 3496228 - RNA, 11 nt, Human
cauugcuuuac

SEQ ID NO: 3496229 - RNA, 17 nt, Human
cauugcuuuacugucaa

SEQ ID NO: 3496230 - RNA, 18 nt, Human
cauugcuuucugaaauua

SEQ ID NO: 3496231 - RNA, 18 nt, Human
cauugcuuugaagcaguu

SEQ ID NO: 3496232 - RNA, 15 nt, Human
cauugcuuuuauuuu

SEQ ID NO: 3496233 - RNA, 17 nt, Human
cauugcuuuuauuuuga

SEQ ID NO: 3496234 - RNA, 11 nt, Human
cauugcuuuuc

SEQ ID NO: 3496235 - RNA, 19 nt, Human
cauuggaaauuuagcauug

SEQ ID NO: 3496236 - RNA, 16 nt, Human
cauuggaaauuucacg

SEQ ID NO: 3496237 - RNA, 19 nt, Human
cauuggaaauuucacguca

SEQ ID NO: 3496238 - RNA, 20 nt, Human
cauuggaagagcagcaccuc

SEQ ID NO: 3496239 - RNA, 22 nt, Human
cauuggaagcagguuaaauguu

SEQ ID NO: 3496240 - RNA, 15 nt, Human
cauuggauucugaga

SEQ ID NO: 3496241 - RNA, 22 nt, Human
cauuggcuuuauccucuuuaga

SEQ ID NO: 3496242 - RNA, 23 nt, Human
cauugggaaggggacccccgccc

SEQ ID NO: 3496243 - RNA, 22 nt, Human
cauugggcagcgcccuuccucu

SEQ ID NO: 3496244 - RNA, 17 nt, Human
cauugggccauguuuaa

SEQ ID NO: 3496245 - RNA, 17 nt, Human
cauuggggcucccagcc

SEQ ID NO: 3496246 - RNA, 19 nt, Human
cauuggggcucccagccag

SEQ ID NO: 3496247 - RNA, 21 nt, Human
cauuggggcucccagccaggc

SEQ ID NO: 3496248 - RNA, 21 nt, Human
cauugggguuccgcacuuucc

SEQ ID NO: 3496249 - RNA, 19 nt, Human
cauugggucuauuccagcu

SEQ ID NO: 3496250 - RNA, 22 nt, Human
cauugggucuauuccagcucau

SEQ ID NO: 3496251 - RNA, 19 nt, Human
cauuggguggguaaauuca

SEQ ID NO: 3496252 - RNA, 14 nt, Human
cauugguccaagau

SEQ ID NO: 3496253 - RNA, 14 nt, Human
cauugguuaauuuu

SEQ ID NO: 3496254 - RNA, 22 nt, Human
cauugguucccuuugcuccacc

SEQ ID NO: 3496255 - RNA, 15 nt, Human
cauuguaaaauaauu

SEQ ID NO: 3496256 - RNA, 23 nt, Human
cauuguaaacaaacucuugaaga

SEQ ID NO: 3496257 - RNA, 16 nt, Human
cauuguaauguuacug

SEQ ID NO: 3496258 - RNA, 17 nt, Human
cauuguaauguuacuga

SEQ ID NO: 3496259 - RNA, 13 nt, Human
cauuguaauguug

SEQ ID NO: 3496260 - RNA, 19 nt, Human
cauuguacaguuuguuuac

SEQ ID NO: 3496261 - RNA, 15 nt, Human
cauuguacuaccugu

SEQ ID NO: 3496262 - RNA, 19 nt, Human
cauuguagagcuucuggca

SEQ ID NO: 3496263 - RNA, 19 nt, Human
cauuguagcgucuuucuuu

SEQ ID NO: 3496264 - RNA, 17 nt, Human
cauuguauauaugugug

SEQ ID NO: 3496265 - RNA, 20 nt, Human
cauuguauauauguguguuu

SEQ ID NO: 3496266 - RNA, 22 nt, Human
cauuguaugauguguugugaua

SEQ ID NO: 3496267 - RNA, 15 nt, Human
cauuguauguaucua

SEQ ID NO: 3496268 - RNA, 15 nt, Human
cauuguaugugguca

SEQ ID NO: 3496269 - RNA, 15 nt, Human
cauuguauuagaucu

SEQ ID NO: 3496270 - RNA, 21 nt, Human
cauuguccaauccuauguuuu

SEQ ID NO: 3496271 - RNA, 14 nt, Human
cauuguccagagcu

SEQ ID NO: 3496272 - RNA, 15 nt, Human
cauuguccagagcug

SEQ ID NO: 3496273 - RNA, 18 nt, Human
cauuguccagagcugcuu

SEQ ID NO: 3496274 - RNA, 15 nt, Human
cauugucccucugcc

SEQ ID NO: 3496275 - RNA, 20 nt, Human
cauugucccucuucacuccc

SEQ ID NO: 3496276 - RNA, 17 nt, Human
cauugucucguuuguga

SEQ ID NO: 3496277 - RNA, 23 nt, Human
cauugucuucggaaaccuuggug

SEQ ID NO: 3496278 - RNA, 17 nt, Human
cauugugaacugacagg

SEQ ID NO: 3496279 - RNA, 18 nt, Human
cauugugauuggccugua

SEQ ID NO: 3496280 - RNA, 13 nt, Human
cauugugcuucuu

SEQ ID NO: 3496281 - RNA, 13 nt, Human
cauuguggcuccu

SEQ ID NO: 3496282 - RNA, 21 nt, Human
cauugugggauguucagcacu

SEQ ID NO: 3496283 - RNA, 22 nt, Human
cauugugggauguucagcacug

SEQ ID NO: 3496284 - RNA, 22 nt, Human
cauugugguuauuuuuauacag

SEQ ID NO: 3496285 - RNA, 13 nt, Human
cgagggcagcugc

SEQ ID NO: 3496286 - RNA, 16 nt, Human
cgagggcagcugcuau

SEQ ID NO: 3496287 - RNA, 22 nt, Human
cgaggggccuuuguucuggggg

SEQ ID NO: 3496288 - RNA, 21 nt, Human
cgaggggcgggacccaggcac

SEQ ID NO: 3496289 - RNA, 20 nt, Human
cgaggggcucucagcucagc

SEQ ID NO: 3496290 - RNA, 15 nt, Human
cgagggggcugcucc

SEQ ID NO: 3496291 - RNA, 15 nt, Human
cgaggguccuggcuc

SEQ ID NO: 3496292 - RNA, 16 nt, Human
cgaggguccuggcucc

SEQ ID NO: 3496293 - RNA, 14 nt, Human
cgagguagaguuug

SEQ ID NO: 3496294 - RNA, 16 nt, Human
cgaggucaacagagaa

SEQ ID NO: 3496295 - RNA, 21 nt, Human
cgaggugccuucuucagggcc

SEQ ID NO: 3496296 - RNA, 14 nt, Human
cgaguaagauuaag

SEQ ID NO: 3496297 - RNA, 15 nt, Human
cgaguaauaugccug

SEQ ID NO: 3496298 - RNA, 14 nt, Human
cgaguacugugggc

SEQ ID NO: 3496299 - RNA, 17 nt, Human
cgaguacugugggcaau

SEQ ID NO: 3496300 - RNA, 22 nt, Human
cgaguacugugggcaauuuaga

SEQ ID NO: 3496301 - RNA, 16 nt, Human
cgaguagaaaauguga

SEQ ID NO: 3496302 - RNA, 15 nt, Human
cgaguagcugggacu

SEQ ID NO: 3496303 - RNA, 13 nt, Human
cgaguauguguuu

SEQ ID NO: 3496304 - RNA, 18 nt, Human
cgagucaccuuccaggac

SEQ ID NO: 3496305 - RNA, 18 nt, Human
cgagucacugccucuccc

SEQ ID NO: 3496306 - RNA, 22 nt, Human
cgagucacugccucucccuggc

SEQ ID NO: 3496307 - RNA, 17 nt, Human
cgagucauccagaaugu

SEQ ID NO: 3496308 - RNA, 14 nt, Human
cgaguccaagcugg

SEQ ID NO: 3496309 - RNA, 17 nt, Human
cgagucucuucuccacu

SEQ ID NO: 3496310 - RNA, 15 nt, Human
cgagucugggacaca

SEQ ID NO: 3496311 - RNA, 11 nt, Human
cgagugccagg

SEQ ID NO: 3496312 - RNA, 18 nt, Human
cgaguggagucugccacc

SEQ ID NO: 3496313 - RNA, 19 nt, Human
cgaguggagucugccaccc

SEQ ID NO: 3496314 - RNA, 20 nt, Human
cgaguggauagaugcccugc

SEQ ID NO: 3496315 - RNA, 22 nt, Human
cgagugugaagcuuccuuggcu

SEQ ID NO: 3496316 - RNA, 15 nt, Human
cgauaaggaagaaac

SEQ ID NO: 3496317 - RNA, 15 nt, Human
cgauaaucagagaaa

SEQ ID NO: 3496318 - RNA, 18 nt, Human
cgauacaccgggccugga

SEQ ID NO: 3496319 - RNA, 20 nt, Human
cgauacugcgacuuucugcc

SEQ ID NO: 3496320 - RNA, 22 nt, Human
cgauacugcgacuuucugccug

SEQ ID NO: 3496321 - RNA, 14 nt, Human
cgauagugguggug

SEQ ID NO: 3496322 - RNA, 14 nt, Human
cgaucacaaaugac

SEQ ID NO: 3496323 - RNA, 19 nt, Human
cgaucacaaaugacuuuau

SEQ ID NO: 3496324 - RNA, 24 nt, Human
cgaucacaacgugcauugugcuuc

SEQ ID NO: 3496325 - RNA, 23 nt, Human
cgaucauggcucacugcagccuc

SEQ ID NO: 3496326 - RNA, 15 nt, Human
cgauccaccugucuc

SEQ ID NO: 3496327 - RNA, 13 nt, Human
cgauccugccacc

SEQ ID NO: 3496328 - RNA, 19 nt, Human
cgaucggggcacugcaggg

SEQ ID NO: 3496329 - RNA, 17 nt, Human
cgaucucuccuggccua

SEQ ID NO: 3496330 - RNA, 20 nt, Human
cgaugaugcuuguaacaaga

SEQ ID NO: 3496331 - RNA, 16 nt, Human
cgaugauucaggugca

SEQ ID NO: 3496332 - RNA, 14 nt, Human
cgaugcccagagac

SEQ ID NO: 3496333 - RNA, 20 nt, Human
cgaugcuccagccaaccccu

SEQ ID NO: 3496334 - RNA, 21 nt, Human
cgaugggggaugcuucaugug

SEQ ID NO: 3496335 - RNA, 19 nt, Human
cgauguaugcagcuaucug

SEQ ID NO: 3496336 - RNA, 19 nt, Human
cgauguggaacugcugcca

SEQ ID NO: 3496337 - RNA, 17 nt, Human
cgauguggcccuggccu

SEQ ID NO: 3496338 - RNA, 17 nt, Human
cgauguuauuagauguu

SEQ ID NO: 3496339 - RNA, 15 nt, Human
cgauucauauugaau

SEQ ID NO: 3496340 - RNA, 17 nt, Human
cgauucccucucccagg

SEQ ID NO: 3496341 - RNA, 19 nt, Human
cgauucccucucccaggcc

SEQ ID NO: 3496342 - RNA, 12 nt, Human
cgauucuccugc

SEQ ID NO: 3496343 - RNA, 18 nt, Human
cgauucuccugccucagc

SEQ ID NO: 3496344 - RNA, 21 nt, Human
cgauugcaggagucccugcca

SEQ ID NO: 3496345 - RNA, 14 nt, Human
cgauuuaagguauu

SEQ ID NO: 3496346 - RNA, 15 nt, Human
cgauuuaauucucuu

SEQ ID NO: 3496347 - RNA, 17 nt, Human
cgauuucuguaaacucu

SEQ ID NO: 3496348 - RNA, 12 nt, Human
cgauuucuguuu

SEQ ID NO: 3496349 - RNA, 13 nt, Human
cgauuuugccugu

SEQ ID NO: 3496350 - RNA, 13 nt, Human
cgauuuuguaucu

SEQ ID NO: 3496351 - RNA, 18 nt, Human
cgauuuuguaucugcagg

SEQ ID NO: 3496352 - RNA, 20 nt, Human
cgcaaacccccuuugugcug

SEQ ID NO: 3496353 - RNA, 17 nt, Human
cgcaaccaagugugcua

SEQ ID NO: 3496354 - RNA, 20 nt, Human
cgcaagccuguaaucccagc

SEQ ID NO: 3496355 - RNA, 21 nt, Human
cgcaagccuguaaucccagcu

SEQ ID NO: 3496356 - RNA, 11 nt, Human
cgcaagcugag

SEQ ID NO: 3496357 - RNA, 18 nt, Human
cgcaagggaggcccagcg

SEQ ID NO: 3496358 - RNA, 15 nt, Human
cgcaagucugcagcc

SEQ ID NO: 3496359 - RNA, 18 nt, Human
cgcaaugugcccccagac

SEQ ID NO: 3496360 - RNA, 20 nt, Human
cgcaaugugcccccagacgc

SEQ ID NO: 3496361 - RNA, 16 nt, Human
cggccuccauccugag

SEQ ID NO: 3496362 - RNA, 17 nt, Human
cggccuccauccugagg

SEQ ID NO: 3496363 - RNA, 18 nt, Human
cggccuccauccugaggc

SEQ ID NO: 3496364 - RNA, 23 nt, Human
cggccuccauccugaggcuccac

SEQ ID NO: 3496365 - RNA, 21 nt, Human
cggccuccguccaggagccug

SEQ ID NO: 3496366 - RNA, 19 nt, Human
cggccuccuaaagugcugg

SEQ ID NO: 3496367 - RNA, 23 nt, Human
cggccuccucuucaccccggcag

SEQ ID NO: 3496368 - RNA, 21 nt, Human
cggccuccuucugagcuccug

SEQ ID NO: 3496369 - RNA, 13 nt, Human
cggccucuaaccc

SEQ ID NO: 3496370 - RNA, 17 nt, Human
cggccucuaaccccagg

SEQ ID NO: 3496371 - RNA, 14 nt, Human
cggccucucuggcc

SEQ ID NO: 3496372 - RNA, 16 nt, Human
cggccucucuggccuc

SEQ ID NO: 3496373 - RNA, 19 nt, Human
cggccucucuggccuccca

SEQ ID NO: 3496374 - RNA, 21 nt, Human
cggccucucuggccucccacc

SEQ ID NO: 3496375 - RNA, 13 nt, Human
cggccucugccuu

SEQ ID NO: 3496376 - RNA, 13 nt, Human
cggccucuucucu

SEQ ID NO: 3496377 - RNA, 15 nt, Human
cggccugaugcuccc

SEQ ID NO: 3496378 - RNA, 13 nt, Human
cggccugccagga

SEQ ID NO: 3496379 - RNA, 18 nt, Human
cggccugcucccagcagc

SEQ ID NO: 3496380 - RNA, 19 nt, Human
cggccugcucccagcagcc

SEQ ID NO: 3496381 - RNA, 12 nt, Human
cggccuguccuc

SEQ ID NO: 3496382 - RNA, 14 nt, Human
cggccuuucccacu

SEQ ID NO: 3496383 - RNA, 17 nt, Human
cggccuuuguugcucag

SEQ ID NO: 3496384 - RNA, 20 nt, Human
cggcgaccgcccuccgcgaa

SEQ ID NO: 3496385 - RNA, 13 nt, Human
cggcgcgguggcu

SEQ ID NO: 3496386 - RNA, 16 nt, Human
cggcgcuucccagcac

SEQ ID NO: 3496387 - RNA, 12 nt, Human
cggcggcgccgg

SEQ ID NO: 3496388 - RNA, 19 nt, Human
cggcggucccagcucccug

SEQ ID NO: 3496389 - RNA, 15 nt, Human
cggcguacaggcugg

SEQ ID NO: 3496390 - RNA, 17 nt, Human
cggcgucagccuccagc

SEQ ID NO: 3496391 - RNA, 23 nt, Human
cggcgucagccuccagccucugu

SEQ ID NO: 3496392 - RNA, 15 nt, Human
cggcuaagaggcugc

SEQ ID NO: 3496393 - RNA, 16 nt, Human
cggcuaagaggcugcu

SEQ ID NO: 3496394 - RNA, 13 nt, Human
cggcuacucagca

SEQ ID NO: 3496395 - RNA, 14 nt, Human
cggcuacucagcag

SEQ ID NO: 3496396 - RNA, 16 nt, Human
cggcuacucagcagcc

SEQ ID NO: 3496397 - RNA, 19 nt, Human
cggcuacucagcagcccuc

SEQ ID NO: 3496398 - RNA, 21 nt, Human
cggcuacucagcagcccuccu

SEQ ID NO: 3496399 - RNA, 14 nt, Human
cggcucacugcagc

SEQ ID NO: 3496400 - RNA, 13 nt, Human
cggcuccaggcuc

SEQ ID NO: 3496401 - RNA, 15 nt, Human
cggcuccaggcuccu

SEQ ID NO: 3496402 - RNA, 16 nt, Human
cggcuccaggcuccuu

SEQ ID NO: 3496403 - RNA, 19 nt, Human
cggcuccaguccccagaac

SEQ ID NO: 3496404 - RNA, 15 nt, Human
cggcuccccaugugu

SEQ ID NO: 3496405 - RNA, 17 nt, Human
cggcuccccaugugucc

SEQ ID NO: 3496406 - RNA, 14 nt, Human
cggcuccucaggga

SEQ ID NO: 3496407 - RNA, 23 nt, Human
cggcuccucucuaaccuccuuua

SEQ ID NO: 3496408 - RNA, 14 nt, Human
cggcuccugcugca

SEQ ID NO: 3496409 - RNA, 11 nt, Human
cggcuccuggu

SEQ ID NO: 3496410 - RNA, 23 nt, Human
cggcuccugugcuuucccugaac

SEQ ID NO: 3496411 - RNA, 16 nt, Human
cggcucggaggaagcc

SEQ ID NO: 3496412 - RNA, 23 nt, Human
cggcucucuauagcaccagggcu

SEQ ID NO: 3496413 - RNA, 15 nt, Human
cggcucugaagcaag

SEQ ID NO: 3496414 - RNA, 17 nt, Human
cggcucuggccuccaag

SEQ ID NO: 3496415 - RNA, 15 nt, Human
cggcucuguccccag

SEQ ID NO: 3496416 - RNA, 19 nt, Human
cggcucuguccccagccug

SEQ ID NO: 3496417 - RNA, 15 nt, Human
cggcugagagcccca

SEQ ID NO: 3496418 - RNA, 23 nt, Human
cggcugagucaugaucucccugc

SEQ ID NO: 3496419 - RNA, 22 nt, Human
cggcugcagcucacccagcccc

SEQ ID NO: 3496420 - RNA, 18 nt, Human
cggcuggaaaugcugggc

SEQ ID NO: 3496421 - RNA, 20 nt, Human
cggcuggaaaugcugggcug

SEQ ID NO: 3496422 - RNA, 14 nt, Human
cggcuggccuggcc

SEQ ID NO: 3496423 - RNA, 12 nt, Human
cggcugggagga

SEQ ID NO: 3496424 - RNA, 12 nt, Human
cggcugggcaca

SEQ ID NO: 3496425 - RNA, 20 nt, Human
cggcugggcacacgccuccc

SEQ ID NO: 3496426 - RNA, 23 nt, Human
cggcuggggucccagcagcugcc

SEQ ID NO: 3496427 - RNA, 14 nt, Human
cggcugugcucaga

SEQ ID NO: 3496428 - RNA, 13 nt, Human
cggcugugcuggg

SEQ ID NO: 3496429 - RNA, 11 nt, Human
cggcugugugu

SEQ ID NO: 3496430 - RNA, 22 nt, Human
cggcugugugugcacgcgugug

SEQ ID NO: 3496431 - RNA, 23 nt, Human
cggcuuagacuucgacucaggau

SEQ ID NO: 3496432 - RNA, 22 nt, Human
cgggaaaagcagcccuuggcca

SEQ ID NO: 3496433 - RNA, 15 nt, Human
cgggaacagacaaca

SEQ ID NO: 3496434 - RNA, 13 nt, Human
cgggaacaguguu

SEQ ID NO: 3496435 - RNA, 14 nt, Human
cgggaaccaagcag

SEQ ID NO: 3496436 - RNA, 17 nt, Human
cgggaaccuccccagcc

SEQ ID NO: 3496437 - RNA, 20 nt, Human
cgggaagagaggaguucaau

SEQ ID NO: 3496438 - RNA, 23 nt, Human
cgggaagcaucuuccagaagugu

SEQ ID NO: 3496439 - RNA, 16 nt, Human
cgggaagggggcuggg

SEQ ID NO: 3496440 - RNA, 19 nt, Human
cgggaagggggcugggaca

SEQ ID NO: 3496441 - RNA, 10 nt, Human
cgggaauauu

SEQ ID NO: 3496442 - RNA, 20 nt, Human
cgggaauuuucaucuaggau

SEQ ID NO: 3496443 - RNA, 19 nt, Human
cgggacaccuaggcuaggg

SEQ ID NO: 3496444 - RNA, 14 nt, Human
cgggacagaguagc

SEQ ID NO: 3496445 - RNA, 22 nt, Human
cgggacaucacagggugggccu

SEQ ID NO: 3496446 - RNA, 16 nt, Human
cgggaccacccugagc

SEQ ID NO: 3496447 - RNA, 18 nt, Human
cgggaccacccugagccg

SEQ ID NO: 3496448 - RNA, 18 nt, Human
cgggacguggcaccuccu

SEQ ID NO: 3496449 - RNA, 11 nt, Human
cgggacucugc

SEQ ID NO: 3496450 - RNA, 20 nt, Human
cgggagcagugucuuccaua

SEQ ID NO: 3496451 - RNA, 22 nt, Human
cgggagcaucucuugaggccag

SEQ ID NO: 3496452 - RNA, 22 nt, Human
cgggagccaugcgcccccuccg

SEQ ID NO: 3496453 - RNA, 18 nt, Human
cgggagccgcuggcagaa

SEQ ID NO: 3496454 - RNA, 21 nt, Human
cgggagccugaucaccugccc

SEQ ID NO: 3496455 - RNA, 22 nt, Human
cgggagccugaucaccugcccu

SEQ ID NO: 3496456 - RNA, 13 nt, Human
cgggaggcugaga

SEQ ID NO: 3496457 - RNA, 20 nt, Human
cgggaggcugagacaggaga

SEQ ID NO: 3496458 - RNA, 23 nt, Human
cgggaggcugagacaggagaauc

SEQ ID NO: 3496459 - RNA, 16 nt, Human
cgggaggcugaggcag

SEQ ID NO: 3496460 - RNA, 18 nt, Human
cgggaggcugaggcagga

SEQ ID NO: 3496461 - RNA, 20 nt, Human
cgggaggucgaggcaggagg

SEQ ID NO: 3496462 - RNA, 22 nt, Human
cgggaugggagccgggcaaacu

SEQ ID NO: 3496463 - RNA, 18 nt, Human
cgggaugguccuggggcu

SEQ ID NO: 3496464 - RNA, 15 nt, Human
cgggcaccagccagc

SEQ ID NO: 3496465 - RNA, 16 nt, Human
cgggcaccagccagcg

SEQ ID NO: 3496466 - RNA, 21 nt, Human
cgggcaccuauagucccagcu

SEQ ID NO: 3496467 - RNA, 22 nt, Human
cgggcacucagaagacacugau

SEQ ID NO: 3496468 - RNA, 16 nt, Human
cgggcagagggcugga

SEQ ID NO: 3496469 - RNA, 15 nt, Human
cgggcagcacagcaa

SEQ ID NO: 3496470 - RNA, 16 nt, Human
cgggcagccuggcucc

SEQ ID NO: 3496471 - RNA, 22 nt, Human
cgggcagccuggcucccaggac

SEQ ID NO: 3496472 - RNA, 15 nt, Human
cgggcaugggcacuc

SEQ ID NO: 3496473 - RNA, 21 nt, Human
cgggcaugguggcgcaagccu

SEQ ID NO: 3496474 - RNA, 15 nt, Human
cgggccaaggaccug

SEQ ID NO: 3496475 - RNA, 20 nt, Human
cgggccaaggacugccgacc

SEQ ID NO: 3496476 - RNA, 22 nt, Human
cgggccacuccuuccugcccca

SEQ ID NO: 3496477 - RNA, 20 nt, Human
cgggccagccaggcgggcuc

SEQ ID NO: 3496478 - RNA, 21 nt, Human
cgggccagccaggcgggcuca

SEQ ID NO: 3496479 - RNA, 23 nt, Human
cgggccagccaggcgggcucaag

SEQ ID NO: 3496480 - RNA, 13 nt, Human
cgggccagggcug

SEQ ID NO: 3496481 - RNA, 19 nt, Human
cgggcccaccuggccaccu

SEQ ID NO: 3496482 - RNA, 23 nt, Human
cgggcccagcccccacagugcug

SEQ ID NO: 3496483 - RNA, 13 nt, Human
cgggcccaggcca

SEQ ID NO: 3496484 - RNA, 19 nt, Human
cgggccccaccugcagcuc

SEQ ID NO: 3496485 - RNA, 12 nt, Human
cgggccccucau

SEQ ID NO: 3496486 - RNA, 22 nt, Human
cgggcccguugaggaugaggcc

SEQ ID NO: 3496487 - RNA, 21 nt, Human
cgggcccuucccacaggacau

SEQ ID NO: 3496488 - RNA, 20 nt, Human
cgggccuggagaacuagaga

SEQ ID NO: 3496489 - RNA, 13 nt, Human
cgggccuguacag

SEQ ID NO: 3496490 - RNA, 14 nt, Human
cgggccuguacagu

SEQ ID NO: 3496491 - RNA, 17 nt, Human
cgggccuguacagucug

SEQ ID NO: 3496492 - RNA, 17 nt, Human
cgggccuguccacaggc

SEQ ID NO: 3496493 - RNA, 17 nt, Human
cgggcgagucacugccu

SEQ ID NO: 3496494 - RNA, 16 nt, Human
cgggcgcacugccucu

SEQ ID NO: 3496495 - RNA, 19 nt, Human
cgggcucagcaaaagaugc

SEQ ID NO: 3496496 - RNA, 18 nt, Human
cgggcucagggaccacag

SEQ ID NO: 3496497 - RNA, 21 nt, Human
cgaggaggugucucaggcugc

SEQ ID NO: 3496498 - RNA, 22 nt, Human
cgaggaguaacaauacaaaugg

SEQ ID NO: 3496499 - RNA, 13 nt, Human
cgaggcagaggac

SEQ ID NO: 3496500 - RNA, 22 nt, Human
cgaggcagggucaggagagggg

SEQ ID NO: 3496501 - RNA, 11 nt, Human
cgaggccagua

SEQ ID NO: 3496502 - RNA, 13 nt, Human
cgaggcccgcaug

SEQ ID NO: 3496503 - RNA, 19 nt, Human
cgaggcccucgggcccagc

SEQ ID NO: 3496504 - RNA, 20 nt, Human
cgaggcccucgggcccagcc

SEQ ID NO: 3496505 - RNA, 13 nt, Human
cgccucaaaaugu

SEQ ID NO: 3496506 - RNA, 22 nt, Human
cgccuccaaccccucgcccagu

SEQ ID NO: 3496507 - RNA, 16 nt, Human
cgccuccaacccuagc

SEQ ID NO: 3496508 - RNA, 21 nt, Human
cgccuccauuuuuguuguuau

SEQ ID NO: 3496509 - RNA, 11 nt, Human
cgccucccagc

SEQ ID NO: 3496510 - RNA, 10 nt, Human
cgccuccccg

SEQ ID NO: 3496511 - RNA, 22 nt, Human
cgccuccccgaaacaggcuacu

SEQ ID NO: 3496512 - RNA, 22 nt, Human
ccaagaauauugcaaaauacau

SEQ ID NO: 3496513 - RNA, 23 nt, Human
ccaagaauauugcaaaauacaug

SEQ ID NO: 3496514 - RNA, 12 nt, Human
ccaagaaucuau

SEQ ID NO: 3496515 - RNA, 12 nt, Human
ccaagaaugcug

SEQ ID NO: 3496516 - RNA, 13 nt, Human
ccaagaaugcuga

SEQ ID NO: 3496517 - RNA, 11 nt, Human
ccaagaaugua

SEQ ID NO: 3496518 - RNA, 17 nt, Human
ccaagaauguacgucca

SEQ ID NO: 3496519 - RNA, 21 nt, Human
ccaagaauguacguccagccu

SEQ ID NO: 3496520 - RNA, 21 nt, Human
ccaagacagaugccccagagc

SEQ ID NO: 3496521 - RNA, 23 nt, Human
ccaagacagaugccccagagcug

SEQ ID NO: 3496522 - RNA, 16 nt, Human
ccaagacauugucaau

SEQ ID NO: 3496523 - RNA, 14 nt, Human
ccaagaccagacuc

SEQ ID NO: 3496524 - RNA, 15 nt, Human
ccaagaccuucuccu

SEQ ID NO: 3496525 - RNA, 17 nt, Human
ccaagacuccagcccug

SEQ ID NO: 3496526 - RNA, 14 nt, Human
ccaagacucuagag

SEQ ID NO: 3496527 - RNA, 21 nt, Human
ccaagacucuagaguccaagg

SEQ ID NO: 3496528 - RNA, 22 nt, Human
ccaagacucuagaguccaaggu

SEQ ID NO: 3496529 - RNA, 17 nt, Human
ccaagacugcuguggcc

SEQ ID NO: 3496530 - RNA, 18 nt, Human
ccaagacugcuguggcca

SEQ ID NO: 3496531 - RNA, 21 nt, Human
ccaagacugcuguggccagga

SEQ ID NO: 3496532 - RNA, 19 nt, Human
ccaagacuucauugucccu

SEQ ID NO: 3496533 - RNA, 20 nt, Human
ccaagacuuggcaacagaag

SEQ ID NO: 3496534 - RNA, 22 nt, Human
ccaagacuuggcaacagaagca

SEQ ID NO: 3496535 - RNA, 17 nt, Human
ccaagagaaacuuccua

SEQ ID NO: 3496536 - RNA, 13 nt, Human
ccaagagaacucg

SEQ ID NO: 3496537 - RNA, 24 nt, Human
ccaagagacuccuugagagaccag

SEQ ID NO: 3496538 - RNA, 13 nt, Human
ccaagagagaaag

SEQ ID NO: 3496539 - RNA, 20 nt, Human
ccaagagauugcuaauugcu

SEQ ID NO: 3496540 - RNA, 19 nt, Human
ccaagagcagaggcagcga

SEQ ID NO: 3496541 - RNA, 17 nt, Human
ccaagagcaucaugccu

SEQ ID NO: 3496542 - RNA, 12 nt, Human
ccaagagccuga

SEQ ID NO: 3496543 - RNA, 19 nt, Human
ccaagaggaaguucagauc

SEQ ID NO: 3496544 - RNA, 11 nt, Human
ccaagaggcug

SEQ ID NO: 3496545 - RNA, 12 nt, Human
ccaagaggcugc

SEQ ID NO: 3496546 - RNA, 13 nt, Human
ccaagaggcugca

SEQ ID NO: 3496547 - RNA, 14 nt, Human
ccaagaggcugcag

SEQ ID NO: 3496548 - RNA, 15 nt, Human
ccaagaggcugcagc

SEQ ID NO: 3496549 - RNA, 16 nt, Human
ccaagaggcugcagcc

SEQ ID NO: 3496550 - RNA, 12 nt, Human
ccaagaggcugg

SEQ ID NO: 3496551 - RNA, 13 nt, Human
ccaagaucuauaa

SEQ ID NO: 3496552 - RNA, 15 nt, Human
ccaagauggcccauc

SEQ ID NO: 3496553 - RNA, 18 nt, Human
ccaagauggcccauccug

SEQ ID NO: 3496554 - RNA, 22 nt, Human
ccaagaugggcaucuuuuguau

SEQ ID NO: 3496555 - RNA, 21 nt, Human
ccaagauucacaccugacucu

SEQ ID NO: 3496556 - RNA, 14 nt, Human
ccaagauucuagau

SEQ ID NO: 3496557 - RNA, 19 nt, Human
ccaagauuuaaaugccaua

SEQ ID NO: 3496558 - RNA, 14 nt, Human
ccaagcaaauguua

SEQ ID NO: 3496559 - RNA, 23 nt, Human
ccaagcaaccuggguccaaauaa

SEQ ID NO: 3496560 - RNA, 13 nt, Human
ccaagcacagcag

SEQ ID NO: 3496561 - RNA, 19 nt, Human
ccaagcacagugguggcag

SEQ ID NO: 3496562 - RNA, 17 nt, Human
ccaagcaggagacgaca

SEQ ID NO: 3496563 - RNA, 22 nt, Human
ccaagcaguugggacuacaggc

SEQ ID NO: 3496564 - RNA, 22 nt, Human
ccaagcauaccaacacgagcag

SEQ ID NO: 3496565 - RNA, 23 nt, Human
ccaagccaagggaaccugugucc

SEQ ID NO: 3496566 - RNA, 14 nt, Human
ccaagccccauccu

SEQ ID NO: 3496567 - RNA, 18 nt, Human
ccaagcccgacuugcugu

SEQ ID NO: 3496568 - RNA, 23 nt, Human
ccaagcccuggagccaacugcug

SEQ ID NO: 3496569 - RNA, 15 nt, Human
ccaagccguggcuuc

SEQ ID NO: 3496570 - RNA, 16 nt, Human
ccaagccguggcuucc

SEQ ID NO: 3496571 - RNA, 23 nt, Human
ccaagccguggcuucccgcucag

SEQ ID NO: 3496572 - RNA, 16 nt, Human
ccaagccuccacagcg

SEQ ID NO: 3496573 - RNA, 19 nt, Human
ccaagccuccacagcgagg

SEQ ID NO: 3496574 - RNA, 13 nt, Human
ccaagccugacca

SEQ ID NO: 3496575 - RNA, 19 nt, Human
ccaagccuuggcucuaccc

SEQ ID NO: 3496576 - RNA, 17 nt, Human
ccaagcgcccuggcccc

SEQ ID NO: 3496577 - RNA, 15 nt, Human
ccaagcuaucuaaag

SEQ ID NO: 3496578 - RNA, 17 nt, Human
ccaagcuauucaauucu

SEQ ID NO: 3496579 - RNA, 17 nt, Human
ccaagcuauuccuuucc

SEQ ID NO: 3496580 - RNA, 18 nt, Human
ccaagcucaaagcgugga

SEQ ID NO: 3496581 - RNA, 18 nt, Human
ccaagcucacaguuccuc

SEQ ID NO: 3496582 - RNA, 22 nt, Human
ccaagcucacaguuccucgccc

SEQ ID NO: 3496583 - RNA, 14 nt, Human
ccaagcuccaucuc

SEQ ID NO: 3496584 - RNA, 13 nt, Human
ccaagcucccagg

SEQ ID NO: 3496585 - RNA, 15 nt, Human
ccaagcucccaggca

SEQ ID NO: 3496586 - RNA, 13 nt, Human
ccaagcucccugc

SEQ ID NO: 3496587 - RNA, 15 nt, Human
ccaagcucccugccc

SEQ ID NO: 3496588 - RNA, 17 nt, Human
ccaagcucccugcccca

SEQ ID NO: 3496589 - RNA, 20 nt, Human
ccaagcuccuccucggaacc

SEQ ID NO: 3496590 - RNA, 18 nt, Human
ccaagcucuagugggaag

SEQ ID NO: 3496591 - RNA, 13 nt, Human
ccaagcucugcuc

SEQ ID NO: 3496592 - RNA, 14 nt, Human
ccaagcucugcucc

SEQ ID NO: 3496593 - RNA, 17 nt, Human
ccaagcugaggugccca

SEQ ID NO: 3496594 - RNA, 21 nt, Human
ccaagcugaggugcccaggag

SEQ ID NO: 3496595 - RNA, 15 nt, Human
ccaagcugaguuucc

SEQ ID NO: 3496596 - RNA, 16 nt, Human
ccaagcugaguuuccu

SEQ ID NO: 3496597 - RNA, 13 nt, Human
ccaagcugggccc

SEQ ID NO: 3496598 - RNA, 17 nt, Human
ccaagcugggccccagc

SEQ ID NO: 3496599 - RNA, 12 nt, Human
ccaagcuggucc

SEQ ID NO: 3496600 - RNA, 19 nt, Human
ccaagcuggucccacucag

SEQ ID NO: 3496601 - RNA, 20 nt, Human
ccaagcugugacccucaauu

SEQ ID NO: 3496602 - RNA, 17 nt, Human
ccaagcuguuuucuucu

SEQ ID NO: 3496603 - RNA, 18 nt, Human
ccaagcuguuuucuucua

SEQ ID NO: 3496604 - RNA, 22 nt, Human
ccaagcuuccauagcugcugcc

SEQ ID NO: 3496605 - RNA, 15 nt, Human
ccaagcuuguuauca

SEQ ID NO: 3496606 - RNA, 15 nt, Human
ccaagcuuuaaauua

SEQ ID NO: 3496607 - RNA, 14 nt, Human
ccaaggaaaacugc

SEQ ID NO: 3496608 - RNA, 22 nt, Human
ccaaggaccccucaccuugcaa

SEQ ID NO: 3496609 - RNA, 14 nt, Human
ccaaggaccugaga

SEQ ID NO: 3496610 - RNA, 14 nt, Human
ccaaggagaaacag

SEQ ID NO: 3496611 - RNA, 14 nt, Human
ccaaggagacacaa

SEQ ID NO: 3496612 - RNA, 12 nt, Human
ccaaggagcaca

SEQ ID NO: 3496613 - RNA, 13 nt, Human
ccaaggagcacag

SEQ ID NO: 3496614 - RNA, 14 nt, Human
ccaaggagcacagg

SEQ ID NO: 3496615 - RNA, 19 nt, Human
ccaaggagcacagguccca

SEQ ID NO: 3496616 - RNA, 15 nt, Human
ccaaggagcugagaa

SEQ ID NO: 3496617 - RNA, 13 nt, Human
ccaaggagcugcu

SEQ ID NO: 3496618 - RNA, 18 nt, Human
ccaaggaugccccguccc

SEQ ID NO: 3496619 - RNA, 16 nt, Human
ccaaggcaaggcaggu

SEQ ID NO: 3496620 - RNA, 22 nt, Human
ccaaggcaaggggugccuggga

SEQ ID NO: 3496621 - RNA, 21 nt, Human
ccaaggcagaggccugggcug

SEQ ID NO: 3496622 - RNA, 22 nt, Human
ccaaggcagaggccugggcugg

SEQ ID NO: 3496623 - RNA, 15 nt, Human
ccaaggccaaaggaa

SEQ ID NO: 3496624 - RNA, 17 nt, Human
ccaaggccaaaggaagc

SEQ ID NO: 3496625 - RNA, 13 nt, Human
ccaaggccagguu

SEQ ID NO: 3496626 - RNA, 17 nt, Human
ccaaggcccccugccug

SEQ ID NO: 3496627 - RNA, 21 nt, Human
ccaaggcccccugccugcccu

SEQ ID NO: 3496628 - RNA, 16 nt, Human
ccaaggccgaagcucu

SEQ ID NO: 3496629 - RNA, 18 nt, Human
ccaaggccgaagcucugg

SEQ ID NO: 3496630 - RNA, 21 nt, Human
ccaaggcggccccucccgccc

SEQ ID NO: 3496631 - RNA, 20 nt, Human
ccaaggcugcgucuggaggg

SEQ ID NO: 3496632 - RNA, 14 nt, Human
ccaaggcuggcagg

SEQ ID NO: 3496633 - RNA, 21 nt, Human
ccaagggaaagaaaaggaagg

SEQ ID NO: 3496634 - RNA, 24 nt, Human
ccaagggcaaaauucccagggaag

SEQ ID NO: 3496635 - RNA, 17 nt, Human
ccaagggcuucugcacc

SEQ ID NO: 3496636 - RNA, 19 nt, Human
ccaaggggaaucagaacuc

SEQ ID NO: 3496637 - RNA, 22 nt, Human
ccaaggggagucaccuucccuu

SEQ ID NO: 3496638 - RNA, 15 nt, Human
ccaaggggccugagc

SEQ ID NO: 3496639 - RNA, 16 nt, Human
ccaaggggccugagca

SEQ ID NO: 3496640 - RNA, 17 nt, Human
ccaaggggccugagcag

SEQ ID NO: 3496641 - RNA, 16 nt, Human
ccaaggucuaggugga

SEQ ID NO: 3496642 - RNA, 21 nt, Human
ccaaggucugagccacagcag

SEQ ID NO: 3496643 - RNA, 15 nt, Human
ccaagguggcacggu

SEQ ID NO: 3496644 - RNA, 18 nt, Human
ccaaggugggcugagccc

SEQ ID NO: 3496645 - RNA, 23 nt, Human
ccaagguggucugcucgggccca

SEQ ID NO: 3496646 - RNA, 15 nt, Human
ccaagguguccuaca

SEQ ID NO: 3496647 - RNA, 20 nt, Human
ccaagguguccuacagaaaa

SEQ ID NO: 3496648 - RNA, 22 nt, Human
ccaagguguccuacagaaaaac

SEQ ID NO: 3496649 - RNA, 16 nt, Human
ccaagguucuccaaca

SEQ ID NO: 3496650 - RNA, 23 nt, Human
cggggugaguccauucucccagg

SEQ ID NO: 3496651 - RNA, 16 nt, Human
cggggugcccacaggc

SEQ ID NO: 3496652 - RNA, 15 nt, Human
cggggugcuuccuug

SEQ ID NO: 3496653 - RNA, 16 nt, Human
cgggguggauuggauu

SEQ ID NO: 3496654 - RNA, 16 nt, Human
cgggguggccacagcg

SEQ ID NO: 3496655 - RNA, 16 nt, Human
cggggugggggcagca

SEQ ID NO: 3496656 - RNA, 20 nt, Human
cgggugaacaaagcagccac

SEQ ID NO: 3496657 - RNA, 21 nt, Human
cgggugaacaaagcagccacg

SEQ ID NO: 3496658 - RNA, 15 nt, Human
cgggugcucagggcu

SEQ ID NO: 3496659 - RNA, 18 nt, Human
cggguggaucaccugagg

SEQ ID NO: 3496660 - RNA, 18 nt, Human
cggguggcuagucagaga

SEQ ID NO: 3496661 - RNA, 18 nt, Human
cggguggcucugggaucc

SEQ ID NO: 3496662 - RNA, 20 nt, Human
cgggugggcggcacagccuu

SEQ ID NO: 3496663 - RNA, 12 nt, Human
cgggugggggug

SEQ ID NO: 3496664 - RNA, 12 nt, Human
cggguggucccc

SEQ ID NO: 3496665 - RNA, 17 nt, Human
cggguuagacagccaaa

SEQ ID NO: 3496666 - RNA, 17 nt, Human
cggguuauaaugaauga

SEQ ID NO: 3496667 - RNA, 23 nt, Human
cggguuuggcgggccaaggacug

SEQ ID NO: 3496668 - RNA, 20 nt, Human
cgguaaaacaccggagacua

SEQ ID NO: 3496669 - RNA, 13 nt, Human
cgguaacuguccu

SEQ ID NO: 3496670 - RNA, 17 nt, Human
cgguaacuguccugucc

SEQ ID NO: 3496671 - RNA, 22 nt, Human
cgguagccagcacacagggcag

SEQ ID NO: 3496672 - RNA, 18 nt, Human
cgguauccccccaucuug

SEQ ID NO: 3496673 - RNA, 20 nt, Human
cgguccacccaggagccccg

SEQ ID NO: 3496674 - RNA, 16 nt, Human
cggucccaccccuccc

SEQ ID NO: 3496675 - RNA, 20 nt, Human
cgguccccacuuuauugcca

SEQ ID NO: 3496676 - RNA, 21 nt, Human
cggucccuugagaccucagcc

SEQ ID NO: 3496677 - RNA, 24 nt, Human
cggucgcccuuugcugcauggcag

SEQ ID NO: 3496678 - RNA, 23 nt, Human
cggucgggggggacccuccaagg

SEQ ID NO: 3496679 - RNA, 11 nt, Human
cggucucaggc

SEQ ID NO: 3496680 - RNA, 15 nt, Human
cggucuccugacugg

SEQ ID NO: 3496681 - RNA, 16 nt, Human
cggucuccugacuggu

SEQ ID NO: 3496682 - RNA, 20 nt, Human
cggucugcaagucagaggau

SEQ ID NO: 3496683 - RNA, 13 nt, Human
cggucugugcccc

SEQ ID NO: 3496684 - RNA, 18 nt, Human
cggugaaggugacagcag

SEQ ID NO: 3496685 - RNA, 16 nt, Human
cggugaauggcuuugu

SEQ ID NO: 3496686 - RNA, 18 nt, Human
cggugaauggcuuuguau

SEQ ID NO: 3496687 - RNA, 20 nt, Human
cggugagaggggaacagacu

SEQ ID NO: 3496688 - RNA, 13 nt, Human
cggugcagucugg

SEQ ID NO: 3496689 - RNA, 17 nt, Human
cggugccaugaagggac

SEQ ID NO: 3496690 - RNA, 13 nt, Human
cggugcccacacc

SEQ ID NO: 3496691 - RNA, 19 nt, Human
cggugccuggguggggcug

SEQ ID NO: 3496692 - RNA, 18 nt, Human
cggugcuaucucccccag

SEQ ID NO: 3496693 - RNA, 20 nt, Human
cggugcuaucucccccagcc

SEQ ID NO: 3496694 - RNA, 22 nt, Human
cggugcuaucucccccagcccc

SEQ ID NO: 3496695 - RNA, 13 nt, Human
cggugcucagggg

SEQ ID NO: 3496696 - RNA, 21 nt, Human
cggugcuguccucagguggcc

SEQ ID NO: 3496697 - RNA, 15 nt, Human
cgguggaagagcuca

SEQ ID NO: 3496698 - RNA, 22 nt, Human
cgguggacuugaacuuuccugg

SEQ ID NO: 3496699 - RNA, 13 nt, Human
cgguggaggccag

SEQ ID NO: 3496700 - RNA, 11 nt, Human
cgguggccucu

SEQ ID NO: 3496701 - RNA, 15 nt, Human
cgguggcgggcaccu

SEQ ID NO: 3496702 - RNA, 13 nt, Human
cgguggcuaaagg

SEQ ID NO: 3496703 - RNA, 13 nt, Human
cgguggcugggca

SEQ ID NO: 3496704 - RNA, 19 nt, Human
cggugggcacccacccugg

SEQ ID NO: 3496705 - RNA, 14 nt, Human
cggugggcacuguu

SEQ ID NO: 3496706 - RNA, 19 nt, Human
cggugggcauuugugaggc

SEQ ID NO: 3496707 - RNA, 19 nt, Human
cggugggccuugcugggga

SEQ ID NO: 3496708 - RNA, 16 nt, Human
cggugggggggcagag

SEQ ID NO: 3496709 - RNA, 10 nt, Human
cggugggggu

SEQ ID NO: 3496710 - RNA, 18 nt, Human
cggugucuuguucuguca

SEQ ID NO: 3496711 - RNA, 15 nt, Human
cggugugcaccaggg

SEQ ID NO: 3496712 - RNA, 20 nt, Human
cggugugccugcagccccgc

SEQ ID NO: 3496713 - RNA, 13 nt, Human
cggugugggggcc

SEQ ID NO: 3496714 - RNA, 23 nt, Human
cggugugggggccccgucucagg

SEQ ID NO: 3496715 - RNA, 19 nt, Human
cgguuaacaaauaacaacu

SEQ ID NO: 3496716 - RNA, 21 nt, Human
cgguuauaaaaaaugguucag

SEQ ID NO: 3496717 - RNA, 18 nt, Human
cgguucaaaccugugaag

SEQ ID NO: 3496718 - RNA, 13 nt, Human
cgguucaccagcc

SEQ ID NO: 3496719 - RNA, 14 nt, Human
cgguucaccagccu

SEQ ID NO: 3496720 - RNA, 18 nt, Human
cgguuccacgucccccug

SEQ ID NO: 3496721 - RNA, 20 nt, Human
cgguuccacgucccccuggg

SEQ ID NO: 3496722 - RNA, 16 nt, Human
cgguuuccagggaggg

SEQ ID NO: 3496723 - RNA, 17 nt, Human
ccaccugcaucuggggc

SEQ ID NO: 3496724 - RNA, 20 nt, Human
ccaccugccacuaggcuggg

SEQ ID NO: 3496725 - RNA, 15 nt, Human
ccaccugcccaucac

SEQ ID NO: 3496726 - RNA, 16 nt, Human
ccaccugcccaucaca

SEQ ID NO: 3496727 - RNA, 23 nt, Human
ccaccugcccaucacaggguugg

SEQ ID NO: 3496728 - RNA, 20 nt, Human
ccaccugccugcgucuuccg

SEQ ID NO: 3496729 - RNA, 21 nt, Human
ccaccugccugcgucuuccgc

SEQ ID NO: 3496730 - RNA, 12 nt, Human
ccaccugccugg

SEQ ID NO: 3496731 - RNA, 20 nt, Human
ccaccugccuguugggccag

SEQ ID NO: 3496732 - RNA, 22 nt, Human
ccaccugcggugcuaucucccc

SEQ ID NO: 3496733 - RNA, 19 nt, Human
ccaccugcuagugugaauu

SEQ ID NO: 3496734 - RNA, 15 nt, Human
ccaccugcucccagg

SEQ ID NO: 3496735 - RNA, 12 nt, Human
ccaccuggaccc

SEQ ID NO: 3496736 - RNA, 17 nt, Human
ccaccuggaccccugca

SEQ ID NO: 3496737 - RNA, 19 nt, Human
ccaccuggaccccugcauu

SEQ ID NO: 3496738 - RNA, 12 nt, Human
ccaccuggcccc

SEQ ID NO: 3496739 - RNA, 22 nt, Human
ccaccuggccccaugucucuca

SEQ ID NO: 3496740 - RNA, 12 nt, Human
ccaccuggcccu

SEQ ID NO: 3496741 - RNA, 18 nt, Human
ccaccuggcccucucuga

SEQ ID NO: 3496742 - RNA, 12 nt, Human
ccaccuggcuca

SEQ ID NO: 3496743 - RNA, 22 nt, Human
ccaccuggcucucaccucuagg

SEQ ID NO: 3496744 - RNA, 22 nt, Human
ccaccugggcauauccaccacc

SEQ ID NO: 3496745 - RNA, 16 nt, Human
ccaccuggggcaguca

SEQ ID NO: 3496746 - RNA, 21 nt, Human
ccaccugguuccggaauccug

SEQ ID NO: 3496747 - RNA, 22 nt, Human
ccaccugucaaacaaagccaga

SEQ ID NO: 3496748 - RNA, 16 nt, Human
ccaccugucccaccuc

SEQ ID NO: 3496749 - RNA, 23 nt, Human
ccaccugucucagccucccagag

SEQ ID NO: 3496750 - RNA, 22 nt, Human
ccaccugucugucugucugucc

SEQ ID NO: 3496751 - RNA, 11 nt, Human
ccaccuguggg

SEQ ID NO: 3496752 - RNA, 12 nt, Human
ccaccugugggu

SEQ ID NO: 3496753 - RNA, 17 nt, Human
ccaccuucaauuccugg

SEQ ID NO: 3496754 - RNA, 13 nt, Human
ccaccuucacauu

SEQ ID NO: 3496755 - RNA, 12 nt, Human
ccaccuucccag

SEQ ID NO: 3496756 - RNA, 15 nt, Human
ccaccuucccagcuc

SEQ ID NO: 3496757 - RNA, 13 nt, Human
ccaccuuggcuca

SEQ ID NO: 3496758 - RNA, 16 nt, Human
ccaccuuggcucaagu

SEQ ID NO: 3496759 - RNA, 12 nt, Human
ccaccuuggcug

SEQ ID NO: 3496760 - RNA, 22 nt, Human
ccaccuuguuggagccugcagg

SEQ ID NO: 3496761 - RNA, 17 nt, Human
ccaccuuuauuaaaauc

SEQ ID NO: 3496762 - RNA, 20 nt, Human
ccaccuuuauuaaaaucuua

SEQ ID NO: 3496763 - RNA, 14 nt, Human
ccacgaaggagccc

SEQ ID NO: 3496764 - RNA, 18 nt, Human
ccacgaauuucugugccc

SEQ ID NO: 3496765 - RNA, 21 nt, Human
ccacgaauuucugugcccucc

SEQ ID NO: 3496766 - RNA, 16 nt, Human
ccacgacacugcagcc

SEQ ID NO: 3496767 - RNA, 12 nt, Human
ccacgagggcug

SEQ ID NO: 3496768 - RNA, 22 nt, Human
ccacgagggcuggcuggccuca

SEQ ID NO: 3496769 - RNA, 16 nt, Human
ccacgagggucaggac

SEQ ID NO: 3496770 - RNA, 15 nt, Human
ccacgauccugccac

SEQ ID NO: 3496771 - RNA, 23 nt, Human
ccacgauccugccacccuguagc

SEQ ID NO: 3496772 - RNA, 18 nt, Human
ccacgauguggcccuggc

SEQ ID NO: 3496773 - RNA, 20 nt, Human
ccacgauguggcccuggccu

SEQ ID NO: 3496774 - RNA, 20 nt, Human
ccacgauuuucuccagcuca

SEQ ID NO: 3496775 - RNA, 21 nt, Human
ccacgauuuucuccagcucag

SEQ ID NO: 3496776 - RNA, 15 nt, Human
ccacgcagccaggac

SEQ ID NO: 3496777 - RNA, 13 nt, Human
ccacgccacagcc

SEQ ID NO: 3496778 - RNA, 13 nt, Human
ccacgcccccacu

SEQ ID NO: 3496779 - RNA, 18 nt, Human
ccacgcccccacugguga

SEQ ID NO: 3496780 - RNA, 14 nt, Human
ccacgcccuccccu

SEQ ID NO: 3496781 - RNA, 17 nt, Human
ccacgcccuccccuccc

SEQ ID NO: 3496782 - RNA, 22 nt, Human
ccacgcccuccccuccccugcu

SEQ ID NO: 3496783 - RNA, 15 nt, Human
ccacgccuagccuca

SEQ ID NO: 3496784 - RNA, 18 nt, Human
ccacgcgggggccuugag

SEQ ID NO: 3496785 - RNA, 20 nt, Human
ccacgcgugccguggcacca

SEQ ID NO: 3496786 - RNA, 14 nt, Human
ccacgcuagggcgg

SEQ ID NO: 3496787 - RNA, 22 nt, Human
ccacgcuagggcggggcacaga

SEQ ID NO: 3496788 - RNA, 12 nt, Human
ccacgcuccagc

SEQ ID NO: 3496789 - RNA, 20 nt, Human
ccacgcugacuacagggccg

SEQ ID NO: 3496790 - RNA, 13 nt, Human
ccacgcuggagug

SEQ ID NO: 3496791 - RNA, 19 nt, Human
ccacgcuggagugcaguga

SEQ ID NO: 3496792 - RNA, 13 nt, Human
ccacgcuucucuu

SEQ ID NO: 3496793 - RNA, 15 nt, Human
ccacgcuucucuuug

SEQ ID NO: 3496794 - RNA, 18 nt, Human
ccacggacguuuccauca

SEQ ID NO: 3496795 - RNA, 16 nt, Human
cuaccaacuggaagca

SEQ ID NO: 3496796 - RNA, 18 nt, Human
cuaccaacuggaagcaca

SEQ ID NO: 3496797 - RNA, 20 nt, Human
cuaccaacuuguauccaggc

SEQ ID NO: 3496798 - RNA, 16 nt, Human
cuaccaacuuuacugu

SEQ ID NO: 3496799 - RNA, 23 nt, Human
cuaccaacuuucaagaacuuguu

SEQ ID NO: 3496800 - RNA, 20 nt, Human
cuaccaaggucuucuuaaua

SEQ ID NO: 3496801 - RNA, 13 nt, Human
cuaccaauauuag

SEQ ID NO: 3496802 - RNA, 13 nt, Human
cuaccaauauuua

SEQ ID NO: 3496803 - RNA, 15 nt, Human
cuaccaauauuuaau

SEQ ID NO: 3496804 - RNA, 21 nt, Human
cuaccaauauuuaaucuuuua

SEQ ID NO: 3496805 - RNA, 15 nt, Human
cuaccaaugcaugca

SEQ ID NO: 3496806 - RNA, 13 nt, Human
cuaccacaguguc

SEQ ID NO: 3496807 - RNA, 18 nt, Human
cuaccacaugccaagcac

SEQ ID NO: 3496808 - RNA, 13 nt, Human
cuaccaccagcug

SEQ ID NO: 3496809 - RNA, 14 nt, Human
cuaccaccagcugu

SEQ ID NO: 3496810 - RNA, 15 nt, Human
cuaccaccagcugug

SEQ ID NO: 3496811 - RNA, 16 nt, Human
cuaccaccagcugugu

SEQ ID NO: 3496812 - RNA, 18 nt, Human
cuaccaccccuuccuguc

SEQ ID NO: 3496813 - RNA, 14 nt, Human
cuaccaccucccca

SEQ ID NO: 3496814 - RNA, 15 nt, Human
cuaccaccuccccag

SEQ ID NO: 3496815 - RNA, 16 nt, Human
cuaccaccuccccagc

SEQ ID NO: 3496816 - RNA, 16 nt, Human
cuaccacucacaugac

SEQ ID NO: 3496817 - RNA, 12 nt, Human
cuaccacuccug

SEQ ID NO: 3496818 - RNA, 22 nt, Human
cuaccagcgcccgcugggcuga

SEQ ID NO: 3496819 - RNA, 22 nt, Human
cuaccaggucaaaauagugcca

SEQ ID NO: 3496820 - RNA, 15 nt, Human
cuaccagguguucua

SEQ ID NO: 3496821 - RNA, 18 nt, Human
cuaccagugcaggcuggc

SEQ ID NO: 3496822 - RNA, 14 nt, Human
cuaccaucagggac

SEQ ID NO: 3496823 - RNA, 19 nt, Human
cuaccaugaacagaaaaca

SEQ ID NO: 3496824 - RNA, 13 nt, Human
cuaccauuucaga

SEQ ID NO: 3496825 - RNA, 12 nt, Human
cuacccaaagga

SEQ ID NO: 3496826 - RNA, 13 nt, Human
cuacccaaccacu

SEQ ID NO: 3496827 - RNA, 15 nt, Human
cuacccaaccacuca

SEQ ID NO: 3496828 - RNA, 16 nt, Human
cuacccaaccacucaa

SEQ ID NO: 3496829 - RNA, 18 nt, Human
cuacccacaccucugcca

SEQ ID NO: 3496830 - RNA, 20 nt, Human
cuacccacaccucugccaga

SEQ ID NO: 3496831 - RNA, 23 nt, Human
cuacccacguucucacacccacc

SEQ ID NO: 3496832 - RNA, 15 nt, Human
cuacccagcccaucu

SEQ ID NO: 3496833 - RNA, 17 nt, Human
cuacccagcgagcccug

SEQ ID NO: 3496834 - RNA, 20 nt, Human
cuacccagcgagcccuggug

SEQ ID NO: 3496835 - RNA, 20 nt, Human
cuacccaggaggcugaggug

SEQ ID NO: 3496836 - RNA, 17 nt, Human
cuaccccaauuccuugu

SEQ ID NO: 3496837 - RNA, 19 nt, Human
cuacccccuccucucugcc

SEQ ID NO: 3496838 - RNA, 13 nt, Human
cuacccccugugc

SEQ ID NO: 3496839 - RNA, 15 nt, Human
cuaccccgcagacac

SEQ ID NO: 3496840 - RNA, 11 nt, Human
cuaccccuccc

SEQ ID NO: 3496841 - RNA, 17 nt, Human
cuaccccucccagcuga

SEQ ID NO: 3496842 - RNA, 21 nt, Human
cuaccccucccggcccugccu

SEQ ID NO: 3496843 - RNA, 14 nt, Human
cuaccccuggauga

SEQ ID NO: 3496844 - RNA, 12 nt, Human
cuaccccuggcu

SEQ ID NO: 3496845 - RNA, 15 nt, Human
cuacccgcagaguuc

SEQ ID NO: 3496846 - RNA, 17 nt, Human
cuacccgcaucuucugu

SEQ ID NO: 3496847 - RNA, 20 nt, Human
cuacccgggaagggggcugg

SEQ ID NO: 3496848 - RNA, 15 nt, Human
cuacccguuccaaaa

SEQ ID NO: 3496849 - RNA, 15 nt, Human
cuacccuaaccaagu

SEQ ID NO: 3496850 - RNA, 19 nt, Human
cuacccuagccauuccugg

SEQ ID NO: 3496851 - RNA, 16 nt, Human
cuacccucccaccccc

SEQ ID NO: 3496852 - RNA, 20 nt, Human
cuacccucccugcugucccc

SEQ ID NO: 3496853 - RNA, 17 nt, Human
cuacccucgggcccacc

SEQ ID NO: 3496854 - RNA, 19 nt, Human
cuacccucgggcccaccug

SEQ ID NO: 3496855 - RNA, 17 nt, Human
cuacccucuuagaaaaa

SEQ ID NO: 3496856 - RNA, 12 nt, Human
cuacccugagcu

SEQ ID NO: 3496857 - RNA, 13 nt, Human
cuacccugccucc

SEQ ID NO: 3496858 - RNA, 17 nt, Human
cuacccuggacuugccu

SEQ ID NO: 3496859 - RNA, 16 nt, Human
cuacccuuuuucucca

SEQ ID NO: 3496860 - RNA, 21 nt, Human
cuaccgacccaggguucccgc

SEQ ID NO: 3496861 - RNA, 23 nt, Human
cuaccgagucucuucuccacugg

SEQ ID NO: 3496862 - RNA, 13 nt, Human
cuaccgaguucaa

SEQ ID NO: 3496863 - RNA, 14 nt, Human
cuaccgaguucaag

SEQ ID NO: 3496864 - RNA, 22 nt, Human
cuaccucacuauucaaguauua

SEQ ID NO: 3496865 - RNA, 11 nt, Human
cuaccucagcc

SEQ ID NO: 3496866 - RNA, 12 nt, Human
cuaccucagccu

SEQ ID NO: 3496867 - RNA, 14 nt, Human
cuaccucagccuag

SEQ ID NO: 3496868 - RNA, 17 nt, Human
cuaccucaggcagcuca

SEQ ID NO: 3496869 - RNA, 14 nt, Human
cuaccucaggcagg

SEQ ID NO: 3496870 - RNA, 23 nt, Human
cuaccucaggcaggaagggcagg

SEQ ID NO: 3496871 - RNA, 13 nt, Human
cuaccucagguug

SEQ ID NO: 3496872 - RNA, 14 nt, Human
cuaccucagguugc

SEQ ID NO: 3496873 - RNA, 18 nt, Human
cuaccucagguugcuggu

SEQ ID NO: 3496874 - RNA, 19 nt, Human
cuaccucagguugcugguu

SEQ ID NO: 3496875 - RNA, 20 nt, Human
cuaccucagguugcugguug

SEQ ID NO: 3496876 - RNA, 15 nt, Human
cuaccucagucagua

SEQ ID NO: 3496877 - RNA, 23 nt, Human
cuaccucccuccccgucucauuc

SEQ ID NO: 3496878 - RNA, 14 nt, Human
cuaccuccucaggg

SEQ ID NO: 3496879 - RNA, 15 nt, Human
cuaccuccucaggga

SEQ ID NO: 3496880 - RNA, 13 nt, Human
cuaccucucuguc

SEQ ID NO: 3496881 - RNA, 14 nt, Human
cuaccugagcuaaa

SEQ ID NO: 3496882 - RNA, 16 nt, Human
cuaccugaggggccuc

SEQ ID NO: 3496883 - RNA, 23 nt, Human
cuaccugaggggccucuuauggg

SEQ ID NO: 3496884 - RNA, 15 nt, Human
cuaccugaucccacu

SEQ ID NO: 3496885 - RNA, 20 nt, Human
cuaccugauuggugcaaccc

SEQ ID NO: 3496886 - RNA, 14 nt, Human
cuaccugccacuca

SEQ ID NO: 3496887 - RNA, 15 nt, Human
cuaccugccacucac

SEQ ID NO: 3496888 - RNA, 21 nt, Human
cuaccugccccacuuguccuu

SEQ ID NO: 3496889 - RNA, 12 nt, Human
cuaccugcccuc

SEQ ID NO: 3496890 - RNA, 14 nt, Human
cuaccugcccugga

SEQ ID NO: 3496891 - RNA, 20 nt, Human
ccacucgggaggcugagaca

SEQ ID NO: 3496892 - RNA, 23 nt, Human
ccacucuaccagugcaggcuggc

SEQ ID NO: 3496893 - RNA, 20 nt, Human
ccacucuacccucccacccc

SEQ ID NO: 3496894 - RNA, 23 nt, Human
ccacucuaggggucaggcuccau

SEQ ID NO: 3496895 - RNA, 15 nt, Human
ccacucucagaggcc

SEQ ID NO: 3496896 - RNA, 16 nt, Human
ccacucucauucccca

SEQ ID NO: 3496897 - RNA, 14 nt, Human
ccacucuccccaca

SEQ ID NO: 3496898 - RNA, 17 nt, Human
ccacucuccccacacua

SEQ ID NO: 3496899 - RNA, 20 nt, Human
ccacucucccccacccccuc

SEQ ID NO: 3496900 - RNA, 21 nt, Human
ccacucuccuugcuacccaga

SEQ ID NO: 3496901 - RNA, 14 nt, Human
ccacucugccucug

SEQ ID NO: 3496902 - RNA, 21 nt, Human
ccacucugcucgccuuagcac

SEQ ID NO: 3496903 - RNA, 13 nt, Human
ccacucugcucug

SEQ ID NO: 3496904 - RNA, 19 nt, Human
ccacucugcuucucugacu

SEQ ID NO: 3496905 - RNA, 23 nt, Human
ccacucuggagcauuucucauca

SEQ ID NO: 3496906 - RNA, 15 nt, Human
ccacucuggcagcca

SEQ ID NO: 3496907 - RNA, 16 nt, Human
ccacucuggcagccac

SEQ ID NO: 3496908 - RNA, 17 nt, Human
ccacucuggcagccaca

SEQ ID NO: 3496909 - RNA, 11 nt, Human
ccacucuguaa

SEQ ID NO: 3496910 - RNA, 13 nt, Human
ccacucuguaauu

SEQ ID NO: 3496911 - RNA, 14 nt, Human
ccacucuguaauug

SEQ ID NO: 3496912 - RNA, 22 nt, Human
ccacucugugccugaccuugag

SEQ ID NO: 3496913 - RNA, 11 nt, Human
ccacucuucuc

SEQ ID NO: 3496914 - RNA, 15 nt, Human
ccacucuuucuuuca

SEQ ID NO: 3496915 - RNA, 14 nt, Human
ccacugaagaggag

SEQ ID NO: 3496916 - RNA, 14 nt, Human
ccacugaagcuggg

SEQ ID NO: 3496917 - RNA, 16 nt, Human
ccacugacagccuccc

SEQ ID NO: 3496918 - RNA, 13 nt, Human
ccacugaccagaa

SEQ ID NO: 3496919 - RNA, 16 nt, Human
ccacugacugcaggga

SEQ ID NO: 3496920 - RNA, 22 nt, Human
ccacugauagaugucuauucuu

SEQ ID NO: 3496921 - RNA, 17 nt, Human
ccacugaugcuguucuc

SEQ ID NO: 3496922 - RNA, 15 nt, Human
ccacugauggaaaca

SEQ ID NO: 3496923 - RNA, 18 nt, Human
ccacugcaaguccuuuug

SEQ ID NO: 3496924 - RNA, 22 nt, Human
ccacugcaaguccuuuuguaaa

SEQ ID NO: 3496925 - RNA, 14 nt, Human
ccacugcacagagc

SEQ ID NO: 3496926 - RNA, 22 nt, Human
ccacugcacccccuccugcugc

SEQ ID NO: 3496927 - RNA, 11 nt, Human
ccacugcacuc

SEQ ID NO: 3496928 - RNA, 14 nt, Human
ccacugcacuccag

SEQ ID NO: 3496929 - RNA, 13 nt, Human
ccacugccagcag

SEQ ID NO: 3496930 - RNA, 17 nt, Human
ccacugccagcagcagc

SEQ ID NO: 3496931 - RNA, 16 nt, Human
ccacugccauaaaaca

SEQ ID NO: 3496932 - RNA, 19 nt, Human
ccacugcccacccccucaa

SEQ ID NO: 3496933 - RNA, 15 nt, Human
ccacugcccacuggc

SEQ ID NO: 3496934 - RNA, 15 nt, Human
ccacugcccgagcug

SEQ ID NO: 3496935 - RNA, 13 nt, Human
ccacugcccucug

SEQ ID NO: 3496936 - RNA, 17 nt, Human
ccacugcccuucucauu

SEQ ID NO: 3496937 - RNA, 13 nt, Human
ccacugccucagg

SEQ ID NO: 3496938 - RNA, 14 nt, Human
ccacugccucaggu

SEQ ID NO: 3496939 - RNA, 16 nt, Human
ccacugccucagguuc

SEQ ID NO: 3496940 - RNA, 13 nt, Human
ccacugccucucc

SEQ ID NO: 3496941 - RNA, 17 nt, Human
ccacugccucucccucu

SEQ ID NO: 3496942 - RNA, 17 nt, Human
ccagcccugcuggggau

SEQ ID NO: 3496943 - RNA, 19 nt, Human
ccagcccugcuggggaucc

SEQ ID NO: 3496944 - RNA, 17 nt, Human
ccagcccuggcugaagg

SEQ ID NO: 3496945 - RNA, 18 nt, Human
ccagcccuggcugaagga

SEQ ID NO: 3496946 - RNA, 21 nt, Human
ccagcccuggcugaaggacug

SEQ ID NO: 3496947 - RNA, 15 nt, Human
ccagcccuggggcug

SEQ ID NO: 3496948 - RNA, 19 nt, Human
ccagcccuggggcugggcc

SEQ ID NO: 3496949 - RNA, 13 nt, Human
cuaauaauaaaua

SEQ ID NO: 3496950 - RNA, 14 nt, Human
cuaauaauaaauag

SEQ ID NO: 3496951 - RNA, 17 nt, Human
cuaauaauaaauaguuc

SEQ ID NO: 3496952 - RNA, 18 nt, Human
cuaauaaucauuggauuc

SEQ ID NO: 3496953 - RNA, 19 nt, Human
cuaauaaucuuguuucuga

SEQ ID NO: 3496954 - RNA, 20 nt, Human
cuaauaaugagcuauuaaaa

SEQ ID NO: 3496955 - RNA, 14 nt, Human
cuaauaauuucuaa

SEQ ID NO: 3496956 - RNA, 16 nt, Human
cuaauacauuaaagca

SEQ ID NO: 3496957 - RNA, 16 nt, Human
cuaauaccucugugug

SEQ ID NO: 3496958 - RNA, 17 nt, Human
cuaauaccucugugugc

SEQ ID NO: 3496959 - RNA, 20 nt, Human
cuaauagaacucaguuuuaa

SEQ ID NO: 3496960 - RNA, 18 nt, Human
cuaauagacuaaaugaaa

SEQ ID NO: 3496961 - RNA, 19 nt, Human
cuaauagcuacaucuacuu

SEQ ID NO: 3496962 - RNA, 22 nt, Human
cuaauagggcaauuaauuccuu

SEQ ID NO: 3496963 - RNA, 14 nt, Human
cuaauaguauaaac

SEQ ID NO: 3496964 - RNA, 17 nt, Human
cuaauauauaugaauaa

SEQ ID NO: 3496965 - RNA, 11 nt, Human
cuaauauauuu

SEQ ID NO: 3496966 - RNA, 17 nt, Human
cuaauauauuuaaaaau

SEQ ID NO: 3496967 - RNA, 21 nt, Human
cuaauaugaugacuguuuuua

SEQ ID NO: 3496968 - RNA, 18 nt, Human
cuaauauuaaaaauaugg

SEQ ID NO: 3496969 - RNA, 13 nt, Human
cuaauauuaaaag

SEQ ID NO: 3496970 - RNA, 16 nt, Human
cuaauauuaaaaguca

SEQ ID NO: 3496971 - RNA, 13 nt, Human
cuaaucaaagcca

SEQ ID NO: 3496972 - RNA, 20 nt, Human
cuaaucaaagccagggucuc

SEQ ID NO: 3496973 - RNA, 21 nt, Human
cuaaucagcauucucacuccu

SEQ ID NO: 3496974 - RNA, 12 nt, Human
cuaaucaguguc

SEQ ID NO: 3496975 - RNA, 13 nt, Human
cuaaucagugucu

SEQ ID NO: 3496976 - RNA, 16 nt, Human
cuaaucagugucucac

SEQ ID NO: 3496977 - RNA, 18 nt, Human
cuaaucagugucucacac

SEQ ID NO: 3496978 - RNA, 13 nt, Human
cuaauccaaccca

SEQ ID NO: 3496979 - RNA, 19 nt, Human
cuaaucccugggcauugcu

SEQ ID NO: 3496980 - RNA, 20 nt, Human
cuaaucuauggucgggagac

SEQ ID NO: 3496981 - RNA, 14 nt, Human
cuaaucuauugggu

SEQ ID NO: 3496982 - RNA, 18 nt, Human
cuaaucuauuggguucau

SEQ ID NO: 3496983 - RNA, 21 nt, Human
cuaaucuauuggguucauuau

SEQ ID NO: 3496984 - RNA, 22 nt, Human
cuaaucuauuggguucauuauu

SEQ ID NO: 3496985 - RNA, 18 nt, Human
cuaaucucauaccucuga

SEQ ID NO: 3496986 - RNA, 20 nt, Human
cuaaucucauaccucugacc

SEQ ID NO: 3496987 - RNA, 21 nt, Human
cuaaucucauaccucugacca

SEQ ID NO: 3496988 - RNA, 22 nt, Human
cuaaucucauaccucugaccaa

SEQ ID NO: 3496989 - RNA, 20 nt, Human
cuaaucugugcuguuucaaa

SEQ ID NO: 3496990 - RNA, 22 nt, Human
cuaaucuucagggcacugcugc

SEQ ID NO: 3496991 - RNA, 23 nt, Human
cuaaugaagggaaaggauauuuu

SEQ ID NO: 3496992 - RNA, 22 nt, Human
cuaaugaaugcauaaaauguua

SEQ ID NO: 3496993 - RNA, 22 nt, Human
cuaaugacaucaccacaguuua

SEQ ID NO: 3496994 - RNA, 15 nt, Human
cuaaugacauucaau

SEQ ID NO: 3496995 - RNA, 16 nt, Human
cuaaugagaagucaac

SEQ ID NO: 3496996 - RNA, 18 nt, Human
cuaaugccuuacucuucu

SEQ ID NO: 3496997 - RNA, 19 nt, Human
cuaaugcuccuuguuccua

SEQ ID NO: 3496998 - RNA, 23 nt, Human
cuaaugcugcagauuugggcugg

SEQ ID NO: 3496999 - RNA, 16 nt, Human
cuaauguaaaaugauu

SEQ ID NO: 3497000 - RNA, 19 nt, Human
cuaauguaauaacugugaa

SEQ ID NO: 3497001 - RNA, 21 nt, Human
cuaauguauuuuauuguaaca

SEQ ID NO: 3497002 - RNA, 21 nt, Human
cuaaugucuucauuucauugu

SEQ ID NO: 3497003 - RNA, 17 nt, Human
cuaauguuuaagcagaa

SEQ ID NO: 3497004 - RNA, 17 nt, Human
cuaauguuuaugagcca

SEQ ID NO: 3497005 - RNA, 16 nt, Human
cuaauuaaaaaguuaa

SEQ ID NO: 3497006 - RNA, 20 nt, Human
cuaauuaaaacacuuucaaa

SEQ ID NO: 3497007 - RNA, 18 nt, Human
cuaauuaaccuuacuaau

SEQ ID NO: 3497008 - RNA, 13 nt, Human
cuaauuaauaaag

SEQ ID NO: 3497009 - RNA, 14 nt, Human
cuaauuaauaaauu

SEQ ID NO: 3497010 - RNA, 13 nt, Human
cuaauuaauauau

SEQ ID NO: 3497011 - RNA, 18 nt, Human
cuaauuaauauauuaaaa

SEQ ID NO: 3497012 - RNA, 17 nt, Human
cuaauuaauuguaaucu

SEQ ID NO: 3497013 - RNA, 22 nt, Human
cuaauuacgauaaggaagaaac

SEQ ID NO: 3497014 - RNA, 20 nt, Human
cuaauuaggguacauuuaua

SEQ ID NO: 3497015 - RNA, 21 nt, Human
cuaauuauacuacuuuguuag

SEQ ID NO: 3497016 - RNA, 16 nt, Human
cuaauuauauaauauu

SEQ ID NO: 3497017 - RNA, 18 nt, Human
cuaauuauauaauauuuu

SEQ ID NO: 3497018 - RNA, 16 nt, Human
cuaauuauuuuaauua

SEQ ID NO: 3497019 - RNA, 22 nt, Human
cuaauuauuuuaauuagguuaa

SEQ ID NO: 3497020 - RNA, 18 nt, Human
cuaauucaaggaauuucu

SEQ ID NO: 3497021 - RNA, 15 nt, Human
cuaauucacagugcu

SEQ ID NO: 3497022 - RNA, 20 nt, Human
cuaauucagccauguacaga

SEQ ID NO: 3497023 - RNA, 15 nt, Human
cuaauuccacaccuu

SEQ ID NO: 3497024 - RNA, 17 nt, Human
cuaauuccacaccuuuu

SEQ ID NO: 3497025 - RNA, 16 nt, Human
cuaauuccacagcugc

SEQ ID NO: 3497026 - RNA, 17 nt, Human
cuaauucccauuuugca

SEQ ID NO: 3497027 - RNA, 24 nt, Human
cuaauucuaaccagagcaagcuuu

SEQ ID NO: 3497028 - RNA, 14 nt, Human
cuaauucuaaugug

SEQ ID NO: 3497029 - RNA, 20 nt, Human
cuaauucuauuaaagugcua

SEQ ID NO: 3497030 - RNA, 15 nt, Human
cuaauucuuccuuug

SEQ ID NO: 3497031 - RNA, 16 nt, Human
cuaauucuucuguccu

SEQ ID NO: 3497032 - RNA, 17 nt, Human
cuaauucuugcauauuu

SEQ ID NO: 3497033 - RNA, 13 nt, Human
cuaauucuuuaau

SEQ ID NO: 3497034 - RNA, 17 nt, Human
cuaauugacuuuagaaa

SEQ ID NO: 3497035 - RNA, 14 nt, Human
cuaauugcuguuga

SEQ ID NO: 3497036 - RNA, 15 nt, Human
cuaauugcuguugaa

SEQ ID NO: 3497037 - RNA, 16 nt, Human
cuaauugcuguugaaa

SEQ ID NO: 3497038 - RNA, 21 nt, Human
cuaauugcuguugaaagcaaa

SEQ ID NO: 3497039 - RNA, 24 nt, Human
cuaauugcuguugaaagcaaaaau

SEQ ID NO: 3497040 - RNA, 17 nt, Human
cuaauugggaguccagg

SEQ ID NO: 3497041 - RNA, 19 nt, Human
cuaauugguacuuuuaaaa

SEQ ID NO: 3497042 - RNA, 16 nt, Human
cuaauuguauaacagg

SEQ ID NO: 3497043 - RNA, 12 nt, Human
cuaauuuaaaaa

SEQ ID NO: 3497044 - RNA, 14 nt, Human
cuaauuuaaagaga

SEQ ID NO: 3497045 - RNA, 17 nt, Human
cuaauuuaacccagcuc

SEQ ID NO: 3497046 - RNA, 21 nt, Human
cuaauuuauccugaaauuuca

SEQ ID NO: 3497047 - RNA, 17 nt, Human
cuaauuuauucuaaauu

SEQ ID NO: 3497048 - RNA, 19 nt, Human
cuaauuucaaaaauauaac

SEQ ID NO: 3497049 - RNA, 18 nt, Human
cuaauuucaaaaugcuuu

SEQ ID NO: 3497050 - RNA, 19 nt, Human
cuaauuucaaaaugcuuuu

SEQ ID NO: 3497051 - RNA, 22 nt, Human
cuaauuucaaaaugcuuuuuau

SEQ ID NO: 3497052 - RNA, 15 nt, Human
cuaauuugauguuua

SEQ ID NO: 3497053 - RNA, 16 nt, Human
cuaauuugauguuuac

SEQ ID NO: 3497054 - RNA, 14 nt, Human
cuaauuugcugcug

SEQ ID NO: 3497055 - RNA, 22 nt, Human
cuaauuuguaggaaaaagcaag

SEQ ID NO: 3497056 - RNA, 19 nt, Human
cuaauuuguuuuggauaua

SEQ ID NO: 3497057 - RNA, 19 nt, Human
cuaauuuuacauguuuaua

SEQ ID NO: 3497058 - RNA, 19 nt, Human
cuaauuuucucaaaagcau

SEQ ID NO: 3497059 - RNA, 20 nt, Human
cuaauuuucucaaaagcauu

SEQ ID NO: 3497060 - RNA, 22 nt, Human
cuaauuuucucaaaagcauuua

SEQ ID NO: 3497061 - RNA, 12 nt, Human
cuaauuuuuaag

SEQ ID NO: 3497062 - RNA, 17 nt, Human
cuaauuuuuauuaauuu

SEQ ID NO: 3497063 - RNA, 22 nt, Human
cuaauuuuuauuaauuuuaguu

SEQ ID NO: 3497064 - RNA, 17 nt, Human
cuaauuuuuauucauaa

SEQ ID NO: 3497065 - RNA, 18 nt, Human
cuaauuuuuauuuuugcu

SEQ ID NO: 3497066 - RNA, 13 nt, Human
cuaauuuuuguau

SEQ ID NO: 3497067 - RNA, 23 nt, Human
cuaauuuuuguauuuuuaguaga

SEQ ID NO: 3497068 - RNA, 18 nt, Human
cuaauuuuuguauuuuuu

SEQ ID NO: 3497069 - RNA, 17 nt, Human
cuacaaaaacacagcaa

SEQ ID NO: 3497070 - RNA, 16 nt, Human
cuacaaaaauuaacug

SEQ ID NO: 3497071 - RNA, 20 nt, Human
cuacaaaaccugauguuaaa

SEQ ID NO: 3497072 - RNA, 18 nt, Human
cuacaaaauuugaaauuu

SEQ ID NO: 3497073 - RNA, 17 nt, Human
cuacaaacaaaauuucu

SEQ ID NO: 3497074 - RNA, 17 nt, Human
cuacaaagguuuaaaug

SEQ ID NO: 3497075 - RNA, 14 nt, Human
cuacaacagccuca

SEQ ID NO: 3497076 - RNA, 16 nt, Human
cuacaacagccucacu

SEQ ID NO: 3497077 - RNA, 13 nt, Human
cuacaaccaagcu

SEQ ID NO: 3497078 - RNA, 20 nt, Human
cuacaaccaagcucucugca

SEQ ID NO: 3497079 - RNA, 15 nt, Human
cuacaaccaauggaa

SEQ ID NO: 3497080 - RNA, 17 nt, Human
cuacaacuucagcagua

SEQ ID NO: 3497081 - RNA, 15 nt, Human
cuacaauacaucuga

SEQ ID NO: 3497082 - RNA, 12 nt, Human
cuacaauauaua

SEQ ID NO: 3497083 - RNA, 16 nt, Human
cuacaauaucuucaua

SEQ ID NO: 3497084 - RNA, 13 nt, Human
cuacacacugcau

SEQ ID NO: 3497085 - RNA, 21 nt, Human
cuacacagggauguacaaggc

SEQ ID NO: 3497086 - RNA, 12 nt, Human
cuaucuguauuc

SEQ ID NO: 3497087 - RNA, 18 nt, Human
cuaucugucugguggccc

SEQ ID NO: 3497088 - RNA, 12 nt, Human
cuaucugugcua

SEQ ID NO: 3497089 - RNA, 15 nt, Human
cuaucuuaauacuaa

SEQ ID NO: 3497090 - RNA, 13 nt, Human
cuaucuuaauuuu

SEQ ID NO: 3497091 - RNA, 14 nt, Human
cuaucuuaauuuug

SEQ ID NO: 3497092 - RNA, 21 nt, Human
cuaucuuagugguuccccacc

SEQ ID NO: 3497093 - RNA, 14 nt, Human
cuaucuucauguaa

SEQ ID NO: 3497094 - RNA, 13 nt, Human
cuaucuuccaaau

SEQ ID NO: 3497095 - RNA, 17 nt, Human
cuaucuugcucuguaau

SEQ ID NO: 3497096 - RNA, 14 nt, Human
cuaucuuugccacc

SEQ ID NO: 3497097 - RNA, 19 nt, Human
cuaucuuugccacccucau

SEQ ID NO: 3497098 - RNA, 21 nt, Human
cuaucuuugccacccucaugc

SEQ ID NO: 3497099 - RNA, 19 nt, Human
cuaucuuuuguuuccuuuu

SEQ ID NO: 3497100 - RNA, 17 nt, Human
cuaugaaaaugcuggcu

SEQ ID NO: 3497101 - RNA, 16 nt, Human
cuaugaacugaaggca

SEQ ID NO: 3497102 - RNA, 20 nt, Human
cuaugaagagcuagagaaau

SEQ ID NO: 3497103 - RNA, 13 nt, Human
ccagcccuggucu

SEQ ID NO: 3497104 - RNA, 20 nt, Human
ccagcccuggucucagcagc

SEQ ID NO: 3497105 - RNA, 18 nt, Human
ccagcccuguggaaggga

SEQ ID NO: 3497106 - RNA, 16 nt, Human
ccagcccuuagcaggg

SEQ ID NO: 3497107 - RNA, 17 nt, Human
ccagcccuuagcaggga

SEQ ID NO: 3497108 - RNA, 13 nt, Human
ccagcccuuccuc

SEQ ID NO: 3497109 - RNA, 18 nt, Human
ccagcccuuccucugcuc

SEQ ID NO: 3497110 - RNA, 20 nt, Human
ccagcccuuugggaggcuga

SEQ ID NO: 3497111 - RNA, 14 nt, Human
ccagccgacccccu

SEQ ID NO: 3497112 - RNA, 23 nt, Human
ccagccgacccccucucccugca

SEQ ID NO: 3497113 - RNA, 23 nt, Human
ccagccgagauagccaaggccaa

SEQ ID NO: 3497114 - RNA, 19 nt, Human
ccagccgccaucagcccaa

SEQ ID NO: 3497115 - RNA, 14 nt, Human
ccagccggcauggc

SEQ ID NO: 3497116 - RNA, 13 nt, Human
ccagccggccucu

SEQ ID NO: 3497117 - RNA, 20 nt, Human
ccagccggccucucuggccu

SEQ ID NO: 3497118 - RNA, 22 nt, Human
ccagccggccucucuggccucc

SEQ ID NO: 3497119 - RNA, 21 nt, Human
ccagccggggcgaguggcacg

SEQ ID NO: 3497120 - RNA, 20 nt, Human
ccagccgugagugcagaccc

SEQ ID NO: 3497121 - RNA, 19 nt, Human
ccagccgugaugcucaggc

SEQ ID NO: 3497122 - RNA, 23 nt, Human
ccagccgugaugcucaggcuuga

SEQ ID NO: 3497123 - RNA, 21 nt, Human
ccagccuaugagcauccugag

SEQ ID NO: 3497124 - RNA, 17 nt, Human
ccagccucaaauccagg

SEQ ID NO: 3497125 - RNA, 23 nt, Human
ccagccucaaauccaggacccug

SEQ ID NO: 3497126 - RNA, 14 nt, Human
ccagccucacccuu

SEQ ID NO: 3497127 - RNA, 21 nt, Human
ccagccucagcgcggcccucc

SEQ ID NO: 3497128 - RNA, 13 nt, Human
ccagccucccuga

SEQ ID NO: 3497129 - RNA, 21 nt, Human
ccagccuccgagagggagaga

SEQ ID NO: 3497130 - RNA, 11 nt, Human
ccagccuccuc

SEQ ID NO: 3497131 - RNA, 15 nt, Human
ccagccuccucugga

SEQ ID NO: 3497132 - RNA, 23 nt, Human
ccagccuccucuggacggcaggc

SEQ ID NO: 3497133 - RNA, 20 nt, Human
ccagccucuagggaccccuc

SEQ ID NO: 3497134 - RNA, 13 nt, Human
ccagccucucccc

SEQ ID NO: 3497135 - RNA, 14 nt, Human
ccagccucuccccu

SEQ ID NO: 3497136 - RNA, 19 nt, Human
ccagccucugagccccugg

SEQ ID NO: 3497137 - RNA, 21 nt, Human
ccagccucugagccccuggga

SEQ ID NO: 3497138 - RNA, 24 nt, Human
ccagccucugagccccugggacug

SEQ ID NO: 3497139 - RNA, 15 nt, Human
ccagccucuguuccc

SEQ ID NO: 3497140 - RNA, 19 nt, Human
ccagccugaacagaagcuc

SEQ ID NO: 3497141 - RNA, 17 nt, Human
ccagccugaccuuccuu

SEQ ID NO: 3497142 - RNA, 11 nt, Human
ccagccugagc

SEQ ID NO: 3497143 - RNA, 12 nt, Human
ccagccugagca

SEQ ID NO: 3497144 - RNA, 19 nt, Human
ccagccugagcgacaguga

SEQ ID NO: 3497145 - RNA, 13 nt, Human
ccagccugaggca

SEQ ID NO: 3497146 - RNA, 16 nt, Human
ccagccugccuggcag

SEQ ID NO: 3497147 - RNA, 18 nt, Human
ccagccugccuggcaggc

SEQ ID NO: 3497148 - RNA, 14 nt, Human
ccagccugcgccug

SEQ ID NO: 3497149 - RNA, 14 nt, Human
ccagccugcuagcu

SEQ ID NO: 3497150 - RNA, 15 nt, Human
ccagccugcuagcua

SEQ ID NO: 3497151 - RNA, 21 nt, Human
ccagccugcuagcuagcucaa

SEQ ID NO: 3497152 - RNA, 13 nt, Human
ccagccuggagau

SEQ ID NO: 3497153 - RNA, 20 nt, Human
ccagccuggagaugaaaucu

SEQ ID NO: 3497154 - RNA, 11 nt, Human
ccagccuggcc

SEQ ID NO: 3497155 - RNA, 12 nt, Human
ccagccuggcca

SEQ ID NO: 3497156 - RNA, 12 nt, Human
ccagccuggccc

SEQ ID NO: 3497157 - RNA, 13 nt, Human
ccagccuggccca

SEQ ID NO: 3497158 - RNA, 16 nt, Human
ccagccuggcccagcu

SEQ ID NO: 3497159 - RNA, 12 nt, Human
ccagccuggccu

SEQ ID NO: 3497160 - RNA, 15 nt, Human
ccagccuggccuccu

SEQ ID NO: 3497161 - RNA, 16 nt, Human
ccagccuggccuccug

SEQ ID NO: 3497162 - RNA, 19 nt, Human
ccagccuggccuccugccu

SEQ ID NO: 3497163 - RNA, 22 nt, Human
ccagccuggccuccugccucua

SEQ ID NO: 3497164 - RNA, 12 nt, Human
ccagccuggcuc

SEQ ID NO: 3497165 - RNA, 15 nt, Human
ccagccuggcuucug

SEQ ID NO: 3497166 - RNA, 17 nt, Human
ccagccuggcuucugga

SEQ ID NO: 3497167 - RNA, 19 nt, Human
ccagccuggcuucuggagc

SEQ ID NO: 3497168 - RNA, 20 nt, Human
ccagccuggcuucuggagcc

SEQ ID NO: 3497169 - RNA, 21 nt, Human
ccagccugggauaggggcaga

SEQ ID NO: 3497170 - RNA, 16 nt, Human
ccagccugggcagcca

SEQ ID NO: 3497171 - RNA, 21 nt, Human
ccagccugggcccaucucccu

SEQ ID NO: 3497172 - RNA, 23 nt, Human
ccagccugggcccaucucccugc

SEQ ID NO: 3497173 - RNA, 14 nt, Human
ccagccugggccua

SEQ ID NO: 3497174 - RNA, 16 nt, Human
ccagccugggcgacag

SEQ ID NO: 3497175 - RNA, 19 nt, Human
ccagccugggcgacagagc

SEQ ID NO: 3497176 - RNA, 17 nt, Human
ccagccuggggccuggc

SEQ ID NO: 3497177 - RNA, 18 nt, Human
ccagccuggggccuggca

SEQ ID NO: 3497178 - RNA, 23 nt, Human
ccagccugucccauggacacucc

SEQ ID NO: 3497179 - RNA, 20 nt, Human
ccagccuguuggacccgcuc

SEQ ID NO: 3497180 - RNA, 20 nt, Human
ccagccuuccucugcagcug

SEQ ID NO: 3497181 - RNA, 21 nt, Human
ccagccuuccucugcagcuga

SEQ ID NO: 3497182 - RNA, 19 nt, Human
ccagccuucuuccauccca

SEQ ID NO: 3497183 - RNA, 23 nt, Human
ccagccuugaccauucuccaccu

SEQ ID NO: 3497184 - RNA, 17 nt, Human
ccagccuugagcccugg

SEQ ID NO: 3497185 - RNA, 18 nt, Human
ccagccuugagcccuggc

SEQ ID NO: 3497186 - RNA, 19 nt, Human
ccagccuugagcccuggcu

SEQ ID NO: 3497187 - RNA, 18 nt, Human
ccagccuuggcaucuaga

SEQ ID NO: 3497188 - RNA, 20 nt, Human
ccagccuuucucccaggcca

SEQ ID NO: 3497189 - RNA, 20 nt, Human
ccagccuuugaucagguggg

SEQ ID NO: 3497190 - RNA, 15 nt, Human
ccagccuuuguuccc

SEQ ID NO: 3497191 - RNA, 15 nt, Human
ccagcgagcccuggu

SEQ ID NO: 3497192 - RNA, 21 nt, Human
ccagcgagcccugguggcagu

SEQ ID NO: 3497193 - RNA, 16 nt, Human
ccagcgaggaggcucc

SEQ ID NO: 3497194 - RNA, 19 nt, Human
ccagcgcccgcugggcuga

SEQ ID NO: 3497195 - RNA, 21 nt, Human
ccagcgccucccuccacccca

SEQ ID NO: 3497196 - RNA, 20 nt, Human
ccagcgcggacauccccugc

SEQ ID NO: 3497197 - RNA, 15 nt, Human
ccagcggacaguggc

SEQ ID NO: 3497198 - RNA, 19 nt, Human
ccagcggacaguggcagga

SEQ ID NO: 3497199 - RNA, 13 nt, Human
ccagcggccccuc

SEQ ID NO: 3497200 - RNA, 14 nt, Human
ccagcggccccucc

SEQ ID NO: 3497201 - RNA, 15 nt, Human
ccagcggccccuccc

SEQ ID NO: 3497202 - RNA, 17 nt, Human
ccagcgggaauggcagc

SEQ ID NO: 3497203 - RNA, 19 nt, Human
ccagcguauauauaagaaa

SEQ ID NO: 3497204 - RNA, 21 nt, Human
ccagcguauauauaagaaaga

SEQ ID NO: 3497205 - RNA, 23 nt, Human
ccagcgucagcugcucccuggca

SEQ ID NO: 3497206 - RNA, 22 nt, Human
ccagcgucccagucucuggcag

SEQ ID NO: 3497207 - RNA, 19 nt, Human
ccagcguccuccucuguga

SEQ ID NO: 3497208 - RNA, 13 nt, Human
ccagcuaagaacc

SEQ ID NO: 3497209 - RNA, 14 nt, Human
ccagcuaagaaccu

SEQ ID NO: 3497210 - RNA, 21 nt, Human
ccagcuaaggacauuucccag

SEQ ID NO: 3497211 - RNA, 23 nt, Human
ccagcuaaggacauuucccaggg

SEQ ID NO: 3497212 - RNA, 16 nt, Human
ccagcuaagggguggg

SEQ ID NO: 3497213 - RNA, 17 nt, Human
ccagcuaaucuguaggg

SEQ ID NO: 3497214 - RNA, 23 nt, Human
ccagcuaaucuguagggcuggac

SEQ ID NO: 3497215 - RNA, 16 nt, Human
ccagcuacccuuuuuc

SEQ ID NO: 3497216 - RNA, 22 nt, Human
ccagcuacccuuuuucuccagc

SEQ ID NO: 3497217 - RNA, 16 nt, Human
ccagcuacucagaagc

SEQ ID NO: 3497218 - RNA, 21 nt, Human
ccagcuacucagaagccugag

SEQ ID NO: 3497219 - RNA, 17 nt, Human
ccagcuacucaggaggc

SEQ ID NO: 3497220 - RNA, 20 nt, Human
ccagcuacucaggaggcuga

SEQ ID NO: 3497221 - RNA, 17 nt, Human
ccagcuacuuccuccuc

SEQ ID NO: 3497222 - RNA, 17 nt, Human
ccagcuacuugggaagc

SEQ ID NO: 3497223 - RNA, 16 nt, Human
ccagcuacuugggagg

SEQ ID NO: 3497224 - RNA, 17 nt, Human
ccagcuacuugggaggc

SEQ ID NO: 3497225 - RNA, 19 nt, Human
ccagcuacuugggaggcug

SEQ ID NO: 3497226 - RNA, 14 nt, Human
ccagcuagugaccc

SEQ ID NO: 3497227 - RNA, 18 nt, Human
ccagcuagugacccacau

SEQ ID NO: 3497228 - RNA, 21 nt, Human
ccagcuagugacccacaugcc

SEQ ID NO: 3497229 - RNA, 17 nt, Human
ccagcuauuuuuacuag

SEQ ID NO: 3497230 - RNA, 21 nt, Human
cuggcuguuuggacuuuguau

SEQ ID NO: 3497231 - RNA, 14 nt, Human
cuggcuuauuuuaa

SEQ ID NO: 3497232 - RNA, 22 nt, Human
cuggcuuauuuuaaugugauga

SEQ ID NO: 3497233 - RNA, 14 nt, Human
cuggcuucacagau

SEQ ID NO: 3497234 - RNA, 22 nt, Human
cuggcuucaggcaauucuccug

SEQ ID NO: 3497235 - RNA, 15 nt, Human
cuggcuuccagguau

SEQ ID NO: 3497236 - RNA, 20 nt, Human
cuggcuucccauccccagcg

SEQ ID NO: 3497237 - RNA, 21 nt, Human
cuggcuucccauccccagcga

SEQ ID NO: 3497238 - RNA, 16 nt, Human
cuggcuucgcaaaaug

SEQ ID NO: 3497239 - RNA, 16 nt, Human
cuggcuucuccuuugg

SEQ ID NO: 3497240 - RNA, 14 nt, Human
cuggcuucuggagc

SEQ ID NO: 3497241 - RNA, 15 nt, Human
cuggcuucuggagcc

SEQ ID NO: 3497242 - RNA, 12 nt, Human
cuggcuucuggc

SEQ ID NO: 3497243 - RNA, 23 nt, Human
cuggcuucuguggggccccucac

SEQ ID NO: 3497244 - RNA, 19 nt, Human
cuggcuugaauuggugaca

SEQ ID NO: 3497245 - RNA, 16 nt, Human
cuggcuuuaagccuuc

SEQ ID NO: 3497246 - RNA, 17 nt, Human
cuggcuuuaagccuuca

SEQ ID NO: 3497247 - RNA, 21 nt, Human
cuggcuuucauuuucucucag

SEQ ID NO: 3497248 - RNA, 16 nt, Human
cuggcuuugcccaacc

SEQ ID NO: 3497249 - RNA, 17 nt, Human
cuggcuuugcccaaccu

SEQ ID NO: 3497250 - RNA, 21 nt, Human
cuggcuuugcccaaccucagc

SEQ ID NO: 3497251 - RNA, 14 nt, Human
cuggcuuuggcuuc

SEQ ID NO: 3497252 - RNA, 19 nt, Human
cuggcuuugucccacagcu

SEQ ID NO: 3497253 - RNA, 22 nt, Human
cuggcuuuuauuaaugcacuuu

SEQ ID NO: 3497254 - RNA, 23 nt, Human
cuggcuuuuauuaaugcacuuuc

SEQ ID NO: 3497255 - RNA, 19 nt, Human
cuggcuuuucacugcuggc

SEQ ID NO: 3497256 - RNA, 20 nt, Human
cuggcuuuucuguuuccugu

SEQ ID NO: 3497257 - RNA, 15 nt, Human
cuggcuuuuuaacuc

SEQ ID NO: 3497258 - RNA, 17 nt, Human
cugggaaacacuccuug

SEQ ID NO: 3497259 - RNA, 22 nt, Human
cugggaaacacuccuugcauca

SEQ ID NO: 3497260 - RNA, 21 nt, Human
cugggaaaccccuucucugug

SEQ ID NO: 3497261 - RNA, 19 nt, Human
cugggaaagacauccauaa

SEQ ID NO: 3497262 - RNA, 16 nt, Human
cugggaaagccccugc

SEQ ID NO: 3497263 - RNA, 18 nt, Human
cugggaaauauucccuag

SEQ ID NO: 3497264 - RNA, 22 nt, Human
cugggaaaugagaaggcagcca

SEQ ID NO: 3497265 - RNA, 23 nt, Human
cugggaaauggcuugaagccaag

SEQ ID NO: 3497266 - RNA, 18 nt, Human
cugggaaccucccagagg

SEQ ID NO: 3497267 - RNA, 17 nt, Human
cugggaacucaccuggg

SEQ ID NO: 3497268 - RNA, 18 nt, Human
cugggaacucccaagaac

SEQ ID NO: 3497269 - RNA, 19 nt, Human
cugggaacucccaagaaca

SEQ ID NO: 3497270 - RNA, 21 nt, Human
cugggaacucccaagaacagc

SEQ ID NO: 3497271 - RNA, 19 nt, Human
cugggaacugcagaccugu

SEQ ID NO: 3497272 - RNA, 19 nt, Human
cugggaagacgccugagcu

SEQ ID NO: 3497273 - RNA, 17 nt, Human
cugggaagauaggcucu

SEQ ID NO: 3497274 - RNA, 13 nt, Human
cugggaaggccuc

SEQ ID NO: 3497275 - RNA, 13 nt, Human
cugggaagggaag

SEQ ID NO: 3497276 - RNA, 21 nt, Human
cugggaauguauaguauuuga

SEQ ID NO: 3497277 - RNA, 13 nt, Human
cugggaauguauu

SEQ ID NO: 3497278 - RNA, 22 nt, Human
cugggaauguauuauucugcag

SEQ ID NO: 3497279 - RNA, 18 nt, Human
cugggacaacugcuccca

SEQ ID NO: 3497280 - RNA, 22 nt, Human
cugggacaacugcucccaccuc

SEQ ID NO: 3497281 - RNA, 23 nt, Human
cugggacacuuaacagaugcaau

SEQ ID NO: 3497282 - RNA, 10 nt, Human
cugggacagg

SEQ ID NO: 3497283 - RNA, 17 nt, Human
cugggacagggagcagc

SEQ ID NO: 3497284 - RNA, 22 nt, Human
cugggacaguuuaucaugaagc

SEQ ID NO: 3497285 - RNA, 23 nt, Human
cugggacaguuuaucaugaagcc

SEQ ID NO: 3497286 - RNA, 14 nt, Human
cugggacaugggaa

SEQ ID NO: 3497287 - RNA, 22 nt, Human
cugggacaugggaaaggggaag

SEQ ID NO: 3497288 - RNA, 22 nt, Human
cugggaccacagguucaugcca

SEQ ID NO: 3497289 - RNA, 14 nt, Human
cugggaccacguga

SEQ ID NO: 3497290 - RNA, 14 nt, Human
cugggacccuuucc

SEQ ID NO: 3497291 - RNA, 23 nt, Human
cugggaccgcuacaccacucugg

SEQ ID NO: 3497292 - RNA, 14 nt, Human
cugggacgcucugc

SEQ ID NO: 3497293 - RNA, 21 nt, Human
cugggacguggcucagccagc

SEQ ID NO: 3497294 - RNA, 15 nt, Human
cugggacuacaggca

SEQ ID NO: 3497295 - RNA, 21 nt, Human
cugggacuacaggcacccacc

SEQ ID NO: 3497296 - RNA, 17 nt, Human
cugggacuacaggugug

SEQ ID NO: 3497297 - RNA, 15 nt, Human
cugggacucagccuu

SEQ ID NO: 3497298 - RNA, 17 nt, Human
cugggacucagccuuca

SEQ ID NO: 3497299 - RNA, 14 nt, Human
cugggacuuccuug

SEQ ID NO: 3497300 - RNA, 18 nt, Human
cugggacuuccuugcucu

SEQ ID NO: 3497301 - RNA, 20 nt, Human
cugggacuuccuugcucucc

SEQ ID NO: 3497302 - RNA, 21 nt, Human
cugggacuuccuugcucuccc

SEQ ID NO: 3497303 - RNA, 18 nt, Human
cugggacuugcaaaaagg

SEQ ID NO: 3497304 - RNA, 12 nt, Human
cugggagaaaau

SEQ ID NO: 3497305 - RNA, 15 nt, Human
cugggagaaaaucau

SEQ ID NO: 3497306 - RNA, 19 nt, Human
cugggagaaaaucaucaag

SEQ ID NO: 3497307 - RNA, 19 nt, Human
cugggagaaaucuggcuuc

SEQ ID NO: 3497308 - RNA, 20 nt, Human
cugggagaaaucuggcuucu

SEQ ID NO: 3497309 - RNA, 16 nt, Human
cugggagaaccucagg

SEQ ID NO: 3497310 - RNA, 12 nt, Human
cugggagaggau

SEQ ID NO: 3497311 - RNA, 17 nt, Human
cugggagaggcagagug

SEQ ID NO: 3497312 - RNA, 20 nt, Human
cugggagaggcagcccagga

SEQ ID NO: 3497313 - RNA, 23 nt, Human
cugggagaggcagcccaggaagu

SEQ ID NO: 3497314 - RNA, 19 nt, Human
cugggagauucaagggacc

SEQ ID NO: 3497315 - RNA, 22 nt, Human
cugggagcagcccgcugagugg

SEQ ID NO: 3497316 - RNA, 18 nt, Human
cugggagcccccagccug

SEQ ID NO: 3497317 - RNA, 20 nt, Human
cugggagcccccagccuguc

SEQ ID NO: 3497318 - RNA, 19 nt, Human
cugggagccuacccacccc

SEQ ID NO: 3497319 - RNA, 21 nt, Human
cugggagcuccacucugcuuc

SEQ ID NO: 3497320 - RNA, 15 nt, Human
cugggagcucugcag

SEQ ID NO: 3497321 - RNA, 12 nt, Human
cugggaggaacc

SEQ ID NO: 3497322 - RNA, 14 nt, Human
cugggaggagggag

SEQ ID NO: 3497323 - RNA, 15 nt, Human
cugggaggagggaga

SEQ ID NO: 3497324 - RNA, 19 nt, Human
cugggaggagggcaggcau

SEQ ID NO: 3497325 - RNA, 17 nt, Human
cugggaggcaagagggg

SEQ ID NO: 3497326 - RNA, 20 nt, Human
cugggaggcaagaggggugg

SEQ ID NO: 3497327 - RNA, 21 nt, Human
cugggaggcaagaggggugga

SEQ ID NO: 3497328 - RNA, 22 nt, Human
cugggaggcaagagggguggag

SEQ ID NO: 3497329 - RNA, 22 nt, Human
cugggaggcauggcccuggggu

SEQ ID NO: 3497330 - RNA, 20 nt, Human
cugggaggcccugagacagg

SEQ ID NO: 3497331 - RNA, 16 nt, Human
cugggaggcucuggag

SEQ ID NO: 3497332 - RNA, 20 nt, Human
cugggaggcucuggagccca

SEQ ID NO: 3497333 - RNA, 15 nt, Human
cugggagggcagcag

SEQ ID NO: 3497334 - RNA, 20 nt, Human
cugggagggcagcagggcua

SEQ ID NO: 3497335 - RNA, 22 nt, Human
cugggagggcagcagggcuacc

SEQ ID NO: 3497336 - RNA, 13 nt, Human
cugggagggccca

SEQ ID NO: 3497337 - RNA, 16 nt, Human
cugggaucugacugca

SEQ ID NO: 3497338 - RNA, 17 nt, Human
cugggaucugacugcac

SEQ ID NO: 3497339 - RNA, 15 nt, Human
cugggaucugguggu

SEQ ID NO: 3497340 - RNA, 17 nt, Human
cugggauggaggggagu

SEQ ID NO: 3497341 - RNA, 18 nt, Human
cugggauggugggcuuca

SEQ ID NO: 3497342 - RNA, 21 nt, Human
cugggauggugggcuucaggg

SEQ ID NO: 3497343 - RNA, 22 nt, Human
cugggauguggcugcagcagcg

SEQ ID NO: 3497344 - RNA, 14 nt, Human
cugggauguuucug

SEQ ID NO: 3497345 - RNA, 19 nt, Human
cugggauguuucugucaca

SEQ ID NO: 3497346 - RNA, 21 nt, Human
cugggauuacaagcgugagcc

SEQ ID NO: 3497347 - RNA, 21 nt, Human
cugggauuacaggcgugagcc

SEQ ID NO: 3497348 - RNA, 22 nt, Human
cugggauuacaggcgugagcca

SEQ ID NO: 3497349 - RNA, 20 nt, Human
cugggauuacaggcuccugc

SEQ ID NO: 3497350 - RNA, 23 nt, Human
cugggauuacaggcuccugccac

SEQ ID NO: 3497351 - RNA, 11 nt, Human
cugggauuagg

SEQ ID NO: 3497352 - RNA, 22 nt, Human
cugggauucaggaaaaggccug

SEQ ID NO: 3497353 - RNA, 17 nt, Human
cugggauucuacuuuaa

SEQ ID NO: 3497354 - RNA, 17 nt, Human
cugggauuggcugugaa

SEQ ID NO: 3497355 - RNA, 21 nt, Human
cugggauuggcugugaacuga

SEQ ID NO: 3497356 - RNA, 17 nt, Human
cugggauuuuaaacuag

SEQ ID NO: 3497357 - RNA, 22 nt, Human
cugggauuuuaaacuagaugac

SEQ ID NO: 3497358 - RNA, 15 nt, Human
cugggcaacagagca

SEQ ID NO: 3497359 - RNA, 15 nt, Human
cugggcaagcuggcg

SEQ ID NO: 3497360 - RNA, 22 nt, Human
cugggcaaggaaaaagaaaaua

SEQ ID NO: 3497361 - RNA, 16 nt, Human
cugggcacacgccucc

SEQ ID NO: 3497362 - RNA, 17 nt, Human
cugggcacacgccuccc

SEQ ID NO: 3497363 - RNA, 22 nt, Human
cugggcacacgccucccacugg

SEQ ID NO: 3497364 - RNA, 23 nt, Human
cugggcacacgccucccacuggg

SEQ ID NO: 3497365 - RNA, 14 nt, Human
cugggcacacgcug

SEQ ID NO: 3497366 - RNA, 16 nt, Human
cugggcacacgcugcu

SEQ ID NO: 3497367 - RNA, 20 nt, Human
cugggcacacgcugcucugc

SEQ ID NO: 3497368 - RNA, 22 nt, Human
cugggcacacgcugcucugccc

SEQ ID NO: 3497369 - RNA, 20 nt, Human
cugggcaccggggccucgga

SEQ ID NO: 3497370 - RNA, 16 nt, Human
cugggcaccuggggag

SEQ ID NO: 3497371 - RNA, 17 nt, Human
cugggcaccuggggagu

SEQ ID NO: 3497372 - RNA, 23 nt, Human
ccugcgucuuccgccccugccug

SEQ ID NO: 3497373 - RNA, 17 nt, Human
ccugcguggcugacccc

SEQ ID NO: 3497374 - RNA, 12 nt, Human
ccugcgugggga

SEQ ID NO: 3497375 - RNA, 17 nt, Human
ccugcguguucucagag

SEQ ID NO: 3497376 - RNA, 17 nt, Human
ccugcguugguccagag

SEQ ID NO: 3497377 - RNA, 14 nt, Human
ccugcuacaccuau

SEQ ID NO: 3497378 - RNA, 23 nt, Human
ccugcuacaccuauuaucccagc

SEQ ID NO: 3497379 - RNA, 13 nt, Human
ccugcuacugcca

SEQ ID NO: 3497380 - RNA, 23 nt, Human
ccugcuagaugagaauucagcug

SEQ ID NO: 3497381 - RNA, 19 nt, Human
ccugcuaggccagagccca

SEQ ID NO: 3497382 - RNA, 20 nt, Human
ccugcucagcccugcaccau

SEQ ID NO: 3497383 - RNA, 12 nt, Human
ccugcuccacag

SEQ ID NO: 3497384 - RNA, 21 nt, Human
ccugcuccagaauuuggaaau

SEQ ID NO: 3497385 - RNA, 13 nt, Human
ccugcuccagacc

SEQ ID NO: 3497386 - RNA, 16 nt, Human
ccugcuccagaccuga

SEQ ID NO: 3497387 - RNA, 22 nt, Human
ccugcuccagaccugauccugg

SEQ ID NO: 3497388 - RNA, 12 nt, Human
ccugcuccagcu

SEQ ID NO: 3497389 - RNA, 13 nt, Human
ccugcuccagcug

SEQ ID NO: 3497390 - RNA, 12 nt, Human
ccugcucccagg

SEQ ID NO: 3497391 - RNA, 20 nt, Human
ccugcucccauccugugugu

SEQ ID NO: 3497392 - RNA, 15 nt, Human
ccugcucccucccau

SEQ ID NO: 3497393 - RNA, 17 nt, Human
ccugcuccgcugcuccu

SEQ ID NO: 3497394 - RNA, 22 nt, Human
ccugcuccgcugcuccuuggcu

SEQ ID NO: 3497395 - RNA, 15 nt, Human
ccugcuccucccugg

SEQ ID NO: 3497396 - RNA, 17 nt, Human
ccugcuccucccuggcu

SEQ ID NO: 3497397 - RNA, 14 nt, Human
ccugcuccugcagc

SEQ ID NO: 3497398 - RNA, 16 nt, Human
ccugcuccugcagcau

SEQ ID NO: 3497399 - RNA, 18 nt, Human
ccugcucuagugggacag

SEQ ID NO: 3497400 - RNA, 22 nt, Human
ccugcucuccaagucucagugg

SEQ ID NO: 3497401 - RNA, 22 nt, Human
ccugcucuccgaccagacaccu

SEQ ID NO: 3497402 - RNA, 12 nt, Human
ccugcucuccuc

SEQ ID NO: 3497403 - RNA, 18 nt, Human
ccugcucuccucuugcca

SEQ ID NO: 3497404 - RNA, 19 nt, Human
ccugcucucuacccagccc

SEQ ID NO: 3497405 - RNA, 20 nt, Human
ccugcucucuacccagccca

SEQ ID NO: 3497406 - RNA, 12 nt, Human
ccugcucugcug

SEQ ID NO: 3497407 - RNA, 13 nt, Human
ccugcucugcuga

SEQ ID NO: 3497408 - RNA, 23 nt, Human
ccugcugaaugauuuccaaagag

SEQ ID NO: 3497409 - RNA, 18 nt, Human
ccugcugaccugugcaca

SEQ ID NO: 3497410 - RNA, 20 nt, Human
ccugcugagagacccaagga

SEQ ID NO: 3497411 - RNA, 20 nt, Human
ccugcugagccucacagcag

SEQ ID NO: 3497412 - RNA, 11 nt, Human
ccugcugagcu

SEQ ID NO: 3497413 - RNA, 13 nt, Human
ccugcugagcucu

SEQ ID NO: 3497414 - RNA, 15 nt, Human
ccugcugagcucuga

SEQ ID NO: 3497415 - RNA, 16 nt, Human
ccugcugagcucugag

SEQ ID NO: 3497416 - RNA, 20 nt, Human
ccugcugagcucugagaggc

SEQ ID NO: 3497417 - RNA, 19 nt, Human
ccugcugagggaccagcca

SEQ ID NO: 3497418 - RNA, 18 nt, Human
ccugcugagucccaggcu

SEQ ID NO: 3497419 - RNA, 19 nt, Human
ccugcugagucccaggcug

SEQ ID NO: 3497420 - RNA, 16 nt, Human
ccugcugcaccaaccc

SEQ ID NO: 3497421 - RNA, 19 nt, Human
ccugcugcaccaacccagc

SEQ ID NO: 3497422 - RNA, 23 nt, Human
ccugcugcaccaacccagccgcu

SEQ ID NO: 3497423 - RNA, 22 nt, Human
ccugcugcagaggggcaggccc

SEQ ID NO: 3497424 - RNA, 14 nt, Human
ccugcugcaggggc

SEQ ID NO: 3497425 - RNA, 20 nt, Human
ccugcugcaggggcucugga

SEQ ID NO: 3497426 - RNA, 21 nt, Human
ccugcugcaggggcucuggag

SEQ ID NO: 3497427 - RNA, 11 nt, Human
ccugcugcagu

SEQ ID NO: 3497428 - RNA, 12 nt, Human
ccugcugcaguu

SEQ ID NO: 3497429 - RNA, 16 nt, Human
ccugcugcaguugcca

SEQ ID NO: 3497430 - RNA, 17 nt, Human
ccugcugcaguugccag

SEQ ID NO: 3497431 - RNA, 19 nt, Human
ccugcugcaguugccaguc

SEQ ID NO: 3497432 - RNA, 20 nt, Human
ccugcugcaguugccaguca

SEQ ID NO: 3497433 - RNA, 21 nt, Human
ccugcugccaguaccagcccc

SEQ ID NO: 3497434 - RNA, 23 nt, Human
cuguccuggugguauuuucaaua

SEQ ID NO: 3497435 - RNA, 17 nt, Human
cuguccuguaacuguua

SEQ ID NO: 3497436 - RNA, 14 nt, Human
cuguccuguacauu

SEQ ID NO: 3497437 - RNA, 20 nt, Human
cuguccugucaucaucaugg

SEQ ID NO: 3497438 - RNA, 21 nt, Human
cuguccugucaucaucauggc

SEQ ID NO: 3497439 - RNA, 14 nt, Human
cuguccuguccugc

SEQ ID NO: 3497440 - RNA, 16 nt, Human
cuguccuguugauuaa

SEQ ID NO: 3497441 - RNA, 19 nt, Human
cuguccuuacccaucugca

SEQ ID NO: 3497442 - RNA, 17 nt, Human
cuguccuugaaggacua

SEQ ID NO: 3497443 - RNA, 19 nt, Human
cuguccuugaaugccauag

SEQ ID NO: 3497444 - RNA, 21 nt, Human
cuguccuuucuagagcacugc

SEQ ID NO: 3497445 - RNA, 22 nt, Human
cuguccuuucuagagcacugcc

SEQ ID NO: 3497446 - RNA, 23 nt, Human
cugucgaguucggcucugggugg

SEQ ID NO: 3497447 - RNA, 23 nt, Human
cugucgauuagacuggacagcuu

SEQ ID NO: 3497448 - RNA, 13 nt, Human
cugucgcccagug

SEQ ID NO: 3497449 - RNA, 19 nt, Human
cugucgccuuagcauguuu

SEQ ID NO: 3497450 - RNA, 15 nt, Human
cugucgcucucaguu

SEQ ID NO: 3497451 - RNA, 13 nt, Human
cugucgcugcuuc

SEQ ID NO: 3497452 - RNA, 15 nt, Human
cugucggaggaaaga

SEQ ID NO: 3497453 - RNA, 20 nt, Human
cugucggcgcugccccaucu

SEQ ID NO: 3497454 - RNA, 23 nt, Human
cugucggcgcugccccaucuccc

SEQ ID NO: 3497455 - RNA, 19 nt, Human
cugucgggcuuugugugaa

SEQ ID NO: 3497456 - RNA, 15 nt, Human
cugucguuaaaaaca

SEQ ID NO: 3497457 - RNA, 13 nt, Human
cugucuaaaaaac

SEQ ID NO: 3497458 - RNA, 14 nt, Human
cugucuaaaaaaca

SEQ ID NO: 3497459 - RNA, 15 nt, Human
cugucuaaccuguga

SEQ ID NO: 3497460 - RNA, 13 nt, Human
cugucuaacuuua

SEQ ID NO: 3497461 - RNA, 14 nt, Human
cugucuaccaucuc

SEQ ID NO: 3497462 - RNA, 18 nt, Human
cugucuagagagggaggc

SEQ ID NO: 3497463 - RNA, 16 nt, Human
cugucuagcacuuccu

SEQ ID NO: 3497464 - RNA, 17 nt, Human
cugucuagcacuuccuu

SEQ ID NO: 3497465 - RNA, 20 nt, Human
cugucuagcacuuccuugcc

SEQ ID NO: 3497466 - RNA, 15 nt, Human
cugucuagcaugcca

SEQ ID NO: 3497467 - RNA, 18 nt, Human
cugucuagcaugccaaca

SEQ ID NO: 3497468 - RNA, 21 nt, Human
cugucuagcaugccaacaaga

SEQ ID NO: 3497469 - RNA, 21 nt, Human
cugucuaggucaguacccacc

SEQ ID NO: 3497470 - RNA, 18 nt, Human
cugucuagucucuccugu

SEQ ID NO: 3497471 - RNA, 13 nt, Human
cugucuauucuag

SEQ ID NO: 3497472 - RNA, 19 nt, Human
cugucuauuucugcugaau

SEQ ID NO: 3497473 - RNA, 16 nt, Human
cugucucaaaaaaaga

SEQ ID NO: 3497474 - RNA, 18 nt, Human
cugucucaagagggcacu

SEQ ID NO: 3497475 - RNA, 19 nt, Human
cugucucaagagggcacug

SEQ ID NO: 3497476 - RNA, 20 nt, Human
cugucucaagcucuuccuua

SEQ ID NO: 3497477 - RNA, 17 nt, Human
cugucucaccuggacuu

SEQ ID NO: 3497478 - RNA, 13 nt, Human
cugucucagacuc

SEQ ID NO: 3497479 - RNA, 13 nt, Human
cugucucagccuc

SEQ ID NO: 3497480 - RNA, 17 nt, Human
cugucucagccucccag

SEQ ID NO: 3497481 - RNA, 17 nt, Human
cugucucaguuucacuu

SEQ ID NO: 3497482 - RNA, 20 nt, Human
cugucucauccaucaucaug

SEQ ID NO: 3497483 - RNA, 20 nt, Human
cugucucauccccagggguc

SEQ ID NO: 3497484 - RNA, 20 nt, Human
cugucucccuauaaugcugg

SEQ ID NO: 3497485 - RNA, 20 nt, Human
cugucuccucucucuguaau

SEQ ID NO: 3497486 - RNA, 22 nt, Human
cugucuccuuucaccccagggc

SEQ ID NO: 3497487 - RNA, 17 nt, Human
cugucucgagcgcccug

SEQ ID NO: 3497488 - RNA, 19 nt, Human
cugucucgagcgcccugca

SEQ ID NO: 3497489 - RNA, 22 nt, Human
cugucucgagcgcccugcagac

SEQ ID NO: 3497490 - RNA, 13 nt, Human
cugucucuccauc

SEQ ID NO: 3497491 - RNA, 21 nt, Human
cugucucucuucucagagugg

SEQ ID NO: 3497492 - RNA, 18 nt, Human
cugucucugccucccuca

SEQ ID NO: 3497493 - RNA, 12 nt, Human
cugucucugcuc

SEQ ID NO: 3497494 - RNA, 12 nt, Human
cugucucuucca

SEQ ID NO: 3497495 - RNA, 15 nt, Human
cugucucuuccauau

SEQ ID NO: 3497496 - RNA, 19 nt, Human
cugucugaaggacacuucc

SEQ ID NO: 3497497 - RNA, 17 nt, Human
cugucugaucugugcuu

SEQ ID NO: 3497498 - RNA, 21 nt, Human
cugucugaucugugcuuucca

SEQ ID NO: 3497499 - RNA, 20 nt, Human
cugucugccaaccuaaaacu

SEQ ID NO: 3497500 - RNA, 20 nt, Human
cugucugccagccagcagcc

SEQ ID NO: 3497501 - RNA, 13 nt, Human
cugucugccccag

SEQ ID NO: 3497502 - RNA, 19 nt, Human
cugucugccccagcccaga

SEQ ID NO: 3497503 - RNA, 14 nt, Human
cugucugccccgcc

SEQ ID NO: 3497504 - RNA, 17 nt, Human
cugucugcuccagcucu

SEQ ID NO: 3497505 - RNA, 19 nt, Human
cugucugcuccagcucugg

SEQ ID NO: 3497506 - RNA, 16 nt, Human
cugucuggccccccug

SEQ ID NO: 3497507 - RNA, 16 nt, Human
cugucugggugcuacu

SEQ ID NO: 3497508 - RNA, 21 nt, Human
cugucugggugcuacugggga

SEQ ID NO: 3497509 - RNA, 23 nt, Human
cugucugggugcuacuggggaaa

SEQ ID NO: 3497510 - RNA, 17 nt, Human
cugucuggguggcucac

SEQ ID NO: 3497511 - RNA, 23 nt, Human
cugucugguggccccguuucugg

SEQ ID NO: 3497512 - RNA, 16 nt, Human
cugucuguagagggcc

SEQ ID NO: 3497513 - RNA, 20 nt, Human
cugucuguagagggcccugg

SEQ ID NO: 3497514 - RNA, 20 nt, Human
cugucugucucuccaucugu

SEQ ID NO: 3497515 - RNA, 17 nt, Human
cugucugucugucccaa

SEQ ID NO: 3497516 - RNA, 20 nt, Human
ccuggccagaugcaccagcc

SEQ ID NO: 3497517 - RNA, 16 nt, Human
ccuggccagauggccc

SEQ ID NO: 3497518 - RNA, 19 nt, Human
ccuggccagauggcccgga

SEQ ID NO: 3497519 - RNA, 12 nt, Human
ccuggccaggag

SEQ ID NO: 3497520 - RNA, 15 nt, Human
ccuggccaggagcuc

SEQ ID NO: 3497521 - RNA, 20 nt, Human
ccuggccaggagcucuucag

SEQ ID NO: 3497522 - RNA, 21 nt, Human
ccuggccaggagcucuucagg

SEQ ID NO: 3497523 - RNA, 21 nt, Human
ccuggccaggcacccccugga

SEQ ID NO: 3497524 - RNA, 22 nt, Human
ccuggccaggcagaucugugcc

SEQ ID NO: 3497525 - RNA, 14 nt, Human
ccuggccagggccu

SEQ ID NO: 3497526 - RNA, 12 nt, Human
ccuggccagugc

SEQ ID NO: 3497527 - RNA, 14 nt, Human
ccuggccaucucug

SEQ ID NO: 3497528 - RNA, 22 nt, Human
ccuggcccaccccacccacuuc

SEQ ID NO: 3497529 - RNA, 13 nt, Human
ccuggcccagccu

SEQ ID NO: 3497530 - RNA, 15 nt, Human
ccuggcccagcggcc

SEQ ID NO: 3497531 - RNA, 21 nt, Human
ccuggcccagcggccccuccc

SEQ ID NO: 3497532 - RNA, 15 nt, Human
ccuggcccagcuccc

SEQ ID NO: 3497533 - RNA, 16 nt, Human
ccuggcccagcucccc

SEQ ID NO: 3497534 - RNA, 15 nt, Human
ccuggcccagggcau

SEQ ID NO: 3497535 - RNA, 13 nt, Human
ccuggcccauaga

SEQ ID NO: 3497536 - RNA, 22 nt, Human
ccuggcccauagaaacaugaca

SEQ ID NO: 3497537 - RNA, 23 nt, Human
ccuggcccauagaaacaugacac

SEQ ID NO: 3497538 - RNA, 15 nt, Human
ccuggcccaucaggg

SEQ ID NO: 3497539 - RNA, 17 nt, Human
ccuggcccaucagugua

SEQ ID NO: 3497540 - RNA, 20 nt, Human
ccuggcccaucaguguaccc

SEQ ID NO: 3497541 - RNA, 15 nt, Human
ccuggccccaugucu

SEQ ID NO: 3497542 - RNA, 21 nt, Human
ccuggccccaugucucucaga

SEQ ID NO: 3497543 - RNA, 23 nt, Human
ccuggcccccaaccucagggcuc

SEQ ID NO: 3497544 - RNA, 21 nt, Human
ccuggcccccacauggugaug

SEQ ID NO: 3497545 - RNA, 13 nt, Human
ccuggccccucuc

SEQ ID NO: 3497546 - RNA, 16 nt, Human
ccuggccccucucccu

SEQ ID NO: 3497547 - RNA, 13 nt, Human
ccuggcccucaag

SEQ ID NO: 3497548 - RNA, 12 nt, Human
ccuggcccucug

SEQ ID NO: 3497549 - RNA, 15 nt, Human
ccuggcccucugugu

SEQ ID NO: 3497550 - RNA, 13 nt, Human
ccuggcccugccc

SEQ ID NO: 3497551 - RNA, 17 nt, Human
ccuggcccugcuuccug

SEQ ID NO: 3497552 - RNA, 14 nt, Human
ccuggcccuggggc

SEQ ID NO: 3497553 - RNA, 15 nt, Human
ccuggcccuggggcc

SEQ ID NO: 3497554 - RNA, 12 nt, Human
ccuggcccuuac

SEQ ID NO: 3497555 - RNA, 15 nt, Human
ccuggccgcccccug

SEQ ID NO: 3497556 - RNA, 22 nt, Human
ccuggccgcccccugcccccca

SEQ ID NO: 3497557 - RNA, 19 nt, Human
ccuggccgcggagccugca

SEQ ID NO: 3497558 - RNA, 19 nt, Human
ccuggccggcaaccccagu

SEQ ID NO: 3497559 - RNA, 21 nt, Human
ccuggccggcaaccccaguuc

SEQ ID NO: 3497560 - RNA, 23 nt, Human
ccuggccggcaaccccaguucug

SEQ ID NO: 3497561 - RNA, 13 nt, Human
ccuggccggccag

SEQ ID NO: 3497562 - RNA, 23 nt, Human
ccuggccggugugggggccccgu

SEQ ID NO: 3497563 - RNA, 20 nt, Human
ccuggccuagaccagcagac

SEQ ID NO: 3497564 - RNA, 23 nt, Human
ccuggccuauccgcugccagccu

SEQ ID NO: 3497565 - RNA, 13 nt, Human
ccuggccucagac

SEQ ID NO: 3497566 - RNA, 20 nt, Human
ccuggccucagacugcaccc

SEQ ID NO: 3497567 - RNA, 13 nt, Human
ccuggccuccagg

SEQ ID NO: 3497568 - RNA, 18 nt, Human
ccuggccuccaggcccgu

SEQ ID NO: 3497569 - RNA, 15 nt, Human
ccuggccuccccugc

SEQ ID NO: 3497570 - RNA, 17 nt, Human
ccuggccuccccugcca

SEQ ID NO: 3497571 - RNA, 24 nt, Human
ccuggccuccggcgucagccucca

SEQ ID NO: 3497572 - RNA, 14 nt, Human
ccuggccuccugcc

SEQ ID NO: 3497573 - RNA, 18 nt, Human
ccuggccuccugccucua

SEQ ID NO: 3497574 - RNA, 12 nt, Human
ccuggccucugc

SEQ ID NO: 3497575 - RNA, 14 nt, Human
ccuggccucugugc

SEQ ID NO: 3497576 - RNA, 14 nt, Human
ccuggccugagcug

SEQ ID NO: 3497577 - RNA, 13 nt, Human
ccuggccugcugg

SEQ ID NO: 3497578 - RNA, 12 nt, Human
ccuggccuggca

SEQ ID NO: 3497579 - RNA, 15 nt, Human
ccuggccuggcacac

SEQ ID NO: 3497580 - RNA, 13 nt, Human
ccuggccuggccc

SEQ ID NO: 3497581 - RNA, 18 nt, Human
ccuggccuggcccugccc

SEQ ID NO: 3497582 - RNA, 20 nt, Human
ccuggccuggcccugcccug

SEQ ID NO: 3497583 - RNA, 17 nt, Human
ccuggccugucucggaa

SEQ ID NO: 3497584 - RNA, 17 nt, Human
ccuggccugucugugaa

SEQ ID NO: 3497585 - RNA, 16 nt, Human
ccuggccuuuccuggu

SEQ ID NO: 3497586 - RNA, 19 nt, Human
ccuggcgcaggugggcugg

SEQ ID NO: 3497587 - RNA, 17 nt, Human
ccuggcgggaugggcca

SEQ ID NO: 3497588 - RNA, 20 nt, Human
ccuggcgggaugggccaccg

SEQ ID NO: 3497589 - RNA, 21 nt, Human
ccuggcgggaugggccaccgc

SEQ ID NO: 3497590 - RNA, 12 nt, Human
ccuggcggggug

SEQ ID NO: 3497591 - RNA, 20 nt, Human
ccuggcuccaaacccucgag

SEQ ID NO: 3497592 - RNA, 21 nt, Human
ccuggcuccaaacccucgagg

SEQ ID NO: 3497593 - RNA, 16 nt, Human
ccuggcucccaggaca

SEQ ID NO: 3497594 - RNA, 11 nt, Human
ccuggcucccc

SEQ ID NO: 3497595 - RNA, 12 nt, Human
ccuggcucccuc

SEQ ID NO: 3497596 - RNA, 19 nt, Human
ccuggcucccucacucuca

SEQ ID NO: 3497597 - RNA, 15 nt, Human
ccuggcucccuccuc

SEQ ID NO: 3497598 - RNA, 18 nt, Human
ccuggcuccgcugugugg

SEQ ID NO: 3497599 - RNA, 18 nt, Human
cugugagacccccacacc

SEQ ID NO: 3497600 - RNA, 19 nt, Human
cugugagacccccacaccu

SEQ ID NO: 3497601 - RNA, 23 nt, Human
cugugagacccccacaccucagu

SEQ ID NO: 3497602 - RNA, 22 nt, Human
cugugagauggcuggcugguga

SEQ ID NO: 3497603 - RNA, 13 nt, Human
cugugagaugugu

SEQ ID NO: 3497604 - RNA, 15 nt, Human
cugugagcaagaagu

SEQ ID NO: 3497605 - RNA, 14 nt, Human
cugugagccagucu

SEQ ID NO: 3497606 - RNA, 14 nt, Human
cugugagccccugg

SEQ ID NO: 3497607 - RNA, 16 nt, Human
cugugagccccugguc

SEQ ID NO: 3497608 - RNA, 13 nt, Human
cugugagcugcac

SEQ ID NO: 3497609 - RNA, 18 nt, Human
cugugaggagccccaucu

SEQ ID NO: 3497610 - RNA, 14 nt, Human
cugugaggcagggg

SEQ ID NO: 3497611 - RNA, 15 nt, Human
cugugaggcuguccu

SEQ ID NO: 3497612 - RNA, 15 nt, Human
cugugaguaaauauu

SEQ ID NO: 3497613 - RNA, 23 nt, Human
cugugaguacuacaguccuccca

SEQ ID NO: 3497614 - RNA, 20 nt, Human
cugugagucuuugguucuaa

SEQ ID NO: 3497615 - RNA, 20 nt, Human
cugugaguguaagugugagu

SEQ ID NO: 3497616 - RNA, 21 nt, Human
cugugaguguaagugugagua

SEQ ID NO: 3497617 - RNA, 16 nt, Human
cugugaguucucccug

SEQ ID NO: 3497618 - RNA, 13 nt, Human
cugugaucauuua

SEQ ID NO: 3497619 - RNA, 19 nt, Human
cugugaucauuuauuuuaa

SEQ ID NO: 3497620 - RNA, 19 nt, Human
cugugauccacccaacccu

SEQ ID NO: 3497621 - RNA, 22 nt, Human
cugugaucugggucucuaaucu

SEQ ID NO: 3497622 - RNA, 15 nt, Human
cugugauggggcccu

SEQ ID NO: 3497623 - RNA, 16 nt, Human
cugugauggggcccug

SEQ ID NO: 3497624 - RNA, 20 nt, Human
cugugauggggcccugccuc

SEQ ID NO: 3497625 - RNA, 13 nt, Human
cugugauguuugu

SEQ ID NO: 3497626 - RNA, 16 nt, Human
cugugauucagaaaau

SEQ ID NO: 3497627 - RNA, 22 nt, Human
cugugauuccacuacaccuggc

SEQ ID NO: 3497628 - RNA, 22 nt, Human
cugugauugggcguagaagugg

SEQ ID NO: 3497629 - RNA, 22 nt, Human
cugugauuuuugguauuugaaa

SEQ ID NO: 3497630 - RNA, 19 nt, Human
cugugcaacggucuccuga

SEQ ID NO: 3497631 - RNA, 21 nt, Human
cugugcaauagacacauacau

SEQ ID NO: 3497632 - RNA, 11 nt, Human
cugugcacaca

SEQ ID NO: 3497633 - RNA, 21 nt, Human
cugugcacaccccacucccac

SEQ ID NO: 3497634 - RNA, 22 nt, Human
cugugcacaccccacucccaca

SEQ ID NO: 3497635 - RNA, 11 nt, Human
cugugcacagc

SEQ ID NO: 3497636 - RNA, 13 nt, Human
cugugcacagccc

SEQ ID NO: 3497637 - RNA, 20 nt, Human
cugugcacaucugugucuug

SEQ ID NO: 3497638 - RNA, 18 nt, Human
cugugcacgcaguggccu

SEQ ID NO: 3497639 - RNA, 15 nt, Human
cugugcacgguggac

SEQ ID NO: 3497640 - RNA, 14 nt, Human
cugugcagccccgc

SEQ ID NO: 3497641 - RNA, 22 nt, Human
cugugcagccccgccuccaggc

SEQ ID NO: 3497642 - RNA, 19 nt, Human
cugugcagccgcugagcga

SEQ ID NO: 3497643 - RNA, 17 nt, Human
cugugcagcgcagcugg

SEQ ID NO: 3497644 - RNA, 23 nt, Human
cugugcaguggcccccacagaaa

SEQ ID NO: 3497645 - RNA, 14 nt, Human
cugugcauggguga

SEQ ID NO: 3497646 - RNA, 17 nt, Human
cugugcaugggugaagg

SEQ ID NO: 3497647 - RNA, 17 nt, Human
cugugcaugguggcacc

SEQ ID NO: 3497648 - RNA, 16 nt, Human
cugugcauguaugucu

SEQ ID NO: 3497649 - RNA, 13 nt, Human
cugugccacccac

SEQ ID NO: 3497650 - RNA, 15 nt, Human
cugugccacccuggg

SEQ ID NO: 3497651 - RNA, 16 nt, Human
cugugccacccugggc

SEQ ID NO: 3497652 - RNA, 20 nt, Human
cugugccacccugggcucug

SEQ ID NO: 3497653 - RNA, 22 nt, Human
cugugccacccugggcucugug

SEQ ID NO: 3497654 - RNA, 20 nt, Human
cugugccagagccuggggcu

SEQ ID NO: 3497655 - RNA, 14 nt, Human
cugugccagcccag

SEQ ID NO: 3497656 - RNA, 14 nt, Human
cugugccaggugaa

SEQ ID NO: 3497657 - RNA, 20 nt, Human
cugugccaggugaggucagc

SEQ ID NO: 3497658 - RNA, 16 nt, Human
cugugccaugugccag

SEQ ID NO: 3497659 - RNA, 18 nt, Human
cugugcccacaucccagg

SEQ ID NO: 3497660 - RNA, 19 nt, Human
cugugcccacaucccaggc

SEQ ID NO: 3497661 - RNA, 18 nt, Human
cugugggcucccuuccuc

SEQ ID NO: 3497662 - RNA, 22 nt, Human
cugugggcugcacucugugccc

SEQ ID NO: 3497663 - RNA, 23 nt, Human
cugugggcugcacucugugccca

SEQ ID NO: 3497664 - RNA, 14 nt, Human
cuguggggaaaggg

SEQ ID NO: 3497665 - RNA, 21 nt, Human
cuguggggaucucaggggcug

SEQ ID NO: 3497666 - RNA, 17 nt, Human
cuguggggcugguagcu

SEQ ID NO: 3497667 - RNA, 22 nt, Human
cugugggggaagagcacagccc

SEQ ID NO: 3497668 - RNA, 21 nt, Human
cugugggggguaaucccugcu

SEQ ID NO: 3497669 - RNA, 23 nt, Human
cugugggggugagggucccaugu

SEQ ID NO: 3497670 - RNA, 16 nt, Human
cugugggguuuuguua

SEQ ID NO: 3497671 - RNA, 13 nt, Human
cugugggugaugg

SEQ ID NO: 3497672 - RNA, 19 nt, Human
cugugggugauggggaggg

SEQ ID NO: 3497673 - RNA, 18 nt, Human
cugugguaaaugccacac

SEQ ID NO: 3497674 - RNA, 22 nt, Human
cugugguccugaauucuuuccc

SEQ ID NO: 3497675 - RNA, 19 nt, Human
cuguggucggugccagagg

SEQ ID NO: 3497676 - RNA, 12 nt, Human
cuguggugacuu

SEQ ID NO: 3497677 - RNA, 20 nt, Human
cuguggugacuuuggauaau

SEQ ID NO: 3497678 - RNA, 15 nt, Human
cuguggugugucccc

SEQ ID NO: 3497679 - RNA, 22 nt, Human
cuguggugugucccccucuguc

SEQ ID NO: 3497680 - RNA, 18 nt, Human
cugugguucugagauggc

SEQ ID NO: 3497681 - RNA, 20 nt, Human
cugugguucugagauggcuc

SEQ ID NO: 3497682 - RNA, 19 nt, Human
cugugguuggcugggaaau

SEQ ID NO: 3497683 - RNA, 15 nt, Human
cugugguuucauguu

SEQ ID NO: 3497684 - RNA, 19 nt, Human
cugugguuuccaaggagcu

SEQ ID NO: 3497685 - RNA, 20 nt, Human
cugugguuuccaaggagcug

SEQ ID NO: 3497686 - RNA, 21 nt, Human
cugugguuuccaaggagcuga

SEQ ID NO: 3497687 - RNA, 18 nt, Human
cugugguuuuccccuccc

SEQ ID NO: 3497688 - RNA, 22 nt, Human
cugugguuuuccccucccuggg

SEQ ID NO: 3497689 - RNA, 23 nt, Human
cugugguuuuccccucccugggu

SEQ ID NO: 3497690 - RNA, 16 nt, Human
cuguguaaaaagagag

SEQ ID NO: 3497691 - RNA, 11 nt, Human
cuguguaaacu

SEQ ID NO: 3497692 - RNA, 14 nt, Human
cuguguaaaguuag

SEQ ID NO: 3497693 - RNA, 16 nt, Human
cuguguaacagcuccu

SEQ ID NO: 3497694 - RNA, 18 nt, Human
cuguguaacagcuccuug

SEQ ID NO: 3497695 - RNA, 19 nt, Human
cuguguaacagcuccuugg

SEQ ID NO: 3497696 - RNA, 19 nt, Human
cuguguaaucauuucuugg

SEQ ID NO: 3497697 - RNA, 14 nt, Human
cuguguacaaagaa

SEQ ID NO: 3497698 - RNA, 21 nt, Human
cuguguacagaauucugcuac

SEQ ID NO: 3497699 - RNA, 17 nt, Human
cuguguacauaacugaa

SEQ ID NO: 3497700 - RNA, 20 nt, Human
cuguguacauaacugaaaau

SEQ ID NO: 3497701 - RNA, 15 nt, Human
cuguguacugcaguu

SEQ ID NO: 3497702 - RNA, 23 nt, Human
cuguguagcugugaccugcugag

SEQ ID NO: 3497703 - RNA, 13 nt, Human
cuguguauauuau

SEQ ID NO: 3497704 - RNA, 15 nt, Human
cuguguauauuauuu

SEQ ID NO: 3497705 - RNA, 19 nt, Human
cuguguauauuauuuggca

SEQ ID NO: 3497706 - RNA, 20 nt, Human
cuguguauauuauuuggcag

SEQ ID NO: 3497707 - RNA, 19 nt, Human
cuguguauggaaaaaccau

SEQ ID NO: 3497708 - RNA, 15 nt, Human
cuguguauguacaua

SEQ ID NO: 3497709 - RNA, 15 nt, Human
cuguguauuccaaga

SEQ ID NO: 3497710 - RNA, 13 nt, Human
cuguguauuuaau

SEQ ID NO: 3497711 - RNA, 17 nt, Human
cugugucaauccagaug

SEQ ID NO: 3497712 - RNA, 14 nt, Human
cugugucacuacgu

SEQ ID NO: 3497713 - RNA, 17 nt, Human
cugugucacuggcugcc

SEQ ID NO: 3497714 - RNA, 22 nt, Human
cugugucacuggcugccuccac

SEQ ID NO: 3497715 - RNA, 19 nt, Human
cugugucagcauagaagua

SEQ ID NO: 3497716 - RNA, 20 nt, Human
cugugucagcauagaaguaa

SEQ ID NO: 3497717 - RNA, 19 nt, Human
cugugucagcgccuggccu

SEQ ID NO: 3497718 - RNA, 22 nt, Human
cugugucagguggggcagcuug

SEQ ID NO: 3497719 - RNA, 16 nt, Human
cugugucaguuuaugu

SEQ ID NO: 3497720 - RNA, 15 nt, Human
cugugucauaaacag

SEQ ID NO: 3497721 - RNA, 18 nt, Human
cuguguccaacuccagua

SEQ ID NO: 3497722 - RNA, 19 nt, Human
cuguguccaacuccaguac

SEQ ID NO: 3497723 - RNA, 13 nt, Human
cuguguccaugcg

SEQ ID NO: 3497724 - RNA, 22 nt, Human
cugugucccaugacccaccccu

SEQ ID NO: 3497725 - RNA, 23 nt, Human
cugugucccaugacccaccccug

SEQ ID NO: 3497726 - RNA, 15 nt, Human
cugugucccucucuc

SEQ ID NO: 3497727 - RNA, 19 nt, Human
cugugucccucucucugga

SEQ ID NO: 3497728 - RNA, 15 nt, Human
cuguguccggcccag

SEQ ID NO: 3497729 - RNA, 15 nt, Human
cuguguccuggugcu

SEQ ID NO: 3497730 - RNA, 18 nt, Human
cuguguccuugcaccugc

SEQ ID NO: 3497731 - RNA, 12 nt, Human
cugugucuaaac

SEQ ID NO: 3497732 - RNA, 14 nt, Human
cugugucuaaacug

SEQ ID NO: 3497733 - RNA, 17 nt, Human
cugugucuaagauucua

SEQ ID NO: 3497734 - RNA, 20 nt, Human
cugugucuaagauucuagau

SEQ ID NO: 3497735 - RNA, 21 nt, Human
cugugucuaagauucuagauc

SEQ ID NO: 3497736 - RNA, 18 nt, Human
cugugucugagagcaaag

SEQ ID NO: 3497737 - RNA, 19 nt, Human
cugugucugaguggcuuca

SEQ ID NO: 3497738 - RNA, 22 nt, Human
cugugucugcccaaugaauaau

SEQ ID NO: 3497739 - RNA, 19 nt, Human
cugugucuugcaauggcag

SEQ ID NO: 3497740 - RNA, 21 nt, Human
cugugucuugcaauggcagcc

SEQ ID NO: 3497741 - RNA, 21 nt, Human
cugugucuuuaaaugcugcuu

SEQ ID NO: 3497742 - RNA, 20 nt, Human
cugugucuuuuuucacuaca

SEQ ID NO: 3497743 - RNA, 13 nt, Human
cugugugaaaaug

SEQ ID NO: 3497744 - RNA, 20 nt, Human
cugugugaaacuuucauucc

SEQ ID NO: 3497745 - RNA, 13 nt, Human
cugugugaaugug

SEQ ID NO: 3497746 - RNA, 14 nt, Human
cugugugaaugugg

SEQ ID NO: 3497747 - RNA, 17 nt, Human
cugugugaaugugggca

SEQ ID NO: 3497748 - RNA, 18 nt, Human
cugugugcaagugugugc

SEQ ID NO: 3497749 - RNA, 13 nt, Human
cugugugcagguu

SEQ ID NO: 3497750 - RNA, 15 nt, Human
cugugugcgcucugu

SEQ ID NO: 3497751 - RNA, 14 nt, Human
cugugugcucagga

SEQ ID NO: 3497752 - RNA, 20 nt, Human
cugugugcucaggagcccug

SEQ ID NO: 3497753 - RNA, 23 nt, Human
cugugugcucaggagcccuggga

SEQ ID NO: 3497754 - RNA, 21 nt, Human
cugugugcugugguuccuggg

SEQ ID NO: 3497755 - RNA, 13 nt, Human
cugugugcuuuuu

SEQ ID NO: 3497756 - RNA, 23 nt, Human
cuguguggagagggaaugugaaa

SEQ ID NO: 3497757 - RNA, 15 nt, Human
cuguguggcagucug

SEQ ID NO: 3497758 - RNA, 19 nt, Human
cugugugggacuguacaca

SEQ ID NO: 3497759 - RNA, 16 nt, Human
cugugugucaguuuuc

SEQ ID NO: 3497760 - RNA, 23 nt, Human
cugugugucccaggcagggagac

SEQ ID NO: 3497761 - RNA, 19 nt, Human
cugugugugaccccuccug

SEQ ID NO: 3497762 - RNA, 18 nt, Human
cugugugugagugugaau

SEQ ID NO: 3497763 - RNA, 17 nt, Human
cugugugugaugugcau

SEQ ID NO: 3497764 - RNA, 11 nt, Human
cugugugugcc

SEQ ID NO: 3497765 - RNA, 18 nt, Human
cugugugugcccucuggg

SEQ ID NO: 3497766 - RNA, 23 nt, Human
cugugugugcccucugggcucug

SEQ ID NO: 3497767 - RNA, 18 nt, Human
cugugugugcgccuacag

SEQ ID NO: 3497768 - RNA, 20 nt, Human
cugugugugcgccuacagga

SEQ ID NO: 3497769 - RNA, 14 nt, Human
cugugugugugaau

SEQ ID NO: 3497770 - RNA, 17 nt, Human
cugugugugugaaugaa

SEQ ID NO: 3497771 - RNA, 21 nt, Human
cugugugugugugugugcgug

SEQ ID NO: 3497772 - RNA, 23 nt, Human
cugugugugugugugugcgugug

SEQ ID NO: 3497773 - RNA, 19 nt, Human
cuguguguuaagcucugcu

SEQ ID NO: 3497774 - RNA, 20 nt, Human
cuguguguuaagcucugcua

SEQ ID NO: 3497775 - RNA, 12 nt, Human
cuguguguuagu

SEQ ID NO: 3497776 - RNA, 19 nt, Human
cuguguguuaguucccaac

SEQ ID NO: 3497777 - RNA, 13 nt, Human
cuguguguuccug

SEQ ID NO: 3497778 - RNA, 20 nt, Human
cuguguguugccacaggaca

SEQ ID NO: 3497779 - RNA, 22 nt, Human
cuguguguugccacaggacaca

SEQ ID NO: 3497780 - RNA, 16 nt, Human
cuguguguuuaugugu

SEQ ID NO: 3497781 - RNA, 21 nt, Human
cuguguuaauuuaaguuuuga

SEQ ID NO: 3497782 - RNA, 22 nt, Human
cuguguuauuauagagcagaaa

SEQ ID NO: 3497783 - RNA, 17 nt, Human
cuguguucaaaaauaua

SEQ ID NO: 3497784 - RNA, 13 nt, Human
cuguguuccuggc

SEQ ID NO: 3497785 - RNA, 23 nt, Human
cuguguugcauuauucauuuagu

SEQ ID NO: 3497786 - RNA, 23 nt, Human
cuguguugccacaguagaacugu

SEQ ID NO: 3497787 - RNA, 20 nt, Human
cuguguugcgugucgugggu

SEQ ID NO: 3497788 - RNA, 19 nt, Human
cuguguuguauuaacaaaa

SEQ ID NO: 3497789 - RNA, 22 nt, Human
cuguguuguauuaacaaaaguu

SEQ ID NO: 3497790 - RNA, 14 nt, Human
cuguguugucucua

SEQ ID NO: 3497791 - RNA, 22 nt, Human
cuguguugucucuagagcaggg

SEQ ID NO: 3497792 - RNA, 21 nt, Human
cuguguuuaauuucuucaaaa

SEQ ID NO: 3497793 - RNA, 22 nt, Human
cuguguuuauauggaagaaagu

SEQ ID NO: 3497794 - RNA, 21 nt, Human
cuguguuuauucaaacugaaa

SEQ ID NO: 3497795 - RNA, 22 nt, Human
cuguguuugagcucugcagccc

SEQ ID NO: 3497796 - RNA, 23 nt, Human
cuguguuugcagccugcucuagu

SEQ ID NO: 3497797 - RNA, 14 nt, Human
cuguguuugcuccc

SEQ ID NO: 3497798 - RNA, 16 nt, Human
cuguguuuggcuuuca

SEQ ID NO: 3497799 - RNA, 23 nt, Human
cuguguuuggcuuucagggaggc

SEQ ID NO: 3497800 - RNA, 14 nt, Human
cuguguuuguuccu

SEQ ID NO: 3497801 - RNA, 13 nt, Human
cuguguuuuaaua

SEQ ID NO: 3497802 - RNA, 17 nt, Human
cuguguuuugaaagaau

SEQ ID NO: 3497803 - RNA, 15 nt, Human
cuguguuuuugaaau

SEQ ID NO: 3497804 - RNA, 23 nt, Human
cuuacagugagggcuauacaugg

SEQ ID NO: 3497805 - RNA, 17 nt, Human
cuuacauaaacaucagg

SEQ ID NO: 3497806 - RNA, 22 nt, Human
cuuacauuagcaguuugcuuug

SEQ ID NO: 3497807 - RNA, 21 nt, Human
cuuacauucucuaauaagaaa

SEQ ID NO: 3497808 - RNA, 23 nt, Human
cuuacauucucuaauaagaaaac

SEQ ID NO: 3497809 - RNA, 13 nt, Human
cuuacauuuguga

SEQ ID NO: 3497810 - RNA, 15 nt, Human
cuuaccaaaggauag

SEQ ID NO: 3497811 - RNA, 15 nt, Human
cuuaccaacuuucug

SEQ ID NO: 3497812 - RNA, 17 nt, Human
cuuaccaacuuucugua

SEQ ID NO: 3497813 - RNA, 13 nt, Human
cuuaccauuaaag

SEQ ID NO: 3497814 - RNA, 18 nt, Human
cuguguuuuugaaauauu

SEQ ID NO: 3497815 - RNA, 20 nt, Human
cuguuaaaagaugaaaauau

SEQ ID NO: 3497816 - RNA, 12 nt, Human
cuguuaaaaugc

SEQ ID NO: 3497817 - RNA, 14 nt, Human
cuguuaaacuguua

SEQ ID NO: 3497818 - RNA, 15 nt, Human
cuguuaaauacagga

SEQ ID NO: 3497819 - RNA, 16 nt, Human
cuguuaaauacaggaa

SEQ ID NO: 3497820 - RNA, 20 nt, Human
cuguuaaauugcuguguauc

SEQ ID NO: 3497821 - RNA, 13 nt, Human
cuguuaacugaau

SEQ ID NO: 3497822 - RNA, 14 nt, Human
cuguuaacugaaua

SEQ ID NO: 3497823 - RNA, 18 nt, Human
cuguuaacugaauaccac

SEQ ID NO: 3497824 - RNA, 19 nt, Human
cuguuaacuuauucaaaga

SEQ ID NO: 3497825 - RNA, 16 nt, Human
cuguuaauaguucagg

SEQ ID NO: 3497826 - RNA, 13 nt, Human
cuguuaauguauu

SEQ ID NO: 3497827 - RNA, 13 nt, Human
cuguuacaaaaug

SEQ ID NO: 3497828 - RNA, 17 nt, Human
cuguuacaaaauguaac

SEQ ID NO: 3497829 - RNA, 18 nt, Human
cuguuacaaaauguaacu

SEQ ID NO: 3497830 - RNA, 19 nt, Human
cuguuacaaaauguaacug

SEQ ID NO: 3497831 - RNA, 18 nt, Human
cuguuacacuuuuuggaa

SEQ ID NO: 3497832 - RNA, 15 nt, Human
cuguuacaguaaugu

SEQ ID NO: 3497833 - RNA, 21 nt, Human
cuguuacauaacaagaaaauc

SEQ ID NO: 3497834 - RNA, 19 nt, Human
cuguuaccaugucacugug

SEQ ID NO: 3497835 - RNA, 18 nt, Human
cuguuacccagagaauau

SEQ ID NO: 3497836 - RNA, 22 nt, Human
cuguuacccaggguggagugca

SEQ ID NO: 3497837 - RNA, 17 nt, Human
cuguuaccgccugucuc

SEQ ID NO: 3497838 - RNA, 20 nt, Human
cuguuaccugaucaaugaca

SEQ ID NO: 3497839 - RNA, 14 nt, Human
cuguuacugggccc

SEQ ID NO: 3497840 - RNA, 15 nt, Human
cuguuacugggcccu

SEQ ID NO: 3497841 - RNA, 13 nt, Human
cuguuacugucuu

SEQ ID NO: 3497842 - RNA, 15 nt, Human
cuguuacuuaccuaa

SEQ ID NO: 3497843 - RNA, 19 nt, Human
cuguuacuuaccuaaacag

SEQ ID NO: 3497844 - RNA, 15 nt, Human
cuguuagaacacuau

SEQ ID NO: 3497845 - RNA, 23 nt, Human
cuguuagaacacuauuuucagaa

SEQ ID NO: 3497846 - RNA, 13 nt, Human
cuguuagcacugu

SEQ ID NO: 3497847 - RNA, 17 nt, Human
cuguuagcacuguugau

SEQ ID NO: 3497848 - RNA, 18 nt, Human
cuguuagcacuguugaug

SEQ ID NO: 3497849 - RNA, 17 nt, Human
cuguuagccauguggcu

SEQ ID NO: 3497850 - RNA, 16 nt, Human
cuguuagcuguuauuu

SEQ ID NO: 3497851 - RNA, 14 nt, Human
cuguuagggccuug

SEQ ID NO: 3497852 - RNA, 15 nt, Human
cuguuagggccuugg

SEQ ID NO: 3497853 - RNA, 13 nt, Human
cuguuagucauuu

SEQ ID NO: 3497854 - RNA, 15 nt, Human
cuguuagucauuugc

SEQ ID NO: 3497855 - RNA, 14 nt, Human
cuguuauaacucug

SEQ ID NO: 3497856 - RNA, 13 nt, Human
cuguuauauaaau

SEQ ID NO: 3497857 - RNA, 14 nt, Human
cuguuauauaaaug

SEQ ID NO: 3497858 - RNA, 15 nt, Human
cuguuauauaaaugg

SEQ ID NO: 3497859 - RNA, 21 nt, Human
cuguuaucauuuuuuccuguu

SEQ ID NO: 3497860 - RNA, 13 nt, Human
cuguuauccaugg

SEQ ID NO: 3497861 - RNA, 17 nt, Human
cuguuauccuauuuaga

SEQ ID NO: 3497862 - RNA, 13 nt, Human
cuguuaugggcuu

SEQ ID NO: 3497863 - RNA, 17 nt, Human
cuguuaugucuguuuaa

SEQ ID NO: 3497864 - RNA, 21 nt, Human
cuguuaugucuguuuaagaaa

SEQ ID NO: 3497865 - RNA, 15 nt, Human
cuguuauucuuugca

SEQ ID NO: 3497866 - RNA, 16 nt, Human
cuguuauucuuugcac

SEQ ID NO: 3497867 - RNA, 14 nt, Human
cuguuauuuauaau

SEQ ID NO: 3497868 - RNA, 23 nt, Human
cuguucaagagcacacuuggccc

SEQ ID NO: 3497869 - RNA, 23 nt, Human
cuguucaauguuuuuaaaaaucu

SEQ ID NO: 3497870 - RNA, 15 nt, Human
cuguucacucacucu

SEQ ID NO: 3497871 - RNA, 16 nt, Human
cuguucacuuuuccuc

SEQ ID NO: 3497872 - RNA, 17 nt, Human
cuguucagcauucuuag

SEQ ID NO: 3497873 - RNA, 15 nt, Human
cuguucagcuccagc

SEQ ID NO: 3497874 - RNA, 19 nt, Human
cuguucagcuuuuauuccu

SEQ ID NO: 3497875 - RNA, 16 nt, Human
cuguucaguaauaaaa

SEQ ID NO: 3497876 - RNA, 12 nt, Human
cuguucaguuac

SEQ ID NO: 3497877 - RNA, 15 nt, Human
cuguucaguuacaga

SEQ ID NO: 3497878 - RNA, 17 nt, Human
cuguucaguuacagaaa

SEQ ID NO: 3497879 - RNA, 21 nt, Human
cuguucaguuacagaaagugg

SEQ ID NO: 3497880 - RNA, 21 nt, Human
cuguucauacacuaaccaaau

SEQ ID NO: 3497881 - RNA, 14 nt, Human
cuguucauggcaga

SEQ ID NO: 3497882 - RNA, 17 nt, Human
cuguucauuccuccagg

SEQ ID NO: 3497883 - RNA, 14 nt, Human
cuguucauuguaag

SEQ ID NO: 3497884 - RNA, 14 nt, Human
cuguucauuuccuc

SEQ ID NO: 3497885 - RNA, 17 nt, Human
cuguucauuuccucaaa

SEQ ID NO: 3497886 - RNA, 19 nt, Human
cuguucauuuguuauucuu

SEQ ID NO: 3497887 - RNA, 17 nt, Human
cuguuccaaauucaguu

SEQ ID NO: 3497888 - RNA, 20 nt, Human
cuguuccagugguaagcuau

SEQ ID NO: 3497889 - RNA, 18 nt, Human
cuguucccaaauuuucua

SEQ ID NO: 3497890 - RNA, 14 nt, Human
cuguucccaugaga

SEQ ID NO: 3497891 - RNA, 18 nt, Human
cuguucccauucuugcau

SEQ ID NO: 3497892 - RNA, 12 nt, Human
cuguuccccuca

SEQ ID NO: 3497893 - RNA, 22 nt, Human
cuguuccccucacuggaugaaa

SEQ ID NO: 3497894 - RNA, 18 nt, Human
cuguuccccucucccuuc

SEQ ID NO: 3497895 - RNA, 12 nt, Human
cuguuccugcug

SEQ ID NO: 3497896 - RNA, 13 nt, Human
cuguuccugcugc

SEQ ID NO: 3497897 - RNA, 14 nt, Human
cuguuccugcugcu

SEQ ID NO: 3497898 - RNA, 16 nt, Human
cuguuccuuagaccuu

SEQ ID NO: 3497899 - RNA, 15 nt, Human
cuguuccuucacauc

SEQ ID NO: 3497900 - RNA, 21 nt, Human
cuguuccuucacauccugugu

SEQ ID NO: 3497901 - RNA, 13 nt, Human
cuguuccuucccu

SEQ ID NO: 3497902 - RNA, 22 nt, Human
cuguuccuucccugugccuccu

SEQ ID NO: 3497903 - RNA, 18 nt, Human
cuguucggaagggguucc

SEQ ID NO: 3497904 - RNA, 22 nt, Human
cuguucggaagggguuccucaa

SEQ ID NO: 3497905 - RNA, 16 nt, Human
cuguucuaaagcucug

SEQ ID NO: 3497906 - RNA, 14 nt, Human
cucugcugaggguc

SEQ ID NO: 3497907 - RNA, 15 nt, Human
cucugcugccauggc

SEQ ID NO: 3497908 - RNA, 23 nt, Human
cucugcugccugcccgcacagca

SEQ ID NO: 3497909 - RNA, 15 nt, Human
cucugcugcuggcug

SEQ ID NO: 3497910 - RNA, 22 nt, Human
cucugcugcugucccucccccu

SEQ ID NO: 3497911 - RNA, 11 nt, Human
cucugcugcuu

SEQ ID NO: 3497912 - RNA, 18 nt, Human
cucugcuggcccagccaa

SEQ ID NO: 3497913 - RNA, 14 nt, Human
cucugcuggccgga

SEQ ID NO: 3497914 - RNA, 20 nt, Human
cucugcuggccgggcacagc

SEQ ID NO: 3497915 - RNA, 21 nt, Human
cucugcuggccgggcacagcu

SEQ ID NO: 3497916 - RNA, 14 nt, Human
cucugcuggccugg

SEQ ID NO: 3497917 - RNA, 11 nt, Human
cucugcugugg

SEQ ID NO: 3497918 - RNA, 13 nt, Human
cucugcuucagcu

SEQ ID NO: 3497919 - RNA, 18 nt, Human
cucugcuucuccaaggaa

SEQ ID NO: 3497920 - RNA, 17 nt, Human
cucugcuucucugacuu

SEQ ID NO: 3497921 - RNA, 21 nt, Human
cucugcuucucugacuucugc

SEQ ID NO: 3497922 - RNA, 12 nt, Human
cucugcuugcca

SEQ ID NO: 3497923 - RNA, 14 nt, Human
cucugcuugccauc

SEQ ID NO: 3497924 - RNA, 13 nt, Human
cucugcuugccga

SEQ ID NO: 3497925 - RNA, 18 nt, Human
cucugcuuucugauguug

SEQ ID NO: 3497926 - RNA, 19 nt, Human
cucugcuuugacugagcag

SEQ ID NO: 3497927 - RNA, 19 nt, Human
cucuggaaaaugugaccca

SEQ ID NO: 3497928 - RNA, 23 nt, Human
cucuggaaaggaggaaggagccu

SEQ ID NO: 3497929 - RNA, 21 nt, Human
cucuggaagagaggaaugccu

SEQ ID NO: 3497930 - RNA, 20 nt, Human
cucuggaauuugcaagucau

SEQ ID NO: 3497931 - RNA, 16 nt, Human
cucuggacaaagcguu

SEQ ID NO: 3497932 - RNA, 20 nt, Human
cucuggaccagccuguugga

SEQ ID NO: 3497933 - RNA, 18 nt, Human
cucuggacggcaggcuca

SEQ ID NO: 3497934 - RNA, 14 nt, Human
cucuggacucuaaa

SEQ ID NO: 3497935 - RNA, 16 nt, Human
cucuggacuggcuaga

SEQ ID NO: 3497936 - RNA, 20 nt, Human
cucuggagacagccccagag

SEQ ID NO: 3497937 - RNA, 24 nt, Human
cucuggagacagccccagagcagg

SEQ ID NO: 3497938 - RNA, 12 nt, Human
cucuggagagaa

SEQ ID NO: 3497939 - RNA, 15 nt, Human
cucuggagcauuucu

SEQ ID NO: 3497940 - RNA, 19 nt, Human
cucuggagccaaguccaga

SEQ ID NO: 3497941 - RNA, 22 nt, Human
cucuggagccaccugucccacc

SEQ ID NO: 3497942 - RNA, 13 nt, Human
cucuggagccagc

SEQ ID NO: 3497943 - RNA, 23 nt, Human
cucuggagccagccgagcaggag

SEQ ID NO: 3497944 - RNA, 13 nt, Human
cucuggaggccuc

SEQ ID NO: 3497945 - RNA, 15 nt, Human
cucuggaggccucug

SEQ ID NO: 3497946 - RNA, 22 nt, Human
cucuggaggccucugggccucc

SEQ ID NO: 3497947 - RNA, 14 nt, Human
cucuggaguggcca

SEQ ID NO: 3497948 - RNA, 21 nt, Human
cucuggaugauggauuccaca

SEQ ID NO: 3497949 - RNA, 13 nt, Human
cucuggauggcac

SEQ ID NO: 3497950 - RNA, 17 nt, Human
cucuggauuaggucucu

SEQ ID NO: 3497951 - RNA, 15 nt, Human
cucuggauucagccu

SEQ ID NO: 3497952 - RNA, 18 nt, Human
cucuggauucagccuucu

SEQ ID NO: 3497953 - RNA, 20 nt, Human
cucuggauucagccuucuuu

SEQ ID NO: 3497954 - RNA, 21 nt, Human
cucuggauucagccuucuuuu

SEQ ID NO: 3497955 - RNA, 16 nt, Human
cucuggcagcaccgcc

SEQ ID NO: 3497956 - RNA, 22 nt, Human
cucuggcagcaccgccucuucc

SEQ ID NO: 3497957 - RNA, 15 nt, Human
cucuggcagccacac

SEQ ID NO: 3497958 - RNA, 16 nt, Human
cucuggcagccacacu

SEQ ID NO: 3497959 - RNA, 13 nt, Human
cucuggccccaag

SEQ ID NO: 3497960 - RNA, 24 nt, Human
cucuggcccucuaccccugaucug

SEQ ID NO: 3497961 - RNA, 14 nt, Human
cucuggcccugccu

SEQ ID NO: 3497962 - RNA, 20 nt, Human
cucuggcccuggcccuuacu

SEQ ID NO: 3497963 - RNA, 18 nt, Human
cucuggccucagccgacu

SEQ ID NO: 3497964 - RNA, 14 nt, Human
cucuggccucccac

SEQ ID NO: 3497965 - RNA, 15 nt, Human
cucuggccucccacc

SEQ ID NO: 3497966 - RNA, 12 nt, Human
cucuggccuucg

SEQ ID NO: 3497967 - RNA, 22 nt, Human
cucuggccuucggccuccaucc

SEQ ID NO: 3497968 - RNA, 15 nt, Human
cucuggccuuuuccu

SEQ ID NO: 3497969 - RNA, 14 nt, Human
cucuggcguguggg

SEQ ID NO: 3497970 - RNA, 22 nt, Human
cucuggcucacagacuggagac

SEQ ID NO: 3497971 - RNA, 15 nt, Human
cucuggcugaacccu

SEQ ID NO: 3497972 - RNA, 19 nt, Human
cucuggcugacuaaauuug

SEQ ID NO: 3497973 - RNA, 21 nt, Human
cucuggcugguuuggaaugcu

SEQ ID NO: 3497974 - RNA, 22 nt, Human
cucuggcugguuuggaaugcuu

SEQ ID NO: 3497975 - RNA, 21 nt, Human
cucuggcuguaaggcucuaga

SEQ ID NO: 3497976 - RNA, 22 nt, Human
cucuggcuguaaggcucuagau

SEQ ID NO: 3497977 - RNA, 18 nt, Human
cucuggcuuccagguauc

SEQ ID NO: 3497978 - RNA, 20 nt, Human
cucuggcuuggccacagcca

SEQ ID NO: 3497979 - RNA, 20 nt, Human
cucugggaaaugagaaggca

SEQ ID NO: 3497980 - RNA, 13 nt, Human
cucugggaaccuc

SEQ ID NO: 3497981 - RNA, 20 nt, Human
cucugggaaccucccagagg

SEQ ID NO: 3497982 - RNA, 14 nt, Human
cucugggaacuucu

SEQ ID NO: 3497983 - RNA, 12 nt, Human
cucugggagaaa

SEQ ID NO: 3497984 - RNA, 14 nt, Human
cucugggagaaaau

SEQ ID NO: 3497985 - RNA, 15 nt, Human
cucugggcaggaccu

SEQ ID NO: 3497986 - RNA, 14 nt, Human
cucugggccacuug

SEQ ID NO: 3497987 - RNA, 18 nt, Human
cucugggccacuuggagu

SEQ ID NO: 3497988 - RNA, 20 nt, Human
cucugggccauucuccacag

SEQ ID NO: 3497989 - RNA, 16 nt, Human
cucugggcuauggaca

SEQ ID NO: 3497990 - RNA, 21 nt, Human
cucugggcuauggacacaggg

SEQ ID NO: 3497991 - RNA, 11 nt, Human
cucugggcucu

SEQ ID NO: 3497992 - RNA, 15 nt, Human
cucugggcucugagu

SEQ ID NO: 3497993 - RNA, 15 nt, Human
cucugggcuggauga

SEQ ID NO: 3497994 - RNA, 23 nt, Human
cucugggcuguaacguggcacug

SEQ ID NO: 3497995 - RNA, 14 nt, Human
cucuggggacuccg

SEQ ID NO: 3497996 - RNA, 20 nt, Human
cucuggggcaggcugcuuca

SEQ ID NO: 3497997 - RNA, 14 nt, Human
cucuggggcucuag

SEQ ID NO: 3497998 - RNA, 22 nt, Human
cucuggggcuguugaagucacc

SEQ ID NO: 3497999 - RNA, 16 nt, Human
cucugggggcugagga

SEQ ID NO: 3498000 - RNA, 16 nt, Human
cucugggggguggcca

SEQ ID NO: 3498001 - RNA, 17 nt, Human
cucugguaauauugacu

SEQ ID NO: 3498002 - RNA, 17 nt, Human
cucugguacaauuucuu

SEQ ID NO: 3498003 - RNA, 22 nt, Human
cucugguccggacacuccuaga

SEQ ID NO: 3498004 - RNA, 22 nt, Human
cucuggucugggugccccgucc

SEQ ID NO: 3498005 - RNA, 23 nt, Human
cucuggugagucaccacuucagg

SEQ ID NO: 3498006 - RNA, 23 nt, Human
cucuggugagucuuggcggcagc

SEQ ID NO: 3498007 - RNA, 16 nt, Human
cucuggugccuccaga

SEQ ID NO: 3498008 - RNA, 17 nt, Human
cucugguggcacaggag

SEQ ID NO: 3498009 - RNA, 21 nt, Human
cugacagaaggugccacuuua

SEQ ID NO: 3498010 - RNA, 18 nt, Human
cugacagaaucucugaau

SEQ ID NO: 3498011 - RNA, 12 nt, Human
cugacagacaca

SEQ ID NO: 3498012 - RNA, 12 nt, Human
cugacagaggag

SEQ ID NO: 3498013 - RNA, 13 nt, Human
cugacagaggggg

SEQ ID NO: 3498014 - RNA, 18 nt, Human
cugacagaugucagccga

SEQ ID NO: 3498015 - RNA, 16 nt, Human
cugacagccagaacuc

SEQ ID NO: 3498016 - RNA, 14 nt, Human
cugacagccuccca

SEQ ID NO: 3498017 - RNA, 12 nt, Human
cugacagcugcu

SEQ ID NO: 3498018 - RNA, 14 nt, Human
cugacagcugcucc

SEQ ID NO: 3498019 - RNA, 15 nt, Human
cugacagcugcuccu

SEQ ID NO: 3498020 - RNA, 19 nt, Human
cugacagcugcuccuagag

SEQ ID NO: 3498021 - RNA, 22 nt, Human
cugacagcugcuccuagaggga

SEQ ID NO: 3498022 - RNA, 16 nt, Human
cugacaggcaaugcug

SEQ ID NO: 3498023 - RNA, 21 nt, Human
cugacaggcaaugcuggcugu

SEQ ID NO: 3498024 - RNA, 12 nt, Human
cugacagggcca

SEQ ID NO: 3498025 - RNA, 17 nt, Human
cugacagggccagugca

SEQ ID NO: 3498026 - RNA, 21 nt, Human
cugacaggugaggucuguucc

SEQ ID NO: 3498027 - RNA, 17 nt, Human
cugacagucaugcaguc

SEQ ID NO: 3498028 - RNA, 17 nt, Human
cugacaguccucuccac

SEQ ID NO: 3498029 - RNA, 21 nt, Human
cugacaguccucuccaccuag

SEQ ID NO: 3498030 - RNA, 15 nt, Human
cugacaguuuuucug

SEQ ID NO: 3498031 - RNA, 13 nt, Human
cugacaucaaaaa

SEQ ID NO: 3498032 - RNA, 14 nt, Human
cugacaucacagca

SEQ ID NO: 3498033 - RNA, 15 nt, Human
cugacaucacagcag

SEQ ID NO: 3498034 - RNA, 16 nt, Human
cugacaucacagcagc

SEQ ID NO: 3498035 - RNA, 23 nt, Human
cugacaucacagcagccuccaac

SEQ ID NO: 3498036 - RNA, 14 nt, Human
cugacaucucugca

SEQ ID NO: 3498037 - RNA, 17 nt, Human
cugacaucuguguuuca

SEQ ID NO: 3498038 - RNA, 21 nt, Human
cugacaucuguguuucaagug

SEQ ID NO: 3498039 - RNA, 21 nt, Human
cugacaucuugaauccuucca

SEQ ID NO: 3498040 - RNA, 20 nt, Human
cugacaugauuccuuccugu

SEQ ID NO: 3498041 - RNA, 18 nt, Human
cugacauggcucuggacu

SEQ ID NO: 3498042 - RNA, 19 nt, Human
cugacauggcucuggacuc

SEQ ID NO: 3498043 - RNA, 18 nt, Human
cugacauuaacaguuuuc

SEQ ID NO: 3498044 - RNA, 16 nt, Human
cugacauucaccugcc

SEQ ID NO: 3498045 - RNA, 15 nt, Human
cugacauucugauuc

SEQ ID NO: 3498046 - RNA, 14 nt, Human
cugacauugccaaa

SEQ ID NO: 3498047 - RNA, 16 nt, Human
cugacauugccaaaaa

SEQ ID NO: 3498048 - RNA, 14 nt, Human
cugacauuggagcc

SEQ ID NO: 3498049 - RNA, 16 nt, Human
cugacauuggagccug

SEQ ID NO: 3498050 - RNA, 18 nt, Human
cugacauuuggaguguuc

SEQ ID NO: 3498051 - RNA, 21 nt, Human
cugacauuuggaguguucccc

SEQ ID NO: 3498052 - RNA, 15 nt, Human
cugaccaaacagcca

SEQ ID NO: 3498053 - RNA, 19 nt, Human
cugaccaacaguuccuuca

SEQ ID NO: 3498054 - RNA, 16 nt, Human
cugaccaacauggaga

SEQ ID NO: 3498055 - RNA, 14 nt, Human
cugaccaagagaga

SEQ ID NO: 3498056 - RNA, 19 nt, Human
cugaccaauauuguacagu

SEQ ID NO: 3498057 - RNA, 16 nt, Human
cugaccaauugugcug

SEQ ID NO: 3498058 - RNA, 12 nt, Human
cugaccacacuu

SEQ ID NO: 3498059 - RNA, 16 nt, Human
cugaccacacuuccug

SEQ ID NO: 3498060 - RNA, 17 nt, Human
cugaccacacuuccugu

SEQ ID NO: 3498061 - RNA, 18 nt, Human
cugaccacacuuccuguc

SEQ ID NO: 3498062 - RNA, 19 nt, Human
cugaccacacuuccugucc

SEQ ID NO: 3498063 - RNA, 16 nt, Human
cugaccacccuccccu

SEQ ID NO: 3498064 - RNA, 13 nt, Human
cugaccagaacua

SEQ ID NO: 3498065 - RNA, 16 nt, Human
cugaccagcagcgccu

SEQ ID NO: 3498066 - RNA, 20 nt, Human
cugaccagcagcgccuuucc

SEQ ID NO: 3498067 - RNA, 20 nt, Human
cugaccagccgugagcaugu

SEQ ID NO: 3498068 - RNA, 19 nt, Human
cugaccagcugcuccgagg

SEQ ID NO: 3498069 - RNA, 22 nt, Human
cugaccauauugugcuucacag

SEQ ID NO: 3498070 - RNA, 23 nt, Human
cugaccauccacucuacccuccc

SEQ ID NO: 3498071 - RNA, 15 nt, Human
cugaccaugcucauc

SEQ ID NO: 3498072 - RNA, 20 nt, Human
cugaccaugcucaucugcug

SEQ ID NO: 3498073 - RNA, 12 nt, Human
cugacccacugc

SEQ ID NO: 3498074 - RNA, 21 nt, Human
cugacccagccccuugagaaa

SEQ ID NO: 3498075 - RNA, 12 nt, Human
cugacccaggcc

SEQ ID NO: 3498076 - RNA, 14 nt, Human
cugacccaggccgc

SEQ ID NO: 3498077 - RNA, 17 nt, Human
cugacccaggccgcagc

SEQ ID NO: 3498078 - RNA, 19 nt, Human
cugacccaggccgcagcuc

SEQ ID NO: 3498079 - RNA, 23 nt, Human
cugacccaggccgcagcucuugc

SEQ ID NO: 3498080 - RNA, 11 nt, Human
cugacccaguc

SEQ ID NO: 3498081 - RNA, 15 nt, Human
cugacccagucccug

SEQ ID NO: 3498082 - RNA, 13 nt, Human
cugacccagugag

SEQ ID NO: 3498083 - RNA, 14 nt, Human
cugacccagugaga

SEQ ID NO: 3498084 - RNA, 13 nt, Human
cugacccagugcc

SEQ ID NO: 3498085 - RNA, 20 nt, Human
cugacccagugcccccacug

SEQ ID NO: 3498086 - RNA, 15 nt, Human
cugacccaugcugcc

SEQ ID NO: 3498087 - RNA, 16 nt, Human
cugacccaugcugccc

SEQ ID NO: 3498088 - RNA, 17 nt, Human
cugacccaugcugcccu

SEQ ID NO: 3498089 - RNA, 18 nt, Human
cugacccaugcugcccug

SEQ ID NO: 3498090 - RNA, 22 nt, Human
cugacccaugcugcccugugag

SEQ ID NO: 3498091 - RNA, 16 nt, Human
cugacccauugcuguu

SEQ ID NO: 3498092 - RNA, 21 nt, Human
cugaccccaaacaccuuccag

SEQ ID NO: 3498093 - RNA, 20 nt, Human
cugaccccucauagcccuca

SEQ ID NO: 3498094 - RNA, 16 nt, Human
cugaccccugcucagu

SEQ ID NO: 3498095 - RNA, 20 nt, Human
cugacccuacucccuugccc

SEQ ID NO: 3498096 - RNA, 17 nt, Human
cugacccuaugggucua

SEQ ID NO: 3498097 - RNA, 18 nt, Human
cugacccuccaccgcaga

SEQ ID NO: 3498098 - RNA, 14 nt, Human
cugacccuccuguu

SEQ ID NO: 3498099 - RNA, 13 nt, Human
cugacccugcaga

SEQ ID NO: 3498100 - RNA, 23 nt, Human
cugacccuuacagccucugacuu

SEQ ID NO: 3498101 - RNA, 15 nt, Human
cugacccuuccagac

SEQ ID NO: 3498102 - RNA, 11 nt, Human
cugaccucagc

SEQ ID NO: 3498103 - RNA, 12 nt, Human
cugaccucagca

SEQ ID NO: 3498104 - RNA, 15 nt, Human
cugaccuccacagcu

SEQ ID NO: 3498105 - RNA, 12 nt, Human
cugaccucccag

SEQ ID NO: 3498106 - RNA, 16 nt, Human
cugaccucccagcccu

SEQ ID NO: 3498107 - RNA, 18 nt, Human
cugaccucccccuccuuc

SEQ ID NO: 3498108 - RNA, 22 nt, Human
cugaccucccccuccuucccag

SEQ ID NO: 3498109 - RNA, 21 nt, Human
cugaccucccucuaauuuauc

SEQ ID NO: 3498110 - RNA, 19 nt, Human
cugaccuccgccauccacc

SEQ ID NO: 3498111 - RNA, 12 nt, Human
cugaccucuggu

SEQ ID NO: 3498112 - RNA, 21 nt, Human
cugaccucuugcugucucugc

SEQ ID NO: 3498113 - RNA, 18 nt, Human
cugaccugccucucacac

SEQ ID NO: 3498114 - RNA, 13 nt, Human
cugaccugcugac

SEQ ID NO: 3498115 - RNA, 17 nt, Human
cugaccuggcccccuca

SEQ ID NO: 3498116 - RNA, 21 nt, Human
cugaccugguccacagggcac

SEQ ID NO: 3498117 - RNA, 15 nt, Human
cugaccugucaugcc

SEQ ID NO: 3498118 - RNA, 17 nt, Human
cugaccugucaugcccc

SEQ ID NO: 3498119 - RNA, 17 nt, Human
cugaccugugagcccag

SEQ ID NO: 3498120 - RNA, 21 nt, Human
cugaccugugagcccagcugg

SEQ ID NO: 3498121 - RNA, 19 nt, Human
cugaccuuaaaugcaacca

SEQ ID NO: 3498122 - RNA, 18 nt, Human
cugaccuuccucgcagag

SEQ ID NO: 3498123 - RNA, 20 nt, Human
cugaccuuccucgcagagag

SEQ ID NO: 3498124 - RNA, 23 nt, Human
cugaccuuccucgcagagaggcc

SEQ ID NO: 3498125 - RNA, 16 nt, Human
cugaccuuccuuccug

SEQ ID NO: 3498126 - RNA, 17 nt, Human
cugaccuugaugagcug

SEQ ID NO: 3498127 - RNA, 19 nt, Human
cugaccuuggagagacaca

SEQ ID NO: 3498128 - RNA, 21 nt, Human
cugaccuuggagagacacagc

SEQ ID NO: 3498129 - RNA, 23 nt, Human
cugacgacuugagugcucaguag

SEQ ID NO: 3498130 - RNA, 14 nt, Human
cugacggacucaug

SEQ ID NO: 3498131 - RNA, 20 nt, Human
cugacggccagggagaagcu

SEQ ID NO: 3498132 - RNA, 13 nt, Human
cugacggcccugc

SEQ ID NO: 3498133 - RNA, 20 nt, Human
cugacggcgcccccagugug

SEQ ID NO: 3498134 - RNA, 16 nt, Human
cugacggugcagucug

SEQ ID NO: 3498135 - RNA, 23 nt, Human
cugacguagcugcaaaggacaga

SEQ ID NO: 3498136 - RNA, 21 nt, Human
cugacgucugaagcuugacuc

SEQ ID NO: 3498137 - RNA, 18 nt, Human
cugacgugccuuuugcac

SEQ ID NO: 3498138 - RNA, 20 nt, Human
cugacgugccuuuugcaccc

SEQ ID NO: 3498139 - RNA, 23 nt, Human
cugacgugccuuuugcaccccuc

SEQ ID NO: 3498140 - RNA, 14 nt, Human
cugacuaaacuuuu

SEQ ID NO: 3498141 - RNA, 12 nt, Human
cugacuaaauuu

SEQ ID NO: 3498142 - RNA, 13 nt, Human
cugacuaaauuug

SEQ ID NO: 3498143 - RNA, 15 nt, Human
cugacuacagggccg

SEQ ID NO: 3498144 - RNA, 16 nt, Human
cugacuacauuuuuuc

SEQ ID NO: 3498145 - RNA, 15 nt, Human
cugacuacuuugccu

SEQ ID NO: 3498146 - RNA, 15 nt, Human
cugacuaugacauaa

SEQ ID NO: 3498147 - RNA, 13 nt, Human
cugacucacaaga

SEQ ID NO: 3498148 - RNA, 15 nt, Human
cugacucaggcauca

SEQ ID NO: 3498149 - RNA, 21 nt, Human
cugacucagggcuccuggguu

SEQ ID NO: 3498150 - RNA, 20 nt, Human
cugacuccacgauccugcca

SEQ ID NO: 3498151 - RNA, 18 nt, Human
cugacucccaaagagcug

SEQ ID NO: 3498152 - RNA, 19 nt, Human
cugacucccaaagagcugc

SEQ ID NO: 3498153 - RNA, 18 nt, Human
cugacuccuaccugcccu

SEQ ID NO: 3498154 - RNA, 13 nt, Human
cugacuccugguc

SEQ ID NO: 3498155 - RNA, 14 nt, Human
cugacuccuggucc

SEQ ID NO: 3498156 - RNA, 15 nt, Human
cugacuccugguccu

SEQ ID NO: 3498157 - RNA, 16 nt, Human
cugacucgguuucucc

SEQ ID NO: 3498158 - RNA, 17 nt, Human
cugacucgguuucucca

SEQ ID NO: 3498159 - RNA, 16 nt, Human
cugacucucugugacc

SEQ ID NO: 3498160 - RNA, 18 nt, Human
cucugguuguuucuguuc

SEQ ID NO: 3498161 - RNA, 20 nt, Human
cucugguuuggggcgaggca

SEQ ID NO: 3498162 - RNA, 21 nt, Human
cucuguaaucucguuucaaaa

SEQ ID NO: 3498163 - RNA, 16 nt, Human
cucuguaauugcaaaa

SEQ ID NO: 3498164 - RNA, 21 nt, Human
cucuguacagagcccacgccc

SEQ ID NO: 3498165 - RNA, 11 nt, Human
cucuguacuuu

SEQ ID NO: 3498166 - RNA, 22 nt, Human
cucuguacuuuucauucucuuu

SEQ ID NO: 3498167 - RNA, 14 nt, Human
cucuguagaaauuc

SEQ ID NO: 3498168 - RNA, 18 nt, Human
cucuguauaaacauuaaa

SEQ ID NO: 3498169 - RNA, 23 nt, Human
cucuguauuuuuucuugcauuga

SEQ ID NO: 3498170 - RNA, 18 nt, Human
cucugucacugcaggcac

SEQ ID NO: 3498171 - RNA, 14 nt, Human
cucugucaggccuu

SEQ ID NO: 3498172 - RNA, 19 nt, Human
cucuguccaggcacugaga

SEQ ID NO: 3498173 - RNA, 17 nt, Human
cucugucccauucccug

SEQ ID NO: 3498174 - RNA, 12 nt, Human
cucuguccccag

SEQ ID NO: 3498175 - RNA, 14 nt, Human
cucuguccccuucu

SEQ ID NO: 3498176 - RNA, 23 nt, Human
cucuguccccuucucucaucucu

SEQ ID NO: 3498177 - RNA, 18 nt, Human
cucuguccugacuucagg

SEQ ID NO: 3498178 - RNA, 17 nt, Human
cucuguccugcuucuga

SEQ ID NO: 3498179 - RNA, 15 nt, Human
cucuguccugggagu

SEQ ID NO: 3498180 - RNA, 16 nt, Human
cucugucgagccuggg

SEQ ID NO: 3498181 - RNA, 22 nt, Human
cucugucgcccaggcuggagug

SEQ ID NO: 3498182 - RNA, 17 nt, Human
cucugucuaccaucucc

SEQ ID NO: 3498183 - RNA, 10 nt, Human
cucugucuca

SEQ ID NO: 3498184 - RNA, 22 nt, Human
cucugucucagacuuuuguaca

SEQ ID NO: 3498185 - RNA, 18 nt, Human
cucugucucauccuccug

SEQ ID NO: 3498186 - RNA, 16 nt, Human
cucugucucaugugug

SEQ ID NO: 3498187 - RNA, 22 nt, Human
cucugucugaguaagaaacaga

SEQ ID NO: 3498188 - RNA, 17 nt, Human
cucugucuggcaaugcc

SEQ ID NO: 3498189 - RNA, 13 nt, Human
cucugucuucugg

SEQ ID NO: 3498190 - RNA, 14 nt, Human
cucugucuucugga

SEQ ID NO: 3498191 - RNA, 18 nt, Human
cucugugaacccuaugag

SEQ ID NO: 3498192 - RNA, 18 nt, Human
cucugugaacgauuuaga

SEQ ID NO: 3498193 - RNA, 21 nt, Human
cucugugaacgauuuagaaag

SEQ ID NO: 3498194 - RNA, 18 nt, Human
cucugugaagcauucgag

SEQ ID NO: 3498195 - RNA, 15 nt, Human
cucugugaccugccc

SEQ ID NO: 3498196 - RNA, 23 nt, Human
cucugugaccugccccgcccagc

SEQ ID NO: 3498197 - RNA, 21 nt, Human
cucugugagaagguuuauugu

SEQ ID NO: 3498198 - RNA, 23 nt, Human
cucugugagaagguuuauuguua

SEQ ID NO: 3498199 - RNA, 18 nt, Human
cucugugagcaucacagu

SEQ ID NO: 3498200 - RNA, 22 nt, Human
cucugugagcaucacaguuuug

SEQ ID NO: 3498201 - RNA, 20 nt, Human
cucugugcacuuauuuauga

SEQ ID NO: 3498202 - RNA, 20 nt, Human
cucugugccagagccugggg

SEQ ID NO: 3498203 - RNA, 20 nt, Human
cucugugcccaugggcacug

SEQ ID NO: 3498204 - RNA, 20 nt, Human
cucugugcccccaucacccu

SEQ ID NO: 3498205 - RNA, 15 nt, Human
cucugugccuucuuu

SEQ ID NO: 3498206 - RNA, 19 nt, Human
cucugugcugacccuccug

SEQ ID NO: 3498207 - RNA, 18 nt, Human
cucugugcuguggaagca

SEQ ID NO: 3498208 - RNA, 13 nt, Human
cucugugcugugu

SEQ ID NO: 3498209 - RNA, 11 nt, Human
cucuguggaug

SEQ ID NO: 3498210 - RNA, 23 nt, Human
cucugugggcugcacucugugcc

SEQ ID NO: 3498211 - RNA, 14 nt, Human
cucuguggugucug

SEQ ID NO: 3498212 - RNA, 19 nt, Human
cucuguguauuugcuuuuu

SEQ ID NO: 3498213 - RNA, 16 nt, Human
cucugugucacuggcu

SEQ ID NO: 3498214 - RNA, 15 nt, Human
cucugugucaggugg

SEQ ID NO: 3498215 - RNA, 21 nt, Human
cucugugucagguggggcagc

SEQ ID NO: 3498216 - RNA, 14 nt, Human
cucuguguccuucc

SEQ ID NO: 3498217 - RNA, 17 nt, Human
cucuguguccuucccug

SEQ ID NO: 3498218 - RNA, 15 nt, Human
cucugugucuaagau

SEQ ID NO: 3498219 - RNA, 18 nt, Human
cucugugucuaagauucu

SEQ ID NO: 3498220 - RNA, 19 nt, Human
cucugugucuaagauucua

SEQ ID NO: 3498221 - RNA, 21 nt, Human
cucugugucugaguggcuuca

SEQ ID NO: 3498222 - RNA, 13 nt, Human
cucugugugcucc

SEQ ID NO: 3498223 - RNA, 20 nt, Human
cucuguuauguacuguacua

SEQ ID NO: 3498224 - RNA, 15 nt, Human
cucuguucaaagcug

SEQ ID NO: 3498225 - RNA, 17 nt, Human
cucuguucauuuccuca

SEQ ID NO: 3498226 - RNA, 16 nt, Human
cucuguuccaugucuc

SEQ ID NO: 3498227 - RNA, 14 nt, Human
cucuguuccuggcu

SEQ ID NO: 3498228 - RNA, 22 nt, Human
cucuguuccuggcucagccuca

SEQ ID NO: 3498229 - RNA, 19 nt, Human
cucuguucugcacacagca

SEQ ID NO: 3498230 - RNA, 20 nt, Human
cucuguucugcacacagcac

SEQ ID NO: 3498231 - RNA, 21 nt, Human
cucuguucugcacacagcacg

SEQ ID NO: 3498232 - RNA, 19 nt, Human
cucuguucuuccucagcca

SEQ ID NO: 3498233 - RNA, 19 nt, Human
cucuguugacuggcugugu

SEQ ID NO: 3498234 - RNA, 17 nt, Human
cucuguugcccaggcug

SEQ ID NO: 3498235 - RNA, 20 nt, Human
cucuguugcccaggcuggag

SEQ ID NO: 3498236 - RNA, 12 nt, Human
cucuguuguccu

SEQ ID NO: 3498237 - RNA, 21 nt, Human
cucuguugucguaaagauuug

SEQ ID NO: 3498238 - RNA, 14 nt, Human
cucuguuugugggg

SEQ ID NO: 3498239 - RNA, 20 nt, Human
cucuguuuuacaaguuggag

SEQ ID NO: 3498240 - RNA, 22 nt, Human
cucuguuuuacaaguuggaguc

SEQ ID NO: 3498241 - RNA, 16 nt, Human
cucuuaaaaaauaaaa

SEQ ID NO: 3498242 - RNA, 18 nt, Human
cucuuaaaaaauaaaaac

SEQ ID NO: 3498243 - RNA, 24 nt, Human
cucuuaaaacccaagugccuuagc

SEQ ID NO: 3498244 - RNA, 22 nt, Human
cucuuaaagaaaacccaccccg

SEQ ID NO: 3498245 - RNA, 12 nt, Human
cucuuaaaguug

SEQ ID NO: 3498246 - RNA, 13 nt, Human
cucuuaagaagac

SEQ ID NO: 3498247 - RNA, 13 nt, Human
cucuuaagccauc

SEQ ID NO: 3498248 - RNA, 20 nt, Human
cucuuaagccaucuugguaa

SEQ ID NO: 3498249 - RNA, 12 nt, Human
cucuuaaguuuc

SEQ ID NO: 3498250 - RNA, 14 nt, Human
cucuuaaguuucuc

SEQ ID NO: 3498251 - RNA, 19 nt, Human
cucuuaccaguauuuaacu

SEQ ID NO: 3498252 - RNA, 18 nt, Human
cucuuacgcccaacccuu

SEQ ID NO: 3498253 - RNA, 18 nt, Human
cucuuacuacacugagga

SEQ ID NO: 3498254 - RNA, 18 nt, Human
cucuuacucuuuccuauu

SEQ ID NO: 3498255 - RNA, 20 nt, Human
cucuuacucuuuccuauuuc

SEQ ID NO: 3498256 - RNA, 14 nt, Human
cucuuacugcuaac

SEQ ID NO: 3498257 - RNA, 22 nt, Human
cucuuacuuuccuuuccccagc

SEQ ID NO: 3498258 - RNA, 15 nt, Human
cucuuagaacauugu

SEQ ID NO: 3498259 - RNA, 22 nt, Human
cucuuagaagaauauuguauug

SEQ ID NO: 3498260 - RNA, 14 nt, Human
cucuuagauggauu

SEQ ID NO: 3498261 - RNA, 18 nt, Human
cucuuagcaaaaacaugu

SEQ ID NO: 3498262 - RNA, 22 nt, Human
cucuuauaucuaaaucugucca

SEQ ID NO: 3498263 - RNA, 15 nt, Human
cucuuaucucaguca

SEQ ID NO: 3498264 - RNA, 22 nt, Human
cucuuaucucagucaugcauaa

SEQ ID NO: 3498265 - RNA, 13 nt, Human
cucuuaugccauu

SEQ ID NO: 3498266 - RNA, 18 nt, Human
cucuuaugccauuuguuu

SEQ ID NO: 3498267 - RNA, 14 nt, Human
cucuuauuacaaag

SEQ ID NO: 3498268 - RNA, 16 nt, Human
cucuuauucaguaaaa

SEQ ID NO: 3498269 - RNA, 19 nt, Human
cucuuauugcccacgcugg

SEQ ID NO: 3498270 - RNA, 14 nt, Human
cucuuauugccuca

SEQ ID NO: 3498271 - RNA, 17 nt, Human
cucuucaaaaacuguuu

SEQ ID NO: 3498272 - RNA, 15 nt, Human
cucuucaaaugccug

SEQ ID NO: 3498273 - RNA, 16 nt, Human
cucuucaacugaccag

SEQ ID NO: 3498274 - RNA, 22 nt, Human
cucuucaccccggcaggcccug

SEQ ID NO: 3498275 - RNA, 11 nt, Human
cucuucagaaa

SEQ ID NO: 3498276 - RNA, 23 nt, Human
cucuucagacucucagcccagaa

SEQ ID NO: 3498277 - RNA, 13 nt, Human
cucuucagaggcc

SEQ ID NO: 3498278 - RNA, 18 nt, Human
cucuucagaucucuaacu

SEQ ID NO: 3498279 - RNA, 16 nt, Human
cucuucaggccucccu

SEQ ID NO: 3498280 - RNA, 18 nt, Human
cucuucaggccucccucu

SEQ ID NO: 3498281 - RNA, 13 nt, Human
cucuucagucucu

SEQ ID NO: 3498282 - RNA, 19 nt, Human
cucuucaguuaagccuuug

SEQ ID NO: 3498283 - RNA, 20 nt, Human
cucuucaguuaagccuuugg

SEQ ID NO: 3498284 - RNA, 13 nt, Human
cucuucauacuuu

SEQ ID NO: 3498285 - RNA, 19 nt, Human
cucuucauacuuuuuuuca

SEQ ID NO: 3498286 - RNA, 17 nt, Human
cucuucauauucagcuu

SEQ ID NO: 3498287 - RNA, 17 nt, Human
cucuuccacucuccuug

SEQ ID NO: 3498288 - RNA, 15 nt, Human
cucuuccaggcagcc

SEQ ID NO: 3498289 - RNA, 13 nt, Human
cucuuccaggcug

SEQ ID NO: 3498290 - RNA, 15 nt, Human
cucuuccaugcugug

SEQ ID NO: 3498291 - RNA, 16 nt, Human
cucuuccccagacgcc

SEQ ID NO: 3498292 - RNA, 14 nt, Human
cucuucccccaaga

SEQ ID NO: 3498293 - RNA, 15 nt, Human
cucuucccccaagau

SEQ ID NO: 3498294 - RNA, 15 nt, Human
cucuucccccaccac

SEQ ID NO: 3498295 - RNA, 18 nt, Human
cucuucccccucucccag

SEQ ID NO: 3498296 - RNA, 19 nt, Human
cucuucccccucucccagu

SEQ ID NO: 3498297 - RNA, 16 nt, Human
cucuucccccuuccaa

SEQ ID NO: 3498298 - RNA, 22 nt, Human
cucuucccugaacuuccugcuu

SEQ ID NO: 3498299 - RNA, 23 nt, Human
cucuucccugaacuuccugcuuc

SEQ ID NO: 3498300 - RNA, 16 nt, Human
cucuuccgacucuuuc

SEQ ID NO: 3498301 - RNA, 22 nt, Human
cucuuccuacccaaccacucaa

SEQ ID NO: 3498302 - RNA, 12 nt, Human
cucuuccuaucc

SEQ ID NO: 3498303 - RNA, 15 nt, Human
cucuuccuaucccau

SEQ ID NO: 3498304 - RNA, 16 nt, Human
cucuuccuauuuuugu

SEQ ID NO: 3498305 - RNA, 19 nt, Human
cucuuccuccaaggacaga

SEQ ID NO: 3498306 - RNA, 16 nt, Human
cucuuccuccugacac

SEQ ID NO: 3498307 - RNA, 18 nt, Human
cucuuccuccugacaccc

SEQ ID NO: 3498308 - RNA, 21 nt, Human
cucuuccuccugacaccccac

SEQ ID NO: 3498309 - RNA, 14 nt, Human
cccuaagccagccu

SEQ ID NO: 3498310 - RNA, 18 nt, Human
cccuaagccagcugcccc

SEQ ID NO: 3498311 - RNA, 18 nt, Human
cccuaaggcaugugugaa

SEQ ID NO: 3498312 - RNA, 20 nt, Human
cccuaaggcaugugugaaac

SEQ ID NO: 3498313 - RNA, 21 nt, Human
cccuaaggucauuaccacagg

SEQ ID NO: 3498314 - RNA, 12 nt, Human
cccuaaugccug

SEQ ID NO: 3498315 - RNA, 17 nt, Human
cccuaaugcgcaggcug

SEQ ID NO: 3498316 - RNA, 21 nt, Human
cccuaauucagccauguacag

SEQ ID NO: 3498317 - RNA, 17 nt, Human
cccuacacccagacccc

SEQ ID NO: 3498318 - RNA, 18 nt, Human
cccuacaccccuccccug

SEQ ID NO: 3498319 - RNA, 20 nt, Human
cccuacaguugaaaaacagc

SEQ ID NO: 3498320 - RNA, 14 nt, Human
cccuacauguauug

SEQ ID NO: 3498321 - RNA, 20 nt, Human
cccuaccaccuccccagccu

SEQ ID NO: 3498322 - RNA, 20 nt, Human
cccuaccagcgcccgcuggg

SEQ ID NO: 3498323 - RNA, 22 nt, Human
cccuaccagcgcccgcugggcu

SEQ ID NO: 3498324 - RNA, 16 nt, Human
cccuaccccuggcugu

SEQ ID NO: 3498325 - RNA, 13 nt, Human
cccuacccucuag

SEQ ID NO: 3498326 - RNA, 20 nt, Human
cccuaccucaaccuguaaau

SEQ ID NO: 3498327 - RNA, 23 nt, Human
cccuaccugauuggugcaacccu

SEQ ID NO: 3498328 - RNA, 16 nt, Human
cccuaccugccccacu

SEQ ID NO: 3498329 - RNA, 15 nt, Human
cccuacucccugcag

SEQ ID NO: 3498330 - RNA, 16 nt, Human
cccuacucccugcaga

SEQ ID NO: 3498331 - RNA, 22 nt, Human
cccuagacuuuaggcuuucagc

SEQ ID NO: 3498332 - RNA, 18 nt, Human
cccuagagccugccugga

SEQ ID NO: 3498333 - RNA, 13 nt, Human
cccuagauaguuu

SEQ ID NO: 3498334 - RNA, 19 nt, Human
cccuagcagcccacccugc

SEQ ID NO: 3498335 - RNA, 23 nt, Human
cccuagcagcccacccugcugcu

SEQ ID NO: 3498336 - RNA, 13 nt, Human
cccuagcagugaa

SEQ ID NO: 3498337 - RNA, 20 nt, Human
cccuagcccagcgcucugcc

SEQ ID NO: 3498338 - RNA, 13 nt, Human
cccuagcccagga

SEQ ID NO: 3498339 - RNA, 17 nt, Human
cccuagccgguuccugu

SEQ ID NO: 3498340 - RNA, 23 nt, Human
cccuagccgguuccugucccugc

SEQ ID NO: 3498341 - RNA, 11 nt, Human
cccuagccuug

SEQ ID NO: 3498342 - RNA, 20 nt, Human
cccuagcuccacacccucuc

SEQ ID NO: 3498343 - RNA, 22 nt, Human
cccuagcuuagagccucccuca

SEQ ID NO: 3498344 - RNA, 17 nt, Human
cccuagcuuuagacccu

SEQ ID NO: 3498345 - RNA, 19 nt, Human
cccuagcuuuagacccugg

SEQ ID NO: 3498346 - RNA, 23 nt, Human
cccuagcuuuauauauggacaug

SEQ ID NO: 3498347 - RNA, 17 nt, Human
cccuaggaacucagucc

SEQ ID NO: 3498348 - RNA, 16 nt, Human
cccuagggcugggugu

SEQ ID NO: 3498349 - RNA, 21 nt, Human
cccuaggucagcuugcugccc

SEQ ID NO: 3498350 - RNA, 12 nt, Human
cccuagguguuu

SEQ ID NO: 3498351 - RNA, 15 nt, Human
cccuagguguuuugu

SEQ ID NO: 3498352 - RNA, 12 nt, Human
cccuagguuccc

SEQ ID NO: 3498353 - RNA, 20 nt, Human
cccuaguaagugccuuccau

SEQ ID NO: 3498354 - RNA, 16 nt, Human
cccuagucccuucccc

SEQ ID NO: 3498355 - RNA, 21 nt, Human
cccuagugacccggaggccac

SEQ ID NO: 3498356 - RNA, 19 nt, Human
cccuauacuguaguauucu

SEQ ID NO: 3498357 - RNA, 19 nt, Human
cccuauaucuauaaacacu

SEQ ID NO: 3498358 - RNA, 23 nt, Human
cccuauauguaguauaaagaaaa

SEQ ID NO: 3498359 - RNA, 23 nt, Human
cccuaucuaacccucccauggca

SEQ ID NO: 3498360 - RNA, 13 nt, Human
cccuaucuccuga

SEQ ID NO: 3498361 - RNA, 17 nt, Human
cccuaucuccugacaga

SEQ ID NO: 3498362 - RNA, 16 nt, Human
cccuaucuuugccacc

SEQ ID NO: 3498363 - RNA, 23 nt, Human
cccuauuuaacagggucucuagu

SEQ ID NO: 3498364 - RNA, 16 nt, Human
cccuauuuccccaccc

SEQ ID NO: 3498365 - RNA, 20 nt, Human
cccuauuuuuuuucuguuau

SEQ ID NO: 3498366 - RNA, 21 nt, Human
cccuauuuuuuuucuguuaua

SEQ ID NO: 3498367 - RNA, 15 nt, Human
cccucaaaccuccuc

SEQ ID NO: 3498368 - RNA, 19 nt, Human
cccucaaaccuccucuucu

SEQ ID NO: 3498369 - RNA, 21 nt, Human
cccucaaaccuccucuucuga

SEQ ID NO: 3498370 - RNA, 24 nt, Human
cccucaaaccuccucuucugacgu

SEQ ID NO: 3498371 - RNA, 15 nt, Human
cccucaaagaggcag

SEQ ID NO: 3498372 - RNA, 17 nt, Human
cccucaacaagggagag

SEQ ID NO: 3498373 - RNA, 16 nt, Human
cccucaacaccucugc

SEQ ID NO: 3498374 - RNA, 16 nt, Human
cccucaaggccuccca

SEQ ID NO: 3498375 - RNA, 17 nt, Human
cccucaaggccucccac

SEQ ID NO: 3498376 - RNA, 12 nt, Human
cccucacagccu

SEQ ID NO: 3498377 - RNA, 17 nt, Human
cccucacagccucugac

SEQ ID NO: 3498378 - RNA, 21 nt, Human
cccucacccacuuuggccucc

SEQ ID NO: 3498379 - RNA, 15 nt, Human
cccucacccugagcc

SEQ ID NO: 3498380 - RNA, 18 nt, Human
cccucaccuugcaacaca

SEQ ID NO: 3498381 - RNA, 23 nt, Human
cccucaccuuggcaccagacacc

SEQ ID NO: 3498382 - RNA, 15 nt, Human
cccucacucucagga

SEQ ID NO: 3498383 - RNA, 14 nt, Human
cccucacucuggcc

SEQ ID NO: 3498384 - RNA, 18 nt, Human
cccucacugaaugccuca

SEQ ID NO: 3498385 - RNA, 19 nt, Human
cccucacuggcucuccugg

SEQ ID NO: 3498386 - RNA, 9 nt, Human
cccucagaa

SEQ ID NO: 3498387 - RNA, 20 nt, Human
cccucagaaaaugaguaaca

SEQ ID NO: 3498388 - RNA, 20 nt, Human
cccucagaaacacuggggcu

SEQ ID NO: 3498389 - RNA, 18 nt, Human
cccucagaacccuuggcu

SEQ ID NO: 3498390 - RNA, 16 nt, Human
cccucagacuggggca

SEQ ID NO: 3498391 - RNA, 14 nt, Human
cccucagauguccc

SEQ ID NO: 3498392 - RNA, 16 nt, Human
cccucagaugucccuu

SEQ ID NO: 3498393 - RNA, 19 nt, Human
cccucagcaccccuuccau

SEQ ID NO: 3498394 - RNA, 21 nt, Human
cccucagcaccccuuccaugu

SEQ ID NO: 3498395 - RNA, 19 nt, Human
cccucagccacacccaggc

SEQ ID NO: 3498396 - RNA, 13 nt, Human
cccucagccccuc

SEQ ID NO: 3498397 - RNA, 16 nt, Human
cccucagcucggcuca

SEQ ID NO: 3498398 - RNA, 21 nt, Human
cccucaggacccucgcuggcc

SEQ ID NO: 3498399 - RNA, 23 nt, Human
cccucaggacccucgcuggcccc

SEQ ID NO: 3498400 - RNA, 21 nt, Human
cccucaggcauaggccugggu

SEQ ID NO: 3498401 - RNA, 22 nt, Human
cccucagggaucuugcauuccc

SEQ ID NO: 3498402 - RNA, 18 nt, Human
cccucagggcaaagccag

SEQ ID NO: 3498403 - RNA, 19 nt, Human
cccucagggcaaagccagg

SEQ ID NO: 3498404 - RNA, 16 nt, Human
cccucagggucccugg

SEQ ID NO: 3498405 - RNA, 13 nt, Human
cccucaguugugc

SEQ ID NO: 3498406 - RNA, 14 nt, Human
cccucaguugugca

SEQ ID NO: 3498407 - RNA, 17 nt, Human
cccucaguugugcagcu

SEQ ID NO: 3498408 - RNA, 15 nt, Human
cccucauagcccuca

SEQ ID NO: 3498409 - RNA, 19 nt, Human
cccucaucaaggacacggg

SEQ ID NO: 3498410 - RNA, 14 nt, Human
cccucaucuguccc

SEQ ID NO: 3498411 - RNA, 17 nt, Human
cccucaugcugccaaua

SEQ ID NO: 3498412 - RNA, 16 nt, Human
cccucauggccccucu

SEQ ID NO: 3498413 - RNA, 17 nt, Human
cccucauggccccucug

SEQ ID NO: 3498414 - RNA, 23 nt, Human
cccucauuaaaauauugaaaucu

SEQ ID NO: 3498415 - RNA, 12 nt, Human
cccucauuaaug

SEQ ID NO: 3498416 - RNA, 19 nt, Human
cccucauuacggcuccucu

SEQ ID NO: 3498417 - RNA, 18 nt, Human
cccucauuacugggccuu

SEQ ID NO: 3498418 - RNA, 15 nt, Human
cccucauucaggaaa

SEQ ID NO: 3498419 - RNA, 15 nt, Human
cccuccaaaagcacu

SEQ ID NO: 3498420 - RNA, 23 nt, Human
cccuccaaauggagaagcugcag

SEQ ID NO: 3498421 - RNA, 17 nt, Human
cccuccacaccugcggc

SEQ ID NO: 3498422 - RNA, 15 nt, Human
cccuccacaucccug

SEQ ID NO: 3498423 - RNA, 23 nt, Human
cccuccacauuucccccuagccu

SEQ ID NO: 3498424 - RNA, 14 nt, Human
cccuccaccccagg

SEQ ID NO: 3498425 - RNA, 12 nt, Human
cccuccacccug

SEQ ID NO: 3498426 - RNA, 12 nt, Human
cccuccaccucc

SEQ ID NO: 3498427 - RNA, 14 nt, Human
cccuccaccucccu

SEQ ID NO: 3498428 - RNA, 19 nt, Human
cccuccaccucccugcaau

SEQ ID NO: 3498429 - RNA, 13 nt, Human
cccuccaccugcu

SEQ ID NO: 3498430 - RNA, 18 nt, Human
cccuccacguucaccccu

SEQ ID NO: 3498431 - RNA, 17 nt, Human
cccuccacuccuuccug

SEQ ID NO: 3498432 - RNA, 13 nt, Human
cccuccacugccc

SEQ ID NO: 3498433 - RNA, 15 nt, Human
cccuccacugcccuc

SEQ ID NO: 3498434 - RNA, 19 nt, Human
cccuccagaacacggcuca

SEQ ID NO: 3498435 - RNA, 13 nt, Human
cccuccagagaca

SEQ ID NO: 3498436 - RNA, 12 nt, Human
cccuccagccuu

SEQ ID NO: 3498437 - RNA, 20 nt, Human
cccuccagcuuguggagccc

SEQ ID NO: 3498438 - RNA, 12 nt, Human
cccuccaggagu

SEQ ID NO: 3498439 - RNA, 22 nt, Human
cccuccaucuguacuuggucca

SEQ ID NO: 3498440 - RNA, 17 nt, Human
cccuccaugugggcuag

SEQ ID NO: 3498441 - RNA, 21 nt, Human
cccucccaagcuggcuggggu

SEQ ID NO: 3498442 - RNA, 12 nt, Human
cccucccacccc

SEQ ID NO: 3498443 - RNA, 15 nt, Human
cccucccacccccag

SEQ ID NO: 3498444 - RNA, 13 nt, Human
cccucccaccucu

SEQ ID NO: 3498445 - RNA, 10 nt, Human
cccucccacu

SEQ ID NO: 3498446 - RNA, 15 nt, Human
cccucccacuuugcu

SEQ ID NO: 3498447 - RNA, 14 nt, Human
cccucccagcucug

SEQ ID NO: 3498448 - RNA, 17 nt, Human
cccucccagcugacagu

SEQ ID NO: 3498449 - RNA, 14 nt, Human
cccucccagggagc

SEQ ID NO: 3498450 - RNA, 17 nt, Human
cccucccaucugggagu

SEQ ID NO: 3498451 - RNA, 21 nt, Human
cccuccccaacugaccaccuu

SEQ ID NO: 3498452 - RNA, 15 nt, Human
cccucccccagccac

SEQ ID NO: 3498453 - RNA, 23 nt, Human
cccucccccagccaugccagcug

SEQ ID NO: 3498454 - RNA, 15 nt, Human
cccucccccccaugc

SEQ ID NO: 3498455 - RNA, 21 nt, Human
cccucccccgccacuccugaa

SEQ ID NO: 3498456 - RNA, 13 nt, Human
cccucccccgucc

SEQ ID NO: 3498457 - RNA, 13 nt, Human
cccucccccugag

SEQ ID NO: 3498458 - RNA, 14 nt, Human
cccucccccugccc

SEQ ID NO: 3498459 - RNA, 23 nt, Human
cucuuccuccugacaccccacuu

SEQ ID NO: 3498460 - RNA, 11 nt, Human
cucuuccucug

SEQ ID NO: 3498461 - RNA, 17 nt, Human
cucuuccucugaggcug

SEQ ID NO: 3498462 - RNA, 22 nt, Human
cucuuccucugaggcuggaucc

SEQ ID NO: 3498463 - RNA, 13 nt, Human
cucuuccucuucc

SEQ ID NO: 3498464 - RNA, 12 nt, Human
cucuuccucuug

SEQ ID NO: 3498465 - RNA, 23 nt, Human
cucuuccucuugacccugcaccc

SEQ ID NO: 3498466 - RNA, 13 nt, Human
cucuuccugcccc

SEQ ID NO: 3498467 - RNA, 18 nt, Human
cucuuccugccccucuuu

SEQ ID NO: 3498468 - RNA, 20 nt, Human
cucuuccugccccucuuucu

SEQ ID NO: 3498469 - RNA, 23 nt, Human
cucuuccugccccucuuucucuu

SEQ ID NO: 3498470 - RNA, 15 nt, Human
cucuuccuggacagg

SEQ ID NO: 3498471 - RNA, 19 nt, Human
cucuuccuggacaggccag

SEQ ID NO: 3498472 - RNA, 21 nt, Human
cucuuccuuacuuuuuauaua

SEQ ID NO: 3498473 - RNA, 19 nt, Human
cucuuccuucccugcugug

SEQ ID NO: 3498474 - RNA, 23 nt, Human
cucuuccuugaagaacugcaggc

SEQ ID NO: 3498475 - RNA, 18 nt, Human
cucuucgaagccuugccu

SEQ ID NO: 3498476 - RNA, 14 nt, Human
cucuucggcccuca

SEQ ID NO: 3498477 - RNA, 15 nt, Human
cucuucuagagccgu

SEQ ID NO: 3498478 - RNA, 17 nt, Human
cucuucuauuuuguaaa

SEQ ID NO: 3498479 - RNA, 19 nt, Human
cucuucuccacuggaugga

SEQ ID NO: 3498480 - RNA, 13 nt, Human
cucuucuccaggc

SEQ ID NO: 3498481 - RNA, 16 nt, Human
cucuucucccagaauc

SEQ ID NO: 3498482 - RNA, 17 nt, Human
cucuucucccagaaucc

SEQ ID NO: 3498483 - RNA, 21 nt, Human
cucuucucccagaaucccagc

SEQ ID NO: 3498484 - RNA, 22 nt, Human
cucuucucccagaaucccagcc

SEQ ID NO: 3498485 - RNA, 16 nt, Human
cucuucuccccagagu

SEQ ID NO: 3498486 - RNA, 14 nt, Human
cucuucuccccuuc

SEQ ID NO: 3498487 - RNA, 17 nt, Human
cucuucuccccuuccau

SEQ ID NO: 3498488 - RNA, 13 nt, Human
cucuucucuccag

SEQ ID NO: 3498489 - RNA, 15 nt, Human
cucuucucucugcuc

SEQ ID NO: 3498490 - RNA, 15 nt, Human
cucuucucuuccugu

SEQ ID NO: 3498491 - RNA, 20 nt, Human
cucuucugaauaaagcaauu

SEQ ID NO: 3498492 - RNA, 22 nt, Human
cucuucugacgugccuuuugca

SEQ ID NO: 3498493 - RNA, 18 nt, Human
cucuucugagcuauuuca

SEQ ID NO: 3498494 - RNA, 23 nt, Human
cucuucugagcuauuucaucuau

SEQ ID NO: 3498495 - RNA, 12 nt, Human
cucuucugcucc

SEQ ID NO: 3498496 - RNA, 19 nt, Human
cucuucugcuccacccuug

SEQ ID NO: 3498497 - RNA, 21 nt, Human
cucuucugcuccacccuuggc

SEQ ID NO: 3498498 - RNA, 21 nt, Human
cucuucugggagggcagcagg

SEQ ID NO: 3498499 - RNA, 19 nt, Human
cucuucuggggcaggcugg

SEQ ID NO: 3498500 - RNA, 23 nt, Human
cucuucuggggcaggcugggcca

SEQ ID NO: 3498501 - RNA, 19 nt, Human
cucuucuuaacuuaaauuu

SEQ ID NO: 3498502 - RNA, 22 nt, Human
cucuucuuaauguacauagugc

SEQ ID NO: 3498503 - RNA, 23 nt, Human
cucuucuuaauguacauagugcu

SEQ ID NO: 3498504 - RNA, 14 nt, Human
cucuucuucucaag

SEQ ID NO: 3498505 - RNA, 18 nt, Human
cucuucuugaacacucau

SEQ ID NO: 3498506 - RNA, 21 nt, Human
cucuucuuuauacuguaauuu

SEQ ID NO: 3498507 - RNA, 20 nt, Human
cucuucuuucagacuugcca

SEQ ID NO: 3498508 - RNA, 22 nt, Human
cucuucuuucagacuugccaug

SEQ ID NO: 3498509 - RNA, 23 nt, Human
cucuucuuuuaaaccauuuucuu

SEQ ID NO: 3498510 - RNA, 22 nt, Human
cucuucuuuuagcaguaaaaua

SEQ ID NO: 3498511 - RNA, 18 nt, Human
cucuugaacuccugaccu

SEQ ID NO: 3498512 - RNA, 19 nt, Human
cucuugaacugagcuugga

SEQ ID NO: 3498513 - RNA, 15 nt, Human
cucuugaccaggcug

SEQ ID NO: 3498514 - RNA, 19 nt, Human
cucuugaccaggcugccuc

SEQ ID NO: 3498515 - RNA, 18 nt, Human
cucuugacccugcacccu

SEQ ID NO: 3498516 - RNA, 13 nt, Human
cucuugaccucag

SEQ ID NO: 3498517 - RNA, 15 nt, Human
cucuugaccucaggu

SEQ ID NO: 3498518 - RNA, 16 nt, Human
cucuugaccucaggug

SEQ ID NO: 3498519 - RNA, 22 nt, Human
cucuugagcaguggcuggucca

SEQ ID NO: 3498520 - RNA, 18 nt, Human
cucuugagccuugaacuu

SEQ ID NO: 3498521 - RNA, 23 nt, Human
cucuugauaccccccucugucuu

SEQ ID NO: 3498522 - RNA, 13 nt, Human
cucuugaugccug

SEQ ID NO: 3498523 - RNA, 22 nt, Human
cucuugauucauaaugacuuaa

SEQ ID NO: 3498524 - RNA, 24 nt, Human
cucuugauucauaaugacuuaagc

SEQ ID NO: 3498525 - RNA, 13 nt, Human
cucuugcacccgc

SEQ ID NO: 3498526 - RNA, 15 nt, Human
cucuugcacccgccu

SEQ ID NO: 3498527 - RNA, 21 nt, Human
cucuugccaaccuguaauaaa

SEQ ID NO: 3498528 - RNA, 23 nt, Human
cucuugccaaccuguaauaaaua

SEQ ID NO: 3498529 - RNA, 17 nt, Human
cucuugccacugccucu

SEQ ID NO: 3498530 - RNA, 19 nt, Human
cucuugccacugccucuuc

SEQ ID NO: 3498531 - RNA, 20 nt, Human
cucuugccacugccucuucc

SEQ ID NO: 3498532 - RNA, 19 nt, Human
cucuugcccauccugacug

SEQ ID NO: 3498533 - RNA, 19 nt, Human
cucuugccccaacccccag

SEQ ID NO: 3498534 - RNA, 22 nt, Human
cucuugccccaacccccagcac

SEQ ID NO: 3498535 - RNA, 23 nt, Human
cucuugccccaacccccagcacc

SEQ ID NO: 3498536 - RNA, 13 nt, Human
cucuugcccccca

SEQ ID NO: 3498537 - RNA, 19 nt, Human
cucuugccccccaccccag

SEQ ID NO: 3498538 - RNA, 20 nt, Human
cucuugccccccaccccagc

SEQ ID NO: 3498539 - RNA, 22 nt, Human
cucuugccccccaccccagccu

SEQ ID NO: 3498540 - RNA, 16 nt, Human
cucuugcccuucccug

SEQ ID NO: 3498541 - RNA, 17 nt, Human
cucuugcccuucccugu

SEQ ID NO: 3498542 - RNA, 21 nt, Human
cucuugcccuucccugucccu

SEQ ID NO: 3498543 - RNA, 16 nt, Human
cucuugccgaggagcc

SEQ ID NO: 3498544 - RNA, 21 nt, Human
cucuugccgaggagccaggca

SEQ ID NO: 3498545 - RNA, 17 nt, Human
cucuugcggucccuucu

SEQ ID NO: 3498546 - RNA, 12 nt, Human
cucuugcucaaa

SEQ ID NO: 3498547 - RNA, 19 nt, Human
cucuugcucaaaaaucugu

SEQ ID NO: 3498548 - RNA, 14 nt, Human
cucuugcucuuucu

SEQ ID NO: 3498549 - RNA, 19 nt, Human
cucuugcugucucugcucg

SEQ ID NO: 3498550 - RNA, 18 nt, Human
cucuuggaccucugcucu

SEQ ID NO: 3498551 - RNA, 20 nt, Human
cucuuggaccucugcucuga

SEQ ID NO: 3498552 - RNA, 18 nt, Human
cucuuggagaagucucag

SEQ ID NO: 3498553 - RNA, 15 nt, Human
cucuuggagccugca

SEQ ID NO: 3498554 - RNA, 16 nt, Human
cucuuggccugaucag

SEQ ID NO: 3498555 - RNA, 14 nt, Human
cucuuggcuccacu

SEQ ID NO: 3498556 - RNA, 15 nt, Human
cucuuggcuggcuuc

SEQ ID NO: 3498557 - RNA, 12 nt, Human
cucuugggacau

SEQ ID NO: 3498558 - RNA, 22 nt, Human
cucuugggcaauauucucugua

SEQ ID NO: 3498559 - RNA, 21 nt, Human
cucuuggggacaugggucgcc

SEQ ID NO: 3498560 - RNA, 18 nt, Human
cucuugguccugcugcag

SEQ ID NO: 3498561 - RNA, 15 nt, Human
cucuuggucuuccca

SEQ ID NO: 3498562 - RNA, 22 nt, Human
cucuuguaaagacugguuuucu

SEQ ID NO: 3498563 - RNA, 18 nt, Human
cucuuguaaauaaagccc

SEQ ID NO: 3498564 - RNA, 19 nt, Human
cucuuguaaauaaagcccu

SEQ ID NO: 3498565 - RNA, 24 nt, Human
cucuuguaaauaaagcccugggau

SEQ ID NO: 3498566 - RNA, 12 nt, Human
cucuuguaagau

SEQ ID NO: 3498567 - RNA, 23 nt, Human
cucuuguaaugauauagccagaa

SEQ ID NO: 3498568 - RNA, 20 nt, Human
cucuuguauaagauccuaga

SEQ ID NO: 3498569 - RNA, 21 nt, Human
cucuuguauaagauccuagau

SEQ ID NO: 3498570 - RNA, 15 nt, Human
cucuuguauuaaacu

SEQ ID NO: 3498571 - RNA, 21 nt, Human
cucuugucccacgugucuucc

SEQ ID NO: 3498572 - RNA, 23 nt, Human
cucuugucccacgugucuuccac

SEQ ID NO: 3498573 - RNA, 14 nt, Human
cucuugugcuggau

SEQ ID NO: 3498574 - RNA, 23 nt, Human
cucuugugcuggauggagcccag

SEQ ID NO: 3498575 - RNA, 21 nt, Human
cucuuguugagccgugggcaa

SEQ ID NO: 3498576 - RNA, 17 nt, Human
cucuuguugaguucugu

SEQ ID NO: 3498577 - RNA, 16 nt, Human
cucuuguuuucaguuu

SEQ ID NO: 3498578 - RNA, 13 nt, Human
cucuuguuuuguu

SEQ ID NO: 3498579 - RNA, 20 nt, Human
cucuuguuuuguuugucucu

SEQ ID NO: 3498580 - RNA, 23 nt, Human
cucuuguuuuuauuaauuuauau

SEQ ID NO: 3498581 - RNA, 15 nt, Human
cucuuuaaaacaaaa

SEQ ID NO: 3498582 - RNA, 17 nt, Human
cucuuuaaaacaaaaca

SEQ ID NO: 3498583 - RNA, 20 nt, Human
cucuuuaaaaggaaagaaaa

SEQ ID NO: 3498584 - RNA, 21 nt, Human
cucuuuaacucaggacuccag

SEQ ID NO: 3498585 - RNA, 18 nt, Human
cucuuuaaugucacaggc

SEQ ID NO: 3498586 - RNA, 22 nt, Human
cucuuuaaugucacaggcaggu

SEQ ID NO: 3498587 - RNA, 17 nt, Human
cucuuuagaguuagacu

SEQ ID NO: 3498588 - RNA, 22 nt, Human
cucuuuauauggccucaagauc

SEQ ID NO: 3498589 - RNA, 13 nt, Human
cucuuuauuccua

SEQ ID NO: 3498590 - RNA, 22 nt, Human
cucuuuauuuuccccuaucauu

SEQ ID NO: 3498591 - RNA, 11 nt, Human
cucuuucaaag

SEQ ID NO: 3498592 - RNA, 15 nt, Human
cucuuucagaaaaca

SEQ ID NO: 3498593 - RNA, 21 nt, Human
cucuuucagaaaacagaaaaa

SEQ ID NO: 3498594 - RNA, 14 nt, Human
cucuuucagcuccu

SEQ ID NO: 3498595 - RNA, 15 nt, Human
cucuuucagcuccug

SEQ ID NO: 3498596 - RNA, 15 nt, Human
cucuuucccacccag

SEQ ID NO: 3498597 - RNA, 13 nt, Human
cucuuucccuccc

SEQ ID NO: 3498598 - RNA, 17 nt, Human
cucuuucccucccuucc

SEQ ID NO: 3498599 - RNA, 13 nt, Human
cucuuucccuggu

SEQ ID NO: 3498600 - RNA, 17 nt, Human
cucuuucccuuccaguu

SEQ ID NO: 3498601 - RNA, 20 nt, Human
cucuuuccuauuucaguguu

SEQ ID NO: 3498602 - RNA, 16 nt, Human
cucuuucgucacccuu

SEQ ID NO: 3498603 - RNA, 18 nt, Human
cucuuucuccuuagucuu

SEQ ID NO: 3498604 - RNA, 15 nt, Human
cucuuucucuccuuu

SEQ ID NO: 3498605 - RNA, 13 nt, Human
cucuuucucucuu

SEQ ID NO: 3498606 - RNA, 16 nt, Human
cucuuucucucuuccc

SEQ ID NO: 3498607 - RNA, 20 nt, Human
cugacucugaaaucugaaga

SEQ ID NO: 3498608 - RNA, 15 nt, Human
cugacucugcccccu

SEQ ID NO: 3498609 - RNA, 21 nt, Human
cugacucugcccccugcuggc

SEQ ID NO: 3498610 - RNA, 17 nt, Human
cugacugaggcaguuug

SEQ ID NO: 3498611 - RNA, 16 nt, Human
cugacugaugcuuuca

SEQ ID NO: 3498612 - RNA, 16 nt, Human
cugacugccaagccau

SEQ ID NO: 3498613 - RNA, 21 nt, Human
cugacuggauucauucucaua

SEQ ID NO: 3498614 - RNA, 18 nt, Human
cugacugggaccaggcac

SEQ ID NO: 3498615 - RNA, 14 nt, Human
cugacugggccagg

SEQ ID NO: 3498616 - RNA, 14 nt, Human
cugacugggggcag

SEQ ID NO: 3498617 - RNA, 17 nt, Human
cugacugggggcagaca

SEQ ID NO: 3498618 - RNA, 22 nt, Human
cugacuguccucuccccuccag

SEQ ID NO: 3498619 - RNA, 18 nt, Human
cugacuguuuucucuuga

SEQ ID NO: 3498620 - RNA, 20 nt, Human
cugacuuaagcaaaagaaaa

SEQ ID NO: 3498621 - RNA, 24 nt, Human
cugacuuaagcaaaagaaaaagau

SEQ ID NO: 3498622 - RNA, 14 nt, Human
cugacuucaggggc

SEQ ID NO: 3498623 - RNA, 18 nt, Human
cugacuucuaauaucauu

SEQ ID NO: 3498624 - RNA, 15 nt, Human
cugacuucugccugg

SEQ ID NO: 3498625 - RNA, 14 nt, Human
cugacuucuguuua

SEQ ID NO: 3498626 - RNA, 14 nt, Human
cugacuuggcuggu

SEQ ID NO: 3498627 - RNA, 15 nt, Human
cugacuuggcuggug

SEQ ID NO: 3498628 - RNA, 16 nt, Human
cugacuuggcuggugu

SEQ ID NO: 3498629 - RNA, 17 nt, Human
cugacuuggcuggugug

SEQ ID NO: 3498630 - RNA, 20 nt, Human
cugacuuggcugguguggua

SEQ ID NO: 3498631 - RNA, 21 nt, Human
cugacuuggggagauggaguu

SEQ ID NO: 3498632 - RNA, 20 nt, Human
cugacuuguuugucuuccau

SEQ ID NO: 3498633 - RNA, 15 nt, Human
cugacuuugcuugcu

SEQ ID NO: 3498634 - RNA, 17 nt, Human
cugacuuugcuugcuuu

SEQ ID NO: 3498635 - RNA, 18 nt, Human
cugacuuugcuugcuuug

SEQ ID NO: 3498636 - RNA, 22 nt, Human
cugagaaagacuauucaaacag

SEQ ID NO: 3498637 - RNA, 23 nt, Human
cugagaaagacuauucaaacagu

SEQ ID NO: 3498638 - RNA, 11 nt, Human
cugagaaauuu

SEQ ID NO: 3498639 - RNA, 22 nt, Human
cugagaacagaucuccaaagcu

SEQ ID NO: 3498640 - RNA, 23 nt, Human
cugagaacagaucuccaaagcuu

SEQ ID NO: 3498641 - RNA, 15 nt, Human
cugagaaccuggccu

SEQ ID NO: 3498642 - RNA, 20 nt, Human
cugagaaccuggccuucagu

SEQ ID NO: 3498643 - RNA, 13 nt, Human
cugagaacuccug

SEQ ID NO: 3498644 - RNA, 22 nt, Human
cugagaagagagaucaaaugga

SEQ ID NO: 3498645 - RNA, 18 nt, Human
cugagaagaggagcccuc

SEQ ID NO: 3498646 - RNA, 22 nt, Human
cugagaagaggagcccucaucu

SEQ ID NO: 3498647 - RNA, 17 nt, Human
cugagaagcugcuccag

SEQ ID NO: 3498648 - RNA, 18 nt, Human
cugagaaggggaggaccu

SEQ ID NO: 3498649 - RNA, 22 nt, Human
cugagaaggggaggaccucugg

SEQ ID NO: 3498650 - RNA, 23 nt, Human
cugagaaggggaggaccucuggg

SEQ ID NO: 3498651 - RNA, 23 nt, Human
cugagaagguuugguccagccug

SEQ ID NO: 3498652 - RNA, 17 nt, Human
cugagaauagaaggaaa

SEQ ID NO: 3498653 - RNA, 18 nt, Human
cugagaauagaaggaaac

SEQ ID NO: 3498654 - RNA, 20 nt, Human
cugagaauauaauacuguau

SEQ ID NO: 3498655 - RNA, 23 nt, Human
cugagaauauaauacuguauuug

SEQ ID NO: 3498656 - RNA, 14 nt, Human
cugagaaucuuuau

SEQ ID NO: 3498657 - RNA, 22 nt, Human
cugagaaucuuuauugagaaag

SEQ ID NO: 3498658 - RNA, 17 nt, Human
cugagaaugaacaaaga

SEQ ID NO: 3498659 - RNA, 17 nt, Human
cugagaauguaagaacu

SEQ ID NO: 3498660 - RNA, 15 nt, Human
cugagaauuccaagg

SEQ ID NO: 3498661 - RNA, 22 nt, Human
cugagaauuuaaaaauaagaaa

SEQ ID NO: 3498662 - RNA, 17 nt, Human
cugagacaaauggaggc

SEQ ID NO: 3498663 - RNA, 15 nt, Human
cugagacagcccggg

SEQ ID NO: 3498664 - RNA, 22 nt, Human
cugagaccaguugggagcacug

SEQ ID NO: 3498665 - RNA, 17 nt, Human
cugagacccaggacucc

SEQ ID NO: 3498666 - RNA, 21 nt, Human
cugagacccaggacuccuccc

SEQ ID NO: 3498667 - RNA, 13 nt, Human
cugagaccccugg

SEQ ID NO: 3498668 - RNA, 15 nt, Human
cugagaccccuggcc

SEQ ID NO: 3498669 - RNA, 13 nt, Human
cugagaccugaag

SEQ ID NO: 3498670 - RNA, 12 nt, Human
cugagacucaca

SEQ ID NO: 3498671 - RNA, 14 nt, Human
cugagacucagaca

SEQ ID NO: 3498672 - RNA, 16 nt, Human
cugagacuccagaccu

SEQ ID NO: 3498673 - RNA, 19 nt, Human
cugagacucgcgacaaugc

SEQ ID NO: 3498674 - RNA, 20 nt, Human
cugagacucgcgacaaugca

SEQ ID NO: 3498675 - RNA, 21 nt, Human
cugagacucgcgacaaugcaa

SEQ ID NO: 3498676 - RNA, 22 nt, Human
cugagacucgcgacaaugcaaa

SEQ ID NO: 3498677 - RNA, 15 nt, Human
cugagacugugcugu

SEQ ID NO: 3498678 - RNA, 12 nt, Human
cugagagaaaua

SEQ ID NO: 3498679 - RNA, 22 nt, Human
cugagagaggccauucuuuccc

SEQ ID NO: 3498680 - RNA, 13 nt, Human
cugagagaucugc

SEQ ID NO: 3498681 - RNA, 16 nt, Human
cugagagaucugcugu

SEQ ID NO: 3498682 - RNA, 11 nt, Human
cugagagcaaa

SEQ ID NO: 3498683 - RNA, 22 nt, Human
cugagagcauguuuuaucauua

SEQ ID NO: 3498684 - RNA, 17 nt, Human
cugagagccccagcuga

SEQ ID NO: 3498685 - RNA, 21 nt, Human
cugagaggacuuuucuuugug

SEQ ID NO: 3498686 - RNA, 22 nt, Human
cugagaggacuuuucuuugugg

SEQ ID NO: 3498687 - RNA, 15 nt, Human
cugagaggcaggcau

SEQ ID NO: 3498688 - RNA, 14 nt, Human
cugagaggcugucu

SEQ ID NO: 3498689 - RNA, 17 nt, Human
cugagaguagagucacu

SEQ ID NO: 3498690 - RNA, 20 nt, Human
cugagaguauuuaggcagau

SEQ ID NO: 3498691 - RNA, 14 nt, Human
cugagagucagcuc

SEQ ID NO: 3498692 - RNA, 15 nt, Human
cugagagucuagauu

SEQ ID NO: 3498693 - RNA, 17 nt, Human
cugagauacauacagaa

SEQ ID NO: 3498694 - RNA, 15 nt, Human
cugagauaugaacau

SEQ ID NO: 3498695 - RNA, 15 nt, Human
cugagauccuggacu

SEQ ID NO: 3498696 - RNA, 14 nt, Human
cugagaucgugccg

SEQ ID NO: 3498697 - RNA, 17 nt, Human
cugagaucucugcagga

SEQ ID NO: 3498698 - RNA, 18 nt, Human
cugagaucucugcaggaa

SEQ ID NO: 3498699 - RNA, 20 nt, Human
cugagaugccuggugagcau

SEQ ID NO: 3498700 - RNA, 15 nt, Human
cugagauggcccucu

SEQ ID NO: 3498701 - RNA, 16 nt, Human
cugagauggcucccag

SEQ ID NO: 3498702 - RNA, 17 nt, Human
cugagauggcucccagg

SEQ ID NO: 3498703 - RNA, 18 nt, Human
cugagauggcucccaggg

SEQ ID NO: 3498704 - RNA, 16 nt, Human
cugagaugugaacaca

SEQ ID NO: 3498705 - RNA, 19 nt, Human
cugagauuauuuuaaucua

SEQ ID NO: 3498706 - RNA, 14 nt, Human
cugagauuuauuaa

SEQ ID NO: 3498707 - RNA, 19 nt, Human
cugagauuucaucugcucu

SEQ ID NO: 3498708 - RNA, 20 nt, Human
cugagcaaauguggcuccug

SEQ ID NO: 3498709 - RNA, 24 nt, Human
cugagcaacagagugagacccugu

SEQ ID NO: 3498710 - RNA, 18 nt, Human
cugagcaagacccugucu

SEQ ID NO: 3498711 - RNA, 20 nt, Human
cugagcaagacccugucucu

SEQ ID NO: 3498712 - RNA, 15 nt, Human
cugagcaagagcugg

SEQ ID NO: 3498713 - RNA, 16 nt, Human
cugagcaagagcuggc

SEQ ID NO: 3498714 - RNA, 17 nt, Human
cugagcaaucugacccu

SEQ ID NO: 3498715 - RNA, 18 nt, Human
cugagcaaugucugugcu

SEQ ID NO: 3498716 - RNA, 19 nt, Human
cugagcacauucuggcuca

SEQ ID NO: 3498717 - RNA, 20 nt, Human
cugagcacccagcucugucu

SEQ ID NO: 3498718 - RNA, 14 nt, Human
cugagcacccucug

SEQ ID NO: 3498719 - RNA, 17 nt, Human
cugagcaccgugucaag

SEQ ID NO: 3498720 - RNA, 17 nt, Human
cugagcaccucccagcc

SEQ ID NO: 3498721 - RNA, 13 nt, Human
cugagcaccugcu

SEQ ID NO: 3498722 - RNA, 13 nt, Human
cugagcacugcca

SEQ ID NO: 3498723 - RNA, 14 nt, Human
cugagcacuggagu

SEQ ID NO: 3498724 - RNA, 16 nt, Human
cugagcacuguuuaua

SEQ ID NO: 3498725 - RNA, 17 nt, Human
cugagcagaaagaggcc

SEQ ID NO: 3498726 - RNA, 21 nt, Human
cugagcagacuggugagcaga

SEQ ID NO: 3498727 - RNA, 16 nt, Human
cugagcagcgagccug

SEQ ID NO: 3498728 - RNA, 16 nt, Human
cugagcaggaccucug

SEQ ID NO: 3498729 - RNA, 18 nt, Human
cugagcaggaccucugaa

SEQ ID NO: 3498730 - RNA, 16 nt, Human
cugagcaggauuuuaa

SEQ ID NO: 3498731 - RNA, 16 nt, Human
cugagcagggccgggg

SEQ ID NO: 3498732 - RNA, 17 nt, Human
cugagcagggccgggga

SEQ ID NO: 3498733 - RNA, 21 nt, Human
cugagcagggccggggaacug

SEQ ID NO: 3498734 - RNA, 12 nt, Human
cugagcaggugu

SEQ ID NO: 3498735 - RNA, 22 nt, Human
cugagcaguccuuggccugcua

SEQ ID NO: 3498736 - RNA, 19 nt, Human
cugagcauaaguccucuag

SEQ ID NO: 3498737 - RNA, 20 nt, Human
cugagcauacucaacaaaac

SEQ ID NO: 3498738 - RNA, 14 nt, Human
cugagccagauuuc

SEQ ID NO: 3498739 - RNA, 23 nt, Human
cugagccaggcuagcuggagccu

SEQ ID NO: 3498740 - RNA, 17 nt, Human
cugagccagggucucca

SEQ ID NO: 3498741 - RNA, 20 nt, Human
cugagccagggucuccagaa

SEQ ID NO: 3498742 - RNA, 22 nt, Human
cugagccagugcuuuaauggca

SEQ ID NO: 3498743 - RNA, 10 nt, Human
cugagcccac

SEQ ID NO: 3498744 - RNA, 12 nt, Human
cugagcccacug

SEQ ID NO: 3498745 - RNA, 13 nt, Human
cugagcccacugu

SEQ ID NO: 3498746 - RNA, 12 nt, Human
cugagcccaggg

SEQ ID NO: 3498747 - RNA, 14 nt, Human
cugagcccagggag

SEQ ID NO: 3498748 - RNA, 17 nt, Human
cugagcccagggaggcc

SEQ ID NO: 3498749 - RNA, 15 nt, Human
cugagcccccagcuu

SEQ ID NO: 3498750 - RNA, 17 nt, Human
cugagcccccagcuucc

SEQ ID NO: 3498751 - RNA, 22 nt, Human
cugagcccccagcuuccagcag

SEQ ID NO: 3498752 - RNA, 21 nt, Human
cugagccccgcagaccucccc

SEQ ID NO: 3498753 - RNA, 18 nt, Human
cugagccccgcccucuuc

SEQ ID NO: 3498754 - RNA, 22 nt, Human
cugagccccgcccucuuccuga

SEQ ID NO: 3498755 - RNA, 22 nt, Human
cugagccccuaccccacaccag

SEQ ID NO: 3498756 - RNA, 16 nt, Human
cccuccccgcccuuuu

SEQ ID NO: 3498757 - RNA, 14 nt, Human
cccuccccggcccu

SEQ ID NO: 3498758 - RNA, 21 nt, Human
cccuccccuaaugccugcgga

SEQ ID NO: 3498759 - RNA, 18 nt, Human
cccuccccuccaucccug

SEQ ID NO: 3498760 - RNA, 12 nt, Human
cccuccccuccc

SEQ ID NO: 3498761 - RNA, 24 nt, Human
cccuccccucucuugcacccgccu

SEQ ID NO: 3498762 - RNA, 15 nt, Human
cccuccccuggggac

SEQ ID NO: 3498763 - RNA, 23 nt, Human
cccuccccuugccugugccaggu

SEQ ID NO: 3498764 - RNA, 16 nt, Human
cccucccgccccuucc

SEQ ID NO: 3498765 - RNA, 16 nt, Human
cccucccuacccuaac

SEQ ID NO: 3498766 - RNA, 12 nt, Human
cccucccuaccu

SEQ ID NO: 3498767 - RNA, 14 nt, Human
cccucccuaccuca

SEQ ID NO: 3498768 - RNA, 20 nt, Human
cccucccuaccucaaccugu

SEQ ID NO: 3498769 - RNA, 14 nt, Human
cccucccuggagug

SEQ ID NO: 3498770 - RNA, 14 nt, Human
cccucccuggcucc

SEQ ID NO: 3498771 - RNA, 12 nt, Human
cccucccugggu

SEQ ID NO: 3498772 - RNA, 13 nt, Human
cccucccuggguu

SEQ ID NO: 3498773 - RNA, 19 nt, Human
cccucccuguuccccagag

SEQ ID NO: 3498774 - RNA, 12 nt, Human
cccucccuugga

SEQ ID NO: 3498775 - RNA, 14 nt, Human
cccucccuuucucc

SEQ ID NO: 3498776 - RNA, 16 nt, Human
cccucccuuucucccc

SEQ ID NO: 3498777 - RNA, 18 nt, Human
cccuccgccaggcgagau

SEQ ID NO: 3498778 - RNA, 14 nt, Human
cccuccgccauucu

SEQ ID NO: 3498779 - RNA, 13 nt, Human
cccuccgcccugc

SEQ ID NO: 3498780 - RNA, 14 nt, Human
cccuccgccuucac

SEQ ID NO: 3498781 - RNA, 17 nt, Human
cccuccgcucuguagug

SEQ ID NO: 3498782 - RNA, 17 nt, Human
cccuccgggucuuccua

SEQ ID NO: 3498783 - RNA, 13 nt, Human
cccuccuaaccua

SEQ ID NO: 3498784 - RNA, 18 nt, Human
cccuccuaccccucccag

SEQ ID NO: 3498785 - RNA, 21 nt, Human
cccuccuaccccucccagcug

SEQ ID NO: 3498786 - RNA, 17 nt, Human
cccuccuacccugcgcc

SEQ ID NO: 3498787 - RNA, 23 nt, Human
cccuccucaccucuggacuggcu

SEQ ID NO: 3498788 - RNA, 19 nt, Human
cccuccucacuggccaucc

SEQ ID NO: 3498789 - RNA, 13 nt, Human
cccuccuccacuc

SEQ ID NO: 3498790 - RNA, 20 nt, Human
cccuccucccuuuuuccuug

SEQ ID NO: 3498791 - RNA, 18 nt, Human
cccuccucuagcuguggg

SEQ ID NO: 3498792 - RNA, 13 nt, Human
cccuccucuccca

SEQ ID NO: 3498793 - RNA, 14 nt, Human
cccuccucucugcc

SEQ ID NO: 3498794 - RNA, 15 nt, Human
cccuccucucugccc

SEQ ID NO: 3498795 - RNA, 19 nt, Human
cccuccucugaaacagcug

SEQ ID NO: 3498796 - RNA, 20 nt, Human
cccuccucugaaacagcugc

SEQ ID NO: 3498797 - RNA, 11 nt, Human
cccuccucugc

SEQ ID NO: 3498798 - RNA, 22 nt, Human
cccuccucugcuugccaucccu

SEQ ID NO: 3498799 - RNA, 18 nt, Human
cccuccugaaacuuacac

SEQ ID NO: 3498800 - RNA, 11 nt, Human
cccuccugcug

SEQ ID NO: 3498801 - RNA, 16 nt, Human
cccuccuggccucaga

SEQ ID NO: 3498802 - RNA, 19 nt, Human
cccuccuggccucagacug

SEQ ID NO: 3498803 - RNA, 19 nt, Human
cccuccugggaucugcucg

SEQ ID NO: 3498804 - RNA, 16 nt, Human
cccuccuggggccagg

SEQ ID NO: 3498805 - RNA, 17 nt, Human
cccuccuggggccaggc

SEQ ID NO: 3498806 - RNA, 18 nt, Human
cccuccuggggccaggcc

SEQ ID NO: 3498807 - RNA, 21 nt, Human
cccuccuggugucaccccaga

SEQ ID NO: 3498808 - RNA, 21 nt, Human
cccuccugugcucagcccuga

SEQ ID NO: 3498809 - RNA, 19 nt, Human
cccuccugugcugggggaa

SEQ ID NO: 3498810 - RNA, 18 nt, Human
cccuccuguugcacccag

SEQ ID NO: 3498811 - RNA, 19 nt, Human
cccuccuguugcacccagc

SEQ ID NO: 3498812 - RNA, 21 nt, Human
cccuccuucccaagugagucu

SEQ ID NO: 3498813 - RNA, 13 nt, Human
cccuccuucccac

SEQ ID NO: 3498814 - RNA, 19 nt, Human
cccuccuucccacucuucu

SEQ ID NO: 3498815 - RNA, 17 nt, Human
cccuccuugccuccugu

SEQ ID NO: 3498816 - RNA, 23 nt, Human
cccuccuugcucugcaggcaccu

SEQ ID NO: 3498817 - RNA, 13 nt, Human
cccuccuuuccca

SEQ ID NO: 3498818 - RNA, 15 nt, Human
cccuccuuuuuaugu

SEQ ID NO: 3498819 - RNA, 22 nt, Human
cccucgaagcgcgccacucgcu

SEQ ID NO: 3498820 - RNA, 16 nt, Human
cccucgauauuuuuaa

SEQ ID NO: 3498821 - RNA, 13 nt, Human
cccucgcccaguc

SEQ ID NO: 3498822 - RNA, 18 nt, Human
cccucgcccagucccagc

SEQ ID NO: 3498823 - RNA, 22 nt, Human
cccucgcccagucccagcagcc

SEQ ID NO: 3498824 - RNA, 17 nt, Human
cccucgcugcuucugug

SEQ ID NO: 3498825 - RNA, 15 nt, Human
cccucgcuggccccc

SEQ ID NO: 3498826 - RNA, 19 nt, Human
cccucgcuggcccccacug

SEQ ID NO: 3498827 - RNA, 21 nt, Human
cccucgcuggcccccacuggc

SEQ ID NO: 3498828 - RNA, 19 nt, Human
cccucggaguucuucuuga

SEQ ID NO: 3498829 - RNA, 15 nt, Human
cccucgggcccaccu

SEQ ID NO: 3498830 - RNA, 13 nt, Human
cccucgggcccag

SEQ ID NO: 3498831 - RNA, 14 nt, Human
cccucgggcccagc

SEQ ID NO: 3498832 - RNA, 15 nt, Human
cccucgggcccagcc

SEQ ID NO: 3498833 - RNA, 17 nt, Human
cccucggggaugugucc

SEQ ID NO: 3498834 - RNA, 16 nt, Human
cccucggugggagcca

SEQ ID NO: 3498835 - RNA, 15 nt, Human
cccucgucuuuccca

SEQ ID NO: 3498836 - RNA, 13 nt, Human
cccucgugccagu

SEQ ID NO: 3498837 - RNA, 16 nt, Human
cccucguggacaccug

SEQ ID NO: 3498838 - RNA, 18 nt, Human
cccucguggacaccugcc

SEQ ID NO: 3498839 - RNA, 22 nt, Human
cccucguggacaccugcccugc

SEQ ID NO: 3498840 - RNA, 17 nt, Human
cccucguggccagcccg

SEQ ID NO: 3498841 - RNA, 20 nt, Human
cccucguggccagcccggcu

SEQ ID NO: 3498842 - RNA, 15 nt, Human
cccucuacagagcuu

SEQ ID NO: 3498843 - RNA, 20 nt, Human
cccucuacugggagccuacc

SEQ ID NO: 3498844 - RNA, 19 nt, Human
cccucuagaaauuuuucag

SEQ ID NO: 3498845 - RNA, 15 nt, Human
cccucuauuuagcau

SEQ ID NO: 3498846 - RNA, 12 nt, Human
cccucucagccc

SEQ ID NO: 3498847 - RNA, 14 nt, Human
cccucucagcccuc

SEQ ID NO: 3498848 - RNA, 22 nt, Human
cccucucaggcaugccugugug

SEQ ID NO: 3498849 - RNA, 21 nt, Human
cccucucaggugaccaaaauc

SEQ ID NO: 3498850 - RNA, 16 nt, Human
cccucucauuuagccu

SEQ ID NO: 3498851 - RNA, 13 nt, Human
cccucuccagcag

SEQ ID NO: 3498852 - RNA, 12 nt, Human
cccucucccacc

SEQ ID NO: 3498853 - RNA, 18 nt, Human
cccucucccacccucuuc

SEQ ID NO: 3498854 - RNA, 14 nt, Human
cccucucccaggcc

SEQ ID NO: 3498855 - RNA, 22 nt, Human
cccucuccccagggaagcagca

SEQ ID NO: 3498856 - RNA, 19 nt, Human
cccucuccccccccccucc

SEQ ID NO: 3498857 - RNA, 15 nt, Human
cccucuccccugccc

SEQ ID NO: 3498858 - RNA, 17 nt, Human
cccucucccucuaggcu

SEQ ID NO: 3498859 - RNA, 15 nt, Human
cccucucccugcaug

SEQ ID NO: 3498860 - RNA, 12 nt, Human
cccucuccugcc

SEQ ID NO: 3498861 - RNA, 15 nt, Human
cccucuccugggcag

SEQ ID NO: 3498862 - RNA, 23 nt, Human
cccucuccugggcagcugccucc

SEQ ID NO: 3498863 - RNA, 14 nt, Human
cccucuccuuccug

SEQ ID NO: 3498864 - RNA, 15 nt, Human
cccucuccuuccuua

SEQ ID NO: 3498865 - RNA, 18 nt, Human
cccucucucauacccucc

SEQ ID NO: 3498866 - RNA, 22 nt, Human
cccucucucauacccucccucc

SEQ ID NO: 3498867 - RNA, 13 nt, Human
cccucucuccucc

SEQ ID NO: 3498868 - RNA, 13 nt, Human
cccucucucugac

SEQ ID NO: 3498869 - RNA, 23 nt, Human
cccucucugaaggaggccaccuc

SEQ ID NO: 3498870 - RNA, 18 nt, Human
cccucucugcaucugacc

SEQ ID NO: 3498871 - RNA, 18 nt, Human
cccucucuugcacccgcc

SEQ ID NO: 3498872 - RNA, 15 nt, Human
cccucugaccugcac

SEQ ID NO: 3498873 - RNA, 15 nt, Human
cccucugcccacucc

SEQ ID NO: 3498874 - RNA, 18 nt, Human
cccucugcccacucccug

SEQ ID NO: 3498875 - RNA, 13 nt, Human
cccucugcccagc

SEQ ID NO: 3498876 - RNA, 16 nt, Human
cccucugcccagcuug

SEQ ID NO: 3498877 - RNA, 13 nt, Human
cccucugccccau

SEQ ID NO: 3498878 - RNA, 15 nt, Human
cccucugccccaucc

SEQ ID NO: 3498879 - RNA, 13 nt, Human
cccucugcccugc

SEQ ID NO: 3498880 - RNA, 14 nt, Human
cccucugccggcuc

SEQ ID NO: 3498881 - RNA, 14 nt, Human
cccucugcuggccg

SEQ ID NO: 3498882 - RNA, 16 nt, Human
cccucuggcccugccu

SEQ ID NO: 3498883 - RNA, 12 nt, Human
cccucuggccgc

SEQ ID NO: 3498884 - RNA, 12 nt, Human
cccucuggcucc

SEQ ID NO: 3498885 - RNA, 17 nt, Human
cccucuggcuccagcug

SEQ ID NO: 3498886 - RNA, 15 nt, Human
cccucugggaaccuc

SEQ ID NO: 3498887 - RNA, 16 nt, Human
cccucugggaaccucc

SEQ ID NO: 3498888 - RNA, 22 nt, Human
cccucugggaaccucccagagg

SEQ ID NO: 3498889 - RNA, 10 nt, Human
cccucugggc

SEQ ID NO: 3498890 - RNA, 13 nt, Human
cccucugggcacu

SEQ ID NO: 3498891 - RNA, 16 nt, Human
cccucuggggcuguuc

SEQ ID NO: 3498892 - RNA, 13 nt, Human
cccucuguccacc

SEQ ID NO: 3498893 - RNA, 24 nt, Human
cccucuguccaggcacugagauac

SEQ ID NO: 3498894 - RNA, 13 nt, Human
cccucuguccuga

SEQ ID NO: 3498895 - RNA, 14 nt, Human
cccucuguccugac

SEQ ID NO: 3498896 - RNA, 23 nt, Human
cccucuguucaguaacagggccu

SEQ ID NO: 3498897 - RNA, 11 nt, Human
cccucuuccau

SEQ ID NO: 3498898 - RNA, 13 nt, Human
cccucuuccauca

SEQ ID NO: 3498899 - RNA, 20 nt, Human
cccucuuccuacccugccuc

SEQ ID NO: 3498900 - RNA, 15 nt, Human
cccucuuccugacga

SEQ ID NO: 3498901 - RNA, 14 nt, Human
cccucuuccuguga

SEQ ID NO: 3498902 - RNA, 16 nt, Human
cccucuucucaagugc

SEQ ID NO: 3498903 - RNA, 20 nt, Human
cccucuucucaagugccuua

SEQ ID NO: 3498904 - RNA, 16 nt, Human
cccucuucuucucaag

SEQ ID NO: 3498905 - RNA, 22 nt, Human
cccucuugacccaucucccccu

SEQ ID NO: 3498906 - RNA, 18 nt, Human
cccucuugccccaacccc

SEQ ID NO: 3498907 - RNA, 22 nt, Human
cccucuugccccaacccccagc

SEQ ID NO: 3498908 - RNA, 17 nt, Human
cucuuucucucuucccu

SEQ ID NO: 3498909 - RNA, 14 nt, Human
cucuuucucuuucu

SEQ ID NO: 3498910 - RNA, 12 nt, Human
cucuuucugggc

SEQ ID NO: 3498911 - RNA, 11 nt, Human
cucuuucugua

SEQ ID NO: 3498912 - RNA, 13 nt, Human
cucuuucuguaua

SEQ ID NO: 3498913 - RNA, 15 nt, Human
cucuuucugucuucu

SEQ ID NO: 3498914 - RNA, 19 nt, Human
cucuuucuucuuccacaca

SEQ ID NO: 3498915 - RNA, 17 nt, Human
cucuuugaaugacaaag

SEQ ID NO: 3498916 - RNA, 20 nt, Human
cucuuugaauuuucuguguu

SEQ ID NO: 3498917 - RNA, 14 nt, Human
cucuuugagaaaua

SEQ ID NO: 3498918 - RNA, 15 nt, Human
cucuuugagauagaa

SEQ ID NO: 3498919 - RNA, 15 nt, Human
cccuggccuguucug

SEQ ID NO: 3498920 - RNA, 19 nt, Human
cccuggccuguucuguuuu

SEQ ID NO: 3498921 - RNA, 13 nt, Human
cccuggcuccagg

SEQ ID NO: 3498922 - RNA, 19 nt, Human
cccuggcucccacaggccc

SEQ ID NO: 3498923 - RNA, 23 nt, Human
cccuggcucccaugaccauacug

SEQ ID NO: 3498924 - RNA, 13 nt, Human
cccuggcucccuc

SEQ ID NO: 3498925 - RNA, 20 nt, Human
cccuggcucccuccuccagg

SEQ ID NO: 3498926 - RNA, 23 nt, Human
cccuggcucccuccuccaggccu

SEQ ID NO: 3498927 - RNA, 13 nt, Human
cccuggcucugcu

SEQ ID NO: 3498928 - RNA, 14 nt, Human
cccuggcugaagga

SEQ ID NO: 3498929 - RNA, 15 nt, Human
cccuggcugcccugg

SEQ ID NO: 3498930 - RNA, 18 nt, Human
cccuggcugcccuggccc

SEQ ID NO: 3498931 - RNA, 22 nt, Human
cccuggcugcccuggcccugag

SEQ ID NO: 3498932 - RNA, 14 nt, Human
cccuggcugccggc

SEQ ID NO: 3498933 - RNA, 14 nt, Human
cccuggcugcugcc

SEQ ID NO: 3498934 - RNA, 18 nt, Human
cccuggcugcugccccca

SEQ ID NO: 3498935 - RNA, 22 nt, Human
cccuggcugguaagggccaagu

SEQ ID NO: 3498936 - RNA, 22 nt, Human
cccuggcuguacugcucaggcu

SEQ ID NO: 3498937 - RNA, 19 nt, Human
cccuggcuuguaacuccac

SEQ ID NO: 3498938 - RNA, 10 nt, Human
cccuggcuuu

SEQ ID NO: 3498939 - RNA, 13 nt, Human
cccuggcuuuuca

SEQ ID NO: 3498940 - RNA, 18 nt, Human
cccuggcuuuucacugcu

SEQ ID NO: 3498941 - RNA, 19 nt, Human
cccuggcuuuucacugcug

SEQ ID NO: 3498942 - RNA, 15 nt, Human
cccugggaaggccuc

SEQ ID NO: 3498943 - RNA, 22 nt, Human
cccugggagaaucgcuccugca

SEQ ID NO: 3498944 - RNA, 13 nt, Human
cccugggccaggg

SEQ ID NO: 3498945 - RNA, 22 nt, Human
cccugggccagggucuguguga

SEQ ID NO: 3498946 - RNA, 20 nt, Human
cccugggccccaccaccuag

SEQ ID NO: 3498947 - RNA, 22 nt, Human
cccugggccccaccaccuaggc

SEQ ID NO: 3498948 - RNA, 11 nt, Human
cccugggccug

SEQ ID NO: 3498949 - RNA, 13 nt, Human
cccugggccugcu

SEQ ID NO: 3498950 - RNA, 17 nt, Human
cccugggccugcugcug

SEQ ID NO: 3498951 - RNA, 13 nt, Human
cccugggccuugg

SEQ ID NO: 3498952 - RNA, 17 nt, Human
cccugggcucugugggc

SEQ ID NO: 3498953 - RNA, 20 nt, Human
cccugggcucugugggcugc

SEQ ID NO: 3498954 - RNA, 15 nt, Human
cccugggcugugcua

SEQ ID NO: 3498955 - RNA, 19 nt, Human
cccuggggaaggagccagu

SEQ ID NO: 3498956 - RNA, 20 nt, Human
cugcaaguccuuuuguaaag

SEQ ID NO: 3498957 - RNA, 19 nt, Human
cugcaagugacaucucuuu

SEQ ID NO: 3498958 - RNA, 22 nt, Human
cugcaagugagcaaaccugccc

SEQ ID NO: 3498959 - RNA, 22 nt, Human
cugcaagugaggugugucacaa

SEQ ID NO: 3498960 - RNA, 15 nt, Human
cugcaauaaaauggg

SEQ ID NO: 3498961 - RNA, 14 nt, Human
cugcaauaacuucu

SEQ ID NO: 3498962 - RNA, 16 nt, Human
cugcaauaacuucuga

SEQ ID NO: 3498963 - RNA, 17 nt, Human
cugcaauaacuucugac

SEQ ID NO: 3498964 - RNA, 18 nt, Human
cugcaauaacuucugacc

SEQ ID NO: 3498965 - RNA, 19 nt, Human
cugcaauaacuucugaccu

SEQ ID NO: 3498966 - RNA, 19 nt, Human
cugcaauagagacuguaga

SEQ ID NO: 3498967 - RNA, 12 nt, Human
cugcaauauuug

SEQ ID NO: 3498968 - RNA, 16 nt, Human
cugcaauauuugaauu

SEQ ID NO: 3498969 - RNA, 18 nt, Human
cugcaauauuugaauuuu

SEQ ID NO: 3498970 - RNA, 19 nt, Human
cugcaaucauaugugaucu

SEQ ID NO: 3498971 - RNA, 16 nt, Human
cugcaauccugucuuu

SEQ ID NO: 3498972 - RNA, 20 nt, Human
cugcaauguaucccuucuca

SEQ ID NO: 3498973 - RNA, 16 nt, Human
cugcaauguuuuccuu

SEQ ID NO: 3498974 - RNA, 18 nt, Human
cugcaauucaaaaguucc

SEQ ID NO: 3498975 - RNA, 15 nt, Human
cugcaauuccccucu

SEQ ID NO: 3498976 - RNA, 16 nt, Human
cugcaauuccccucug

SEQ ID NO: 3498977 - RNA, 19 nt, Human
cugcaauucccuggauaga

SEQ ID NO: 3498978 - RNA, 15 nt, Human
cugcaauugcuuagg

SEQ ID NO: 3498979 - RNA, 16 nt, Human
cugcaauugcuuagga

SEQ ID NO: 3498980 - RNA, 20 nt, Human
cugcaauugcuuaggauguu

SEQ ID NO: 3498981 - RNA, 13 nt, Human
cugcacaaagccc

SEQ ID NO: 3498982 - RNA, 18 nt, Human
cugcacaaagcccuucca

SEQ ID NO: 3498983 - RNA, 20 nt, Human
cugcacaaagcccuuccaug

SEQ ID NO: 3498984 - RNA, 18 nt, Human
cugcacaagccagggugu

SEQ ID NO: 3498985 - RNA, 15 nt, Human
cugcacaagcugcac

SEQ ID NO: 3498986 - RNA, 18 nt, Human
cugcacaagcugcacccu

SEQ ID NO: 3498987 - RNA, 15 nt, Human
cugcacaauaaaaau

SEQ ID NO: 3498988 - RNA, 22 nt, Human
cugcacaauaaaaauguuuaac

SEQ ID NO: 3498989 - RNA, 16 nt, Human
cugcacaauaacuccu

SEQ ID NO: 3498990 - RNA, 21 nt, Human
cugcacaccuugaaucugccu

SEQ ID NO: 3498991 - RNA, 21 nt, Human
cugcacagagcucuccagcuc

SEQ ID NO: 3498992 - RNA, 23 nt, Human
cugcacagagcucuccagcucca

SEQ ID NO: 3498993 - RNA, 19 nt, Human
cugcacagcaggcugccag

SEQ ID NO: 3498994 - RNA, 20 nt, Human
cugcacagcaggcugccagu

SEQ ID NO: 3498995 - RNA, 21 nt, Human
cugcacagcaggcugccagug

SEQ ID NO: 3498996 - RNA, 13 nt, Human
cugcacagcggcc

SEQ ID NO: 3498997 - RNA, 19 nt, Human
cugcacagggcagcugggc

SEQ ID NO: 3498998 - RNA, 18 nt, Human
cugcacagugacuucuga

SEQ ID NO: 3498999 - RNA, 20 nt, Human
cugcacagugacuucugaga

SEQ ID NO: 3499000 - RNA, 21 nt, Human
cugcacagugacuucugagau

SEQ ID NO: 3499001 - RNA, 22 nt, Human
cugcacagugacuucugagauc

SEQ ID NO: 3499002 - RNA, 18 nt, Human
cugcacagugcaucucag

SEQ ID NO: 3499003 - RNA, 22 nt, Human
cugcacaucuguaaaucuacac

SEQ ID NO: 3499004 - RNA, 15 nt, Human
cugcacaugauuuca

SEQ ID NO: 3499005 - RNA, 21 nt, Human
cugcacaugucuuguacaugu

SEQ ID NO: 3499006 - RNA, 17 nt, Human
cugcaccaacccagccg

SEQ ID NO: 3499007 - RNA, 23 nt, Human
cugcaccaacccagccgcugccc

SEQ ID NO: 3499008 - RNA, 13 nt, Human
cugcaccaggaga

SEQ ID NO: 3499009 - RNA, 15 nt, Human
cugcaccaggagaca

SEQ ID NO: 3499010 - RNA, 17 nt, Human
cugcaccauugcugcuc

SEQ ID NO: 3499011 - RNA, 18 nt, Human
cugcaccauuuaaaaaca

SEQ ID NO: 3499012 - RNA, 18 nt, Human
cugcacccagaacagugg

SEQ ID NO: 3499013 - RNA, 11 nt, Human
cugcacccagg

SEQ ID NO: 3499014 - RNA, 14 nt, Human
cugcaccccccugg

SEQ ID NO: 3499015 - RNA, 17 nt, Human
cugcaccccccugggcu

SEQ ID NO: 3499016 - RNA, 18 nt, Human
cugcacccccuccugcug

SEQ ID NO: 3499017 - RNA, 20 nt, Human
cugcacccccuccugcugca

SEQ ID NO: 3499018 - RNA, 20 nt, Human
cugcaccccuucucuccucc

SEQ ID NO: 3499019 - RNA, 14 nt, Human
cugcacccucaggc

SEQ ID NO: 3499020 - RNA, 12 nt, Human
cugcacccucca

SEQ ID NO: 3499021 - RNA, 16 nt, Human
cugcacccuggggccu

SEQ ID NO: 3499022 - RNA, 17 nt, Human
cugcacccuucuuuucu

SEQ ID NO: 3499023 - RNA, 20 nt, Human
cugcacccuucuuuucucau

SEQ ID NO: 3499024 - RNA, 14 nt, Human
cugcaccggcuggc

SEQ ID NO: 3499025 - RNA, 15 nt, Human
cugcaccggcuggcc

SEQ ID NO: 3499026 - RNA, 23 nt, Human
cugcaccggcuggccuggccccu

SEQ ID NO: 3499027 - RNA, 15 nt, Human
cugcaccgggccaca

SEQ ID NO: 3499028 - RNA, 18 nt, Human
cugcaccggggccugggc

SEQ ID NO: 3499029 - RNA, 17 nt, Human
cugcaccguacugugga

SEQ ID NO: 3499030 - RNA, 18 nt, Human
cugcaccugccagccugg

SEQ ID NO: 3499031 - RNA, 15 nt, Human
cugcacggugaaugg

SEQ ID NO: 3499032 - RNA, 15 nt, Human
cugcacgugcgggug

SEQ ID NO: 3499033 - RNA, 19 nt, Human
cugcacuaaagccagccug

SEQ ID NO: 3499034 - RNA, 22 nt, Human
cugcacuaaagccagccugacc

SEQ ID NO: 3499035 - RNA, 18 nt, Human
cugcacuacuccucugca

SEQ ID NO: 3499036 - RNA, 19 nt, Human
cugcacuacuccucugcag

SEQ ID NO: 3499037 - RNA, 20 nt, Human
cugcacuacuccucugcagu

SEQ ID NO: 3499038 - RNA, 18 nt, Human
cugcacuauagccuaggu

SEQ ID NO: 3499039 - RNA, 23 nt, Human
cugcacuauagccuaggugacag

SEQ ID NO: 3499040 - RNA, 14 nt, Human
cugcacuccagccu

SEQ ID NO: 3499041 - RNA, 16 nt, Human
cugcacuccagccuga

SEQ ID NO: 3499042 - RNA, 17 nt, Human
cugcacuccagccugag

SEQ ID NO: 3499043 - RNA, 20 nt, Human
cugcacuccagccugagcga

SEQ ID NO: 3499044 - RNA, 20 nt, Human
cugcacuccagccuggguga

SEQ ID NO: 3499045 - RNA, 19 nt, Human
cugcacucccaccugacac

SEQ ID NO: 3499046 - RNA, 14 nt, Human
cugcacuccccugc

SEQ ID NO: 3499047 - RNA, 15 nt, Human
cugcacuccccugcu

SEQ ID NO: 3499048 - RNA, 15 nt, Human
cugcacuccucaggg

SEQ ID NO: 3499049 - RNA, 22 nt, Human
cugcacuccucagggcagccuc

SEQ ID NO: 3499050 - RNA, 15 nt, Human
cugcacucucauugu

SEQ ID NO: 3499051 - RNA, 14 nt, Human
cugcacucugugcc

SEQ ID NO: 3499052 - RNA, 20 nt, Human
cugcacucugugcccauggg

SEQ ID NO: 3499053 - RNA, 11 nt, Human
cugcacugaaa

SEQ ID NO: 3499054 - RNA, 20 nt, Human
cugcacugacccacagccuc

SEQ ID NO: 3499055 - RNA, 16 nt, Human
cugcacugacucugga

SEQ ID NO: 3499056 - RNA, 18 nt, Human
cugcacugagcagagucu

SEQ ID NO: 3499057 - RNA, 15 nt, Human
cugcacugaugcugc

SEQ ID NO: 3499058 - RNA, 17 nt, Human
cugcacugaugcugccc

SEQ ID NO: 3499059 - RNA, 16 nt, Human
cugcacuggggagccc

SEQ ID NO: 3499060 - RNA, 18 nt, Human
cugcacuguaaaaugugg

SEQ ID NO: 3499061 - RNA, 12 nt, Human
cugcacugucaa

SEQ ID NO: 3499062 - RNA, 21 nt, Human
cugcacuguccugcuccacag

SEQ ID NO: 3499063 - RNA, 13 nt, Human
cugcacuuacaau

SEQ ID NO: 3499064 - RNA, 21 nt, Human
cugcacuuacaaucccaccuu

SEQ ID NO: 3499065 - RNA, 22 nt, Human
cugcacuugcgguuccggcaug

SEQ ID NO: 3499066 - RNA, 14 nt, Human
cugcacuuugaugu

SEQ ID NO: 3499067 - RNA, 21 nt, Human
cugcacuuugaugucaugugu

SEQ ID NO: 3499068 - RNA, 22 nt, Human
cugcacuuugaugucauguguu

SEQ ID NO: 3499069 - RNA, 20 nt, Human
cugcagaaacccugagcaga

SEQ ID NO: 3499070 - RNA, 16 nt, Human
cugcagaaacuacuga

SEQ ID NO: 3499071 - RNA, 21 nt, Human
cugcagaaccggagagccagc

SEQ ID NO: 3499072 - RNA, 15 nt, Human
cugcagaagcaaggg

SEQ ID NO: 3499073 - RNA, 13 nt, Human
cugcagaaggaaa

SEQ ID NO: 3499074 - RNA, 14 nt, Human
cugcagaaggaaaa

SEQ ID NO: 3499075 - RNA, 19 nt, Human
cugcagaaggaaaaaugug

SEQ ID NO: 3499076 - RNA, 13 nt, Human
cugcagaaggcca

SEQ ID NO: 3499077 - RNA, 15 nt, Human
cugcagaccacgccc

SEQ ID NO: 3499078 - RNA, 14 nt, Human
cugcagacccugcc

SEQ ID NO: 3499079 - RNA, 16 nt, Human
cugcagacccugcccu

SEQ ID NO: 3499080 - RNA, 15 nt, Human
cugcagaccuguccu

SEQ ID NO: 3499081 - RNA, 14 nt, Human
cugcagagauuucu

SEQ ID NO: 3499082 - RNA, 23 nt, Human
cugcagagcagugggccuggcca

SEQ ID NO: 3499083 - RNA, 21 nt, Human
cugcagagcugcgggcugggu

SEQ ID NO: 3499084 - RNA, 11 nt, Human
cugcagaggcc

SEQ ID NO: 3499085 - RNA, 17 nt, Human
cugcagaggccagaggc

SEQ ID NO: 3499086 - RNA, 10 nt, Human
cugcagaggg

SEQ ID NO: 3499087 - RNA, 13 nt, Human
cugcagagggcac

SEQ ID NO: 3499088 - RNA, 21 nt, Human
cugcagaggggaaaccagugu

SEQ ID NO: 3499089 - RNA, 13 nt, Human
cugcagaggggca

SEQ ID NO: 3499090 - RNA, 20 nt, Human
cugcagaggggcuuucugga

SEQ ID NO: 3499091 - RNA, 22 nt, Human
cugcagaggggcuuucuggaga

SEQ ID NO: 3499092 - RNA, 23 nt, Human
cugcagaggggcuuucuggagag

SEQ ID NO: 3499093 - RNA, 16 nt, Human
cugcagaggucugugc

SEQ ID NO: 3499094 - RNA, 23 nt, Human
cugcagaggucugugcugaggcc

SEQ ID NO: 3499095 - RNA, 15 nt, Human
cugcagaguuuggau

SEQ ID NO: 3499096 - RNA, 20 nt, Human
cugcagauacuacugaccag

SEQ ID NO: 3499097 - RNA, 14 nt, Human
cugcagaugccacc

SEQ ID NO: 3499098 - RNA, 18 nt, Human
cugcagauugagaccuac

SEQ ID NO: 3499099 - RNA, 23 nt, Human
cugcagauuugggcuggaacaga

SEQ ID NO: 3499100 - RNA, 18 nt, Human
cugcagcaaucuuugaaa

SEQ ID NO: 3499101 - RNA, 19 nt, Human
cugcagcaccgaggggccu

SEQ ID NO: 3499102 - RNA, 14 nt, Human
cugcagcaccucca

SEQ ID NO: 3499103 - RNA, 15 nt, Human
cugcagcaccuccag

SEQ ID NO: 3499104 - RNA, 22 nt, Human
cugcagcacggacaauaaaccu

SEQ ID NO: 3499105 - RNA, 12 nt, Human
cugagccugccg

SEQ ID NO: 3499106 - RNA, 16 nt, Human
cugagccugccgagca

SEQ ID NO: 3499107 - RNA, 16 nt, Human
cugagccuggcuggca

SEQ ID NO: 3499108 - RNA, 14 nt, Human
cugagccuucugag

SEQ ID NO: 3499109 - RNA, 16 nt, Human
cugagcgacagugaga

SEQ ID NO: 3499110 - RNA, 15 nt, Human
cugagcgccaggaug

SEQ ID NO: 3499111 - RNA, 15 nt, Human
cugagcgccuccauc

SEQ ID NO: 3499112 - RNA, 15 nt, Human
cugagcgccuggguc

SEQ ID NO: 3499113 - RNA, 19 nt, Human
cugagcggaugcaucuggg

SEQ ID NO: 3499114 - RNA, 18 nt, Human
cugagcgggaggcagagu

SEQ ID NO: 3499115 - RNA, 22 nt, Human
cugagcggugggggaggagggu

SEQ ID NO: 3499116 - RNA, 23 nt, Human
cugagcgugcuuuccaaaaccca

SEQ ID NO: 3499117 - RNA, 15 nt, Human
cugagcuagaacccu

SEQ ID NO: 3499118 - RNA, 21 nt, Human
cugagcuauuucaucuauuuu

SEQ ID NO: 3499119 - RNA, 14 nt, Human
cugagcucacaagg

SEQ ID NO: 3499120 - RNA, 22 nt, Human
cugagcucacaaggcagcaagg

SEQ ID NO: 3499121 - RNA, 22 nt, Human
cugagcuccagcuccuuugggc

SEQ ID NO: 3499122 - RNA, 14 nt, Human
cugagcuccucugg

SEQ ID NO: 3499123 - RNA, 14 nt, Human
cugagcucugagag

SEQ ID NO: 3499124 - RNA, 18 nt, Human
cugagcucugagaggccc

SEQ ID NO: 3499125 - RNA, 17 nt, Human
cugagcucuuugcacua

SEQ ID NO: 3499126 - RNA, 16 nt, Human
cugagcugagccaggc

SEQ ID NO: 3499127 - RNA, 17 nt, Human
cugagcugagccaggcu

SEQ ID NO: 3499128 - RNA, 13 nt, Human
cugagcugaggca

SEQ ID NO: 3499129 - RNA, 18 nt, Human
cugagcugcccacagcag

SEQ ID NO: 3499130 - RNA, 21 nt, Human
cugagcugcccacagcaggcc

SEQ ID NO: 3499131 - RNA, 14 nt, Human
cugagcuggccucu

SEQ ID NO: 3499132 - RNA, 22 nt, Human
cugagcuggccucucacugccu

SEQ ID NO: 3499133 - RNA, 15 nt, Human
cugagcuucucugug

SEQ ID NO: 3499134 - RNA, 16 nt, Human
cugagcuucucuguga

SEQ ID NO: 3499135 - RNA, 21 nt, Human
cugagcuuggaagcuucuggu

SEQ ID NO: 3499136 - RNA, 15 nt, Human
cugagcuuggccaga

SEQ ID NO: 3499137 - RNA, 18 nt, Human
cugagcuuggccagaagg

SEQ ID NO: 3499138 - RNA, 21 nt, Human
cugagcuuuggacgcacacag

SEQ ID NO: 3499139 - RNA, 15 nt, Human
cugaggaaaggccag

SEQ ID NO: 3499140 - RNA, 16 nt, Human
cugaggaaaggccagc

SEQ ID NO: 3499141 - RNA, 19 nt, Human
cugaggaaaggccagcugg

SEQ ID NO: 3499142 - RNA, 20 nt, Human
cugaggaaaggccagcuggc

SEQ ID NO: 3499143 - RNA, 22 nt, Human
cugaggaacccuuacaguagga

SEQ ID NO: 3499144 - RNA, 23 nt, Human
cugaggaagaugggggcaagaag

SEQ ID NO: 3499145 - RNA, 19 nt, Human
cugaggaagcugggguuca

SEQ ID NO: 3499146 - RNA, 21 nt, Human
cugaggaaggaggggaagcug

SEQ ID NO: 3499147 - RNA, 22 nt, Human
cugaggaaggaggggaagcugc

SEQ ID NO: 3499148 - RNA, 23 nt, Human
cugaggaaggaggggaagcugca

SEQ ID NO: 3499149 - RNA, 19 nt, Human
cugaggaaucaacagggca

SEQ ID NO: 3499150 - RNA, 20 nt, Human
cugaggaauccagacccggc

SEQ ID NO: 3499151 - RNA, 14 nt, Human
cugaggacaaagug

SEQ ID NO: 3499152 - RNA, 20 nt, Human
cugaggacacuaaccacgcu

SEQ ID NO: 3499153 - RNA, 22 nt, Human
cugaggacacuaaccacgcugg

SEQ ID NO: 3499154 - RNA, 20 nt, Human
cugaggacagaugccuccuu

SEQ ID NO: 3499155 - RNA, 15 nt, Human
cugaggacagcuguc

SEQ ID NO: 3499156 - RNA, 19 nt, Human
cugaggacauggcuucuga

SEQ ID NO: 3499157 - RNA, 14 nt, Human
cugaggaggccucc

SEQ ID NO: 3499158 - RNA, 15 nt, Human
cugaggaggccucca

SEQ ID NO: 3499159 - RNA, 23 nt, Human
cugaggaggccuugggcucugcu

SEQ ID NO: 3499160 - RNA, 12 nt, Human
cugaggagucug

SEQ ID NO: 3499161 - RNA, 17 nt, Human
cugaggagucugagguc

SEQ ID NO: 3499162 - RNA, 18 nt, Human
cugaggagucugaggucc

SEQ ID NO: 3499163 - RNA, 20 nt, Human
cugaggagucugagguccug

SEQ ID NO: 3499164 - RNA, 15 nt, Human
cugaggagugaggaa

SEQ ID NO: 3499165 - RNA, 16 nt, Human
cugaggaucagaaagu

SEQ ID NO: 3499166 - RNA, 13 nt, Human
cugaggaugagcu

SEQ ID NO: 3499167 - RNA, 18 nt, Human
cugaggaugggucagagc

SEQ ID NO: 3499168 - RNA, 19 nt, Human
cugaggaugggucagagcu

SEQ ID NO: 3499169 - RNA, 20 nt, Human
cugaggaugggucagagcua

SEQ ID NO: 3499170 - RNA, 14 nt, Human
cugaggauuucaag

SEQ ID NO: 3499171 - RNA, 22 nt, Human
cugaggcagacagcagcucagg

SEQ ID NO: 3499172 - RNA, 24 nt, Human
cugaggcagcagugugaggccagg

SEQ ID NO: 3499173 - RNA, 15 nt, Human
cugaggcaggagaau

SEQ ID NO: 3499174 - RNA, 15 nt, Human
cugaggcaggaggau

SEQ ID NO: 3499175 - RNA, 17 nt, Human
cugaggcagguccccag

SEQ ID NO: 3499176 - RNA, 18 nt, Human
cugaggcagguccccaga

SEQ ID NO: 3499177 - RNA, 19 nt, Human
cugaggcagguccccagac

SEQ ID NO: 3499178 - RNA, 15 nt, Human
cugaggcauccagca

SEQ ID NO: 3499179 - RNA, 12 nt, Human
cugaggccagcc

SEQ ID NO: 3499180 - RNA, 15 nt, Human
cugaggccagccugg

SEQ ID NO: 3499181 - RNA, 18 nt, Human
cugaggccagccuggccu

SEQ ID NO: 3499182 - RNA, 20 nt, Human
cugaggccagccuggccucc

SEQ ID NO: 3499183 - RNA, 13 nt, Human
cugaggcccagag

SEQ ID NO: 3499184 - RNA, 14 nt, Human
cugaggcccagagg

SEQ ID NO: 3499185 - RNA, 18 nt, Human
cugaggcccagagggccu

SEQ ID NO: 3499186 - RNA, 23 nt, Human
cugaggcccagagggccugcaag

SEQ ID NO: 3499187 - RNA, 15 nt, Human
cugaggcccuucucu

SEQ ID NO: 3499188 - RNA, 22 nt, Human
cugaggcccuucucuccagccc

SEQ ID NO: 3499189 - RNA, 21 nt, Human
cugaggccuaaaaguaaacau

SEQ ID NO: 3499190 - RNA, 17 nt, Human
cugaggccuagacucug

SEQ ID NO: 3499191 - RNA, 21 nt, Human
cugaggccugagacccaggac

SEQ ID NO: 3499192 - RNA, 14 nt, Human
cugaggccugggcc

SEQ ID NO: 3499193 - RNA, 18 nt, Human
cugaggccuuaucauuca

SEQ ID NO: 3499194 - RNA, 22 nt, Human
cugaggcgagaagggcugcuuc

SEQ ID NO: 3499195 - RNA, 17 nt, Human
cugaggcgggagaauca

SEQ ID NO: 3499196 - RNA, 15 nt, Human
cugaggcuccacuug

SEQ ID NO: 3499197 - RNA, 22 nt, Human
cugaggcucugacccagugaga

SEQ ID NO: 3499198 - RNA, 16 nt, Human
cugaggcucuuucugg

SEQ ID NO: 3499199 - RNA, 14 nt, Human
cugaggcugaggca

SEQ ID NO: 3499200 - RNA, 18 nt, Human
cugaggcuggcacaggac

SEQ ID NO: 3499201 - RNA, 13 nt, Human
cugaggcugggcu

SEQ ID NO: 3499202 - RNA, 15 nt, Human
cugaggcugggcucc

SEQ ID NO: 3499203 - RNA, 17 nt, Human
cugaggcugggcucccu

SEQ ID NO: 3499204 - RNA, 20 nt, Human
cugaggcugggggagagccg

SEQ ID NO: 3499205 - RNA, 17 nt, Human
cugaggcuguggucaca

SEQ ID NO: 3499206 - RNA, 15 nt, Human
cugaggcuuuggauu

SEQ ID NO: 3499207 - RNA, 12 nt, Human
cccuguuauuuu

SEQ ID NO: 3499208 - RNA, 14 nt, Human
cccuguucacucua

SEQ ID NO: 3499209 - RNA, 22 nt, Human
cccuguucacucuacuuagcau

SEQ ID NO: 3499210 - RNA, 17 nt, Human
cccuguucagcuacucc

SEQ ID NO: 3499211 - RNA, 14 nt, Human
cccuguuccccaga

SEQ ID NO: 3499212 - RNA, 16 nt, Human
cccuguuccccagaga

SEQ ID NO: 3499213 - RNA, 20 nt, Human
cccuguuccugcugcugucu

SEQ ID NO: 3499214 - RNA, 14 nt, Human
cccuguuccuggag

SEQ ID NO: 3499215 - RNA, 14 nt, Human
cccuguucuggcag

SEQ ID NO: 3499216 - RNA, 12 nt, Human
cccuguucuucc

SEQ ID NO: 3499217 - RNA, 13 nt, Human
cccuguucuuccu

SEQ ID NO: 3499218 - RNA, 14 nt, Human
cccuguucuuccuc

SEQ ID NO: 3499219 - RNA, 21 nt, Human
cccuguucuuccuccagcugc

SEQ ID NO: 3499220 - RNA, 11 nt, Human
cccuguugcua

SEQ ID NO: 3499221 - RNA, 16 nt, Human
cccuguugugccacag

SEQ ID NO: 3499222 - RNA, 19 nt, Human
cccuguuuaauauuuaaac

SEQ ID NO: 3499223 - RNA, 19 nt, Human
cccuguuucagaggcucag

SEQ ID NO: 3499224 - RNA, 15 nt, Human
cccuguuuguuucug

SEQ ID NO: 3499225 - RNA, 16 nt, Human
cccuguuuguuucuga

SEQ ID NO: 3499226 - RNA, 16 nt, Human
cccuguuuucccccca

SEQ ID NO: 3499227 - RNA, 18 nt, Human
cccuguuuucugagcccg

SEQ ID NO: 3499228 - RNA, 22 nt, Human
cccuguuuucugagcccgggcu

SEQ ID NO: 3499229 - RNA, 14 nt, Human
cccuuaaaggggag

SEQ ID NO: 3499230 - RNA, 23 nt, Human
cccuuaagaaugaguuucuuaga

SEQ ID NO: 3499231 - RNA, 14 nt, Human
cccuuacacuuacu

SEQ ID NO: 3499232 - RNA, 17 nt, Human
cccuuaccacugcucug

SEQ ID NO: 3499233 - RNA, 22 nt, Human
cccuuaccccuuagccucccug

SEQ ID NO: 3499234 - RNA, 13 nt, Human
cccuuaccuuccc

SEQ ID NO: 3499235 - RNA, 14 nt, Human
cccuuacuuagcau

SEQ ID NO: 3499236 - RNA, 16 nt, Human
cccuuacuucuugccc

SEQ ID NO: 3499237 - RNA, 20 nt, Human
cccuuacuugcuucucuagc

SEQ ID NO: 3499238 - RNA, 12 nt, Human
cccuuagacaga

SEQ ID NO: 3499239 - RNA, 22 nt, Human
cccuuagacagaggcccucaag

SEQ ID NO: 3499240 - RNA, 14 nt, Human
cccuuagcccccac

SEQ ID NO: 3499241 - RNA, 22 nt, Human
cccuuagcccccacccacuucc

SEQ ID NO: 3499242 - RNA, 15 nt, Human
cccuuagucccccaa

SEQ ID NO: 3499243 - RNA, 13 nt, Human
cccuuauaaaauc

SEQ ID NO: 3499244 - RNA, 13 nt, Human
cccuuauccagga

SEQ ID NO: 3499245 - RNA, 15 nt, Human
cccuuauccaggacu

SEQ ID NO: 3499246 - RNA, 14 nt, Human
cccuuaucccugcu

SEQ ID NO: 3499247 - RNA, 16 nt, Human
cccuuauccucccugu

SEQ ID NO: 3499248 - RNA, 21 nt, Human
cccuuauccucccuguaacuu

SEQ ID NO: 3499249 - RNA, 20 nt, Human
cccuuauuacacggaaaacg

SEQ ID NO: 3499250 - RNA, 19 nt, Human
cccuuauugcuguccugga

SEQ ID NO: 3499251 - RNA, 12 nt, Human
cccuuauuuccu

SEQ ID NO: 3499252 - RNA, 22 nt, Human
cccuucaacguuucuucacuuu

SEQ ID NO: 3499253 - RNA, 13 nt, Human
cccuucacaaagc

SEQ ID NO: 3499254 - RNA, 18 nt, Human
cccuucacaaagcccaag

SEQ ID NO: 3499255 - RNA, 16 nt, Human
cccuucacaguguuuc

SEQ ID NO: 3499256 - RNA, 15 nt, Human
cccuucacauaguuu

SEQ ID NO: 3499257 - RNA, 17 nt, Human
cccuucacugccuuugc

SEQ ID NO: 3499258 - RNA, 22 nt, Human
cccuucacuucugaccacacuu

SEQ ID NO: 3499259 - RNA, 23 nt, Human
cccuucacuucugaccacacuuc

SEQ ID NO: 3499260 - RNA, 19 nt, Human
cccuucaguacccucucag

SEQ ID NO: 3499261 - RNA, 18 nt, Human
aaaugcaugauugcagaa

SEQ ID NO: 3499262 - RNA, 21 nt, Human
aaaugcaugauugcagaauug

SEQ ID NO: 3499263 - RNA, 12 nt, Human
aaaugcauugua

SEQ ID NO: 3499264 - RNA, 16 nt, Human
aaaugccaaauuaaaa

SEQ ID NO: 3499265 - RNA, 21 nt, Human
aaaugccauuuauuuauugau

SEQ ID NO: 3499266 - RNA, 15 nt, Human
aaaugcccagccccu

SEQ ID NO: 3499267 - RNA, 13 nt, Human
aaaugcccucuuc

SEQ ID NO: 3499268 - RNA, 15 nt, Human
aaaugccuaauaaac

SEQ ID NO: 3499269 - RNA, 18 nt, Human
aaaugccucaguguauuu

SEQ ID NO: 3499270 - RNA, 21 nt, Human
aaaugccuccaaaguauugua

SEQ ID NO: 3499271 - RNA, 15 nt, Human
aaaugccuuaaaaug

SEQ ID NO: 3499272 - RNA, 17 nt, Human
aaaugccuuaaaaugga

SEQ ID NO: 3499273 - RNA, 18 nt, Human
aaaugccuuaaaauggaa

SEQ ID NO: 3499274 - RNA, 17 nt, Human
aaaugccuuacuuugua

SEQ ID NO: 3499275 - RNA, 20 nt, Human
aaaugccuuacuuuguauga

SEQ ID NO: 3499276 - RNA, 17 nt, Human
aaaugccuuagaaaugu

SEQ ID NO: 3499277 - RNA, 14 nt, Human
aaaugccuuugaga

SEQ ID NO: 3499278 - RNA, 16 nt, Human
aaaugccuuugagaca

SEQ ID NO: 3499279 - RNA, 23 nt, Human
aaaugcgguuauaaaaaaugguu

SEQ ID NO: 3499280 - RNA, 23 nt, Human
aaaugcuaauauuaaaagucaca

SEQ ID NO: 3499281 - RNA, 20 nt, Human
aaaugcuagguuaauuccaa

SEQ ID NO: 3499282 - RNA, 21 nt, Human
aaaugcuaugucauuucaugu

SEQ ID NO: 3499283 - RNA, 22 nt, Human
aaaugcuaugucauuucauguc

SEQ ID NO: 3499284 - RNA, 14 nt, Human
aaaugcuauuuuuu

SEQ ID NO: 3499285 - RNA, 13 nt, Human
aaaugcucucuca

SEQ ID NO: 3499286 - RNA, 16 nt, Human
aaaugcucucucaaau

SEQ ID NO: 3499287 - RNA, 19 nt, Human
aaaugcucuuauuucauca

SEQ ID NO: 3499288 - RNA, 17 nt, Human
aaaugcugaaaauugcc

SEQ ID NO: 3499289 - RNA, 20 nt, Human
aaaugcugcgcccuucccca

SEQ ID NO: 3499290 - RNA, 19 nt, Human
aaaugcuucauuuguaugu

SEQ ID NO: 3499291 - RNA, 13 nt, Human
aaaugcuuugcuu

SEQ ID NO: 3499292 - RNA, 18 nt, Human
aaaugcuuuuuauuucug

SEQ ID NO: 3499293 - RNA, 20 nt, Human
aaaugcuuuuuauuucugca

SEQ ID NO: 3499294 - RNA, 13 nt, Human
aaauggaaacuau

SEQ ID NO: 3499295 - RNA, 14 nt, Human
aaauggaaauuuug

SEQ ID NO: 3499296 - RNA, 20 nt, Human
aaauggaacgcuaaugaaac

SEQ ID NO: 3499297 - RNA, 17 nt, Human
aaauggaaguggcaaua

SEQ ID NO: 3499298 - RNA, 17 nt, Human
aaauggaauacucuuau

SEQ ID NO: 3499299 - RNA, 16 nt, Human
aaauggacacugugcc

SEQ ID NO: 3499300 - RNA, 14 nt, Human
aaauggacguguua

SEQ ID NO: 3499301 - RNA, 20 nt, Human
aaauggacguguuaugacuc

SEQ ID NO: 3499302 - RNA, 21 nt, Human
aaauggacguguuaugacucc

SEQ ID NO: 3499303 - RNA, 19 nt, Human
aaauggacuguggugacuu

SEQ ID NO: 3499304 - RNA, 20 nt, Human
aaauggacuguggugacuuu

SEQ ID NO: 3499305 - RNA, 16 nt, Human
aaauggagaagcugca

SEQ ID NO: 3499306 - RNA, 23 nt, Human
aaauggaggaucucuaaagagca

SEQ ID NO: 3499307 - RNA, 22 nt, Human
aaauggagguccuucugcugga

SEQ ID NO: 3499308 - RNA, 23 nt, Human
aaauggagucauuugagucucuu

SEQ ID NO: 3499309 - RNA, 14 nt, Human
aaauggaguuggag

SEQ ID NO: 3499310 - RNA, 21 nt, Human
aaauggauacuacaucuuuaa

SEQ ID NO: 3499311 - RNA, 21 nt, Human
aaauggaugccuugaauaaua

SEQ ID NO: 3499312 - RNA, 15 nt, Human
aaauggcaacaaacu

SEQ ID NO: 3499313 - RNA, 21 nt, Human
aaauggcgucuggaaguccaa

SEQ ID NO: 3499314 - RNA, 16 nt, Human
aaauggcucagaugcc

SEQ ID NO: 3499315 - RNA, 22 nt, Human
aaauggcuucagaauuaaaacu

SEQ ID NO: 3499316 - RNA, 21 nt, Human
aaaugggaacauuuauuuuau

SEQ ID NO: 3499317 - RNA, 15 nt, Human
aaaugggacuucuuu

SEQ ID NO: 3499318 - RNA, 15 nt, Human
aaaugggcacuuaaa

SEQ ID NO: 3499319 - RNA, 17 nt, Human
aaauggggccagaucca

SEQ ID NO: 3499320 - RNA, 18 nt, Human
aaaugggggugcauuuga

SEQ ID NO: 3499321 - RNA, 16 nt, Human
aaaugguagcauuuua

SEQ ID NO: 3499322 - RNA, 20 nt, Human
aaaugguagcauuuuaaaca

SEQ ID NO: 3499323 - RNA, 18 nt, Human
aaauggucgcccaggaga

SEQ ID NO: 3499324 - RNA, 20 nt, Human
aaauggucucuaacauuucc

SEQ ID NO: 3499325 - RNA, 11 nt, Human
aaauggugccu

SEQ ID NO: 3499326 - RNA, 20 nt, Human
aaauggugguuguuucuucc

SEQ ID NO: 3499327 - RNA, 22 nt, Human
aaauggugguuguuucuuccaa

SEQ ID NO: 3499328 - RNA, 18 nt, Human
aaaugguguuuuaucuuc

SEQ ID NO: 3499329 - RNA, 11 nt, Human
aaaugguuaaa

SEQ ID NO: 3499330 - RNA, 23 nt, Human
aaaugguucagaauuaaacuuuu

SEQ ID NO: 3499331 - RNA, 20 nt, Human
aaaugguuguauuagauguu

SEQ ID NO: 3499332 - RNA, 22 nt, Human
aaaugguuguauuagauguucu

SEQ ID NO: 3499333 - RNA, 20 nt, Human
aaaugguuuggugcuuuuua

SEQ ID NO: 3499334 - RNA, 15 nt, Human
aaauguaaacauuuu

SEQ ID NO: 3499335 - RNA, 15 nt, Human
aaauguaaacugcca

SEQ ID NO: 3499336 - RNA, 17 nt, Human
aaauguaaauauucuau

SEQ ID NO: 3499337 - RNA, 11 nt, Human
aaauguaacug

SEQ ID NO: 3499338 - RNA, 21 nt, Human
aaauguaacuguccguaguau

SEQ ID NO: 3499339 - RNA, 23 nt, Human
aaauguaacugugccaguucuuu

SEQ ID NO: 3499340 - RNA, 14 nt, Human
aaauguaacuguua

SEQ ID NO: 3499341 - RNA, 18 nt, Human
aaauguaacuuuuguaag

SEQ ID NO: 3499342 - RNA, 14 nt, Human
aaauguaagaucgu

SEQ ID NO: 3499343 - RNA, 22 nt, Human
aaauguaagauuauagauucua

SEQ ID NO: 3499344 - RNA, 13 nt, Human
aaauguaauuuaa

SEQ ID NO: 3499345 - RNA, 18 nt, Human
aaauguaauuuaaaugaa

SEQ ID NO: 3499346 - RNA, 19 nt, Human
aaauguacaaaauaaaguu

SEQ ID NO: 3499347 - RNA, 21 nt, Human
aaauguacaaaauaaaguuac

SEQ ID NO: 3499348 - RNA, 19 nt, Human
aaauguacagacauauuua

SEQ ID NO: 3499349 - RNA, 14 nt, Human
aaauguacauguau

SEQ ID NO: 3499350 - RNA, 17 nt, Human
aaauguacauguauuaa

SEQ ID NO: 3499351 - RNA, 16 nt, Human
aaauguaccugaugua

SEQ ID NO: 3499352 - RNA, 15 nt, Human
cugcagguugggcca

SEQ ID NO: 3499353 - RNA, 20 nt, Human
cugcaguagucucugugcuu

SEQ ID NO: 3499354 - RNA, 17 nt, Human
cugcaguaugaaaauaa

SEQ ID NO: 3499355 - RNA, 19 nt, Human
cugcagucacuucguggga

SEQ ID NO: 3499356 - RNA, 21 nt, Human
cugcagucagucaugauggca

SEQ ID NO: 3499357 - RNA, 16 nt, Human
cugcagugaggcugug

SEQ ID NO: 3499358 - RNA, 14 nt, Human
cugcaguuaauuag

SEQ ID NO: 3499359 - RNA, 21 nt, Human
cugcaguuaauuagcauucug

SEQ ID NO: 3499360 - RNA, 15 nt, Human
cugcaguucgacucu

SEQ ID NO: 3499361 - RNA, 20 nt, Human
cugcaguucgacucugugcu

SEQ ID NO: 3499362 - RNA, 16 nt, Human
cugcaguuuugcuauc

SEQ ID NO: 3499363 - RNA, 20 nt, Human
cugcauaagugaaaaucuua

SEQ ID NO: 3499364 - RNA, 15 nt, Human
cugcauaauguuucu

SEQ ID NO: 3499365 - RNA, 22 nt, Human
cugcauaauucugaaguuauau

SEQ ID NO: 3499366 - RNA, 15 nt, Human
cugcauaccaaccug

SEQ ID NO: 3499367 - RNA, 16 nt, Human
cugcauaccaaccugg

SEQ ID NO: 3499368 - RNA, 20 nt, Human
cugcauaggaguuuggagga

SEQ ID NO: 3499369 - RNA, 22 nt, Human
cugcauaggaguuuggaggaag

SEQ ID NO: 3499370 - RNA, 23 nt, Human
cugcauaggaguuuggaggaagu

SEQ ID NO: 3499371 - RNA, 20 nt, Human
cugcaucagcugcugaaaca

SEQ ID NO: 3499372 - RNA, 12 nt, Human
cugcaucaucuu

SEQ ID NO: 3499373 - RNA, 22 nt, Human
cugcauccagagauucauuuuc

SEQ ID NO: 3499374 - RNA, 21 nt, Human
cugcauccauucuccugagga

SEQ ID NO: 3499375 - RNA, 15 nt, Human
cugcaucccagcacc

SEQ ID NO: 3499376 - RNA, 20 nt, Human
cugcaucccagcaccugccu

SEQ ID NO: 3499377 - RNA, 21 nt, Human
cugcaucccagcaccugccuc

SEQ ID NO: 3499378 - RNA, 15 nt, Human
cugcauccccuuggc

SEQ ID NO: 3499379 - RNA, 22 nt, Human
cugcauccccuuggcugugagg

SEQ ID NO: 3499380 - RNA, 18 nt, Human
cugcauccucuggagcca

SEQ ID NO: 3499381 - RNA, 16 nt, Human
cugcaucguuucaucu

SEQ ID NO: 3499382 - RNA, 22 nt, Human
cugcaucguuucaucuuccaac

SEQ ID NO: 3499383 - RNA, 20 nt, Human
cugcaucuagaggcuuccuu

SEQ ID NO: 3499384 - RNA, 21 nt, Human
cugcaucuagaggcuuccuuc

SEQ ID NO: 3499385 - RNA, 20 nt, Human
cugcaucugaccagcagcgc

SEQ ID NO: 3499386 - RNA, 21 nt, Human
cugcaucugggauucccacca

SEQ ID NO: 3499387 - RNA, 13 nt, Human
cugcaucuugggg

SEQ ID NO: 3499388 - RNA, 14 nt, Human
cugcaucuugggga

SEQ ID NO: 3499389 - RNA, 16 nt, Human
cugcaugauguuugcc

SEQ ID NO: 3499390 - RNA, 11 nt, Human
cugcaugcaga

SEQ ID NO: 3499391 - RNA, 16 nt, Human
cugcaugcccucucag

SEQ ID NO: 3499392 - RNA, 20 nt, Human
cugcaugcccucucaggccg

SEQ ID NO: 3499393 - RNA, 23 nt, Human
cugcaugcgagugcucauuucag

SEQ ID NO: 3499394 - RNA, 16 nt, Human
cugcaugcggcccagc

SEQ ID NO: 3499395 - RNA, 21 nt, Human
cugcaugcggcccagcccggc

SEQ ID NO: 3499396 - RNA, 18 nt, Human
cugcaugcugcuggacag

SEQ ID NO: 3499397 - RNA, 19 nt, Human
cugcauggaccuaacauuc

SEQ ID NO: 3499398 - RNA, 23 nt, Human
cugcauggcagggggcugcugcu

SEQ ID NO: 3499399 - RNA, 17 nt, Human
cugcauggcauccucca

SEQ ID NO: 3499400 - RNA, 22 nt, Human
cugcauggcauccuccagcccc

SEQ ID NO: 3499401 - RNA, 16 nt, Human
cugcaugggccagccc

SEQ ID NO: 3499402 - RNA, 18 nt, Human
cugcauguauaaaugaag

SEQ ID NO: 3499403 - RNA, 22 nt, Human
cugcauguggcuuuuuuaaaaa

SEQ ID NO: 3499404 - RNA, 14 nt, Human
cugcauuagaaaaa

SEQ ID NO: 3499405 - RNA, 17 nt, Human
cugcauuauucucuuuu

SEQ ID NO: 3499406 - RNA, 24 nt, Human
cugcauuauuugagaagcugcuca

SEQ ID NO: 3499407 - RNA, 20 nt, Human
cugcauucacccagacagcu

SEQ ID NO: 3499408 - RNA, 21 nt, Human
cugcauucacccagacagcuc

SEQ ID NO: 3499409 - RNA, 15 nt, Human
cugcauucauuuuua

SEQ ID NO: 3499410 - RNA, 16 nt, Human
cugcauucauuuuuau

SEQ ID NO: 3499411 - RNA, 22 nt, Human
cugcauucuucugaucacugaa

SEQ ID NO: 3499412 - RNA, 16 nt, Human
cugcauucuuucugua

SEQ ID NO: 3499413 - RNA, 22 nt, Human
cugcauugccugcggucaaggc

SEQ ID NO: 3499414 - RNA, 19 nt, Human
cugaggugcccaggagaag

SEQ ID NO: 3499415 - RNA, 22 nt, Human
cugaggugccugucccaccccc

SEQ ID NO: 3499416 - RNA, 13 nt, Human
cugaggugggagg

SEQ ID NO: 3499417 - RNA, 17 nt, Human
cugaggugggcccagga

SEQ ID NO: 3499418 - RNA, 20 nt, Human
cugaggugggcccaggacca

SEQ ID NO: 3499419 - RNA, 17 nt, Human
cugaggugugggggcug

SEQ ID NO: 3499420 - RNA, 18 nt, Human
cugaggugugggggcugc

SEQ ID NO: 3499421 - RNA, 22 nt, Human
cugaggugugggggcugcagca

SEQ ID NO: 3499422 - RNA, 14 nt, Human
cugagguuccucug

SEQ ID NO: 3499423 - RNA, 15 nt, Human
cugagguuccucugc

SEQ ID NO: 3499424 - RNA, 19 nt, Human
cugagguuccucugccugc

SEQ ID NO: 3499425 - RNA, 20 nt, Human
cugagguuccucugccugcc

SEQ ID NO: 3499426 - RNA, 23 nt, Human
cugagguuccucugccugccccg

SEQ ID NO: 3499427 - RNA, 14 nt, Human
cugagguuucaccc

SEQ ID NO: 3499428 - RNA, 21 nt, Human
cugagguuucacccuuaaccc

SEQ ID NO: 3499429 - RNA, 20 nt, Human
cugaguaagaaaugcugccc

SEQ ID NO: 3499430 - RNA, 17 nt, Human
cugaguacguugugcau

SEQ ID NO: 3499431 - RNA, 18 nt, Human
cugaguacguugugcauu

SEQ ID NO: 3499432 - RNA, 21 nt, Human
cugaguacguugugcauuugg

SEQ ID NO: 3499433 - RNA, 16 nt, Human
cugaguacuccacacu

SEQ ID NO: 3499434 - RNA, 23 nt, Human
cugaguacuccacacugcacaau

SEQ ID NO: 3499435 - RNA, 12 nt, Human
cugaguagaaag

SEQ ID NO: 3499436 - RNA, 18 nt, Human
cugaguagaugcgcagcc

SEQ ID NO: 3499437 - RNA, 17 nt, Human
cugaguagcucugccuu

SEQ ID NO: 3499438 - RNA, 18 nt, Human
cugaguagcucugccuuu

SEQ ID NO: 3499439 - RNA, 16 nt, Human
cugaguagggggagca

SEQ ID NO: 3499440 - RNA, 21 nt, Human
cugaguaucuccucgcaagcu

SEQ ID NO: 3499441 - RNA, 20 nt, Human
cugaguauguuaagcucuuu

SEQ ID NO: 3499442 - RNA, 22 nt, Human
cugaguauuaaaauguaugcau

SEQ ID NO: 3499443 - RNA, 21 nt, Human
cugaguauuaauaucugagga

SEQ ID NO: 3499444 - RNA, 15 nt, Human
cugagucaaguuguu

SEQ ID NO: 3499445 - RNA, 21 nt, Human
cugagucagagccaugucuuc

SEQ ID NO: 3499446 - RNA, 17 nt, Human
cugagucaggacuugaa

SEQ ID NO: 3499447 - RNA, 19 nt, Human
cugagucagggcccagagg

SEQ ID NO: 3499448 - RNA, 22 nt, Human
cugagucagggcccagaggcug

SEQ ID NO: 3499449 - RNA, 21 nt, Human
cugagucaugaucucccugcc

SEQ ID NO: 3499450 - RNA, 17 nt, Human
cugagucccaggagcug

SEQ ID NO: 3499451 - RNA, 20 nt, Human
cugagucccaggcugagccu

SEQ ID NO: 3499452 - RNA, 13 nt, Human
cugaguccgaccu

SEQ ID NO: 3499453 - RNA, 13 nt, Human
cugaguccuggcc

SEQ ID NO: 3499454 - RNA, 22 nt, Human
cugaguccuuaaacagggcauc

SEQ ID NO: 3499455 - RNA, 19 nt, Human
cugagucguacagaaagcu

SEQ ID NO: 3499456 - RNA, 23 nt, Human
cugagucguacagaaagcugccu

SEQ ID NO: 3499457 - RNA, 15 nt, Human
cugagucucccaagg

SEQ ID NO: 3499458 - RNA, 19 nt, Human
cugagucugaaggcugggu

SEQ ID NO: 3499459 - RNA, 22 nt, Human
cugagucugggcagcugucccu

SEQ ID NO: 3499460 - RNA, 20 nt, Human
cugagucuguucugguaauc

SEQ ID NO: 3499461 - RNA, 13 nt, Human
cugagugaaaaau

SEQ ID NO: 3499462 - RNA, 14 nt, Human
cugagugaaaaauc

SEQ ID NO: 3499463 - RNA, 15 nt, Human
cugagugaaccugua

SEQ ID NO: 3499464 - RNA, 18 nt, Human
cugagugaaccuguauaa

SEQ ID NO: 3499465 - RNA, 21 nt, Human
cugagugacucuauauagcug

SEQ ID NO: 3499466 - RNA, 16 nt, Human
cugagugcaggcccac

SEQ ID NO: 3499467 - RNA, 20 nt, Human
cugagugcaggcccacccug

SEQ ID NO: 3499468 - RNA, 16 nt, Human
cugagugccuggccaa

SEQ ID NO: 3499469 - RNA, 19 nt, Human
cugagugccuggccaaagg

SEQ ID NO: 3499470 - RNA, 20 nt, Human
cugagugccuucugugggga

SEQ ID NO: 3499471 - RNA, 23 nt, Human
cugaguggcuucacuccugcugu

SEQ ID NO: 3499472 - RNA, 13 nt, Human
cugagugggaagc

SEQ ID NO: 3499473 - RNA, 21 nt, Human
cugagugggaagcccauccug

SEQ ID NO: 3499474 - RNA, 15 nt, Human
cugaguuaugaugua

SEQ ID NO: 3499475 - RNA, 13 nt, Human
cugaguuccugag

SEQ ID NO: 3499476 - RNA, 14 nt, Human
cugaguugaagagg

SEQ ID NO: 3499477 - RNA, 20 nt, Human
cugaguugacuugacagaac

SEQ ID NO: 3499478 - RNA, 11 nt, Human
cugaguugcca

SEQ ID NO: 3499479 - RNA, 14 nt, Human
cugaguugccaaga

SEQ ID NO: 3499480 - RNA, 16 nt, Human
cugaguugccaagaca

SEQ ID NO: 3499481 - RNA, 21 nt, Human
cugaguugguguugacaugug

SEQ ID NO: 3499482 - RNA, 17 nt, Human
cugaguuuaccauuugu

SEQ ID NO: 3499483 - RNA, 18 nt, Human
cugaguuuaccauuugua

SEQ ID NO: 3499484 - RNA, 21 nt, Human
cugaguuuaccauuuguaaua

SEQ ID NO: 3499485 - RNA, 20 nt, Human
cugaguuucauucuccugcc

SEQ ID NO: 3499486 - RNA, 13 nt, Human
cugaguuugugcu

SEQ ID NO: 3499487 - RNA, 18 nt, Human
cugaguuugugcuggugu

SEQ ID NO: 3499488 - RNA, 11 nt, Human
cugaguuuucc

SEQ ID NO: 3499489 - RNA, 18 nt, Human
cugaguuuuccauggcag

SEQ ID NO: 3499490 - RNA, 20 nt, Human
cugaguuuuccauggcagga

SEQ ID NO: 3499491 - RNA, 17 nt, Human
cugaguuuuguguuugu

SEQ ID NO: 3499492 - RNA, 19 nt, Human
cugauaaaacaacagcucg

SEQ ID NO: 3499493 - RNA, 19 nt, Human
cugauaaaaccauguagaa

SEQ ID NO: 3499494 - RNA, 18 nt, Human
cccuugccaccccacccu

SEQ ID NO: 3499495 - RNA, 17 nt, Human
cccuugccacuuugcac

SEQ ID NO: 3499496 - RNA, 15 nt, Human
cccuugccagacaug

SEQ ID NO: 3499497 - RNA, 13 nt, Human
cccuugccagcug

SEQ ID NO: 3499498 - RNA, 12 nt, Human
cccuugcccagg

SEQ ID NO: 3499499 - RNA, 15 nt, Human
cccuugcccagggcu

SEQ ID NO: 3499500 - RNA, 20 nt, Human
cccuugcccagggcucagcc

SEQ ID NO: 3499501 - RNA, 22 nt, Human
cccuugcccagggcucagccug

SEQ ID NO: 3499502 - RNA, 19 nt, Human
cccuugcccaugcugggcu

SEQ ID NO: 3499503 - RNA, 13 nt, Human
cccuugcccugac

SEQ ID NO: 3499504 - RNA, 16 nt, Human
cccuugcccugaccuc

SEQ ID NO: 3499505 - RNA, 20 nt, Human
cccuugcccugaccucccag

SEQ ID NO: 3499506 - RNA, 17 nt, Human
cccuugccgucuaccug

SEQ ID NO: 3499507 - RNA, 20 nt, Human
cccuugccugugccagguga

SEQ ID NO: 3499508 - RNA, 20 nt, Human
cccuugccuuucgaggccug

SEQ ID NO: 3499509 - RNA, 19 nt, Human
cccuugcucuccccugccc

SEQ ID NO: 3499510 - RNA, 23 nt, Human
cccuugcuggccccagcccugcu

SEQ ID NO: 3499511 - RNA, 21 nt, Human
cccuugcuguaugcugaucau

SEQ ID NO: 3499512 - RNA, 18 nt, Human
cccuugcuugccugcagg

SEQ ID NO: 3499513 - RNA, 19 nt, Human
cccuugcuugccugcaggg

SEQ ID NO: 3499514 - RNA, 23 nt, Human
cccuugcuugccugcagggccau

SEQ ID NO: 3499515 - RNA, 19 nt, Human
cccuuggaaaccugcccug

SEQ ID NO: 3499516 - RNA, 16 nt, Human
cccuuggacuugagga

SEQ ID NO: 3499517 - RNA, 15 nt, Human
cccuuggaggccagc

SEQ ID NO: 3499518 - RNA, 18 nt, Human
cccuuggaggccagccag

SEQ ID NO: 3499519 - RNA, 17 nt, Human
cccuuggauuguccccg

SEQ ID NO: 3499520 - RNA, 12 nt, Human
cccuuggccuca

SEQ ID NO: 3499521 - RNA, 13 nt, Human
cccuuggccucag

SEQ ID NO: 3499522 - RNA, 14 nt, Human
cccuuggccucaga

SEQ ID NO: 3499523 - RNA, 19 nt, Human
cccuuggccugucucaucc

SEQ ID NO: 3499524 - RNA, 19 nt, Human
cccuugggccaccccuccu

SEQ ID NO: 3499525 - RNA, 21 nt, Human
cccuugggccagaaguaccag

SEQ ID NO: 3499526 - RNA, 16 nt, Human
cccuugggcucugaug

SEQ ID NO: 3499527 - RNA, 18 nt, Human
cccuuguagcuccucccc

SEQ ID NO: 3499528 - RNA, 21 nt, Human
cccuugugaaucaagggucag

SEQ ID NO: 3499529 - RNA, 20 nt, Human
cccuuguggucccaccccac

SEQ ID NO: 3499530 - RNA, 22 nt, Human
cccuuguggucccaccccacac

SEQ ID NO: 3499531 - RNA, 12 nt, Human
cccuuguuccag

SEQ ID NO: 3499532 - RNA, 13 nt, Human
cccuuuacccucu

SEQ ID NO: 3499533 - RNA, 20 nt, Human
cccuuucagaugucuucugc

SEQ ID NO: 3499534 - RNA, 20 nt, Human
cccuuucccaccccaaccug

SEQ ID NO: 3499535 - RNA, 22 nt, Human
cccuuuccccagcaucacuccc

SEQ ID NO: 3499536 - RNA, 14 nt, Human
cccuuucccgggcu

SEQ ID NO: 3499537 - RNA, 14 nt, Human
cccuuucccucgcu

SEQ ID NO: 3499538 - RNA, 9 nt, Human
cccuuuccu

SEQ ID NO: 3499539 - RNA, 14 nt, Human
cccuuuccuccuca

SEQ ID NO: 3499540 - RNA, 15 nt, Human
cccuuuccuguccca

SEQ ID NO: 3499541 - RNA, 16 nt, Human
cccuuucuagaccaau

SEQ ID NO: 3499542 - RNA, 22 nt, Human
cccuuucuaucguucucucuuu

SEQ ID NO: 3499543 - RNA, 12 nt, Human
cccuuucugugu

SEQ ID NO: 3499544 - RNA, 12 nt, Human
cccuuucuuccu

SEQ ID NO: 3499545 - RNA, 15 nt, Human
cccuuucuuggccag

SEQ ID NO: 3499546 - RNA, 17 nt, Human
cccuuucuuggccaguu

SEQ ID NO: 3499547 - RNA, 21 nt, Human
cccuuugcaucguccccuccc

SEQ ID NO: 3499548 - RNA, 17 nt, Human
cccuuugcugcauggca

SEQ ID NO: 3499549 - RNA, 13 nt, Human
cccuuugcugucc

SEQ ID NO: 3499550 - RNA, 23 nt, Human
cccuuugcugugaggcuguccug

SEQ ID NO: 3499551 - RNA, 16 nt, Human
cccuuugggaggcuga

SEQ ID NO: 3499552 - RNA, 17 nt, Human
cccuuugggcccaggga

SEQ ID NO: 3499553 - RNA, 16 nt, Human
cccuuugggcccugca

SEQ ID NO: 3499554 - RNA, 19 nt, Human
cccuuugggcccugcaugu

SEQ ID NO: 3499555 - RNA, 22 nt, Human
cccuuugggcccugcauguagu

SEQ ID NO: 3499556 - RNA, 20 nt, Human
cccuuuggggguugaauagg

SEQ ID NO: 3499557 - RNA, 21 nt, Human
cccuuuguccuccugcugcca

SEQ ID NO: 3499558 - RNA, 17 nt, Human
cccuuugucuuucaaac

SEQ ID NO: 3499559 - RNA, 15 nt, Human
cccuuugugcugugg

SEQ ID NO: 3499560 - RNA, 16 nt, Human
cccuuuuaaaguugau

SEQ ID NO: 3499561 - RNA, 15 nt, Human
cccuuuucagcuucu

SEQ ID NO: 3499562 - RNA, 18 nt, Human
cccuuuucagcuucugcu

SEQ ID NO: 3499563 - RNA, 9 nt, Human
cccuuuucc

SEQ ID NO: 3499564 - RNA, 16 nt, Human
cccuuuucuacaguua

SEQ ID NO: 3499565 - RNA, 13 nt, Human
cccuuuucuguuc

SEQ ID NO: 3499566 - RNA, 18 nt, Human
cccuuuucuuuucuaccc

SEQ ID NO: 3499567 - RNA, 22 nt, Human
cccuuuuucaauaacuggaaca

SEQ ID NO: 3499568 - RNA, 14 nt, Human
cccuuuuucaauga

SEQ ID NO: 3499569 - RNA, 19 nt, Human
cugcauugcuagauaaaag

SEQ ID NO: 3499570 - RNA, 22 nt, Human
cugcauuggaacuggaggcagg

SEQ ID NO: 3499571 - RNA, 23 nt, Human
cugcauuggaacuggaggcaggg

SEQ ID NO: 3499572 - RNA, 18 nt, Human
cugcauuuaaaagauaca

SEQ ID NO: 3499573 - RNA, 22 nt, Human
cugcauuuaaaagauacaguua

SEQ ID NO: 3499574 - RNA, 22 nt, Human
cugcauuuagggaguauucuaa

SEQ ID NO: 3499575 - RNA, 23 nt, Human
cugcauuuagggaguauucuaau

SEQ ID NO: 3499576 - RNA, 19 nt, Human
cugcauuuccucgcagccu

SEQ ID NO: 3499577 - RNA, 17 nt, Human
cugcauuucgguggcua

SEQ ID NO: 3499578 - RNA, 18 nt, Human
cugcauuucgguggcuag

SEQ ID NO: 3499579 - RNA, 9 nt, Human
cugcauuuu

SEQ ID NO: 3499580 - RNA, 17 nt, Human
cugcauuuucaccccac

SEQ ID NO: 3499581 - RNA, 20 nt, Human
cugcauuuucugaaacuaau

SEQ ID NO: 3499582 - RNA, 15 nt, Human
cugcauuuucugggu

SEQ ID NO: 3499583 - RNA, 21 nt, Human
cugcauuuugcuauuguaaau

SEQ ID NO: 3499584 - RNA, 15 nt, Human
cugcauuuuucugca

SEQ ID NO: 3499585 - RNA, 16 nt, Human
cugcauuuuucugcag

SEQ ID NO: 3499586 - RNA, 18 nt, Human
cugccaaaggaugugaua

SEQ ID NO: 3499587 - RNA, 19 nt, Human
cugccaaaggaugugauau

SEQ ID NO: 3499588 - RNA, 21 nt, Human
cugccaaagggaaauaucauu

SEQ ID NO: 3499589 - RNA, 23 nt, Human
cugccaaccauaccuuccuuccc

SEQ ID NO: 3499590 - RNA, 22 nt, Human
cugccaaccuaaaacucuuucg

SEQ ID NO: 3499591 - RNA, 14 nt, Human
cugccaaccucgcu

SEQ ID NO: 3499592 - RNA, 12 nt, Human
cugccaagagag

SEQ ID NO: 3499593 - RNA, 12 nt, Human
cugccaagccau

SEQ ID NO: 3499594 - RNA, 18 nt, Human
cugccaaggccagagugg

SEQ ID NO: 3499595 - RNA, 13 nt, Human
cugccaauauccu

SEQ ID NO: 3499596 - RNA, 14 nt, Human
cugccaauauccua

SEQ ID NO: 3499597 - RNA, 16 nt, Human
cugccaauauccuaau

SEQ ID NO: 3499598 - RNA, 19 nt, Human
cugccaaugggagcucaug

SEQ ID NO: 3499599 - RNA, 23 nt, Human
cugccacacaaacguauguaaau

SEQ ID NO: 3499600 - RNA, 15 nt, Human
cugccacaccugagc

SEQ ID NO: 3499601 - RNA, 16 nt, Human
cugccacaccugagcc

SEQ ID NO: 3499602 - RNA, 23 nt, Human
cugccacacgucugacccucucc

SEQ ID NO: 3499603 - RNA, 13 nt, Human
cugccacacucug

SEQ ID NO: 3499604 - RNA, 18 nt, Human
cugccacacucugacgca

SEQ ID NO: 3499605 - RNA, 22 nt, Human
cugccacacuucaggcucuucu

SEQ ID NO: 3499606 - RNA, 21 nt, Human
cugccacagccuccccugcca

SEQ ID NO: 3499607 - RNA, 18 nt, Human
cugccacauuagaacuuc

SEQ ID NO: 3499608 - RNA, 22 nt, Human
cugccaccaaaggccaggguca

SEQ ID NO: 3499609 - RNA, 18 nt, Human
cugccaccaccagaaagc

SEQ ID NO: 3499610 - RNA, 19 nt, Human
cugccaccacgcccggcua

SEQ ID NO: 3499611 - RNA, 22 nt, Human
cugccaccagagaccguccuca

SEQ ID NO: 3499612 - RNA, 14 nt, Human
cugccaccaggcca

SEQ ID NO: 3499613 - RNA, 17 nt, Human
cugccaccauccugcug

SEQ ID NO: 3499614 - RNA, 17 nt, Human
cugccacccaccucccu

SEQ ID NO: 3499615 - RNA, 19 nt, Human
cugccacccaccucccugc

SEQ ID NO: 3499616 - RNA, 23 nt, Human
cugccacccaccucccugccucc

SEQ ID NO: 3499617 - RNA, 20 nt, Human
cugccacccagccccagcca

SEQ ID NO: 3499618 - RNA, 16 nt, Human
cugccacccaggaucc

SEQ ID NO: 3499619 - RNA, 14 nt, Human
cugccacccugggg

SEQ ID NO: 3499620 - RNA, 20 nt, Human
cugccacccuggggagaaag

SEQ ID NO: 3499621 - RNA, 13 nt, Human
cugccaccucccc

SEQ ID NO: 3499622 - RNA, 17 nt, Human
cugccaccuccccccac

SEQ ID NO: 3499623 - RNA, 19 nt, Human
cugccaccuccccuugcca

SEQ ID NO: 3499624 - RNA, 13 nt, Human
cugccaccucccu

SEQ ID NO: 3499625 - RNA, 16 nt, Human
cugccaccucccugac

SEQ ID NO: 3499626 - RNA, 16 nt, Human
cugccaccuggacccc

SEQ ID NO: 3499627 - RNA, 15 nt, Human
cugccaccuggggca

SEQ ID NO: 3499628 - RNA, 16 nt, Human
cugccaccuggggcag

SEQ ID NO: 3499629 - RNA, 18 nt, Human
cugccaccuggggcaguc

SEQ ID NO: 3499630 - RNA, 16 nt, Human
cugccaccugucuguc

SEQ ID NO: 3499631 - RNA, 17 nt, Human
cugccaccugucugucu

SEQ ID NO: 3499632 - RNA, 15 nt, Human
cugccacuaggcugg

SEQ ID NO: 3499633 - RNA, 18 nt, Human
cugccacuaggcugggug

SEQ ID NO: 3499634 - RNA, 18 nt, Human
cugccacucacacagcca

SEQ ID NO: 3499635 - RNA, 20 nt, Human
cugccacucacacagccagg

SEQ ID NO: 3499636 - RNA, 16 nt, Human
cugccacucacuaggc

SEQ ID NO: 3499637 - RNA, 16 nt, Human
cugccacucaggccca

SEQ ID NO: 3499638 - RNA, 12 nt, Human
cugcccucgcac

SEQ ID NO: 3499639 - RNA, 20 nt, Human
cugcccucguggccagcccg

SEQ ID NO: 3499640 - RNA, 21 nt, Human
cugcccucguggccagcccgg

SEQ ID NO: 3499641 - RNA, 14 nt, Human
cugcccucuagagc

SEQ ID NO: 3499642 - RNA, 22 nt, Human
cugcccucucccaaaaaacuac

SEQ ID NO: 3499643 - RNA, 13 nt, Human
cugcccucuccug

SEQ ID NO: 3499644 - RNA, 14 nt, Human
cugcccucuccugg

SEQ ID NO: 3499645 - RNA, 15 nt, Human
cugcccucuccuggg

SEQ ID NO: 3499646 - RNA, 19 nt, Human
cugcccucuccugggcagc

SEQ ID NO: 3499647 - RNA, 20 nt, Human
cugcccucuccugggcagcu

SEQ ID NO: 3499648 - RNA, 17 nt, Human
cugcccucuccuuccuu

SEQ ID NO: 3499649 - RNA, 20 nt, Human
cugcccucugcauccucugg

SEQ ID NO: 3499650 - RNA, 11 nt, Human
cugcccugaga

SEQ ID NO: 3499651 - RNA, 14 nt, Human
cugcccugccaccu

SEQ ID NO: 3499652 - RNA, 21 nt, Human
cugcccugccaccugucuguc

SEQ ID NO: 3499653 - RNA, 13 nt, Human
cugcccugccacu

SEQ ID NO: 3499654 - RNA, 21 nt, Human
cugcccugcccaccuggccuc

SEQ ID NO: 3499655 - RNA, 14 nt, Human
cugcccugcccugc

SEQ ID NO: 3499656 - RNA, 13 nt, Human
cugcccugccuga

SEQ ID NO: 3499657 - RNA, 22 nt, Human
cugcccugcugccgccucccag

SEQ ID NO: 3499658 - RNA, 23 nt, Human
cugcccuggaacauccuuugcag

SEQ ID NO: 3499659 - RNA, 21 nt, Human
cugcccuggcugcugccccca

SEQ ID NO: 3499660 - RNA, 12 nt, Human
cugcccugggag

SEQ ID NO: 3499661 - RNA, 13 nt, Human
cugcccugggagg

SEQ ID NO: 3499662 - RNA, 19 nt, Human
cugcccugggauguccaca

SEQ ID NO: 3499663 - RNA, 21 nt, Human
cugcccugggauguccacaga

SEQ ID NO: 3499664 - RNA, 14 nt, Human
cugcccugguccag

SEQ ID NO: 3499665 - RNA, 21 nt, Human
cugcccugguccagggaagcu

SEQ ID NO: 3499666 - RNA, 12 nt, Human
cugcccuggugc

SEQ ID NO: 3499667 - RNA, 15 nt, Human
cugcccuggugcugc

SEQ ID NO: 3499668 - RNA, 17 nt, Human
cugcccuggugcugcca

SEQ ID NO: 3499669 - RNA, 17 nt, Human
cugcccugucaggaggc

SEQ ID NO: 3499670 - RNA, 13 nt, Human
cugcccugugagu

SEQ ID NO: 3499671 - RNA, 12 nt, Human
cugcccuguggg

SEQ ID NO: 3499672 - RNA, 16 nt, Human
cugcccugugggcccc

SEQ ID NO: 3499673 - RNA, 17 nt, Human
cugcccuuaccugccag

SEQ ID NO: 3499674 - RNA, 19 nt, Human
cugcccuuaccugccagga

SEQ ID NO: 3499675 - RNA, 21 nt, Human
cugcccuucaccccaguggcc

SEQ ID NO: 3499676 - RNA, 18 nt, Human
cugcccuugucccacuca

SEQ ID NO: 3499677 - RNA, 23 nt, Human
cugcccuugucccacucaagcca

SEQ ID NO: 3499678 - RNA, 20 nt, Human
cugcccuuguuuggggcagg

SEQ ID NO: 3499679 - RNA, 22 nt, Human
cugcccuuguuuggggcaggag

SEQ ID NO: 3499680 - RNA, 18 nt, Human
cugcccuuuguccuccug

SEQ ID NO: 3499681 - RNA, 20 nt, Human
cugcccuuuguccuccugcu

SEQ ID NO: 3499682 - RNA, 21 nt, Human
cugcccuuuuuucugccuccu

SEQ ID NO: 3499683 - RNA, 16 nt, Human
cugccgaccagagccc

SEQ ID NO: 3499684 - RNA, 16 nt, Human
cugccgaccgaggcug

SEQ ID NO: 3499685 - RNA, 19 nt, Human
cugccgaccucguccuccc

SEQ ID NO: 3499686 - RNA, 14 nt, Human
cugccgacuccugg

SEQ ID NO: 3499687 - RNA, 23 nt, Human
cugccgagaguccaucagccucc

SEQ ID NO: 3499688 - RNA, 14 nt, Human
cugccgagcaaccg

SEQ ID NO: 3499689 - RNA, 16 nt, Human
cugccgagcaaccgug

SEQ ID NO: 3499690 - RNA, 21 nt, Human
cugccgagcaaccguggcccu

SEQ ID NO: 3499691 - RNA, 14 nt, Human
cugccgcaccccag

SEQ ID NO: 3499692 - RNA, 15 nt, Human
cugccgcagagcugg

SEQ ID NO: 3499693 - RNA, 18 nt, Human
cugccgcagagcuggccg

SEQ ID NO: 3499694 - RNA, 14 nt, Human
cugccgcagcccug

SEQ ID NO: 3499695 - RNA, 17 nt, Human
cugccgcagcccugcag

SEQ ID NO: 3499696 - RNA, 19 nt, Human
cugccgcagcccugcagag

SEQ ID NO: 3499697 - RNA, 23 nt, Human
cugccgcagcccugcagagggca

SEQ ID NO: 3499698 - RNA, 16 nt, Human
cugccgccccacccag

SEQ ID NO: 3499699 - RNA, 20 nt, Human
cugccgccgcuagguagagu

SEQ ID NO: 3499700 - RNA, 16 nt, Human
cugccgccucccagcc

SEQ ID NO: 3499701 - RNA, 17 nt, Human
cugccgcuaccucccuc

SEQ ID NO: 3499702 - RNA, 21 nt, Human
cugccggacccggaggccgag

SEQ ID NO: 3499703 - RNA, 17 nt, Human
cugccggagaggaagag

SEQ ID NO: 3499704 - RNA, 23 nt, Human
cugccggagaggaagagacacuc

SEQ ID NO: 3499705 - RNA, 15 nt, Human
cugccggcccugggg

SEQ ID NO: 3499706 - RNA, 17 nt, Human
cugccggcucuggcucu

SEQ ID NO: 3499707 - RNA, 18 nt, Human
cugccgggcugagggccu

SEQ ID NO: 3499708 - RNA, 20 nt, Human
cugccggggcagcccccuca

SEQ ID NO: 3499709 - RNA, 20 nt, Human
cugccggguucuagucuccu

SEQ ID NO: 3499710 - RNA, 21 nt, Human
cugccggguucuagucuccuu

SEQ ID NO: 3499711 - RNA, 21 nt, Human
cugccgguaaacacgccugca

SEQ ID NO: 3499712 - RNA, 20 nt, Human
cugccgguuugaaaauaugc

SEQ ID NO: 3499713 - RNA, 20 nt, Human
cugccgucagugcugugcug

SEQ ID NO: 3499714 - RNA, 17 nt, Human
cugccgucucuggagcg

SEQ ID NO: 3499715 - RNA, 19 nt, Human
cugccgugccgccugcacu

SEQ ID NO: 3499716 - RNA, 20 nt, Human
cugccguggggccgccgccu

SEQ ID NO: 3499717 - RNA, 21 nt, Human
cugccguggggccgccgccuc

SEQ ID NO: 3499718 - RNA, 14 nt, Human
cugccuaaguggcu

SEQ ID NO: 3499719 - RNA, 16 nt, Human
cugccuaaguggcugc

SEQ ID NO: 3499720 - RNA, 19 nt, Human
cugccuaaguggcugcuga

SEQ ID NO: 3499721 - RNA, 20 nt, Human
cugccuacagaacuucagaa

SEQ ID NO: 3499722 - RNA, 15 nt, Human
cugccuacugcaucg

SEQ ID NO: 3499723 - RNA, 14 nt, Human
cugccuagaaacaa

SEQ ID NO: 3499724 - RNA, 15 nt, Human
cugccuagauucagg

SEQ ID NO: 3499725 - RNA, 19 nt, Human
cugccuagcacucacaugc

SEQ ID NO: 3499726 - RNA, 19 nt, Human
cugccuaggaauucccagc

SEQ ID NO: 3499727 - RNA, 21 nt, Human
cugccuaggauucacacccca

SEQ ID NO: 3499728 - RNA, 23 nt, Human
cugccuaggauucacaccccacc

SEQ ID NO: 3499729 - RNA, 16 nt, Human
cugccuaggcugaccu

SEQ ID NO: 3499730 - RNA, 15 nt, Human
cugccuauugcagcu

SEQ ID NO: 3499731 - RNA, 13 nt, Human
cugccuauuuuaa

SEQ ID NO: 3499732 - RNA, 15 nt, Human
cugccucacagcugg

SEQ ID NO: 3499733 - RNA, 23 nt, Human
cugccucacagcuggccgucacu

SEQ ID NO: 3499734 - RNA, 15 nt, Human
cugccucaccgcuuc

SEQ ID NO: 3499735 - RNA, 18 nt, Human
cugccucaccgcuucccu

SEQ ID NO: 3499736 - RNA, 19 nt, Human
cugccucagccucccaaag

SEQ ID NO: 3499737 - RNA, 18 nt, Human
cugccucagccucccaag

SEQ ID NO: 3499738 - RNA, 17 nt, Human
cugccucagccucccga

SEQ ID NO: 3499739 - RNA, 11 nt, Human
cugccucagga

SEQ ID NO: 3499740 - RNA, 12 nt, Human
cugccucaggac

SEQ ID NO: 3499741 - RNA, 14 nt, Human
cugccucaggacug

SEQ ID NO: 3499742 - RNA, 22 nt, Human
cugccucaggaggcaggaccuu

SEQ ID NO: 3499743 - RNA, 12 nt, Human
cugccucagguu

SEQ ID NO: 3499744 - RNA, 17 nt, Human
cugccucagguuccuau

SEQ ID NO: 3499745 - RNA, 16 nt, Human
cugccuccacccucug

SEQ ID NO: 3499746 - RNA, 13 nt, Human
cugccuccauccu

SEQ ID NO: 3499747 - RNA, 14 nt, Human
cugccuccauccua

SEQ ID NO: 3499748 - RNA, 12 nt, Human
cugccucccauc

SEQ ID NO: 3499749 - RNA, 15 nt, Human
cugccuccccaaccc

SEQ ID NO: 3499750 - RNA, 19 nt, Human
cugccuccccaacccugcc

SEQ ID NO: 3499751 - RNA, 14 nt, Human
cugccuccccuccu

SEQ ID NO: 3499752 - RNA, 17 nt, Human
cugccuccccuccucug

SEQ ID NO: 3499753 - RNA, 21 nt, Human
cugccucccgcccccuuggcu

SEQ ID NO: 3499754 - RNA, 14 nt, Human
cugccucccucacc

SEQ ID NO: 3499755 - RNA, 22 nt, Human
cugccucccucacccugagccc

SEQ ID NO: 3499756 - RNA, 17 nt, Human
cugccucccuguccacc

SEQ ID NO: 3499757 - RNA, 23 nt, Human
cugccucccuucaugcauggaaa

SEQ ID NO: 3499758 - RNA, 14 nt, Human
cugccucccuugac

SEQ ID NO: 3499759 - RNA, 15 nt, Human
cugccuccucguucc

SEQ ID NO: 3499760 - RNA, 17 nt, Human
cugccuccucguuccuu

SEQ ID NO: 3499761 - RNA, 13 nt, Human
cugccuccucuuc

SEQ ID NO: 3499762 - RNA, 14 nt, Human
cugccuccucuuca

SEQ ID NO: 3499763 - RNA, 13 nt, Human
cugccuccugccu

SEQ ID NO: 3499764 - RNA, 17 nt, Human
cugccuccugccugccc

SEQ ID NO: 3499765 - RNA, 15 nt, Human
cugccuccuggguuc

SEQ ID NO: 3499766 - RNA, 17 nt, Human
cugccuccuuugugagg

SEQ ID NO: 3499767 - RNA, 21 nt, Human
cugccuccuuugugaggaagc

SEQ ID NO: 3499768 - RNA, 23 nt, Human
cugccuccuuugugaggaagccg

SEQ ID NO: 3499769 - RNA, 19 nt, Human
cugccucgaaacacagaaa

SEQ ID NO: 3499770 - RNA, 17 nt, Human
cugccucgggaaccuca

SEQ ID NO: 3499771 - RNA, 19 nt, Human
cugccucuacugggaaggc

SEQ ID NO: 3499772 - RNA, 21 nt, Human
cugccucucacacacauagau

SEQ ID NO: 3499773 - RNA, 22 nt, Human
cugccucucaucaacugaauga

SEQ ID NO: 3499774 - RNA, 15 nt, Human
cugccucuccaggca

SEQ ID NO: 3499775 - RNA, 17 nt, Human
cugccucucccaggcag

SEQ ID NO: 3499776 - RNA, 20 nt, Human
cugccucucccaggcagggg

SEQ ID NO: 3499777 - RNA, 21 nt, Human
cugccucucccaggcaggggc

SEQ ID NO: 3499778 - RNA, 13 nt, Human
cugccucucccuc

SEQ ID NO: 3499779 - RNA, 15 nt, Human
cugccucucccucug

SEQ ID NO: 3499780 - RNA, 17 nt, Human
cugccucucccuggccc

SEQ ID NO: 3499781 - RNA, 21 nt, Human
cugccucucgcuccucaaccc

SEQ ID NO: 3499782 - RNA, 19 nt, Human
cugccucucugcagguccc

SEQ ID NO: 3499783 - RNA, 21 nt, Human
cugccacaccagucacaugac

SEQ ID NO: 3499784 - RNA, 22 nt, Human
cugccacacgucugacccucuc

SEQ ID NO: 3499785 - RNA, 21 nt, Human
cugccacacucuccaucaccc

SEQ ID NO: 3499786 - RNA, 16 nt, Human
cugccacauuagaacu

SEQ ID NO: 3499787 - RNA, 16 nt, Human
cugccaccacgcccgg

SEQ ID NO: 3499788 - RNA, 17 nt, Human
cugccaccaggccaccu

SEQ ID NO: 3499789 - RNA, 23 nt, Human
cugccaccaggccaccuccccag

SEQ ID NO: 3499790 - RNA, 14 nt, Human
cugccaccagucac

SEQ ID NO: 3499791 - RNA, 14 nt, Human
cugccaccauccug

SEQ ID NO: 3499792 - RNA, 19 nt, Human
cugccaccauccugcugcu

SEQ ID NO: 3499793 - RNA, 23 nt, Human
cugccacccagccccagccaggg

SEQ ID NO: 3499794 - RNA, 12 nt, Human
cugccacccagg

SEQ ID NO: 3499795 - RNA, 15 nt, Human
cugccacccuaccug

SEQ ID NO: 3499796 - RNA, 17 nt, Human
cugccacccugggccug

SEQ ID NO: 3499797 - RNA, 10 nt, Human
cugccaccuc

SEQ ID NO: 3499798 - RNA, 14 nt, Human
cugccaccuccccu

SEQ ID NO: 3499799 - RNA, 16 nt, Human
cugccaccuccugccu

SEQ ID NO: 3499800 - RNA, 16 nt, Human
cugccaccucuccauc

SEQ ID NO: 3499801 - RNA, 15 nt, Human
cugccaccugcugcu

SEQ ID NO: 3499802 - RNA, 13 nt, Human
cugccaccuggac

SEQ ID NO: 3499803 - RNA, 15 nt, Human
cugccaccuggaccc

SEQ ID NO: 3499804 - RNA, 22 nt, Human
cugccaccuggaccccugcauu

SEQ ID NO: 3499805 - RNA, 12 nt, Human
cugccaccuguc

SEQ ID NO: 3499806 - RNA, 13 nt, Human
cugccaccugucu

SEQ ID NO: 3499807 - RNA, 19 nt, Human
cugccacuaggcugggugc

SEQ ID NO: 3499808 - RNA, 23 nt, Human
cugccacucaggcccaaagccuc

SEQ ID NO: 3499809 - RNA, 18 nt, Human
cugccacugaggggggau

SEQ ID NO: 3499810 - RNA, 23 nt, Human
cugccacugaggggggauccagu

SEQ ID NO: 3499811 - RNA, 12 nt, Human
cugccacuuugc

SEQ ID NO: 3499812 - RNA, 22 nt, Human
cugccacuuugcacauuuugau

SEQ ID NO: 3499813 - RNA, 23 nt, Human
cugccacuuugguacauggccag

SEQ ID NO: 3499814 - RNA, 21 nt, Human
cugccagaagauccccucagg

SEQ ID NO: 3499815 - RNA, 23 nt, Human
cugccagaagauccccucaggac

SEQ ID NO: 3499816 - RNA, 13 nt, Human
cugccagagaagc

SEQ ID NO: 3499817 - RNA, 13 nt, Human
cugccagaugcug

SEQ ID NO: 3499818 - RNA, 16 nt, Human
cugccagaugcugaug

SEQ ID NO: 3499819 - RNA, 21 nt, Human
cugccagaugcugauguucag

SEQ ID NO: 3499820 - RNA, 15 nt, Human
cugccagcaacgcag

SEQ ID NO: 3499821 - RNA, 15 nt, Human
cugccagcagcagca

SEQ ID NO: 3499822 - RNA, 21 nt, Human
cugccagcagcagcaggugau

SEQ ID NO: 3499823 - RNA, 15 nt, Human
cugccagccagcagc

SEQ ID NO: 3499824 - RNA, 15 nt, Human
cugccagccccacac

SEQ ID NO: 3499825 - RNA, 19 nt, Human
cugccagccccacacagcu

SEQ ID NO: 3499826 - RNA, 12 nt, Human
cugccagccccu

SEQ ID NO: 3499827 - RNA, 17 nt, Human
cugccagccuugagccc

SEQ ID NO: 3499828 - RNA, 20 nt, Human
cugccagccuugagcccugg

SEQ ID NO: 3499829 - RNA, 22 nt, Human
cugccagccuugagcccuggcu

SEQ ID NO: 3499830 - RNA, 12 nt, Human
cugccagcucuu

SEQ ID NO: 3499831 - RNA, 16 nt, Human
cugccagcugcacuga

SEQ ID NO: 3499832 - RNA, 16 nt, Human
cugccaggaagccagc

SEQ ID NO: 3499833 - RNA, 18 nt, Human
cugccaggaggacccagg

SEQ ID NO: 3499834 - RNA, 13 nt, Human
cugccaggaggga

SEQ ID NO: 3499835 - RNA, 20 nt, Human
cugccaggagggacaaagga

SEQ ID NO: 3499836 - RNA, 21 nt, Human
cugccaggagggacaaaggag

SEQ ID NO: 3499837 - RNA, 18 nt, Human
cugccaggcacaggcagg

SEQ ID NO: 3499838 - RNA, 19 nt, Human
cugccaggcacaggcaggg

SEQ ID NO: 3499839 - RNA, 12 nt, Human
cugccaggcagg

SEQ ID NO: 3499840 - RNA, 13 nt, Human
cugccaggcaggg

SEQ ID NO: 3499841 - RNA, 11 nt, Human
cugccaggcau

SEQ ID NO: 3499842 - RNA, 15 nt, Human
cugccaggccagccu

SEQ ID NO: 3499843 - RNA, 17 nt, Human
cugccaggccagccucc

SEQ ID NO: 3499844 - RNA, 22 nt, Human
cugccaggccagccuccgagag

SEQ ID NO: 3499845 - RNA, 13 nt, Human
cugccaggccccc

SEQ ID NO: 3499846 - RNA, 14 nt, Human
cugccaggccccca

SEQ ID NO: 3499847 - RNA, 15 nt, Human
cugccaggcccccac

SEQ ID NO: 3499848 - RNA, 12 nt, Human
cugccagggaca

SEQ ID NO: 3499849 - RNA, 22 nt, Human
cugccagggacagagggggugg

SEQ ID NO: 3499850 - RNA, 23 nt, Human
cugccagggagacagagcucaca

SEQ ID NO: 3499851 - RNA, 13 nt, Human
cugccagggcagu

SEQ ID NO: 3499852 - RNA, 17 nt, Human
cugccagggcagugcua

SEQ ID NO: 3499853 - RNA, 16 nt, Human
cugccaguccuagcug

SEQ ID NO: 3499854 - RNA, 21 nt, Human
cugccaguccuagcugcacag

SEQ ID NO: 3499855 - RNA, 18 nt, Human
cugccagucucacugugg

SEQ ID NO: 3499856 - RNA, 13 nt, Human
cugccagugccug

SEQ ID NO: 3499857 - RNA, 17 nt, Human
cugccagugccuuaccu

SEQ ID NO: 3499858 - RNA, 18 nt, Human
cugccagugccuuaccuc

SEQ ID NO: 3499859 - RNA, 22 nt, Human
cugccagugccuuaccuccugc

SEQ ID NO: 3499860 - RNA, 23 nt, Human
cugccaguguccugagccccagg

SEQ ID NO: 3499861 - RNA, 15 nt, Human
cugccaguguggagu

SEQ ID NO: 3499862 - RNA, 22 nt, Human
cugccauaaaacauuaagaaaa

SEQ ID NO: 3499863 - RNA, 17 nt, Human
cugccauauauaacaga

SEQ ID NO: 3499864 - RNA, 14 nt, Human
cugccauauuaaau

SEQ ID NO: 3499865 - RNA, 20 nt, Human
cugccauauucuguuggcca

SEQ ID NO: 3499866 - RNA, 21 nt, Human
cugccauauucuguuggccag

SEQ ID NO: 3499867 - RNA, 17 nt, Human
cugccauccagggaugc

SEQ ID NO: 3499868 - RNA, 16 nt, Human
cugccauccagguuca

SEQ ID NO: 3499869 - RNA, 18 nt, Human
cugccauccagguucagc

SEQ ID NO: 3499870 - RNA, 21 nt, Human
cugccauccagguucagcuug

SEQ ID NO: 3499871 - RNA, 15 nt, Human
cugccauccucccaa

SEQ ID NO: 3499872 - RNA, 21 nt, Human
cugccauccuggcccagggca

SEQ ID NO: 3499873 - RNA, 22 nt, Human
cugccauccuggcccagggcau

SEQ ID NO: 3499874 - RNA, 19 nt, Human
cugccaucuuaguuuggau

SEQ ID NO: 3499875 - RNA, 16 nt, Human
cugccaucuucccagc

SEQ ID NO: 3499876 - RNA, 15 nt, Human
cugccaugaacugga

SEQ ID NO: 3499877 - RNA, 15 nt, Human
cugccaugcagggcc

SEQ ID NO: 3499878 - RNA, 16 nt, Human
cugccaugcagggccu

SEQ ID NO: 3499879 - RNA, 14 nt, Human
cugccaugccagga

SEQ ID NO: 3499880 - RNA, 17 nt, Human
cugccaugccaggaacc

SEQ ID NO: 3499881 - RNA, 18 nt, Human
cugccaugccaggaaccu

SEQ ID NO: 3499882 - RNA, 21 nt, Human
cugccaugccaggaaccuguc

SEQ ID NO: 3499883 - RNA, 17 nt, Human
cugccauggaacuguuu

SEQ ID NO: 3499884 - RNA, 20 nt, Human
cugccauggaacuguuuccu

SEQ ID NO: 3499885 - RNA, 22 nt, Human
cugccauggaacuguuuccuuc

SEQ ID NO: 3499886 - RNA, 17 nt, Human
cugccauggaggcacac

SEQ ID NO: 3499887 - RNA, 23 nt, Human
cugccauggcuagguagaaguga

SEQ ID NO: 3499888 - RNA, 18 nt, Human
cugccauguaccuccccu

SEQ ID NO: 3499889 - RNA, 20 nt, Human
cugccauguaccuccccugc

SEQ ID NO: 3499890 - RNA, 21 nt, Human
cugccauguaccuccccugcc

SEQ ID NO: 3499891 - RNA, 22 nt, Human
cugccauguaccuccccugccu

SEQ ID NO: 3499892 - RNA, 19 nt, Human
cugccauuauuuucuguca

SEQ ID NO: 3499893 - RNA, 20 nt, Human
cugccauuauuuucugucag

SEQ ID NO: 3499894 - RNA, 22 nt, Human
cugccauuauuuucugucagau

SEQ ID NO: 3499895 - RNA, 13 nt, Human
cugccauuucaug

SEQ ID NO: 3499896 - RNA, 15 nt, Human
cugccauuucugaga

SEQ ID NO: 3499897 - RNA, 21 nt, Human
cugccauuugauuuuucuaac

SEQ ID NO: 3499898 - RNA, 21 nt, Human
cugccauuugcacccuccgcc

SEQ ID NO: 3499899 - RNA, 13 nt, Human
cugcccaaagcag

SEQ ID NO: 3499900 - RNA, 23 nt, Human
cugcccaaagcagcacuuauaaa

SEQ ID NO: 3499901 - RNA, 14 nt, Human
cugcccaagcccag

SEQ ID NO: 3499902 - RNA, 16 nt, Human
cugcccaagcccaggc

SEQ ID NO: 3499903 - RNA, 20 nt, Human
cugcccacaccuccuggggc

SEQ ID NO: 3499904 - RNA, 15 nt, Human
cugcccacagcaggc

SEQ ID NO: 3499905 - RNA, 16 nt, Human
cugcccacccccucaa

SEQ ID NO: 3499906 - RNA, 21 nt, Human
cugcccaccucagccucccaa

SEQ ID NO: 3499907 - RNA, 15 nt, Human
cugcccaccugccgg

SEQ ID NO: 3499908 - RNA, 14 nt, Human
cugcccaccugccu

SEQ ID NO: 3499909 - RNA, 16 nt, Human
cugcccaccugccugg

SEQ ID NO: 3499910 - RNA, 17 nt, Human
cugcccaccugccuggc

SEQ ID NO: 3499911 - RNA, 20 nt, Human
cugcccaccugccuggccgg

SEQ ID NO: 3499912 - RNA, 13 nt, Human
cugcccaccuggc

SEQ ID NO: 3499913 - RNA, 15 nt, Human
cugcccaccuggccu

SEQ ID NO: 3499914 - RNA, 18 nt, Human
cugcccaccuggccucug

SEQ ID NO: 3499915 - RNA, 18 nt, Human
cugcccacucccugcaac

SEQ ID NO: 3499916 - RNA, 16 nt, Human
cugcccacuggccggc

SEQ ID NO: 3499917 - RNA, 18 nt, Human
cugcccagaccccucugg

SEQ ID NO: 3499918 - RNA, 18 nt, Human
cugcccagaguugcuggg

SEQ ID NO: 3499919 - RNA, 16 nt, Human
ccguccugccuguggc

SEQ ID NO: 3499920 - RNA, 15 nt, Human
ccgucuacagcuccc

SEQ ID NO: 3499921 - RNA, 14 nt, Human
ccgucuacauuuca

SEQ ID NO: 3499922 - RNA, 11 nt, Human
ccgucucaggu

SEQ ID NO: 3499923 - RNA, 13 nt, Human
ccgucuccugcgg

SEQ ID NO: 3499924 - RNA, 17 nt, Human
ccgucugggguucagcc

SEQ ID NO: 3499925 - RNA, 19 nt, Human
ccgucugggguucagcccc

SEQ ID NO: 3499926 - RNA, 21 nt, Human
ccgucugggguucagccccuc

SEQ ID NO: 3499927 - RNA, 23 nt, Human
ccgucugggguucagccccuccu

SEQ ID NO: 3499928 - RNA, 15 nt, Human
cugcgugccugugga

SEQ ID NO: 3499929 - RNA, 16 nt, Human
cugcguggcugacccc

SEQ ID NO: 3499930 - RNA, 17 nt, Human
cugcguggcugaccccc

SEQ ID NO: 3499931 - RNA, 15 nt, Human
cugcguggggacagg

SEQ ID NO: 3499932 - RNA, 19 nt, Human
cugcgugucaccugugcuu

SEQ ID NO: 3499933 - RNA, 19 nt, Human
cugcgugugggacccgccg

SEQ ID NO: 3499934 - RNA, 13 nt, Human
cugcguucugcaa

SEQ ID NO: 3499935 - RNA, 15 nt, Human
cugcuaaauaaaauu

SEQ ID NO: 3499936 - RNA, 18 nt, Human
cugcuaaaucuccuauuu

SEQ ID NO: 3499937 - RNA, 17 nt, Human
cugcuaaauugauguug

SEQ ID NO: 3499938 - RNA, 18 nt, Human
cugcuaaauugauguuga

SEQ ID NO: 3499939 - RNA, 22 nt, Human
cugcuaaauugauguugaugca

SEQ ID NO: 3499940 - RNA, 20 nt, Human
cugcuaacuuggagccccag

SEQ ID NO: 3499941 - RNA, 23 nt, Human
cugcuaacuuggagccccagugc

SEQ ID NO: 3499942 - RNA, 22 nt, Human
cugcuaaggauuagucccuggc

SEQ ID NO: 3499943 - RNA, 21 nt, Human
cugcuaaguauuucccagcac

SEQ ID NO: 3499944 - RNA, 15 nt, Human
cugcuaauauuuucc

SEQ ID NO: 3499945 - RNA, 18 nt, Human
cugcuaaucuucagggca

SEQ ID NO: 3499946 - RNA, 15 nt, Human
cugcuaauucuuugc

SEQ ID NO: 3499947 - RNA, 22 nt, Human
cugcuaauucuuugcaaaaauc

SEQ ID NO: 3499948 - RNA, 15 nt, Human
cugcuacaaagaaga

SEQ ID NO: 3499949 - RNA, 20 nt, Human
cugcuacaaagaagacaugu

SEQ ID NO: 3499950 - RNA, 16 nt, Human
cugcuacacauacagg

SEQ ID NO: 3499951 - RNA, 15 nt, Human
cugcuacagagcaga

SEQ ID NO: 3499952 - RNA, 20 nt, Human
cugcuacagcaauuucuaau

SEQ ID NO: 3499953 - RNA, 17 nt, Human
cugcuacccagaaauca

SEQ ID NO: 3499954 - RNA, 21 nt, Human
cugcuaccguugacuuccagg

SEQ ID NO: 3499955 - RNA, 14 nt, Human
cugcuaccucacug

SEQ ID NO: 3499956 - RNA, 18 nt, Human
cugcuaccucacuggggu

SEQ ID NO: 3499957 - RNA, 23 nt, Human
cugcuacucaaguagcauuuacu

SEQ ID NO: 3499958 - RNA, 21 nt, Human
cugcuacuuauauaauugcca

SEQ ID NO: 3499959 - RNA, 13 nt, Human
cugcuagaaaugg

SEQ ID NO: 3499960 - RNA, 12 nt, Human
cugcuagaacuu

SEQ ID NO: 3499961 - RNA, 14 nt, Human
cugcuagaacuuuu

SEQ ID NO: 3499962 - RNA, 21 nt, Human
cugcuagaacuuuuuuaaaua

SEQ ID NO: 3499963 - RNA, 22 nt, Human
cugcuagaacuuuuuuaaauaa

SEQ ID NO: 3499964 - RNA, 21 nt, Human
cugcuagcuagcucaacuagu

SEQ ID NO: 3499965 - RNA, 19 nt, Human
cugcuaggcgagugccagg

SEQ ID NO: 3499966 - RNA, 23 nt, Human
cugcuaggcgagugccaggacuc

SEQ ID NO: 3499967 - RNA, 15 nt, Human
cugcuaggugggcca

SEQ ID NO: 3499968 - RNA, 16 nt, Human
cugcuaggugggccag

SEQ ID NO: 3499969 - RNA, 20 nt, Human
cugcuaggugggccagcccc

SEQ ID NO: 3499970 - RNA, 16 nt, Human
cugcuaguguucuguc

SEQ ID NO: 3499971 - RNA, 22 nt, Human
cugcuaguguucuuucucuuuc

SEQ ID NO: 3499972 - RNA, 14 nt, Human
cugcuauagccugg

SEQ ID NO: 3499973 - RNA, 21 nt, Human
cugcuauccccaucucccugc

SEQ ID NO: 3499974 - RNA, 18 nt, Human
cugcuauuaggccagcaa

SEQ ID NO: 3499975 - RNA, 13 nt, Human
cugcuauuuccca

SEQ ID NO: 3499976 - RNA, 17 nt, Human
cugcuauuucccaagcu

SEQ ID NO: 3499977 - RNA, 15 nt, Human
cugcuauuuuacugu

SEQ ID NO: 3499978 - RNA, 14 nt, Human
cugcucacauaucu

SEQ ID NO: 3499979 - RNA, 19 nt, Human
cugcucacauaucugucau

SEQ ID NO: 3499980 - RNA, 15 nt, Human
cugcucaccgcccau

SEQ ID NO: 3499981 - RNA, 19 nt, Human
cugcucaccgcccaucagg

SEQ ID NO: 3499982 - RNA, 12 nt, Human
cugcucacuuua

SEQ ID NO: 3499983 - RNA, 18 nt, Human
cugcucagaacuugcugc

SEQ ID NO: 3499984 - RNA, 19 nt, Human
cugcucagaacuugcugcu

SEQ ID NO: 3499985 - RNA, 21 nt, Human
cugcucagcagugagagcaga

SEQ ID NO: 3499986 - RNA, 23 nt, Human
cugcucagcagugagagcagaug

SEQ ID NO: 3499987 - RNA, 11 nt, Human
cugcucagcca

SEQ ID NO: 3499988 - RNA, 15 nt, Human
cugcucagcccugga

SEQ ID NO: 3499989 - RNA, 17 nt, Human
cugcucagcccuggagg

SEQ ID NO: 3499990 - RNA, 16 nt, Human
cugcucaggcugcagc

SEQ ID NO: 3499991 - RNA, 20 nt, Human
cugcucaggcugcagcugga

SEQ ID NO: 3499992 - RNA, 18 nt, Human
cugcucaguaaagcacuu

SEQ ID NO: 3499993 - RNA, 15 nt, Human
cugcucauauuguga

SEQ ID NO: 3499994 - RNA, 19 nt, Human
cugcucauauugugauucu

SEQ ID NO: 3499995 - RNA, 12 nt, Human
cugcuccacagu

SEQ ID NO: 3499996 - RNA, 13 nt, Human
cugcuccacagug

SEQ ID NO: 3499997 - RNA, 16 nt, Human
cugcuccacaguguug

SEQ ID NO: 3499998 - RNA, 16 nt, Human
cugcuccaccacaucc

SEQ ID NO: 3499999 - RNA, 14 nt, Human
cugcuccacccuug

SEQ ID NO: 3500000 - RNA, 18 nt, Human
cugcuccacccuuggccu

SEQ ID NO: 3500001 - RNA, 18 nt, Human
cugcuccaccuuucagcc

SEQ ID NO: 3500002 - RNA, 13 nt, Human
cugcuccacgcgc

SEQ ID NO: 3500003 - RNA, 20 nt, Human
cugcuccacgcgcuucgacu

SEQ ID NO: 3500004 - RNA, 15 nt, Human
cugcuccagaccuga

SEQ ID NO: 3500005 - RNA, 14 nt, Human
cugcuccagcucug

SEQ ID NO: 3500006 - RNA, 14 nt, Human
cugcuccaggccug

SEQ ID NO: 3500007 - RNA, 21 nt, Human
cugcucccaaggggccugagc

SEQ ID NO: 3500008 - RNA, 16 nt, Human
cugcucccaccuccug

SEQ ID NO: 3500009 - RNA, 16 nt, Human
cugcucccaccuggcu

SEQ ID NO: 3500010 - RNA, 20 nt, Human
cugcucccaccuggcucugu

SEQ ID NO: 3500011 - RNA, 16 nt, Human
cugcucccagcagccc

SEQ ID NO: 3500012 - RNA, 17 nt, Human
cugcucccagcagcccu

SEQ ID NO: 3500013 - RNA, 18 nt, Human
cugcucccauccugugug

SEQ ID NO: 3500014 - RNA, 19 nt, Human
cugcucccauccugugugu

SEQ ID NO: 3500015 - RNA, 16 nt, Human
cugcuccccaggggag

SEQ ID NO: 3500016 - RNA, 13 nt, Human
cugcucccccacc

SEQ ID NO: 3500017 - RNA, 17 nt, Human
cugcucccccacccccu

SEQ ID NO: 3500018 - RNA, 23 nt, Human
cugcucccccacccccuccccag

SEQ ID NO: 3500019 - RNA, 19 nt, Human
cugcucccccuuuucccuc

SEQ ID NO: 3500020 - RNA, 21 nt, Human
cugcuccccucugcacggacc

SEQ ID NO: 3500021 - RNA, 17 nt, Human
cugcucccuaagccagc

SEQ ID NO: 3500022 - RNA, 19 nt, Human
cugcucccuaagccagccu

SEQ ID NO: 3500023 - RNA, 12 nt, Human
cugcucccucuc

SEQ ID NO: 3500024 - RNA, 17 nt, Human
cugcucccugaagccag

SEQ ID NO: 3500025 - RNA, 18 nt, Human
cugcucccugaagccagc

SEQ ID NO: 3500026 - RNA, 21 nt, Human
cugcucccugaagccagccuu

SEQ ID NO: 3500027 - RNA, 19 nt, Human
cugcucccuguagggucca

SEQ ID NO: 3500028 - RNA, 16 nt, Human
cugcuccgcugcuccu

SEQ ID NO: 3500029 - RNA, 21 nt, Human
cugcuccuagagggaggggcc

SEQ ID NO: 3500030 - RNA, 22 nt, Human
cugcuccuagagggaggggccu

SEQ ID NO: 3500031 - RNA, 14 nt, Human
cugcuccuccaggg

SEQ ID NO: 3500032 - RNA, 16 nt, Human
cugcuccuccagggcc

SEQ ID NO: 3500033 - RNA, 14 nt, Human
cugcuccucccugg

SEQ ID NO: 3500034 - RNA, 17 nt, Human
cugcuccucccuggcug

SEQ ID NO: 3500035 - RNA, 15 nt, Human
cugcuccucuccagg

SEQ ID NO: 3500036 - RNA, 17 nt, Human
cugcuccucuccaggca

SEQ ID NO: 3500037 - RNA, 19 nt, Human
cugcuccucuccccagcaa

SEQ ID NO: 3500038 - RNA, 20 nt, Human
cugcuccugagcccccagcu

SEQ ID NO: 3500039 - RNA, 16 nt, Human
cugcuccugcagcaug

SEQ ID NO: 3500040 - RNA, 13 nt, Human
cugcuccuggagc

SEQ ID NO: 3500041 - RNA, 17 nt, Human
cugcuccuuagcugcca

SEQ ID NO: 3500042 - RNA, 15 nt, Human
cugcuccuuccccau

SEQ ID NO: 3500043 - RNA, 23 nt, Human
cugcuccuuccccaucguugccc

SEQ ID NO: 3500044 - RNA, 14 nt, Human
cugcuccuucccuu

SEQ ID NO: 3500045 - RNA, 13 nt, Human
cugcuccuuggcu

SEQ ID NO: 3500046 - RNA, 20 nt, Human
cugcuccuuggcuuaccuga

SEQ ID NO: 3500047 - RNA, 14 nt, Human
cugcucgcccuccu

SEQ ID NO: 3500048 - RNA, 17 nt, Human
cugcucgcccuccuuuc

SEQ ID NO: 3500049 - RNA, 23 nt, Human
cugcucgcccuccuuucugugcc

SEQ ID NO: 3500050 - RNA, 13 nt, Human
cugcucgggccca

SEQ ID NO: 3500051 - RNA, 14 nt, Human
cugcucgggcccag

SEQ ID NO: 3500052 - RNA, 18 nt, Human
cugcucggggugcacagg

SEQ ID NO: 3500053 - RNA, 20 nt, Human
cugcucggggugcacaggag

SEQ ID NO: 3500054 - RNA, 21 nt, Human
cugcucggggugcacaggagg

SEQ ID NO: 3500055 - RNA, 22 nt, Human
cugcucguccccaagugaccua

SEQ ID NO: 3500056 - RNA, 12 nt, Human
cugcucuaacag

SEQ ID NO: 3500057 - RNA, 21 nt, Human
cugcucuagugggacagccca

SEQ ID NO: 3500058 - RNA, 20 nt, Human
cugcucucaaaccccugacc

SEQ ID NO: 3500059 - RNA, 23 nt, Human
cugcucucaaaccccugaccuca

SEQ ID NO: 3500060 - RNA, 22 nt, Human
cugcucucaccuugguuccugg

SEQ ID NO: 3500061 - RNA, 20 nt, Human
cugcucuccaagucucagug

SEQ ID NO: 3500062 - RNA, 18 nt, Human
cugcucuccucuucuacu

SEQ ID NO: 3500063 - RNA, 14 nt, Human
cugcucuccucuug

SEQ ID NO: 3500064 - RNA, 13 nt, Human
cugcucuccuucc

SEQ ID NO: 3500065 - RNA, 16 nt, Human
cugcucucuacccagc

SEQ ID NO: 3500066 - RNA, 20 nt, Human
cugcucucuacccagcccau

SEQ ID NO: 3500067 - RNA, 16 nt, Human
cugcucugaacacgaa

SEQ ID NO: 3500068 - RNA, 11 nt, Human
cugcucugacg

SEQ ID NO: 3500069 - RNA, 22 nt, Human
cugcucugagaauuguugagau

SEQ ID NO: 3500070 - RNA, 16 nt, Human
cugcucugagccacag

SEQ ID NO: 3500071 - RNA, 20 nt, Human
cugcucugaggcuuccagag

SEQ ID NO: 3500072 - RNA, 14 nt, Human
cugcccugcuguuu

SEQ ID NO: 3500073 - RNA, 17 nt, Human
cugcccuggaacauccu

SEQ ID NO: 3500074 - RNA, 14 nt, Human
cugcccuggcccug

SEQ ID NO: 3500075 - RNA, 18 nt, Human
cugcccuggcccugaggu

SEQ ID NO: 3500076 - RNA, 15 nt, Human
cugcccuggcuccag

SEQ ID NO: 3500077 - RNA, 16 nt, Human
cugcccuggcugcugc

SEQ ID NO: 3500078 - RNA, 15 nt, Human
ccuaaguucuuagau

SEQ ID NO: 3500079 - RNA, 20 nt, Human
ccuaauaaaaaggugaccau

SEQ ID NO: 3500080 - RNA, 22 nt, Human
ccuaauaaacauccuucaagaa

SEQ ID NO: 3500081 - RNA, 13 nt, Human
ccuaauaaagcug

SEQ ID NO: 3500082 - RNA, 20 nt, Human
ccuaauaauaucccacuggg

SEQ ID NO: 3500083 - RNA, 18 nt, Human
ccuaauacauuaaagcag

SEQ ID NO: 3500084 - RNA, 20 nt, Human
ccuaauacauuaaagcaguc

SEQ ID NO: 3500085 - RNA, 22 nt, Human
ccuaaucagaaauuuuuaucag

SEQ ID NO: 3500086 - RNA, 14 nt, Human
ccuaauccaggcag

SEQ ID NO: 3500087 - RNA, 18 nt, Human
ccuaauccaggcagaucc

SEQ ID NO: 3500088 - RNA, 21 nt, Human
ccuaaucccugggcauugcuu

SEQ ID NO: 3500089 - RNA, 20 nt, Human
ccuaaucuauggucgggaga

SEQ ID NO: 3500090 - RNA, 18 nt, Human
ccuaaucucauaccucug

SEQ ID NO: 3500091 - RNA, 19 nt, Human
ccuaaucucauaccucuga

SEQ ID NO: 3500092 - RNA, 21 nt, Human
ccuaaucucauaccucugacc

SEQ ID NO: 3500093 - RNA, 22 nt, Human
ccuaaugacaucaccacaguuu

SEQ ID NO: 3500094 - RNA, 15 nt, Human
ccuaauggugaugca

SEQ ID NO: 3500095 - RNA, 17 nt, Human
ccuaauguggcagcugu

SEQ ID NO: 3500096 - RNA, 16 nt, Human
ccuaauuaccagucuu

SEQ ID NO: 3500097 - RNA, 16 nt, Human
ccuaauuccacagcug

SEQ ID NO: 3500098 - RNA, 17 nt, Human
ccuaauuccacagcugc

SEQ ID NO: 3500099 - RNA, 15 nt, Human
ccuaauuucuccucc

SEQ ID NO: 3500100 - RNA, 18 nt, Human
ccuaauuucuccucccuu

SEQ ID NO: 3500101 - RNA, 20 nt, Human
ccuaauuucuccucccuucc

SEQ ID NO: 3500102 - RNA, 15 nt, Human
ccuacaagacacagu

SEQ ID NO: 3500103 - RNA, 17 nt, Human
ccuacaagagcagccug

SEQ ID NO: 3500104 - RNA, 19 nt, Human
ccuacaagagcagccugug

SEQ ID NO: 3500105 - RNA, 20 nt, Human
ccuacaagauuuagaaaaaa

SEQ ID NO: 3500106 - RNA, 16 nt, Human
ccuacaaguuuaagua

SEQ ID NO: 3500107 - RNA, 14 nt, Human
ccuacacacuguca

SEQ ID NO: 3500108 - RNA, 13 nt, Human
ccuacaccauucc

SEQ ID NO: 3500109 - RNA, 19 nt, Human
ccuacacccagaccccagg

SEQ ID NO: 3500110 - RNA, 17 nt, Human
ccuacagaaaaaccuug

SEQ ID NO: 3500111 - RNA, 21 nt, Human
ccuacagaauacuagccagag

SEQ ID NO: 3500112 - RNA, 13 nt, Human
ccuacagagcugu

SEQ ID NO: 3500113 - RNA, 17 nt, Human
ccuacagaggucucugc

SEQ ID NO: 3500114 - RNA, 15 nt, Human
ccuacagcacuacug

SEQ ID NO: 3500115 - RNA, 20 nt, Human
ccuacagcacuacugggugu

SEQ ID NO: 3500116 - RNA, 17 nt, Human
ccuacagcuuugauccc

SEQ ID NO: 3500117 - RNA, 18 nt, Human
ccuacaggagugagcacu

SEQ ID NO: 3500118 - RNA, 12 nt, Human
ccuacaggcuga

SEQ ID NO: 3500119 - RNA, 15 nt, Human
ccuacaguguacagu

SEQ ID NO: 3500120 - RNA, 16 nt, Human
ccuacaguguacaguc

SEQ ID NO: 3500121 - RNA, 20 nt, Human
ccuacaguguacagucuugu

SEQ ID NO: 3500122 - RNA, 15 nt, Human
ccuacaguuuuaacu

SEQ ID NO: 3500123 - RNA, 19 nt, Human
ccuacaguuuuaacugugg

SEQ ID NO: 3500124 - RNA, 17 nt, Human
ccuacauaucccuucca

SEQ ID NO: 3500125 - RNA, 14 nt, Human
ccuaccaaccucug

SEQ ID NO: 3500126 - RNA, 17 nt, Human
ccuaccaauagauuccc

SEQ ID NO: 3500127 - RNA, 19 nt, Human
ccuaccaauagauucccca

SEQ ID NO: 3500128 - RNA, 12 nt, Human
ccuaccaaugca

SEQ ID NO: 3500129 - RNA, 16 nt, Human
ccuaccaaugcaugca

SEQ ID NO: 3500130 - RNA, 13 nt, Human
ccuaccacagugu

SEQ ID NO: 3500131 - RNA, 15 nt, Human
ccuaccacagugucu

SEQ ID NO: 3500132 - RNA, 15 nt, Human
ccuaccaccacgccc

SEQ ID NO: 3500133 - RNA, 18 nt, Human
ccuaccaccuccccagcc

SEQ ID NO: 3500134 - RNA, 17 nt, Human
ccuaccagcgcccgcug

SEQ ID NO: 3500135 - RNA, 22 nt, Human
ccuaccagcgcccgcugggcug

SEQ ID NO: 3500136 - RNA, 13 nt, Human
ccuacccacaccu

SEQ ID NO: 3500137 - RNA, 19 nt, Human
ccuacccacaccucugcca

SEQ ID NO: 3500138 - RNA, 22 nt, Human
ccuacccagagauugcuucuca

SEQ ID NO: 3500139 - RNA, 14 nt, Human
ccuacccauccccg

SEQ ID NO: 3500140 - RNA, 19 nt, Human
ccuaccccaauuccuugua

SEQ ID NO: 3500141 - RNA, 11 nt, Human
ccuaccccaca

SEQ ID NO: 3500142 - RNA, 20 nt, Human
ccuaccccacaccaggccgu

SEQ ID NO: 3500143 - RNA, 13 nt, Human
ccuaccccaccac

SEQ ID NO: 3500144 - RNA, 20 nt, Human
ccuaccccgcagacaccuug

SEQ ID NO: 3500145 - RNA, 21 nt, Human
ccuaccccgcagacaccuugg

SEQ ID NO: 3500146 - RNA, 14 nt, Human
ccuaccccucccag

SEQ ID NO: 3500147 - RNA, 14 nt, Human
ccuaccccugacuu

SEQ ID NO: 3500148 - RNA, 16 nt, Human
ccuacccuaaccaagu

SEQ ID NO: 3500149 - RNA, 23 nt, Human
ccuacccucgggcccaccuggcc

SEQ ID NO: 3500150 - RNA, 15 nt, Human
ccuacccugccuccc

SEQ ID NO: 3500151 - RNA, 23 nt, Human
ccuacccugccucccuugacuuu

SEQ ID NO: 3500152 - RNA, 14 nt, Human
ccuacccuggacuu

SEQ ID NO: 3500153 - RNA, 17 nt, Human
ccuaccgaaaccuugcc

SEQ ID NO: 3500154 - RNA, 20 nt, Human
ccuaccgaaaccuugccuuu

SEQ ID NO: 3500155 - RNA, 22 nt, Human
ccuaccgagucucuucuccacu

SEQ ID NO: 3500156 - RNA, 21 nt, Human
ccuaccggcaauuuccggcca

SEQ ID NO: 3500157 - RNA, 20 nt, Human
ccuaccucaaccuguaaauu

SEQ ID NO: 3500158 - RNA, 22 nt, Human
ccuaccucaaccuguaaauuau

SEQ ID NO: 3500159 - RNA, 15 nt, Human
ccuaccucaggcagg

SEQ ID NO: 3500160 - RNA, 22 nt, Human
ccuaccucagguugcugguugc

SEQ ID NO: 3500161 - RNA, 13 nt, Human
ccuaccuccaaag

SEQ ID NO: 3500162 - RNA, 13 nt, Human
ccuaccugaugga

SEQ ID NO: 3500163 - RNA, 12 nt, Human
ccuaccugcucu

SEQ ID NO: 3500164 - RNA, 15 nt, Human
ccuaccugugccuga

SEQ ID NO: 3500165 - RNA, 21 nt, Human
ccuaccugugugguacucuga

SEQ ID NO: 3500166 - RNA, 13 nt, Human
ccuacgcugaaga

SEQ ID NO: 3500167 - RNA, 21 nt, Human
ccuacgucaaacaugaagugu

SEQ ID NO: 3500168 - RNA, 20 nt, Human
ccuacuagggaccuggggaa

SEQ ID NO: 3500169 - RNA, 16 nt, Human
ccuacuagucaccaga

SEQ ID NO: 3500170 - RNA, 16 nt, Human
ccuacuaucacugaac

SEQ ID NO: 3500171 - RNA, 23 nt, Human
ccuacucacacaggcauuuccug

SEQ ID NO: 3500172 - RNA, 20 nt, Human
ccuacuccugacuccuaccu

SEQ ID NO: 3500173 - RNA, 16 nt, Human
ccuacuccugucuucu

SEQ ID NO: 3500174 - RNA, 13 nt, Human
ccuacucuucucu

SEQ ID NO: 3500175 - RNA, 20 nt, Human
ccuacucuucucucugcucu

SEQ ID NO: 3500176 - RNA, 13 nt, Human
ccuacugaaugcu

SEQ ID NO: 3500177 - RNA, 13 nt, Human
ccuacuguucuaa

SEQ ID NO: 3500178 - RNA, 15 nt, Human
ccuacuguucuaaag

SEQ ID NO: 3500179 - RNA, 23 nt, Human
ccuacuguucuaaagcucugaca

SEQ ID NO: 3500180 - RNA, 17 nt, Human
ccuacuuccagguucug

SEQ ID NO: 3500181 - RNA, 13 nt, Human
ccuacuuccccuu

SEQ ID NO: 3500182 - RNA, 15 nt, Human
ccuacuuccugugac

SEQ ID NO: 3500183 - RNA, 19 nt, Human
ccuacuucuccagccuaga

SEQ ID NO: 3500184 - RNA, 22 nt, Human
ccuacuucuuuugcucuuagcu

SEQ ID NO: 3500185 - RNA, 15 nt, Human
ccuacuuugacuuuu

SEQ ID NO: 3500186 - RNA, 17 nt, Human
ccuagaaacaacacugu

SEQ ID NO: 3500187 - RNA, 15 nt, Human
ccuagaaauacaugg

SEQ ID NO: 3500188 - RNA, 21 nt, Human
ccuagaacacuaacucaccag

SEQ ID NO: 3500189 - RNA, 12 nt, Human
ccuagaagaagc

SEQ ID NO: 3500190 - RNA, 19 nt, Human
ccuagaccuaaacggcuca

SEQ ID NO: 3500191 - RNA, 20 nt, Human
ccuagacuuuaggcuuucag

SEQ ID NO: 3500192 - RNA, 18 nt, Human
ccuagagaacgcagcccu

SEQ ID NO: 3500193 - RNA, 16 nt, Human
ccuagagacagaagca

SEQ ID NO: 3500194 - RNA, 14 nt, Human
ccuagagccagacc

SEQ ID NO: 3500195 - RNA, 16 nt, Human
ccuagagggaggggcc

SEQ ID NO: 3500196 - RNA, 17 nt, Human
ccuagagggaggggccu

SEQ ID NO: 3500197 - RNA, 22 nt, Human
ccuagaguagaguggagggagg

SEQ ID NO: 3500198 - RNA, 17 nt, Human
ccuagauaaaaagaugg

SEQ ID NO: 3500199 - RNA, 21 nt, Human
ccuagauaugaauauauggca

SEQ ID NO: 3500200 - RNA, 20 nt, Human
ccuagauccacacacagagg

SEQ ID NO: 3500201 - RNA, 14 nt, Human
ccuagauccuaagg

SEQ ID NO: 3500202 - RNA, 16 nt, Human
ccuagauccuaagggu

SEQ ID NO: 3500203 - RNA, 22 nt, Human
ccuagauguauaacuaggagcu

SEQ ID NO: 3500204 - RNA, 11 nt, Human
ccuagauuaua

SEQ ID NO: 3500205 - RNA, 15 nt, Human
ccuagauuauaucaa

SEQ ID NO: 3500206 - RNA, 14 nt, Human
ccuagcaagcuggc

SEQ ID NO: 3500207 - RNA, 16 nt, Human
ccuagcaagcuggccu

SEQ ID NO: 3500208 - RNA, 13 nt, Human
ccuagcacagcag

SEQ ID NO: 3500209 - RNA, 18 nt, Human
ccuagcacaugcuucaau

SEQ ID NO: 3500210 - RNA, 12 nt, Human
ccuagcagugaa

SEQ ID NO: 3500211 - RNA, 16 nt, Human
ccuagcagugaacuau

SEQ ID NO: 3500212 - RNA, 19 nt, Human
ccuagcauacguacacauu

SEQ ID NO: 3500213 - RNA, 14 nt, Human
ccuagccauuccug

SEQ ID NO: 3500214 - RNA, 15 nt, Human
ccuagcccacccugc

SEQ ID NO: 3500215 - RNA, 17 nt, Human
ccuagcccacccugcug

SEQ ID NO: 3500216 - RNA, 13 nt, Human
ccuagcccagcgc

SEQ ID NO: 3500217 - RNA, 11 nt, Human
ccuagcccagg

SEQ ID NO: 3500218 - RNA, 14 nt, Human
cugcucccccuuuu

SEQ ID NO: 3500219 - RNA, 18 nt, Human
cugcucccccuuuucccu

SEQ ID NO: 3500220 - RNA, 19 nt, Human
cugcuccccuaaagccuca

SEQ ID NO: 3500221 - RNA, 17 nt, Human
cugcuccccucccuccu

SEQ ID NO: 3500222 - RNA, 13 nt, Human
cugcucccucaga

SEQ ID NO: 3500223 - RNA, 16 nt, Human
cugcucccucuccccc

SEQ ID NO: 3500224 - RNA, 20 nt, Human
cugcucccugaagccagccu

SEQ ID NO: 3500225 - RNA, 13 nt, Human
cugcucccuggca

SEQ ID NO: 3500226 - RNA, 15 nt, Human
cugcucccuggcauu

SEQ ID NO: 3500227 - RNA, 13 nt, Human
cugcuccucaugg

SEQ ID NO: 3500228 - RNA, 17 nt, Human
cugcuccuccagggcca

SEQ ID NO: 3500229 - RNA, 13 nt, Human
cugcuccucccug

SEQ ID NO: 3500230 - RNA, 20 nt, Human
cugcuccucccuggcugccc

SEQ ID NO: 3500231 - RNA, 13 nt, Human
cugcuccucucca

SEQ ID NO: 3500232 - RNA, 15 nt, Human
cugcuccugagcccc

SEQ ID NO: 3500233 - RNA, 16 nt, Human
cugcuccugagccccc

SEQ ID NO: 3500234 - RNA, 17 nt, Human
cugcuccugagccccca

SEQ ID NO: 3500235 - RNA, 14 nt, Human
cugcuccugcagca

SEQ ID NO: 3500236 - RNA, 16 nt, Human
cugcuccuucccuugc

SEQ ID NO: 3500237 - RNA, 17 nt, Human
cugcuccuucccuugcu

SEQ ID NO: 3500238 - RNA, 19 nt, Human
cugcuccuuggcuuaccug

SEQ ID NO: 3500239 - RNA, 14 nt, Human
cugcucgcucccug

SEQ ID NO: 3500240 - RNA, 16 nt, Human
cugcucgggcccaggc

SEQ ID NO: 3500241 - RNA, 19 nt, Human
cugcucgggcccaggccau

SEQ ID NO: 3500242 - RNA, 22 nt, Human
cugcucgggcccaggccaucuu

SEQ ID NO: 3500243 - RNA, 13 nt, Human
cugcucggggugc

SEQ ID NO: 3500244 - RNA, 17 nt, Human
cugcucggggugcacag

SEQ ID NO: 3500245 - RNA, 19 nt, Human
cugcucggggugcacagga

SEQ ID NO: 3500246 - RNA, 23 nt, Human
cugcucggggugcacaggagggg

SEQ ID NO: 3500247 - RNA, 13 nt, Human
cugcucuccagcc

SEQ ID NO: 3500248 - RNA, 11 nt, Human
cugcucuccuc

SEQ ID NO: 3500249 - RNA, 17 nt, Human
cugcucuccucuucuac

SEQ ID NO: 3500250 - RNA, 20 nt, Human
cugcucuccucuugccacug

SEQ ID NO: 3500251 - RNA, 21 nt, Human
cugcucuccucuugccacugc

SEQ ID NO: 3500252 - RNA, 12 nt, Human
cugcucuccuuc

SEQ ID NO: 3500253 - RNA, 19 nt, Human
cugcucuccuuccuggagc

SEQ ID NO: 3500254 - RNA, 17 nt, Human
cugcucucuacccagcc

SEQ ID NO: 3500255 - RNA, 24 nt, Human
cugcucucuuuuucuccaggguca

SEQ ID NO: 3500256 - RNA, 19 nt, Human
cugcucugaacacgaagcu

SEQ ID NO: 3500257 - RNA, 21 nt, Human
cugcucugaauuaguccuugc

SEQ ID NO: 3500258 - RNA, 13 nt, Human
cugcucugagcca

SEQ ID NO: 3500259 - RNA, 18 nt, Human
cugcucugaggcuuccag

SEQ ID NO: 3500260 - RNA, 19 nt, Human
cugcucugaggcuuccaga

SEQ ID NO: 3500261 - RNA, 21 nt, Human
cugcucugaggcuuccagaga

SEQ ID NO: 3500262 - RNA, 22 nt, Human
cugcucugaggcuuccagagag

SEQ ID NO: 3500263 - RNA, 13 nt, Human
cugcucugaugca

SEQ ID NO: 3500264 - RNA, 11 nt, Human
cugcucugccc

SEQ ID NO: 3500265 - RNA, 15 nt, Human
cugcucugccccagc

SEQ ID NO: 3500266 - RNA, 21 nt, Human
cugcucugcgugucaccugug

SEQ ID NO: 3500267 - RNA, 11 nt, Human
cugcucugcug

SEQ ID NO: 3500268 - RNA, 19 nt, Human
cugcucuggaauuugcaag

SEQ ID NO: 3500269 - RNA, 18 nt, Human
cugcucugguuguuucug

SEQ ID NO: 3500270 - RNA, 21 nt, Human
cugcucuuaugccauuuguuu

SEQ ID NO: 3500271 - RNA, 15 nt, Human
cugcucuucauccca

SEQ ID NO: 3500272 - RNA, 21 nt, Human
cugcucuucaucccauuccag

SEQ ID NO: 3500273 - RNA, 17 nt, Human
cugcucuuggcuggacc

SEQ ID NO: 3500274 - RNA, 19 nt, Human
cugcucuuggcuggaccca

SEQ ID NO: 3500275 - RNA, 13 nt, Human
cuggagcagaagg

SEQ ID NO: 3500276 - RNA, 13 nt, Human
cuggagcagacca

SEQ ID NO: 3500277 - RNA, 12 nt, Human
cuggagcagcca

SEQ ID NO: 3500278 - RNA, 17 nt, Human
cuggagcagccacccca

SEQ ID NO: 3500279 - RNA, 16 nt, Human
cuggagcaggccuugc

SEQ ID NO: 3500280 - RNA, 12 nt, Human
cuggagcaucug

SEQ ID NO: 3500281 - RNA, 16 nt, Human
cuggagcaucugacuc

SEQ ID NO: 3500282 - RNA, 22 nt, Human
cuggagcauuguguauagaacu

SEQ ID NO: 3500283 - RNA, 22 nt, Human
cuggagccaccugucccaccuc

SEQ ID NO: 3500284 - RNA, 15 nt, Human
cuggagccacuaacu

SEQ ID NO: 3500285 - RNA, 21 nt, Human
cuggagccagacucuggucuu

SEQ ID NO: 3500286 - RNA, 22 nt, Human
cuggagccagacucuggucuuc

SEQ ID NO: 3500287 - RNA, 14 nt, Human
cuggagccagccga

SEQ ID NO: 3500288 - RNA, 21 nt, Human
cuggagccaugggcacaaagg

SEQ ID NO: 3500289 - RNA, 17 nt, Human
cuggagcccacuguacu

SEQ ID NO: 3500290 - RNA, 20 nt, Human
cuggagcccacuguacuugc

SEQ ID NO: 3500291 - RNA, 21 nt, Human
cuggagcccacuguacuugcu

SEQ ID NO: 3500292 - RNA, 16 nt, Human
cuggagcccagaggag

SEQ ID NO: 3500293 - RNA, 17 nt, Human
cuggagcccagaggagg

SEQ ID NO: 3500294 - RNA, 12 nt, Human
cuggagccccac

SEQ ID NO: 3500295 - RNA, 14 nt, Human
cuggagccccuggg

SEQ ID NO: 3500296 - RNA, 18 nt, Human
cuggagccccuggguggg

SEQ ID NO: 3500297 - RNA, 17 nt, Human
cuggagccuggugcccu

SEQ ID NO: 3500298 - RNA, 13 nt, Human
cuggagccugugu

SEQ ID NO: 3500299 - RNA, 14 nt, Human
cuggagccugugua

SEQ ID NO: 3500300 - RNA, 16 nt, Human
cuggagccuguguaac

SEQ ID NO: 3500301 - RNA, 22 nt, Human
cuggagcuagaauuugauaugu

SEQ ID NO: 3500302 - RNA, 14 nt, Human
cuggagcucaucug

SEQ ID NO: 3500303 - RNA, 21 nt, Human
cuggagcucaucugcaaaagg

SEQ ID NO: 3500304 - RNA, 13 nt, Human
cuggagcuccugg

SEQ ID NO: 3500305 - RNA, 14 nt, Human
cuggagcuccuggg

SEQ ID NO: 3500306 - RNA, 18 nt, Human
cuggagcuccugggaagg

SEQ ID NO: 3500307 - RNA, 13 nt, Human
cuggagcucugcc

SEQ ID NO: 3500308 - RNA, 18 nt, Human
cuggagcuucauuuuggu

SEQ ID NO: 3500309 - RNA, 14 nt, Human
cuggaggaaaacug

SEQ ID NO: 3500310 - RNA, 17 nt, Human
cuggaggaaaacugaga

SEQ ID NO: 3500311 - RNA, 19 nt, Human
cuggaggaaaacugagacu

SEQ ID NO: 3500312 - RNA, 12 nt, Human
cuggaggaccug

SEQ ID NO: 3500313 - RNA, 16 nt, Human
cuggaggaccugagcc

SEQ ID NO: 3500314 - RNA, 18 nt, Human
cuggaggaccugagccug

SEQ ID NO: 3500315 - RNA, 20 nt, Human
cuggaggaccugagccugcc

SEQ ID NO: 3500316 - RNA, 22 nt, Human
cuggaggaccugagccugccga

SEQ ID NO: 3500317 - RNA, 13 nt, Human
cuggaggagagaa

SEQ ID NO: 3500318 - RNA, 15 nt, Human
cuggaggagcccagg

SEQ ID NO: 3500319 - RNA, 22 nt, Human
cuggaggauccccuccaagccu

SEQ ID NO: 3500320 - RNA, 17 nt, Human
cuggaggaugugggcag

SEQ ID NO: 3500321 - RNA, 13 nt, Human
cuggaggcagggc

SEQ ID NO: 3500322 - RNA, 15 nt, Human
cuggaggcagggccu

SEQ ID NO: 3500323 - RNA, 19 nt, Human
cuggaggcagggccuugcc

SEQ ID NO: 3500324 - RNA, 22 nt, Human
cuggaggcagggccuugcccag

SEQ ID NO: 3500325 - RNA, 14 nt, Human
cuggaggcccaggc

SEQ ID NO: 3500326 - RNA, 18 nt, Human
cuggaggcccaggcuggg

SEQ ID NO: 3500327 - RNA, 19 nt, Human
cuggaggcccaggcuggga

SEQ ID NO: 3500328 - RNA, 20 nt, Human
cuggaggccccuggagccag

SEQ ID NO: 3500329 - RNA, 21 nt, Human
cuggaggccccuggagccaga

SEQ ID NO: 3500330 - RNA, 13 nt, Human
cuggaggccucag

SEQ ID NO: 3500331 - RNA, 16 nt, Human
cuggaggccucaggug

SEQ ID NO: 3500332 - RNA, 18 nt, Human
cuggaggccucaggugcu

SEQ ID NO: 3500333 - RNA, 21 nt, Human
cuggaggccucaggugcuguc

SEQ ID NO: 3500334 - RNA, 16 nt, Human
cuggaggccucugggc

SEQ ID NO: 3500335 - RNA, 18 nt, Human
cuggaggccucugggccu

SEQ ID NO: 3500336 - RNA, 19 nt, Human
cuggaggccuuccagcugc

SEQ ID NO: 3500337 - RNA, 22 nt, Human
cuggaggccuuccagcugcugu

SEQ ID NO: 3500338 - RNA, 18 nt, Human
cuggaggcggugcggcag

SEQ ID NO: 3500339 - RNA, 18 nt, Human
cuggaggcucaaauuuug

SEQ ID NO: 3500340 - RNA, 23 nt, Human
cuggagggaagaguggaggugga

SEQ ID NO: 3500341 - RNA, 21 nt, Human
cuggagggaaugaaccuggag

SEQ ID NO: 3500342 - RNA, 19 nt, Human
cuggagggcuagaaccugg

SEQ ID NO: 3500343 - RNA, 22 nt, Human
cuggagggcuagaaucuggaga

SEQ ID NO: 3500344 - RNA, 20 nt, Human
cuggagggcuggaaucugga

SEQ ID NO: 3500345 - RNA, 14 nt, Human
cuggaggggccccu

SEQ ID NO: 3500346 - RNA, 23 nt, Human
cuggaggggccccugcuucucca

SEQ ID NO: 3500347 - RNA, 21 nt, Human
cuggaggggcuagaaccuaga

SEQ ID NO: 3500348 - RNA, 20 nt, Human
cuggagggggaauggcagca

SEQ ID NO: 3500349 - RNA, 16 nt, Human
cuggagggguguggcu

SEQ ID NO: 3500350 - RNA, 20 nt, Human
cuggagggguguggcuccuu

SEQ ID NO: 3500351 - RNA, 16 nt, Human
cuggagguaaggccuu

SEQ ID NO: 3500352 - RNA, 17 nt, Human
cuggagguacgaaaaga

SEQ ID NO: 3500353 - RNA, 16 nt, Human
cuggaggugggagcag

SEQ ID NO: 3500354 - RNA, 18 nt, Human
cuggaggugggagcagga

SEQ ID NO: 3500355 - RNA, 22 nt, Human
cuggaggugggagcaggagauu

SEQ ID NO: 3500356 - RNA, 18 nt, Human
cuggagguggggccugga

SEQ ID NO: 3500357 - RNA, 16 nt, Human
cuggagguggggcgag

SEQ ID NO: 3500358 - RNA, 20 nt, Human
cuggagguggggcgaggcag

SEQ ID NO: 3500359 - RNA, 15 nt, Human
cuggagguugauaac

SEQ ID NO: 3500360 - RNA, 19 nt, Human
cuggagguugauaacuuug

SEQ ID NO: 3500361 - RNA, 21 nt, Human
cuggagguugauaacuuugcu

SEQ ID NO: 3500362 - RNA, 15 nt, Human
cuggaguccagucuc

SEQ ID NO: 3500363 - RNA, 15 nt, Human
ccuccccgcaccccc

SEQ ID NO: 3500364 - RNA, 16 nt, Human
ccuccccgcccuuuuu

SEQ ID NO: 3500365 - RNA, 17 nt, Human
ccuccccgucucauucc

SEQ ID NO: 3500366 - RNA, 18 nt, Human
ccuccccuauccacccag

SEQ ID NO: 3500367 - RNA, 22 nt, Human
ccuccccuauccacccagccca

SEQ ID NO: 3500368 - RNA, 13 nt, Human
ccuccccucacag

SEQ ID NO: 3500369 - RNA, 13 nt, Human
ccuccccuccagc

SEQ ID NO: 3500370 - RNA, 14 nt, Human
ccuccccuccaucc

SEQ ID NO: 3500371 - RNA, 20 nt, Human
ccuccccuccaucccuggcc

SEQ ID NO: 3500372 - RNA, 16 nt, Human
ccuccccuccccugcu

SEQ ID NO: 3500373 - RNA, 19 nt, Human
ccuccccuccccugcugca

SEQ ID NO: 3500374 - RNA, 13 nt, Human
ccuccccucccgu

SEQ ID NO: 3500375 - RNA, 17 nt, Human
ccuccccuccucugcuu

SEQ ID NO: 3500376 - RNA, 20 nt, Human
ccuccccuccuugccuccug

SEQ ID NO: 3500377 - RNA, 17 nt, Human
ccuccccucucuugcac

SEQ ID NO: 3500378 - RNA, 21 nt, Human
ccuccccucucuugcacccgc

SEQ ID NO: 3500379 - RNA, 14 nt, Human
ccuccccugaggcu

SEQ ID NO: 3500380 - RNA, 17 nt, Human
ccuccccugccaccagg

SEQ ID NO: 3500381 - RNA, 13 nt, Human
ccuccccugccag

SEQ ID NO: 3500382 - RNA, 14 nt, Human
ccuccccugcccuc

SEQ ID NO: 3500383 - RNA, 22 nt, Human
ccuccccuggagggggaauggc

SEQ ID NO: 3500384 - RNA, 23 nt, Human
ccuccccuggggacagcaagggc

SEQ ID NO: 3500385 - RNA, 17 nt, Human
ccuccccuucccugcaa

SEQ ID NO: 3500386 - RNA, 13 nt, Human
ccuccccuugaau

SEQ ID NO: 3500387 - RNA, 14 nt, Human
ccuccccuugggcg

SEQ ID NO: 3500388 - RNA, 18 nt, Human
ccucccgaauagcuggga

SEQ ID NO: 3500389 - RNA, 14 nt, Human
ccucccgagcuccu

SEQ ID NO: 3500390 - RNA, 18 nt, Human
ccucccgaguagcuggga

SEQ ID NO: 3500391 - RNA, 15 nt, Human
ccucccgcaccccga

SEQ ID NO: 3500392 - RNA, 15 nt, Human
ccucccggcauggga

SEQ ID NO: 3500393 - RNA, 17 nt, Human
ccucccgggcccucccu

SEQ ID NO: 3500394 - RNA, 15 nt, Human
ccucccuaccucaac

SEQ ID NO: 3500395 - RNA, 16 nt, Human
ccucccuaccucaacc

SEQ ID NO: 3500396 - RNA, 11 nt, Human
ccucccucagc

SEQ ID NO: 3500397 - RNA, 15 nt, Human
ccucccucagccccu

SEQ ID NO: 3500398 - RNA, 19 nt, Human
ccucccuccaccccaggac

SEQ ID NO: 3500399 - RNA, 16 nt, Human
ccucccucccucuuuc

SEQ ID NO: 3500400 - RNA, 12 nt, Human
ccucccuccugc

SEQ ID NO: 3500401 - RNA, 13 nt, Human
ccucccucucucu

SEQ ID NO: 3500402 - RNA, 18 nt, Human
ccucccucugaccugcag

SEQ ID NO: 3500403 - RNA, 19 nt, Human
ccucccucugaggcuguag

SEQ ID NO: 3500404 - RNA, 15 nt, Human
ccucccugacccugc

SEQ ID NO: 3500405 - RNA, 14 nt, Human
ccucccugauguac

SEQ ID NO: 3500406 - RNA, 20 nt, Human
ccucccugcaucugaccagc

SEQ ID NO: 3500407 - RNA, 21 nt, Human
ccucccugcaucugaccagca

SEQ ID NO: 3500408 - RNA, 15 nt, Human
ccucccugcccaggc

SEQ ID NO: 3500409 - RNA, 21 nt, Human
ccucccugccccucccuucaa

SEQ ID NO: 3500410 - RNA, 12 nt, Human
ccucccugccuc

SEQ ID NO: 3500411 - RNA, 14 nt, Human
ccucccugccucca

SEQ ID NO: 3500412 - RNA, 14 nt, Human
ccucccugcugucc

SEQ ID NO: 3500413 - RNA, 19 nt, Human
ccucccugcuguccccucu

SEQ ID NO: 3500414 - RNA, 20 nt, Human
ccucccugcuguccccucuu

SEQ ID NO: 3500415 - RNA, 13 nt, Human
ccucccuggagug

SEQ ID NO: 3500416 - RNA, 14 nt, Human
ccucccuggccugu

SEQ ID NO: 3500417 - RNA, 13 nt, Human
ccucccuggcucc

SEQ ID NO: 3500418 - RNA, 14 nt, Human
ccucccuggcugcc

SEQ ID NO: 3500419 - RNA, 20 nt, Human
ccucccuggcugcccuggcc

SEQ ID NO: 3500420 - RNA, 22 nt, Human
ccucccuggcugcccuggcccu

SEQ ID NO: 3500421 - RNA, 12 nt, Human
ccucccuggguu

SEQ ID NO: 3500422 - RNA, 13 nt, Human
ccucccuggguuc

SEQ ID NO: 3500423 - RNA, 14 nt, Human
ccucccuggguuca

SEQ ID NO: 3500424 - RNA, 11 nt, Human
ccucccuguaa

SEQ ID NO: 3500425 - RNA, 11 nt, Human
ccucccugucc

SEQ ID NO: 3500426 - RNA, 14 nt, Human
ccucccuguccacc

SEQ ID NO: 3500427 - RNA, 18 nt, Human
ccucccuguuccccagag

SEQ ID NO: 3500428 - RNA, 23 nt, Human
ccucccuguugacgaagucucuu

SEQ ID NO: 3500429 - RNA, 13 nt, Human
ccucccuuagcuc

SEQ ID NO: 3500430 - RNA, 19 nt, Human
ccucccuuccgacccucug

SEQ ID NO: 3500431 - RNA, 20 nt, Human
ccucccuuccgacccucugg

SEQ ID NO: 3500432 - RNA, 21 nt, Human
ccucccuuccgacccucuggg

SEQ ID NO: 3500433 - RNA, 22 nt, Human
ccucccuuccgacccucuggga

SEQ ID NO: 3500434 - RNA, 10 nt, Human
ccucccuucu

SEQ ID NO: 3500435 - RNA, 21 nt, Human
ccucccuucuacugcuucuac

SEQ ID NO: 3500436 - RNA, 16 nt, Human
cuggauucauuuccug

SEQ ID NO: 3500437 - RNA, 19 nt, Human
cuggauucauuuccugccc

SEQ ID NO: 3500438 - RNA, 20 nt, Human
cuggauuggguuaugaauau

SEQ ID NO: 3500439 - RNA, 15 nt, Human
cuggauuuuuaccag

SEQ ID NO: 3500440 - RNA, 19 nt, Human
cuggcaaaaggaucuuugu

SEQ ID NO: 3500441 - RNA, 21 nt, Human
cuggcaaaaggaucuuugugg

SEQ ID NO: 3500442 - RNA, 16 nt, Human
cuggcaaacagggccu

SEQ ID NO: 3500443 - RNA, 17 nt, Human
cuggcaaacagggccuc

SEQ ID NO: 3500444 - RNA, 22 nt, Human
cuggcaaacaugaaaaaucggc

SEQ ID NO: 3500445 - RNA, 19 nt, Human
cuggcaaacuucagacuga

SEQ ID NO: 3500446 - RNA, 16 nt, Human
cuggcaaagcagaaug

SEQ ID NO: 3500447 - RNA, 19 nt, Human
cuggcaaagcagaauguga

SEQ ID NO: 3500448 - RNA, 20 nt, Human
cuggcaaagcuuuuagaaau

SEQ ID NO: 3500449 - RNA, 21 nt, Human
cuggcaaagguggcucuccag

SEQ ID NO: 3500450 - RNA, 16 nt, Human
cuggcaacacagaggc

SEQ ID NO: 3500451 - RNA, 17 nt, Human
cuggcaagaaaagaguu

SEQ ID NO: 3500452 - RNA, 16 nt, Human
cuggcaaggacacaga

SEQ ID NO: 3500453 - RNA, 20 nt, Human
cuggcaaggacuuuguacau

SEQ ID NO: 3500454 - RNA, 15 nt, Human
cuggcaauagugugu

SEQ ID NO: 3500455 - RNA, 21 nt, Human
cuggcaaugaaaaauucucag

SEQ ID NO: 3500456 - RNA, 21 nt, Human
cuggcaaugccacagcccugu

SEQ ID NO: 3500457 - RNA, 16 nt, Human
cuggcaaugguaguuu

SEQ ID NO: 3500458 - RNA, 22 nt, Human
cuggcaaugguaguuucugugg

SEQ ID NO: 3500459 - RNA, 21 nt, Human
cuggcacacaucaggaguuca

SEQ ID NO: 3500460 - RNA, 13 nt, Human
cuggcacagaggu

SEQ ID NO: 3500461 - RNA, 12 nt, Human
cuggcacagccu

SEQ ID NO: 3500462 - RNA, 15 nt, Human
cuggcacagccugca

SEQ ID NO: 3500463 - RNA, 23 nt, Human
cuggcacagccuggcuguggccu

SEQ ID NO: 3500464 - RNA, 18 nt, Human
cuggcacaggacugauuc

SEQ ID NO: 3500465 - RNA, 22 nt, Human
cuggcacaggacugauucuggg

SEQ ID NO: 3500466 - RNA, 12 nt, Human
cuggcacagucu

SEQ ID NO: 3500467 - RNA, 19 nt, Human
cuggcacagugucugggcu

SEQ ID NO: 3500468 - RNA, 14 nt, Human
cuggcacaucagaa

SEQ ID NO: 3500469 - RNA, 17 nt, Human
cuggcacauuuccccag

SEQ ID NO: 3500470 - RNA, 19 nt, Human
cuggcacccaccguggagg

SEQ ID NO: 3500471 - RNA, 19 nt, Human
cuggcacccggccccugcu

SEQ ID NO: 3500472 - RNA, 21 nt, Human
cuggcacccggccccugcugg

SEQ ID NO: 3500473 - RNA, 22 nt, Human
cuggcacccggccccugcuggu

SEQ ID NO: 3500474 - RNA, 16 nt, Human
cuggcacugcugugcu

SEQ ID NO: 3500475 - RNA, 20 nt, Human
cuggcacugcuuccagugag

SEQ ID NO: 3500476 - RNA, 17 nt, Human
cuggcacuggaccccag

SEQ ID NO: 3500477 - RNA, 14 nt, Human
cuggcacuuggaga

SEQ ID NO: 3500478 - RNA, 23 nt, Human
cuggcagaaagcaaaugugaccu

SEQ ID NO: 3500479 - RNA, 13 nt, Human
cuggcagaacuga

SEQ ID NO: 3500480 - RNA, 19 nt, Human
cuggcagaacugagcuccu

SEQ ID NO: 3500481 - RNA, 23 nt, Human
cuggcagaaugcuagcucugagc

SEQ ID NO: 3500482 - RNA, 14 nt, Human
cuggcagagaugcc

SEQ ID NO: 3500483 - RNA, 17 nt, Human
cuggcagaguugaagac

SEQ ID NO: 3500484 - RNA, 18 nt, Human
cuggcagaguugaagaca

SEQ ID NO: 3500485 - RNA, 19 nt, Human
cuggcagcaccgccucuuc

SEQ ID NO: 3500486 - RNA, 14 nt, Human
cuggcagccacacu

SEQ ID NO: 3500487 - RNA, 15 nt, Human
cuggcagccacacuu

SEQ ID NO: 3500488 - RNA, 13 nt, Human
cuggcagcccaga

SEQ ID NO: 3500489 - RNA, 22 nt, Human
cuggcagcccagagacuuugua

SEQ ID NO: 3500490 - RNA, 13 nt, Human
cuggcagccccag

SEQ ID NO: 3500491 - RNA, 15 nt, Human
cuggcagccccagca

SEQ ID NO: 3500492 - RNA, 22 nt, Human
cuggcagccgugccuucagcuc

SEQ ID NO: 3500493 - RNA, 14 nt, Human
cuggcagccuccca

SEQ ID NO: 3500494 - RNA, 13 nt, Human
cuggcagcucagc

SEQ ID NO: 3500495 - RNA, 23 nt, Human
cuggcagcucuccagucaggagg

SEQ ID NO: 3500496 - RNA, 12 nt, Human
cuggcagcucug

SEQ ID NO: 3500497 - RNA, 17 nt, Human
cuggcagcucuggacag

SEQ ID NO: 3500498 - RNA, 20 nt, Human
cuggcaggaugacccugcga

SEQ ID NO: 3500499 - RNA, 24 nt, Human
cuggcaggcaggcucccagggaca

SEQ ID NO: 3500500 - RNA, 13 nt, Human
cuggcaggcaggg

SEQ ID NO: 3500501 - RNA, 22 nt, Human
cuggcagggaggucaggcccug

SEQ ID NO: 3500502 - RNA, 23 nt, Human
cuggcagggaggucaggcccugg

SEQ ID NO: 3500503 - RNA, 17 nt, Human
cuggcagggugggaugg

SEQ ID NO: 3500504 - RNA, 12 nt, Human
cuggcagguccu

SEQ ID NO: 3500505 - RNA, 20 nt, Human
cuggcaguuuauauuuaacu

SEQ ID NO: 3500506 - RNA, 15 nt, Human
cuggcauagagcagc

SEQ ID NO: 3500507 - RNA, 18 nt, Human
cuggcaucgcaccauucu

SEQ ID NO: 3500508 - RNA, 14 nt, Human
ccuccucucacucc

SEQ ID NO: 3500509 - RNA, 21 nt, Human
ccuccucucacuccccagccu

SEQ ID NO: 3500510 - RNA, 15 nt, Human
ccuccucuccaccau

SEQ ID NO: 3500511 - RNA, 14 nt, Human
ccuccucucccauc

SEQ ID NO: 3500512 - RNA, 13 nt, Human
ccuccucucugcc

SEQ ID NO: 3500513 - RNA, 15 nt, Human
ccuccucugaaacag

SEQ ID NO: 3500514 - RNA, 21 nt, Human
ccuccucugaaacagcugccu

SEQ ID NO: 3500515 - RNA, 23 nt, Human
ccuccucugaaacagcugccuua

SEQ ID NO: 3500516 - RNA, 18 nt, Human
ccuccucugacuugggga

SEQ ID NO: 3500517 - RNA, 21 nt, Human
ccuccucugcacucccaccug

SEQ ID NO: 3500518 - RNA, 13 nt, Human
ccuccucugccac

SEQ ID NO: 3500519 - RNA, 11 nt, Human
ccuccucugcu

SEQ ID NO: 3500520 - RNA, 22 nt, Human
ccuccucuggacggcaggcuca

SEQ ID NO: 3500521 - RNA, 17 nt, Human
ccuccucugucugcccu

SEQ ID NO: 3500522 - RNA, 11 nt, Human
ccuccucugug

SEQ ID NO: 3500523 - RNA, 12 nt, Human
ccuccucuguga

SEQ ID NO: 3500524 - RNA, 13 nt, Human
ccuccucugugaa

SEQ ID NO: 3500525 - RNA, 22 nt, Human
ccuccucuucaccccggcaggc

SEQ ID NO: 3500526 - RNA, 20 nt, Human
ccuccugaaacuuacacaca

SEQ ID NO: 3500527 - RNA, 22 nt, Human
ccuccugaaccgcacagcucag

SEQ ID NO: 3500528 - RNA, 15 nt, Human
ccuccugacacccca

SEQ ID NO: 3500529 - RNA, 17 nt, Human
ccuccugacaccccacu

SEQ ID NO: 3500530 - RNA, 19 nt, Human
ccuccugacacccuucucc

SEQ ID NO: 3500531 - RNA, 21 nt, Human
ccuccugacccauugcuguug

SEQ ID NO: 3500532 - RNA, 16 nt, Human
ccuccugaccugaggc

SEQ ID NO: 3500533 - RNA, 19 nt, Human
ccuccugagggaggaccug

SEQ ID NO: 3500534 - RNA, 22 nt, Human
ccuccugaguugaagucaugcu

SEQ ID NO: 3500535 - RNA, 19 nt, Human
ccuccugcagaccacgccc

SEQ ID NO: 3500536 - RNA, 15 nt, Human
ccuccugcccaggag

SEQ ID NO: 3500537 - RNA, 16 nt, Human
ccuccugcccaggaga

SEQ ID NO: 3500538 - RNA, 19 nt, Human
ccuccugcccaggagagcc

SEQ ID NO: 3500539 - RNA, 21 nt, Human
ccuccugcccaggagagccag

SEQ ID NO: 3500540 - RNA, 23 nt, Human
ccuccugcccaggagagccagcc

SEQ ID NO: 3500541 - RNA, 17 nt, Human
ccuccugcccagucccc

SEQ ID NO: 3500542 - RNA, 18 nt, Human
ccuccugcgcgcaugugc

SEQ ID NO: 3500543 - RNA, 20 nt, Human
ccuccugcgcgcaugugcgc

SEQ ID NO: 3500544 - RNA, 11 nt, Human
ccuccugcugc

SEQ ID NO: 3500545 - RNA, 18 nt, Human
ccuccuggaaccuugcug

SEQ ID NO: 3500546 - RNA, 22 nt, Human
ccuccuggaaccuugcuguccu

SEQ ID NO: 3500547 - RNA, 21 nt, Human
ccuccuggacauuuuuucagu

SEQ ID NO: 3500548 - RNA, 15 nt, Human
ccuccuggcccaggu

SEQ ID NO: 3500549 - RNA, 21 nt, Human
ccuccuggccucagacugcac

SEQ ID NO: 3500550 - RNA, 17 nt, Human
ccuccugggaaugaagc

SEQ ID NO: 3500551 - RNA, 17 nt, Human
ccuccugggaucugcuc

SEQ ID NO: 3500552 - RNA, 13 nt, Human
ccuccugggcuaa

SEQ ID NO: 3500553 - RNA, 10 nt, Human
ccuccugggg

SEQ ID NO: 3500554 - RNA, 12 nt, Human
ccuccuggggcc

SEQ ID NO: 3500555 - RNA, 13 nt, Human
ccuccuggggcca

SEQ ID NO: 3500556 - RNA, 21 nt, Human
ccuccuggggccaggccgggc

SEQ ID NO: 3500557 - RNA, 21 nt, Human
ccuccugguggguccaggggc

SEQ ID NO: 3500558 - RNA, 18 nt, Human
ccuccuggugucacccca

SEQ ID NO: 3500559 - RNA, 22 nt, Human
ccuccuguaaaugguguacaua

SEQ ID NO: 3500560 - RNA, 15 nt, Human
ccuccugucucuggc

SEQ ID NO: 3500561 - RNA, 14 nt, Human
ccuccugugcucag

SEQ ID NO: 3500562 - RNA, 15 nt, Human
ccuccugugcucagc

SEQ ID NO: 3500563 - RNA, 17 nt, Human
ccuccugugcucagccc

SEQ ID NO: 3500564 - RNA, 19 nt, Human
ccuccugugcucagcccug

SEQ ID NO: 3500565 - RNA, 20 nt, Human
ccuccuguggaacccagcag

SEQ ID NO: 3500566 - RNA, 14 nt, Human
ccuccuguggccug

SEQ ID NO: 3500567 - RNA, 18 nt, Human
ccuccuguggccugccag

SEQ ID NO: 3500568 - RNA, 12 nt, Human
ccuccugugggg

SEQ ID NO: 3500569 - RNA, 17 nt, Human
ccuccuguguagcuggg

SEQ ID NO: 3500570 - RNA, 13 nt, Human
ccuccugugugug

SEQ ID NO: 3500571 - RNA, 22 nt, Human
ccuccugugugugcgccuacag

SEQ ID NO: 3500572 - RNA, 23 nt, Human
ccuccugugugugcgccuacagg

SEQ ID NO: 3500573 - RNA, 21 nt, Human
ccuccuguugcacccagcccu

SEQ ID NO: 3500574 - RNA, 22 nt, Human
ccuccuguugcacccagcccug

SEQ ID NO: 3500575 - RNA, 23 nt, Human
ccuccuguugggagagggcgcag

SEQ ID NO: 3500576 - RNA, 17 nt, Human
ccuccuucaauuccaua

SEQ ID NO: 3500577 - RNA, 15 nt, Human
ccuccuucagacacc

SEQ ID NO: 3500578 - RNA, 23 nt, Human
ccuccuucauaugaaaggugcca

SEQ ID NO: 3500579 - RNA, 17 nt, Human
ccuccuuccaccucccu

SEQ ID NO: 3500580 - RNA, 12 nt, Human
ccuccuucccac

SEQ ID NO: 3500581 - RNA, 14 nt, Human
ccuccuuccuugac

SEQ ID NO: 3500582 - RNA, 15 nt, Human
ccuccuuccuugacc

SEQ ID NO: 3500583 - RNA, 18 nt, Human
ccuccuuccuugaccagc

SEQ ID NO: 3500584 - RNA, 20 nt, Human
ccuccuuccuugaccagcag

SEQ ID NO: 3500585 - RNA, 15 nt, Human
ccuccuucucccuuu

SEQ ID NO: 3500586 - RNA, 17 nt, Human
ccuccuucucccuuuuu

SEQ ID NO: 3500587 - RNA, 23 nt, Human
ccuccuucucugucucaugugug

SEQ ID NO: 3500588 - RNA, 22 nt, Human
ccuccuucugagcuccuguccc

SEQ ID NO: 3500589 - RNA, 14 nt, Human
ccuccuugccuccu

SEQ ID NO: 3500590 - RNA, 17 nt, Human
ccuccuugcuuguuaca

SEQ ID NO: 3500591 - RNA, 12 nt, Human
ccuccuugggca

SEQ ID NO: 3500592 - RNA, 15 nt, Human
ccuccuuguccaccc

SEQ ID NO: 3500593 - RNA, 16 nt, Human
ccuccuuguccaccca

SEQ ID NO: 3500594 - RNA, 19 nt, Human
ccuccuuuacccucaucug

SEQ ID NO: 3500595 - RNA, 13 nt, Human
cuggcccccacau

SEQ ID NO: 3500596 - RNA, 13 nt, Human
cuggcccccacug

SEQ ID NO: 3500597 - RNA, 15 nt, Human
cuggcccccagcugu

SEQ ID NO: 3500598 - RNA, 17 nt, Human
cuggcccccucccugga

SEQ ID NO: 3500599 - RNA, 18 nt, Human
cuggcccccucccuggau

SEQ ID NO: 3500600 - RNA, 14 nt, Human
cuggccccgccgcc

SEQ ID NO: 3500601 - RNA, 16 nt, Human
cuggccccgccgccug

SEQ ID NO: 3500602 - RNA, 22 nt, Human
cuggccccgccgccugguacuc

SEQ ID NO: 3500603 - RNA, 18 nt, Human
cuggccccggaucagagc

SEQ ID NO: 3500604 - RNA, 20 nt, Human
cuggccccuagaaucagccu

SEQ ID NO: 3500605 - RNA, 22 nt, Human
cuggccccucaccugggcaccu

SEQ ID NO: 3500606 - RNA, 17 nt, Human
cuggccccucagggucc

SEQ ID NO: 3500607 - RNA, 18 nt, Human
cuggccccucaggguccc

SEQ ID NO: 3500608 - RNA, 24 nt, Human
cuggccccucgccuguggagcuca

SEQ ID NO: 3500609 - RNA, 13 nt, Human
cuggccccucucc

SEQ ID NO: 3500610 - RNA, 15 nt, Human
cuggccccucucccu

SEQ ID NO: 3500611 - RNA, 24 nt, Human
cuggccccucucccuugggcucug

SEQ ID NO: 3500612 - RNA, 12 nt, Human
cuggccccuggg

SEQ ID NO: 3500613 - RNA, 17 nt, Human
cuggccccuuugggccc

SEQ ID NO: 3500614 - RNA, 20 nt, Human
cuggccccuuugggcccugc

SEQ ID NO: 3500615 - RNA, 18 nt, Human
cuggcccgucauguuccu

SEQ ID NO: 3500616 - RNA, 13 nt, Human
cuggcccuagacu

SEQ ID NO: 3500617 - RNA, 16 nt, Human
cuggcccucaaggccu

SEQ ID NO: 3500618 - RNA, 19 nt, Human
cuggcccucaaggccuccc

SEQ ID NO: 3500619 - RNA, 21 nt, Human
cuggcccucaaggccucccac

SEQ ID NO: 3500620 - RNA, 22 nt, Human
cuggcccucaaggccucccaca

SEQ ID NO: 3500621 - RNA, 19 nt, Human
cuggcccucgacacucacc

SEQ ID NO: 3500622 - RNA, 23 nt, Human
cuggcccucucugaaggaggcca

SEQ ID NO: 3500623 - RNA, 14 nt, Human
cuggcccucugugu

SEQ ID NO: 3500624 - RNA, 16 nt, Human
cuggcccucuucuuac

SEQ ID NO: 3500625 - RNA, 13 nt, Human
cuggcccugcccu

SEQ ID NO: 3500626 - RNA, 16 nt, Human
cuggcccugcccugag

SEQ ID NO: 3500627 - RNA, 17 nt, Human
cuggcccugcccugagg

SEQ ID NO: 3500628 - RNA, 15 nt, Human
cuggcccugcccugg

SEQ ID NO: 3500629 - RNA, 13 nt, Human
cuggcccugcuuc

SEQ ID NO: 3500630 - RNA, 21 nt, Human
cuggcccugcuuccugcuugc

SEQ ID NO: 3500631 - RNA, 12 nt, Human
cuggcccuggcu

SEQ ID NO: 3500632 - RNA, 11 nt, Human
cuggcccuggg

SEQ ID NO: 3500633 - RNA, 21 nt, Human
cuggcccugggagaaucgcuc

SEQ ID NO: 3500634 - RNA, 19 nt, Human
cuggcccuuacuugcuucu

SEQ ID NO: 3500635 - RNA, 12 nt, Human
cuggcccuuccu

SEQ ID NO: 3500636 - RNA, 17 nt, Human
cuggccgaggguccugg

SEQ ID NO: 3500637 - RNA, 21 nt, Human
cuggccgaggguccuggcucc

SEQ ID NO: 3500638 - RNA, 21 nt, Human
cuggccgcccccagcccccuc

SEQ ID NO: 3500639 - RNA, 22 nt, Human
cuggccgcccccugccccccag

SEQ ID NO: 3500640 - RNA, 19 nt, Human
cuggccgccucacccccuc

SEQ ID NO: 3500641 - RNA, 22 nt, Human
cuggccgcguuuagaccaagga

SEQ ID NO: 3500642 - RNA, 14 nt, Human
cuggccggccagcc

SEQ ID NO: 3500643 - RNA, 13 nt, Human
cuggccgggagcc

SEQ ID NO: 3500644 - RNA, 20 nt, Human
cuggccgggcacagcugugg

SEQ ID NO: 3500645 - RNA, 20 nt, Human
cuggccggucugcaagucag

SEQ ID NO: 3500646 - RNA, 23 nt, Human
cuggccguugauguuggcuggga

SEQ ID NO: 3500647 - RNA, 17 nt, Human
cuggccuagcauacgua

SEQ ID NO: 3500648 - RNA, 23 nt, Human
cuggccuagcauacguacacauu

SEQ ID NO: 3500649 - RNA, 23 nt, Human
cuggccuaggagauaucugaggg

SEQ ID NO: 3500650 - RNA, 17 nt, Human
cuggccuagucccuucc

SEQ ID NO: 3500651 - RNA, 23 nt, Human
cuggccucaagugauucuccugc

SEQ ID NO: 3500652 - RNA, 15 nt, Human
auuuauugguuuugc

SEQ ID NO: 3500653 - RNA, 18 nt, Human
auuuauuguauuuuagua

SEQ ID NO: 3500654 - RNA, 20 nt, Human
auuuauuguuuauuuaucag

SEQ ID NO: 3500655 - RNA, 16 nt, Human
auuuauuuaaaauagc

SEQ ID NO: 3500656 - RNA, 14 nt, Human
auuuauuuaaagca

SEQ ID NO: 3500657 - RNA, 20 nt, Human
auuuauuuaaagcauugcuu

SEQ ID NO: 3500658 - RNA, 14 nt, Human
auuuauuuaaauuu

SEQ ID NO: 3500659 - RNA, 13 nt, Human
auuuauuuaauaa

SEQ ID NO: 3500660 - RNA, 16 nt, Human
auuuauuuaauaacaa

SEQ ID NO: 3500661 - RNA, 20 nt, Human
auuuauuuaauaacaauugu

SEQ ID NO: 3500662 - RNA, 18 nt, Human
auuuauuuacaaauguuu

SEQ ID NO: 3500663 - RNA, 17 nt, Human
auuuauuuacugcuagu

SEQ ID NO: 3500664 - RNA, 16 nt, Human
auuuauuuauguacuu

SEQ ID NO: 3500665 - RNA, 18 nt, Human
auuuauuuauguacuuuu

SEQ ID NO: 3500666 - RNA, 13 nt, Human
auuuauuuauuau

SEQ ID NO: 3500667 - RNA, 14 nt, Human
auuuauuuauuauu

SEQ ID NO: 3500668 - RNA, 14 nt, Human
auuuauuuauuuaa

SEQ ID NO: 3500669 - RNA, 14 nt, Human
auuuauuuauuuau

SEQ ID NO: 3500670 - RNA, 13 nt, Human
auuuauuuccuag

SEQ ID NO: 3500671 - RNA, 20 nt, Human
auuuauuuuaauaauguuuc

SEQ ID NO: 3500672 - RNA, 21 nt, Human
auuuauuuuaauaauguuuca

SEQ ID NO: 3500673 - RNA, 16 nt, Human
auuuauuuuaugagaa

SEQ ID NO: 3500674 - RNA, 17 nt, Human
auuuauuuuaugagaaa

SEQ ID NO: 3500675 - RNA, 15 nt, Human
auuuauuuuccuaaa

SEQ ID NO: 3500676 - RNA, 17 nt, Human
auuuauuuuccuaaaga

SEQ ID NO: 3500677 - RNA, 19 nt, Human
auuuauuuuccuaaagaga

SEQ ID NO: 3500678 - RNA, 15 nt, Human
auuuauuuuguaauu

SEQ ID NO: 3500679 - RNA, 16 nt, Human
auuuauuuuguaauua

SEQ ID NO: 3500680 - RNA, 22 nt, Human
auuuauuuuguaugaaauauau

SEQ ID NO: 3500681 - RNA, 18 nt, Human
auuuauuuuucaguucca

SEQ ID NO: 3500682 - RNA, 22 nt, Human
auuuauuuuucaguuccaagaa

SEQ ID NO: 3500683 - RNA, 21 nt, Human
auuuauuuuucucaugaaucu

SEQ ID NO: 3500684 - RNA, 19 nt, Human
auuuauuuuuuacauuauu

SEQ ID NO: 3500685 - RNA, 22 nt, Human
auuuauuuuuucuuuucuuuac

SEQ ID NO: 3500686 - RNA, 18 nt, Human
auuuauuuuuuuuaaaga

SEQ ID NO: 3500687 - RNA, 21 nt, Human
auuuauuuuuuuuaauuguau

SEQ ID NO: 3500688 - RNA, 23 nt, Human
auuuauuuuuuuuaauuguauuu

SEQ ID NO: 3500689 - RNA, 12 nt, Human
auuucaaaaauu

SEQ ID NO: 3500690 - RNA, 17 nt, Human
auuucaaaaauuuggaa

SEQ ID NO: 3500691 - RNA, 20 nt, Human
auuucaaaaauuuggaauuc

SEQ ID NO: 3500692 - RNA, 14 nt, Human
auuucaaaacucau

SEQ ID NO: 3500693 - RNA, 20 nt, Human
auacaguuuuccuaaaugua

SEQ ID NO: 3500694 - RNA, 20 nt, Human
auacauaaaagaaauaaacc

SEQ ID NO: 3500695 - RNA, 22 nt, Human
auacauaacuaaauuugauacu

SEQ ID NO: 3500696 - RNA, 24 nt, Human
auacauaacuaaauuugauacuua

SEQ ID NO: 3500697 - RNA, 21 nt, Human
auacauaagcggcguaaguuu

SEQ ID NO: 3500698 - RNA, 15 nt, Human
auacauacaccagca

SEQ ID NO: 3500699 - RNA, 19 nt, Human
auacauacacuuguauaaa

SEQ ID NO: 3500700 - RNA, 20 nt, Human
auacauacggucagguuuaa

SEQ ID NO: 3500701 - RNA, 18 nt, Human
auacauagggauaugcgu

SEQ ID NO: 3500702 - RNA, 14 nt, Human
auacauauggaugu

SEQ ID NO: 3500703 - RNA, 18 nt, Human
auacauauguagacuaua

SEQ ID NO: 3500704 - RNA, 21 nt, Human
auacauauguagacuauauac

SEQ ID NO: 3500705 - RNA, 14 nt, Human
auacauauuuccaa

SEQ ID NO: 3500706 - RNA, 14 nt, Human
auacaucaguuauu

SEQ ID NO: 3500707 - RNA, 15 nt, Human
auacaucucucccca

SEQ ID NO: 3500708 - RNA, 16 nt, Human
auacaucucuccccaa

SEQ ID NO: 3500709 - RNA, 17 nt, Human
auacaugaaaauuuuaa

SEQ ID NO: 3500710 - RNA, 18 nt, Human
auacaugaagcuucaugc

SEQ ID NO: 3500711 - RNA, 16 nt, Human
auacaugacucagcau

SEQ ID NO: 3500712 - RNA, 20 nt, Human
auacaugcauauaaugaaua

SEQ ID NO: 3500713 - RNA, 17 nt, Human
auacaugccacaucaaa

SEQ ID NO: 3500714 - RNA, 13 nt, Human
auacaugcugcua

SEQ ID NO: 3500715 - RNA, 14 nt, Human
auacauggauaaca

SEQ ID NO: 3500716 - RNA, 21 nt, Human
auacaugucacauuuagcugu

SEQ ID NO: 3500717 - RNA, 16 nt, Human
auacaugugauacauu

SEQ ID NO: 3500718 - RNA, 18 nt, Human
auacaugugauacauuuu

SEQ ID NO: 3500719 - RNA, 12 nt, Human
auacaugugugu

SEQ ID NO: 3500720 - RNA, 13 nt, Human
auacaugugugua

SEQ ID NO: 3500721 - RNA, 14 nt, Human
auacauguguguau

SEQ ID NO: 3500722 - RNA, 18 nt, Human
auacauguguguauauau

SEQ ID NO: 3500723 - RNA, 22 nt, Human
auacauguguguauauaugugu

SEQ ID NO: 3500724 - RNA, 16 nt, Human
auacauguuuauguaa

SEQ ID NO: 3500725 - RNA, 19 nt, Human
auacauguuuauguaaaca

SEQ ID NO: 3500726 - RNA, 21 nt, Human
auacauguuuauguaaacaaa

SEQ ID NO: 3500727 - RNA, 16 nt, Human
auacauuaaagcaguc

SEQ ID NO: 3500728 - RNA, 13 nt, Human
auacauuaguaaa

SEQ ID NO: 3500729 - RNA, 18 nt, Human
auacauuaguaaaugucu

SEQ ID NO: 3500730 - RNA, 17 nt, Human
auacauuauauuucuau

SEQ ID NO: 3500731 - RNA, 20 nt, Human
auacauucaaauuugucugg

SEQ ID NO: 3500732 - RNA, 17 nt, Human
auacauugaauuagaaa

SEQ ID NO: 3500733 - RNA, 22 nt, Human
auacauuguacgaagaguauuu

SEQ ID NO: 3500734 - RNA, 20 nt, Human
auacauuguauauaugugua

SEQ ID NO: 3500735 - RNA, 21 nt, Human
auacauuuaaaacauuaaaau

SEQ ID NO: 3500736 - RNA, 21 nt, Human
auacauuuauaauguuugcua

SEQ ID NO: 3500737 - RNA, 22 nt, Human
auacauuucuccuuugauaaaa

SEQ ID NO: 3500738 - RNA, 19 nt, Human
auacauuugaggggaaaac

SEQ ID NO: 3500739 - RNA, 14 nt, Human
auacauuuguaugu

SEQ ID NO: 3500740 - RNA, 17 nt, Human
auacauuuguauguugu

SEQ ID NO: 3500741 - RNA, 16 nt, Human
auaccaaaauguugcu

SEQ ID NO: 3500742 - RNA, 14 nt, Human
auaccaauaaagug

SEQ ID NO: 3500743 - RNA, 19 nt, Human
auaccaaugaaaaaaugua

SEQ ID NO: 3500744 - RNA, 20 nt, Human
auaccaaugcuuuuaucaaa

SEQ ID NO: 3500745 - RNA, 15 nt, Human
auaccacaucaaaua

SEQ ID NO: 3500746 - RNA, 14 nt, Human
auaccacucuguaa

SEQ ID NO: 3500747 - RNA, 15 nt, Human
auaccagacugcagg

SEQ ID NO: 3500748 - RNA, 19 nt, Human
auaccagccaguaaauggg

SEQ ID NO: 3500749 - RNA, 23 nt, Human
auaccagcuacuccggaggcuga

SEQ ID NO: 3500750 - RNA, 19 nt, Human
auaccagcuuguaugcaau

SEQ ID NO: 3500751 - RNA, 20 nt, Human
auaccagugaaccaaagaga

SEQ ID NO: 3500752 - RNA, 17 nt, Human
auaccauacucauuucu

SEQ ID NO: 3500753 - RNA, 19 nt, Human
auaccauacucauuucuaa

SEQ ID NO: 3500754 - RNA, 11 nt, Human
auaccaucagc

SEQ ID NO: 3500755 - RNA, 17 nt, Human
auaccaucagcaaagaa

SEQ ID NO: 3500756 - RNA, 19 nt, Human
auaccauuaaaacugcuuu

SEQ ID NO: 3500757 - RNA, 13 nt, Human
auaccauuuccgu

SEQ ID NO: 3500758 - RNA, 18 nt, Human
auacccaaauccucucca

SEQ ID NO: 3500759 - RNA, 12 nt, Human
auacccaccccc

SEQ ID NO: 3500760 - RNA, 17 nt, Human
auacccccccaugcagu

SEQ ID NO: 3500761 - RNA, 17 nt, Human
auacccccugcaaagcc

SEQ ID NO: 3500762 - RNA, 22 nt, Human
auacccccugcaaagcccagcu

SEQ ID NO: 3500763 - RNA, 14 nt, Human
auacccugcccuug

SEQ ID NO: 3500764 - RNA, 22 nt, Human
auacccuuggaaauacuguaug

SEQ ID NO: 3500765 - RNA, 14 nt, Human
auaccuaaguacug

SEQ ID NO: 3500766 - RNA, 17 nt, Human
auaccuaaguacuguaa

SEQ ID NO: 3500767 - RNA, 15 nt, Human
auaccuacauguauu

SEQ ID NO: 3500768 - RNA, 14 nt, Human
auaccuauaaugug

SEQ ID NO: 3500769 - RNA, 15 nt, Human
auaccuauaaugugu

SEQ ID NO: 3500770 - RNA, 21 nt, Human
auaccucaggaaagaauagaa

SEQ ID NO: 3500771 - RNA, 13 nt, Human
auaccucauguuu

SEQ ID NO: 3500772 - RNA, 17 nt, Human
auaccucauguuuauga

SEQ ID NO: 3500773 - RNA, 20 nt, Human
auaccucauguuuaugaaaa

SEQ ID NO: 3500774 - RNA, 14 nt, Human
auaccucuaauagu

SEQ ID NO: 3500775 - RNA, 15 nt, Human
auaccucugaccaac

SEQ ID NO: 3500776 - RNA, 13 nt, Human
auaccucugugug

SEQ ID NO: 3500777 - RNA, 17 nt, Human
auaccucugugugcucc

SEQ ID NO: 3500778 - RNA, 20 nt, Human
auaccucuuagcugagugga

SEQ ID NO: 3500779 - RNA, 18 nt, Human
auaccugggcauacuaau

SEQ ID NO: 3500780 - RNA, 14 nt, Human
auaccugucaauac

SEQ ID NO: 3500781 - RNA, 15 nt, Human
auaccugucccccug

SEQ ID NO: 3500782 - RNA, 16 nt, Human
auaccugucccccuga

SEQ ID NO: 3500783 - RNA, 18 nt, Human
auaccugucccccugaca

SEQ ID NO: 3500784 - RNA, 15 nt, Human
auaccuguuuaaauu

SEQ ID NO: 3500785 - RNA, 13 nt, Human
auaccuuaaaauu

SEQ ID NO: 3500786 - RNA, 21 nt, Human
auaccuuaaaauuugaaacau

SEQ ID NO: 3500787 - RNA, 20 nt, Human
auaccuucgggguacaaguc

SEQ ID NO: 3500788 - RNA, 13 nt, Human
auaccuucuuauu

SEQ ID NO: 3500789 - RNA, 14 nt, Human
auaccuugcuuauu

SEQ ID NO: 3500790 - RNA, 20 nt, Human
auaccuuugcuacuacuaug

SEQ ID NO: 3500791 - RNA, 17 nt, Human
auacgacuuuauuuucu

SEQ ID NO: 3500792 - RNA, 20 nt, Human
auacgagagcagaggucucc

SEQ ID NO: 3500793 - RNA, 23 nt, Human
auacgcaacauaauuaaauuuug

SEQ ID NO: 3500794 - RNA, 20 nt, Human
auacgcuacuauaaagagaa

SEQ ID NO: 3500795 - RNA, 15 nt, Human
auacgcuuuucuuug

SEQ ID NO: 3500796 - RNA, 15 nt, Human
auacggcuccccagu

SEQ ID NO: 3500797 - RNA, 19 nt, Human
auuucccaacacaaagauu

SEQ ID NO: 3500798 - RNA, 12 nt, Human
auuucccaggac

SEQ ID NO: 3500799 - RNA, 14 nt, Human
auuucccaggaccc

SEQ ID NO: 3500800 - RNA, 16 nt, Human
auuucccaggacccug

SEQ ID NO: 3500801 - RNA, 15 nt, Human
auuucccaggguuaa

SEQ ID NO: 3500802 - RNA, 21 nt, Human
auuucccauccccugugggaa

SEQ ID NO: 3500803 - RNA, 14 nt, Human
auuucccaucugca

SEQ ID NO: 3500804 - RNA, 18 nt, Human
auuucccaugauuucaug

SEQ ID NO: 3500805 - RNA, 15 nt, Human
auuuccccagaccug

SEQ ID NO: 3500806 - RNA, 15 nt, Human
auuuccccagggcac

SEQ ID NO: 3500807 - RNA, 21 nt, Human
auuuccccaggggaaaaugaa

SEQ ID NO: 3500808 - RNA, 17 nt, Human
auuuccccccuccgccu

SEQ ID NO: 3500809 - RNA, 23 nt, Human
auuuccccccuccgccuccagga

SEQ ID NO: 3500810 - RNA, 17 nt, Human
auuucccccuuucuucc

SEQ ID NO: 3500811 - RNA, 17 nt, Human
auuuccccuaaucuuuu

SEQ ID NO: 3500812 - RNA, 23 nt, Human
auuuccccucugcacccagaaca

SEQ ID NO: 3500813 - RNA, 15 nt, Human
auuuccccuuuugca

SEQ ID NO: 3500814 - RNA, 16 nt, Human
auuuccccuuuugcau

SEQ ID NO: 3500815 - RNA, 21 nt, Human
auuuccccuuuugcauucucc

SEQ ID NO: 3500816 - RNA, 15 nt, Human
auuucccguggcccc

SEQ ID NO: 3500817 - RNA, 16 nt, Human
auuucccguggcccca

SEQ ID NO: 3500818 - RNA, 18 nt, Human
auuucccguggccccagc

SEQ ID NO: 3500819 - RNA, 18 nt, Human
auuucccuaaaauacauu

SEQ ID NO: 3500820 - RNA, 20 nt, Human
auuucccuaaaauacauuua

SEQ ID NO: 3500821 - RNA, 17 nt, Human
auuucccuacauuaaac

SEQ ID NO: 3500822 - RNA, 23 nt, Human
auuucccugaaggaaccaaagcg

SEQ ID NO: 3500823 - RNA, 18 nt, Human
auuucccugacuccucua

SEQ ID NO: 3500824 - RNA, 12 nt, Human
auuucccuucuu

SEQ ID NO: 3500825 - RNA, 13 nt, Human
auuucccuucuug

SEQ ID NO: 3500826 - RNA, 16 nt, Human
auuucccuucuugcau

SEQ ID NO: 3500827 - RNA, 20 nt, Human
auuucccuuuagcuguguua

SEQ ID NO: 3500828 - RNA, 21 nt, Human
auuucccuuuagcuguguuau

SEQ ID NO: 3500829 - RNA, 23 nt, Human
auuucccuuuagcuguguuauua

SEQ ID NO: 3500830 - RNA, 22 nt, Human
auuuccgcacuucagaauucca

SEQ ID NO: 3500831 - RNA, 18 nt, Human
auuuccguaauucuuauu

SEQ ID NO: 3500832 - RNA, 16 nt, Human
auuuccguuaaaauac

SEQ ID NO: 3500833 - RNA, 17 nt, Human
auuuccguuaaaauacc

SEQ ID NO: 3500834 - RNA, 15 nt, Human
auuuccuaugaugua

SEQ ID NO: 3500835 - RNA, 22 nt, Human
auuuccucaacguugcucccca

SEQ ID NO: 3500836 - RNA, 19 nt, Human
auuuccucagcuuaucucu

SEQ ID NO: 3500837 - RNA, 21 nt, Human
auuuccucaugugaucacaau

SEQ ID NO: 3500838 - RNA, 22 nt, Human
auuuccucaugugaucacaauu

SEQ ID NO: 3500839 - RNA, 19 nt, Human
auuuccucccucugccccu

SEQ ID NO: 3500840 - RNA, 11 nt, Human
auuuccucuau

SEQ ID NO: 3500841 - RNA, 17 nt, Human
auuuccuggugugaagg

SEQ ID NO: 3500842 - RNA, 16 nt, Human
auuuccuguuggauuu

SEQ ID NO: 3500843 - RNA, 22 nt, Human
auuuccuguuggauuuguuuaa

SEQ ID NO: 3500844 - RNA, 15 nt, Human
auuuccuugugcaaa

SEQ ID NO: 3500845 - RNA, 13 nt, Human
auuuccuuuaugu

SEQ ID NO: 3500846 - RNA, 20 nt, Human
auuuccuuuaugugaauuuu

SEQ ID NO: 3500847 - RNA, 21 nt, Human
auuucgccguugaagaggaag

SEQ ID NO: 3500848 - RNA, 14 nt, Human
auugcuaaauguaa

SEQ ID NO: 3500849 - RNA, 15 nt, Human
auugcuaauugcugu

SEQ ID NO: 3500850 - RNA, 20 nt, Human
auugcuacuguccuacccac

SEQ ID NO: 3500851 - RNA, 22 nt, Human
auugcuacuguccuacccaccc

SEQ ID NO: 3500852 - RNA, 14 nt, Human
auugcuaguauuug

SEQ ID NO: 3500853 - RNA, 16 nt, Human
auugcuaguauuugaa

SEQ ID NO: 3500854 - RNA, 18 nt, Human
auugcuaguauuugaauu

SEQ ID NO: 3500855 - RNA, 20 nt, Human
auugcuaguauuugaauuaa

SEQ ID NO: 3500856 - RNA, 18 nt, Human
auugcuauguuacuauuu

SEQ ID NO: 3500857 - RNA, 22 nt, Human
auugcuauguuuugacauuuuu

SEQ ID NO: 3500858 - RNA, 17 nt, Human
auugcucacaguuauua

SEQ ID NO: 3500859 - RNA, 19 nt, Human
auugcucccuaagacugug

SEQ ID NO: 3500860 - RNA, 12 nt, Human
auugcugaaauu

SEQ ID NO: 3500861 - RNA, 22 nt, Human
auugcugaagggcauucuuucc

SEQ ID NO: 3500862 - RNA, 18 nt, Human
auugcugauggugcaaug

SEQ ID NO: 3500863 - RNA, 23 nt, Human
auugcugauggugcaaugaccuu

SEQ ID NO: 3500864 - RNA, 13 nt, Human
auugcugauuuua

SEQ ID NO: 3500865 - RNA, 17 nt, Human
auugcugauuuuaaugg

SEQ ID NO: 3500866 - RNA, 18 nt, Human
auugcugcuccuuagcug

SEQ ID NO: 3500867 - RNA, 20 nt, Human
auugcugcuccuuagcugcc

SEQ ID NO: 3500868 - RNA, 15 nt, Human
auugcugcugguaau

SEQ ID NO: 3500869 - RNA, 20 nt, Human
auugcuggcaaagacagaag

SEQ ID NO: 3500870 - RNA, 22 nt, Human
auugcuggcaaagacagaagcc

SEQ ID NO: 3500871 - RNA, 18 nt, Human
auugcuggucuuguaaga

SEQ ID NO: 3500872 - RNA, 19 nt, Human
auugcuggucuuguaagag

SEQ ID NO: 3500873 - RNA, 14 nt, Human
auugcugguucuau

SEQ ID NO: 3500874 - RNA, 22 nt, Human
auugcugguucuauuuaaugga

SEQ ID NO: 3500875 - RNA, 23 nt, Human
auugcugucaaguuccuuugggu

SEQ ID NO: 3500876 - RNA, 22 nt, Human
auugcuguccuugaaugccaua

SEQ ID NO: 3500877 - RNA, 15 nt, Human
auugcugucugcagc

SEQ ID NO: 3500878 - RNA, 21 nt, Human
auugcuguguccaacuccagu

SEQ ID NO: 3500879 - RNA, 22 nt, Human
auugcuguguccaacuccagua

SEQ ID NO: 3500880 - RNA, 23 nt, Human
auugcuguguccaacuccaguac

SEQ ID NO: 3500881 - RNA, 19 nt, Human
auugcugugugucccaggc

SEQ ID NO: 3500882 - RNA, 23 nt, Human
auugcuguuaugucuguuuaaga

SEQ ID NO: 3500883 - RNA, 21 nt, Human
auugcuguugaaagcaaaaau

SEQ ID NO: 3500884 - RNA, 23 nt, Human
auugcuguugaaagcaaaaaugc

SEQ ID NO: 3500885 - RNA, 16 nt, Human
auugcuuaaaauagca

SEQ ID NO: 3500886 - RNA, 13 nt, Human
auugcuuacauuu

SEQ ID NO: 3500887 - RNA, 19 nt, Human
auugcuuacauuuuuacaa

SEQ ID NO: 3500888 - RNA, 21 nt, Human
auugcuuacauuuuuacaaua

SEQ ID NO: 3500889 - RNA, 23 nt, Human
auugcuuauuuauuguauucugg

SEQ ID NO: 3500890 - RNA, 22 nt, Human
auugcuucuucuccuaugugua

SEQ ID NO: 3500891 - RNA, 23 nt, Human
auugcuucuucuccuauguguaa

SEQ ID NO: 3500892 - RNA, 13 nt, Human
auugcuucuucug

SEQ ID NO: 3500893 - RNA, 14 nt, Human
auugcuucuucuga

SEQ ID NO: 3500894 - RNA, 18 nt, Human
auugcuugagcccaggag

SEQ ID NO: 3500895 - RNA, 14 nt, Human
auugcuugagcuca

SEQ ID NO: 3500896 - RNA, 18 nt, Human
auugcuugagcucaggag

SEQ ID NO: 3500897 - RNA, 15 nt, Human
auugcuuuauaaaua

SEQ ID NO: 3500898 - RNA, 13 nt, Human
auugcuuucugaa

SEQ ID NO: 3500899 - RNA, 14 nt, Human
auugcuuucuuuca

SEQ ID NO: 3500900 - RNA, 10 nt, Human
auugcuuuga

SEQ ID NO: 3500901 - RNA, 23 nt, Human
auugcuuugaagcaguuguguca

SEQ ID NO: 3500902 - RNA, 18 nt, Human
auugcuuuuaaaacuacu

SEQ ID NO: 3500903 - RNA, 17 nt, Human
auugcuuuuaaaauuuu

SEQ ID NO: 3500904 - RNA, 15 nt, Human
auugcuuuuuuguau

SEQ ID NO: 3500905 - RNA, 18 nt, Human
auuggaacuggaggcagg

SEQ ID NO: 3500906 - RNA, 14 nt, Human
auuggaagaaauuc

SEQ ID NO: 3500907 - RNA, 19 nt, Human
auuggaagcagguuaaaug

SEQ ID NO: 3500908 - RNA, 21 nt, Human
auuggaagcagguuaaauguu

SEQ ID NO: 3500909 - RNA, 17 nt, Human
auuggaaggagacacag

SEQ ID NO: 3500910 - RNA, 19 nt, Human
auuggaaggagacacagau

SEQ ID NO: 3500911 - RNA, 20 nt, Human
auuggaaggagacacagaug

SEQ ID NO: 3500912 - RNA, 14 nt, Human
auuggaaucugaua

SEQ ID NO: 3500913 - RNA, 17 nt, Human
auuggaaugcacucaga

SEQ ID NO: 3500914 - RNA, 12 nt, Human
auuggaauuaac

SEQ ID NO: 3500915 - RNA, 15 nt, Human
auuggaauuaaccug

SEQ ID NO: 3500916 - RNA, 22 nt, Human
auuggacauagauauuuucaca

SEQ ID NO: 3500917 - RNA, 14 nt, Human
auuggacccuucca

SEQ ID NO: 3500918 - RNA, 21 nt, Human
auuggagagggcucugugcug

SEQ ID NO: 3500919 - RNA, 17 nt, Human
auuggagauagggaaag

SEQ ID NO: 3500920 - RNA, 21 nt, Human
auuggagcggugggcacuguu

SEQ ID NO: 3500921 - RNA, 19 nt, Human
auuggagcucgugggacag

SEQ ID NO: 3500922 - RNA, 23 nt, Human
auuggaggaaagcaaccggugga

SEQ ID NO: 3500923 - RNA, 20 nt, Human
auuggaguuggaguagaaug

SEQ ID NO: 3500924 - RNA, 21 nt, Human
auuggaguuggaguagaaugu

SEQ ID NO: 3500925 - RNA, 20 nt, Human
auuggauacagcaguagaca

SEQ ID NO: 3500926 - RNA, 22 nt, Human
auuggauuauuuaauaacauua

SEQ ID NO: 3500927 - RNA, 14 nt, Human
auuggauuuccuaa

SEQ ID NO: 3500928 - RNA, 16 nt, Human
auuggauuugucuuug

SEQ ID NO: 3500929 - RNA, 22 nt, Human
auuggauuuuauguugacauuu

SEQ ID NO: 3500930 - RNA, 13 nt, Human
auuggcaaaacua

SEQ ID NO: 3500931 - RNA, 20 nt, Human
auuggcaccuaauccaggca

SEQ ID NO: 3500932 - RNA, 12 nt, Human
auuggcagcaga

SEQ ID NO: 3500933 - RNA, 13 nt, Human
auuggcagcagau

SEQ ID NO: 3500934 - RNA, 15 nt, Human
auuggcagcagauuu

SEQ ID NO: 3500935 - RNA, 19 nt, Human
auuggcagcaggugcugcu

SEQ ID NO: 3500936 - RNA, 23 nt, Human
auuggcauggaaauuuaaagcag

SEQ ID NO: 3500937 - RNA, 18 nt, Human
auuggcauggauuucugu

SEQ ID NO: 3500938 - RNA, 12 nt, Human
auuggccuguag

SEQ ID NO: 3500939 - RNA, 19 nt, Human
auuggcuagagguucaaag

SEQ ID NO: 3500940 - RNA, 19 nt, Human
auagaaagugccagaaagu

SEQ ID NO: 3500941 - RNA, 18 nt, Human
auagaaaguguucuguua

SEQ ID NO: 3500942 - RNA, 19 nt, Human
auagaaaguguucuguuac

SEQ ID NO: 3500943 - RNA, 22 nt, Human
auagaaaguguucuguuacaaa

SEQ ID NO: 3500944 - RNA, 23 nt, Human
auagaaaguguucuguuacaaaa

SEQ ID NO: 3500945 - RNA, 23 nt, Human
auagaaaguugcaaggcaaaugu

SEQ ID NO: 3500946 - RNA, 14 nt, Human
auagaaauauauac

SEQ ID NO: 3500947 - RNA, 17 nt, Human
auagaaaugccaagcac

SEQ ID NO: 3500948 - RNA, 19 nt, Human
auagaaaugccaagcacuu

SEQ ID NO: 3500949 - RNA, 12 nt, Human
auagaaauggaa

SEQ ID NO: 3500950 - RNA, 23 nt, Human
auagaaauggaaauuuugcuauc

SEQ ID NO: 3500951 - RNA, 16 nt, Human
auagaaauuuuguaag

SEQ ID NO: 3500952 - RNA, 18 nt, Human
auagaaauuuuguaagaa

SEQ ID NO: 3500953 - RNA, 14 nt, Human
auagaacaacauau

SEQ ID NO: 3500954 - RNA, 13 nt, Human
auagaacagugcu

SEQ ID NO: 3500955 - RNA, 20 nt, Human
auagaaccucuuugucuaca

SEQ ID NO: 3500956 - RNA, 21 nt, Human
auagaacucaguuuuaacuag

SEQ ID NO: 3500957 - RNA, 19 nt, Human
auagaacuggguaaaugca

SEQ ID NO: 3500958 - RNA, 14 nt, Human
auagaagaaaaaag

SEQ ID NO: 3500959 - RNA, 19 nt, Human
auagaagaacugcaaaggu

SEQ ID NO: 3500960 - RNA, 12 nt, Human
auagaagaaugc

SEQ ID NO: 3500961 - RNA, 16 nt, Human
auagaagaaugcaugc

SEQ ID NO: 3500962 - RNA, 17 nt, Human
auagaaggaaacuagcu

SEQ ID NO: 3500963 - RNA, 18 nt, Human
auagaaggaaacuagcuu

SEQ ID NO: 3500964 - RNA, 15 nt, Human
auagaaggaggagag

SEQ ID NO: 3500965 - RNA, 13 nt, Human
auagaaggcaggu

SEQ ID NO: 3500966 - RNA, 13 nt, Human
auagaaguaaaaa

SEQ ID NO: 3500967 - RNA, 14 nt, Human
auagaagucuucau

SEQ ID NO: 3500968 - RNA, 15 nt, Human
auagaagucuucaug

SEQ ID NO: 3500969 - RNA, 17 nt, Human
auagaagucuucaugaa

SEQ ID NO: 3500970 - RNA, 14 nt, Human
auagaaguuuagau

SEQ ID NO: 3500971 - RNA, 23 nt, Human
auagaaguuuguccauuuguaaa

SEQ ID NO: 3500972 - RNA, 18 nt, Human
auagaauaaaauauaauu

SEQ ID NO: 3500973 - RNA, 18 nt, Human
auagaauaaaggcaguuu

SEQ ID NO: 3500974 - RNA, 22 nt, Human
auagaauaaaggcaguuuucua

SEQ ID NO: 3500975 - RNA, 19 nt, Human
auagaauauaauuaucgga

SEQ ID NO: 3500976 - RNA, 19 nt, Human
auagaauguaaaugucuca

SEQ ID NO: 3500977 - RNA, 16 nt, Human
auagaauuaacacaug

SEQ ID NO: 3500978 - RNA, 15 nt, Human
auagaauuagcuuuu

SEQ ID NO: 3500979 - RNA, 22 nt, Human
auagaauuauaacuggaaagaa

SEQ ID NO: 3500980 - RNA, 22 nt, Human
auagaauugacauugaaaucua

SEQ ID NO: 3500981 - RNA, 19 nt, Human
auagaauuuuuaauguuuu

SEQ ID NO: 3500982 - RNA, 17 nt, Human
auagacaaauagaaaau

SEQ ID NO: 3500983 - RNA, 19 nt, Human
auagacaaauagaaaaugg

SEQ ID NO: 3500984 - RNA, 16 nt, Human
auagacaauuuauuau

SEQ ID NO: 3500985 - RNA, 23 nt, Human
auagacaauuuauuauggcacau

SEQ ID NO: 3500986 - RNA, 20 nt, Human
auagacaauuugcacaucuu

SEQ ID NO: 3500987 - RNA, 14 nt, Human
auagacagaagaaa

SEQ ID NO: 3500988 - RNA, 17 nt, Human
auagacagaagaaacaa

SEQ ID NO: 3500989 - RNA, 14 nt, Human
auagacaguuugua

SEQ ID NO: 3500990 - RNA, 21 nt, Human
auagacaguuuguaaauguua

SEQ ID NO: 3500991 - RNA, 13 nt, Human
auagacaugaaag

SEQ ID NO: 3500992 - RNA, 15 nt, Human
auagacccucucaag

SEQ ID NO: 3500993 - RNA, 17 nt, Human
auagaccuuuucauuug

SEQ ID NO: 3500994 - RNA, 22 nt, Human
auagaccuuuuuuuuuuuucca

SEQ ID NO: 3500995 - RNA, 17 nt, Human
auagacuagagaaaccg

SEQ ID NO: 3500996 - RNA, 21 nt, Human
auagacugccgugcauuagca

SEQ ID NO: 3500997 - RNA, 18 nt, Human
auagacuggaaaaaauga

SEQ ID NO: 3500998 - RNA, 22 nt, Human
auagagaaggaaagcuuuggca

SEQ ID NO: 3500999 - RNA, 17 nt, Human
auagagaauguuccaga

SEQ ID NO: 3501000 - RNA, 14 nt, Human
auagagacgggacu

SEQ ID NO: 3501001 - RNA, 17 nt, Human
auuucggauuuuuucca

SEQ ID NO: 3501002 - RNA, 16 nt, Human
auuucgugacuuuuuu

SEQ ID NO: 3501003 - RNA, 14 nt, Human
auuucuaaaaaaca

SEQ ID NO: 3501004 - RNA, 21 nt, Human
auuucuaaaaaacagaggcca

SEQ ID NO: 3501005 - RNA, 17 nt, Human
auuucuaaaauauaaga

SEQ ID NO: 3501006 - RNA, 21 nt, Human
auuucuaaagauaauauuacu

SEQ ID NO: 3501007 - RNA, 12 nt, Human
auuucuaaaucu

SEQ ID NO: 3501008 - RNA, 15 nt, Human
auuucuaacucugau

SEQ ID NO: 3501009 - RNA, 16 nt, Human
auuucuaacucugaug

SEQ ID NO: 3501010 - RNA, 18 nt, Human
auuucuaacucugaugua

SEQ ID NO: 3501011 - RNA, 19 nt, Human
auuucuaacucugauguaa

SEQ ID NO: 3501012 - RNA, 21 nt, Human
auuucuaagucaaacacuugu

SEQ ID NO: 3501013 - RNA, 14 nt, Human
auuucuaauuaugu

SEQ ID NO: 3501014 - RNA, 15 nt, Human
auuucuaauuaugua

SEQ ID NO: 3501015 - RNA, 19 nt, Human
auuucuacacagugggaac

SEQ ID NO: 3501016 - RNA, 20 nt, Human
auuucuaccaaggcauauca

SEQ ID NO: 3501017 - RNA, 21 nt, Human
auuucuacucuuaaguuucuc

SEQ ID NO: 3501018 - RNA, 16 nt, Human
auuucuacugucaaau

SEQ ID NO: 3501019 - RNA, 17 nt, Human
auuucuacugugacuga

SEQ ID NO: 3501020 - RNA, 23 nt, Human
auuucuagccugcacuuugaugu

SEQ ID NO: 3501021 - RNA, 18 nt, Human
auuucuagcuuaucuacu

SEQ ID NO: 3501022 - RNA, 21 nt, Human
auuucuagcuuaucuacuucc

SEQ ID NO: 3501023 - RNA, 16 nt, Human
auuucuagcuuuuuaa

SEQ ID NO: 3501024 - RNA, 22 nt, Human
auuucuaggaagaauuuuaaaa

SEQ ID NO: 3501025 - RNA, 20 nt, Human
auuucuaggacugaauuaug

SEQ ID NO: 3501026 - RNA, 15 nt, Human
auuucuaguuauuua

SEQ ID NO: 3501027 - RNA, 15 nt, Human
auuucuauauuuuca

SEQ ID NO: 3501028 - RNA, 18 nt, Human
auuucuauauuuucauuc

SEQ ID NO: 3501029 - RNA, 20 nt, Human
auuucuaugaaauauuaugu

SEQ ID NO: 3501030 - RNA, 11 nt, Human
auuucuauuaa

SEQ ID NO: 3501031 - RNA, 22 nt, Human
auuucuauuauuaauugcaaaa

SEQ ID NO: 3501032 - RNA, 12 nt, Human
auuucuauuuau

SEQ ID NO: 3501033 - RNA, 18 nt, Human
auuucuauuucuccucca

SEQ ID NO: 3501034 - RNA, 20 nt, Human
auuucucaacaaagcacagu

SEQ ID NO: 3501035 - RNA, 14 nt, Human
auuucucacugaga

SEQ ID NO: 3501036 - RNA, 18 nt, Human
auuucucagacuuuggaa

SEQ ID NO: 3501037 - RNA, 15 nt, Human
auuucucauguugaa

SEQ ID NO: 3501038 - RNA, 15 nt, Human
auuucucauugacuu

SEQ ID NO: 3501039 - RNA, 17 nt, Human
auuucucauugacuuuu

SEQ ID NO: 3501040 - RNA, 17 nt, Human
auuucuccucccuuccu

SEQ ID NO: 3501041 - RNA, 20 nt, Human
auuucuccugcguguucuca

SEQ ID NO: 3501042 - RNA, 11 nt, Human
auuucuccuuu

SEQ ID NO: 3501043 - RNA, 17 nt, Human
auuucucucaucuguua

SEQ ID NO: 3501044 - RNA, 13 nt, Human
auuucucucucca

SEQ ID NO: 3501045 - RNA, 18 nt, Human
auuucucucuccagucuu

SEQ ID NO: 3501046 - RNA, 22 nt, Human
auuucucucuccagucuuccac

SEQ ID NO: 3501047 - RNA, 19 nt, Human
auuucucugauuugcaaaa

SEQ ID NO: 3501048 - RNA, 15 nt, Human
auuucucuguuccau

SEQ ID NO: 3501049 - RNA, 20 nt, Human
auuucucuuacugcaaaugu

SEQ ID NO: 3501050 - RNA, 16 nt, Human
auuucucuuucuuuac

SEQ ID NO: 3501051 - RNA, 18 nt, Human
auuucucuuucuuuacaa

SEQ ID NO: 3501052 - RNA, 20 nt, Human
auuucugaaaugaccucaag

SEQ ID NO: 3501053 - RNA, 18 nt, Human
auuucugauauagaauug

SEQ ID NO: 3501054 - RNA, 18 nt, Human
auuucugcauauguugaa

SEQ ID NO: 3501055 - RNA, 16 nt, Human
auuucugccauuucau

SEQ ID NO: 3501056 - RNA, 17 nt, Human
auuucugccauuucaug

SEQ ID NO: 3501057 - RNA, 19 nt, Human
auuucugccauuucauguc

SEQ ID NO: 3501058 - RNA, 13 nt, Human
auuucugccuccc

SEQ ID NO: 3501059 - RNA, 16 nt, Human
auuucugccuccccuu

SEQ ID NO: 3501060 - RNA, 16 nt, Human
auuucugcuuucuuug

SEQ ID NO: 3501061 - RNA, 16 nt, Human
auuucugggucuuuug

SEQ ID NO: 3501062 - RNA, 16 nt, Human
auuucuguaaauacca

SEQ ID NO: 3501063 - RNA, 17 nt, Human
auuucuguaaauaccau

SEQ ID NO: 3501064 - RNA, 19 nt, Human
auuucugucacaguaaaaa

SEQ ID NO: 3501065 - RNA, 15 nt, Human
auuucugucagaaug

SEQ ID NO: 3501066 - RNA, 21 nt, Human
auuucugucauucaaaugggu

SEQ ID NO: 3501067 - RNA, 13 nt, Human
auuucuguucagc

SEQ ID NO: 3501068 - RNA, 12 nt, Human
auuucuguuuag

SEQ ID NO: 3501069 - RNA, 15 nt, Human
auuucuguuucucau

SEQ ID NO: 3501070 - RNA, 22 nt, Human
auuucuuaauuauuauaaaaau

SEQ ID NO: 3501071 - RNA, 13 nt, Human
auuucuuacaggc

SEQ ID NO: 3501072 - RNA, 15 nt, Human
auuucuuaucaccac

SEQ ID NO: 3501073 - RNA, 19 nt, Human
auuucuuaucaccacagua

SEQ ID NO: 3501074 - RNA, 16 nt, Human
auuucuuaugugacau

SEQ ID NO: 3501075 - RNA, 17 nt, Human
auuucuuaugugacauu

SEQ ID NO: 3501076 - RNA, 16 nt, Human
auuucuucaaaaugua

SEQ ID NO: 3501077 - RNA, 17 nt, Human
auuucuucaaaauguau

SEQ ID NO: 3501078 - RNA, 20 nt, Human
auuucuucaaaauguauaua

SEQ ID NO: 3501079 - RNA, 22 nt, Human
auuucuucaaaauguauauauu

SEQ ID NO: 3501080 - RNA, 21 nt, Human
auuucuucaaauccuuccaaa

SEQ ID NO: 3501081 - RNA, 20 nt, Human
auuucuugguaagaagccgg

SEQ ID NO: 3501082 - RNA, 13 nt, Human
auuucuugugccu

SEQ ID NO: 3501083 - RNA, 11 nt, Human
auuucuuuaua

SEQ ID NO: 3501084 - RNA, 16 nt, Human
auuucuuuauauuuau

SEQ ID NO: 3501085 - RNA, 14 nt, Human
auuucuuuccagag

SEQ ID NO: 3501086 - RNA, 16 nt, Human
auuucuuugaaaaaaa

SEQ ID NO: 3501087 - RNA, 15 nt, Human
auuucuuugccuguu

SEQ ID NO: 3501088 - RNA, 19 nt, Human
auuucuuugccuguucagu

SEQ ID NO: 3501089 - RNA, 23 nt, Human
auuucuuugccuguucaguuaca

SEQ ID NO: 3501090 - RNA, 21 nt, Human
auuucuuugcuguaagauguc

SEQ ID NO: 3501091 - RNA, 15 nt, Human
auuugaaaaauauaa

SEQ ID NO: 3501092 - RNA, 19 nt, Human
auuugaaaacagaaauugg

SEQ ID NO: 3501093 - RNA, 17 nt, Human
auuugaaaauaauuguu

SEQ ID NO: 3501094 - RNA, 15 nt, Human
auuugaaaauuuuga

SEQ ID NO: 3501095 - RNA, 18 nt, Human
auuugaaacacuuugcau

SEQ ID NO: 3501096 - RNA, 13 nt, Human
auuugaaacauug

SEQ ID NO: 3501097 - RNA, 13 nt, Human
auuugaaagugcc

SEQ ID NO: 3501098 - RNA, 17 nt, Human
auuugaaagugccuuug

SEQ ID NO: 3501099 - RNA, 22 nt, Human
auuugaaagugccuuugcagcu

SEQ ID NO: 3501100 - RNA, 14 nt, Human
auuugaaauauuga

SEQ ID NO: 3501101 - RNA, 19 nt, Human
auuugaacaaugaaguuga

SEQ ID NO: 3501102 - RNA, 22 nt, Human
auuugaacacuggcuaaagaua

SEQ ID NO: 3501103 - RNA, 17 nt, Human
auuugaaccaaaacauu

SEQ ID NO: 3501104 - RNA, 20 nt, Human
auuugaaccaaaacauuccg

SEQ ID NO: 3501105 - RNA, 14 nt, Human
auuugaaccaauaa

SEQ ID NO: 3501106 - RNA, 16 nt, Human
auuugaagacuucaaa

SEQ ID NO: 3501107 - RNA, 17 nt, Human
auuugaagacuucaaaa

SEQ ID NO: 3501108 - RNA, 16 nt, Human
auuugaagcaaagcac

SEQ ID NO: 3501109 - RNA, 14 nt, Human
auuugaagggucuu

SEQ ID NO: 3501110 - RNA, 23 nt, Human
auuugaaggucugcaagaaccug

SEQ ID NO: 3501111 - RNA, 17 nt, Human
auuugaaggucuugauu

SEQ ID NO: 3501112 - RNA, 15 nt, Human
auuugaaucuugucu

SEQ ID NO: 3501113 - RNA, 20 nt, Human
auuugaaucuugucucaaug

SEQ ID NO: 3501114 - RNA, 13 nt, Human
auuugaaugaaaa

SEQ ID NO: 3501115 - RNA, 15 nt, Human
auuugaaugaaaaau

SEQ ID NO: 3501116 - RNA, 20 nt, Human
auuugaaugauuuuucuuua

SEQ ID NO: 3501117 - RNA, 22 nt, Human
auuugaaugauuuuucuuuaca

SEQ ID NO: 3501118 - RNA, 12 nt, Human
auuugaaugcau

SEQ ID NO: 3501119 - RNA, 18 nt, Human
auuugaaugcauuuuguu

SEQ ID NO: 3501120 - RNA, 18 nt, Human
auuugaauggguccauuu

SEQ ID NO: 3501121 - RNA, 20 nt, Human
auuugaauguaugcuucaua

SEQ ID NO: 3501122 - RNA, 13 nt, Human
auuugaauguuaa

SEQ ID NO: 3501123 - RNA, 15 nt, Human
auuugaauuaaaacu

SEQ ID NO: 3501124 - RNA, 17 nt, Human
auuugaauuaaaacuuc

SEQ ID NO: 3501125 - RNA, 23 nt, Human
auuugaauuaucagcaaagaaaa

SEQ ID NO: 3501126 - RNA, 17 nt, Human
auuugacauagucuggc

SEQ ID NO: 3501127 - RNA, 21 nt, Human
auuugacauagucuggcugua

SEQ ID NO: 3501128 - RNA, 11 nt, Human
auuugaccucc

SEQ ID NO: 3501129 - RNA, 22 nt, Human
auuugaccuccucccuguuauu

SEQ ID NO: 3501130 - RNA, 17 nt, Human
auuugacuaauuuuaca

SEQ ID NO: 3501131 - RNA, 19 nt, Human
auuugacuguuuuuaccca

SEQ ID NO: 3501132 - RNA, 21 nt, Human
auuugacuugcaugaagagaa

SEQ ID NO: 3501133 - RNA, 18 nt, Human
auuugacuuucugucugu

SEQ ID NO: 3501134 - RNA, 16 nt, Human
auuugacuuuucugua

SEQ ID NO: 3501135 - RNA, 22 nt, Human
auuugacuuuucuguaauucag

SEQ ID NO: 3501136 - RNA, 18 nt, Human
auuugagaagcugcucaa

SEQ ID NO: 3501137 - RNA, 20 nt, Human
auuugagaagcugcucaacu

SEQ ID NO: 3501138 - RNA, 21 nt, Human
auuugagaauauaaaaaacuu

SEQ ID NO: 3501139 - RNA, 13 nt, Human
auuugagacauuc

SEQ ID NO: 3501140 - RNA, 14 nt, Human
auuugagacuauuu

SEQ ID NO: 3501141 - RNA, 21 nt, Human
auuugagauguauuucaacuu

SEQ ID NO: 3501142 - RNA, 12 nt, Human
auuugagauuuu

SEQ ID NO: 3501143 - RNA, 22 nt, Human
auuugaggacaaccauuccaga

SEQ ID NO: 3501144 - RNA, 23 nt, Human
auuugaggaguguuaagauugca

SEQ ID NO: 3501145 - RNA, 23 nt, Human
auuugaggauuuagaagugucau

SEQ ID NO: 3501146 - RNA, 17 nt, Human
auuugaggggaaaacac

SEQ ID NO: 3501147 - RNA, 22 nt, Human
auuugaggggaaaacaccauaa

SEQ ID NO: 3501148 - RNA, 23 nt, Human
auuugaggucuguucuuuccaaa

SEQ ID NO: 3501149 - RNA, 13 nt, Human
auuugagucucuu

SEQ ID NO: 3501150 - RNA, 19 nt, Human
auuugaguguuuuaagaua

SEQ ID NO: 3501151 - RNA, 16 nt, Human
auagagacuugggaau

SEQ ID NO: 3501152 - RNA, 19 nt, Human
auagagaugagcuuucuuu

SEQ ID NO: 3501153 - RNA, 22 nt, Human
auagagauuugucuaauugcau

SEQ ID NO: 3501154 - RNA, 15 nt, Human
auagagcaaaauuga

SEQ ID NO: 3501155 - RNA, 17 nt, Human
auagagcaaaauugaug

SEQ ID NO: 3501156 - RNA, 20 nt, Human
auagagccggguguccccaa

SEQ ID NO: 3501157 - RNA, 13 nt, Human
auagagccugagg

SEQ ID NO: 3501158 - RNA, 22 nt, Human
auagagcuagcuaaucucuaca

SEQ ID NO: 3501159 - RNA, 18 nt, Human
auagagcuuuuaaaaaug

SEQ ID NO: 3501160 - RNA, 19 nt, Human
auagaggcuagcuucugcu

SEQ ID NO: 3501161 - RNA, 18 nt, Human
auagaggcuucuccgcca

SEQ ID NO: 3501162 - RNA, 19 nt, Human
auagagguauauuggaaga

SEQ ID NO: 3501163 - RNA, 14 nt, Human
auagaguacacugc

SEQ ID NO: 3501164 - RNA, 22 nt, Human
auagaguugggacaauugcuua

SEQ ID NO: 3501165 - RNA, 17 nt, Human
auagauaacucuuugga

SEQ ID NO: 3501166 - RNA, 13 nt, Human
auagauacaaaug

SEQ ID NO: 3501167 - RNA, 13 nt, Human
auagauauaauga

SEQ ID NO: 3501168 - RNA, 20 nt, Human
auagauauaaugaacaaaau

SEQ ID NO: 3501169 - RNA, 19 nt, Human
auagaucaaagucaaaaau

SEQ ID NO: 3501170 - RNA, 21 nt, Human
auagaucacauaacagaaugc

SEQ ID NO: 3501171 - RNA, 15 nt, Human
auagaucccccagac

SEQ ID NO: 3501172 - RNA, 19 nt, Human
auagaucuccagcgucagc

SEQ ID NO: 3501173 - RNA, 19 nt, Human
auagaugcaagauauuuau

SEQ ID NO: 3501174 - RNA, 14 nt, Human
auagaugcccugcu

SEQ ID NO: 3501175 - RNA, 20 nt, Human
auagaugcuggcccagggcc

SEQ ID NO: 3501176 - RNA, 23 nt, Human
auagaugcuggcccagggcccag

SEQ ID NO: 3501177 - RNA, 13 nt, Human
auagaugggaaug

SEQ ID NO: 3501178 - RNA, 22 nt, Human
auagaugggggaaagcaaagca

SEQ ID NO: 3501179 - RNA, 23 nt, Human
auagaugggucuggcugagcuga

SEQ ID NO: 3501180 - RNA, 22 nt, Human
auagauguagauaaacucagaa

SEQ ID NO: 3501181 - RNA, 16 nt, Human
auagaugucuuuuaua

SEQ ID NO: 3501182 - RNA, 20 nt, Human
auagaugucuuuuauagugg

SEQ ID NO: 3501183 - RNA, 17 nt, Human
auagaugucuuuuccca

SEQ ID NO: 3501184 - RNA, 13 nt, Human
auagaugugugga

SEQ ID NO: 3501185 - RNA, 17 nt, Human
auagauuaauggcacug

SEQ ID NO: 3501186 - RNA, 18 nt, Human
auagauuaauggcacuga

SEQ ID NO: 3501187 - RNA, 13 nt, Human
auagauuagaaaa

SEQ ID NO: 3501188 - RNA, 14 nt, Human
auagauuagaaaaa

SEQ ID NO: 3501189 - RNA, 18 nt, Human
auagauucaccuguaaaa

SEQ ID NO: 3501190 - RNA, 19 nt, Human
auagauucaccuguaaaac

SEQ ID NO: 3501191 - RNA, 23 nt, Human
auagauucaccuguaaaacuuua

SEQ ID NO: 3501192 - RNA, 13 nt, Human
auagauucuaaag

SEQ ID NO: 3501193 - RNA, 18 nt, Human
auagauucuaaagauucu

SEQ ID NO: 3501194 - RNA, 17 nt, Human
auagauugcucaaauca

SEQ ID NO: 3501195 - RNA, 20 nt, Human
auagauuguccuuuugcaaa

SEQ ID NO: 3501196 - RNA, 13 nt, Human
auagauugugaau

SEQ ID NO: 3501197 - RNA, 15 nt, Human
auagauugugaauaa

SEQ ID NO: 3501198 - RNA, 21 nt, Human
auagauuuauuuuucaguucc

SEQ ID NO: 3501199 - RNA, 22 nt, Human
auagauuuauuuuucaguucca

SEQ ID NO: 3501200 - RNA, 13 nt, Human
auagcaaagaauu

SEQ ID NO: 3501201 - RNA, 15 nt, Human
auagcaacaggaaaa

SEQ ID NO: 3501202 - RNA, 15 nt, Human
auagcaacaugcuuc

SEQ ID NO: 3501203 - RNA, 17 nt, Human
auagcaagauugcuuaa

SEQ ID NO: 3501204 - RNA, 13 nt, Human
auagcaagugaau

SEQ ID NO: 3501205 - RNA, 22 nt, Human
auagcaauccauguuaguuuuu

SEQ ID NO: 3501206 - RNA, 17 nt, Human
auagcacagacccugcc

SEQ ID NO: 3501207 - RNA, 15 nt, Human
auagcacugagcaaa

SEQ ID NO: 3501208 - RNA, 11 nt, Human
auagcacuuuc

SEQ ID NO: 3501209 - RNA, 18 nt, Human
auagcacuuucauugcca

SEQ ID NO: 3501210 - RNA, 12 nt, Human
auagcacuuuga

SEQ ID NO: 3501211 - RNA, 19 nt, Human
auagcagaucuguuuugug

SEQ ID NO: 3501212 - RNA, 19 nt, Human
auagcagccaguucaaaaa

SEQ ID NO: 3501213 - RNA, 15 nt, Human
auagcagcuuauuca

SEQ ID NO: 3501214 - RNA, 18 nt, Human
auagcagcuuauucacaa

SEQ ID NO: 3501215 - RNA, 22 nt, Human
auagcaguauauguuaauuugu

SEQ ID NO: 3501216 - RNA, 13 nt, Human
auagcaugaaaua

SEQ ID NO: 3501217 - RNA, 15 nt, Human
auagcaugaaauaaa

SEQ ID NO: 3501218 - RNA, 16 nt, Human
auagcaugaaauaaaa

SEQ ID NO: 3501219 - RNA, 15 nt, Human
auagcauguauugug

SEQ ID NO: 3501220 - RNA, 16 nt, Human
auagcauugugaacug

SEQ ID NO: 3501221 - RNA, 21 nt, Human
auagcauuuuugauuuaugca

SEQ ID NO: 3501222 - RNA, 21 nt, Human
auagccaaggccaaaggaagc

SEQ ID NO: 3501223 - RNA, 23 nt, Human
auagccacauuuggaauacuuuu

SEQ ID NO: 3501224 - RNA, 13 nt, Human
auagccacuaacc

SEQ ID NO: 3501225 - RNA, 21 nt, Human
auagccauugaucauaaacug

SEQ ID NO: 3501226 - RNA, 13 nt, Human
auagcccacuuac

SEQ ID NO: 3501227 - RNA, 15 nt, Human
auagcccacuuacau

SEQ ID NO: 3501228 - RNA, 17 nt, Human
auagcccagacacagaa

SEQ ID NO: 3501229 - RNA, 13 nt, Human
auuuugaaauugu

SEQ ID NO: 3501230 - RNA, 15 nt, Human
auuuugaaauuguuu

SEQ ID NO: 3501231 - RNA, 22 nt, Human
auuuugaaccugaugaaaauaa

SEQ ID NO: 3501232 - RNA, 15 nt, Human
auuuugaagcuaauu

SEQ ID NO: 3501233 - RNA, 21 nt, Human
auuuugaagcuaauuauuuua

SEQ ID NO: 3501234 - RNA, 19 nt, Human
auuuugaagugcuguuuau

SEQ ID NO: 3501235 - RNA, 14 nt, Human
auuuugaaguuuac

SEQ ID NO: 3501236 - RNA, 19 nt, Human
auuuugaaguuuacauuuu

SEQ ID NO: 3501237 - RNA, 13 nt, Human
auuuugaaucaau

SEQ ID NO: 3501238 - RNA, 15 nt, Human
auuuugaaucaauaa

SEQ ID NO: 3501239 - RNA, 19 nt, Human
auuuugacacuauaucugu

SEQ ID NO: 3501240 - RNA, 24 nt, Human
auuuugacaguuauuuugauaaca

SEQ ID NO: 3501241 - RNA, 17 nt, Human
auuuugaccuacucuca

SEQ ID NO: 3501242 - RNA, 18 nt, Human
auuuugaccuacucucau

SEQ ID NO: 3501243 - RNA, 15 nt, Human
auuuugagaacaaag

SEQ ID NO: 3501244 - RNA, 21 nt, Human
auuuugagcugaaaugcugca

SEQ ID NO: 3501245 - RNA, 13 nt, Human
auuuugagugacu

SEQ ID NO: 3501246 - RNA, 23 nt, Human
auuuugagugacucgaggguugg

SEQ ID NO: 3501247 - RNA, 20 nt, Human
auuuugauauaaucuuucaa

SEQ ID NO: 3501248 - RNA, 13 nt, Human
auuuugaucuuca

SEQ ID NO: 3501249 - RNA, 16 nt, Human
auuuugaucuucaaca

SEQ ID NO: 3501250 - RNA, 24 nt, Human
auuuugaugcagcauuugauaaug

SEQ ID NO: 3501251 - RNA, 17 nt, Human
auuuugauguaaagaug

SEQ ID NO: 3501252 - RNA, 18 nt, Human
auuuugauguaaagaugu

SEQ ID NO: 3501253 - RNA, 15 nt, Human
auuuugauguuuuaa

SEQ ID NO: 3501254 - RNA, 16 nt, Human
auuuugauuauuguau

SEQ ID NO: 3501255 - RNA, 18 nt, Human
auuuugauuauuguauuu

SEQ ID NO: 3501256 - RNA, 18 nt, Human
auuuugcaaaauuuccag

SEQ ID NO: 3501257 - RNA, 19 nt, Human
auuuugcaaaauuuccagu

SEQ ID NO: 3501258 - RNA, 21 nt, Human
auuuugcaaagauuuaaucug

SEQ ID NO: 3501259 - RNA, 14 nt, Human
auuuugcaaauaua

SEQ ID NO: 3501260 - RNA, 18 nt, Human
auuuugcaaggugcauuu

SEQ ID NO: 3501261 - RNA, 12 nt, Human
auuuugcauaaa

SEQ ID NO: 3501262 - RNA, 19 nt, Human
auuuugcauaauaaaugcu

SEQ ID NO: 3501263 - RNA, 20 nt, Human
auuuugcauauccuuuuagu

SEQ ID NO: 3501264 - RNA, 19 nt, Human
auuuugccaagggcauaaa

SEQ ID NO: 3501265 - RNA, 23 nt, Human
auuuugcccuugacaaagucaag

SEQ ID NO: 3501266 - RNA, 22 nt, Human
auuuugccuaauacauuaaagc

SEQ ID NO: 3501267 - RNA, 13 nt, Human
auuuugccugugu

SEQ ID NO: 3501268 - RNA, 12 nt, Human
auuuugcuguau

SEQ ID NO: 3501269 - RNA, 16 nt, Human
auuuugcuuuaauuuu

SEQ ID NO: 3501270 - RNA, 20 nt, Human
auuuugcuuugugauuuuug

SEQ ID NO: 3501271 - RNA, 20 nt, Human
auuuuggaaaauaaauuauu

SEQ ID NO: 3501272 - RNA, 17 nt, Human
auuuuggaagauuuuca

SEQ ID NO: 3501273 - RNA, 14 nt, Human
auuuuggaauuugc

SEQ ID NO: 3501274 - RNA, 18 nt, Human
auuuuggagagauaggaa

SEQ ID NO: 3501275 - RNA, 20 nt, Human
auuuuggagagauaggaagg

SEQ ID NO: 3501276 - RNA, 20 nt, Human
auuuuggagauuauaauaaa

SEQ ID NO: 3501277 - RNA, 22 nt, Human
auuuuggcgaaucucaaaauua

SEQ ID NO: 3501278 - RNA, 19 nt, Human
auuuuggcgcuauuacaaa

SEQ ID NO: 3501279 - RNA, 21 nt, Human
auuuugggacaauuguuuuaa

SEQ ID NO: 3501280 - RNA, 22 nt, Human
auuuugggacaauuguuuuaau

SEQ ID NO: 3501281 - RNA, 14 nt, Human
auuuugggcaugug

SEQ ID NO: 3501282 - RNA, 21 nt, Human
auuuugggguacccacugcuc

SEQ ID NO: 3501283 - RNA, 14 nt, Human
auuuuggggucucu

SEQ ID NO: 3501284 - RNA, 15 nt, Human
auuuugguacuuuua

SEQ ID NO: 3501285 - RNA, 20 nt, Human
auuuugguauuacacuguau

SEQ ID NO: 3501286 - RNA, 14 nt, Human
auuuuggugagaaa

SEQ ID NO: 3501287 - RNA, 20 nt, Human
auuuugguuguauucuuuga

SEQ ID NO: 3501288 - RNA, 22 nt, Human
auuuugguuuuguuccccuccu

SEQ ID NO: 3501289 - RNA, 18 nt, Human
auuuuguaacgaagacac

SEQ ID NO: 3501290 - RNA, 19 nt, Human
auuuuguaacgaagacaca

SEQ ID NO: 3501291 - RNA, 17 nt, Human
auuuuguaagaaggcaa

SEQ ID NO: 3501292 - RNA, 19 nt, Human
auuuuguaauaauaaagaa

SEQ ID NO: 3501293 - RNA, 22 nt, Human
auuuuguaauaauaaagaauag

SEQ ID NO: 3501294 - RNA, 21 nt, Human
auuuuguaauuauugugauuu

SEQ ID NO: 3501295 - RNA, 12 nt, Human
auuuuguaauuu

SEQ ID NO: 3501296 - RNA, 18 nt, Human
auuuuguaauuuucuuga

SEQ ID NO: 3501297 - RNA, 17 nt, Human
auuuuguauaauuguau

SEQ ID NO: 3501298 - RNA, 20 nt, Human
auuuuguauaauuguaucgu

SEQ ID NO: 3501299 - RNA, 14 nt, Human
auuuuguauauauc

SEQ ID NO: 3501300 - RNA, 18 nt, Human
auuuuguauauuuguauu

SEQ ID NO: 3501301 - RNA, 15 nt, Human
auuuuguaucugcag

SEQ ID NO: 3501302 - RNA, 21 nt, Human
auuuuguaucugcaggcagac

SEQ ID NO: 3501303 - RNA, 12 nt, Human
auuuuguaugca

SEQ ID NO: 3501304 - RNA, 15 nt, Human
auuuuguauguuaaa

SEQ ID NO: 3501305 - RNA, 17 nt, Human
auuuuguauugugguau

SEQ ID NO: 3501306 - RNA, 12 nt, Human
auuuuguauuuu

SEQ ID NO: 3501307 - RNA, 15 nt, Human
auuuuguauuuucca

SEQ ID NO: 3501308 - RNA, 20 nt, Human
auuuugucaccagaacacaa

SEQ ID NO: 3501309 - RNA, 12 nt, Human
auuuugucuaaa

SEQ ID NO: 3501310 - RNA, 20 nt, Human
auuuugucugcuuaguaucu

SEQ ID NO: 3501311 - RNA, 12 nt, Human
auuuugucuuua

SEQ ID NO: 3501312 - RNA, 19 nt, Human
auuuugugaaacagacuug

SEQ ID NO: 3501313 - RNA, 22 nt, Human
auuuugugaaacagacuuguau

SEQ ID NO: 3501314 - RNA, 18 nt, Human
auuuugugaagugaagga

SEQ ID NO: 3501315 - RNA, 13 nt, Human
auuuugugaaugg

SEQ ID NO: 3501316 - RNA, 19 nt, Human
auuuugugaguuuguuucu

SEQ ID NO: 3501317 - RNA, 21 nt, Human
auuuuguggaggcagugucau

SEQ ID NO: 3501318 - RNA, 20 nt, Human
auuuugugggaauuuaagag

SEQ ID NO: 3501319 - RNA, 23 nt, Human
auuuugugguuuucgagauuauc

SEQ ID NO: 3501320 - RNA, 20 nt, Human
auuuuguguaaaaaaaccac

SEQ ID NO: 3501321 - RNA, 13 nt, Human
auuuugugugacc

SEQ ID NO: 3501322 - RNA, 18 nt, Human
auuuugugugaccaacug

SEQ ID NO: 3501323 - RNA, 18 nt, Human
auuuuguguuuauucuug

SEQ ID NO: 3501324 - RNA, 20 nt, Human
auuuuguguuuauucuugau

SEQ ID NO: 3501325 - RNA, 16 nt, Human
auuuuguucauacaua

SEQ ID NO: 3501326 - RNA, 18 nt, Human
auuuuguucauacauauu

SEQ ID NO: 3501327 - RNA, 16 nt, Human
auuuuguucuuacaca

SEQ ID NO: 3501328 - RNA, 19 nt, Human
auuuuguugcuguuuugau

SEQ ID NO: 3501329 - RNA, 15 nt, Human
auuuuguuggcauag

SEQ ID NO: 3501330 - RNA, 19 nt, Human
auuuuguuguaaaaagaaa

SEQ ID NO: 3501331 - RNA, 17 nt, Human
auuuuguuuaaaaaauc

SEQ ID NO: 3501332 - RNA, 16 nt, Human
auuuuguuucagugca

SEQ ID NO: 3501333 - RNA, 15 nt, Human
auuuuguuucuguac

SEQ ID NO: 3501334 - RNA, 17 nt, Human
auuuuguuugguauugu

SEQ ID NO: 3501335 - RNA, 14 nt, Human
auuuuguuuugcuu

SEQ ID NO: 3501336 - RNA, 21 nt, Human
auuuuguuuuugucuuaaaaa

SEQ ID NO: 3501337 - RNA, 14 nt, Human
auuuuuaaaaaaua

SEQ ID NO: 3501338 - RNA, 16 nt, Human
auuuuuaaaaaaugaa

SEQ ID NO: 3501339 - RNA, 20 nt, Human
auuuuuaaagaaaaguuuug

SEQ ID NO: 3501340 - RNA, 15 nt, Human
auuuuuaaagauaga

SEQ ID NO: 3501341 - RNA, 12 nt, Human
auuuuuaaauaa

SEQ ID NO: 3501342 - RNA, 20 nt, Human
auuuuuaaaugcaguuacaa

SEQ ID NO: 3501343 - RNA, 19 nt, Human
auuuuuaaauguaaaacau

SEQ ID NO: 3501344 - RNA, 18 nt, Human
auuuuuaagauaauaaua

SEQ ID NO: 3501345 - RNA, 20 nt, Human
auuuuuaagauaauaauaua

SEQ ID NO: 3501346 - RNA, 22 nt, Human
auuuuuaagauaauaauauaug

SEQ ID NO: 3501347 - RNA, 18 nt, Human
auuuuuaagugcugcauu

SEQ ID NO: 3501348 - RNA, 16 nt, Human
auuuuuaaucaugaaa

SEQ ID NO: 3501349 - RNA, 18 nt, Human
auuuuuaauuaaaaacua

SEQ ID NO: 3501350 - RNA, 16 nt, Human
auauaugcauauauau

SEQ ID NO: 3501351 - RNA, 14 nt, Human
auauaugccuuuuu

SEQ ID NO: 3501352 - RNA, 18 nt, Human
auauaugccuuuuuccua

SEQ ID NO: 3501353 - RNA, 15 nt, Human
auauauggaagagga

SEQ ID NO: 3501354 - RNA, 12 nt, Human
auauauggacau

SEQ ID NO: 3501355 - RNA, 19 nt, Human
auauauggcagaguuguaa

SEQ ID NO: 3501356 - RNA, 20 nt, Human
auauauggcagaguuguaaa

SEQ ID NO: 3501357 - RNA, 22 nt, Human
auauauggcagaguuguaaaua

SEQ ID NO: 3501358 - RNA, 17 nt, Human
auauauggcauuugcag

SEQ ID NO: 3501359 - RNA, 20 nt, Human
auauauggggaugguaguuu

SEQ ID NO: 3501360 - RNA, 18 nt, Human
auauauggucuaauguuu

SEQ ID NO: 3501361 - RNA, 19 nt, Human
auauauggucuaauguuua

SEQ ID NO: 3501362 - RNA, 20 nt, Human
auauauggucuaauguuuaa

SEQ ID NO: 3501363 - RNA, 20 nt, Human
auauauguauaugcaauaua

SEQ ID NO: 3501364 - RNA, 11 nt, Human
auauauguaug

SEQ ID NO: 3501365 - RNA, 19 nt, Human
auauauguauguaaaaaug

SEQ ID NO: 3501366 - RNA, 12 nt, Human
auauauguauuu

SEQ ID NO: 3501367 - RNA, 18 nt, Human
auauaugugaggauguau

SEQ ID NO: 3501368 - RNA, 12 nt, Human
auauauguguau

SEQ ID NO: 3501369 - RNA, 13 nt, Human
auauauguguaug

SEQ ID NO: 3501370 - RNA, 15 nt, Human
auauauguguaugua

SEQ ID NO: 3501371 - RNA, 21 nt, Human
auauauguguguuuaaauaaa

SEQ ID NO: 3501372 - RNA, 14 nt, Human
auauauuauacuug

SEQ ID NO: 3501373 - RNA, 18 nt, Human
auaugaacccuuuguuuc

SEQ ID NO: 3501374 - RNA, 19 nt, Human
auaugaacccuuuguuucu

SEQ ID NO: 3501375 - RNA, 14 nt, Human
auaugaacuuaaca

SEQ ID NO: 3501376 - RNA, 22 nt, Human
auaugaauacagggcaugcauu

SEQ ID NO: 3501377 - RNA, 17 nt, Human
auaugacaaauguuucu

SEQ ID NO: 3501378 - RNA, 14 nt, Human
auaugacagcuguc

SEQ ID NO: 3501379 - RNA, 19 nt, Human
auaugacauucaugccugg

SEQ ID NO: 3501380 - RNA, 16 nt, Human
auaugacggaagaaca

SEQ ID NO: 3501381 - RNA, 18 nt, Human
auaugacggaagaacaua

SEQ ID NO: 3501382 - RNA, 23 nt, Human
auaugacggaagaacauagaacu

SEQ ID NO: 3501383 - RNA, 13 nt, Human
auaugacucacau

SEQ ID NO: 3501384 - RNA, 22 nt, Human
auaugacuguuuuucggacagu

SEQ ID NO: 3501385 - RNA, 13 nt, Human
auaugagaagaau

SEQ ID NO: 3501386 - RNA, 23 nt, Human
auaugagaaggugccucaagaau

SEQ ID NO: 3501387 - RNA, 21 nt, Human
auaugagcuuccuucugugaa

SEQ ID NO: 3501388 - RNA, 20 nt, Human
auaugagcuuuauguaauaa

SEQ ID NO: 3501389 - RNA, 16 nt, Human
auaugaguauacaaua

SEQ ID NO: 3501390 - RNA, 17 nt, Human
auaugaguauacaauau

SEQ ID NO: 3501391 - RNA, 20 nt, Human
auaugaguguggaagccgga

SEQ ID NO: 3501392 - RNA, 17 nt, Human
auaugaguuucauagcu

SEQ ID NO: 3501393 - RNA, 19 nt, Human
auaugaguuucauagcuaa

SEQ ID NO: 3501394 - RNA, 21 nt, Human
auaugaguuucauagcuaaga

SEQ ID NO: 3501395 - RNA, 20 nt, Human
auaugauagcgggaaaagga

SEQ ID NO: 3501396 - RNA, 15 nt, Human
auaugauauugcaua

SEQ ID NO: 3501397 - RNA, 16 nt, Human
auaugauauugcauau

SEQ ID NO: 3501398 - RNA, 11 nt, Human
auaugauuaaa

SEQ ID NO: 3501399 - RNA, 17 nt, Human
auaugauuaaaaauauc

SEQ ID NO: 3501400 - RNA, 21 nt, Human
auaugauuaguaaagaaauga

SEQ ID NO: 3501401 - RNA, 22 nt, Human
auaugauucaaaugucuauaaa

SEQ ID NO: 3501402 - RNA, 14 nt, Human
auaugauuguuucu

SEQ ID NO: 3501403 - RNA, 22 nt, Human
auaugauuguuucucaaaucuu

SEQ ID NO: 3501404 - RNA, 15 nt, Human
auaugauuuaaaaca

SEQ ID NO: 3501405 - RNA, 13 nt, Human
auaugauuuauag

SEQ ID NO: 3501406 - RNA, 17 nt, Human
auaugauuucacuagaa

SEQ ID NO: 3501407 - RNA, 22 nt, Human
auaugauuuuauuugacaaaau

SEQ ID NO: 3501408 - RNA, 16 nt, Human
auaugauuuuuuaaaa

SEQ ID NO: 3501409 - RNA, 22 nt, Human
auaugauuuuuuaaaagaaauu

SEQ ID NO: 3501410 - RNA, 20 nt, Human
auaugcaaacaggguaacua

SEQ ID NO: 3501411 - RNA, 23 nt, Human
auaugcaaagcacugacuucuaa

SEQ ID NO: 3501412 - RNA, 19 nt, Human
auaugcacacagugcuuuc

SEQ ID NO: 3501413 - RNA, 15 nt, Human
auaugcaccuugugu

SEQ ID NO: 3501414 - RNA, 20 nt, Human
auaugcaccuugugucugua

SEQ ID NO: 3501415 - RNA, 19 nt, Human
auaugcacuaagucucuuu

SEQ ID NO: 3501416 - RNA, 13 nt, Human
auaugcacuuaua

SEQ ID NO: 3501417 - RNA, 14 nt, Human
auaugcacuuauaa

SEQ ID NO: 3501418 - RNA, 18 nt, Human
auaugcagaaauagacaa

SEQ ID NO: 3501419 - RNA, 22 nt, Human
auaugcauauauauaugugugu

SEQ ID NO: 3501420 - RNA, 21 nt, Human
auaugcuaccaccagcugugu

SEQ ID NO: 3501421 - RNA, 14 nt, Human
auaugcuauuucua

SEQ ID NO: 3501422 - RNA, 18 nt, Human
auaugcuauuucuauauu

SEQ ID NO: 3501423 - RNA, 17 nt, Human
auaugcucugcauguua

SEQ ID NO: 3501424 - RNA, 16 nt, Human
auaugcuuaaaauaag

SEQ ID NO: 3501425 - RNA, 19 nt, Human
auaugcuuaaaauaagcag

SEQ ID NO: 3501426 - RNA, 13 nt, Human
auaugcuuaguaa

SEQ ID NO: 3501427 - RNA, 14 nt, Human
auaugcuuauacac

SEQ ID NO: 3501428 - RNA, 21 nt, Human
auaugcuuauacacuuacacu

SEQ ID NO: 3501429 - RNA, 15 nt, Human
auaugcuucuuuaaa

SEQ ID NO: 3501430 - RNA, 19 nt, Human
auaugcuuuauuaauguuu

SEQ ID NO: 3501431 - RNA, 18 nt, Human
auauggaaauauauauua

SEQ ID NO: 3501432 - RNA, 19 nt, Human
auauggaacuuacauuguu

SEQ ID NO: 3501433 - RNA, 18 nt, Human
auauggaacuucuaauau

SEQ ID NO: 3501434 - RNA, 15 nt, Human
auauggaagaaagua

SEQ ID NO: 3501435 - RNA, 15 nt, Human
auauggacaagaggu

SEQ ID NO: 3501436 - RNA, 16 nt, Human
auauggacaagaggua

SEQ ID NO: 3501437 - RNA, 20 nt, Human
auauggacacuuaauacuac

SEQ ID NO: 3501438 - RNA, 18 nt, Human
auauggaugauucagaaa

SEQ ID NO: 3501439 - RNA, 17 nt, Human
auauggauuuguuacag

SEQ ID NO: 3501440 - RNA, 22 nt, Human
auauggauuuucuauuguuacu

SEQ ID NO: 3501441 - RNA, 23 nt, Human
auauggauuuucuauuguuacuc

SEQ ID NO: 3501442 - RNA, 16 nt, Human
auauggcaaaaauggc

SEQ ID NO: 3501443 - RNA, 18 nt, Human
auauggcagaguuguaaa

SEQ ID NO: 3501444 - RNA, 15 nt, Human
auauggcuauaaaua

SEQ ID NO: 3501445 - RNA, 14 nt, Human
auaugggacugagc

SEQ ID NO: 3501446 - RNA, 14 nt, Human
auaugggagaaaua

SEQ ID NO: 3501447 - RNA, 16 nt, Human
auauggggaauauauu

SEQ ID NO: 3501448 - RNA, 16 nt, Human
auauggggaugcagca

SEQ ID NO: 3501449 - RNA, 20 nt, Human
auauggggaugcagcauuau

SEQ ID NO: 3501450 - RNA, 19 nt, Human
auauggggaugguaguuuu

SEQ ID NO: 3501451 - RNA, 20 nt, Human
auaugggggccuggauucau

SEQ ID NO: 3501452 - RNA, 23 nt, Human
auauggggggccaacaccaggga

SEQ ID NO: 3501453 - RNA, 17 nt, Human
auauggguucuuuuuug

SEQ ID NO: 3501454 - RNA, 22 nt, Human
auauggguugcauuuggucaag

SEQ ID NO: 3501455 - RNA, 15 nt, Human
auaugguauauauac

SEQ ID NO: 3501456 - RNA, 22 nt, Human
auauggucuaccaguuugcuga

SEQ ID NO: 3501457 - RNA, 16 nt, Human
auauguaaaauaaaau

SEQ ID NO: 3501458 - RNA, 20 nt, Human
auauguaaaauaaaauuaug

SEQ ID NO: 3501459 - RNA, 22 nt, Human
auauguaaaugguaugucauuc

SEQ ID NO: 3501460 - RNA, 17 nt, Human
auauguaacaagccacc

SEQ ID NO: 3501461 - RNA, 16 nt, Human
auauguacaguuaucu

SEQ ID NO: 3501462 - RNA, 14 nt, Human
auauguacauaaau

SEQ ID NO: 3501463 - RNA, 15 nt, Human
auauguacauaaauu

SEQ ID NO: 3501464 - RNA, 14 nt, Human
auauguaccaugua

SEQ ID NO: 3501465 - RNA, 17 nt, Human
auauguacuugucaaag

SEQ ID NO: 3501466 - RNA, 13 nt, Human
auauguagacuau

SEQ ID NO: 3501467 - RNA, 20 nt, Human
auauguagacuauauacaug

SEQ ID NO: 3501468 - RNA, 19 nt, Human
auauguagccuuuacuguu

SEQ ID NO: 3501469 - RNA, 19 nt, Human
auauguaguauaaagaaaa

SEQ ID NO: 3501470 - RNA, 13 nt, Human
auauguauguaaa

SEQ ID NO: 3501471 - RNA, 17 nt, Human
auauguauguguuuaga

SEQ ID NO: 3501472 - RNA, 19 nt, Human
auauguauguguuuagaau

SEQ ID NO: 3501473 - RNA, 22 nt, Human
auauguauguguuuagaauuga

SEQ ID NO: 3501474 - RNA, 21 nt, Human
auauguauuaacacuacucaa

SEQ ID NO: 3501475 - RNA, 22 nt, Human
auauguauuauuuauaauuccu

SEQ ID NO: 3501476 - RNA, 13 nt, Human
auauguauucuuu

SEQ ID NO: 3501477 - RNA, 17 nt, Human
auauguauuuuauguau

SEQ ID NO: 3501478 - RNA, 17 nt, Human
auauguauuuuuauaua

SEQ ID NO: 3501479 - RNA, 14 nt, Human
auaugucaagccau

SEQ ID NO: 3501480 - RNA, 22 nt, Human
auaugucaagugcugugcaagg

SEQ ID NO: 3501481 - RNA, 18 nt, Human
auaugucagugcugaugu

SEQ ID NO: 3501482 - RNA, 20 nt, Human
auauguccucuuuuguuguu

SEQ ID NO: 3501483 - RNA, 11 nt, Human
auauguccugg

SEQ ID NO: 3501484 - RNA, 13 nt, Human
auaugugaacagu

SEQ ID NO: 3501485 - RNA, 21 nt, Human
auaugugaauccucuucuuua

SEQ ID NO: 3501486 - RNA, 21 nt, Human
auaugugagauuuuuuauugc

SEQ ID NO: 3501487 - RNA, 16 nt, Human
auaugugccacauuuu

SEQ ID NO: 3501488 - RNA, 18 nt, Human
auaugugcuggaauucua

SEQ ID NO: 3501489 - RNA, 18 nt, Human
auaugugcuugccucagu

SEQ ID NO: 3501490 - RNA, 20 nt, Human
auauguguauauauacauac

SEQ ID NO: 3501491 - RNA, 21 nt, Human
auauguguauauauacauaca

SEQ ID NO: 3501492 - RNA, 20 nt, Human
auauguguguguauguuugc

SEQ ID NO: 3501493 - RNA, 17 nt, Human
auauguguuuuucacau

SEQ ID NO: 3501494 - RNA, 19 nt, Human
auauguguuuuucacauuu

SEQ ID NO: 3501495 - RNA, 20 nt, Human
auauguuaaccucaguguca

SEQ ID NO: 3501496 - RNA, 23 nt, Human
auauguuaagcagcuaaauuuuc

SEQ ID NO: 3501497 - RNA, 17 nt, Human
auauguugaauacuuuu

SEQ ID NO: 3501498 - RNA, 16 nt, Human
auauguuguaauauuu

SEQ ID NO: 3501499 - RNA, 21 nt, Human
auauguuguaauauuucuuca

SEQ ID NO: 3501500 - RNA, 15 nt, Human
auauguuuaaaagua

SEQ ID NO: 3501501 - RNA, 17 nt, Human
auauguuuaccuuuuaa

SEQ ID NO: 3501502 - RNA, 20 nt, Human
auauguuuaccuuuuaauua

SEQ ID NO: 3501503 - RNA, 22 nt, Human
auauguuuaccuuuuaauuaau

SEQ ID NO: 3501504 - RNA, 13 nt, Human
auauguuucaaac

SEQ ID NO: 3501505 - RNA, 16 nt, Human
auauguuucaaacuuu

SEQ ID NO: 3501506 - RNA, 17 nt, Human
auauguuucaaacuuug

SEQ ID NO: 3501507 - RNA, 21 nt, Human
auauguuucacacaaacaagg

SEQ ID NO: 3501508 - RNA, 20 nt, Human
auauguuuccuuguuuauca

SEQ ID NO: 3501509 - RNA, 22 nt, Human
auauguuuuaaauauagaauuu

SEQ ID NO: 3501510 - RNA, 14 nt, Human
auauguuuuuuaga

SEQ ID NO: 3501511 - RNA, 15 nt, Human
auauuaaaaagucuu

SEQ ID NO: 3501512 - RNA, 17 nt, Human
auauuaaaaagucuuuu

SEQ ID NO: 3501513 - RNA, 20 nt, Human
auuuuuuuuuaagcucugag

SEQ ID NO: 3501514 - RNA, 21 nt, Human
auuuuuuuuuaagcucugagc

SEQ ID NO: 3501515 - RNA, 19 nt, Human
auuuuuuuuucauacacuu

SEQ ID NO: 3501516 - RNA, 15 nt, Human
auuuggaaaggaaug

SEQ ID NO: 3501517 - RNA, 22 nt, Human
auuuggaaauaaagucagaugg

SEQ ID NO: 3501518 - RNA, 12 nt, Human
auuuggaaaucc

SEQ ID NO: 3501519 - RNA, 22 nt, Human
auuuggaauaaaaauuccagaa

SEQ ID NO: 3501520 - RNA, 13 nt, Human
auuuggaauacuu

SEQ ID NO: 3501521 - RNA, 15 nt, Human
auuuggaauacuuuu

SEQ ID NO: 3501522 - RNA, 14 nt, Human
auuuggaccauuuu

SEQ ID NO: 3501523 - RNA, 20 nt, Human
caaaagguucacuaaagcag

SEQ ID NO: 3501524 - RNA, 15 nt, Human
caaaaguaaugccuc

SEQ ID NO: 3501525 - RNA, 18 nt, Human
caaaaguagaacuuugua

SEQ ID NO: 3501526 - RNA, 20 nt, Human
caaaaguagaacuuuguaua

SEQ ID NO: 3501527 - RNA, 21 nt, Human
caaaaguagaacuuuguauag

SEQ ID NO: 3501528 - RNA, 22 nt, Human
caaaaguagaacuuuguauagu

SEQ ID NO: 3501529 - RNA, 18 nt, Human
caaaaguaucgggggcug

SEQ ID NO: 3501530 - RNA, 22 nt, Human
caaaaguaucgggggcuggggc

SEQ ID NO: 3501531 - RNA, 16 nt, Human
caaaaguauuuuccug

SEQ ID NO: 3501532 - RNA, 17 nt, Human
caaaaguauuuuccugu

SEQ ID NO: 3501533 - RNA, 13 nt, Human
caaaaguggucag

SEQ ID NO: 3501534 - RNA, 16 nt, Human
caaaaguuauuaaaau

SEQ ID NO: 3501535 - RNA, 18 nt, Human
caaaaguuccaagagucu

SEQ ID NO: 3501536 - RNA, 23 nt, Human
caaaaguuccaagagucuaaaga

SEQ ID NO: 3501537 - RNA, 18 nt, Human
caaaaguucugacuugac

SEQ ID NO: 3501538 - RNA, 14 nt, Human
caaaaguuucucuu

SEQ ID NO: 3501539 - RNA, 18 nt, Human
caaaaguuuguuugcuua

SEQ ID NO: 3501540 - RNA, 11 nt, Human
caaaauaaaaa

SEQ ID NO: 3501541 - RNA, 15 nt, Human
caaaauaaaaaccaa

SEQ ID NO: 3501542 - RNA, 15 nt, Human
caaaauaaaaacuau

SEQ ID NO: 3501543 - RNA, 21 nt, Human
caaaauaaaaagugacacagc

SEQ ID NO: 3501544 - RNA, 17 nt, Human
caaaauaaaacaaaggg

SEQ ID NO: 3501545 - RNA, 14 nt, Human
caaaauaaaacaua

SEQ ID NO: 3501546 - RNA, 15 nt, Human
caaaauaaaacauag

SEQ ID NO: 3501547 - RNA, 17 nt, Human
caaaauaaaacauagca

SEQ ID NO: 3501548 - RNA, 20 nt, Human
caaaauaaaacuuuuuaaaa

SEQ ID NO: 3501549 - RNA, 14 nt, Human
caaaauaaaucagu

SEQ ID NO: 3501550 - RNA, 14 nt, Human
caaaauaaauguug

SEQ ID NO: 3501551 - RNA, 13 nt, Human
caaaauaaauugg

SEQ ID NO: 3501552 - RNA, 14 nt, Human
caaaauaagaaaag

SEQ ID NO: 3501553 - RNA, 18 nt, Human
caaaauaagaaaagaugu

SEQ ID NO: 3501554 - RNA, 14 nt, Human
caaaauaaugucuu

SEQ ID NO: 3501555 - RNA, 13 nt, Human
caaaauacaugaa

SEQ ID NO: 3501556 - RNA, 20 nt, Human
caaaauacauucuuuuugcu

SEQ ID NO: 3501557 - RNA, 14 nt, Human
caaaauagaaaagu

SEQ ID NO: 3501558 - RNA, 13 nt, Human
caaaauagaaagu

SEQ ID NO: 3501559 - RNA, 13 nt, Human
caaaauagaagcu

SEQ ID NO: 3501560 - RNA, 13 nt, Human
caaaauagagaau

SEQ ID NO: 3501561 - RNA, 15 nt, Human
caaaauagcauuugu

SEQ ID NO: 3501562 - RNA, 13 nt, Human
caaaauagggacu

SEQ ID NO: 3501563 - RNA, 18 nt, Human
caaaauaggguauauuuu

SEQ ID NO: 3501564 - RNA, 16 nt, Human
caaaauagugccacua

SEQ ID NO: 3501565 - RNA, 13 nt, Human
caaaauauaaagc

SEQ ID NO: 3501566 - RNA, 18 nt, Human
caaaauauacaaaacuuu

SEQ ID NO: 3501567 - RNA, 12 nt, Human
caaaauauuuaa

SEQ ID NO: 3501568 - RNA, 13 nt, Human
caaaauauuuaaa

SEQ ID NO: 3501569 - RNA, 14 nt, Human
caaaauauuuaaaa

SEQ ID NO: 3501570 - RNA, 17 nt, Human
caaaauauuuaaaaaug

SEQ ID NO: 3501571 - RNA, 20 nt, Human
caaaauauuuaaaaaugucu

SEQ ID NO: 3501572 - RNA, 17 nt, Human
caaaauauuuguacaua

SEQ ID NO: 3501573 - RNA, 17 nt, Human
caaaaucacuuccauag

SEQ ID NO: 3501574 - RNA, 12 nt, Human
caaaaucaguuu

SEQ ID NO: 3501575 - RNA, 22 nt, Human
caaaaucauuuuauaugucaaa

SEQ ID NO: 3501576 - RNA, 16 nt, Human
caaaauccccuucuca

SEQ ID NO: 3501577 - RNA, 18 nt, Human
caaaauccugacuauuau

SEQ ID NO: 3501578 - RNA, 18 nt, Human
caaaauccuuccaaagaa

SEQ ID NO: 3501579 - RNA, 19 nt, Human
caaaauccuuccaaagaau

SEQ ID NO: 3501580 - RNA, 16 nt, Human
caaaauccuugcuuau

SEQ ID NO: 3501581 - RNA, 18 nt, Human
caaaaucgauuggcuuua

SEQ ID NO: 3501582 - RNA, 23 nt, Human
caaaaucucuccacuuucagcug

SEQ ID NO: 3501583 - RNA, 16 nt, Human
caaaaucuguucuaac

SEQ ID NO: 3501584 - RNA, 22 nt, Human
caaaaucuugaucaguuaagaa

SEQ ID NO: 3501585 - RNA, 22 nt, Human
caaaaugaaacgcaaccaccac

SEQ ID NO: 3501586 - RNA, 18 nt, Human
caaaaugacaucuuuuua

SEQ ID NO: 3501587 - RNA, 23 nt, Human
caaaaugacaucuuuuuaaagcu

SEQ ID NO: 3501588 - RNA, 22 nt, Human
caaaaugagagggcaguguuuc

SEQ ID NO: 3501589 - RNA, 21 nt, Human
caaaaugagcccuguccugcc

SEQ ID NO: 3501590 - RNA, 17 nt, Human
caaaaugaggaauguau

SEQ ID NO: 3501591 - RNA, 20 nt, Human
caaaaugauggacccaaugc

SEQ ID NO: 3501592 - RNA, 20 nt, Human
caaaaugcuuuuuauuucug

SEQ ID NO: 3501593 - RNA, 19 nt, Human
caaaauggauacauaaaga

SEQ ID NO: 3501594 - RNA, 16 nt, Human
caaaauguaacuguua

SEQ ID NO: 3501595 - RNA, 23 nt, Human
caaaauguaggcuuaguuugugu

SEQ ID NO: 3501596 - RNA, 16 nt, Human
caaaauguauauauuu

SEQ ID NO: 3501597 - RNA, 12 nt, Human
caaaaugugagu

SEQ ID NO: 3501598 - RNA, 20 nt, Human
caaaauguuaucuucucaag

SEQ ID NO: 3501599 - RNA, 18 nt, Human
caaaauguuauuucccua

SEQ ID NO: 3501600 - RNA, 22 nt, Human
caaaauguugaaauaugauguu

SEQ ID NO: 3501601 - RNA, 15 nt, Human
caaaauuaaaucugu

SEQ ID NO: 3501602 - RNA, 20 nt, Human
caaaauuaagguguuugaaa

SEQ ID NO: 3501603 - RNA, 23 nt, Human
caaaauuagccaguaauccugua

SEQ ID NO: 3501604 - RNA, 21 nt, Human
caaaauuauaggagacuugua

SEQ ID NO: 3501605 - RNA, 17 nt, Human
caaaauucaaagcaugg

SEQ ID NO: 3501606 - RNA, 19 nt, Human
caaaauucauuucuaauua

SEQ ID NO: 3501607 - RNA, 13 nt, Human
caaaauucccagg

SEQ ID NO: 3501608 - RNA, 21 nt, Human
caaaauucgaccugauuuaca

SEQ ID NO: 3501609 - RNA, 22 nt, Human
caaaauugauguguuuauuuau

SEQ ID NO: 3501610 - RNA, 17 nt, Human
caaaauugcaaaucuug

SEQ ID NO: 3501611 - RNA, 16 nt, Human
caaaauuguuacaaau

SEQ ID NO: 3501612 - RNA, 19 nt, Human
caaaauuuauuuuauaaga

SEQ ID NO: 3501613 - RNA, 23 nt, Human
caaaauuuauuuuauaagaaaaa

SEQ ID NO: 3501614 - RNA, 14 nt, Human
caaaauuugaaauu

SEQ ID NO: 3501615 - RNA, 13 nt, Human
caaaauuugacua

SEQ ID NO: 3501616 - RNA, 23 nt, Human
caaaauuugacuaauuuuacaug

SEQ ID NO: 3501617 - RNA, 19 nt, Human
caaaauuugaugccaggac

SEQ ID NO: 3501618 - RNA, 14 nt, Human
caaaauuuuaaaaa

SEQ ID NO: 3501619 - RNA, 14 nt, Human
caaaauuuuauucc

SEQ ID NO: 3501620 - RNA, 18 nt, Human
caaaauuuuauuccuaua

SEQ ID NO: 3501621 - RNA, 19 nt, Human
caaaauuuuauuuugugcu

SEQ ID NO: 3501622 - RNA, 20 nt, Human
caaaauuuucucauuuucuu

SEQ ID NO: 3501623 - RNA, 18 nt, Human
caaaauuuuucaacccca

SEQ ID NO: 3501624 - RNA, 22 nt, Human
caaaauuuuuucucuaggaaau

SEQ ID NO: 3501625 - RNA, 16 nt, Human
caaacaaaaagguucu

SEQ ID NO: 3501626 - RNA, 17 nt, Human
caaacaaauaugcaaaa

SEQ ID NO: 3501627 - RNA, 16 nt, Human
caaacaagcauauaaa

SEQ ID NO: 3501628 - RNA, 20 nt, Human
caaacaagcauauaaaaugg

SEQ ID NO: 3501629 - RNA, 24 nt, Human
caaacaauaguaauucucaggcca

SEQ ID NO: 3501630 - RNA, 21 nt, Human
caaacaaucucuuaaauuggg

SEQ ID NO: 3501631 - RNA, 17 nt, Human
caaacaaugacaaagca

SEQ ID NO: 3501632 - RNA, 22 nt, Human
caaacaauggaaacugaaugcu

SEQ ID NO: 3501633 - RNA, 14 nt, Human
caaacacaagguca

SEQ ID NO: 3501634 - RNA, 20 nt, Human
caaacacaaggucauggcca

SEQ ID NO: 3501635 - RNA, 13 nt, Human
caaacacauuaag

SEQ ID NO: 3501636 - RNA, 16 nt, Human
caaacacauuguuauu

SEQ ID NO: 3501637 - RNA, 15 nt, Human
caaacaccuggacuu

SEQ ID NO: 3501638 - RNA, 13 nt, Human
caaacagaacagg

SEQ ID NO: 3501639 - RNA, 17 nt, Human
caaacagaacaggguca

SEQ ID NO: 3501640 - RNA, 11 nt, Human
caaacagcaaa

SEQ ID NO: 3501641 - RNA, 20 nt, Human
caaacagcaaaccaagagau

SEQ ID NO: 3501642 - RNA, 14 nt, Human
caaacaguagguug

SEQ ID NO: 3501643 - RNA, 17 nt, Human
caaacagucucccuucc

SEQ ID NO: 3501644 - RNA, 21 nt, Human
caaacaucacucugcugcuua

SEQ ID NO: 3501645 - RNA, 18 nt, Human
caaacauccuaucaacaa

SEQ ID NO: 3501646 - RNA, 14 nt, Human
caaacaugaagugu

SEQ ID NO: 3501647 - RNA, 15 nt, Human
caaacaugagaugug

SEQ ID NO: 3501648 - RNA, 23 nt, Human
caaacaugagauguguggacugu

SEQ ID NO: 3501649 - RNA, 14 nt, Human
caaacauguauuua

SEQ ID NO: 3501650 - RNA, 18 nt, Human
caaacaugugguuaaugc

SEQ ID NO: 3501651 - RNA, 14 nt, Human
caaacauuaauguu

SEQ ID NO: 3501652 - RNA, 15 nt, Human
caaacauuaauguug

SEQ ID NO: 3501653 - RNA, 15 nt, Human
caaacauuaguacuu

SEQ ID NO: 3501654 - RNA, 17 nt, Human
caaacauuguguugaca

SEQ ID NO: 3501655 - RNA, 14 nt, Human
caaacauuucaaag

SEQ ID NO: 3501656 - RNA, 18 nt, Human
caaacauuuucuggccag

SEQ ID NO: 3501657 - RNA, 14 nt, Human
caaaccaaauaaaa

SEQ ID NO: 3501658 - RNA, 17 nt, Human
caaaccaaauuuuaauu

SEQ ID NO: 3501659 - RNA, 20 nt, Human
caaaccaacaggcuaccaac

SEQ ID NO: 3501660 - RNA, 17 nt, Human
caaaccaagucggaaca

SEQ ID NO: 3501661 - RNA, 16 nt, Human
auuuuuaagugcugca

SEQ ID NO: 3501662 - RNA, 14 nt, Human
auuuuuaagugguu

SEQ ID NO: 3501663 - RNA, 18 nt, Human
auuuuuaauauauacuau

SEQ ID NO: 3501664 - RNA, 14 nt, Human
auuuuuaaucauga

SEQ ID NO: 3501665 - RNA, 15 nt, Human
auuuuuaaucaugaa

SEQ ID NO: 3501666 - RNA, 17 nt, Human
auuuuuaaucaugaaau

SEQ ID NO: 3501667 - RNA, 15 nt, Human
auuuuuaauuaaaaa

SEQ ID NO: 3501668 - RNA, 17 nt, Human
auuuuuacaauguaauu

SEQ ID NO: 3501669 - RNA, 18 nt, Human
auuuuuacaauguaauua

SEQ ID NO: 3501670 - RNA, 14 nt, Human
auuuuuacagaauu

SEQ ID NO: 3501671 - RNA, 17 nt, Human
auuuuuacaucuaaacu

SEQ ID NO: 3501672 - RNA, 21 nt, Human
auuuuuacauuuaaaccuuuu

SEQ ID NO: 3501673 - RNA, 11 nt, Human
auuuuuaccag

SEQ ID NO: 3501674 - RNA, 17 nt, Human
auuuuuacccuaauguc

SEQ ID NO: 3501675 - RNA, 21 nt, Human
auuuuuacguuugaagacauu

SEQ ID NO: 3501676 - RNA, 14 nt, Human
auuuuuacugccac

SEQ ID NO: 3501677 - RNA, 23 nt, Human
auuuuuagaauaagaauuugcau

SEQ ID NO: 3501678 - RNA, 21 nt, Human
auuuuuagaauuaaaaaagca

SEQ ID NO: 3501679 - RNA, 20 nt, Human
auuuuuagaugguuacacug

SEQ ID NO: 3501680 - RNA, 23 nt, Human
auuuuuagaugguuacacuguua

SEQ ID NO: 3501681 - RNA, 22 nt, Human
auuuuuagccugugucauugcc

SEQ ID NO: 3501682 - RNA, 17 nt, Human
auuuuuaggacaugaaa

SEQ ID NO: 3501683 - RNA, 16 nt, Human
auuuuuaguaaagaca

SEQ ID NO: 3501684 - RNA, 16 nt, Human
auuuuuauacaguagu

SEQ ID NO: 3501685 - RNA, 14 nt, Human
auuuuuauauagcu

SEQ ID NO: 3501686 - RNA, 18 nt, Human
auuuuuauauuaguugcu

SEQ ID NO: 3501687 - RNA, 20 nt, Human
auuuuuauauuaguugcuuu

SEQ ID NO: 3501688 - RNA, 16 nt, Human
auuuuuauauuuacua

SEQ ID NO: 3501689 - RNA, 16 nt, Human
auuuuuauauuugaaa

SEQ ID NO: 3501690 - RNA, 20 nt, Human
auuuuuaucaguuacacaug

SEQ ID NO: 3501691 - RNA, 12 nt, Human
auuuuuauccau

SEQ ID NO: 3501692 - RNA, 16 nt, Human
auuuuuaucuauauaa

SEQ ID NO: 3501693 - RNA, 17 nt, Human
auuuuuaugaugaugaa

SEQ ID NO: 3501694 - RNA, 15 nt, Human
auuuuuauggaauuu

SEQ ID NO: 3501695 - RNA, 16 nt, Human
auuuuuauuaaauuau

SEQ ID NO: 3501696 - RNA, 14 nt, Human
auuuuuauuaugca

SEQ ID NO: 3501697 - RNA, 13 nt, Human
auuuuuauuauua

SEQ ID NO: 3501698 - RNA, 15 nt, Human
auuuuuauuauuugu

SEQ ID NO: 3501699 - RNA, 12 nt, Human
auuuuuauucau

SEQ ID NO: 3501700 - RNA, 14 nt, Human
auuuuuauucauaa

SEQ ID NO: 3501701 - RNA, 12 nt, Human
auuuuuauuguu

SEQ ID NO: 3501702 - RNA, 18 nt, Human
auuuuuauuuuugcugag

SEQ ID NO: 3501703 - RNA, 15 nt, Human
auuuuucaaagcaau

SEQ ID NO: 3501704 - RNA, 22 nt, Human
auuuuucaaccccacccuguuu

SEQ ID NO: 3501705 - RNA, 23 nt, Human
auuuuucaaccccacccuguuug

SEQ ID NO: 3501706 - RNA, 13 nt, Human
auuuuucaacuuu

SEQ ID NO: 3501707 - RNA, 15 nt, Human
auuuuucaaggaagg

SEQ ID NO: 3501708 - RNA, 17 nt, Human
auuuuucaauaaagcau

SEQ ID NO: 3501709 - RNA, 22 nt, Human
auuuuucaauauauugaacuuu

SEQ ID NO: 3501710 - RNA, 18 nt, Human
auuuuucacauaucuagu

SEQ ID NO: 3501711 - RNA, 21 nt, Human
auuuuucacauaucuaguaug

SEQ ID NO: 3501712 - RNA, 22 nt, Human
auuuuucacucuaagucaugua

SEQ ID NO: 3501713 - RNA, 19 nt, Human
auuuuucaugauuuugaaa

SEQ ID NO: 3501714 - RNA, 19 nt, Human
auuuuucccaggcaaauaa

SEQ ID NO: 3501715 - RNA, 17 nt, Human
auuuuuccguuugcuuu

SEQ ID NO: 3501716 - RNA, 23 nt, Human
auuuuuccuaugcuauugacaau

SEQ ID NO: 3501717 - RNA, 16 nt, Human
auuuuucuaaacguaa

SEQ ID NO: 3501718 - RNA, 17 nt, Human
auuuuucuaaccuugaa

SEQ ID NO: 3501719 - RNA, 18 nt, Human
auuuuucuacugcucuuu

SEQ ID NO: 3501720 - RNA, 21 nt, Human
caaauguucuaaguuucuaag

SEQ ID NO: 3501721 - RNA, 23 nt, Human
caaauguucuaaguuucuaagau

SEQ ID NO: 3501722 - RNA, 16 nt, Human
caaauguuuaaacauu

SEQ ID NO: 3501723 - RNA, 17 nt, Human
caaauguuuacagggag

SEQ ID NO: 3501724 - RNA, 19 nt, Human
caaauguuucuaagguaac

SEQ ID NO: 3501725 - RNA, 15 nt, Human
caaauguuuugacau

SEQ ID NO: 3501726 - RNA, 13 nt, Human
caaauuaaaaaaa

SEQ ID NO: 3501727 - RNA, 21 nt, Human
caaauuaaaaaagauaaacac

SEQ ID NO: 3501728 - RNA, 19 nt, Human
caaauuaaaaagauucuuu

SEQ ID NO: 3501729 - RNA, 22 nt, Human
caaauuaaggguuaagaaaaga

SEQ ID NO: 3501730 - RNA, 15 nt, Human
caaauuaauuggcag

SEQ ID NO: 3501731 - RNA, 18 nt, Human
caaauuaauuggcagcag

SEQ ID NO: 3501732 - RNA, 19 nt, Human
caaauuaauuggcagcaga

SEQ ID NO: 3501733 - RNA, 16 nt, Human
caaauuacucuuucuc

SEQ ID NO: 3501734 - RNA, 19 nt, Human
caaauuacucuuucuccau

SEQ ID NO: 3501735 - RNA, 11 nt, Human
caaauuagaaa

SEQ ID NO: 3501736 - RNA, 19 nt, Human
caaauuagaaaauguuauu

SEQ ID NO: 3501737 - RNA, 14 nt, Human
caaauuagggcaau

SEQ ID NO: 3501738 - RNA, 21 nt, Human
caaauuagggcaauuggaaca

SEQ ID NO: 3501739 - RNA, 14 nt, Human
caaauuaguuauau

SEQ ID NO: 3501740 - RNA, 13 nt, Human
caaauuauaaaaa

SEQ ID NO: 3501741 - RNA, 18 nt, Human
caaauuauaauguauuca

SEQ ID NO: 3501742 - RNA, 20 nt, Human
caaauuauaauguauucaua

SEQ ID NO: 3501743 - RNA, 20 nt, Human
caaauuaucaagcuaauaaa

SEQ ID NO: 3501744 - RNA, 14 nt, Human
caaauuaucuuaaa

SEQ ID NO: 3501745 - RNA, 19 nt, Human
caaauuaucuugauacauu

SEQ ID NO: 3501746 - RNA, 21 nt, Human
caaauuaugcuaagaauuuuu

SEQ ID NO: 3501747 - RNA, 14 nt, Human
caaauuauuugugu

SEQ ID NO: 3501748 - RNA, 20 nt, Human
caaauucaguuucauaaaag

SEQ ID NO: 3501749 - RNA, 15 nt, Human
caaauucugucucug

SEQ ID NO: 3501750 - RNA, 15 nt, Human
caaauucuguuucuu

SEQ ID NO: 3501751 - RNA, 15 nt, Human
caaauucuucugaac

SEQ ID NO: 3501752 - RNA, 23 nt, Human
caaauugagacagugcacaugaa

SEQ ID NO: 3501753 - RNA, 19 nt, Human
caaauugagagaauggaaa

SEQ ID NO: 3501754 - RNA, 22 nt, Human
caaauugcacagaaguccugua

SEQ ID NO: 3501755 - RNA, 19 nt, Human
caaauugccuucauuuuau

SEQ ID NO: 3501756 - RNA, 22 nt, Human
caaauugcuccuaagcuucaaa

SEQ ID NO: 3501757 - RNA, 19 nt, Human
caaauugcuugaaagaaaa

SEQ ID NO: 3501758 - RNA, 13 nt, Human
caaauuggagaaa

SEQ ID NO: 3501759 - RNA, 21 nt, Human
caaauuggagcuucauggcag

SEQ ID NO: 3501760 - RNA, 21 nt, Human
caaauuguaagcaugcacaaa

SEQ ID NO: 3501761 - RNA, 16 nt, Human
caaauuguaauuaaua

SEQ ID NO: 3501762 - RNA, 21 nt, Human
caaauugucaccugcuucucu

SEQ ID NO: 3501763 - RNA, 19 nt, Human
caaauugugcuucucccca

SEQ ID NO: 3501764 - RNA, 14 nt, Human
caaauuguggagcc

SEQ ID NO: 3501765 - RNA, 15 nt, Human
caaauuuaaaacaaa

SEQ ID NO: 3501766 - RNA, 13 nt, Human
caaauuuaacagg

SEQ ID NO: 3501767 - RNA, 14 nt, Human
caaauuuacagaga

SEQ ID NO: 3501768 - RNA, 13 nt, Human
caaauuuaucaaa

SEQ ID NO: 3501769 - RNA, 15 nt, Human
caaauuuauuuccaa

SEQ ID NO: 3501770 - RNA, 21 nt, Human
caaauuuauuuuuuucuuuug

SEQ ID NO: 3501771 - RNA, 16 nt, Human
caaauuucaaaagaca

SEQ ID NO: 3501772 - RNA, 11 nt, Human
caaauuucaca

SEQ ID NO: 3501773 - RNA, 17 nt, Human
caaauuucaugaccagu

SEQ ID NO: 3501774 - RNA, 19 nt, Human
caaauuucucuguuccaua

SEQ ID NO: 3501775 - RNA, 15 nt, Human
caaauuuguaaacuu

SEQ ID NO: 3501776 - RNA, 22 nt, Human
caaauuugucuugccuuauuaa

SEQ ID NO: 3501777 - RNA, 17 nt, Human
caaauuuuaauuuuugc

SEQ ID NO: 3501778 - RNA, 15 nt, Human
caaauuuuaucugcc

SEQ ID NO: 3501779 - RNA, 15 nt, Human
caaauuuuauuugua

SEQ ID NO: 3501780 - RNA, 15 nt, Human
caaauuuuggccaaa

SEQ ID NO: 3501781 - RNA, 20 nt, Human
caaauuuuucucaguuugua

SEQ ID NO: 3501782 - RNA, 20 nt, Human
caaauuuuucugcuuuaaaa

SEQ ID NO: 3501783 - RNA, 14 nt, Human
caacaaaauacauu

SEQ ID NO: 3501784 - RNA, 17 nt, Human
caacaaacugcacauga

SEQ ID NO: 3501785 - RNA, 21 nt, Human
caacaaacugcacaugauuuc

SEQ ID NO: 3501786 - RNA, 22 nt, Human
caacaaacugcacaugauuuca

SEQ ID NO: 3501787 - RNA, 12 nt, Human
caacaaagaaau

SEQ ID NO: 3501788 - RNA, 19 nt, Human
caacaaagccaacagucaa

SEQ ID NO: 3501789 - RNA, 22 nt, Human
caacaaaggauuaauugcugca

SEQ ID NO: 3501790 - RNA, 18 nt, Human
caacaaaggcaaguuaag

SEQ ID NO: 3501791 - RNA, 22 nt, Human
caacaaauauucacuggccccu

SEQ ID NO: 3501792 - RNA, 21 nt, Human
caacaaauuagguuuuguaca

SEQ ID NO: 3501793 - RNA, 16 nt, Human
caacaacaauugguaa

SEQ ID NO: 3501794 - RNA, 14 nt, Human
caacaacauccaug

SEQ ID NO: 3501795 - RNA, 20 nt, Human
caacaagaagggacugagag

SEQ ID NO: 3501796 - RNA, 14 nt, Human
caacaagaaugcau

SEQ ID NO: 3501797 - RNA, 15 nt, Human
caacaagaguuuauu

SEQ ID NO: 3501798 - RNA, 19 nt, Human
caacaaggcuugcugcaga

SEQ ID NO: 3501799 - RNA, 18 nt, Human
caacaagggcaguggagg

SEQ ID NO: 3501800 - RNA, 19 nt, Human
caacaagguuauaugaaua

SEQ ID NO: 3501801 - RNA, 13 nt, Human
caacaauaaaaua

SEQ ID NO: 3501802 - RNA, 15 nt, Human
caacaauaaaauuuu

SEQ ID NO: 3501803 - RNA, 13 nt, Human
caacaauaacacu

SEQ ID NO: 3501804 - RNA, 18 nt, Human
caacaauccuagugcuuu

SEQ ID NO: 3501805 - RNA, 23 nt, Human
caacaauucucccgggacucugc

SEQ ID NO: 3501806 - RNA, 19 nt, Human
caaaagccuuguguauauu

SEQ ID NO: 3501807 - RNA, 20 nt, Human
caaaagccuuguguauauuu

SEQ ID NO: 3501808 - RNA, 22 nt, Human
caaaagccuuguguauauuugu

SEQ ID NO: 3501809 - RNA, 23 nt, Human
caaaagccuuguguauauuugua

SEQ ID NO: 3501810 - RNA, 21 nt, Human
caaaagcugaacacauuucuu

SEQ ID NO: 3501811 - RNA, 14 nt, Human
caaaagcugcucag

SEQ ID NO: 3501812 - RNA, 18 nt, Human
caaaagcuuacaaauacu

SEQ ID NO: 3501813 - RNA, 17 nt, Human
caaaagcuucaaauuaa

SEQ ID NO: 3501814 - RNA, 11 nt, Human
caaaaggaaaa

SEQ ID NO: 3501815 - RNA, 21 nt, Human
caaaaggaucuuuguggccaa

SEQ ID NO: 3501816 - RNA, 20 nt, Human
caaaaggcaguggggcuggg

SEQ ID NO: 3501817 - RNA, 17 nt, Human
caaaaggcauuucccac

SEQ ID NO: 3501818 - RNA, 21 nt, Human
caaaaggcauuucccacccug

SEQ ID NO: 3501819 - RNA, 15 nt, Human
caaaaggcuugcaga

SEQ ID NO: 3501820 - RNA, 19 nt, Human
caaaaggcuugcagaacuu

SEQ ID NO: 3501821 - RNA, 24 nt, Human
caaaagggggauucccugauggaa

SEQ ID NO: 3501822 - RNA, 11 nt, Human
caaaaggguca

SEQ ID NO: 3501823 - RNA, 20 nt, Human
caaaaggguuuaaacugauu

SEQ ID NO: 3501824 - RNA, 21 nt, Human
caaaagguauuuuaaucacca

SEQ ID NO: 3501825 - RNA, 18 nt, Human
caaaaggugccugugagg

SEQ ID NO: 3501826 - RNA, 17 nt, Human
caaaaguaaugccucug

SEQ ID NO: 3501827 - RNA, 22 nt, Human
caaaaguaaugccucugucuag

SEQ ID NO: 3501828 - RNA, 14 nt, Human
caaaaguagaacuu

SEQ ID NO: 3501829 - RNA, 19 nt, Human
caaaaguagaacuuuguau

SEQ ID NO: 3501830 - RNA, 14 nt, Human
caaaaguauuuucc

SEQ ID NO: 3501831 - RNA, 19 nt, Human
caaaagucaaaaggugccu

SEQ ID NO: 3501832 - RNA, 15 nt, Human
caaaagugcuuugga

SEQ ID NO: 3501833 - RNA, 20 nt, Human
caaaaguggccucuuugucu

SEQ ID NO: 3501834 - RNA, 14 nt, Human
caaaaguuccaaga

SEQ ID NO: 3501835 - RNA, 17 nt, Human
caaaaguucugacuuga

SEQ ID NO: 3501836 - RNA, 18 nt, Human
caaaaguuggacuaaaug

SEQ ID NO: 3501837 - RNA, 19 nt, Human
caaaaguuggacuaaaugc

SEQ ID NO: 3501838 - RNA, 21 nt, Human
caaaaguuggacuaaaugccu

SEQ ID NO: 3501839 - RNA, 18 nt, Human
caaaaguuucauccuuuu

SEQ ID NO: 3501840 - RNA, 12 nt, Human
caaaauaaaaac

SEQ ID NO: 3501841 - RNA, 19 nt, Human
caaaauaaaaagugacaca

SEQ ID NO: 3501842 - RNA, 13 nt, Human
caaaauaaaacaa

SEQ ID NO: 3501843 - RNA, 14 nt, Human
caaaauaaaacaaa

SEQ ID NO: 3501844 - RNA, 19 nt, Human
caaaauaaaguuacauugc

SEQ ID NO: 3501845 - RNA, 23 nt, Human
caaaauaaaguuacauugcuggu

SEQ ID NO: 3501846 - RNA, 14 nt, Human
caaaauaaauugaa

SEQ ID NO: 3501847 - RNA, 18 nt, Human
caaaauaaauugaaauau

SEQ ID NO: 3501848 - RNA, 16 nt, Human
caaaauaagaaaagau

SEQ ID NO: 3501849 - RNA, 22 nt, Human
caaaauaagaaaagauguagau

SEQ ID NO: 3501850 - RNA, 16 nt, Human
caaaauaaugucuugu

SEQ ID NO: 3501851 - RNA, 18 nt, Human
caaaauaaugucuuguua

SEQ ID NO: 3501852 - RNA, 21 nt, Human
caaaauaaugucuuguuaaua

SEQ ID NO: 3501853 - RNA, 11 nt, Human
caaaauaauuc

SEQ ID NO: 3501854 - RNA, 18 nt, Human
caaaauaauuuuaagaaa

SEQ ID NO: 3501855 - RNA, 22 nt, Human
caaaauaauuuuaagaaaucaa

SEQ ID NO: 3501856 - RNA, 21 nt, Human
caaaauacuugucuguuuuaa

SEQ ID NO: 3501857 - RNA, 12 nt, Human
caaaauagaaaa

SEQ ID NO: 3501858 - RNA, 22 nt, Human
caaaauagaaaguugcaaggca

SEQ ID NO: 3501859 - RNA, 17 nt, Human
caaaauaggguauauuu

SEQ ID NO: 3501860 - RNA, 20 nt, Human
caaaauauauuuuguuuaca

SEQ ID NO: 3501861 - RNA, 19 nt, Human
caaaauauguugaugaaaa

SEQ ID NO: 3501862 - RNA, 16 nt, Human
caaaauauguuuaaaa

SEQ ID NO: 3501863 - RNA, 18 nt, Human
caaaauauugagcagaau

SEQ ID NO: 3501864 - RNA, 19 nt, Human
caaaauauuuaaaaauguc

SEQ ID NO: 3501865 - RNA, 12 nt, Human
caaaauauuuuc

SEQ ID NO: 3501866 - RNA, 13 nt, Human
caaaauauuuuua

SEQ ID NO: 3501867 - RNA, 17 nt, Human
caaaauauuuuuauaga

SEQ ID NO: 3501868 - RNA, 16 nt, Human
caaaaucaauuaaaau

SEQ ID NO: 3501869 - RNA, 23 nt, Human
caaaaucauggaaugguuauaaa

SEQ ID NO: 3501870 - RNA, 20 nt, Human
caaaauccuugcuuaugaca

SEQ ID NO: 3501871 - RNA, 22 nt, Human
caaaaucucuccacuuucagcu

SEQ ID NO: 3501872 - RNA, 16 nt, Human
caaaaucuugaucagu

SEQ ID NO: 3501873 - RNA, 18 nt, Human
caaaaucuugaucaguua

SEQ ID NO: 3501874 - RNA, 14 nt, Human
caaaaugacaauga

SEQ ID NO: 3501875 - RNA, 20 nt, Human
caaaaugaggaauguauaug

SEQ ID NO: 3501876 - RNA, 18 nt, Human
caaaaugcuuuuuauuuc

SEQ ID NO: 3501877 - RNA, 14 nt, Human
caaaauggaacgcu

SEQ ID NO: 3501878 - RNA, 16 nt, Human
caaaauggaauaaaag

SEQ ID NO: 3501879 - RNA, 16 nt, Human
caaaauggacauggug

SEQ ID NO: 3501880 - RNA, 20 nt, Human
caaaaugggagaucuucuca

SEQ ID NO: 3501881 - RNA, 18 nt, Human
caaaauguaacuguuacc

SEQ ID NO: 3501882 - RNA, 18 nt, Human
caaaauguagaauauuca

SEQ ID NO: 3501883 - RNA, 18 nt, Human
caaaauguauauauuuag

SEQ ID NO: 3501884 - RNA, 21 nt, Human
caaaaugugagugguugaaua

SEQ ID NO: 3501885 - RNA, 19 nt, Human
caaaauguuaucuucucaa

SEQ ID NO: 3501886 - RNA, 22 nt, Human
caaaauguuaucuucucaaguu

SEQ ID NO: 3501887 - RNA, 17 nt, Human
caaaauguuauuucccu

SEQ ID NO: 3501888 - RNA, 19 nt, Human
aucagucauaacuaaauaa

SEQ ID NO: 3501889 - RNA, 21 nt, Human
aucaguccuagaauguuucau

SEQ ID NO: 3501890 - RNA, 20 nt, Human
aucagucuauccacagagag

SEQ ID NO: 3501891 - RNA, 21 nt, Human
aucaguggacagucugcucua

SEQ ID NO: 3501892 - RNA, 18 nt, Human
aucaguggauuucccauc

SEQ ID NO: 3501893 - RNA, 13 nt, Human
aucagugugcccc

SEQ ID NO: 3501894 - RNA, 20 nt, Human
aucagugugucuaaauuuga

SEQ ID NO: 3501895 - RNA, 19 nt, Human
aucaguguuaaaaaauuuu

SEQ ID NO: 3501896 - RNA, 10 nt, Human
aucaguguug

SEQ ID NO: 3501897 - RNA, 14 nt, Human
aucaguguuuaugu

SEQ ID NO: 3501898 - RNA, 18 nt, Human
aucaguguuuuaaauucu

SEQ ID NO: 3501899 - RNA, 22 nt, Human
aucaguuaagaaauuucacaua

SEQ ID NO: 3501900 - RNA, 22 nt, Human
aucaguuacccacucgguccca

SEQ ID NO: 3501901 - RNA, 18 nt, Human
aucaguuacuaagaagaa

SEQ ID NO: 3501902 - RNA, 16 nt, Human
aucaguuacucagccc

SEQ ID NO: 3501903 - RNA, 17 nt, Human
aucaguucauuagaaau

SEQ ID NO: 3501904 - RNA, 14 nt, Human
aucaguuccuuugu

SEQ ID NO: 3501905 - RNA, 18 nt, Human
aucaguugcaauaauacu

SEQ ID NO: 3501906 - RNA, 20 nt, Human
aucaguuuaaaagcacgaca

SEQ ID NO: 3501907 - RNA, 10 nt, Human
aucaguuuga

SEQ ID NO: 3501908 - RNA, 17 nt, Human
aucaguuuuauccacag

SEQ ID NO: 3501909 - RNA, 14 nt, Human
aucauaaaaucaaa

SEQ ID NO: 3501910 - RNA, 18 nt, Human
aucauaaguauuuggaau

SEQ ID NO: 3501911 - RNA, 15 nt, Human
aucauaagugaauuu

SEQ ID NO: 3501912 - RNA, 16 nt, Human
aucauaagugaauuua

SEQ ID NO: 3501913 - RNA, 18 nt, Human
aucauaagugaauuuaua

SEQ ID NO: 3501914 - RNA, 14 nt, Human
aucauaauuaccaa

SEQ ID NO: 3501915 - RNA, 18 nt, Human
aucauaauuaccaaguga

SEQ ID NO: 3501916 - RNA, 17 nt, Human
aucauacacuuccuucu

SEQ ID NO: 3501917 - RNA, 12 nt, Human
aucauagaaaug

SEQ ID NO: 3501918 - RNA, 20 nt, Human
aucauagauuucugauuuua

SEQ ID NO: 3501919 - RNA, 23 nt, Human
aucauagauuucugauuuuaugu

SEQ ID NO: 3501920 - RNA, 22 nt, Human
aucauaggcaccuuuuacugug

SEQ ID NO: 3501921 - RNA, 19 nt, Human
aucauauaaauagaaugua

SEQ ID NO: 3501922 - RNA, 23 nt, Human
aucauauaaauagaauguaaaug

SEQ ID NO: 3501923 - RNA, 24 nt, Human
aucauauaaauagaauguaaaugu

SEQ ID NO: 3501924 - RNA, 21 nt, Human
aucauaugauucugcuuuuac

SEQ ID NO: 3501925 - RNA, 13 nt, Human
aucauauugauga

SEQ ID NO: 3501926 - RNA, 14 nt, Human
aucauauugaugaa

SEQ ID NO: 3501927 - RNA, 18 nt, Human
aucauauugaugaaaaga

SEQ ID NO: 3501928 - RNA, 14 nt, Human
aucaucaagaaggg

SEQ ID NO: 3501929 - RNA, 21 nt, Human
aucaucaagaagggcugcaug

SEQ ID NO: 3501930 - RNA, 21 nt, Human
aucaucaaguaauacaaacua

SEQ ID NO: 3501931 - RNA, 17 nt, Human
aucaucacguauguuau

SEQ ID NO: 3501932 - RNA, 20 nt, Human
aucaucagcauaccuuuauu

SEQ ID NO: 3501933 - RNA, 14 nt, Human
aucaucaggacccu

SEQ ID NO: 3501934 - RNA, 20 nt, Human
aucaucaugcagcucaacuu

SEQ ID NO: 3501935 - RNA, 14 nt, Human
aucaucauuauuau

SEQ ID NO: 3501936 - RNA, 23 nt, Human
aucauccacugugccaugugcca

SEQ ID NO: 3501937 - RNA, 23 nt, Human
aucaucccaucuaagcugcagcu

SEQ ID NO: 3501938 - RNA, 15 nt, Human
aucaucccuuucccu

SEQ ID NO: 3501939 - RNA, 12 nt, Human
aucauccuacug

SEQ ID NO: 3501940 - RNA, 13 nt, Human
aucauccuuucca

SEQ ID NO: 3501941 - RNA, 13 nt, Human
aucaucgccagag

SEQ ID NO: 3501942 - RNA, 15 nt, Human
aucaucgccagaggu

SEQ ID NO: 3501943 - RNA, 22 nt, Human
aucaucgccagaggugcuucac

SEQ ID NO: 3501944 - RNA, 21 nt, Human
aucaucuaccuagauuuaaua

SEQ ID NO: 3501945 - RNA, 19 nt, Human
aucaucuauagaaagcuau

SEQ ID NO: 3501946 - RNA, 23 nt, Human
aucaucuccugccuuccuccugg

SEQ ID NO: 3501947 - RNA, 13 nt, Human
aucaucugccgug

SEQ ID NO: 3501948 - RNA, 14 nt, Human
aucaucuguaagcu

SEQ ID NO: 3501949 - RNA, 15 nt, Human
aucaucuuugugaag

SEQ ID NO: 3501950 - RNA, 17 nt, Human
caaaugacaugcacuga

SEQ ID NO: 3501951 - RNA, 18 nt, Human
caaaugacaugcacugac

SEQ ID NO: 3501952 - RNA, 21 nt, Human
caaaugacaugcacugacccu

SEQ ID NO: 3501953 - RNA, 18 nt, Human
caaaugacccaaagacca

SEQ ID NO: 3501954 - RNA, 13 nt, Human
caaaugacuuuau

SEQ ID NO: 3501955 - RNA, 15 nt, Human
caaaugacuuuauua

SEQ ID NO: 3501956 - RNA, 22 nt, Human
caaaugagggucuugguuccag

SEQ ID NO: 3501957 - RNA, 17 nt, Human
caaaugaugugccugcu

SEQ ID NO: 3501958 - RNA, 21 nt, Human
caaaugaugugccugcuucag

SEQ ID NO: 3501959 - RNA, 12 nt, Human
caaaugauugcu

SEQ ID NO: 3501960 - RNA, 23 nt, Human
caaaugauugcuuuuaaaauuuu

SEQ ID NO: 3501961 - RNA, 21 nt, Human
caaaugcaaaaacucuuugag

SEQ ID NO: 3501962 - RNA, 19 nt, Human
caaaugcagggauugcugc

SEQ ID NO: 3501963 - RNA, 23 nt, Human
caaaugcagggauugcugccacu

SEQ ID NO: 3501964 - RNA, 22 nt, Human
caaaugcaucuuugauguguug

SEQ ID NO: 3501965 - RNA, 19 nt, Human
caaaugcaugcuucuucuc

SEQ ID NO: 3501966 - RNA, 18 nt, Human
caaaugcauggugcaguu

SEQ ID NO: 3501967 - RNA, 16 nt, Human
caaaugccagggcccg

SEQ ID NO: 3501968 - RNA, 15 nt, Human
caaaugcuaauguca

SEQ ID NO: 3501969 - RNA, 21 nt, Human
caaaugcuagaaaaauuguua

SEQ ID NO: 3501970 - RNA, 21 nt, Human
caaaugcugacccaugcaaua

SEQ ID NO: 3501971 - RNA, 18 nt, Human
caaaugcugcgcccuucc

SEQ ID NO: 3501972 - RNA, 17 nt, Human
caaaugcuuggcuucuc

SEQ ID NO: 3501973 - RNA, 21 nt, Human
caaauggaaaggagaggaaag

SEQ ID NO: 3501974 - RNA, 14 nt, Human
caaauggaggaaua

SEQ ID NO: 3501975 - RNA, 21 nt, Human
caaauggaguuggaguucauu

SEQ ID NO: 3501976 - RNA, 17 nt, Human
caaauggauauauuuuc

SEQ ID NO: 3501977 - RNA, 19 nt, Human
caaauggauuccuguuuca

SEQ ID NO: 3501978 - RNA, 21 nt, Human
caaauggcgucuggaagucca

SEQ ID NO: 3501979 - RNA, 16 nt, Human
caaauggggccagauc

SEQ ID NO: 3501980 - RNA, 15 nt, Human
caaaugguacaaaac

SEQ ID NO: 3501981 - RNA, 20 nt, Human
caaauggugguuguuucuuc

SEQ ID NO: 3501982 - RNA, 14 nt, Human
caaauguaaacauu

SEQ ID NO: 3501983 - RNA, 12 nt, Human
caaauguaaagu

SEQ ID NO: 3501984 - RNA, 19 nt, Human
caaauguaacuauguuuua

SEQ ID NO: 3501985 - RNA, 18 nt, Human
caaaugucaucagaacuu

SEQ ID NO: 3501986 - RNA, 16 nt, Human
caaaugucaugcugcc

SEQ ID NO: 3501987 - RNA, 15 nt, Human
caaaugucuuccugg

SEQ ID NO: 3501988 - RNA, 17 nt, Human
caaaugucuuccuggau

SEQ ID NO: 3501989 - RNA, 11 nt, Human
caaaugugaag

SEQ ID NO: 3501990 - RNA, 14 nt, Human
caaaugugaagaug

SEQ ID NO: 3501991 - RNA, 17 nt, Human
caaaugugaagaugcau

SEQ ID NO: 3501992 - RNA, 15 nt, Human
caaauguggcuccug

SEQ ID NO: 3501993 - RNA, 16 nt, Human
caaaugugugcccagc

SEQ ID NO: 3501994 - RNA, 17 nt, Human
caaaugugugcccagcu

SEQ ID NO: 3501995 - RNA, 15 nt, Human
caaauguuaaaaugu

SEQ ID NO: 3501996 - RNA, 16 nt, Human
caaauguuaaaaugug

SEQ ID NO: 3501997 - RNA, 18 nt, Human
caaauguuaaaauguguu

SEQ ID NO: 3501998 - RNA, 13 nt, Human
caaauguuaugca

SEQ ID NO: 3501999 - RNA, 14 nt, Human
caaauguucaucaa

SEQ ID NO: 3502000 - RNA, 18 nt, Human
caaauguucaucaaugaa

SEQ ID NO: 3502001 - RNA, 21 nt, Human
caaauguucaucaaugaauga

SEQ ID NO: 3502002 - RNA, 14 nt, Human
caaauguucuaagu

SEQ ID NO: 3502003 - RNA, 10 nt, Human
caaauguuga

SEQ ID NO: 3502004 - RNA, 19 nt, Human
caaauguuuaaucauauaa

SEQ ID NO: 3502005 - RNA, 23 nt, Human
caaauguuuauuaagcaucagaa

SEQ ID NO: 3502006 - RNA, 14 nt, Human
caaauguuuauuuu

SEQ ID NO: 3502007 - RNA, 19 nt, Human
caaauuaaaaaaaaauugu

SEQ ID NO: 3502008 - RNA, 16 nt, Human
caaauuaaaaaagaua

SEQ ID NO: 3502009 - RNA, 20 nt, Human
caaauuaaaaaagauaaaca

SEQ ID NO: 3502010 - RNA, 18 nt, Human
caaauuaaaaagauucuu

SEQ ID NO: 3502011 - RNA, 15 nt, Human
caaauuaauaaucuu

SEQ ID NO: 3502012 - RNA, 17 nt, Human
caaauuaauaaucuuau

SEQ ID NO: 3502013 - RNA, 15 nt, Human
caaauuaaucuuucu

SEQ ID NO: 3502014 - RNA, 12 nt, Human
caaauuaauugu

SEQ ID NO: 3502015 - RNA, 19 nt, Human
caaauuaauugugugaacu

SEQ ID NO: 3502016 - RNA, 21 nt, Human
caaauuacuuugugaauagaa

SEQ ID NO: 3502017 - RNA, 13 nt, Human
caaauuagaaaau

SEQ ID NO: 3502018 - RNA, 15 nt, Human
caaauuagaagacau

SEQ ID NO: 3502019 - RNA, 18 nt, Human
caaauuagguuuuguaca

SEQ ID NO: 3502020 - RNA, 21 nt, Human
caaauuagguuuuguacaauu

SEQ ID NO: 3502021 - RNA, 17 nt, Human
caaauuauaauguauuc

SEQ ID NO: 3502022 - RNA, 17 nt, Human
caaauuaucaagcuaau

SEQ ID NO: 3502023 - RNA, 21 nt, Human
caaauuaucaagcuaauaaaa

SEQ ID NO: 3502024 - RNA, 13 nt, Human
caaauuaucuuga

SEQ ID NO: 3502025 - RNA, 12 nt, Human
caaauuauuugu

SEQ ID NO: 3502026 - RNA, 17 nt, Human
caaauuauuuguguaau

SEQ ID NO: 3502027 - RNA, 18 nt, Human
caaauuauuuguguaaua

SEQ ID NO: 3502028 - RNA, 14 nt, Human
caaauucaaauaaa

SEQ ID NO: 3502029 - RNA, 17 nt, Human
caaauucaguuucauaa

SEQ ID NO: 3502030 - RNA, 23 nt, Human
caaauucauggcaugcuuaaauu

SEQ ID NO: 3502031 - RNA, 18 nt, Human
caaauucccuccucccuu

SEQ ID NO: 3502032 - RNA, 21 nt, Human
caaauucucaaccuaccaccc

SEQ ID NO: 3502033 - RNA, 22 nt, Human
caaauucucaaccuaccacccc

SEQ ID NO: 3502034 - RNA, 16 nt, Human
caaauucugaauauuu

SEQ ID NO: 3502035 - RNA, 14 nt, Human
caaauucuguuucu

SEQ ID NO: 3502036 - RNA, 14 nt, Human
caaauucuuuugaa

SEQ ID NO: 3502037 - RNA, 16 nt, Human
caaauucuuuugaauu

SEQ ID NO: 3502038 - RNA, 17 nt, Human
caaauucuuuugaauug

SEQ ID NO: 3502039 - RNA, 18 nt, Human
caaauucuuuugaauugu

SEQ ID NO: 3502040 - RNA, 23 nt, Human
caaauucuuuugaauuguuacau

SEQ ID NO: 3502041 - RNA, 20 nt, Human
caaauugcuuacuuuggaau

SEQ ID NO: 3502042 - RNA, 17 nt, Human
caaauugcuugaaagaa

SEQ ID NO: 3502043 - RNA, 22 nt, Human
caaauugcuuuuuuccaaaaca

SEQ ID NO: 3502044 - RNA, 19 nt, Human
caaauuggacuuucaaaau

SEQ ID NO: 3502045 - RNA, 15 nt, Human
caaauuggagcaggg

SEQ ID NO: 3502046 - RNA, 18 nt, Human
caaauuguaauuaauaau

SEQ ID NO: 3502047 - RNA, 19 nt, Human
caaauuguaucuagugcag

SEQ ID NO: 3502048 - RNA, 22 nt, Human
caaauuguaucuagugcagcug

SEQ ID NO: 3502049 - RNA, 18 nt, Human
caaauugugcaguacuuu

SEQ ID NO: 3502050 - RNA, 14 nt, Human
caaauugugcuucu

SEQ ID NO: 3502051 - RNA, 21 nt, Human
caaauugugcuucuccccaga

SEQ ID NO: 3502052 - RNA, 14 nt, Human
caaauuuaaaacaa

SEQ ID NO: 3502053 - RNA, 15 nt, Human
caaauuuacagagac

SEQ ID NO: 3502054 - RNA, 14 nt, Human
caaauuuauaauuu

SEQ ID NO: 3502055 - RNA, 16 nt, Human
caaauuuauaauuuua

SEQ ID NO: 3502056 - RNA, 19 nt, Human
caaauuuaucaaagcauag

SEQ ID NO: 3502057 - RNA, 14 nt, Human
caaauuuauuucca

SEQ ID NO: 3502058 - RNA, 22 nt, Human
caaauuucuaaaucuccaaaau

SEQ ID NO: 3502059 - RNA, 19 nt, Human
caaauuugaaaauaauugu

SEQ ID NO: 3502060 - RNA, 14 nt, Human
caaauuugauugau

SEQ ID NO: 3502061 - RNA, 17 nt, Human
caaauuugauugauuug

SEQ ID NO: 3502062 - RNA, 19 nt, Human
caaauuuugaguugccaca

SEQ ID NO: 3502063 - RNA, 21 nt, Human
caaauuuuggcgaaucucaaa

SEQ ID NO: 3502064 - RNA, 15 nt, Human
caaauuuuucugcuu

SEQ ID NO: 3502065 - RNA, 17 nt, Human
caaauuuuuuaaaagag

SEQ ID NO: 3502066 - RNA, 19 nt, Human
caaauuuuuuaaaagagac

SEQ ID NO: 3502067 - RNA, 23 nt, Human
caaauuuuuugacuuuuuuugua

SEQ ID NO: 3502068 - RNA, 10 nt, Human
caacaaaaaa

SEQ ID NO: 3502069 - RNA, 17 nt, Human
caacaaaaagcuucccc

SEQ ID NO: 3502070 - RNA, 10 nt, Human
caacaaaaau

SEQ ID NO: 3502071 - RNA, 22 nt, Human
caacaaaagaagcccggcuccu

SEQ ID NO: 3502072 - RNA, 23 nt, Human
caacaaaccuguuucugcagcca

SEQ ID NO: 3502073 - RNA, 20 nt, Human
caacaaagaaacaaagaugu

SEQ ID NO: 3502074 - RNA, 14 nt, Human
caacaaagaacacu

SEQ ID NO: 3502075 - RNA, 17 nt, Human
caacaaagcacaguguu

SEQ ID NO: 3502076 - RNA, 16 nt, Human
caacaaagcuguugau

SEQ ID NO: 3502077 - RNA, 19 nt, Human
caacaaauuagguuuugua

SEQ ID NO: 3502078 - RNA, 13 nt, Human
caacaacauccau

SEQ ID NO: 3502079 - RNA, 21 nt, Human
caacaacauguauaauauuuu

SEQ ID NO: 3502080 - RNA, 22 nt, Human
caacaacauguauaauauuuuu

SEQ ID NO: 3502081 - RNA, 21 nt, Human
caacaagaagggacugagaga

SEQ ID NO: 3502082 - RNA, 18 nt, Human
caacaagaauaaaggcag

SEQ ID NO: 3502083 - RNA, 12 nt, Human
caacaagaaugc

SEQ ID NO: 3502084 - RNA, 16 nt, Human
caacaagaaugcauug

SEQ ID NO: 3502085 - RNA, 14 nt, Human
caacaagagcgaaa

SEQ ID NO: 3502086 - RNA, 18 nt, Human
caaggaaaaaauaacaau

SEQ ID NO: 3502087 - RNA, 15 nt, Human
caaggaaaaacaggu

SEQ ID NO: 3502088 - RNA, 14 nt, Human
caaggaaaacugca

SEQ ID NO: 3502089 - RNA, 22 nt, Human
caaggaaaccgccuaguuuacu

SEQ ID NO: 3502090 - RNA, 20 nt, Human
caaggaaagccccagcacua

SEQ ID NO: 3502091 - RNA, 13 nt, Human
caaggaaaggcac

SEQ ID NO: 3502092 - RNA, 18 nt, Human
caaggaagaaauuaacuu

SEQ ID NO: 3502093 - RNA, 16 nt, Human
caaggaagauauacau

SEQ ID NO: 3502094 - RNA, 16 nt, Human
caaggaagccacagcu

SEQ ID NO: 3502095 - RNA, 16 nt, Human
caaccccuucgcuccu

SEQ ID NO: 3502096 - RNA, 15 nt, Human
aucggagccuccucu

SEQ ID NO: 3502097 - RNA, 23 nt, Human
aucggaggcuugucagagcuggg

SEQ ID NO: 3502098 - RNA, 21 nt, Human
aucggccuccucuucaccccg

SEQ ID NO: 3502099 - RNA, 19 nt, Human
aucggcugcauugaagauc

SEQ ID NO: 3502100 - RNA, 21 nt, Human
aucgggaacaguguuucccau

SEQ ID NO: 3502101 - RNA, 16 nt, Human
aucgggagcagugucu

SEQ ID NO: 3502102 - RNA, 21 nt, Human
aucgggagcagugucuuccau

SEQ ID NO: 3502103 - RNA, 16 nt, Human
aucggggagccgggag

SEQ ID NO: 3502104 - RNA, 18 nt, Human
aucggggagccgggagcc

SEQ ID NO: 3502105 - RNA, 14 nt, Human
aucggggccagagg

SEQ ID NO: 3502106 - RNA, 23 nt, Human
aucgguuaacaaauaacaacuuu

SEQ ID NO: 3502107 - RNA, 13 nt, Human
aucguaaaauuaa

SEQ ID NO: 3502108 - RNA, 18 nt, Human
aucguaauguacagaugg

SEQ ID NO: 3502109 - RNA, 14 nt, Human
aucguauagcugua

SEQ ID NO: 3502110 - RNA, 16 nt, Human
aucguauucaccuuca

SEQ ID NO: 3502111 - RNA, 13 nt, Human
aucguccagggag

SEQ ID NO: 3502112 - RNA, 15 nt, Human
aucguccccuccccc

SEQ ID NO: 3502113 - RNA, 15 nt, Human
aucgugacaacacuu

SEQ ID NO: 3502114 - RNA, 21 nt, Human
aucgugacgcugaauaaaugu

SEQ ID NO: 3502115 - RNA, 12 nt, Human
aucguggagaca

SEQ ID NO: 3502116 - RNA, 22 nt, Human
aucguuaguaucuaacauguau

SEQ ID NO: 3502117 - RNA, 15 nt, Human
aucguuaucacugug

SEQ ID NO: 3502118 - RNA, 14 nt, Human
aucguuaugugugu

SEQ ID NO: 3502119 - RNA, 21 nt, Human
aucguuauguguguauaugua

SEQ ID NO: 3502120 - RNA, 20 nt, Human
aucguugcaaccacugcaau

SEQ ID NO: 3502121 - RNA, 14 nt, Human
aucguuuauuucac

SEQ ID NO: 3502122 - RNA, 14 nt, Human
aucguuuucuuaaa

SEQ ID NO: 3502123 - RNA, 18 nt, Human
aucguuuucuuaaagugc

SEQ ID NO: 3502124 - RNA, 18 nt, Human
aucuaaaaauaacuguaa

SEQ ID NO: 3502125 - RNA, 13 nt, Human
aucuaaaaauaua

SEQ ID NO: 3502126 - RNA, 16 nt, Human
aucuaaaaauauacau

SEQ ID NO: 3502127 - RNA, 17 nt, Human
aucuaaaaauauacaug

SEQ ID NO: 3502128 - RNA, 15 nt, Human
aucuaaacugccccc

SEQ ID NO: 3502129 - RNA, 18 nt, Human
aucuaaacuuuaauaugu

SEQ ID NO: 3502130 - RNA, 16 nt, Human
aucuaaaguuauauuu

SEQ ID NO: 3502131 - RNA, 16 nt, Human
aucuaaauaaaaugcu

SEQ ID NO: 3502132 - RNA, 13 nt, Human
aucuaaaucuauu

SEQ ID NO: 3502133 - RNA, 15 nt, Human
aucuaaaucuauuua

SEQ ID NO: 3502134 - RNA, 14 nt, Human
aucuaaaugaugag

SEQ ID NO: 3502135 - RNA, 18 nt, Human
aucuaaauggaaccacuc

SEQ ID NO: 3502136 - RNA, 16 nt, Human
aucuaacaauggaaga

SEQ ID NO: 3502137 - RNA, 14 nt, Human
aucuaaccucaucu

SEQ ID NO: 3502138 - RNA, 15 nt, Human
aucuaaccucaucuu

SEQ ID NO: 3502139 - RNA, 18 nt, Human
aucuaaccucaucuucuu

SEQ ID NO: 3502140 - RNA, 19 nt, Human
aucuaagaauacagcuuuc

SEQ ID NO: 3502141 - RNA, 20 nt, Human
aucuaagaauacagcuuucu

SEQ ID NO: 3502142 - RNA, 20 nt, Human
aucuaaggaugucacagggc

SEQ ID NO: 3502143 - RNA, 13 nt, Human
aucuaagugauau

SEQ ID NO: 3502144 - RNA, 15 nt, Human
aucuaagugauauaa

SEQ ID NO: 3502145 - RNA, 21 nt, Human
aucuaauagcggguuacuuuc

SEQ ID NO: 3502146 - RNA, 18 nt, Human
aucuaauauauaugaaua

SEQ ID NO: 3502147 - RNA, 16 nt, Human
aucuaauauggccaca

SEQ ID NO: 3502148 - RNA, 18 nt, Human
aucuaauauguaacaagc

SEQ ID NO: 3502149 - RNA, 20 nt, Human
aucuaauauguaacaagcca

SEQ ID NO: 3502150 - RNA, 15 nt, Human
aucuaauucugauuc

SEQ ID NO: 3502151 - RNA, 14 nt, Human
aucuaauuuauaaa

SEQ ID NO: 3502152 - RNA, 23 nt, Human
aucuaauuuauaaaaagguguuu

SEQ ID NO: 3502153 - RNA, 14 nt, Human
aucuacaaucucuu

SEQ ID NO: 3502154 - RNA, 23 nt, Human
aucuacaaucucuuuuuguuugc

SEQ ID NO: 3502155 - RNA, 14 nt, Human
aucuacccaaagga

SEQ ID NO: 3502156 - RNA, 21 nt, Human
aucuacccaaaggauacugua

SEQ ID NO: 3502157 - RNA, 14 nt, Human
aucuaccccagacu

SEQ ID NO: 3502158 - RNA, 15 nt, Human
aucuaccuagauuua

SEQ ID NO: 3502159 - RNA, 18 nt, Human
aucuaccuggagggaaga

SEQ ID NO: 3502160 - RNA, 16 nt, Human
aucuaccuuuucucuu

SEQ ID NO: 3502161 - RNA, 19 nt, Human
aucuacuaauuccacaccu

SEQ ID NO: 3502162 - RNA, 13 nt, Human
aucuacucccaag

SEQ ID NO: 3502163 - RNA, 18 nt, Human
aucuacugcauuuaggga

SEQ ID NO: 3502164 - RNA, 19 nt, Human
aucuacuucuguaauugug

SEQ ID NO: 3502165 - RNA, 16 nt, Human
aucuacuuuaauaaau

SEQ ID NO: 3502166 - RNA, 20 nt, Human
aucuagaagaaaugaaauuu

SEQ ID NO: 3502167 - RNA, 22 nt, Human
aucuagaagaaaugaaauuuua

SEQ ID NO: 3502168 - RNA, 19 nt, Human
aucuagaagagucuauugu

SEQ ID NO: 3502169 - RNA, 17 nt, Human
aucuagacaauauacaa

SEQ ID NO: 3502170 - RNA, 18 nt, Human
aucuagauacuguaucau

SEQ ID NO: 3502171 - RNA, 16 nt, Human
aucuagauaucgacuu

SEQ ID NO: 3502172 - RNA, 14 nt, Human
aucuagauguaaau

SEQ ID NO: 3502173 - RNA, 15 nt, Human
aucuagauguaaauu

SEQ ID NO: 3502174 - RNA, 22 nt, Human
aucuagcaaucacaacacuggc

SEQ ID NO: 3502175 - RNA, 19 nt, Human
aucuagccagccccucuuc

SEQ ID NO: 3502176 - RNA, 21 nt, Human
aucuagccagccccucuuccc

SEQ ID NO: 3502177 - RNA, 17 nt, Human
aucuagcgcaauugaag

SEQ ID NO: 3502178 - RNA, 15 nt, Human
aucuagcuaguaaua

SEQ ID NO: 3502179 - RNA, 16 nt, Human
aucuaggaaaauauuu

SEQ ID NO: 3502180 - RNA, 22 nt, Human
aucuaggaaaauauuuugaucu

SEQ ID NO: 3502181 - RNA, 16 nt, Human
aucuaggaaaauuauu

SEQ ID NO: 3502182 - RNA, 18 nt, Human
aucuaggaagacuuugga

SEQ ID NO: 3502183 - RNA, 18 nt, Human
aucuaggcaacauaguau

SEQ ID NO: 3502184 - RNA, 18 nt, Human
aucuagguggaguugaaa

SEQ ID NO: 3502185 - RNA, 15 nt, Human
aucuagguuuaugac

SEQ ID NO: 3502186 - RNA, 18 nt, Human
aucuaguaauauauuuaa

SEQ ID NO: 3502187 - RNA, 15 nt, Human
aucuaguaguuguuc

SEQ ID NO: 3502188 - RNA, 15 nt, Human
aucuaguaugaaauu

SEQ ID NO: 3502189 - RNA, 17 nt, Human
aucuaguaugaaauuau

SEQ ID NO: 3502190 - RNA, 19 nt, Human
aucuaguaugaaauuauau

SEQ ID NO: 3502191 - RNA, 13 nt, Human
aucuagugcagcu

SEQ ID NO: 3502192 - RNA, 15 nt, Human
aucuagugcagcuga

SEQ ID NO: 3502193 - RNA, 21 nt, Human
aucuagugcagcugauuuuaa

SEQ ID NO: 3502194 - RNA, 16 nt, Human
aucuaguuuacagaaa

SEQ ID NO: 3502195 - RNA, 11 nt, Human
aucuauaaaau

SEQ ID NO: 3502196 - RNA, 13 nt, Human
aucuauaaacacu

SEQ ID NO: 3502197 - RNA, 14 nt, Human
aucuauaaacacug

SEQ ID NO: 3502198 - RNA, 15 nt, Human
aucuauaaacacugu

SEQ ID NO: 3502199 - RNA, 21 nt, Human
aucuauaaagcgauauacaga

SEQ ID NO: 3502200 - RNA, 15 nt, Human
aucuauacuugcuuu

SEQ ID NO: 3502201 - RNA, 15 nt, Human
aucuauagaaagugu

SEQ ID NO: 3502202 - RNA, 17 nt, Human
aucuauagaaaguguuc

SEQ ID NO: 3502203 - RNA, 22 nt, Human
aucuauagaaaguguucuguua

SEQ ID NO: 3502204 - RNA, 16 nt, Human
aucuauagaacugaau

SEQ ID NO: 3502205 - RNA, 21 nt, Human
aucuauaggaagauugaaccu

SEQ ID NO: 3502206 - RNA, 11 nt, Human
aucuauauaaa

SEQ ID NO: 3502207 - RNA, 12 nt, Human
aucuauauaaaa

SEQ ID NO: 3502208 - RNA, 13 nt, Human
aucuauauaaaau

SEQ ID NO: 3502209 - RNA, 16 nt, Human
aucuauauguacuugu

SEQ ID NO: 3502210 - RNA, 22 nt, Human
aucuauauguacuugucaaaga

SEQ ID NO: 3502211 - RNA, 15 nt, Human
aucuauauuuaacaa

SEQ ID NO: 3502212 - RNA, 21 nt, Human
aucuauauuuuacauaaauuu

SEQ ID NO: 3502213 - RNA, 17 nt, Human
aucuaucaauagucaag

SEQ ID NO: 3502214 - RNA, 14 nt, Human
aucuaucagaguau

SEQ ID NO: 3502215 - RNA, 16 nt, Human
aucuaucuaguucuaa

SEQ ID NO: 3502216 - RNA, 23 nt, Human
aucuaucuggugauuucuagcuc

SEQ ID NO: 3502217 - RNA, 13 nt, Human
aucuaucugugcu

SEQ ID NO: 3502218 - RNA, 15 nt, Human
aucuaugaaguauau

SEQ ID NO: 3502219 - RNA, 19 nt, Human
aucuaugaaguauauaaug

SEQ ID NO: 3502220 - RNA, 20 nt, Human
aucuaugaaguauauaaugg

SEQ ID NO: 3502221 - RNA, 18 nt, Human
aucuaugcauuuucugga

SEQ ID NO: 3502222 - RNA, 21 nt, Human
aucuaugccaaagaucacuug

SEQ ID NO: 3502223 - RNA, 17 nt, Human
aucuauggucgggagac

SEQ ID NO: 3502224 - RNA, 20 nt, Human
aucuauguuucaucuuguuu

SEQ ID NO: 3502225 - RNA, 14 nt, Human
aucuauguuuuacc

SEQ ID NO: 3502226 - RNA, 14 nt, Human
aucuauuaauauau

SEQ ID NO: 3502227 - RNA, 14 nt, Human
aucuauuauacugu

SEQ ID NO: 3502228 - RNA, 17 nt, Human
aucuauuauacuguauu

SEQ ID NO: 3502229 - RNA, 17 nt, Human
aucuauucagacaagca

SEQ ID NO: 3502230 - RNA, 18 nt, Human
aucuauucugagaaaaca

SEQ ID NO: 3502231 - RNA, 13 nt, Human
aucuauucugugu

SEQ ID NO: 3502232 - RNA, 16 nt, Human
aucuauuggguucauu

SEQ ID NO: 3502233 - RNA, 15 nt, Human
aucuauuguaagaua

SEQ ID NO: 3502234 - RNA, 14 nt, Human
aucuauuuauugga

SEQ ID NO: 3502235 - RNA, 15 nt, Human
aucuauuucugagaa

SEQ ID NO: 3502236 - RNA, 20 nt, Human
aucuauuuguauauauacau

SEQ ID NO: 3502237 - RNA, 18 nt, Human
aucuauuuucuauguacu

SEQ ID NO: 3502238 - RNA, 20 nt, Human
aucuauuuucuauguacuag

SEQ ID NO: 3502239 - RNA, 16 nt, Human
aucuauuuugaugcag

SEQ ID NO: 3502240 - RNA, 14 nt, Human
aucuauuuuggauu

SEQ ID NO: 3502241 - RNA, 21 nt, Human
caaguuguuugagaaauuaag

SEQ ID NO: 3502242 - RNA, 22 nt, Human
caaguuuaucaguaaauaacug

SEQ ID NO: 3502243 - RNA, 16 nt, Human
caaguuucauccagaa

SEQ ID NO: 3502244 - RNA, 16 nt, Human
caaguuuccauagcaa

SEQ ID NO: 3502245 - RNA, 17 nt, Human
caaguuuccauagcaac

SEQ ID NO: 3502246 - RNA, 20 nt, Human
caaguuuccauagcaacagg

SEQ ID NO: 3502247 - RNA, 22 nt, Human
caaguuucuagcuagaaauaug

SEQ ID NO: 3502248 - RNA, 17 nt, Human
caaguuuguaucaggug

SEQ ID NO: 3502249 - RNA, 18 nt, Human
caaguuuucccugaaguu

SEQ ID NO: 3502250 - RNA, 22 nt, Human
caaguuuugugaaauuuuucau

SEQ ID NO: 3502251 - RNA, 13 nt, Human
caaguuuugugua

SEQ ID NO: 3502252 - RNA, 17 nt, Human
caaccccuucgcuccug

SEQ ID NO: 3502253 - RNA, 21 nt, Human
caacccgucuggcccaccagg

SEQ ID NO: 3502254 - RNA, 17 nt, Human
caacccgugccaagucc

SEQ ID NO: 3502255 - RNA, 19 nt, Human
caacccuagguucccuguu

SEQ ID NO: 3502256 - RNA, 19 nt, Human
caacccuaucuccugacag

SEQ ID NO: 3502257 - RNA, 13 nt, Human
caacccucagagc

SEQ ID NO: 3502258 - RNA, 13 nt, Human
caacccucagggc

SEQ ID NO: 3502259 - RNA, 21 nt, Human
caacccucccucagccccucu

SEQ ID NO: 3502260 - RNA, 22 nt, Human
caacccucccucagccccucuu

SEQ ID NO: 3502261 - RNA, 15 nt, Human
caacccuccuaucac

SEQ ID NO: 3502262 - RNA, 19 nt, Human
caacccuccuaucaccucc

SEQ ID NO: 3502263 - RNA, 14 nt, Human
caacccugccccug

SEQ ID NO: 3502264 - RNA, 15 nt, Human
caacccugccccugc

SEQ ID NO: 3502265 - RNA, 13 nt, Human
caacccuggagag

SEQ ID NO: 3502266 - RNA, 17 nt, Human
caacccuggcacccagg

SEQ ID NO: 3502267 - RNA, 16 nt, Human
caacccuggggaagga

SEQ ID NO: 3502268 - RNA, 22 nt, Human
caacccuggggaaggagccagu

SEQ ID NO: 3502269 - RNA, 23 nt, Human
caacccuggggaaggagccaguu

SEQ ID NO: 3502270 - RNA, 15 nt, Human
caacccuguuuccug

SEQ ID NO: 3502271 - RNA, 11 nt, Human
caacccuuccc

SEQ ID NO: 3502272 - RNA, 19 nt, Human
caacccuuccugaaacuuc

SEQ ID NO: 3502273 - RNA, 23 nt, Human
caacccuucuccucuuguaaaua

SEQ ID NO: 3502274 - RNA, 23 nt, Human
caaccgagagaaugcugaccuga

SEQ ID NO: 3502275 - RNA, 14 nt, Human
caaccgaugcucca

SEQ ID NO: 3502276 - RNA, 22 nt, Human
caaccgaugcuccagccaaccc

SEQ ID NO: 3502277 - RNA, 22 nt, Human
caaccgccacacacacaggagc

SEQ ID NO: 3502278 - RNA, 21 nt, Human
caaccgggaugggagccgggc

SEQ ID NO: 3502279 - RNA, 19 nt, Human
caaccggggagcccccgcc

SEQ ID NO: 3502280 - RNA, 20 nt, Human
caaccggggagcccccgccc

SEQ ID NO: 3502281 - RNA, 19 nt, Human
caaccguggcccuuccugg

SEQ ID NO: 3502282 - RNA, 23 nt, Human
caaccguggcccuuccuggacag

SEQ ID NO: 3502283 - RNA, 13 nt, Human
caaccuaaaacuc

SEQ ID NO: 3502284 - RNA, 15 nt, Human
caaccuaaaacucuu

SEQ ID NO: 3502285 - RNA, 16 nt, Human
caaccuaaccuguguc

SEQ ID NO: 3502286 - RNA, 20 nt, Human
caaccuaccaccccuuccug

SEQ ID NO: 3502287 - RNA, 20 nt, Human
caaccuccaccuccuggguu

SEQ ID NO: 3502288 - RNA, 12 nt, Human
caaccuccugug

SEQ ID NO: 3502289 - RNA, 18 nt, Human
caaccucggcuccuggac

SEQ ID NO: 3502290 - RNA, 20 nt, Human
caaccucuaccuccuggguu

SEQ ID NO: 3502291 - RNA, 13 nt, Human
caaccucucacuc

SEQ ID NO: 3502292 - RNA, 20 nt, Human
caaccucugccucccagguu

SEQ ID NO: 3502293 - RNA, 20 nt, Human
caaccucugccuccuggguu

SEQ ID NO: 3502294 - RNA, 20 nt, Human
caaccucugcuucccagguu

SEQ ID NO: 3502295 - RNA, 16 nt, Human
caaccucuuccuccug

SEQ ID NO: 3502296 - RNA, 17 nt, Human
caaccucuucuggcuca

SEQ ID NO: 3502297 - RNA, 13 nt, Human
caaccugaaccua

SEQ ID NO: 3502298 - RNA, 15 nt, Human
caaccugaccaacau

SEQ ID NO: 3502299 - RNA, 21 nt, Human
caaccugaccaacauggagaa

SEQ ID NO: 3502300 - RNA, 23 nt, Human
caaccugaccaacauggagaaac

SEQ ID NO: 3502301 - RNA, 19 nt, Human
caaccugauugugucucuu

SEQ ID NO: 3502302 - RNA, 21 nt, Human
caaccugcucuccucuugcca

SEQ ID NO: 3502303 - RNA, 20 nt, Human
caaccuggggggcaguggug

SEQ ID NO: 3502304 - RNA, 16 nt, Human
caaccuggguccaaau

SEQ ID NO: 3502305 - RNA, 16 nt, Human
caaccuguaaauuauu

SEQ ID NO: 3502306 - RNA, 15 nt, Human
caaccuguaagacug

SEQ ID NO: 3502307 - RNA, 17 nt, Human
caaccuguaauaaauau

SEQ ID NO: 3502308 - RNA, 21 nt, Human
caaccuguaauaaauaugagu

SEQ ID NO: 3502309 - RNA, 18 nt, Human
caaccuguagaguggcca

SEQ ID NO: 3502310 - RNA, 17 nt, Human
caaccuuagauguucua

SEQ ID NO: 3502311 - RNA, 19 nt, Human
caaccuucgccaccugggu

SEQ ID NO: 3502312 - RNA, 19 nt, Human
caaccuucuguggcucaca

SEQ ID NO: 3502313 - RNA, 14 nt, Human
caaccuuggcuugg

SEQ ID NO: 3502314 - RNA, 15 nt, Human
caaccuuucccucac

SEQ ID NO: 3502315 - RNA, 13 nt, Human
caacgaaaagcac

SEQ ID NO: 3502316 - RNA, 20 nt, Human
caacgaagaaaaaaaauaac

SEQ ID NO: 3502317 - RNA, 12 nt, Human
caacgaccaggg

SEQ ID NO: 3502318 - RNA, 19 nt, Human
caacgaccagggccgagga

SEQ ID NO: 3502319 - RNA, 17 nt, Human
caacgagccuuuucacc

SEQ ID NO: 3502320 - RNA, 12 nt, Human
caacgaggaagc

SEQ ID NO: 3502321 - RNA, 16 nt, Human
caacgaucacaaauga

SEQ ID NO: 3502322 - RNA, 14 nt, Human
caacgcacaggaaa

SEQ ID NO: 3502323 - RNA, 12 nt, Human
caacgcagcccu

SEQ ID NO: 3502324 - RNA, 18 nt, Human
caacgcagcccugcuuug

SEQ ID NO: 3502325 - RNA, 20 nt, Human
caacggaaagugcugucuua

SEQ ID NO: 3502326 - RNA, 14 nt, Human
caacggcaagacag

SEQ ID NO: 3502327 - RNA, 18 nt, Human
caacggcccugcagccag

SEQ ID NO: 3502328 - RNA, 23 nt, Human
caacggucuccugacuggugcug

SEQ ID NO: 3502329 - RNA, 13 nt, Human
caacguggcccag

SEQ ID NO: 3502330 - RNA, 19 nt, Human
caacguggcccagagaagc

SEQ ID NO: 3502331 - RNA, 20 nt, Human
caacguggcccagagaagcc

SEQ ID NO: 3502332 - RNA, 21 nt, Human
caacguggcccagagaagcca

SEQ ID NO: 3502333 - RNA, 23 nt, Human
caacguggcuuuuuuuuuuuccc

SEQ ID NO: 3502334 - RNA, 22 nt, Human
caacguuacucagggcuccucc

SEQ ID NO: 3502335 - RNA, 23 nt, Human
caacguuuacaccgacuagccag

SEQ ID NO: 3502336 - RNA, 22 nt, Human
caacuaaaaugugucuugcugu

SEQ ID NO: 3502337 - RNA, 18 nt, Human
caacuaaaguuguacuuu

SEQ ID NO: 3502338 - RNA, 20 nt, Human
caacuaaaguuguacuuuaa

SEQ ID NO: 3502339 - RNA, 22 nt, Human
caacuaacaagaaacucacccc

SEQ ID NO: 3502340 - RNA, 15 nt, Human
caacuacuaauagaa

SEQ ID NO: 3502341 - RNA, 19 nt, Human
caacuacuaccuguaauga

SEQ ID NO: 3502342 - RNA, 13 nt, Human
caacuacuauuca

SEQ ID NO: 3502343 - RNA, 16 nt, Human
caacuagacauucugu

SEQ ID NO: 3502344 - RNA, 21 nt, Human
caacuagugggguuuccuggc

SEQ ID NO: 3502345 - RNA, 19 nt, Human
caacuauauuaucaugcaa

SEQ ID NO: 3502346 - RNA, 19 nt, Human
caacuauccugacuucuaa

SEQ ID NO: 3502347 - RNA, 13 nt, Human
caacucaccccag

SEQ ID NO: 3502348 - RNA, 22 nt, Human
caacucacuccuuuuaaagaaa

SEQ ID NO: 3502349 - RNA, 14 nt, Human
caacucauugcauc

SEQ ID NO: 3502350 - RNA, 13 nt, Human
caacuccagcaac

SEQ ID NO: 3502351 - RNA, 17 nt, Human
caacuccaguagcuugg

SEQ ID NO: 3502352 - RNA, 19 nt, Human
caacucccugccccccagc

SEQ ID NO: 3502353 - RNA, 21 nt, Human
caacucccugccccccagccc

SEQ ID NO: 3502354 - RNA, 19 nt, Human
caacuccuaguucuagaaa

SEQ ID NO: 3502355 - RNA, 21 nt, Human
caacuccuggaagcugugucc

SEQ ID NO: 3502356 - RNA, 17 nt, Human
caacuccuuccagcuag

SEQ ID NO: 3502357 - RNA, 19 nt, Human
caacucgcuuuaggucagc

SEQ ID NO: 3502358 - RNA, 19 nt, Human
caacucguauagcaugcau

SEQ ID NO: 3502359 - RNA, 13 nt, Human
caacucuagcugg

SEQ ID NO: 3502360 - RNA, 14 nt, Human
caacucuccuccag

SEQ ID NO: 3502361 - RNA, 20 nt, Human
caacucuccuccagagucag

SEQ ID NO: 3502362 - RNA, 14 nt, Human
caacucugagccca

SEQ ID NO: 3502363 - RNA, 21 nt, Human
caacucuucccccucucccag

SEQ ID NO: 3502364 - RNA, 16 nt, Human
caacucuugauuaucc

SEQ ID NO: 3502365 - RNA, 15 nt, Human
caacucuuugagaaa

SEQ ID NO: 3502366 - RNA, 16 nt, Human
caacucuuugagaaac

SEQ ID NO: 3502367 - RNA, 22 nt, Human
caacugaaaguguuuccuucau

SEQ ID NO: 3502368 - RNA, 14 nt, Human
caacugaacaaaaa

SEQ ID NO: 3502369 - RNA, 16 nt, Human
caacugaacaaaaaaa

SEQ ID NO: 3502370 - RNA, 17 nt, Human
caacugaacaaaaaaau

SEQ ID NO: 3502371 - RNA, 18 nt, Human
caacugaauaaauaccuc

SEQ ID NO: 3502372 - RNA, 13 nt, Human
caacugacacucc

SEQ ID NO: 3502373 - RNA, 14 nt, Human
caacugacacuccc

SEQ ID NO: 3502374 - RNA, 16 nt, Human
caacugaggcagacag

SEQ ID NO: 3502375 - RNA, 21 nt, Human
caacugaggcagacagcagcu

SEQ ID NO: 3502376 - RNA, 23 nt, Human
caacugcaaagaaagugggaggu

SEQ ID NO: 3502377 - RNA, 19 nt, Human
caacugcaauaacuucuga

SEQ ID NO: 3502378 - RNA, 14 nt, Human
caacugccuacucc

SEQ ID NO: 3502379 - RNA, 23 nt, Human
caacugccucgaaacacagaaac

SEQ ID NO: 3502380 - RNA, 11 nt, Human
caacugcuccc

SEQ ID NO: 3502381 - RNA, 22 nt, Human
caacugcucccaccuccugaca

SEQ ID NO: 3502382 - RNA, 17 nt, Human
caacugcugaugcucau

SEQ ID NO: 3502383 - RNA, 13 nt, Human
caacugcugcccc

SEQ ID NO: 3502384 - RNA, 23 nt, Human
caacugggguggguggggcagug

SEQ ID NO: 3502385 - RNA, 14 nt, Human
cacuugauucauaa

SEQ ID NO: 3502386 - RNA, 13 nt, Human
cacuugcagacuc

SEQ ID NO: 3502387 - RNA, 14 nt, Human
cacuugcagacucu

SEQ ID NO: 3502388 - RNA, 24 nt, Human
cacuugcagacucuacagaggcca

SEQ ID NO: 3502389 - RNA, 12 nt, Human
cacuugcauuuc

SEQ ID NO: 3502390 - RNA, 16 nt, Human
cacuugccaaaaucca

SEQ ID NO: 3502391 - RNA, 20 nt, Human
cacuugccauuccaaaauau

SEQ ID NO: 3502392 - RNA, 18 nt, Human
cacuugccccuguuaccu

SEQ ID NO: 3502393 - RNA, 13 nt, Human
cacuugcccugcu

SEQ ID NO: 3502394 - RNA, 13 nt, Human
cacuugccucuuc

SEQ ID NO: 3502395 - RNA, 17 nt, Human
cacuuggacucuugcuc

SEQ ID NO: 3502396 - RNA, 12 nt, Human
cacuuggagcca

SEQ ID NO: 3502397 - RNA, 22 nt, Human
cacuuggaguuugcauucuuau

SEQ ID NO: 3502398 - RNA, 11 nt, Human
cacuuggccaa

SEQ ID NO: 3502399 - RNA, 16 nt, Human
cacuuggccucuggau

SEQ ID NO: 3502400 - RNA, 20 nt, Human
cacuugggggcucagcaagg

SEQ ID NO: 3502401 - RNA, 19 nt, Human
cacuuggguccaggccuac

SEQ ID NO: 3502402 - RNA, 22 nt, Human
cacuuggguccaggccuacucc

SEQ ID NO: 3502403 - RNA, 15 nt, Human
cacuugguaauugua

SEQ ID NO: 3502404 - RNA, 19 nt, Human
cacuugguaauuguacuaa

SEQ ID NO: 3502405 - RNA, 15 nt, Human
cacuuggucugugag

SEQ ID NO: 3502406 - RNA, 15 nt, Human
cacuuggugcuggga

SEQ ID NO: 3502407 - RNA, 16 nt, Human
cacuugguuggguccu

SEQ ID NO: 3502408 - RNA, 12 nt, Human
cacuuguacaaa

SEQ ID NO: 3502409 - RNA, 17 nt, Human
cacuuguagauuugauu

SEQ ID NO: 3502410 - RNA, 13 nt, Human
cacuuguauauac

SEQ ID NO: 3502411 - RNA, 21 nt, Human
cacuuguauauacgcaucuau

SEQ ID NO: 3502412 - RNA, 19 nt, Human
cacuuguauccucugguuc

SEQ ID NO: 3502413 - RNA, 18 nt, Human
cacuugucauuguuauau

SEQ ID NO: 3502414 - RNA, 20 nt, Human
cacuuguccuuagccuggac

SEQ ID NO: 3502415 - RNA, 22 nt, Human
cacuuguccuuagccuggaccu

SEQ ID NO: 3502416 - RNA, 17 nt, Human
cacuugucggcuccagu

SEQ ID NO: 3502417 - RNA, 14 nt, Human
cacuugugacuuuu

SEQ ID NO: 3502418 - RNA, 17 nt, Human
cacuugugauuauuuau

SEQ ID NO: 3502419 - RNA, 22 nt, Human
cacuugugcacccucuauccca

SEQ ID NO: 3502420 - RNA, 16 nt, Human
cacuugugcuuugcuc

SEQ ID NO: 3502421 - RNA, 18 nt, Human
cacuugugcuuugcucuu

SEQ ID NO: 3502422 - RNA, 19 nt, Human
cacuugugcuuugcucuug

SEQ ID NO: 3502423 - RNA, 22 nt, Human
cacuuguggguuuuuguuuugu

SEQ ID NO: 3502424 - RNA, 23 nt, Human
cacuugugugugggcugugagug

SEQ ID NO: 3502425 - RNA, 18 nt, Human
cacuuguguuaugaagca

SEQ ID NO: 3502426 - RNA, 22 nt, Human
cacuuguguuuugcaagccaga

SEQ ID NO: 3502427 - RNA, 12 nt, Human
cacuuuaauggg

SEQ ID NO: 3502428 - RNA, 20 nt, Human
cacuuuaauuaccaaccugu

SEQ ID NO: 3502429 - RNA, 20 nt, Human
cacuuuaauucucaugugau

SEQ ID NO: 3502430 - RNA, 22 nt, Human
cacuuuacacaauagaauuaua

SEQ ID NO: 3502431 - RNA, 17 nt, Human
cacuuuacccaccuaga

SEQ ID NO: 3502432 - RNA, 18 nt, Human
cacuuuagaauaugccuu

SEQ ID NO: 3502433 - RNA, 21 nt, Human
cacuuuagaugcugaugauuu

SEQ ID NO: 3502434 - RNA, 18 nt, Human
cacuuuauaagucauugu

SEQ ID NO: 3502435 - RNA, 20 nt, Human
cacuuuauaagucauuguau

SEQ ID NO: 3502436 - RNA, 17 nt, Human
cacuuuauuuacuucgu

SEQ ID NO: 3502437 - RNA, 11 nt, Human
cacuuucagcu

SEQ ID NO: 3502438 - RNA, 16 nt, Human
cacuuucagcugucuu

SEQ ID NO: 3502439 - RNA, 20 nt, Human
cacuuucauugccagugucu

SEQ ID NO: 3502440 - RNA, 22 nt, Human
cacuuucauugccagugucuuu

SEQ ID NO: 3502441 - RNA, 14 nt, Human
cacuuucauuuuug

SEQ ID NO: 3502442 - RNA, 19 nt, Human
cacuuuccacuucuuccuu

SEQ ID NO: 3502443 - RNA, 13 nt, Human
cacuuucccaccc

SEQ ID NO: 3502444 - RNA, 15 nt, Human
cacuuuccuccuggc

SEQ ID NO: 3502445 - RNA, 17 nt, Human
cacuuucuagccagagg

SEQ ID NO: 3502446 - RNA, 23 nt, Human
cacuuucuuuuuuuucuauuuca

SEQ ID NO: 3502447 - RNA, 22 nt, Human
cacuuugaaauaccucauguuu

SEQ ID NO: 3502448 - RNA, 17 nt, Human
cacuuugaaauguguuu

SEQ ID NO: 3502449 - RNA, 20 nt, Human
cacuuugaaauguguuucug

SEQ ID NO: 3502450 - RNA, 18 nt, Human
cacuuugagccugggaaa

SEQ ID NO: 3502451 - RNA, 13 nt, Human
cacuuugauguca

SEQ ID NO: 3502452 - RNA, 14 nt, Human
cacuuugcacagcu

SEQ ID NO: 3502453 - RNA, 20 nt, Human
cacuuugcacgacgcccucu

SEQ ID NO: 3502454 - RNA, 16 nt, Human
cacuuugccuccugug

SEQ ID NO: 3502455 - RNA, 17 nt, Human
cacuuugccuccugugu

SEQ ID NO: 3502456 - RNA, 12 nt, Human
cacuuugcucug

SEQ ID NO: 3502457 - RNA, 13 nt, Human
cacuuugcucugg

SEQ ID NO: 3502458 - RNA, 12 nt, Human
cacuuugcuuua

SEQ ID NO: 3502459 - RNA, 17 nt, Human
cacuuugcuuuaauaua

SEQ ID NO: 3502460 - RNA, 18 nt, Human
cacuuugcuuuaauauaa

SEQ ID NO: 3502461 - RNA, 12 nt, Human
cacuuugggagg

SEQ ID NO: 3502462 - RNA, 16 nt, Human
cacuuugggaggccaa

SEQ ID NO: 3502463 - RNA, 19 nt, Human
cacuuugggaggccaagga

SEQ ID NO: 3502464 - RNA, 13 nt, Human
cacuuuguaaauu

SEQ ID NO: 3502465 - RNA, 16 nt, Human
cacuuuguucuggcuc

SEQ ID NO: 3502466 - RNA, 23 nt, Human
cacuuuguucuggcucuuccagg

SEQ ID NO: 3502467 - RNA, 20 nt, Human
aaaaucaacuuuuuauugcc

SEQ ID NO: 3502468 - RNA, 23 nt, Human
aaaaucaacuuuuuauugccuuc

SEQ ID NO: 3502469 - RNA, 18 nt, Human
aaaaucaauaugcagaau

SEQ ID NO: 3502470 - RNA, 23 nt, Human
aaaaucacacuguaaauaugaau

SEQ ID NO: 3502471 - RNA, 16 nt, Human
aaaaucacuaacauua

SEQ ID NO: 3502472 - RNA, 20 nt, Human
aaaaucacuuucauaaucuu

SEQ ID NO: 3502473 - RNA, 19 nt, Human
aaaaucagccaauuauguu

SEQ ID NO: 3502474 - RNA, 21 nt, Human
aaaaucagccaauuauguuaa

SEQ ID NO: 3502475 - RNA, 24 nt, Human
aaaaucagccaauuauguuaaacu

SEQ ID NO: 3502476 - RNA, 13 nt, Human
aaaaucagccugc

SEQ ID NO: 3502477 - RNA, 17 nt, Human
aaaaucagccugcucca

SEQ ID NO: 3502478 - RNA, 19 nt, Human
aaaaucagguauuaaucuu

SEQ ID NO: 3502479 - RNA, 21 nt, Human
aaaaucagguggcuuuugcgg

SEQ ID NO: 3502480 - RNA, 14 nt, Human
aaaaucauauugcu

SEQ ID NO: 3502481 - RNA, 23 nt, Human
aaaaucaucaagaagggcugcau

SEQ ID NO: 3502482 - RNA, 13 nt, Human
aaaaucaucagaa

SEQ ID NO: 3502483 - RNA, 15 nt, Human
aaaaucaucagaaag

SEQ ID NO: 3502484 - RNA, 16 nt, Human
aaaaucaucuauuuug

SEQ ID NO: 3502485 - RNA, 19 nt, Human
aaaaucaucuauuuugaug

SEQ ID NO: 3502486 - RNA, 17 nt, Human
aaaaucaugccaguauu

SEQ ID NO: 3502487 - RNA, 22 nt, Human
aaaaucauggaaugguuauaaa

SEQ ID NO: 3502488 - RNA, 22 nt, Human
aaaaucauugauugucagcuac

SEQ ID NO: 3502489 - RNA, 10 nt, Human
aaaaucauuu

SEQ ID NO: 3502490 - RNA, 21 nt, Human
aaaaucauuucugcaucagcu

SEQ ID NO: 3502491 - RNA, 20 nt, Human
aaaaucauuuuauaugucaa

SEQ ID NO: 3502492 - RNA, 15 nt, Human
aaaauccaaaaagaa

SEQ ID NO: 3502493 - RNA, 19 nt, Human
aaaauccaaauauuguuaa

SEQ ID NO: 3502494 - RNA, 19 nt, Human
aaaauccauacauuugugu

SEQ ID NO: 3502495 - RNA, 14 nt, Human
aaaauccaugaaca

SEQ ID NO: 3502496 - RNA, 14 nt, Human
aaaauccuucuaau

SEQ ID NO: 3502497 - RNA, 23 nt, Human
aaaaucuaauauuaaaaauaugg

SEQ ID NO: 3502498 - RNA, 21 nt, Human
aaaaucuacacuccagugaga

SEQ ID NO: 3502499 - RNA, 14 nt, Human
aaaaucuauucugu

SEQ ID NO: 3502500 - RNA, 20 nt, Human
aaaaucuauuuuguaacuuu

SEQ ID NO: 3502501 - RNA, 16 nt, Human
aaaaucucaaauuucu

SEQ ID NO: 3502502 - RNA, 18 nt, Human
aaaaucucaaauuucuaa

SEQ ID NO: 3502503 - RNA, 19 nt, Human
aaaaucucaaauuucuaaa

SEQ ID NO: 3502504 - RNA, 16 nt, Human
aaaaucucaaauuugg

SEQ ID NO: 3502505 - RNA, 16 nt, Human
aaaaucucaauauuuc

SEQ ID NO: 3502506 - RNA, 17 nt, Human
aaaaucucaauauuuca

SEQ ID NO: 3502507 - RNA, 21 nt, Human
aaaaucucccauuuuggaauu

SEQ ID NO: 3502508 - RNA, 15 nt, Human
aaaaucucuccacuu

SEQ ID NO: 3502509 - RNA, 22 nt, Human
aaaaucucuccacuuucagcug

SEQ ID NO: 3502510 - RNA, 22 nt, Human
aaaaucugaagauuguuuaucu

SEQ ID NO: 3502511 - RNA, 21 nt, Human
aaaaucugagggaaauguuuu

SEQ ID NO: 3502512 - RNA, 19 nt, Human
aaaaucugcagaaggaaaa

SEQ ID NO: 3502513 - RNA, 17 nt, Human
aaaaucugcuguuaacu

SEQ ID NO: 3502514 - RNA, 20 nt, Human
aaaaucugucacguagaacu

SEQ ID NO: 3502515 - RNA, 12 nt, Human
aaaaucugucca

SEQ ID NO: 3502516 - RNA, 17 nt, Human
aaaaucuuaauacuguu

SEQ ID NO: 3502517 - RNA, 18 nt, Human
aaaaucuuaauacuguua

SEQ ID NO: 3502518 - RNA, 16 nt, Human
aaaaucuuauuaaagu

SEQ ID NO: 3502519 - RNA, 22 nt, Human
aaaaucuuauuaaaguuucaaa

SEQ ID NO: 3502520 - RNA, 15 nt, Human
aaaaucuucauggaa

SEQ ID NO: 3502521 - RNA, 18 nt, Human
aaaaucuugaucaguuaa

SEQ ID NO: 3502522 - RNA, 11 nt, Human
aaaaucuuguc

SEQ ID NO: 3502523 - RNA, 12 nt, Human
aaaaucuuguca

SEQ ID NO: 3502524 - RNA, 19 nt, Human
aaaaucuugucauguguau

SEQ ID NO: 3502525 - RNA, 19 nt, Human
aaaaucuugugcuagaaua

SEQ ID NO: 3502526 - RNA, 22 nt, Human
aaaaucuuucuuucuuagaaau

SEQ ID NO: 3502527 - RNA, 23 nt, Human
aaaaucuuucuuucuuagaaauu

SEQ ID NO: 3502528 - RNA, 12 nt, Human
aaaaugaaaaau

SEQ ID NO: 3502529 - RNA, 19 nt, Human
auuauuaaguaacuuauuu

SEQ ID NO: 3502530 - RNA, 21 nt, Human
auuauuaaguaacuuauuuau

SEQ ID NO: 3502531 - RNA, 14 nt, Human
auuauuaaugaaaa

SEQ ID NO: 3502532 - RNA, 16 nt, Human
auuauuaauuuaugca

SEQ ID NO: 3502533 - RNA, 13 nt, Human
auuauuacagugu

SEQ ID NO: 3502534 - RNA, 20 nt, Human
auuauuaccuuacagaaguu

SEQ ID NO: 3502535 - RNA, 21 nt, Human
auuauuacuguugauaauucu

SEQ ID NO: 3502536 - RNA, 13 nt, Human
auuauuacuguuu

SEQ ID NO: 3502537 - RNA, 21 nt, Human
auuauuacuuauuuuugacag

SEQ ID NO: 3502538 - RNA, 15 nt, Human
auuauuacuuuugcu

SEQ ID NO: 3502539 - RNA, 21 nt, Human
auuauuaguaagaaaacauca

SEQ ID NO: 3502540 - RNA, 22 nt, Human
auuauuaguuuacaucauuuuu

SEQ ID NO: 3502541 - RNA, 22 nt, Human
auuauuaguuuugauuuaaugu

SEQ ID NO: 3502542 - RNA, 13 nt, Human
auuauuauaaaaa

SEQ ID NO: 3502543 - RNA, 20 nt, Human
auuauuauaagcauugaaau

SEQ ID NO: 3502544 - RNA, 22 nt, Human
auuauuaucaggggagaaaaau

SEQ ID NO: 3502545 - RNA, 14 nt, Human
auuauuaucuuuaa

SEQ ID NO: 3502546 - RNA, 17 nt, Human
auuauuauuaaaaauau

SEQ ID NO: 3502547 - RNA, 16 nt, Human
auuauuauucuucaua

SEQ ID NO: 3502548 - RNA, 15 nt, Human
auuauuauuuguguu

SEQ ID NO: 3502549 - RNA, 18 nt, Human
auuauucaccauguaaaa

SEQ ID NO: 3502550 - RNA, 20 nt, Human
auuauucaccauguaaaaca

SEQ ID NO: 3502551 - RNA, 19 nt, Human
auuauucacugauuugaca

SEQ ID NO: 3502552 - RNA, 15 nt, Human
auuauucaggcuuua

SEQ ID NO: 3502553 - RNA, 15 nt, Human
auuauucaguuaaga

SEQ ID NO: 3502554 - RNA, 14 nt, Human
auuauucauuuaaa

SEQ ID NO: 3502555 - RNA, 12 nt, Human
auuauucccucu

SEQ ID NO: 3502556 - RNA, 12 nt, Human
auuauucucugc

SEQ ID NO: 3502557 - RNA, 13 nt, Human
auuauucugcagc

SEQ ID NO: 3502558 - RNA, 12 nt, Human
auuauucuugua

SEQ ID NO: 3502559 - RNA, 13 nt, Human
auuauucuuguag

SEQ ID NO: 3502560 - RNA, 12 nt, Human
auuauugaaauu

SEQ ID NO: 3502561 - RNA, 14 nt, Human
auuauugacacuga

SEQ ID NO: 3502562 - RNA, 18 nt, Human
auuauugacacugaacuu

SEQ ID NO: 3502563 - RNA, 21 nt, Human
auuauugaguuccaguugaag

SEQ ID NO: 3502564 - RNA, 15 nt, Human
auuauugauauauau

SEQ ID NO: 3502565 - RNA, 17 nt, Human
auuauugauguuuucau

SEQ ID NO: 3502566 - RNA, 12 nt, Human
auuauugcauua

SEQ ID NO: 3502567 - RNA, 13 nt, Human
auuauugcuguug

SEQ ID NO: 3502568 - RNA, 15 nt, Human
auuauugcuguugcu

SEQ ID NO: 3502569 - RNA, 11 nt, Human
auuauugcuua

SEQ ID NO: 3502570 - RNA, 20 nt, Human
auuauuggaauauaauuguu

SEQ ID NO: 3502571 - RNA, 13 nt, Human
auuauuguauuua

SEQ ID NO: 3502572 - RNA, 19 nt, Human
auuauuguuuauauuuuca

SEQ ID NO: 3502573 - RNA, 14 nt, Human
auuauuuaagacua

SEQ ID NO: 3502574 - RNA, 13 nt, Human
auuauuuaauaaa

SEQ ID NO: 3502575 - RNA, 13 nt, Human
auuauuuaauaac

SEQ ID NO: 3502576 - RNA, 14 nt, Human
auuauuuaauaaca

SEQ ID NO: 3502577 - RNA, 21 nt, Human
auuauuuaauaacauuaccuu

SEQ ID NO: 3502578 - RNA, 12 nt, Human
auuauuuauaau

SEQ ID NO: 3502579 - RNA, 13 nt, Human
auuauuuauaugg

SEQ ID NO: 3502580 - RNA, 22 nt, Human
auuauuuauauggggaauauau

SEQ ID NO: 3502581 - RNA, 12 nt, Human
auuauuuaugua

SEQ ID NO: 3502582 - RNA, 13 nt, Human
auuauuuauguau

SEQ ID NO: 3502583 - RNA, 14 nt, Human
auuauuuauguaug

SEQ ID NO: 3502584 - RNA, 23 nt, Human
auuauuuauuaaaugcccagccc

SEQ ID NO: 3502585 - RNA, 16 nt, Human
auuauuucuaggaaga

SEQ ID NO: 3502586 - RNA, 15 nt, Human
auuauuucugucaca

SEQ ID NO: 3502587 - RNA, 13 nt, Human
auuauuugagaag

SEQ ID NO: 3502588 - RNA, 18 nt, Human
auuauuugauuauuuaag

SEQ ID NO: 3502589 - RNA, 19 nt, Human
auuauuugauuauuuaaga

SEQ ID NO: 3502590 - RNA, 22 nt, Human
auuauuugauuauuuaagacua

SEQ ID NO: 3502591 - RNA, 13 nt, Human
auuauuugcaguc

SEQ ID NO: 3502592 - RNA, 11 nt, Human
auuauuugcau

SEQ ID NO: 3502593 - RNA, 13 nt, Human
auuauuugcaugu

SEQ ID NO: 3502594 - RNA, 14 nt, Human
auuauuugcauguu

SEQ ID NO: 3502595 - RNA, 19 nt, Human
auuauuugcauguuauguu

SEQ ID NO: 3502596 - RNA, 18 nt, Human
auuauuuggcaguuuggu

SEQ ID NO: 3502597 - RNA, 23 nt, Human
auuauuuggcaguuugguauuug

SEQ ID NO: 3502598 - RNA, 21 nt, Human
auuauuugggagggaaaaggg

SEQ ID NO: 3502599 - RNA, 17 nt, Human
auuauuuguaagauauu

SEQ ID NO: 3502600 - RNA, 17 nt, Human
auuauuugucaaauugu

SEQ ID NO: 3502601 - RNA, 18 nt, Human
auuauuuguguaauagaa

SEQ ID NO: 3502602 - RNA, 14 nt, Human
auuauuuguuuucc

SEQ ID NO: 3502603 - RNA, 13 nt, Human
auuauuuuaaaag

SEQ ID NO: 3502604 - RNA, 14 nt, Human
auuauuuuaaaaga

SEQ ID NO: 3502605 - RNA, 13 nt, Human
auuauuuuaaaca

SEQ ID NO: 3502606 - RNA, 17 nt, Human
auuauuuuaaauuauaa

SEQ ID NO: 3502607 - RNA, 18 nt, Human
auuauuuuaaauuauaag

SEQ ID NO: 3502608 - RNA, 20 nt, Human
auuauuuuaaauuauaagga

SEQ ID NO: 3502609 - RNA, 22 nt, Human
auuauuuuaaauuauaaggacu

SEQ ID NO: 3502610 - RNA, 23 nt, Human
auuauuuuaaauuauaaggacug

SEQ ID NO: 3502611 - RNA, 16 nt, Human
auuauuuuauguugca

SEQ ID NO: 3502612 - RNA, 14 nt, Human
auuauuuuauuaug

SEQ ID NO: 3502613 - RNA, 15 nt, Human
auuauuuuauuauga

SEQ ID NO: 3502614 - RNA, 22 nt, Human
auuauuuuauuaugaaacuugu

SEQ ID NO: 3502615 - RNA, 17 nt, Human
auuauuuucauuacaau

SEQ ID NO: 3502616 - RNA, 19 nt, Human
auuauuuucauuacaaugg

SEQ ID NO: 3502617 - RNA, 22 nt, Human
auuauuuucugucagaugagaa

SEQ ID NO: 3502618 - RNA, 12 nt, Human
auuauuuugaug

SEQ ID NO: 3502619 - RNA, 13 nt, Human
auuauuuugauua

SEQ ID NO: 3502620 - RNA, 15 nt, Human
auuauuuuggaaagu

SEQ ID NO: 3502621 - RNA, 14 nt, Human
auuauuuugggguc

SEQ ID NO: 3502622 - RNA, 16 nt, Human
auuauuuuggggucuc

SEQ ID NO: 3502623 - RNA, 17 nt, Human
auuauuuuggggucucu

SEQ ID NO: 3502624 - RNA, 16 nt, Human
auuauuuuguucauac

SEQ ID NO: 3502625 - RNA, 14 nt, Human
auuauuuuuauaau

SEQ ID NO: 3502626 - RNA, 19 nt, Human
auuauuuuuccacuuuguu

SEQ ID NO: 3502627 - RNA, 22 nt, Human
auuauuuuuccacuuuguucuu

SEQ ID NO: 3502628 - RNA, 19 nt, Human
auuauuuuuucagaccgaa

SEQ ID NO: 3502629 - RNA, 21 nt, Human
cagagcuggcaucuaucuggu

SEQ ID NO: 3502630 - RNA, 13 nt, Human
cagagcuggcucu

SEQ ID NO: 3502631 - RNA, 17 nt, Human
cagagcuggcucugagc

SEQ ID NO: 3502632 - RNA, 14 nt, Human
cagagcugggaggg

SEQ ID NO: 3502633 - RNA, 12 nt, Human
cagagcuggugc

SEQ ID NO: 3502634 - RNA, 20 nt, Human
cagagcuggugcggcuggcc

SEQ ID NO: 3502635 - RNA, 19 nt, Human
cagagcuguuuauggccuc

SEQ ID NO: 3502636 - RNA, 13 nt, Human
cagagcuucccug

SEQ ID NO: 3502637 - RNA, 14 nt, Human
cagagcuucccuga

SEQ ID NO: 3502638 - RNA, 16 nt, Human
cagagcuuggacugga

SEQ ID NO: 3502639 - RNA, 14 nt, Human
cagagcuuuucaga

SEQ ID NO: 3502640 - RNA, 14 nt, Human
cagaggaaaucugu

SEQ ID NO: 3502641 - RNA, 20 nt, Human
cagaggaaggggccagaggc

SEQ ID NO: 3502642 - RNA, 16 nt, Human
cagaggaauccuggca

SEQ ID NO: 3502643 - RNA, 17 nt, Human
cagaggaauuuauaccu

SEQ ID NO: 3502644 - RNA, 17 nt, Human
cagaggacacagagaag

SEQ ID NO: 3502645 - RNA, 23 nt, Human
cagaggacaccuguacuggagag

SEQ ID NO: 3502646 - RNA, 22 nt, Human
cagaggacaguauuugugggga

SEQ ID NO: 3502647 - RNA, 16 nt, Human
cagaggaccagggccu

SEQ ID NO: 3502648 - RNA, 21 nt, Human
cagaggaccuguauuuaagca

SEQ ID NO: 3502649 - RNA, 21 nt, Human
cagaggacucccaacccuggc

SEQ ID NO: 3502650 - RNA, 20 nt, Human
cagaggagagauagccugug

SEQ ID NO: 3502651 - RNA, 22 nt, Human
cagaggagagauagccuguggc

SEQ ID NO: 3502652 - RNA, 23 nt, Human
cagaggagagauagccuguggcc

SEQ ID NO: 3502653 - RNA, 20 nt, Human
cagaggagagucccagagca

SEQ ID NO: 3502654 - RNA, 14 nt, Human
cagaggagggcagc

SEQ ID NO: 3502655 - RNA, 13 nt, Human
cagaggaggggcc

SEQ ID NO: 3502656 - RNA, 19 nt, Human
cagaggaggggccgcugcc

SEQ ID NO: 3502657 - RNA, 17 nt, Human
cagaggaugagcucuac

SEQ ID NO: 3502658 - RNA, 21 nt, Human
cagaggaugagcucuacccag

SEQ ID NO: 3502659 - RNA, 18 nt, Human
cagaggauggccaguguc

SEQ ID NO: 3502660 - RNA, 19 nt, Human
cagaggauggccagugucu

SEQ ID NO: 3502661 - RNA, 21 nt, Human
cagaggauugcugccccauca

SEQ ID NO: 3502662 - RNA, 16 nt, Human
cagaggcacagccggg

SEQ ID NO: 3502663 - RNA, 21 nt, Human
cagaggcacagccggggccug

SEQ ID NO: 3502664 - RNA, 17 nt, Human
cagaggcagaacccugg

SEQ ID NO: 3502665 - RNA, 18 nt, Human
cagaggcagaacccuggu

SEQ ID NO: 3502666 - RNA, 11 nt, Human
cagaggcagcc

SEQ ID NO: 3502667 - RNA, 12 nt, Human
cagaggcagccc

SEQ ID NO: 3502668 - RNA, 17 nt, Human
cagaggcaguaccuggg

SEQ ID NO: 3502669 - RNA, 18 nt, Human
cagaggccaacacugugg

SEQ ID NO: 3502670 - RNA, 20 nt, Human
cagaggccagaggcccccag

SEQ ID NO: 3502671 - RNA, 16 nt, Human
cagaggccaugggccu

SEQ ID NO: 3502672 - RNA, 19 nt, Human
cagaggccaugggccuccu

SEQ ID NO: 3502673 - RNA, 11 nt, Human
cagaggcccca

SEQ ID NO: 3502674 - RNA, 22 nt, Human
cagaggcccccagcccagggcu

SEQ ID NO: 3502675 - RNA, 20 nt, Human
cagaagcacugggaucacag

SEQ ID NO: 3502676 - RNA, 14 nt, Human
cagaagcaggauag

SEQ ID NO: 3502677 - RNA, 13 nt, Human
cagaagcauuugu

SEQ ID NO: 3502678 - RNA, 21 nt, Human
cagaagcauuuguauuuugug

SEQ ID NO: 3502679 - RNA, 12 nt, Human
cagaagcccaga

SEQ ID NO: 3502680 - RNA, 16 nt, Human
cagaagccuauuguaa

SEQ ID NO: 3502681 - RNA, 18 nt, Human
cagaagccuccccagcuc

SEQ ID NO: 3502682 - RNA, 22 nt, Human
cagaagccuccccagcucaccc

SEQ ID NO: 3502683 - RNA, 14 nt, Human
cagaagccucuggc

SEQ ID NO: 3502684 - RNA, 19 nt, Human
cagaagccugaggcuggga

SEQ ID NO: 3502685 - RNA, 18 nt, Human
cagaagccugaugcugac

SEQ ID NO: 3502686 - RNA, 19 nt, Human
cagaagccugggggccugg

SEQ ID NO: 3502687 - RNA, 16 nt, Human
cagaagcucccccagc

SEQ ID NO: 3502688 - RNA, 19 nt, Human
cagaagcucccccagcaaa

SEQ ID NO: 3502689 - RNA, 23 nt, Human
cagaagcucccccagcaaagccc

SEQ ID NO: 3502690 - RNA, 15 nt, Human
cagaagcucucgaug

SEQ ID NO: 3502691 - RNA, 19 nt, Human
cagaagcugagcaccaggg

SEQ ID NO: 3502692 - RNA, 12 nt, Human
cagaagcuucca

SEQ ID NO: 3502693 - RNA, 18 nt, Human
cagaaggaagacuucauc

SEQ ID NO: 3502694 - RNA, 11 nt, Human
cagaaggaagg

SEQ ID NO: 3502695 - RNA, 17 nt, Human
cagaaggaucuucaucu

SEQ ID NO: 3502696 - RNA, 17 nt, Human
cagaaggaugaaugagg

SEQ ID NO: 3502697 - RNA, 13 nt, Human
cagaaggcaggga

SEQ ID NO: 3502698 - RNA, 12 nt, Human
cagaaggcuccu

SEQ ID NO: 3502699 - RNA, 15 nt, Human
cagaaggcuccugcc

SEQ ID NO: 3502700 - RNA, 16 nt, Human
cagaaggcuccugccc

SEQ ID NO: 3502701 - RNA, 12 nt, Human
cagaaggcucuu

SEQ ID NO: 3502702 - RNA, 16 nt, Human
cagaagggaaacaguc

SEQ ID NO: 3502703 - RNA, 10 nt, Human
cagaagggag

SEQ ID NO: 3502704 - RNA, 13 nt, Human
cagaagggagcag

SEQ ID NO: 3502705 - RNA, 20 nt, Human
cagaagggagcuggcuccag

SEQ ID NO: 3502706 - RNA, 13 nt, Human
cagaagggagggc

SEQ ID NO: 3502707 - RNA, 21 nt, Human
cagaagggagggcagagcugg

SEQ ID NO: 3502708 - RNA, 16 nt, Human
cagaaggggacugcca

SEQ ID NO: 3502709 - RNA, 14 nt, Human
cagaaggggguggu

SEQ ID NO: 3502710 - RNA, 20 nt, Human
cagaaggggguggugucucc

SEQ ID NO: 3502711 - RNA, 16 nt, Human
cagaagguugugauga

SEQ ID NO: 3502712 - RNA, 15 nt, Human
cagaaguaagccuca

SEQ ID NO: 3502713 - RNA, 15 nt, Human
cagaaguaccagacu

SEQ ID NO: 3502714 - RNA, 16 nt, Human
cagaaguaccagacua

SEQ ID NO: 3502715 - RNA, 16 nt, Human
cagaaguagcuuugca

SEQ ID NO: 3502716 - RNA, 22 nt, Human
cagaaguaggggaagaauaauu

SEQ ID NO: 3502717 - RNA, 17 nt, Human
cagaagucaaggcuuag

SEQ ID NO: 3502718 - RNA, 18 nt, Human
cagaagucaaggcuuaga

SEQ ID NO: 3502719 - RNA, 19 nt, Human
cagaagucaugaagcccaa

SEQ ID NO: 3502720 - RNA, 12 nt, Human
cagaaguccugu

SEQ ID NO: 3502721 - RNA, 19 nt, Human
cagaaguccuguaugucug

SEQ ID NO: 3502722 - RNA, 20 nt, Human
cagaaguccuguaugucugu

SEQ ID NO: 3502723 - RNA, 15 nt, Human
cagaagucuccucaa

SEQ ID NO: 3502724 - RNA, 17 nt, Human
cagaagucuuucagcaa

SEQ ID NO: 3502725 - RNA, 13 nt, Human
cagaagugaaaau

SEQ ID NO: 3502726 - RNA, 20 nt, Human
cagaagugagcuuugcugcu

SEQ ID NO: 3502727 - RNA, 18 nt, Human
cagaagugcccuuccugc

SEQ ID NO: 3502728 - RNA, 20 nt, Human
cagaagugcccuuccugcug

SEQ ID NO: 3502729 - RNA, 21 nt, Human
cagaagugcccuuccugcugc

SEQ ID NO: 3502730 - RNA, 16 nt, Human
cagaaguggagcuggg

SEQ ID NO: 3502731 - RNA, 14 nt, Human
cagaaguuucugcc

SEQ ID NO: 3502732 - RNA, 19 nt, Human
cagaaguuucugccgcagc

SEQ ID NO: 3502733 - RNA, 21 nt, Human
cagaaguuucugccgcagccc

SEQ ID NO: 3502734 - RNA, 22 nt, Human
cagaaguuucugccgcagcccu

SEQ ID NO: 3502735 - RNA, 21 nt, Human
cagaauaaacuggcagcucag

SEQ ID NO: 3502736 - RNA, 13 nt, Human
cagaauaaagcaa

SEQ ID NO: 3502737 - RNA, 15 nt, Human
cagaauaaagcaauu

SEQ ID NO: 3502738 - RNA, 21 nt, Human
cagaauaaagcaauuuuccuu

SEQ ID NO: 3502739 - RNA, 22 nt, Human
cagaauaaagcaauuuuccuug

SEQ ID NO: 3502740 - RNA, 15 nt, Human
cagaauaaguuauug

SEQ ID NO: 3502741 - RNA, 17 nt, Human
cagaauaaguuauugca

SEQ ID NO: 3502742 - RNA, 19 nt, Human
cagaauaaguuauugcagu

SEQ ID NO: 3502743 - RNA, 15 nt, Human
cagaauaauguucua

SEQ ID NO: 3502744 - RNA, 14 nt, Human
cagaauacacuuaa

SEQ ID NO: 3502745 - RNA, 23 nt, Human
cagaauacaguaagcugcucuau

SEQ ID NO: 3502746 - RNA, 15 nt, Human
cagaauacauacaaa

SEQ ID NO: 3502747 - RNA, 20 nt, Human
cagaauacuagccagagcuc

SEQ ID NO: 3502748 - RNA, 15 nt, Human
cagaauagccacauu

SEQ ID NO: 3502749 - RNA, 17 nt, Human
cagaauaucacagaaaa

SEQ ID NO: 3502750 - RNA, 15 nt, Human
cagaauaucugggau

SEQ ID NO: 3502751 - RNA, 13 nt, Human
cagaauaugucag

SEQ ID NO: 3502752 - RNA, 13 nt, Human
cagaauauguuuc

SEQ ID NO: 3502753 - RNA, 20 nt, Human
cagaauauguuucaaacuuu

SEQ ID NO: 3502754 - RNA, 22 nt, Human
cagaauauuagugaccucagcu

SEQ ID NO: 3502755 - RNA, 13 nt, Human
cagaaucaaagca

SEQ ID NO: 3502756 - RNA, 20 nt, Human
cagaaucaaagcaaugcauu

SEQ ID NO: 3502757 - RNA, 23 nt, Human
cagaaucaaagcaaugcauuuug

SEQ ID NO: 3502758 - RNA, 18 nt, Human
cagaaucagcacagauaa

SEQ ID NO: 3502759 - RNA, 13 nt, Human
cagaaucccagcc

SEQ ID NO: 3502760 - RNA, 18 nt, Human
cagaaucccuuaacaguu

SEQ ID NO: 3502761 - RNA, 21 nt, Human
cagaauccuggcccucugugu

SEQ ID NO: 3502762 - RNA, 21 nt, Human
cagaaucgcuccaccuugcag

SEQ ID NO: 3502763 - RNA, 23 nt, Human
cagaaucuaacugguggacaugg

SEQ ID NO: 3502764 - RNA, 14 nt, Human
cagaaucugaaugu

SEQ ID NO: 3502765 - RNA, 18 nt, Human
cagaaucugaauguaauu

SEQ ID NO: 3502766 - RNA, 16 nt, Human
cagaaucuguaugauu

SEQ ID NO: 3502767 - RNA, 18 nt, Human
cagaaucuguaugauucu

SEQ ID NO: 3502768 - RNA, 21 nt, Human
cagaaucuuuccuuccucuca

SEQ ID NO: 3502769 - RNA, 18 nt, Human
cagaaugaggaauaauaa

SEQ ID NO: 3502770 - RNA, 17 nt, Human
cagaaugcuagcucuga

SEQ ID NO: 3502771 - RNA, 21 nt, Human
cagaaugcuagcucugagcca

SEQ ID NO: 3502772 - RNA, 16 nt, Human
cagaaugcuguacauc

SEQ ID NO: 3502773 - RNA, 15 nt, Human
cagaauggaagagag

SEQ ID NO: 3502774 - RNA, 19 nt, Human
cagaauguaagugggccca

SEQ ID NO: 3502775 - RNA, 22 nt, Human
cagaauguaagugggcccaccc

SEQ ID NO: 3502776 - RNA, 23 nt, Human
cagaauguaagugggcccacccg

SEQ ID NO: 3502777 - RNA, 14 nt, Human
cagaauguauauua

SEQ ID NO: 3502778 - RNA, 21 nt, Human
cagaaugugauaaggaaauca

SEQ ID NO: 3502779 - RNA, 17 nt, Human
cagaauguuuuuaaaau

SEQ ID NO: 3502780 - RNA, 23 nt, Human
cagaauuaaacuuuuaauucauu

SEQ ID NO: 3502781 - RNA, 22 nt, Human
cagaauuacuguaacugauuac

SEQ ID NO: 3502782 - RNA, 23 nt, Human
cagaauuacuguaacugauuaca

SEQ ID NO: 3502783 - RNA, 15 nt, Human
cagaauuccuuuucu

SEQ ID NO: 3502784 - RNA, 18 nt, Human
auuauuuuuuuaaaauuu

SEQ ID NO: 3502785 - RNA, 22 nt, Human
auuauuuuuuuaaaauuuugua

SEQ ID NO: 3502786 - RNA, 12 nt, Human
auucaaaaaguc

SEQ ID NO: 3502787 - RNA, 14 nt, Human
auucaaaaaguguu

SEQ ID NO: 3502788 - RNA, 21 nt, Human
auucaaaaguuccaagagucu

SEQ ID NO: 3502789 - RNA, 14 nt, Human
auucaaaauauuua

SEQ ID NO: 3502790 - RNA, 21 nt, Human
auucaaaauugacauugcuuu

SEQ ID NO: 3502791 - RNA, 15 nt, Human
auucaaaccuaaguu

SEQ ID NO: 3502792 - RNA, 19 nt, Human
auucaaacuggggccucca

SEQ ID NO: 3502793 - RNA, 22 nt, Human
auucaaacuggggccuccagaa

SEQ ID NO: 3502794 - RNA, 17 nt, Human
auucaaagcucuauuaa

SEQ ID NO: 3502795 - RNA, 17 nt, Human
auucaaaguugccuaaa

SEQ ID NO: 3502796 - RNA, 20 nt, Human
auucaaaguugccuaaaucc

SEQ ID NO: 3502797 - RNA, 16 nt, Human
auucaaaugucuauaa

SEQ ID NO: 3502798 - RNA, 18 nt, Human
auucaacagcaaguguga

SEQ ID NO: 3502799 - RNA, 22 nt, Human
auucaaccacuguaaaaugaaa

SEQ ID NO: 3502800 - RNA, 13 nt, Human
auucaacuaaaaa

SEQ ID NO: 3502801 - RNA, 16 nt, Human
auucaacuuuccaaau

SEQ ID NO: 3502802 - RNA, 13 nt, Human
auucaacuuugua

SEQ ID NO: 3502803 - RNA, 15 nt, Human
auucaacuuuguaaa

SEQ ID NO: 3502804 - RNA, 22 nt, Human
auucaagaaagccagucuuaac

SEQ ID NO: 3502805 - RNA, 19 nt, Human
auucaaggaauuucuuaac

SEQ ID NO: 3502806 - RNA, 22 nt, Human
auucaaggaauuucuuaacuuc

SEQ ID NO: 3502807 - RNA, 19 nt, Human
auucaagguaaaauucuaa

SEQ ID NO: 3502808 - RNA, 20 nt, Human
auucaaguauuagggguaau

SEQ ID NO: 3502809 - RNA, 21 nt, Human
auucaaguguaaaauauuuug

SEQ ID NO: 3502810 - RNA, 21 nt, Human
auucaauaaaaaaaagaaaug

SEQ ID NO: 3502811 - RNA, 14 nt, Human
auucaauaaaguau

SEQ ID NO: 3502812 - RNA, 22 nt, Human
auucaauaaaguauuuaauuag

SEQ ID NO: 3502813 - RNA, 13 nt, Human
auucaauaaauug

SEQ ID NO: 3502814 - RNA, 13 nt, Human
auucaauauugaa

SEQ ID NO: 3502815 - RNA, 14 nt, Human
auucaauauugaau

SEQ ID NO: 3502816 - RNA, 21 nt, Human
auucaauauugaauuuuuccu

SEQ ID NO: 3502817 - RNA, 15 nt, Human
auucaauauugacau

SEQ ID NO: 3502818 - RNA, 16 nt, Human
auucaauauugacauu

SEQ ID NO: 3502819 - RNA, 20 nt, Human
cagccccaaaacucuccucu

SEQ ID NO: 3502820 - RNA, 15 nt, Human
cagccccacagccca

SEQ ID NO: 3502821 - RNA, 14 nt, Human
cagccccacccagg

SEQ ID NO: 3502822 - RNA, 15 nt, Human
cagccccacccagga

SEQ ID NO: 3502823 - RNA, 16 nt, Human
cagccccacccaggag

SEQ ID NO: 3502824 - RNA, 21 nt, Human
cagccccacccaggagggagg

SEQ ID NO: 3502825 - RNA, 14 nt, Human
cagccccaccccag

SEQ ID NO: 3502826 - RNA, 18 nt, Human
cagccccaccccagggca

SEQ ID NO: 3502827 - RNA, 20 nt, Human
cagccccaccccagggcagc

SEQ ID NO: 3502828 - RNA, 23 nt, Human
cagccccaccccagggcagccag

SEQ ID NO: 3502829 - RNA, 15 nt, Human
cagccccacccuggc

SEQ ID NO: 3502830 - RNA, 17 nt, Human
cagccccacccuggccu

SEQ ID NO: 3502831 - RNA, 14 nt, Human
cagccccacccugu

SEQ ID NO: 3502832 - RNA, 15 nt, Human
cagccccacuccucu

SEQ ID NO: 3502833 - RNA, 23 nt, Human
cagagaugucaucagagcuccuc

SEQ ID NO: 3502834 - RNA, 16 nt, Human
cagagauucccaagcc

SEQ ID NO: 3502835 - RNA, 15 nt, Human
cagagauugcuucuc

SEQ ID NO: 3502836 - RNA, 21 nt, Human
cagagauuucucauugacuuu

SEQ ID NO: 3502837 - RNA, 16 nt, Human
cagagcaaaauaauuu

SEQ ID NO: 3502838 - RNA, 18 nt, Human
cagagcaaccccuggacc

SEQ ID NO: 3502839 - RNA, 21 nt, Human
cagagcaaccccuggacccca

SEQ ID NO: 3502840 - RNA, 22 nt, Human
cagagcaaccccuggaccccag

SEQ ID NO: 3502841 - RNA, 16 nt, Human
cagagcaacgaccagg

SEQ ID NO: 3502842 - RNA, 17 nt, Human
cagagcaagaccccauc

SEQ ID NO: 3502843 - RNA, 20 nt, Human
cagagcaagacucugucuca

SEQ ID NO: 3502844 - RNA, 17 nt, Human
cagagcaagucugcagg

SEQ ID NO: 3502845 - RNA, 18 nt, Human
cagagcaccugcugucug

SEQ ID NO: 3502846 - RNA, 21 nt, Human
cagagcaccugcugucugggu

SEQ ID NO: 3502847 - RNA, 16 nt, Human
cagagcaccuuagaca

SEQ ID NO: 3502848 - RNA, 23 nt, Human
cagagcaccuuagacagucccug

SEQ ID NO: 3502849 - RNA, 20 nt, Human
cagagcaccuuugcacagga

SEQ ID NO: 3502850 - RNA, 22 nt, Human
cagagcaccuuugcacaggaug

SEQ ID NO: 3502851 - RNA, 13 nt, Human
cagagcacugcuc

SEQ ID NO: 3502852 - RNA, 12 nt, Human
cagagcagagac

SEQ ID NO: 3502853 - RNA, 13 nt, Human
cagagcagagacc

SEQ ID NO: 3502854 - RNA, 21 nt, Human
cagagcagagaccaucccuga

SEQ ID NO: 3502855 - RNA, 14 nt, Human
cagagcagaugcag

SEQ ID NO: 3502856 - RNA, 21 nt, Human
cagagcagaugcagagagcca

SEQ ID NO: 3502857 - RNA, 13 nt, Human
cagagcaggaccu

SEQ ID NO: 3502858 - RNA, 19 nt, Human
cagagcaggaccucccuuc

SEQ ID NO: 3502859 - RNA, 22 nt, Human
cagagcaggaccucccuuccga

SEQ ID NO: 3502860 - RNA, 14 nt, Human
cagagcaggacugc

SEQ ID NO: 3502861 - RNA, 17 nt, Human
cagagcaggaggccccu

SEQ ID NO: 3502862 - RNA, 18 nt, Human
cagagcaggaggccccug

SEQ ID NO: 3502863 - RNA, 20 nt, Human
cagagcagugggccuggcca

SEQ ID NO: 3502864 - RNA, 21 nt, Human
cagagcagugggccuggccag

SEQ ID NO: 3502865 - RNA, 19 nt, Human
cagagcauuacgugagcca

SEQ ID NO: 3502866 - RNA, 20 nt, Human
cagagcauuacgugagccag

SEQ ID NO: 3502867 - RNA, 20 nt, Human
cagagcauuccagucaggcu

SEQ ID NO: 3502868 - RNA, 15 nt, Human
cagagcauuuaagag

SEQ ID NO: 3502869 - RNA, 21 nt, Human
cagagcauuuccaacaccaca

SEQ ID NO: 3502870 - RNA, 12 nt, Human
cagagccacagu

SEQ ID NO: 3502871 - RNA, 14 nt, Human
cagagccaggaaga

SEQ ID NO: 3502872 - RNA, 21 nt, Human
cagagccaggaagauccccca

SEQ ID NO: 3502873 - RNA, 13 nt, Human
cagagccaggaga

SEQ ID NO: 3502874 - RNA, 18 nt, Human
cagagccaugucuucucc

SEQ ID NO: 3502875 - RNA, 21 nt, Human
cagagccaugucuucucccug

SEQ ID NO: 3502876 - RNA, 17 nt, Human
cagagcccaccuuggcu

SEQ ID NO: 3502877 - RNA, 19 nt, Human
cagagcccacuccaucugg

SEQ ID NO: 3502878 - RNA, 20 nt, Human
cagagcccagacccuggagg

SEQ ID NO: 3502879 - RNA, 11 nt, Human
cagagcccagc

SEQ ID NO: 3502880 - RNA, 19 nt, Human
cagagcccaggcucggccu

SEQ ID NO: 3502881 - RNA, 23 nt, Human
cagagcccaggcucggccugccc

SEQ ID NO: 3502882 - RNA, 16 nt, Human
cagagccccacagccc

SEQ ID NO: 3502883 - RNA, 17 nt, Human
cagagccccuccuccag

SEQ ID NO: 3502884 - RNA, 10 nt, Human
cagagcccug

SEQ ID NO: 3502885 - RNA, 23 nt, Human
cagagccggggugggguggcugc

SEQ ID NO: 3502886 - RNA, 23 nt, Human
cagagccguaaaaacugaaguuc

SEQ ID NO: 3502887 - RNA, 12 nt, Human
cagagccugcag

SEQ ID NO: 3502888 - RNA, 14 nt, Human
cagagccugcaguu

SEQ ID NO: 3502889 - RNA, 14 nt, Human
cagagccugcccca

SEQ ID NO: 3502890 - RNA, 15 nt, Human
cagagccugccccag

SEQ ID NO: 3502891 - RNA, 17 nt, Human
cagagccuggcugccca

SEQ ID NO: 3502892 - RNA, 13 nt, Human
cagagccuggggc

SEQ ID NO: 3502893 - RNA, 14 nt, Human
cagagccuggggcu

SEQ ID NO: 3502894 - RNA, 13 nt, Human
cagagccuucuca

SEQ ID NO: 3502895 - RNA, 21 nt, Human
cagagccuucucagaagcaca

SEQ ID NO: 3502896 - RNA, 19 nt, Human
cagagccuuuggaugacca

SEQ ID NO: 3502897 - RNA, 16 nt, Human
cagagcgacagagcag

SEQ ID NO: 3502898 - RNA, 15 nt, Human
cagagcgagacucca

SEQ ID NO: 3502899 - RNA, 15 nt, Human
cagagcgccccuccc

SEQ ID NO: 3502900 - RNA, 20 nt, Human
cagagcgccgugaguucuca

SEQ ID NO: 3502901 - RNA, 18 nt, Human
cagagcgcgccccuagcc

SEQ ID NO: 3502902 - RNA, 19 nt, Human
cagagcgcgccccuagccg

SEQ ID NO: 3502903 - RNA, 17 nt, Human
cagagcggaggcugugu

SEQ ID NO: 3502904 - RNA, 22 nt, Human
cagagcgugagcugagcaggcc

SEQ ID NO: 3502905 - RNA, 19 nt, Human
cagagcuaaacuccuuccu

SEQ ID NO: 3502906 - RNA, 20 nt, Human
cagagcuaaacuccuuccug

SEQ ID NO: 3502907 - RNA, 20 nt, Human
cagagcuaagggugggugcu

SEQ ID NO: 3502908 - RNA, 22 nt, Human
cagagcuaagggugggugcuca

SEQ ID NO: 3502909 - RNA, 16 nt, Human
cagagcuacuugggcc

SEQ ID NO: 3502910 - RNA, 19 nt, Human
cagagcucccucugcccca

SEQ ID NO: 3502911 - RNA, 13 nt, Human
cagagcuccucug

SEQ ID NO: 3502912 - RNA, 14 nt, Human
cagagcucuccagc

SEQ ID NO: 3502913 - RNA, 15 nt, Human
cagagcucuccagcu

SEQ ID NO: 3502914 - RNA, 12 nt, Human
cagagcugaaga

SEQ ID NO: 3502915 - RNA, 16 nt, Human
cagagcugaagaguug

SEQ ID NO: 3502916 - RNA, 14 nt, Human
cagagcugacacag

SEQ ID NO: 3502917 - RNA, 19 nt, Human
cagagcugauggagaagga

SEQ ID NO: 3502918 - RNA, 22 nt, Human
cagagcugauggagaaggaagg

SEQ ID NO: 3502919 - RNA, 18 nt, Human
cagagcugccaccugccu

SEQ ID NO: 3502920 - RNA, 13 nt, Human
cagagcugccagu

SEQ ID NO: 3502921 - RNA, 9 nt, Human
cagagcugg

SEQ ID NO: 3502922 - RNA, 23 nt, Human
cagagcuggaccaguggugccuu

SEQ ID NO: 3502923 - RNA, 17 nt, Human
cagagcuggagaugagg

SEQ ID NO: 3502924 - RNA, 22 nt, Human
cagagcuggagaugaggccaga

SEQ ID NO: 3502925 - RNA, 13 nt, Human
cagagcuggguga

SEQ ID NO: 3502926 - RNA, 18 nt, Human
cagagcuggugcggcugg

SEQ ID NO: 3502927 - RNA, 19 nt, Human
cagagcuggugcggcuggc

SEQ ID NO: 3502928 - RNA, 21 nt, Human
cagagcuggugcggcuggcca

SEQ ID NO: 3502929 - RNA, 22 nt, Human
cagagcuggugcggcuggccau

SEQ ID NO: 3502930 - RNA, 23 nt, Human
cagagcuggugcggcuggccaug

SEQ ID NO: 3502931 - RNA, 18 nt, Human
cagagcugguggacccag

SEQ ID NO: 3502932 - RNA, 22 nt, Human
cagagcuguggacuuuguucac

SEQ ID NO: 3502933 - RNA, 20 nt, Human
cagagcuguuuauggccuca

SEQ ID NO: 3502934 - RNA, 18 nt, Human
cagagcuucccugacuca

SEQ ID NO: 3502935 - RNA, 23 nt, Human
cagagcuucuuccaggugcccag

SEQ ID NO: 3502936 - RNA, 15 nt, Human
cagagcuuggacugg

SEQ ID NO: 3502937 - RNA, 17 nt, Human
cagaggaaagcaaagga

SEQ ID NO: 3502938 - RNA, 18 nt, Human
cagaggaaaucuguaaca

SEQ ID NO: 3502939 - RNA, 19 nt, Human
cagaggaacuguccagaga

SEQ ID NO: 3502940 - RNA, 21 nt, Human
cagaggaacuguccagagagc

SEQ ID NO: 3502941 - RNA, 22 nt, Human
cagaggaacuguccagagagca

SEQ ID NO: 3502942 - RNA, 13 nt, Human
cagaggaaggaga

SEQ ID NO: 3502943 - RNA, 19 nt, Human
cagaggaaggggccagagg

SEQ ID NO: 3502944 - RNA, 21 nt, Human
cagaggaaggggccagaggcu

SEQ ID NO: 3502945 - RNA, 18 nt, Human
cagaggaaucacucuugu

SEQ ID NO: 3502946 - RNA, 23 nt, Human
cagaggaaucacucuuguggaug

SEQ ID NO: 3502947 - RNA, 17 nt, Human
cagaggaauccuggcag

SEQ ID NO: 3502948 - RNA, 20 nt, Human
cagaggaauccuggcagccc

SEQ ID NO: 3502949 - RNA, 21 nt, Human
cagaggaauccuggcagccca

SEQ ID NO: 3502950 - RNA, 23 nt, Human
cagaggaauccuggcagcccaga

SEQ ID NO: 3502951 - RNA, 15 nt, Human
cagaggacacagaga

SEQ ID NO: 3502952 - RNA, 13 nt, Human
cagaggacagauc

SEQ ID NO: 3502953 - RNA, 23 nt, Human
cagaggacagaucaauggcgcag

SEQ ID NO: 3502954 - RNA, 16 nt, Human
cagaggaccagcacac

SEQ ID NO: 3502955 - RNA, 15 nt, Human
cagaggaccagggcc

SEQ ID NO: 3502956 - RNA, 20 nt, Human
cagaggaccuguauuuaagc

SEQ ID NO: 3502957 - RNA, 22 nt, Human
cagaggaccuguauuuaagcaa

SEQ ID NO: 3502958 - RNA, 22 nt, Human
cagaggacucacuugcccacac

SEQ ID NO: 3502959 - RNA, 19 nt, Human
cagaggacucccaacccug

SEQ ID NO: 3502960 - RNA, 21 nt, Human
cagaggacugugaugcccugc

SEQ ID NO: 3502961 - RNA, 21 nt, Human
cagaggagaacuugcugccuc

SEQ ID NO: 3502962 - RNA, 18 nt, Human
cagccgagccgggccugg

SEQ ID NO: 3502963 - RNA, 19 nt, Human
cagccgauucaccugagca

SEQ ID NO: 3502964 - RNA, 16 nt, Human
cagccgcagccucccu

SEQ ID NO: 3502965 - RNA, 19 nt, Human
cagccgcagccucccucug

SEQ ID NO: 3502966 - RNA, 17 nt, Human
cagccgccauugccacc

SEQ ID NO: 3502967 - RNA, 18 nt, Human
cagccgccauugccacca

SEQ ID NO: 3502968 - RNA, 21 nt, Human
cagccgccauugccaccagga

SEQ ID NO: 3502969 - RNA, 23 nt, Human
cagccgccauugccaccaggaga

SEQ ID NO: 3502970 - RNA, 13 nt, Human
cagccgccuucac

SEQ ID NO: 3502971 - RNA, 18 nt, Human
cagccgccuucacagcag

SEQ ID NO: 3502972 - RNA, 20 nt, Human
cagccgccuucacagcaguc

SEQ ID NO: 3502973 - RNA, 14 nt, Human
cagccgccuuccuu

SEQ ID NO: 3502974 - RNA, 15 nt, Human
cagccgccuuccuug

SEQ ID NO: 3502975 - RNA, 18 nt, Human
cagccgccuuccuugacc

SEQ ID NO: 3502976 - RNA, 23 nt, Human
cagccgccuuccuugaccuuccu

SEQ ID NO: 3502977 - RNA, 17 nt, Human
cagccgcgcaucagacu

SEQ ID NO: 3502978 - RNA, 13 nt, Human
cagccgcuccaga

SEQ ID NO: 3502979 - RNA, 14 nt, Human
cagccgcuccagag

SEQ ID NO: 3502980 - RNA, 18 nt, Human
cagccgcuccagagucag

SEQ ID NO: 3502981 - RNA, 17 nt, Human
cagccgcuccugucugc

SEQ ID NO: 3502982 - RNA, 18 nt, Human
cagccgcuccugucugcc

SEQ ID NO: 3502983 - RNA, 20 nt, Human
cagccgcuccugucugccag

SEQ ID NO: 3502984 - RNA, 23 nt, Human
cagccgcucggaggccccaaagg

SEQ ID NO: 3502985 - RNA, 16 nt, Human
cagccgcucuccugcc

SEQ ID NO: 3502986 - RNA, 20 nt, Human
cagccgcugagcgaggagau

SEQ ID NO: 3502987 - RNA, 16 nt, Human
cagccgcugcccggcg

SEQ ID NO: 3502988 - RNA, 18 nt, Human
cagccgcuucugacugcu

SEQ ID NO: 3502989 - RNA, 11 nt, Human
cagccgcuugg

SEQ ID NO: 3502990 - RNA, 23 nt, Human
cagccgcuuggcgaugccagcca

SEQ ID NO: 3502991 - RNA, 16 nt, Human
auugacaaaauguuau

SEQ ID NO: 3502992 - RNA, 17 nt, Human
auugacaaaauguuauu

SEQ ID NO: 3502993 - RNA, 22 nt, Human
auugacaaaauguuauuucccu

SEQ ID NO: 3502994 - RNA, 14 nt, Human
auugacaaacucuc

SEQ ID NO: 3502995 - RNA, 13 nt, Human
auugacaaaucug

SEQ ID NO: 3502996 - RNA, 18 nt, Human
auugacaaaucuguguau

SEQ ID NO: 3502997 - RNA, 21 nt, Human
auugacaaaucuguguauauu

SEQ ID NO: 3502998 - RNA, 17 nt, Human
auugacaacaguuacau

SEQ ID NO: 3502999 - RNA, 19 nt, Human
auugacaaccgagaagguu

SEQ ID NO: 3503000 - RNA, 14 nt, Human
auugacaaguuuaa

SEQ ID NO: 3503001 - RNA, 16 nt, Human
auugacaauaaaauau

SEQ ID NO: 3503002 - RNA, 17 nt, Human
auugacaauaaaauauu

SEQ ID NO: 3503003 - RNA, 19 nt, Human
auugacacauccgccuuuu

SEQ ID NO: 3503004 - RNA, 14 nt, Human
auugacacugaacu

SEQ ID NO: 3503005 - RNA, 15 nt, Human
auugacacugaacuu

SEQ ID NO: 3503006 - RNA, 15 nt, Human
auugacacuuaaaaa

SEQ ID NO: 3503007 - RNA, 17 nt, Human
auugacacuuaaaaaug

SEQ ID NO: 3503008 - RNA, 13 nt, Human
auugacagaagcu

SEQ ID NO: 3503009 - RNA, 21 nt, Human
auugacagaucaagcugugag

SEQ ID NO: 3503010 - RNA, 18 nt, Human
auugacaggauuauugga

SEQ ID NO: 3503011 - RNA, 20 nt, Human
auugacaguaacuugguuau

SEQ ID NO: 3503012 - RNA, 18 nt, Human
auugacaucagcaucacc

SEQ ID NO: 3503013 - RNA, 14 nt, Human
auugacauguacag

SEQ ID NO: 3503014 - RNA, 17 nt, Human
auugacauguacagaga

SEQ ID NO: 3503015 - RNA, 23 nt, Human
auugacauguacagagaacuaac

SEQ ID NO: 3503016 - RNA, 22 nt, Human
auugacauugaaaucuaggaaa

SEQ ID NO: 3503017 - RNA, 21 nt, Human
auugacauugcuuuacuguca

SEQ ID NO: 3503018 - RNA, 21 nt, Human
auugacccacaagaaaugaaa

SEQ ID NO: 3503019 - RNA, 17 nt, Human
auugaccgcgacuaauu

SEQ ID NO: 3503020 - RNA, 23 nt, Human
auugaccgcgacuaauuucaaaa

SEQ ID NO: 3503021 - RNA, 17 nt, Human
auugaccugaggcccuu

SEQ ID NO: 3503022 - RNA, 21 nt, Human
auugacgacaagugcugaaca

SEQ ID NO: 3503023 - RNA, 15 nt, Human
auugacgguuuuuua

SEQ ID NO: 3503024 - RNA, 15 nt, Human
auugacgucuagcua

SEQ ID NO: 3503025 - RNA, 22 nt, Human
auugacucaaaucuccaguauu

SEQ ID NO: 3503026 - RNA, 23 nt, Human
auugacucuggguccuuccugaa

SEQ ID NO: 3503027 - RNA, 16 nt, Human
auugacucuugaguug

SEQ ID NO: 3503028 - RNA, 16 nt, Human
auugacuucgacugug

SEQ ID NO: 3503029 - RNA, 14 nt, Human
auugacuuguauau

SEQ ID NO: 3503030 - RNA, 19 nt, Human
auugacuuucaguaaacau

SEQ ID NO: 3503031 - RNA, 16 nt, Human
auugagaaagaaacua

SEQ ID NO: 3503032 - RNA, 12 nt, Human
auugagaaagag

SEQ ID NO: 3503033 - RNA, 19 nt, Human
auugagaagcguauguuuu

SEQ ID NO: 3503034 - RNA, 16 nt, Human
auugagaaggagagaa

SEQ ID NO: 3503035 - RNA, 17 nt, Human
auugagaaggagagaaa

SEQ ID NO: 3503036 - RNA, 21 nt, Human
auugagaauuuuaaauuauaa

SEQ ID NO: 3503037 - RNA, 18 nt, Human
auugagacaaaaauuauc

SEQ ID NO: 3503038 - RNA, 14 nt, Human
auugagacagugca

SEQ ID NO: 3503039 - RNA, 17 nt, Human
auugagaccgugaagau

SEQ ID NO: 3503040 - RNA, 19 nt, Human
auugagagagauguguaau

SEQ ID NO: 3503041 - RNA, 16 nt, Human
auugagaguuuugucu

SEQ ID NO: 3503042 - RNA, 22 nt, Human
auugagauacuuuuucuuuugu

SEQ ID NO: 3503043 - RNA, 18 nt, Human
auugagcagaauucauuc

SEQ ID NO: 3503044 - RNA, 21 nt, Human
auugagcagaauucauucaua

SEQ ID NO: 3503045 - RNA, 14 nt, Human
auugagcuugcaug

SEQ ID NO: 3503046 - RNA, 17 nt, Human
auugaggccaagaauau

SEQ ID NO: 3503047 - RNA, 21 nt, Human
auugaggccaagaauauugca

SEQ ID NO: 3503048 - RNA, 21 nt, Human
auugaggcuugguuccuuccc

SEQ ID NO: 3503049 - RNA, 17 nt, Human
auugaggggauuaauau

SEQ ID NO: 3503050 - RNA, 14 nt, Human
auugagguaaguuu

SEQ ID NO: 3503051 - RNA, 16 nt, Human
auugagguaaguuuuu

SEQ ID NO: 3503052 - RNA, 21 nt, Human
auugaguauccuuucaguguu

SEQ ID NO: 3503053 - RNA, 23 nt, Human
auugaguauuguuuaaaauguaa

SEQ ID NO: 3503054 - RNA, 15 nt, Human
auugagucaaauggu

SEQ ID NO: 3503055 - RNA, 17 nt, Human
auugaguuccaguugaa

SEQ ID NO: 3503056 - RNA, 17 nt, Human
auugaguucuuccugua

SEQ ID NO: 3503057 - RNA, 20 nt, Human
auugaguuuguagguaaaau

SEQ ID NO: 3503058 - RNA, 15 nt, Human
auugaguuuucagug

SEQ ID NO: 3503059 - RNA, 16 nt, Human
auugaguuuucagugg

SEQ ID NO: 3503060 - RNA, 21 nt, Human
auugauaagaaccuuuugagu

SEQ ID NO: 3503061 - RNA, 12 nt, Human
auugauaaguuc

SEQ ID NO: 3503062 - RNA, 15 nt, Human
auugauaaguucaua

SEQ ID NO: 3503063 - RNA, 18 nt, Human
auugauaaguucauacau

SEQ ID NO: 3503064 - RNA, 19 nt, Human
auugauaaguucauacauu

SEQ ID NO: 3503065 - RNA, 21 nt, Human
auugauaaguucauacauugu

SEQ ID NO: 3503066 - RNA, 22 nt, Human
auugauaaguucauacauugua

SEQ ID NO: 3503067 - RNA, 16 nt, Human
auugauaauugcauuc

SEQ ID NO: 3503068 - RNA, 13 nt, Human
auugauagaauaa

SEQ ID NO: 3503069 - RNA, 18 nt, Human
auugauagaguguuauca

SEQ ID NO: 3503070 - RNA, 19 nt, Human
auugauauaaauaaaacau

SEQ ID NO: 3503071 - RNA, 15 nt, Human
auugauaugaaaaau

SEQ ID NO: 3503072 - RNA, 14 nt, Human
auugauauucuaag

SEQ ID NO: 3503073 - RNA, 16 nt, Human
auugauauucuaagaa

SEQ ID NO: 3503074 - RNA, 23 nt, Human
auugauauucuaagaaauaucug

SEQ ID NO: 3503075 - RNA, 15 nt, Human
auugauauugugaac

SEQ ID NO: 3503076 - RNA, 18 nt, Human
auugauauuugugcauuu

SEQ ID NO: 3503077 - RNA, 19 nt, Human
auugaucauuuucccccca

SEQ ID NO: 3503078 - RNA, 16 nt, Human
auugauccagaaagaa

SEQ ID NO: 3503079 - RNA, 18 nt, Human
auugaugaaaagauuuaa

SEQ ID NO: 3503080 - RNA, 22 nt, Human
auugaugaaaagauuuaagcac

SEQ ID NO: 3503081 - RNA, 14 nt, Human
auugaugauccauu

SEQ ID NO: 3503082 - RNA, 18 nt, Human
auugaugggauuugguca

SEQ ID NO: 3503083 - RNA, 16 nt, Human
auugauggggaaggag

SEQ ID NO: 3503084 - RNA, 22 nt, Human
auugauguacagucugucauga

SEQ ID NO: 3503085 - RNA, 21 nt, Human
auugauguggcccuggcugcc

SEQ ID NO: 3503086 - RNA, 14 nt, Human
auugauguugaugc

SEQ ID NO: 3503087 - RNA, 18 nt, Human
auugauguugaugcaauc

SEQ ID NO: 3503088 - RNA, 13 nt, Human
auugauuccuuuu

SEQ ID NO: 3503089 - RNA, 13 nt, Human
auugauugcugug

SEQ ID NO: 3503090 - RNA, 15 nt, Human
auugauugcuguguc

SEQ ID NO: 3503091 - RNA, 15 nt, Human
auugauuguauauag

SEQ ID NO: 3503092 - RNA, 21 nt, Human
auugauuuaagcuuuccuguu

SEQ ID NO: 3503093 - RNA, 13 nt, Human
auugauuucaaga

SEQ ID NO: 3503094 - RNA, 17 nt, Human
auugauuuccuguguca

SEQ ID NO: 3503095 - RNA, 21 nt, Human
auugauuucugccuuccuugc

SEQ ID NO: 3503096 - RNA, 12 nt, Human
auugauuucuuu

SEQ ID NO: 3503097 - RNA, 15 nt, Human
auugauuugauuuuu

SEQ ID NO: 3503098 - RNA, 12 nt, Human
auugauuugcau

SEQ ID NO: 3503099 - RNA, 16 nt, Human
auugauuugcauugaa

SEQ ID NO: 3503100 - RNA, 16 nt, Human
auugauuuuaaaaugu

SEQ ID NO: 3503101 - RNA, 13 nt, Human
auugauuuugaac

SEQ ID NO: 3503102 - RNA, 16 nt, Human
auugcaaaauacauga

SEQ ID NO: 3503103 - RNA, 15 nt, Human
auugcaaaauagcau

SEQ ID NO: 3503104 - RNA, 17 nt, Human
auugcaaaucuugaaau

SEQ ID NO: 3503105 - RNA, 19 nt, Human
auugcaaaucuugaaauua

SEQ ID NO: 3503106 - RNA, 14 nt, Human
auugcaacaaaaua

SEQ ID NO: 3503107 - RNA, 14 nt, Human
cagccuggagcccu

SEQ ID NO: 3503108 - RNA, 19 nt, Human
cagccuggagcccuggaga

SEQ ID NO: 3503109 - RNA, 12 nt, Human
cagccuggaggc

SEQ ID NO: 3503110 - RNA, 13 nt, Human
cagccuggaggcc

SEQ ID NO: 3503111 - RNA, 12 nt, Human
cagccuggaugc

SEQ ID NO: 3503112 - RNA, 10 nt, Human
cagccuggca

SEQ ID NO: 3503113 - RNA, 21 nt, Human
cagccuggcacagggcagugg

SEQ ID NO: 3503114 - RNA, 18 nt, Human
cagccuggccaacauggu

SEQ ID NO: 3503115 - RNA, 15 nt, Human
cagccuggccagaca

SEQ ID NO: 3503116 - RNA, 18 nt, Human
cagccuggccagacacag

SEQ ID NO: 3503117 - RNA, 11 nt, Human
cagccuggccc

SEQ ID NO: 3503118 - RNA, 12 nt, Human
cagccuggccca

SEQ ID NO: 3503119 - RNA, 20 nt, Human
cagccuggcccaccccaccc

SEQ ID NO: 3503120 - RNA, 14 nt, Human
cagccuggcccagc

SEQ ID NO: 3503121 - RNA, 20 nt, Human
cagccuggcccagcuccccc

SEQ ID NO: 3503122 - RNA, 11 nt, Human
cagccuggccu

SEQ ID NO: 3503123 - RNA, 15 nt, Human
cagccuggccuccug

SEQ ID NO: 3503124 - RNA, 16 nt, Human
cagccuggccuccugc

SEQ ID NO: 3503125 - RNA, 23 nt, Human
cagccuggcgaaaccccaucucu

SEQ ID NO: 3503126 - RNA, 20 nt, Human
cagccuggcucccaggacac

SEQ ID NO: 3503127 - RNA, 21 nt, Human
cagccuggcucccaggacacg

SEQ ID NO: 3503128 - RNA, 15 nt, Human
cagccuggcuccccu

SEQ ID NO: 3503129 - RNA, 20 nt, Human
cagccuggcugggacuggga

SEQ ID NO: 3503130 - RNA, 16 nt, Human
cagccuggcuucugga

SEQ ID NO: 3503131 - RNA, 17 nt, Human
cagccuggcuucuggag

SEQ ID NO: 3503132 - RNA, 20 nt, Human
cagccuggcuucuggagccc

SEQ ID NO: 3503133 - RNA, 21 nt, Human
cagccuggcuucuggagcccu

SEQ ID NO: 3503134 - RNA, 11 nt, Human
cagccugggac

SEQ ID NO: 3503135 - RNA, 21 nt, Human
cagccugggauaggggcagag

SEQ ID NO: 3503136 - RNA, 21 nt, Human
cagccugggcccaucucccug

SEQ ID NO: 3503137 - RNA, 22 nt, Human
cagccugggcccaucucccugc

SEQ ID NO: 3503138 - RNA, 16 nt, Human
cagccugggccccagc

SEQ ID NO: 3503139 - RNA, 12 nt, Human
cagccugggccu

SEQ ID NO: 3503140 - RNA, 16 nt, Human
cagccugggccuaugg

SEQ ID NO: 3503141 - RNA, 18 nt, Human
cagccugggccuauggag

SEQ ID NO: 3503142 - RNA, 21 nt, Human
cagccugggccuauggagagc

SEQ ID NO: 3503143 - RNA, 22 nt, Human
cagccugggccuauggagagcc

SEQ ID NO: 3503144 - RNA, 23 nt, Human
cagccugggccuauggagagccc

SEQ ID NO: 3503145 - RNA, 11 nt, Human
cagccugggcg

SEQ ID NO: 3503146 - RNA, 15 nt, Human
cagccugggcgacag

SEQ ID NO: 3503147 - RNA, 18 nt, Human
cagccuggggcuggccuc

SEQ ID NO: 3503148 - RNA, 15 nt, Human
cagccuggggucugg

SEQ ID NO: 3503149 - RNA, 19 nt, Human
cagccuggggucuggaguu

SEQ ID NO: 3503150 - RNA, 23 nt, Human
cagccuggucgccuuccaccucu

SEQ ID NO: 3503151 - RNA, 18 nt, Human
aaacacugccuuuuuauu

SEQ ID NO: 3503152 - RNA, 14 nt, Human
aaacacugcgcuuu

SEQ ID NO: 3503153 - RNA, 21 nt, Human
aaacacugggagaaaugaaaa

SEQ ID NO: 3503154 - RNA, 13 nt, Human
aaacacuguggaa

SEQ ID NO: 3503155 - RNA, 16 nt, Human
aaacacuguucucugc

SEQ ID NO: 3503156 - RNA, 18 nt, Human
aaacacuucauugaaaau

SEQ ID NO: 3503157 - RNA, 24 nt, Human
aaacacuugcggauauucuggacu

SEQ ID NO: 3503158 - RNA, 16 nt, Human
aaacacuugugacuuu

SEQ ID NO: 3503159 - RNA, 14 nt, Human
aaacacuuucucuu

SEQ ID NO: 3503160 - RNA, 13 nt, Human
aaacacuuuuuug

SEQ ID NO: 3503161 - RNA, 19 nt, Human
aaacagaaacaaaaacacu

SEQ ID NO: 3503162 - RNA, 14 nt, Human
aaacagaaauggaa

SEQ ID NO: 3503163 - RNA, 14 nt, Human
aaacagaaauuggu

SEQ ID NO: 3503164 - RNA, 15 nt, Human
aaacagaaauuggua

SEQ ID NO: 3503165 - RNA, 22 nt, Human
aaacagacaaaaacagccucac

SEQ ID NO: 3503166 - RNA, 22 nt, Human
aaacagaccuaaugcuccuugu

SEQ ID NO: 3503167 - RNA, 13 nt, Human
aaacagacuauuu

SEQ ID NO: 3503168 - RNA, 14 nt, Human
aaacagacucaggu

SEQ ID NO: 3503169 - RNA, 15 nt, Human
aaacagagacaggcc

SEQ ID NO: 3503170 - RNA, 22 nt, Human
aaacagagacaggcccaagaga

SEQ ID NO: 3503171 - RNA, 16 nt, Human
aaacagaggaccagca

SEQ ID NO: 3503172 - RNA, 13 nt, Human
aaacagauaccau

SEQ ID NO: 3503173 - RNA, 18 nt, Human
aaacagaugugaauauuc

SEQ ID NO: 3503174 - RNA, 14 nt, Human
aaacagauuuuuac

SEQ ID NO: 3503175 - RNA, 14 nt, Human
aaacagcaaaccaa

SEQ ID NO: 3503176 - RNA, 19 nt, Human
aaacagcaaaccaagagau

SEQ ID NO: 3503177 - RNA, 23 nt, Human
aaacagcaaaccaagagauugcu

SEQ ID NO: 3503178 - RNA, 17 nt, Human
aaacagcauugcuuucu

SEQ ID NO: 3503179 - RNA, 15 nt, Human
aaacagccucacaga

SEQ ID NO: 3503180 - RNA, 17 nt, Human
aaacagcuaaugggaca

SEQ ID NO: 3503181 - RNA, 20 nt, Human
aaacagcugcauuagaaaaa

SEQ ID NO: 3503182 - RNA, 15 nt, Human
aaacagcugccuuag

SEQ ID NO: 3503183 - RNA, 22 nt, Human
aaacagcugccuuagcuucagg

SEQ ID NO: 3503184 - RNA, 16 nt, Human
aaacagcugucucuaa

SEQ ID NO: 3503185 - RNA, 22 nt, Human
aaacagcuucaugccuuuguaa

SEQ ID NO: 3503186 - RNA, 19 nt, Human
aaacagcuuucaagugccu

SEQ ID NO: 3503187 - RNA, 14 nt, Human
aaacaggaaaaaaa

SEQ ID NO: 3503188 - RNA, 15 nt, Human
aaacaggaaaaaaac

SEQ ID NO: 3503189 - RNA, 18 nt, Human
aaacaggaaaaaaacuuu

SEQ ID NO: 3503190 - RNA, 17 nt, Human
aaacaggagacaggaag

SEQ ID NO: 3503191 - RNA, 15 nt, Human
aaacaggcacuuggc

SEQ ID NO: 3503192 - RNA, 15 nt, Human
aaacaggcccagcau

SEQ ID NO: 3503193 - RNA, 17 nt, Human
aaacagggcaucuccag

SEQ ID NO: 3503194 - RNA, 22 nt, Human
aaacaggucaaugaaugaaacu

SEQ ID NO: 3503195 - RNA, 18 nt, Human
aaacagguugggauggga

SEQ ID NO: 3503196 - RNA, 17 nt, Human
aaacaguauuuauuuug

SEQ ID NO: 3503197 - RNA, 19 nt, Human
aaacaguauuuauuuugua

SEQ ID NO: 3503198 - RNA, 17 nt, Human
aaacaguguguaaacaa

SEQ ID NO: 3503199 - RNA, 13 nt, Human
aaacaguguuuug

SEQ ID NO: 3503200 - RNA, 17 nt, Human
aaacaguugcacagcau

SEQ ID NO: 3503201 - RNA, 16 nt, Human
aaacaguugguaacuu

SEQ ID NO: 3503202 - RNA, 18 nt, Human
aaacaguugguaacuuuu

SEQ ID NO: 3503203 - RNA, 19 nt, Human
aaacaguugguaacuuuug

SEQ ID NO: 3503204 - RNA, 22 nt, Human
aaacaguugguaacuuuuguga

SEQ ID NO: 3503205 - RNA, 22 nt, Human
aaacaguuuuuauuaaaacaug

SEQ ID NO: 3503206 - RNA, 14 nt, Human
aaacauaaauaaaa

SEQ ID NO: 3503207 - RNA, 16 nt, Human
aaacauaagagagccu

SEQ ID NO: 3503208 - RNA, 20 nt, Human
aaacauaaucuucugccuuc

SEQ ID NO: 3503209 - RNA, 19 nt, Human
aaacauauauaacaaugcu

SEQ ID NO: 3503210 - RNA, 19 nt, Human
aaacauauccaaguuugaa

SEQ ID NO: 3503211 - RNA, 23 nt, Human
aaacauaucucuuaucuuacgaa

SEQ ID NO: 3503212 - RNA, 14 nt, Human
aaacaucacacaca

SEQ ID NO: 3503213 - RNA, 18 nt, Human
aaacaucauuccuuuuua

SEQ ID NO: 3503214 - RNA, 20 nt, Human
aaacaucauuccuuuuuauu

SEQ ID NO: 3503215 - RNA, 17 nt, Human
aaacauccaauauuuuc

SEQ ID NO: 3503216 - RNA, 18 nt, Human
aaacauccuacaagacac

SEQ ID NO: 3503217 - RNA, 17 nt, Human
aaacauccucuuccaua

SEQ ID NO: 3503218 - RNA, 18 nt, Human
aaacauccuucaagaacu

SEQ ID NO: 3503219 - RNA, 20 nt, Human
aaacaucuauucucuccaaa

SEQ ID NO: 3503220 - RNA, 13 nt, Human
aaacaucucagag

SEQ ID NO: 3503221 - RNA, 13 nt, Human
aaacaugacacug

SEQ ID NO: 3503222 - RNA, 19 nt, Human
aaacaugacucuuuauugu

SEQ ID NO: 3503223 - RNA, 23 nt, Human
aaacaugagguucucucuacugg

SEQ ID NO: 3503224 - RNA, 16 nt, Human
aaacaugcagaacaaa

SEQ ID NO: 3503225 - RNA, 22 nt, Human
aaacaugcuacacacugcaugu

SEQ ID NO: 3503226 - RNA, 15 nt, Human
aaacaugcuguacau

SEQ ID NO: 3503227 - RNA, 22 nt, Human
aaacaugcuguacauacuuuuu

SEQ ID NO: 3503228 - RNA, 16 nt, Human
aaacauggguuuaguu

SEQ ID NO: 3503229 - RNA, 15 nt, Human
aaacaugguuacaau

SEQ ID NO: 3503230 - RNA, 13 nt, Human
aaacauguaugug

SEQ ID NO: 3503231 - RNA, 22 nt, Human
aaacaugucuccuauccugguu

SEQ ID NO: 3503232 - RNA, 20 nt, Human
aaacaugugguuacacagug

SEQ ID NO: 3503233 - RNA, 17 nt, Human
aaacauguuagaagcaa

SEQ ID NO: 3503234 - RNA, 20 nt, Human
aaacauguugccaaaauggu

SEQ ID NO: 3503235 - RNA, 17 nt, Human
aaacauuaaaaauggaa

SEQ ID NO: 3503236 - RNA, 15 nt, Human
aaacauuaaaugucu

SEQ ID NO: 3503237 - RNA, 16 nt, Human
aaacauuaaaugucuu

SEQ ID NO: 3503238 - RNA, 14 nt, Human
aaacauuaagaaaa

SEQ ID NO: 3503239 - RNA, 18 nt, Human
aaacauuaagaaaaucau

SEQ ID NO: 3503240 - RNA, 20 nt, Human
aaacauuaagauugaggccu

SEQ ID NO: 3503241 - RNA, 22 nt, Human
aaacauuaauagcagccuuucu

SEQ ID NO: 3503242 - RNA, 14 nt, Human
aaacauuaauguug

SEQ ID NO: 3503243 - RNA, 19 nt, Human
aaacauuaauguugauuuc

SEQ ID NO: 3503244 - RNA, 22 nt, Human
aaacauuaauguugauuucuag

SEQ ID NO: 3503245 - RNA, 17 nt, Human
aaacauuaguacuuuau

SEQ ID NO: 3503246 - RNA, 24 nt, Human
aaacauuaguacuuuauagaagaa

SEQ ID NO: 3503247 - RNA, 22 nt, Human
aaacauuaguucuauuucuauc

SEQ ID NO: 3503248 - RNA, 20 nt, Human
aaacauuauagauuuucaug

SEQ ID NO: 3503249 - RNA, 18 nt, Human
aaacauuauuaaguaacu

SEQ ID NO: 3503250 - RNA, 21 nt, Human
aaacauuccguuuacauuuua

SEQ ID NO: 3503251 - RNA, 15 nt, Human
caggaaggggcugga

SEQ ID NO: 3503252 - RNA, 22 nt, Human
caggaagggucaaaacauuuua

SEQ ID NO: 3503253 - RNA, 17 nt, Human
caggaaguacuggagaa

SEQ ID NO: 3503254 - RNA, 18 nt, Human
caggaaguacuggagaaa

SEQ ID NO: 3503255 - RNA, 20 nt, Human
caggaaguacuggagaaaau

SEQ ID NO: 3503256 - RNA, 15 nt, Human
caggaaguacuucca

SEQ ID NO: 3503257 - RNA, 15 nt, Human
caggaaguagcacag

SEQ ID NO: 3503258 - RNA, 18 nt, Human
caggaaguagcacaggcu

SEQ ID NO: 3503259 - RNA, 19 nt, Human
caggaauauugucauccuu

SEQ ID NO: 3503260 - RNA, 23 nt, Human
caggaaucaagagcugcccuccu

SEQ ID NO: 3503261 - RNA, 15 nt, Human
caggaaucuuaaggu

SEQ ID NO: 3503262 - RNA, 21 nt, Human
caggaaugccaaggagacauc

SEQ ID NO: 3503263 - RNA, 17 nt, Human
caggaauggagccugca

SEQ ID NO: 3503264 - RNA, 13 nt, Human
caggaaugggcug

SEQ ID NO: 3503265 - RNA, 17 nt, Human
caggaauguguggccug

SEQ ID NO: 3503266 - RNA, 19 nt, Human
caggaauguuaaagucagu

SEQ ID NO: 3503267 - RNA, 21 nt, Human
caggaauucuuggagaaaaug

SEQ ID NO: 3503268 - RNA, 15 nt, Human
caggaauuugggacc

SEQ ID NO: 3503269 - RNA, 18 nt, Human
caggacaacgaggaagcc

SEQ ID NO: 3503270 - RNA, 12 nt, Human
caggacacaggc

SEQ ID NO: 3503271 - RNA, 16 nt, Human
caggacacaggccugu

SEQ ID NO: 3503272 - RNA, 17 nt, Human
caggacacaggccugug

SEQ ID NO: 3503273 - RNA, 20 nt, Human
caggacacaggccuguguag

SEQ ID NO: 3503274 - RNA, 22 nt, Human
caggacacaggccuguguagcu

SEQ ID NO: 3503275 - RNA, 14 nt, Human
caggacaccacacc

SEQ ID NO: 3503276 - RNA, 23 nt, Human
caggacaccacacccagccucag

SEQ ID NO: 3503277 - RNA, 14 nt, Human
caggacagaugcca

SEQ ID NO: 3503278 - RNA, 17 nt, Human
caggacagaugccacac

SEQ ID NO: 3503279 - RNA, 19 nt, Human
caggacagcauggugcaug

SEQ ID NO: 3503280 - RNA, 23 nt, Human
caggacagcauggugcaugccgc

SEQ ID NO: 3503281 - RNA, 23 nt, Human
caggacagcccuucuuuccacag

SEQ ID NO: 3503282 - RNA, 24 nt, Human
caggacagcccuucuuuccacaga

SEQ ID NO: 3503283 - RNA, 12 nt, Human
caggacaggacc

SEQ ID NO: 3503284 - RNA, 13 nt, Human
caggacaggacca

SEQ ID NO: 3503285 - RNA, 22 nt, Human
caggacaggcugcggccccucc

SEQ ID NO: 3503286 - RNA, 15 nt, Human
caggacagggguucc

SEQ ID NO: 3503287 - RNA, 15 nt, Human
caggacaugcaauaa

SEQ ID NO: 3503288 - RNA, 19 nt, Human
caggacaugcaauaaaauu

SEQ ID NO: 3503289 - RNA, 21 nt, Human
caggacaugcaauaaaauuua

SEQ ID NO: 3503290 - RNA, 20 nt, Human
caggacaugcgguagccagc

SEQ ID NO: 3503291 - RNA, 23 nt, Human
caggacaugcgguagccagcaca

SEQ ID NO: 3503292 - RNA, 16 nt, Human
caggacaugcugaagc

SEQ ID NO: 3503293 - RNA, 13 nt, Human
caggaccaagcca

SEQ ID NO: 3503294 - RNA, 12 nt, Human
caggaccacagg

SEQ ID NO: 3503295 - RNA, 14 nt, Human
caggaccacaggcu

SEQ ID NO: 3503296 - RNA, 21 nt, Human
caggaccacaggcucaggcag

SEQ ID NO: 3503297 - RNA, 21 nt, Human
caggaccagcccacgcugacu

SEQ ID NO: 3503298 - RNA, 15 nt, Human
caggaccagcucagg

SEQ ID NO: 3503299 - RNA, 19 nt, Human
caggaccagcucaggacag

SEQ ID NO: 3503300 - RNA, 13 nt, Human
caggaccagcugg

SEQ ID NO: 3503301 - RNA, 18 nt, Human
caggaccaggcaauguga

SEQ ID NO: 3503302 - RNA, 22 nt, Human
caggaccaggguuggcaccuuc

SEQ ID NO: 3503303 - RNA, 21 nt, Human
caggaccagucaaccugggca

SEQ ID NO: 3503304 - RNA, 18 nt, Human
caggaccagucccagagc

SEQ ID NO: 3503305 - RNA, 20 nt, Human
caggaccagucccagagcag

SEQ ID NO: 3503306 - RNA, 15 nt, Human
caggaccccagcucu

SEQ ID NO: 3503307 - RNA, 15 nt, Human
caggacccccuuccc

SEQ ID NO: 3503308 - RNA, 15 nt, Human
caggaccccugcagu

SEQ ID NO: 3503309 - RNA, 13 nt, Human
caggaccccuggg

SEQ ID NO: 3503310 - RNA, 18 nt, Human
caggacccucgcuggccc

SEQ ID NO: 3503311 - RNA, 16 nt, Human
caggacccugccaggc

SEQ ID NO: 3503312 - RNA, 13 nt, Human
caggacccuggac

SEQ ID NO: 3503313 - RNA, 18 nt, Human
caggacccuggacccagc

SEQ ID NO: 3503314 - RNA, 21 nt, Human
caggaccuaggauaucuucuc

SEQ ID NO: 3503315 - RNA, 22 nt, Human
caggaccuaggauaucuucucc

SEQ ID NO: 3503316 - RNA, 16 nt, Human
caggaccucaggugag

SEQ ID NO: 3503317 - RNA, 19 nt, Human
caggaccuccaagccacug

SEQ ID NO: 3503318 - RNA, 20 nt, Human
caggaccuccaagccacuga

SEQ ID NO: 3503319 - RNA, 17 nt, Human
caggaccucccuuccga

SEQ ID NO: 3503320 - RNA, 19 nt, Human
caggaccucccuuccgacc

SEQ ID NO: 3503321 - RNA, 22 nt, Human
caggaccucccuuccgacccuc

SEQ ID NO: 3503322 - RNA, 14 nt, Human
caggaccuggcugc

SEQ ID NO: 3503323 - RNA, 18 nt, Human
caggaccuggcugccaua

SEQ ID NO: 3503324 - RNA, 17 nt, Human
caggaccuguggccaag

SEQ ID NO: 3503325 - RNA, 23 nt, Human
caggacgacuguuuucccaacac

SEQ ID NO: 3503326 - RNA, 18 nt, Human
caggacgccacucauuuc

SEQ ID NO: 3503327 - RNA, 19 nt, Human
caggacgccacucauuuca

SEQ ID NO: 3503328 - RNA, 21 nt, Human
caggacgccacucauuucauc

SEQ ID NO: 3503329 - RNA, 16 nt, Human
caggacggggccggcc

SEQ ID NO: 3503330 - RNA, 19 nt, Human
caggacggggccggccagg

SEQ ID NO: 3503331 - RNA, 23 nt, Human
caggacggggccggccagguggg

SEQ ID NO: 3503332 - RNA, 20 nt, Human
caggacuaacacucagaagc

SEQ ID NO: 3503333 - RNA, 21 nt, Human
caggacuaacacucagaagcc

SEQ ID NO: 3503334 - RNA, 22 nt, Human
caggacuaacacucagaagccu

SEQ ID NO: 3503335 - RNA, 23 nt, Human
caggacuaacacucagaagccug

SEQ ID NO: 3503336 - RNA, 18 nt, Human
caggacucagaagccucu

SEQ ID NO: 3503337 - RNA, 20 nt, Human
caggacucagaagccucugg

SEQ ID NO: 3503338 - RNA, 18 nt, Human
caggacucagcuccccag

SEQ ID NO: 3503339 - RNA, 20 nt, Human
caggacucagcuccccagag

SEQ ID NO: 3503340 - RNA, 17 nt, Human
caggacuccagcccauu

SEQ ID NO: 3503341 - RNA, 16 nt, Human
caggacuccaggccca

SEQ ID NO: 3503342 - RNA, 19 nt, Human
caggacuccaggcccaagg

SEQ ID NO: 3503343 - RNA, 16 nt, Human
caggacuccccaggcc

SEQ ID NO: 3503344 - RNA, 17 nt, Human
caggacuccccaggcca

SEQ ID NO: 3503345 - RNA, 13 nt, Human
caggacucccucc

SEQ ID NO: 3503346 - RNA, 17 nt, Human
auugugucuuuugcaug

SEQ ID NO: 3503347 - RNA, 19 nt, Human
auuguguggauucuuuaaa

SEQ ID NO: 3503348 - RNA, 22 nt, Human
auugugugugcagacuucagga

SEQ ID NO: 3503349 - RNA, 17 nt, Human
auuguguuauuuuacua

SEQ ID NO: 3503350 - RNA, 17 nt, Human
auuguguugacauuaag

SEQ ID NO: 3503351 - RNA, 20 nt, Human
auuguguugacauuaagaau

SEQ ID NO: 3503352 - RNA, 12 nt, Human
auuguguuuaca

SEQ ID NO: 3503353 - RNA, 14 nt, Human
auuguguuuacauu

SEQ ID NO: 3503354 - RNA, 16 nt, Human
auuguguuugucauua

SEQ ID NO: 3503355 - RNA, 21 nt, Human
auuguuaagucuaaauauuuc

SEQ ID NO: 3503356 - RNA, 16 nt, Human
auuguuaauuucaguc

SEQ ID NO: 3503357 - RNA, 18 nt, Human
auuguuaauuucaguccu

SEQ ID NO: 3503358 - RNA, 17 nt, Human
auuguuacacauuaagu

SEQ ID NO: 3503359 - RNA, 20 nt, Human
auuguuacauuauguggaaa

SEQ ID NO: 3503360 - RNA, 15 nt, Human
auuguuacuccauau

SEQ ID NO: 3503361 - RNA, 16 nt, Human
auuguuagucucuuga

SEQ ID NO: 3503362 - RNA, 15 nt, Human
auuguuaguuucuga

SEQ ID NO: 3503363 - RNA, 13 nt, Human
auuguuauuuaua

SEQ ID NO: 3503364 - RNA, 19 nt, Human
auuguucaaacaauaucau

SEQ ID NO: 3503365 - RNA, 20 nt, Human
auuguucauuuugagcugaa

SEQ ID NO: 3503366 - RNA, 16 nt, Human
auuguuccaagacauu

SEQ ID NO: 3503367 - RNA, 16 nt, Human
auuguucccagugaca

SEQ ID NO: 3503368 - RNA, 13 nt, Human
auuguuccuaagu

SEQ ID NO: 3503369 - RNA, 16 nt, Human
auuguuccuaaguucu

SEQ ID NO: 3503370 - RNA, 21 nt, Human
auuguuccuuggagaaaugaa

SEQ ID NO: 3503371 - RNA, 17 nt, Human
auuguucucagaauccc

SEQ ID NO: 3503372 - RNA, 19 nt, Human
auuguugaaaaaguuuguu

SEQ ID NO: 3503373 - RNA, 15 nt, Human
auuguugaaauuuug

SEQ ID NO: 3503374 - RNA, 16 nt, Human
auuguugaaauuuugc

SEQ ID NO: 3503375 - RNA, 17 nt, Human
auuguugaaucuauuuc

SEQ ID NO: 3503376 - RNA, 20 nt, Human
auuguugacaacugugacug

SEQ ID NO: 3503377 - RNA, 21 nt, Human
auuguugacaguucugaagaa

SEQ ID NO: 3503378 - RNA, 22 nt, Human
auuguugacaguucugaagaau

SEQ ID NO: 3503379 - RNA, 23 nt, Human
auuguugagguggucugaauguu

SEQ ID NO: 3503380 - RNA, 20 nt, Human
auuguugguaauuauuuugg

SEQ ID NO: 3503381 - RNA, 13 nt, Human
auuguuguccuuu

SEQ ID NO: 3503382 - RNA, 16 nt, Human
auuguuguccuuuuca

SEQ ID NO: 3503383 - RNA, 19 nt, Human
auuguuguuucuuucuagu

SEQ ID NO: 3503384 - RNA, 20 nt, Human
auuguuguuucuuucuagug

SEQ ID NO: 3503385 - RNA, 17 nt, Human
auuguuguuuguaugua

SEQ ID NO: 3503386 - RNA, 21 nt, Human
auuguuguuuguauguauaau

SEQ ID NO: 3503387 - RNA, 15 nt, Human
auuguuuaaaaucau

SEQ ID NO: 3503388 - RNA, 17 nt, Human
auuguuuaaaauguaau

SEQ ID NO: 3503389 - RNA, 19 nt, Human
auuguuuaucuagauguaa

SEQ ID NO: 3503390 - RNA, 22 nt, Human
auuguuuaucuagauguaaauu

SEQ ID NO: 3503391 - RNA, 17 nt, Human
auuguuuauuuaucagu

SEQ ID NO: 3503392 - RNA, 19 nt, Human
auuguuuauuuaucaguga

SEQ ID NO: 3503393 - RNA, 22 nt, Human
auuguuucauugcgaaucuuuu

SEQ ID NO: 3503394 - RNA, 21 nt, Human
cagccauaggcccuuucagug

SEQ ID NO: 3503395 - RNA, 19 nt, Human
cagccaucaccuuagacca

SEQ ID NO: 3503396 - RNA, 21 nt, Human
cagccaucaccuuagaccacc

SEQ ID NO: 3503397 - RNA, 18 nt, Human
cagccaucauaggaaggg

SEQ ID NO: 3503398 - RNA, 23 nt, Human
cagccauccagggggcaagagga

SEQ ID NO: 3503399 - RNA, 17 nt, Human
cagccaucccagccuug

SEQ ID NO: 3503400 - RNA, 19 nt, Human
cagccaucucaugagggga

SEQ ID NO: 3503401 - RNA, 13 nt, Human
cagccaucugccc

SEQ ID NO: 3503402 - RNA, 17 nt, Human
cagccaucugcccaggg

SEQ ID NO: 3503403 - RNA, 19 nt, Human
cagccaucugcccaggggu

SEQ ID NO: 3503404 - RNA, 21 nt, Human
cagccaucugcccaggggugc

SEQ ID NO: 3503405 - RNA, 18 nt, Human
cagccaugaggaguugcu

SEQ ID NO: 3503406 - RNA, 22 nt, Human
cagccaugaggaguugcuguuu

SEQ ID NO: 3503407 - RNA, 18 nt, Human
cagccaugccagcuggcc

SEQ ID NO: 3503408 - RNA, 21 nt, Human
cagccaugccagcuggccuuu

SEQ ID NO: 3503409 - RNA, 21 nt, Human
cagccaugcccgcauuagcuc

SEQ ID NO: 3503410 - RNA, 20 nt, Human
cagccauuaccauggagaca

SEQ ID NO: 3503411 - RNA, 19 nt, Human
cagccauucacugccccca

SEQ ID NO: 3503412 - RNA, 17 nt, Human
cagccauugcacccagc

SEQ ID NO: 3503413 - RNA, 22 nt, Human
cagccauuggcuauuuaaaacu

SEQ ID NO: 3503414 - RNA, 19 nt, Human
cagcccaaaccaccagaag

SEQ ID NO: 3503415 - RNA, 17 nt, Human
cagcccaaagaaggaaa

SEQ ID NO: 3503416 - RNA, 22 nt, Human
cagcccaaaggggacaggccuc

SEQ ID NO: 3503417 - RNA, 13 nt, Human
cagcccaauccag

SEQ ID NO: 3503418 - RNA, 16 nt, Human
cagcccaauccaggua

SEQ ID NO: 3503419 - RNA, 23 nt, Human
cagcccaauccagguacgcacag

SEQ ID NO: 3503420 - RNA, 16 nt, Human
cagcccaaucccugau

SEQ ID NO: 3503421 - RNA, 19 nt, Human
cagcccacauagugauggu

SEQ ID NO: 3503422 - RNA, 12 nt, Human
cagcccaccccc

SEQ ID NO: 3503423 - RNA, 17 nt, Human
cagcccacccccggcag

SEQ ID NO: 3503424 - RNA, 18 nt, Human
cagcccacccccggcagc

SEQ ID NO: 3503425 - RNA, 22 nt, Human
cagcccacccccggcagcagcc

SEQ ID NO: 3503426 - RNA, 12 nt, Human
cagcccacccuc

SEQ ID NO: 3503427 - RNA, 15 nt, Human
cagcccacccuccug

SEQ ID NO: 3503428 - RNA, 17 nt, Human
cagcccacccuccuguc

SEQ ID NO: 3503429 - RNA, 21 nt, Human
cagcccacccuccugucuucc

SEQ ID NO: 3503430 - RNA, 24 nt, Human
cagcccacccuccugucuucccag

SEQ ID NO: 3503431 - RNA, 12 nt, Human
cagcccacccug

SEQ ID NO: 3503432 - RNA, 15 nt, Human
cagcccacgcugacu

SEQ ID NO: 3503433 - RNA, 22 nt, Human
cagcccacgcugacuacagggc

SEQ ID NO: 3503434 - RNA, 20 nt, Human
cagcccacguccugucagug

SEQ ID NO: 3503435 - RNA, 18 nt, Human
cagcccacuucugccaua

SEQ ID NO: 3503436 - RNA, 20 nt, Human
cagcccagaagugcagaacu

SEQ ID NO: 3503437 - RNA, 12 nt, Human
cagcccagagac

SEQ ID NO: 3503438 - RNA, 13 nt, Human
cagcccagagaca

SEQ ID NO: 3503439 - RNA, 14 nt, Human
cagcccagagccug

SEQ ID NO: 3503440 - RNA, 15 nt, Human
cagcccagagccugg

SEQ ID NO: 3503441 - RNA, 18 nt, Human
cagcccagagccuggcug

SEQ ID NO: 3503442 - RNA, 22 nt, Human
cagcccagaggccgagagcuau

SEQ ID NO: 3503443 - RNA, 15 nt, Human
cagcccagccacgga

SEQ ID NO: 3503444 - RNA, 17 nt, Human
cagcccagcccagcugg

SEQ ID NO: 3503445 - RNA, 11 nt, Human
cagcccagcug

SEQ ID NO: 3503446 - RNA, 17 nt, Human
cagcccagcugcucugc

SEQ ID NO: 3503447 - RNA, 22 nt, Human
cagcccaggaagucucaucugg

SEQ ID NO: 3503448 - RNA, 22 nt, Human
cagcccaggauacuggcacaga

SEQ ID NO: 3503449 - RNA, 23 nt, Human
cagcccaggccgggguggagcau

SEQ ID NO: 3503450 - RNA, 13 nt, Human
cagcccaggccuc

SEQ ID NO: 3503451 - RNA, 20 nt, Human
cagcccaggccuccagcuca

SEQ ID NO: 3503452 - RNA, 16 nt, Human
cagcccagggcuccug

SEQ ID NO: 3503453 - RNA, 17 nt, Human
cagcccagggcuccugc

SEQ ID NO: 3503454 - RNA, 21 nt, Human
cagcccagggcuccugcacuu

SEQ ID NO: 3503455 - RNA, 18 nt, Human
cagcccaggguuccccca

SEQ ID NO: 3503456 - RNA, 19 nt, Human
cagcccauccauaguaacu

SEQ ID NO: 3503457 - RNA, 17 nt, Human
cagcccaucucggagca

SEQ ID NO: 3503458 - RNA, 16 nt, Human
cagcccaucuugccuc

SEQ ID NO: 3503459 - RNA, 21 nt, Human
cagcccaugcccaccugccca

SEQ ID NO: 3503460 - RNA, 22 nt, Human
cagcccauggagauugaccugg

SEQ ID NO: 3503461 - RNA, 17 nt, Human
cagcccauuucuccaga

SEQ ID NO: 3503462 - RNA, 22 nt, Human
cagcccauuugggcagagaggc

SEQ ID NO: 3503463 - RNA, 16 nt, Human
cagccccacaccaggg

SEQ ID NO: 3503464 - RNA, 23 nt, Human
cagccccacaccagggccagccu

SEQ ID NO: 3503465 - RNA, 14 nt, Human
cagccccacagccc

SEQ ID NO: 3503466 - RNA, 22 nt, Human
cagccccaccccagggcagcca

SEQ ID NO: 3503467 - RNA, 16 nt, Human
cagccccacuccucug

SEQ ID NO: 3503468 - RNA, 21 nt, Human
cagccccacuccucugcugac

SEQ ID NO: 3503469 - RNA, 12 nt, Human
cagccccacugc

SEQ ID NO: 3503470 - RNA, 14 nt, Human
cagccccacugcca

SEQ ID NO: 3503471 - RNA, 13 nt, Human
cagccccagccca

SEQ ID NO: 3503472 - RNA, 15 nt, Human
cagccccagcccagc

SEQ ID NO: 3503473 - RNA, 12 nt, Human
cagccccagccu

SEQ ID NO: 3503474 - RNA, 16 nt, Human
cagccccagccugcua

SEQ ID NO: 3503475 - RNA, 14 nt, Human
cagccccagugccc

SEQ ID NO: 3503476 - RNA, 15 nt, Human
cagccccagugccca

SEQ ID NO: 3503477 - RNA, 18 nt, Human
cagccccagugcccacag

SEQ ID NO: 3503478 - RNA, 12 nt, Human
cagccccauccu

SEQ ID NO: 3503479 - RNA, 16 nt, Human
cagccccauccucugu

SEQ ID NO: 3503480 - RNA, 17 nt, Human
cagccccaucugugcau

SEQ ID NO: 3503481 - RNA, 17 nt, Human
cagccccauucugccug

SEQ ID NO: 3503482 - RNA, 23 nt, Human
cagccccauucugccugcccagg

SEQ ID NO: 3503483 - RNA, 24 nt, Human
cagccccauucugccugcccaggc

SEQ ID NO: 3503484 - RNA, 19 nt, Human
cagcccccacagugcuguc

SEQ ID NO: 3503485 - RNA, 20 nt, Human
cagcccccacagugcugucu

SEQ ID NO: 3503486 - RNA, 21 nt, Human
cagcccccacugccuuugacc

SEQ ID NO: 3503487 - RNA, 14 nt, Human
cagcccccagcccc

SEQ ID NO: 3503488 - RNA, 15 nt, Human
cagcccccagccccu

SEQ ID NO: 3503489 - RNA, 17 nt, Human
cagcccccuaagagagc

SEQ ID NO: 3503490 - RNA, 12 nt, Human
cagcccccucac

SEQ ID NO: 3503491 - RNA, 14 nt, Human
cagcccccugacca

SEQ ID NO: 3503492 - RNA, 16 nt, Human
cagcccccugaccacu

SEQ ID NO: 3503493 - RNA, 16 nt, Human
cagcccccugcuucag

SEQ ID NO: 3503494 - RNA, 20 nt, Human
cagcccccugcuucaguccc

SEQ ID NO: 3503495 - RNA, 15 nt, Human
cagcccccuuugggc

SEQ ID NO: 3503496 - RNA, 19 nt, Human
cagcccccuuugggcccag

SEQ ID NO: 3503497 - RNA, 20 nt, Human
cagccccgacuccagccagc

SEQ ID NO: 3503498 - RNA, 18 nt, Human
cagccccgccuccaggcc

SEQ ID NO: 3503499 - RNA, 21 nt, Human
cagccccgcgaccauguggcc

SEQ ID NO: 3503500 - RNA, 18 nt, Human
auuuaacuggugcacuuu

SEQ ID NO: 3503501 - RNA, 21 nt, Human
auuuaacuggugcacuuugua

SEQ ID NO: 3503502 - RNA, 20 nt, Human
auuuaacuuaacauucugua

SEQ ID NO: 3503503 - RNA, 11 nt, Human
auuuaacuucu

SEQ ID NO: 3503504 - RNA, 19 nt, Human
auuuaacuugagcuuuaaa

SEQ ID NO: 3503505 - RNA, 23 nt, Human
auuuaacuugaggguaauaaacu

SEQ ID NO: 3503506 - RNA, 17 nt, Human
auuuaacuuguuuccaa

SEQ ID NO: 3503507 - RNA, 20 nt, Human
auuuaacuuguuuccaaugu

SEQ ID NO: 3503508 - RNA, 21 nt, Human
auuuaacuuuuaguaaaguca

SEQ ID NO: 3503509 - RNA, 23 nt, Human
auuuaacuuuuaguaaagucaag

SEQ ID NO: 3503510 - RNA, 16 nt, Human
auuuaagacacugaaa

SEQ ID NO: 3503511 - RNA, 22 nt, Human
auuuaagcaaauacuuagcaaa

SEQ ID NO: 3503512 - RNA, 12 nt, Human
auuuaagcauug

SEQ ID NO: 3503513 - RNA, 17 nt, Human
auuuaagccuaaagauu

SEQ ID NO: 3503514 - RNA, 22 nt, Human
auuuaaggagauguaagagcuu

SEQ ID NO: 3503515 - RNA, 15 nt, Human
auuuaagggaaaaau

SEQ ID NO: 3503516 - RNA, 16 nt, Human
auuuaagggaaaaaua

SEQ ID NO: 3503517 - RNA, 16 nt, Human
auuuaagggaaagaaa

SEQ ID NO: 3503518 - RNA, 22 nt, Human
auuuaaggucuguuugcuguug

SEQ ID NO: 3503519 - RNA, 15 nt, Human
auuuaaguauucaag

SEQ ID NO: 3503520 - RNA, 20 nt, Human
auuuaaguggggcaaaaccu

SEQ ID NO: 3503521 - RNA, 18 nt, Human
auuuaaguguuggaaaaa

SEQ ID NO: 3503522 - RNA, 22 nt, Human
auuuaaguguuggaaaaaauuu

SEQ ID NO: 3503523 - RNA, 16 nt, Human
auuuaauaacaauugu

SEQ ID NO: 3503524 - RNA, 13 nt, Human
auuuaauaacauu

SEQ ID NO: 3503525 - RNA, 18 nt, Human
auuuaauaacauuaccuu

SEQ ID NO: 3503526 - RNA, 19 nt, Human
auuuaauaacauuaccuua

SEQ ID NO: 3503527 - RNA, 16 nt, Human
auuuaauaauauacuu

SEQ ID NO: 3503528 - RNA, 13 nt, Human
auuuaauaauuau

SEQ ID NO: 3503529 - RNA, 15 nt, Human
auuuaauaauuauau

SEQ ID NO: 3503530 - RNA, 19 nt, Human
auuuaauaccagauaccuu

SEQ ID NO: 3503531 - RNA, 22 nt, Human
auuuaauagguuuggacaaaau

SEQ ID NO: 3503532 - RNA, 16 nt, Human
auuuaauauagcuauu

SEQ ID NO: 3503533 - RNA, 15 nt, Human
auuuaauaucuucag

SEQ ID NO: 3503534 - RNA, 13 nt, Human
auuuaauauuaca

SEQ ID NO: 3503535 - RNA, 15 nt, Human
auuuaauauuuacuc

SEQ ID NO: 3503536 - RNA, 13 nt, Human
auuuaauauuuau

SEQ ID NO: 3503537 - RNA, 14 nt, Human
auuuaaucuuuuau

SEQ ID NO: 3503538 - RNA, 19 nt, Human
auuuaugggccccuggcac

SEQ ID NO: 3503539 - RNA, 16 nt, Human
auuuauggguggauuu

SEQ ID NO: 3503540 - RNA, 19 nt, Human
auuuaugguaaucauauua

SEQ ID NO: 3503541 - RNA, 23 nt, Human
auuuauguaaacugcauuagaaa

SEQ ID NO: 3503542 - RNA, 14 nt, Human
auuuauguagaugu

SEQ ID NO: 3503543 - RNA, 21 nt, Human
auuuauguagaugugcauuuu

SEQ ID NO: 3503544 - RNA, 17 nt, Human
auuuauguauugugcaa

SEQ ID NO: 3503545 - RNA, 22 nt, Human
auuuauguauugugcaaugugu

SEQ ID NO: 3503546 - RNA, 15 nt, Human
auuuauguguauaug

SEQ ID NO: 3503547 - RNA, 13 nt, Human
auuuauguuugca

SEQ ID NO: 3503548 - RNA, 12 nt, Human
auuuauuaaaga

SEQ ID NO: 3503549 - RNA, 14 nt, Human
auuuauuaaagaaa

SEQ ID NO: 3503550 - RNA, 17 nt, Human
auuuauuaaagaaaaaa

SEQ ID NO: 3503551 - RNA, 21 nt, Human
auuuauuaaauuuuuuuguau

SEQ ID NO: 3503552 - RNA, 17 nt, Human
auuuauuaacuuaauaa

SEQ ID NO: 3503553 - RNA, 21 nt, Human
auuuauuaacuuaauaaucaa

SEQ ID NO: 3503554 - RNA, 21 nt, Human
auuuauuaagauggauucuca

SEQ ID NO: 3503555 - RNA, 23 nt, Human
auuuauuaagauggauucucaga

SEQ ID NO: 3503556 - RNA, 20 nt, Human
auuuauuaagguuacagauu

SEQ ID NO: 3503557 - RNA, 16 nt, Human
auuuauuaauugcuuu

SEQ ID NO: 3503558 - RNA, 17 nt, Human
auuuauuaauugcuuug

SEQ ID NO: 3503559 - RNA, 23 nt, Human
auuuauuaugcuuuauuggaaaa

SEQ ID NO: 3503560 - RNA, 16 nt, Human
auuuauuauggcacau

SEQ ID NO: 3503561 - RNA, 15 nt, Human
auuuauuauugaaau

SEQ ID NO: 3503562 - RNA, 16 nt, Human
auuuauuauugaaauu

SEQ ID NO: 3503563 - RNA, 19 nt, Human
auuuauuauuuauuuauua

SEQ ID NO: 3503564 - RNA, 21 nt, Human
auuuauuauuuucaccuguuu

SEQ ID NO: 3503565 - RNA, 14 nt, Human
auuuauucaagaaa

SEQ ID NO: 3503566 - RNA, 21 nt, Human
auuuauucaauaaaguauuua

SEQ ID NO: 3503567 - RNA, 19 nt, Human
auuuauucaauuccucugg

SEQ ID NO: 3503568 - RNA, 20 nt, Human
auuuauucagcuucauuugu

SEQ ID NO: 3503569 - RNA, 21 nt, Human
auuuauucauuauuugucaaa

SEQ ID NO: 3503570 - RNA, 23 nt, Human
auuuauuccauauucauguaaac

SEQ ID NO: 3503571 - RNA, 21 nt, Human
auuuauucugggaauguauag

SEQ ID NO: 3503572 - RNA, 19 nt, Human
auuuauugacucuugaguu

SEQ ID NO: 3503573 - RNA, 22 nt, Human
auuuauugacucuugaguuguu

SEQ ID NO: 3503574 - RNA, 21 nt, Human
auuuauugaggaaaaauaugu

SEQ ID NO: 3503575 - RNA, 23 nt, Human
auuuauugauuccuuuuuucaaa

SEQ ID NO: 3503576 - RNA, 16 nt, Human
auuuauugcacauugu

SEQ ID NO: 3503577 - RNA, 17 nt, Human
auuuauugcacauuguu

SEQ ID NO: 3503578 - RNA, 20 nt, Human
auuuauugcacauuguucaa

SEQ ID NO: 3503579 - RNA, 20 nt, Human
auuuauugcuugauacuuuu

SEQ ID NO: 3503580 - RNA, 14 nt, Human
auuuauugcuuuau

SEQ ID NO: 3503581 - RNA, 23 nt, Human
auuuauuggccccccgaccuugu

SEQ ID NO: 3503582 - RNA, 14 nt, Human
auuuauuggcuuuu

SEQ ID NO: 3503583 - RNA, 18 nt, Human
auuuauuggcuuuucuga

SEQ ID NO: 3503584 - RNA, 14 nt, Human
auuuauugguuuug

SEQ ID NO: 3503585 - RNA, 17 nt, Human
auuuauuguuuauguaa

SEQ ID NO: 3503586 - RNA, 19 nt, Human
auuuauuguuuauguaaau

SEQ ID NO: 3503587 - RNA, 21 nt, Human
auuuauuguuuauguaaaugu

SEQ ID NO: 3503588 - RNA, 13 nt, Human
auuuauuuaaaag

SEQ ID NO: 3503589 - RNA, 14 nt, Human
auuuauuuaaaaga

SEQ ID NO: 3503590 - RNA, 17 nt, Human
auuuauuuaauguuaug

SEQ ID NO: 3503591 - RNA, 15 nt, Human
auuuauuuacaaaug

SEQ ID NO: 3503592 - RNA, 13 nt, Human
auuuauuuacaga

SEQ ID NO: 3503593 - RNA, 14 nt, Human
auuuauuucaucau

SEQ ID NO: 3503594 - RNA, 18 nt, Human
auuuauuuccuaguucug

SEQ ID NO: 3503595 - RNA, 12 nt, Human
auuuauuuccuc

SEQ ID NO: 3503596 - RNA, 17 nt, Human
auuuauuuccucccucu

SEQ ID NO: 3503597 - RNA, 20 nt, Human
auuuauuucuuuuuugccaa

SEQ ID NO: 3503598 - RNA, 13 nt, Human
auuuauuugcuuc

SEQ ID NO: 3503599 - RNA, 22 nt, Human
auuuauuuuaaaaaaugaaaau

SEQ ID NO: 3503600 - RNA, 14 nt, Human
auuuauuuuaagca

SEQ ID NO: 3503601 - RNA, 17 nt, Human
auuuauuuuaauaaugu

SEQ ID NO: 3503602 - RNA, 13 nt, Human
auuuauuuuauga

SEQ ID NO: 3503603 - RNA, 18 nt, Human
auuuauuuuaugagaaau

SEQ ID NO: 3503604 - RNA, 12 nt, Human
auuuauuuuauu

SEQ ID NO: 3503605 - RNA, 16 nt, Human
auuuauuuuccuaaag

SEQ ID NO: 3503606 - RNA, 20 nt, Human
auuuauuuuccuccccagca

SEQ ID NO: 3503607 - RNA, 13 nt, Human
auuuauuuugaca

SEQ ID NO: 3503608 - RNA, 14 nt, Human
auuuauuuugacau

SEQ ID NO: 3503609 - RNA, 21 nt, Human
auuuauuuugacauaaaguug

SEQ ID NO: 3503610 - RNA, 14 nt, Human
auuuauuuuguaau

SEQ ID NO: 3503611 - RNA, 19 nt, Human
auuuauuuuuaagaaagaa

SEQ ID NO: 3503612 - RNA, 20 nt, Human
auuuauuuuuaagaaagaaa

SEQ ID NO: 3503613 - RNA, 18 nt, Human
auuuauuuuuacaagaag

SEQ ID NO: 3503614 - RNA, 17 nt, Human
auuuauuuuugcauggc

SEQ ID NO: 3503615 - RNA, 19 nt, Human
auuucaaaaaaauaaaaua

SEQ ID NO: 3503616 - RNA, 20 nt, Human
auuucaaaaaaauaaaauaa

SEQ ID NO: 3503617 - RNA, 17 nt, Human
auuucaaaaauauaacu

SEQ ID NO: 3503618 - RNA, 16 nt, Human
auuucaaaaauuugga

SEQ ID NO: 3503619 - RNA, 14 nt, Human
auuucaaaagacau

SEQ ID NO: 3503620 - RNA, 16 nt, Human
auuucaaaagacaugu

SEQ ID NO: 3503621 - RNA, 13 nt, Human
auuucaaaauaua

SEQ ID NO: 3503622 - RNA, 15 nt, Human
auuucaaaaugauuu

SEQ ID NO: 3503623 - RNA, 21 nt, Human
auuucaaaaugcuuuuuauua

SEQ ID NO: 3503624 - RNA, 19 nt, Human
auuucaaaguuuuguugua

SEQ ID NO: 3503625 - RNA, 17 nt, Human
auuucaaauuggagcuu

SEQ ID NO: 3503626 - RNA, 23 nt, Human
auuucaacaaguagcuaaagucu

SEQ ID NO: 3503627 - RNA, 19 nt, Human
auuucaagaaaaaauaaau

SEQ ID NO: 3503628 - RNA, 21 nt, Human
auuucaagaaaaaauaaaugg

SEQ ID NO: 3503629 - RNA, 23 nt, Human
auuucaagaaaaaauaaauggaa

SEQ ID NO: 3503630 - RNA, 15 nt, Human
auuucaagagauuua

SEQ ID NO: 3503631 - RNA, 19 nt, Human
auuucaagagauuuaauua

SEQ ID NO: 3503632 - RNA, 22 nt, Human
auuucaagcuuauuuuggagag

SEQ ID NO: 3503633 - RNA, 12 nt, Human
auuucaagguuc

SEQ ID NO: 3503634 - RNA, 14 nt, Human
auuucaagguucua

SEQ ID NO: 3503635 - RNA, 17 nt, Human
auuucaaguacacugaa

SEQ ID NO: 3503636 - RNA, 22 nt, Human
auuucaaguuccaaguugcuaa

SEQ ID NO: 3503637 - RNA, 22 nt, Human
auuucaaucccacguacuuaua

SEQ ID NO: 3503638 - RNA, 23 nt, Human
auuucaauguaauuaaacuguua

SEQ ID NO: 3503639 - RNA, 22 nt, Human
auuucaauguguauaaauuguc

SEQ ID NO: 3503640 - RNA, 21 nt, Human
auuucaauuuccaagagcuga

SEQ ID NO: 3503641 - RNA, 13 nt, Human
auuucacaaauau

SEQ ID NO: 3503642 - RNA, 14 nt, Human
auuucacaaauauu

SEQ ID NO: 3503643 - RNA, 15 nt, Human
auuucacaaauauua

SEQ ID NO: 3503644 - RNA, 14 nt, Human
auuucacaggcuaa

SEQ ID NO: 3503645 - RNA, 17 nt, Human
auuucacaguguguggu

SEQ ID NO: 3503646 - RNA, 13 nt, Human
auuucacauuaau

SEQ ID NO: 3503647 - RNA, 15 nt, Human
auuucaccuguaaac

SEQ ID NO: 3503648 - RNA, 16 nt, Human
auuucacgauucauuu

SEQ ID NO: 3503649 - RNA, 18 nt, Human
auuucacuacuagauuga

SEQ ID NO: 3503650 - RNA, 22 nt, Human
auuucacuauuuuuauuuauau

SEQ ID NO: 3503651 - RNA, 14 nt, Human
auuucacucuccuu

SEQ ID NO: 3503652 - RNA, 23 nt, Human
auuucacuugaguggagguuuau

SEQ ID NO: 3503653 - RNA, 19 nt, Human
auuucacuugaugauacaa

SEQ ID NO: 3503654 - RNA, 18 nt, Human
auuucacuuuagaugcug

SEQ ID NO: 3503655 - RNA, 18 nt, Human
auuucagaaaaugaaaaa

SEQ ID NO: 3503656 - RNA, 12 nt, Human
auuucagacucc

SEQ ID NO: 3503657 - RNA, 18 nt, Human
auuucagacucccauucc

SEQ ID NO: 3503658 - RNA, 19 nt, Human
auuucagagagaaucaaga

SEQ ID NO: 3503659 - RNA, 19 nt, Human
cagccccgugggguuccuc

SEQ ID NO: 3503660 - RNA, 14 nt, Human
cagccccuacugcu

SEQ ID NO: 3503661 - RNA, 15 nt, Human
cagccccuacugcug

SEQ ID NO: 3503662 - RNA, 20 nt, Human
cagccccuagaaacccaagc

SEQ ID NO: 3503663 - RNA, 13 nt, Human
cagccccucccac

SEQ ID NO: 3503664 - RNA, 15 nt, Human
cagccccucccacca

SEQ ID NO: 3503665 - RNA, 22 nt, Human
cagccccucccaccacagcagg

SEQ ID NO: 3503666 - RNA, 14 nt, Human
cagccccuccccca

SEQ ID NO: 3503667 - RNA, 16 nt, Human
cagccccuccucugcc

SEQ ID NO: 3503668 - RNA, 21 nt, Human
cagccccuccucugccaccuc

SEQ ID NO: 3503669 - RNA, 23 nt, Human
cagccccuccucugccaccuccc

SEQ ID NO: 3503670 - RNA, 11 nt, Human
cagccccucuu

SEQ ID NO: 3503671 - RNA, 15 nt, Human
cagccccucuugccc

SEQ ID NO: 3503672 - RNA, 14 nt, Human
cagccccugauccu

SEQ ID NO: 3503673 - RNA, 17 nt, Human
cagccccugccccagcc

SEQ ID NO: 3503674 - RNA, 18 nt, Human
cagccccuggaugcagcc

SEQ ID NO: 3503675 - RNA, 23 nt, Human
cagccccuggaugcagccucaca

SEQ ID NO: 3503676 - RNA, 21 nt, Human
cagccccuggccccaggaccu

SEQ ID NO: 3503677 - RNA, 20 nt, Human
cagccccuguauggcacugg

SEQ ID NO: 3503678 - RNA, 17 nt, Human
cagccccuuagacagag

SEQ ID NO: 3503679 - RNA, 21 nt, Human
cagccccuuagacagaggccc

SEQ ID NO: 3503680 - RNA, 15 nt, Human
cagccccuucucaga

SEQ ID NO: 3503681 - RNA, 16 nt, Human
cagccccuucucagaa

SEQ ID NO: 3503682 - RNA, 16 nt, Human
caggggcccacaggga

SEQ ID NO: 3503683 - RNA, 19 nt, Human
caggggccccuccagcuug

SEQ ID NO: 3503684 - RNA, 20 nt, Human
caggggccccuccagcuugu

SEQ ID NO: 3503685 - RNA, 16 nt, Human
caggggcccugcagcu

SEQ ID NO: 3503686 - RNA, 15 nt, Human
caggggcccuggagc

SEQ ID NO: 3503687 - RNA, 20 nt, Human
caggggcccuggagcagcca

SEQ ID NO: 3503688 - RNA, 16 nt, Human
caggggccugcccagu

SEQ ID NO: 3503689 - RNA, 18 nt, Human
caggggcguguggcucac

SEQ ID NO: 3503690 - RNA, 17 nt, Human
caggggcuacaagaggg

SEQ ID NO: 3503691 - RNA, 14 nt, Human
caggggcucccucc

SEQ ID NO: 3503692 - RNA, 14 nt, Human
caggggcucuggag

SEQ ID NO: 3503693 - RNA, 13 nt, Human
caggggcugcagu

SEQ ID NO: 3503694 - RNA, 12 nt, Human
caggggcugccc

SEQ ID NO: 3503695 - RNA, 13 nt, Human
caggggcugcuuc

SEQ ID NO: 3503696 - RNA, 18 nt, Human
caggggcugcuuccuccu

SEQ ID NO: 3503697 - RNA, 13 nt, Human
caggggcuggcuu

SEQ ID NO: 3503698 - RNA, 15 nt, Human
caggggcuggugggc

SEQ ID NO: 3503699 - RNA, 15 nt, Human
caggggcuuccuggu

SEQ ID NO: 3503700 - RNA, 16 nt, Human
caggggcuugacuuuu

SEQ ID NO: 3503701 - RNA, 15 nt, Human
cagggggaagaagca

SEQ ID NO: 3503702 - RNA, 19 nt, Human
cagggggaagguggggucc

SEQ ID NO: 3503703 - RNA, 19 nt, Human
cagggggagcugggccugg

SEQ ID NO: 3503704 - RNA, 22 nt, Human
cagggggaugccacuccucccu

SEQ ID NO: 3503705 - RNA, 20 nt, Human
cagggggcccaccagagcug

SEQ ID NO: 3503706 - RNA, 12 nt, Human
cagggggcugcu

SEQ ID NO: 3503707 - RNA, 18 nt, Human
cagggggcugcugcuggg

SEQ ID NO: 3503708 - RNA, 12 nt, Human
cagggggcuucc

SEQ ID NO: 3503709 - RNA, 15 nt, Human
caggggggugaggag

SEQ ID NO: 3503710 - RNA, 18 nt, Human
caggggggugaggagcug

SEQ ID NO: 3503711 - RNA, 22 nt, Human
cagcucugccgucucuggagcg

SEQ ID NO: 3503712 - RNA, 23 nt, Human
cagcucugcuugccgaaacugga

SEQ ID NO: 3503713 - RNA, 18 nt, Human
cagcucuggacagcccca

SEQ ID NO: 3503714 - RNA, 16 nt, Human
cagcucuggagggggu

SEQ ID NO: 3503715 - RNA, 14 nt, Human
cagcucuggcaugg

SEQ ID NO: 3503716 - RNA, 15 nt, Human
cagcucugggagagg

SEQ ID NO: 3503717 - RNA, 23 nt, Human
cagcucugggccauucuccacag

SEQ ID NO: 3503718 - RNA, 13 nt, Human
cagcucuggucca

SEQ ID NO: 3503719 - RNA, 22 nt, Human
cagcucugguccauagagagca

SEQ ID NO: 3503720 - RNA, 17 nt, Human
cagcucuguguugccau

SEQ ID NO: 3503721 - RNA, 22 nt, Human
cagcucuguucuuccucagcca

SEQ ID NO: 3503722 - RNA, 18 nt, Human
cagcucuucaucugccca

SEQ ID NO: 3503723 - RNA, 22 nt, Human
cagcucuuccuagcuggagagg

SEQ ID NO: 3503724 - RNA, 17 nt, Human
cagcucuucuccaggcu

SEQ ID NO: 3503725 - RNA, 18 nt, Human
cagcucuucuccaggcug

SEQ ID NO: 3503726 - RNA, 17 nt, Human
cagcucuugcccuuccc

SEQ ID NO: 3503727 - RNA, 20 nt, Human
cagcucuugcuaaucagugu

SEQ ID NO: 3503728 - RNA, 23 nt, Human
cagcucuugcuaaucagugucuc

SEQ ID NO: 3503729 - RNA, 17 nt, Human
cagcucuuggcuccacu

SEQ ID NO: 3503730 - RNA, 18 nt, Human
cagcucuuggcuccacug

SEQ ID NO: 3503731 - RNA, 13 nt, Human
cagcucuuuccuc

SEQ ID NO: 3503732 - RNA, 22 nt, Human
cagcugaaauaugcuggcugga

SEQ ID NO: 3503733 - RNA, 17 nt, Human
cagcugaaugccuccug

SEQ ID NO: 3503734 - RNA, 21 nt, Human
cagcugacaucuugaauccuu

SEQ ID NO: 3503735 - RNA, 17 nt, Human
cagcugaccauggaaga

SEQ ID NO: 3503736 - RNA, 16 nt, Human
cagcugacuuucaaag

SEQ ID NO: 3503737 - RNA, 21 nt, Human
cagcugacuuuucuguccgag

SEQ ID NO: 3503738 - RNA, 14 nt, Human
cagcugagcagggc

SEQ ID NO: 3503739 - RNA, 15 nt, Human
cagcugagcagggcc

SEQ ID NO: 3503740 - RNA, 16 nt, Human
cagcugagcgccagga

SEQ ID NO: 3503741 - RNA, 21 nt, Human
cagcugaggcugggggagagc

SEQ ID NO: 3503742 - RNA, 18 nt, Human
cagcugagugaaaaaucu

SEQ ID NO: 3503743 - RNA, 23 nt, Human
cagcugagugaaaaaucugugga

SEQ ID NO: 3503744 - RNA, 13 nt, Human
cagcugaugacuc

SEQ ID NO: 3503745 - RNA, 12 nt, Human
cagcugauuuua

SEQ ID NO: 3503746 - RNA, 21 nt, Human
cagcugauuuuaacaauaacu

SEQ ID NO: 3503747 - RNA, 15 nt, Human
cagcugcaaaguguu

SEQ ID NO: 3503748 - RNA, 19 nt, Human
cagcugcaagguacucugg

SEQ ID NO: 3503749 - RNA, 16 nt, Human
cagcugcaccagagca

SEQ ID NO: 3503750 - RNA, 16 nt, Human
cagcugcaccccuucc

SEQ ID NO: 3503751 - RNA, 17 nt, Human
cagcugcaccugccagc

SEQ ID NO: 3503752 - RNA, 17 nt, Human
cagcugcagcugggcug

SEQ ID NO: 3503753 - RNA, 15 nt, Human
cagcugccagagaag

SEQ ID NO: 3503754 - RNA, 15 nt, Human
cagcugccagugucc

SEQ ID NO: 3503755 - RNA, 18 nt, Human
cagcugcccccagagcca

SEQ ID NO: 3503756 - RNA, 20 nt, Human
cagcugcccccagagccaca

SEQ ID NO: 3503757 - RNA, 21 nt, Human
cagcugcccccagagccacag

SEQ ID NO: 3503758 - RNA, 12 nt, Human
cagcugccccgg

SEQ ID NO: 3503759 - RNA, 17 nt, Human
cagcugccccggccccu

SEQ ID NO: 3503760 - RNA, 19 nt, Human
cagcugccccggccccucc

SEQ ID NO: 3503761 - RNA, 12 nt, Human
cagcugccccuc

SEQ ID NO: 3503762 - RNA, 15 nt, Human
cagcugccccucccu

SEQ ID NO: 3503763 - RNA, 10 nt, Human
cagcugccuc

SEQ ID NO: 3503764 - RNA, 14 nt, Human
cagcugccuccccu

SEQ ID NO: 3503765 - RNA, 18 nt, Human
cagcugccuccccuccuc

SEQ ID NO: 3503766 - RNA, 20 nt, Human
cagcugccuccccuccucug

SEQ ID NO: 3503767 - RNA, 21 nt, Human
cagcugccuccccuccucugc

SEQ ID NO: 3503768 - RNA, 22 nt, Human
cagcugccuccccuccucugcu

SEQ ID NO: 3503769 - RNA, 13 nt, Human
cagcugccuggga

SEQ ID NO: 3503770 - RNA, 15 nt, Human
cagcugccugggauc

SEQ ID NO: 3503771 - RNA, 19 nt, Human
cagcugccuuagcuucagg

SEQ ID NO: 3503772 - RNA, 21 nt, Human
cagcugccuuagcuucaggaa

SEQ ID NO: 3503773 - RNA, 23 nt, Human
cagcugccuuagcuucaggaacc

SEQ ID NO: 3503774 - RNA, 18 nt, Human
cagcugcgguccacccag

SEQ ID NO: 3503775 - RNA, 19 nt, Human
cagcugcgguccacccagg

SEQ ID NO: 3503776 - RNA, 21 nt, Human
cagcugcgguccacccaggag

SEQ ID NO: 3503777 - RNA, 23 nt, Human
cagcugcgguccacccaggagcc

SEQ ID NO: 3503778 - RNA, 24 nt, Human
cagcugcgguccacccaggagccc

SEQ ID NO: 3503779 - RNA, 23 nt, Human
cagcugcuauccccaucucccug

SEQ ID NO: 3503780 - RNA, 20 nt, Human
cagcugcuauuuauuuuccu

SEQ ID NO: 3503781 - RNA, 22 nt, Human
cagcugcuauuuauuuuccuaa

SEQ ID NO: 3503782 - RNA, 13 nt, Human
cagcugcuccccu

SEQ ID NO: 3503783 - RNA, 20 nt, Human
cagcugcuccccucccuccu

SEQ ID NO: 3503784 - RNA, 21 nt, Human
cagcugcuccccucccuccuc

SEQ ID NO: 3503785 - RNA, 19 nt, Human
cagcugcuccuagagggag

SEQ ID NO: 3503786 - RNA, 14 nt, Human
cagcugcucugccc

SEQ ID NO: 3503787 - RNA, 17 nt, Human
cagcugcucugcccaga

SEQ ID NO: 3503788 - RNA, 18 nt, Human
cagcugcucugcccagag

SEQ ID NO: 3503789 - RNA, 22 nt, Human
cagcugcucugcccagagcugg

SEQ ID NO: 3503790 - RNA, 20 nt, Human
cagcugcugaaacaacaaau

SEQ ID NO: 3503791 - RNA, 12 nt, Human
cagcugcugaga

SEQ ID NO: 3503792 - RNA, 19 nt, Human
cagcugcugagauccugga

SEQ ID NO: 3503793 - RNA, 14 nt, Human
cagcugcugagccg

SEQ ID NO: 3503794 - RNA, 18 nt, Human
cagcugcugagccgcaga

SEQ ID NO: 3503795 - RNA, 13 nt, Human
cagcugcuugggc

SEQ ID NO: 3503796 - RNA, 14 nt, Human
cagcugcuugggcu

SEQ ID NO: 3503797 - RNA, 16 nt, Human
cagcugcuugggcuuc

SEQ ID NO: 3503798 - RNA, 22 nt, Human
cagcugcuugggcuucauccuc

SEQ ID NO: 3503799 - RNA, 22 nt, Human
cagcugcuugugucccuccugg

SEQ ID NO: 3503800 - RNA, 22 nt, Human
cagcugcuuuugucuaugggac

SEQ ID NO: 3503801 - RNA, 22 nt, Human
cagcuggaaaagggucuuggga

SEQ ID NO: 3503802 - RNA, 13 nt, Human
cagcuggacagag

SEQ ID NO: 3503803 - RNA, 16 nt, Human
cagcuggacagagggg

SEQ ID NO: 3503804 - RNA, 18 nt, Human
cagcuggacucugcaucc

SEQ ID NO: 3503805 - RNA, 19 nt, Human
cagcuggacucugcauccc

SEQ ID NO: 3503806 - RNA, 15 nt, Human
cagcuggaggcaggg

SEQ ID NO: 3503807 - RNA, 23 nt, Human
cagcuggaugagaauuugagugc

SEQ ID NO: 3503808 - RNA, 21 nt, Human
cagcuggaugagacuuccaaa

SEQ ID NO: 3503809 - RNA, 18 nt, Human
cagcuggaugauggucuu

SEQ ID NO: 3503810 - RNA, 19 nt, Human
cagcuggauuggguuauga

SEQ ID NO: 3503811 - RNA, 17 nt, Human
cagcuggcccgugacag

SEQ ID NO: 3503812 - RNA, 19 nt, Human
cagcuggccgggagccuga

SEQ ID NO: 3503813 - RNA, 14 nt, Human
cagcuggccuggac

SEQ ID NO: 3503814 - RNA, 20 nt, Human
cagcugggaucugacugcac

SEQ ID NO: 3503815 - RNA, 21 nt, Human
cagcugggcccaacccugucu

SEQ ID NO: 3503816 - RNA, 11 nt, Human
cagcugggcuc

SEQ ID NO: 3503817 - RNA, 15 nt, Human
cagcugggcucugca

SEQ ID NO: 3503818 - RNA, 20 nt, Human
cagcuggggccaggcugggu

SEQ ID NO: 3503819 - RNA, 22 nt, Human
cagcuggggccaggcugggucg

SEQ ID NO: 3503820 - RNA, 21 nt, Human
cagcuggggcguggggagggc

SEQ ID NO: 3503821 - RNA, 17 nt, Human
cagcuggggugcaggga

SEQ ID NO: 3503822 - RNA, 21 nt, Human
cagcugggguggggaccucag

SEQ ID NO: 3503823 - RNA, 15 nt, Human
cagcugggucaggca

SEQ ID NO: 3503824 - RNA, 19 nt, Human
cagcuggguggcacugcca

SEQ ID NO: 3503825 - RNA, 20 nt, Human
cagcuggguggcacugccau

SEQ ID NO: 3503826 - RNA, 21 nt, Human
auuuugaguaucucggaccuu

SEQ ID NO: 3503827 - RNA, 14 nt, Human
auuuugagugacuc

SEQ ID NO: 3503828 - RNA, 15 nt, Human
auuuugauaauaaau

SEQ ID NO: 3503829 - RNA, 14 nt, Human
auuuugauaguggg

SEQ ID NO: 3503830 - RNA, 18 nt, Human
auuuugauccaagcuggu

SEQ ID NO: 3503831 - RNA, 17 nt, Human
auuuugaucuucaacaa

SEQ ID NO: 3503832 - RNA, 12 nt, Human
auuuugaugcag

SEQ ID NO: 3503833 - RNA, 17 nt, Human
auuuugaugcagcauuu

SEQ ID NO: 3503834 - RNA, 20 nt, Human
auuuugaugcagcauuugau

SEQ ID NO: 3503835 - RNA, 21 nt, Human
auuuugaugugacaauaauau

SEQ ID NO: 3503836 - RNA, 17 nt, Human
auuuugauguuuuaagg

SEQ ID NO: 3503837 - RNA, 22 nt, Human
auuuugauuauuguauuuauuc

SEQ ID NO: 3503838 - RNA, 13 nt, Human
auuuugcaaauau

SEQ ID NO: 3503839 - RNA, 21 nt, Human
auuuugcaaucccuuaauauc

SEQ ID NO: 3503840 - RNA, 15 nt, Human
auuuugcauaauaaa

SEQ ID NO: 3503841 - RNA, 14 nt, Human
auuuugcauucaaa

SEQ ID NO: 3503842 - RNA, 15 nt, Human
auuuugcauucaaau

SEQ ID NO: 3503843 - RNA, 16 nt, Human
auuuugccauuuagcg

SEQ ID NO: 3503844 - RNA, 21 nt, Human
auuuugccucuuuucucugug

SEQ ID NO: 3503845 - RNA, 18 nt, Human
auuuugcgucagagaaau

SEQ ID NO: 3503846 - RNA, 23 nt, Human
auuuugcuaaguaaaucucuucu

SEQ ID NO: 3503847 - RNA, 17 nt, Human
auuuugcuauuguaaau

SEQ ID NO: 3503848 - RNA, 19 nt, Human
auuuugcuauuguaaauau

SEQ ID NO: 3503849 - RNA, 14 nt, Human
auuuugcuggaaua

SEQ ID NO: 3503850 - RNA, 20 nt, Human
auuuugcuguagaagauggc

SEQ ID NO: 3503851 - RNA, 12 nt, Human
auuuugcuuugu

SEQ ID NO: 3503852 - RNA, 20 nt, Human
auuuuggaagauuuucaguc

SEQ ID NO: 3503853 - RNA, 14 nt, Human
auuuuggagaaauu

SEQ ID NO: 3503854 - RNA, 18 nt, Human
auuuuggagauuauaaua

SEQ ID NO: 3503855 - RNA, 21 nt, Human
auuuuggcgcuauuacaaaua

SEQ ID NO: 3503856 - RNA, 15 nt, Human
auuuugggaaucuuu

SEQ ID NO: 3503857 - RNA, 23 nt, Human
auuuuggggaaggguuugaauug

SEQ ID NO: 3503858 - RNA, 20 nt, Human
auuuugggguuguguuguca

SEQ ID NO: 3503859 - RNA, 22 nt, Human
auuuugguaaaauacuucuuga

SEQ ID NO: 3503860 - RNA, 14 nt, Human
auuuugguuguauu

SEQ ID NO: 3503861 - RNA, 16 nt, Human
auuuugguuguauucu

SEQ ID NO: 3503862 - RNA, 17 nt, Human
auuuugguuguauucuu

SEQ ID NO: 3503863 - RNA, 21 nt, Human
auuuugguuguauucuuugau

SEQ ID NO: 3503864 - RNA, 21 nt, Human
auuuugguuuuguuccccucc

SEQ ID NO: 3503865 - RNA, 17 nt, Human
auuuuguaaaauguauu

SEQ ID NO: 3503866 - RNA, 18 nt, Human
auuuuguaaaauguauua

SEQ ID NO: 3503867 - RNA, 21 nt, Human
auuuuguaaaauguauuaugu

SEQ ID NO: 3503868 - RNA, 20 nt, Human
auuuuguaaacucaaaauau

SEQ ID NO: 3503869 - RNA, 19 nt, Human
caggggggugaggagcugg

SEQ ID NO: 3503870 - RNA, 20 nt, Human
cagggggguugugaggccug

SEQ ID NO: 3503871 - RNA, 17 nt, Human
caggggucacugaggcc

SEQ ID NO: 3503872 - RNA, 20 nt, Human
caggggucccagccaccccg

SEQ ID NO: 3503873 - RNA, 21 nt, Human
caggggucgucaccaccucuc

SEQ ID NO: 3503874 - RNA, 21 nt, Human
caggggucugagcuccagcuc

SEQ ID NO: 3503875 - RNA, 16 nt, Human
caggggugacacagac

SEQ ID NO: 3503876 - RNA, 17 nt, Human
caggggugacacagacu

SEQ ID NO: 3503877 - RNA, 19 nt, Human
caggggugacacagacuca

SEQ ID NO: 3503878 - RNA, 20 nt, Human
caggggugauuucagagagg

SEQ ID NO: 3503879 - RNA, 13 nt, Human
caggggugccccc

SEQ ID NO: 3503880 - RNA, 20 nt, Human
caggggugcccccuccucuc

SEQ ID NO: 3503881 - RNA, 13 nt, Human
cagggguggagga

SEQ ID NO: 3503882 - RNA, 17 nt, Human
cagggguggaggagagc

SEQ ID NO: 3503883 - RNA, 12 nt, Human
cagggguggggg

SEQ ID NO: 3503884 - RNA, 21 nt, Human
caggguaacuaacuaaaacaa

SEQ ID NO: 3503885 - RNA, 16 nt, Human
caggguagcagguacc

SEQ ID NO: 3503886 - RNA, 16 nt, Human
caggguagcccgccug

SEQ ID NO: 3503887 - RNA, 21 nt, Human
caggguagcccgccugccagu

SEQ ID NO: 3503888 - RNA, 19 nt, Human
caggguauugcuugccacu

SEQ ID NO: 3503889 - RNA, 23 nt, Human
cagggucaaaguguuuucucuga

SEQ ID NO: 3503890 - RNA, 19 nt, Human
cagggucccacagccacgu

SEQ ID NO: 3503891 - RNA, 13 nt, Human
cagggucccucug

SEQ ID NO: 3503892 - RNA, 15 nt, Human
cagggucccucugug

SEQ ID NO: 3503893 - RNA, 14 nt, Human
cagggucccuggug

SEQ ID NO: 3503894 - RNA, 15 nt, Human
cagggucccuggugg

SEQ ID NO: 3503895 - RNA, 18 nt, Human
cagggucccugguggcag

SEQ ID NO: 3503896 - RNA, 20 nt, Human
caggguccucuucugggccu

SEQ ID NO: 3503897 - RNA, 13 nt, Human
caggguccugcua

SEQ ID NO: 3503898 - RNA, 13 nt, Human
caggguccuggga

SEQ ID NO: 3503899 - RNA, 21 nt, Human
cagggucucacuauguugccc

SEQ ID NO: 3503900 - RNA, 22 nt, Human
cagggucucacuauguugccca

SEQ ID NO: 3503901 - RNA, 15 nt, Human
cagggucucacucug

SEQ ID NO: 3503902 - RNA, 16 nt, Human
cagggucucacucugu

SEQ ID NO: 3503903 - RNA, 21 nt, Human
cagggucucacucugucgccc

SEQ ID NO: 3503904 - RNA, 22 nt, Human
cagggucucacucugucgccca

SEQ ID NO: 3503905 - RNA, 18 nt, Human
cagggucuccagaaagcc

SEQ ID NO: 3503906 - RNA, 23 nt, Human
cagggucucuagugcugugaaaa

SEQ ID NO: 3503907 - RNA, 15 nt, Human
cagggucucucccuc

SEQ ID NO: 3503908 - RNA, 21 nt, Human
cagggucucucccucaggugu

SEQ ID NO: 3503909 - RNA, 15 nt, Human
cagggucucugcugc

SEQ ID NO: 3503910 - RNA, 13 nt, Human
cagggucugcucu

SEQ ID NO: 3503911 - RNA, 15 nt, Human
cagggucugggcagg

SEQ ID NO: 3503912 - RNA, 13 nt, Human
cagggucuucccu

SEQ ID NO: 3503913 - RNA, 22 nt, Human
cagggucuucccuaccucaggc

SEQ ID NO: 3503914 - RNA, 17 nt, Human
cagggucuuuucaucug

SEQ ID NO: 3503915 - RNA, 14 nt, Human
cagggugagagcug

SEQ ID NO: 3503916 - RNA, 22 nt, Human
cagggugagagcugcucuggaa

SEQ ID NO: 3503917 - RNA, 18 nt, Human
cagggugagcccaugugg

SEQ ID NO: 3503918 - RNA, 16 nt, Human
cagggugaugccaggu

SEQ ID NO: 3503919 - RNA, 20 nt, Human
caggguggagugcaguggug

SEQ ID NO: 3503920 - RNA, 22 nt, Human
caggguggccacaccucuaucc

SEQ ID NO: 3503921 - RNA, 23 nt, Human
cagggugggccucggccccuccc

SEQ ID NO: 3503922 - RNA, 18 nt, Human
caggguggugcugggacu

SEQ ID NO: 3503923 - RNA, 18 nt, Human
caggguguggcccugcca

SEQ ID NO: 3503924 - RNA, 13 nt, Human
cagggugugugcu

SEQ ID NO: 3503925 - RNA, 20 nt, Human
caggguguugucagcaucuu

SEQ ID NO: 3503926 - RNA, 15 nt, Human
caggguucccccagc

SEQ ID NO: 3503927 - RNA, 17 nt, Human
caggguucccccagccc

SEQ ID NO: 3503928 - RNA, 19 nt, Human
caggguucccgcggggcug

SEQ ID NO: 3503929 - RNA, 21 nt, Human
caggguucccgcggggcuguc

SEQ ID NO: 3503930 - RNA, 21 nt, Human
caggguucuccucuccccucu

SEQ ID NO: 3503931 - RNA, 15 nt, Human
caggguuggccccug

SEQ ID NO: 3503932 - RNA, 21 nt, Human
caggguuggccccugcccggc

SEQ ID NO: 3503933 - RNA, 20 nt, Human
caggguugggcccagaucug

SEQ ID NO: 3503934 - RNA, 20 nt, Human
caggguuucgagaagcugcu

SEQ ID NO: 3503935 - RNA, 20 nt, Human
caggguuuggcugugucuaa

SEQ ID NO: 3503936 - RNA, 13 nt, Human
caggguuuuuacc

SEQ ID NO: 3503937 - RNA, 20 nt, Human
cagguaaaacagggccacau

SEQ ID NO: 3503938 - RNA, 23 nt, Human
cagguaaaacagggccacauaga

SEQ ID NO: 3503939 - RNA, 22 nt, Human
cagguaaagggcaaauaaugau

SEQ ID NO: 3503940 - RNA, 15 nt, Human
cagguaauacaaacu

SEQ ID NO: 3503941 - RNA, 17 nt, Human
cagguaaucgaccugcc

SEQ ID NO: 3503942 - RNA, 14 nt, Human
cagguacagagaag

SEQ ID NO: 3503943 - RNA, 13 nt, Human
cagguaccagcug

SEQ ID NO: 3503944 - RNA, 19 nt, Human
cagguaccagcugcgcuug

SEQ ID NO: 3503945 - RNA, 21 nt, Human
cagguacccuucucgcuuuug

SEQ ID NO: 3503946 - RNA, 23 nt, Human
cagguaccuugaccuuuguacag

SEQ ID NO: 3503947 - RNA, 22 nt, Human
cagguacgcacagacagguuuu

SEQ ID NO: 3503948 - RNA, 19 nt, Human
cagguagaacacaagguca

SEQ ID NO: 3503949 - RNA, 21 nt, Human
cagguagaacgccagggaccc

SEQ ID NO: 3503950 - RNA, 23 nt, Human
cagguagaauuaucuaauuuaua

SEQ ID NO: 3503951 - RNA, 16 nt, Human
cagguagcugccccug

SEQ ID NO: 3503952 - RNA, 20 nt, Human
cagguagcugccccuggcuc

SEQ ID NO: 3503953 - RNA, 22 nt, Human
cagguagcugccccuggcucug

SEQ ID NO: 3503954 - RNA, 19 nt, Human
cagguagcugggauuacag

SEQ ID NO: 3503955 - RNA, 13 nt, Human
cagguagggggga

SEQ ID NO: 3503956 - RNA, 14 nt, Human
cagguauaccucac

SEQ ID NO: 3503957 - RNA, 15 nt, Human
cagguaucuccagga

SEQ ID NO: 3503958 - RNA, 18 nt, Human
cagguaucuccaggauug

SEQ ID NO: 3503959 - RNA, 20 nt, Human
cagguauguugccuuuaugg

SEQ ID NO: 3503960 - RNA, 20 nt, Human
cagguauuuuguuucuuuua

SEQ ID NO: 3503961 - RNA, 12 nt, Human
caggucaacaga

SEQ ID NO: 3503962 - RNA, 23 nt, Human
caggucaacagaaugaaaaauga

SEQ ID NO: 3503963 - RNA, 20 nt, Human
caggucaggaguucgagacc

SEQ ID NO: 3503964 - RNA, 17 nt, Human
caggucaggggugacac

SEQ ID NO: 3503965 - RNA, 20 nt, Human
caggucaggggugacacaga

SEQ ID NO: 3503966 - RNA, 17 nt, Human
cagguccaaugagcuuu

SEQ ID NO: 3503967 - RNA, 19 nt, Human
cagguccaaugagcuuucu

SEQ ID NO: 3503968 - RNA, 15 nt, Human
cagguccagaugugc

SEQ ID NO: 3503969 - RNA, 23 nt, Human
cagguccagcucuggaggggagg

SEQ ID NO: 3503970 - RNA, 13 nt, Human
cagguccaggcug

SEQ ID NO: 3503971 - RNA, 23 nt, Human
caggucccaccuccagcccggga

SEQ ID NO: 3503972 - RNA, 13 nt, Human
cagguccccagac

SEQ ID NO: 3503973 - RNA, 18 nt, Human
cagguccccagcuuuggc

SEQ ID NO: 3503974 - RNA, 16 nt, Human
caggucccccugcagc

SEQ ID NO: 3503975 - RNA, 17 nt, Human
caggucccccugcagcu

SEQ ID NO: 3503976 - RNA, 12 nt, Human
cagguccccuca

SEQ ID NO: 3503977 - RNA, 15 nt, Human
caggucccuaauaaa

SEQ ID NO: 3503978 - RNA, 17 nt, Human
caggucccuaauaaagc

SEQ ID NO: 3503979 - RNA, 20 nt, Human
caggucccuaauaaagcugu

SEQ ID NO: 3503980 - RNA, 14 nt, Human
caggucccucucau

SEQ ID NO: 3503981 - RNA, 20 nt, Human
cagguccucagagaauuucu

SEQ ID NO: 3503982 - RNA, 21 nt, Human
cagguccugcagucuggcuga

SEQ ID NO: 3503983 - RNA, 20 nt, Human
cagguccugguggggcagcu

SEQ ID NO: 3503984 - RNA, 23 nt, Human
cagguccugguggggcagcuccu

SEQ ID NO: 3503985 - RNA, 13 nt, Human
caggucgggcuca

SEQ ID NO: 3503986 - RNA, 17 nt, Human
caggucgggcucagcuc

SEQ ID NO: 3503987 - RNA, 18 nt, Human
caggucgggcucagcucu

SEQ ID NO: 3503988 - RNA, 19 nt, Human
caggucgggcucagcucug

SEQ ID NO: 3503989 - RNA, 13 nt, Human
caggucucccacg

SEQ ID NO: 3503990 - RNA, 13 nt, Human
caggucucccggg

SEQ ID NO: 3503991 - RNA, 19 nt, Human
caggucuugaacuccuggc

SEQ ID NO: 3503992 - RNA, 13 nt, Human
caggucuuuccua

SEQ ID NO: 3503993 - RNA, 13 nt, Human
caggugaaaaugu

SEQ ID NO: 3503994 - RNA, 17 nt, Human
caggugaaaggaaauua

SEQ ID NO: 3503995 - RNA, 18 nt, Human
caggugaaggaggcucca

SEQ ID NO: 3503996 - RNA, 23 nt, Human
caggugaaggaggcuccaggcag

SEQ ID NO: 3503997 - RNA, 20 nt, Human
caggugacagugagguccug

SEQ ID NO: 3503998 - RNA, 18 nt, Human
caggugacaugugaaacc

SEQ ID NO: 3503999 - RNA, 19 nt, Human
caggugacugucuggggag

SEQ ID NO: 3504000 - RNA, 21 nt, Human
caggugagaagcagaggaagg

SEQ ID NO: 3504001 - RNA, 21 nt, Human
caggugagcaaccaguuggcu

SEQ ID NO: 3504002 - RNA, 15 nt, Human
caggugagcccaugg

SEQ ID NO: 3504003 - RNA, 17 nt, Human
caggugagcccauggcc

SEQ ID NO: 3504004 - RNA, 20 nt, Human
caggugagcccauggcccuc

SEQ ID NO: 3504005 - RNA, 20 nt, Human
caggugaguccuagagcuac

SEQ ID NO: 3504006 - RNA, 21 nt, Human
caggugauccacccaccucag

SEQ ID NO: 3504007 - RNA, 20 nt, Human
caggugauuggaccaggcca

SEQ ID NO: 3504008 - RNA, 21 nt, Human
caggugcacaagcuccaagcu

SEQ ID NO: 3504009 - RNA, 12 nt, Human
caggugcagagg

SEQ ID NO: 3504010 - RNA, 13 nt, Human
caggugcagaggu

SEQ ID NO: 3504011 - RNA, 15 nt, Human
caggugcagccagag

SEQ ID NO: 3504012 - RNA, 19 nt, Human
caggugcagccagaggcac

SEQ ID NO: 3504013 - RNA, 23 nt, Human
caggugcagcccccacugccuuu

SEQ ID NO: 3504014 - RNA, 15 nt, Human
caggugcaguggcuc

SEQ ID NO: 3504015 - RNA, 16 nt, Human
caggugccagccugag

SEQ ID NO: 3504016 - RNA, 14 nt, Human
caggugccuccagg

SEQ ID NO: 3504017 - RNA, 17 nt, Human
caggugccuccaggugu

SEQ ID NO: 3504018 - RNA, 17 nt, Human
caggugccuuucaaauu

SEQ ID NO: 3504019 - RNA, 23 nt, Human
caggugcuccccugacagucccu

SEQ ID NO: 3504020 - RNA, 13 nt, Human
caggugcugcuac

SEQ ID NO: 3504021 - RNA, 19 nt, Human
caggugcugcuacccuccc

SEQ ID NO: 3504022 - RNA, 22 nt, Human
caggugcugcuacccucccugc

SEQ ID NO: 3504023 - RNA, 15 nt, Human
caggugcuggagcac

SEQ ID NO: 3504024 - RNA, 21 nt, Human
caggugcuggagcacugggcu

SEQ ID NO: 3504025 - RNA, 22 nt, Human
caggugcuggagcacugggcuc

SEQ ID NO: 3504026 - RNA, 15 nt, Human
caggugcuggucccg

SEQ ID NO: 3504027 - RNA, 18 nt, Human
cagguggaaggcagacag

SEQ ID NO: 3504028 - RNA, 20 nt, Human
cagguggagguggcaucccc

SEQ ID NO: 3504029 - RNA, 15 nt, Human
cagguggccaugccu

SEQ ID NO: 3504030 - RNA, 15 nt, Human
cagguggcccuacug

SEQ ID NO: 3504031 - RNA, 20 nt, Human
cagguggcugacccaguccc

SEQ ID NO: 3504032 - RNA, 22 nt, Human
cagguggcugacccagucccug

SEQ ID NO: 3504033 - RNA, 16 nt, Human
caggugggcccucuga

SEQ ID NO: 3504034 - RNA, 17 nt, Human
caggugggcguggucac

SEQ ID NO: 3504035 - RNA, 19 nt, Human
caggugggcuucccagugg

SEQ ID NO: 3504036 - RNA, 23 nt, Human
cagguggggagacugggcugagg

SEQ ID NO: 3504037 - RNA, 21 nt, Human
cagguggggucacucuggcag

SEQ ID NO: 3504038 - RNA, 22 nt, Human
cagguggggucacucuggcagc

SEQ ID NO: 3504039 - RNA, 22 nt, Human
caggugggucccggcucugugg

SEQ ID NO: 3504040 - RNA, 19 nt, Human
caggugguggcacugagcc

SEQ ID NO: 3504041 - RNA, 20 nt, Human
caggugguggcacugagccc

SEQ ID NO: 3504042 - RNA, 18 nt, Human
cagguggugucacugucc

SEQ ID NO: 3504043 - RNA, 19 nt, Human
cagguggugucacuguccc

SEQ ID NO: 3504044 - RNA, 13 nt, Human
caggugguuuuua

SEQ ID NO: 3504045 - RNA, 19 nt, Human
cagguguccccagcccacu

SEQ ID NO: 3504046 - RNA, 19 nt, Human
caggugucccugcacuugc

SEQ ID NO: 3504047 - RNA, 21 nt, Human
caggugugagccaccacgccc

SEQ ID NO: 3504048 - RNA, 16 nt, Human
caggugugagucacca

SEQ ID NO: 3504049 - RNA, 20 nt, Human
caggugugagucaccaagcc

SEQ ID NO: 3504050 - RNA, 21 nt, Human
caggugugagucaccaagccc

SEQ ID NO: 3504051 - RNA, 23 nt, Human
caggugugagucaccaagcccag

SEQ ID NO: 3504052 - RNA, 23 nt, Human
caggugugcacguggcauguggc

SEQ ID NO: 3504053 - RNA, 18 nt, Human
caggugugccgacagaag

SEQ ID NO: 3504054 - RNA, 20 nt, Human
caggugugguguaauuuaua

SEQ ID NO: 3504055 - RNA, 20 nt, Human
cagguguguccaccugggca

SEQ ID NO: 3504056 - RNA, 18 nt, Human
cagguguuaacauuccaa

SEQ ID NO: 3504057 - RNA, 21 nt, Human
cagguguuuuuuaugaagugc

SEQ ID NO: 3504058 - RNA, 15 nt, Human
cagguuaaauguuuu

SEQ ID NO: 3504059 - RNA, 11 nt, Human
cagguuacaac

SEQ ID NO: 3504060 - RNA, 12 nt, Human
cagguuacaaca

SEQ ID NO: 3504061 - RNA, 16 nt, Human
cagguuauaacagugu

SEQ ID NO: 3504062 - RNA, 17 nt, Human
cagguuauaacaguguu

SEQ ID NO: 3504063 - RNA, 16 nt, Human
cagguuaucugggcau

SEQ ID NO: 3504064 - RNA, 22 nt, Human
cagguuauugcaauaaaguaua

SEQ ID NO: 3504065 - RNA, 14 nt, Human
cagguuauuuuagu

SEQ ID NO: 3504066 - RNA, 21 nt, Human
cagguuauuuuaguuucuguu

SEQ ID NO: 3504067 - RNA, 16 nt, Human
cagguucaacccacag

SEQ ID NO: 3504068 - RNA, 22 nt, Human
cagguucaagcgauucuccugc

SEQ ID NO: 3504069 - RNA, 20 nt, Human
cagguucacaggcgaggccu

SEQ ID NO: 3504070 - RNA, 22 nt, Human
cagguucauggauuacuucucu

SEQ ID NO: 3504071 - RNA, 14 nt, Human
cagguuccaucccg

SEQ ID NO: 3504072 - RNA, 17 nt, Human
cagguucccaagcucag

SEQ ID NO: 3504073 - RNA, 21 nt, Human
cagguucuauuuggaauuuau

SEQ ID NO: 3504074 - RNA, 23 nt, Human
cagguucugguuagcucagcccc

SEQ ID NO: 3504075 - RNA, 21 nt, Human
cagguucuuguuggugcacag

SEQ ID NO: 3504076 - RNA, 16 nt, Human
cagguugaagccaugu

SEQ ID NO: 3504077 - RNA, 17 nt, Human
cagguugcugguugcug

SEQ ID NO: 3504078 - RNA, 20 nt, Human
cagguugcugguugcugugu

SEQ ID NO: 3504079 - RNA, 22 nt, Human
cagguugcugguugcugugugg

SEQ ID NO: 3504080 - RNA, 13 nt, Human
cagguuggacccc

SEQ ID NO: 3504081 - RNA, 17 nt, Human
cagguuggcucugccag

SEQ ID NO: 3504082 - RNA, 18 nt, Human
cagguuggcucugccagu

SEQ ID NO: 3504083 - RNA, 23 nt, Human
cagguuggcucugccaguccugu

SEQ ID NO: 3504084 - RNA, 14 nt, Human
cagguugguggggg

SEQ ID NO: 3504085 - RNA, 18 nt, Human
cagguuguaguaaagaaa

SEQ ID NO: 3504086 - RNA, 22 nt, Human
cagguugucugaagucacugca

SEQ ID NO: 3504087 - RNA, 23 nt, Human
cagguugucugaagucacugcac

SEQ ID NO: 3504088 - RNA, 20 nt, Human
cagguuguuagaaaaaugga

SEQ ID NO: 3504089 - RNA, 16 nt, Human
cagguuguuggugacu

SEQ ID NO: 3504090 - RNA, 18 nt, Human
cagguuuaacauuugccu

SEQ ID NO: 3504091 - RNA, 22 nt, Human
cagguuucuaagcauaaaagau

SEQ ID NO: 3504092 - RNA, 18 nt, Human
cagguuugggaccccugg

SEQ ID NO: 3504093 - RNA, 17 nt, Human
cagguuugucaucagau

SEQ ID NO: 3504094 - RNA, 14 nt, Human
cagguuuguuacau

SEQ ID NO: 3504095 - RNA, 20 nt, Human
cagguuuucacauaaaugca

SEQ ID NO: 3504096 - RNA, 12 nt, Human
cagguuuuccug

SEQ ID NO: 3504097 - RNA, 18 nt, Human
cagguuuucuuuuaagaa

SEQ ID NO: 3504098 - RNA, 15 nt, Human
cagguuuuucaauua

SEQ ID NO: 3504099 - RNA, 19 nt, Human
cagguuuuucaauuaaacg

SEQ ID NO: 3504100 - RNA, 12 nt, Human
cagguuuuuccc

SEQ ID NO: 3504101 - RNA, 13 nt, Human
cagguuuuuccuu

SEQ ID NO: 3504102 - RNA, 15 nt, Human
cagguuuuuccuuuu

SEQ ID NO: 3504103 - RNA, 23 nt, Human
cagguuuuuggucugacccacug

SEQ ID NO: 3504104 - RNA, 21 nt, Human
caguaaaaaaugguguuuuau

SEQ ID NO: 3504105 - RNA, 20 nt, Human
caguaaaauagcugagggaa

SEQ ID NO: 3504106 - RNA, 12 nt, Human
caguaaacacug

SEQ ID NO: 3504107 - RNA, 14 nt, Human
caguaaacacugug

SEQ ID NO: 3504108 - RNA, 15 nt, Human
caguaaacacugugu

SEQ ID NO: 3504109 - RNA, 23 nt, Human
caguaaacgggaacaugcccccu

SEQ ID NO: 3504110 - RNA, 23 nt, Human
caguaaagaacaucccuccuggg

SEQ ID NO: 3504111 - RNA, 14 nt, Human
caguaaagagaaac

SEQ ID NO: 3504112 - RNA, 19 nt, Human
auuuuuauauuaguugcuu

SEQ ID NO: 3504113 - RNA, 14 nt, Human
auuuuuauauuuaa

SEQ ID NO: 3504114 - RNA, 15 nt, Human
auuuuuauauuuagu

SEQ ID NO: 3504115 - RNA, 15 nt, Human
auuuuuauauuugaa

SEQ ID NO: 3504116 - RNA, 18 nt, Human
auuuuuauccaaucuugu

SEQ ID NO: 3504117 - RNA, 19 nt, Human
auuuuuaucuauauaaaau

SEQ ID NO: 3504118 - RNA, 12 nt, Human
auuuuuaucuuu

SEQ ID NO: 3504119 - RNA, 15 nt, Human
auuuuuaucuuucgu

SEQ ID NO: 3504120 - RNA, 14 nt, Human
auuuuuauggaauu

SEQ ID NO: 3504121 - RNA, 15 nt, Human
auuuuuaugugugau

SEQ ID NO: 3504122 - RNA, 18 nt, Human
auuuuuauuacccuucuu

SEQ ID NO: 3504123 - RNA, 22 nt, Human
auuuuuauuaugcauaacugac

SEQ ID NO: 3504124 - RNA, 13 nt, Human
auuuuuauuuaug

SEQ ID NO: 3504125 - RNA, 14 nt, Human
auuuuuauuucuuu

SEQ ID NO: 3504126 - RNA, 21 nt, Human
auuuuuauuuuugcugagacu

SEQ ID NO: 3504127 - RNA, 20 nt, Human
auuuuucaacaaauaucuug

SEQ ID NO: 3504128 - RNA, 17 nt, Human
auuuuucaacuuugaau

SEQ ID NO: 3504129 - RNA, 21 nt, Human
auuuuucaauaaagcauuuau

SEQ ID NO: 3504130 - RNA, 20 nt, Human
auuuuucaauagcacauaug

SEQ ID NO: 3504131 - RNA, 22 nt, Human
auuuuucaauagcacauaugga

SEQ ID NO: 3504132 - RNA, 14 nt, Human
auuuuucaauauau

SEQ ID NO: 3504133 - RNA, 20 nt, Human
auuuuucaauauauugaacu

SEQ ID NO: 3504134 - RNA, 15 nt, Human
auuuuucacauaucu

SEQ ID NO: 3504135 - RNA, 15 nt, Human
auuuuucacuucaaa

SEQ ID NO: 3504136 - RNA, 17 nt, Human
auuuuucagagaauaga

SEQ ID NO: 3504137 - RNA, 14 nt, Human
auuuuucagaugcu

SEQ ID NO: 3504138 - RNA, 15 nt, Human
auuuuucagaugcuu

SEQ ID NO: 3504139 - RNA, 18 nt, Human
auuuuucagaugcuucug

SEQ ID NO: 3504140 - RNA, 18 nt, Human
auuuuucagcucucugua

SEQ ID NO: 3504141 - RNA, 12 nt, Human
auuuuucauauu

SEQ ID NO: 3504142 - RNA, 21 nt, Human
auuuuuccaacuacuaauaga

SEQ ID NO: 3504143 - RNA, 20 nt, Human
auuuuuccuccacugaacua

SEQ ID NO: 3504144 - RNA, 22 nt, Human
auuuuucggaggccccacugau

SEQ ID NO: 3504145 - RNA, 12 nt, Human
auuuuucuaaaa

SEQ ID NO: 3504146 - RNA, 17 nt, Human
auuuuucuaaaaaaaga

SEQ ID NO: 3504147 - RNA, 18 nt, Human
auuuuucuaaccuugaau

SEQ ID NO: 3504148 - RNA, 19 nt, Human
auuuuucucaguuuguaua

SEQ ID NO: 3504149 - RNA, 15 nt, Human
auuuuucucuccugu

SEQ ID NO: 3504150 - RNA, 19 nt, Human
auuuuucucuccuguccuc

SEQ ID NO: 3504151 - RNA, 13 nt, Human
auuuuucugcaga

SEQ ID NO: 3504152 - RNA, 15 nt, Human
auuuuucuuauuuca

SEQ ID NO: 3504153 - RNA, 19 nt, Human
auuuuucuuauuucauuuc

SEQ ID NO: 3504154 - RNA, 20 nt, Human
auuuuucuuauuucauuucu

SEQ ID NO: 3504155 - RNA, 15 nt, Human
auuuuucuuccagga

SEQ ID NO: 3504156 - RNA, 15 nt, Human
auuuuucuuuaacug

SEQ ID NO: 3504157 - RNA, 14 nt, Human
auuuuucuuuacaa

SEQ ID NO: 3504158 - RNA, 18 nt, Human
auuuuugaaacugcauuu

SEQ ID NO: 3504159 - RNA, 12 nt, Human
auuuuugacaga

SEQ ID NO: 3504160 - RNA, 18 nt, Human
auuuuugagcccuuguuu

SEQ ID NO: 3504161 - RNA, 19 nt, Human
auuuuugcaauaccaagua

SEQ ID NO: 3504162 - RNA, 14 nt, Human
auuuuugcaggagc

SEQ ID NO: 3504163 - RNA, 18 nt, Human
auuuuugccauacaucag

SEQ ID NO: 3504164 - RNA, 15 nt, Human
auuuuugccuucauu

SEQ ID NO: 3504165 - RNA, 17 nt, Human
auuuuuggagguuuauu

SEQ ID NO: 3504166 - RNA, 19 nt, Human
auuuuuggagguuuauuac

SEQ ID NO: 3504167 - RNA, 15 nt, Human
auuuuuggauugaca

SEQ ID NO: 3504168 - RNA, 22 nt, Human
auuuuuggugggugaaaggaau

SEQ ID NO: 3504169 - RNA, 19 nt, Human
auuuuugguugaauaaacu

SEQ ID NO: 3504170 - RNA, 18 nt, Human
auuuuuguaaaguuuccg

SEQ ID NO: 3504171 - RNA, 12 nt, Human
auuuuuguaaau

SEQ ID NO: 3504172 - RNA, 19 nt, Human
auuuuuguaaauguguaca

SEQ ID NO: 3504173 - RNA, 20 nt, Human
auuuuuguacaguuugcugu

SEQ ID NO: 3504174 - RNA, 20 nt, Human
auuuuuguagcacugacaga

SEQ ID NO: 3504175 - RNA, 13 nt, Human
caguagagccagc

SEQ ID NO: 3504176 - RNA, 15 nt, Human
caguagagccagcuu

SEQ ID NO: 3504177 - RNA, 15 nt, Human
caguagauugcagaa

SEQ ID NO: 3504178 - RNA, 16 nt, Human
caguagauugcagaaa

SEQ ID NO: 3504179 - RNA, 18 nt, Human
caguagauuuuccaaaug

SEQ ID NO: 3504180 - RNA, 13 nt, Human
caguagauuuucu

SEQ ID NO: 3504181 - RNA, 23 nt, Human
caguagcacaaguuauuuaaauc

SEQ ID NO: 3504182 - RNA, 18 nt, Human
caguagcaguagaugcau

SEQ ID NO: 3504183 - RNA, 14 nt, Human
caguagcugggacc

SEQ ID NO: 3504184 - RNA, 23 nt, Human
caguaggacaaggugcaggcagg

SEQ ID NO: 3504185 - RNA, 15 nt, Human
caguaggagcccagc

SEQ ID NO: 3504186 - RNA, 17 nt, Human
caguaggauaagccacu

SEQ ID NO: 3504187 - RNA, 12 nt, Human
caguaggggagg

SEQ ID NO: 3504188 - RNA, 20 nt, Human
caguagguuauuuagcuugg

SEQ ID NO: 3504189 - RNA, 16 nt, Human
caguagugagaagaau

SEQ ID NO: 3504190 - RNA, 14 nt, Human
caguaguucacaua

SEQ ID NO: 3504191 - RNA, 18 nt, Human
caguaguucucaaagugu

SEQ ID NO: 3504192 - RNA, 15 nt, Human
caguaguuugcauuu

SEQ ID NO: 3504193 - RNA, 18 nt, Human
caguauaaaauuacagug

SEQ ID NO: 3504194 - RNA, 13 nt, Human
caguauaaagaau

SEQ ID NO: 3504195 - RNA, 20 nt, Human
caguauaaccagcugaaguu

SEQ ID NO: 3504196 - RNA, 17 nt, Human
caguauaauuaacaugu

SEQ ID NO: 3504197 - RNA, 21 nt, Human
caguauaauuaacauguuaaa

SEQ ID NO: 3504198 - RNA, 19 nt, Human
caguauaauucuguacuga

SEQ ID NO: 3504199 - RNA, 23 nt, Human
caguauauguuaauuuguguguu

SEQ ID NO: 3504200 - RNA, 13 nt, Human
caguauauuuaua

SEQ ID NO: 3504201 - RNA, 17 nt, Human
caguauauuuuauuuca

SEQ ID NO: 3504202 - RNA, 20 nt, Human
caguauauuuuauuucaaug

SEQ ID NO: 3504203 - RNA, 13 nt, Human
caguaucaugccc

SEQ ID NO: 3504204 - RNA, 16 nt, Human
caguauccacuuugca

SEQ ID NO: 3504205 - RNA, 24 nt, Human
caguauccaugcucuugaccuugu

SEQ ID NO: 3504206 - RNA, 19 nt, Human
caguaucggcacuguacaa

SEQ ID NO: 3504207 - RNA, 20 nt, Human
caguaucggcacuguacaaa

SEQ ID NO: 3504208 - RNA, 21 nt, Human
caguaucuauauauguguaug

SEQ ID NO: 3504209 - RNA, 15 nt, Human
caguaucucagggcc

SEQ ID NO: 3504210 - RNA, 14 nt, Human
caguaucucuucag

SEQ ID NO: 3504211 - RNA, 13 nt, Human
caguaugaaaaua

SEQ ID NO: 3504212 - RNA, 20 nt, Human
caguaugagucaaugugcag

SEQ ID NO: 3504213 - RNA, 15 nt, Human
caguaugauuuauaa

SEQ ID NO: 3504214 - RNA, 17 nt, Human
caguaugcuugcucuaa

SEQ ID NO: 3504215 - RNA, 23 nt, Human
caguauggggguuguaaauuggc

SEQ ID NO: 3504216 - RNA, 17 nt, Human
caguauguauucuuuug

SEQ ID NO: 3504217 - RNA, 19 nt, Human
caguaugugggauauugaa

SEQ ID NO: 3504218 - RNA, 18 nt, Human
caguauguugucaaagag

SEQ ID NO: 3504219 - RNA, 16 nt, Human
caguauguuuuacacu

SEQ ID NO: 3504220 - RNA, 18 nt, Human
caguauguuuuacacugu

SEQ ID NO: 3504221 - RNA, 20 nt, Human
caguauuaauacuaaaauau

SEQ ID NO: 3504222 - RNA, 22 nt, Human
caguauuaauacuaaaauaugu

SEQ ID NO: 3504223 - RNA, 18 nt, Human
caguauuacuucugcuac

SEQ ID NO: 3504224 - RNA, 12 nt, Human
caguauuaugua

SEQ ID NO: 3504225 - RNA, 15 nt, Human
caguauucuagguag

SEQ ID NO: 3504226 - RNA, 19 nt, Human
caguauucuugucaaaaaa

SEQ ID NO: 3504227 - RNA, 12 nt, Human
caguauugaagc

SEQ ID NO: 3504228 - RNA, 15 nt, Human
caguauugaagcauu

SEQ ID NO: 3504229 - RNA, 16 nt, Human
caguauugaagcauuu

SEQ ID NO: 3504230 - RNA, 20 nt, Human
caguauugaagcauuuuaua

SEQ ID NO: 3504231 - RNA, 15 nt, Human
caguauugcucaccc

SEQ ID NO: 3504232 - RNA, 21 nt, Human
caguauugcucacccagugcc

SEQ ID NO: 3504233 - RNA, 13 nt, Human
caguauuguacaa

SEQ ID NO: 3504234 - RNA, 17 nt, Human
caguauuguacaaagua

SEQ ID NO: 3504235 - RNA, 18 nt, Human
caguauuguacaaaguau

SEQ ID NO: 3504236 - RNA, 13 nt, Human
caguauuuaacua

SEQ ID NO: 3504237 - RNA, 16 nt, Human
caguauuuaacuucug

SEQ ID NO: 3504238 - RNA, 11 nt, Human
caguauuucag

SEQ ID NO: 3504239 - RNA, 15 nt, Human
caguauuucagacug

SEQ ID NO: 3504240 - RNA, 14 nt, Human
caguauuuguaauu

SEQ ID NO: 3504241 - RNA, 23 nt, Human
caguauuuguaauuaaaagcaaa

SEQ ID NO: 3504242 - RNA, 14 nt, Human
caguauuuuggaga

SEQ ID NO: 3504243 - RNA, 19 nt, Human
cagucaaaacagagaugug

SEQ ID NO: 3504244 - RNA, 16 nt, Human
cagucaaccugggcaa

SEQ ID NO: 3504245 - RNA, 21 nt, Human
cagucaaccugggcaaagccu

SEQ ID NO: 3504246 - RNA, 13 nt, Human
cagucaagaagaa

SEQ ID NO: 3504247 - RNA, 20 nt, Human
cagucaagaagaaaaagguu

SEQ ID NO: 3504248 - RNA, 16 nt, Human
cagucaagcuguugaa

SEQ ID NO: 3504249 - RNA, 17 nt, Human
cagucaaggaguggcuu

SEQ ID NO: 3504250 - RNA, 13 nt, Human
cagucacagccac

SEQ ID NO: 3504251 - RNA, 14 nt, Human
cagucacagccacc

SEQ ID NO: 3504252 - RNA, 17 nt, Human
cagucaccccggccacc

SEQ ID NO: 3504253 - RNA, 20 nt, Human
cagucaccccggccaccugc

SEQ ID NO: 3504254 - RNA, 12 nt, Human
cagucacugcuc

SEQ ID NO: 3504255 - RNA, 23 nt, Human
cagucacuggagguugaagccaa

SEQ ID NO: 3504256 - RNA, 21 nt, Human
cagucacugucccucaaauga

SEQ ID NO: 3504257 - RNA, 22 nt, Human
cagucacuucggccagagcuga

SEQ ID NO: 3504258 - RNA, 14 nt, Human
caaggauccugagc

SEQ ID NO: 3504259 - RNA, 16 nt, Human
caaggauccugagcca

SEQ ID NO: 3504260 - RNA, 15 nt, Human
caaggauugaaaauu

SEQ ID NO: 3504261 - RNA, 19 nt, Human
caaggauugcuacuguccu

SEQ ID NO: 3504262 - RNA, 17 nt, Human
caaggcaaggcugucaa

SEQ ID NO: 3504263 - RNA, 20 nt, Human
caaggcaaggggugccuggg

SEQ ID NO: 3504264 - RNA, 13 nt, Human
caaggcaccugca

SEQ ID NO: 3504265 - RNA, 19 nt, Human
caaggcaccugcagguugg

SEQ ID NO: 3504266 - RNA, 12 nt, Human
caaggcacugcc

SEQ ID NO: 3504267 - RNA, 14 nt, Human
caaggcacugccug

SEQ ID NO: 3504268 - RNA, 20 nt, Human
caaggcacuugagggggaag

SEQ ID NO: 3504269 - RNA, 13 nt, Human
caaggcaggugcc

SEQ ID NO: 3504270 - RNA, 15 nt, Human
caaggcaggugccuc

SEQ ID NO: 3504271 - RNA, 17 nt, Human
caaggcaggugccucca

SEQ ID NO: 3504272 - RNA, 18 nt, Human
caaggcaggugccuccag

SEQ ID NO: 3504273 - RNA, 19 nt, Human
caaggcaggugccuccagg

SEQ ID NO: 3504274 - RNA, 16 nt, Human
caaggccaaaggaagc

SEQ ID NO: 3504275 - RNA, 20 nt, Human
caaggccaaaggaagcacau

SEQ ID NO: 3504276 - RNA, 20 nt, Human
caaggccaccucuuccuggc

SEQ ID NO: 3504277 - RNA, 21 nt, Human
caaggccaccucuuccuggcc

SEQ ID NO: 3504278 - RNA, 19 nt, Human
caaggccagcaagguggag

SEQ ID NO: 3504279 - RNA, 17 nt, Human
caaggccccagagacuc

SEQ ID NO: 3504280 - RNA, 21 nt, Human
caaggccccagagacucagag

SEQ ID NO: 3504281 - RNA, 22 nt, Human
caaggcccccgggccgacggag

SEQ ID NO: 3504282 - RNA, 20 nt, Human
caaggcccccugccugcccu

SEQ ID NO: 3504283 - RNA, 13 nt, Human
caaggcccgagca

SEQ ID NO: 3504284 - RNA, 16 nt, Human
caaggcccgagcagcu

SEQ ID NO: 3504285 - RNA, 17 nt, Human
caaggcccugcugccca

SEQ ID NO: 3504286 - RNA, 17 nt, Human
caaggccgaagcucugg

SEQ ID NO: 3504287 - RNA, 20 nt, Human
caaggccgcuguucacccac

SEQ ID NO: 3504288 - RNA, 16 nt, Human
caaggccucccacagu

SEQ ID NO: 3504289 - RNA, 18 nt, Human
caaggccucccacaguga

SEQ ID NO: 3504290 - RNA, 16 nt, Human
caaggccugucccugg

SEQ ID NO: 3504291 - RNA, 22 nt, Human
caaggccuuauuggaaagcagu

SEQ ID NO: 3504292 - RNA, 15 nt, Human
caaggcggccccucc

SEQ ID NO: 3504293 - RNA, 19 nt, Human
caaggcguccgcgcgccag

SEQ ID NO: 3504294 - RNA, 22 nt, Human
caaggcguccgcgcgccagcac

SEQ ID NO: 3504295 - RNA, 16 nt, Human
caaggcgugaggaugg

SEQ ID NO: 3504296 - RNA, 21 nt, Human
caaggcugaccaagagagaaa

SEQ ID NO: 3504297 - RNA, 17 nt, Human
caaggcugcagugagcc

SEQ ID NO: 3504298 - RNA, 18 nt, Human
caaggcugcgguuuguug

SEQ ID NO: 3504299 - RNA, 14 nt, Human
caaggcugcgucug

SEQ ID NO: 3504300 - RNA, 16 nt, Human
caaggcugcuuagaau

SEQ ID NO: 3504301 - RNA, 15 nt, Human
caaggcugugcaucu

SEQ ID NO: 3504302 - RNA, 18 nt, Human
caaggcugugcucccugg

SEQ ID NO: 3504303 - RNA, 14 nt, Human
caaggcuguugcau

SEQ ID NO: 3504304 - RNA, 15 nt, Human
caaggcuuagacccu

SEQ ID NO: 3504305 - RNA, 18 nt, Human
caaggcuuagacccucau

SEQ ID NO: 3504306 - RNA, 18 nt, Human
caaggcuuauauucaacc

SEQ ID NO: 3504307 - RNA, 15 nt, Human
caaggcuugcugcag

SEQ ID NO: 3504308 - RNA, 21 nt, Human
caagggaaaggggugcuuuua

SEQ ID NO: 3504309 - RNA, 19 nt, Human
caagggacaaggacacgcg

SEQ ID NO: 3504310 - RNA, 14 nt, Human
caagggagagaccu

SEQ ID NO: 3504311 - RNA, 15 nt, Human
caagggagagaccuc

SEQ ID NO: 3504312 - RNA, 19 nt, Human
caagggagagaccucauca

SEQ ID NO: 3504313 - RNA, 20 nt, Human
caagggagagaccucaucag

SEQ ID NO: 3504314 - RNA, 15 nt, Human
caagggaggcccagc

SEQ ID NO: 3504315 - RNA, 16 nt, Human
caagggaggcccagcg

SEQ ID NO: 3504316 - RNA, 21 nt, Human
caagggaucugguccuaccca

SEQ ID NO: 3504317 - RNA, 22 nt, Human
caagggaugaauuguaaaagca

SEQ ID NO: 3504318 - RNA, 17 nt, Human
caauuugucauuuugaa

SEQ ID NO: 3504319 - RNA, 18 nt, Human
caauuuguuugugcuucu

SEQ ID NO: 3504320 - RNA, 13 nt, Human
caauuuuaaagac

SEQ ID NO: 3504321 - RNA, 20 nt, Human
caauuuuaacacacauaaag

SEQ ID NO: 3504322 - RNA, 18 nt, Human
caauuuuaauuuaguaaa

SEQ ID NO: 3504323 - RNA, 23 nt, Human
caauuuuaauuuaguaaauguua

SEQ ID NO: 3504324 - RNA, 21 nt, Human
caauuuuaucccucaccugua

SEQ ID NO: 3504325 - RNA, 12 nt, Human
caauuuucaggu

SEQ ID NO: 3504326 - RNA, 11 nt, Human
caauuuuccuu

SEQ ID NO: 3504327 - RNA, 13 nt, Human
caauuuuccuuga

SEQ ID NO: 3504328 - RNA, 14 nt, Human
caauuuuccuugaa

SEQ ID NO: 3504329 - RNA, 19 nt, Human
caauuuuccuugaagccga

SEQ ID NO: 3504330 - RNA, 14 nt, Human
caauuuuguuucug

SEQ ID NO: 3504331 - RNA, 12 nt, Human
caauuuuuaaug

SEQ ID NO: 3504332 - RNA, 13 nt, Human
caauuuuuauauu

SEQ ID NO: 3504333 - RNA, 11 nt, Human
caauuuuucca

SEQ ID NO: 3504334 - RNA, 22 nt, Human
caauuuuucuuauuucauuucu

SEQ ID NO: 3504335 - RNA, 15 nt, Human
caauuuuugccuuca

SEQ ID NO: 3504336 - RNA, 21 nt, Human
caauuuuuuaucaugcauguc

SEQ ID NO: 3504337 - RNA, 18 nt, Human
caauuuuuuguucuucag

SEQ ID NO: 3504338 - RNA, 20 nt, Human
caauuuuuuuuauuaguauu

SEQ ID NO: 3504339 - RNA, 22 nt, Human
cacaaaaaaaguugaaggccuu

SEQ ID NO: 3504340 - RNA, 22 nt, Human
cacaaaaagauaccuuaaaauu

SEQ ID NO: 3504341 - RNA, 14 nt, Human
cacaaaaauguuga

SEQ ID NO: 3504342 - RNA, 16 nt, Human
cacaaaaauguugaac

SEQ ID NO: 3504343 - RNA, 19 nt, Human
cacaaaaauguugaaccaa

SEQ ID NO: 3504344 - RNA, 22 nt, Human
cacaaaacaaaugccacacauc

SEQ ID NO: 3504345 - RNA, 13 nt, Human
cacaaaacagccu

SEQ ID NO: 3504346 - RNA, 22 nt, Human
cacaaaacuccgcccccagccu

SEQ ID NO: 3504347 - RNA, 14 nt, Human
cacaaaagccucuc

SEQ ID NO: 3504348 - RNA, 15 nt, Human
cacaaaauauacaaa

SEQ ID NO: 3504349 - RNA, 13 nt, Human
cacaaaauucaaa

SEQ ID NO: 3504350 - RNA, 20 nt, Human
cacaaaauucgaccugauuu

SEQ ID NO: 3504351 - RNA, 14 nt, Human
cacaaacaaacaag

SEQ ID NO: 3504352 - RNA, 18 nt, Human
cacaaacaaacaagcuag

SEQ ID NO: 3504353 - RNA, 16 nt, Human
cacaaacacaagguca

SEQ ID NO: 3504354 - RNA, 21 nt, Human
cacaaacacauuguuauuuuc

SEQ ID NO: 3504355 - RNA, 12 nt, Human
cacaaacauuuu

SEQ ID NO: 3504356 - RNA, 13 nt, Human
cacaaacauuuuu

SEQ ID NO: 3504357 - RNA, 15 nt, Human
cacaaacauuuuuca

SEQ ID NO: 3504358 - RNA, 18 nt, Human
cacaaaccacaacugaca

SEQ ID NO: 3504359 - RNA, 19 nt, Human
cacaaaccacaacugacac

SEQ ID NO: 3504360 - RNA, 15 nt, Human
cacaaaccugccugg

SEQ ID NO: 3504361 - RNA, 17 nt, Human
cacaaacgggcucagca

SEQ ID NO: 3504362 - RNA, 22 nt, Human
cacaaacguauguaaauguaua

SEQ ID NO: 3504363 - RNA, 22 nt, Human
cacaaacugcuuccuuucuuga

SEQ ID NO: 3504364 - RNA, 12 nt, Human
cacaaacuguaa

SEQ ID NO: 3504365 - RNA, 13 nt, Human
cacaaacuguaaa

SEQ ID NO: 3504366 - RNA, 14 nt, Human
cacaaacuguaaau

SEQ ID NO: 3504367 - RNA, 15 nt, Human
cacaaacuguaaaua

SEQ ID NO: 3504368 - RNA, 23 nt, Human
cacaaacuguaaauaaaaagaaa

SEQ ID NO: 3504369 - RNA, 19 nt, Human
cacaaacuuuuauacucuu

SEQ ID NO: 3504370 - RNA, 18 nt, Human
cacaaagagaaaaagaaa

SEQ ID NO: 3504371 - RNA, 15 nt, Human
cacaaagaguucugg

SEQ ID NO: 3504372 - RNA, 22 nt, Human
cacaaagcacaguuugaacaaa

SEQ ID NO: 3504373 - RNA, 15 nt, Human
cacaaagcagauccu

SEQ ID NO: 3504374 - RNA, 20 nt, Human
cacaaaggcaaaggguccag

SEQ ID NO: 3504375 - RNA, 13 nt, Human
cacaaagggccca

SEQ ID NO: 3504376 - RNA, 15 nt, Human
cacaaagggcccaga

SEQ ID NO: 3504377 - RNA, 17 nt, Human
cacaaauauuaaaaagu

SEQ ID NO: 3504378 - RNA, 13 nt, Human
cacaaaugacuuu

SEQ ID NO: 3504379 - RNA, 14 nt, Human
cacaaauuaguuau

SEQ ID NO: 3504380 - RNA, 20 nt, Human
cacaaauuaugcuaagaauu

SEQ ID NO: 3504381 - RNA, 22 nt, Human
cacaacaaaaauuugaaccaaa

SEQ ID NO: 3504382 - RNA, 11 nt, Human
cacaacagauu

SEQ ID NO: 3504383 - RNA, 19 nt, Human
cacaacauuugcagauguu

SEQ ID NO: 3504384 - RNA, 23 nt, Human
cacaaccaccguuacaaguauac

SEQ ID NO: 3504385 - RNA, 20 nt, Human
cacaacccaucuaccccugg

SEQ ID NO: 3504386 - RNA, 14 nt, Human
cacaacccccagcu

SEQ ID NO: 3504387 - RNA, 17 nt, Human
cacaacccuguuuuaua

SEQ ID NO: 3504388 - RNA, 15 nt, Human
cacaaccugcaucuu

SEQ ID NO: 3504389 - RNA, 17 nt, Human
cacaaccuucuguggcu

SEQ ID NO: 3504390 - RNA, 18 nt, Human
cacaaccuucuguggcuc

SEQ ID NO: 3504391 - RNA, 19 nt, Human
cacaaccuucuguggcuca

SEQ ID NO: 3504392 - RNA, 16 nt, Human
cacaacgugcaacuga

SEQ ID NO: 3504393 - RNA, 19 nt, Human
cacaacgugcauugugcuu

SEQ ID NO: 3504394 - RNA, 22 nt, Human
cacaacucacuccuuuuaaaga

SEQ ID NO: 3504395 - RNA, 12 nt, Human
cacaacugacac

SEQ ID NO: 3504396 - RNA, 13 nt, Human
cacaacugacaca

SEQ ID NO: 3504397 - RNA, 20 nt, Human
cacaacugcaauaacuucug

SEQ ID NO: 3504398 - RNA, 21 nt, Human
cacaacugcaauaacuucuga

SEQ ID NO: 3504399 - RNA, 19 nt, Human
cacaacugugugauuaaaa

SEQ ID NO: 3504400 - RNA, 13 nt, Human
cacaacuuaaaaa

SEQ ID NO: 3504401 - RNA, 17 nt, Human
cacaacuuaguguaaua

SEQ ID NO: 3504402 - RNA, 12 nt, Human
cacaacuuguuu

SEQ ID NO: 3504403 - RNA, 21 nt, Human
caauaaaaugugauuuuucug

SEQ ID NO: 3504404 - RNA, 22 nt, Human
caauaaaaugugauuuuucuga

SEQ ID NO: 3504405 - RNA, 13 nt, Human
caauaaaauuaua

SEQ ID NO: 3504406 - RNA, 20 nt, Human
caauaaaauuuuuuuggucu

SEQ ID NO: 3504407 - RNA, 19 nt, Human
caauaaaauuuuuuuucau

SEQ ID NO: 3504408 - RNA, 21 nt, Human
caauaaacaacagcugaagca

SEQ ID NO: 3504409 - RNA, 19 nt, Human
caauaaaccaaugaacgaa

SEQ ID NO: 3504410 - RNA, 13 nt, Human
caauaaaccaggu

SEQ ID NO: 3504411 - RNA, 23 nt, Human
caauaaaccagguuuagacagua

SEQ ID NO: 3504412 - RNA, 23 nt, Human
caauaaaccuccgccaaugcacg

SEQ ID NO: 3504413 - RNA, 16 nt, Human
caauaaacgauuuaau

SEQ ID NO: 3504414 - RNA, 12 nt, Human
caauaaagaaaa

SEQ ID NO: 3504415 - RNA, 22 nt, Human
caauaaagaguuagaaugaaaa

SEQ ID NO: 3504416 - RNA, 15 nt, Human
caauaaagcugcuga

SEQ ID NO: 3504417 - RNA, 23 nt, Human
caauaaagcugcugagaaucuag

SEQ ID NO: 3504418 - RNA, 16 nt, Human
caauaaaguauaaugu

SEQ ID NO: 3504419 - RNA, 20 nt, Human
caauaaaguauaauguuuau

SEQ ID NO: 3504420 - RNA, 12 nt, Human
caauaaaguauc

SEQ ID NO: 3504421 - RNA, 14 nt, Human
caauaaagugaccc

SEQ ID NO: 3504422 - RNA, 13 nt, Human
caauaaaguuuga

SEQ ID NO: 3504423 - RNA, 14 nt, Human
caauaaaguuugau

SEQ ID NO: 3504424 - RNA, 13 nt, Human
caauaaauagaca

SEQ ID NO: 3504425 - RNA, 17 nt, Human
caauaaauagacacgca

SEQ ID NO: 3504426 - RNA, 18 nt, Human
caauaaaucugacccagu

SEQ ID NO: 3504427 - RNA, 20 nt, Human
caauaaaucugacccagugc

SEQ ID NO: 3504428 - RNA, 12 nt, Human
caauaaaugaau

SEQ ID NO: 3504429 - RNA, 15 nt, Human
caauaaauggcugua

SEQ ID NO: 3504430 - RNA, 14 nt, Human
caauaaauuuugaa

SEQ ID NO: 3504431 - RNA, 16 nt, Human
caauaaauuuugaaaa

SEQ ID NO: 3504432 - RNA, 17 nt, Human
caauaaauuuugaaaag

SEQ ID NO: 3504433 - RNA, 22 nt, Human
caauaaauuuugaaaaguaaua

SEQ ID NO: 3504434 - RNA, 13 nt, Human
caauaacagcugc

SEQ ID NO: 3504435 - RNA, 21 nt, Human
caauaacuacuguguuccugg

SEQ ID NO: 3504436 - RNA, 16 nt, Human
caauaacuucugaccu

SEQ ID NO: 3504437 - RNA, 18 nt, Human
caauaagaacaaauacaa

SEQ ID NO: 3504438 - RNA, 19 nt, Human
caauaagcaucaaacucuu

SEQ ID NO: 3504439 - RNA, 17 nt, Human
caauaaggucaaugcca

SEQ ID NO: 3504440 - RNA, 21 nt, Human
caauaagugugugguagaaac

SEQ ID NO: 3504441 - RNA, 24 nt, Human
caauaauaaaaaauauucuuguca

SEQ ID NO: 3504442 - RNA, 18 nt, Human
caauaauaauaccucccu

SEQ ID NO: 3504443 - RNA, 17 nt, Human
caauaauauauuuucug

SEQ ID NO: 3504444 - RNA, 23 nt, Human
caauaauauuguuguauaauuuc

SEQ ID NO: 3504445 - RNA, 13 nt, Human
caauaaugcagua

SEQ ID NO: 3504446 - RNA, 23 nt, Human
caauaaugcaguaugguacauuu

SEQ ID NO: 3504447 - RNA, 23 nt, Human
caauaauggaaaaaaaaaaaaga

SEQ ID NO: 3504448 - RNA, 17 nt, Human
caauaauggucccaucc

SEQ ID NO: 3504449 - RNA, 19 nt, Human
caauaauggucccauccag

SEQ ID NO: 3504450 - RNA, 20 nt, Human
caauaauggucccauccagg

SEQ ID NO: 3504451 - RNA, 13 nt, Human
caauacaaaugga

SEQ ID NO: 3504452 - RNA, 16 nt, Human
caauacaaguuucauc

SEQ ID NO: 3504453 - RNA, 21 nt, Human
caauacaaguuucauccagaa

SEQ ID NO: 3504454 - RNA, 13 nt, Human
caauacagauaua

SEQ ID NO: 3504455 - RNA, 16 nt, Human
caauacagauauauuu

SEQ ID NO: 3504456 - RNA, 17 nt, Human
caauacaguacaggcag

SEQ ID NO: 3504457 - RNA, 18 nt, Human
caauacaguacaggcagc

SEQ ID NO: 3504458 - RNA, 23 nt, Human
caauacaucccuuaccugggaaa

SEQ ID NO: 3504459 - RNA, 14 nt, Human
caauaccccaugga

SEQ ID NO: 3504460 - RNA, 17 nt, Human
caauaccugaaugcucu

SEQ ID NO: 3504461 - RNA, 17 nt, Human
caauacuagucacccca

SEQ ID NO: 3504462 - RNA, 16 nt, Human
caauagacacauacau

SEQ ID NO: 3504463 - RNA, 15 nt, Human
caauagagacuguag

SEQ ID NO: 3504464 - RNA, 16 nt, Human
caauagagacuguaga

SEQ ID NO: 3504465 - RNA, 16 nt, Human
caauagaucuccagcg

SEQ ID NO: 3504466 - RNA, 19 nt, Human
caauagauugcucaaauca

SEQ ID NO: 3504467 - RNA, 19 nt, Human
caauagcaacguagcuucu

SEQ ID NO: 3504468 - RNA, 17 nt, Human
caauagcacauauggaa

SEQ ID NO: 3504469 - RNA, 20 nt, Human
caauagcacuuucauugcca

SEQ ID NO: 3504470 - RNA, 21 nt, Human
caauagcacuuucauugccag

SEQ ID NO: 3504471 - RNA, 19 nt, Human
caauagcagacaguguuuu

SEQ ID NO: 3504472 - RNA, 21 nt, Human
caauagcccaggauauauuuu

SEQ ID NO: 3504473 - RNA, 23 nt, Human
caauagccgauaucagaauuugu

SEQ ID NO: 3504474 - RNA, 16 nt, Human
caauagcguguguaga

SEQ ID NO: 3504475 - RNA, 15 nt, Human
caauaggaaaaacug

SEQ ID NO: 3504476 - RNA, 16 nt, Human
caauaggaaaaacuga

SEQ ID NO: 3504477 - RNA, 15 nt, Human
caauagguaaagcua

SEQ ID NO: 3504478 - RNA, 17 nt, Human
caauagucaaauugugu

SEQ ID NO: 3504479 - RNA, 19 nt, Human
caauagucaaauuguguga

SEQ ID NO: 3504480 - RNA, 22 nt, Human
caauaguguccuaugcaauaaa

SEQ ID NO: 3504481 - RNA, 15 nt, Human
caauaguguguucug

SEQ ID NO: 3504482 - RNA, 17 nt, Human
caauaguguguucugau

SEQ ID NO: 3504483 - RNA, 23 nt, Human
caauaguguguucugauuagaaa

SEQ ID NO: 3504484 - RNA, 22 nt, Human
caauaguucaaggaacuugaaa

SEQ ID NO: 3504485 - RNA, 22 nt, Human
caauauaaaacuguacuucacu

SEQ ID NO: 3504486 - RNA, 14 nt, Human
caauauaagagcuu

SEQ ID NO: 3504487 - RNA, 20 nt, Human
caauauagaaaaauaaaaau

SEQ ID NO: 3504488 - RNA, 16 nt, Human
cacacuuccaccagcc

SEQ ID NO: 3504489 - RNA, 14 nt, Human
cacacuucucagga

SEQ ID NO: 3504490 - RNA, 23 nt, Human
cacacuucucaggacacaggccu

SEQ ID NO: 3504491 - RNA, 22 nt, Human
cacacuucugugagacccccac

SEQ ID NO: 3504492 - RNA, 21 nt, Human
cacacuugacaucaacugcau

SEQ ID NO: 3504493 - RNA, 21 nt, Human
cacacuuggcccaaguggcag

SEQ ID NO: 3504494 - RNA, 22 nt, Human
cacacuuguaggauaagugaaa

SEQ ID NO: 3504495 - RNA, 17 nt, Human
cacacuugucggcucca

SEQ ID NO: 3504496 - RNA, 23 nt, Human
cacacuugucggcuccagucccc

SEQ ID NO: 3504497 - RNA, 16 nt, Human
cacacuuguuccagcu

SEQ ID NO: 3504498 - RNA, 19 nt, Human
cacacuuguuccagcucuu

SEQ ID NO: 3504499 - RNA, 15 nt, Human
cacacuuuggcccag

SEQ ID NO: 3504500 - RNA, 14 nt, Human
cacagaaaacuaga

SEQ ID NO: 3504501 - RNA, 13 nt, Human
cacagaaaagcau

SEQ ID NO: 3504502 - RNA, 14 nt, Human
cacagaaaagcaua

SEQ ID NO: 3504503 - RNA, 15 nt, Human
cacagaaaauauacu

SEQ ID NO: 3504504 - RNA, 16 nt, Human
cacagaaacacugccu

SEQ ID NO: 3504505 - RNA, 19 nt, Human
cacagaaacacugccuuuu

SEQ ID NO: 3504506 - RNA, 20 nt, Human
cacagaaacacugccuuuuu

SEQ ID NO: 3504507 - RNA, 22 nt, Human
cacagaaagacugagcucaagg

SEQ ID NO: 3504508 - RNA, 12 nt, Human
cacagaaagccu

SEQ ID NO: 3504509 - RNA, 18 nt, Human
cacagaaagccuaucaaa

SEQ ID NO: 3504510 - RNA, 12 nt, Human
cacagaaauaua

SEQ ID NO: 3504511 - RNA, 13 nt, Human
cacagaaauauau

SEQ ID NO: 3504512 - RNA, 14 nt, Human
cacagaaaugcugc

SEQ ID NO: 3504513 - RNA, 19 nt, Human
cacagaaaugcugcuggcc

SEQ ID NO: 3504514 - RNA, 22 nt, Human
cacagaaaugcugcuggccaaa

SEQ ID NO: 3504515 - RNA, 20 nt, Human
cacagaagacuucccagcuu

SEQ ID NO: 3504516 - RNA, 13 nt, Human
cacagaagaugaa

SEQ ID NO: 3504517 - RNA, 16 nt, Human
cacagaagccaggagc

SEQ ID NO: 3504518 - RNA, 19 nt, Human
cacagaaggggacugccac

SEQ ID NO: 3504519 - RNA, 19 nt, Human
cacagaagugcuuucuucu

SEQ ID NO: 3504520 - RNA, 13 nt, Human
cacagacacacac

SEQ ID NO: 3504521 - RNA, 18 nt, Human
cacagacacacacacgca

SEQ ID NO: 3504522 - RNA, 22 nt, Human
cacagacacuaacgaaauauca

SEQ ID NO: 3504523 - RNA, 15 nt, Human
cacagacaggacccc

SEQ ID NO: 3504524 - RNA, 21 nt, Human
cacagacagguuuucacauaa

SEQ ID NO: 3504525 - RNA, 19 nt, Human
cacagacauacuaaccagc

SEQ ID NO: 3504526 - RNA, 20 nt, Human
cacagacauucugccaggcc

SEQ ID NO: 3504527 - RNA, 14 nt, Human
cacagacccugccc

SEQ ID NO: 3504528 - RNA, 16 nt, Human
cacagaccuggagccc

SEQ ID NO: 3504529 - RNA, 22 nt, Human
cacagaccuggagccccugggu

SEQ ID NO: 3504530 - RNA, 23 nt, Human
cacagaccuggagccccugggug

SEQ ID NO: 3504531 - RNA, 19 nt, Human
cacagacgccuuacuggca

SEQ ID NO: 3504532 - RNA, 23 nt, Human
cacagacggaaggguaaacaaua

SEQ ID NO: 3504533 - RNA, 20 nt, Human
cacagacuggagacaaugca

SEQ ID NO: 3504534 - RNA, 23 nt, Human
cacagacuguugucccugcacuc

SEQ ID NO: 3504535 - RNA, 22 nt, Human
cacagagaagacaaaauuagca

SEQ ID NO: 3504536 - RNA, 16 nt, Human
cacagagacauuccuc

SEQ ID NO: 3504537 - RNA, 14 nt, Human
cacagagacccccg

SEQ ID NO: 3504538 - RNA, 18 nt, Human
cacagagagggagagcag

SEQ ID NO: 3504539 - RNA, 10 nt, Human
cacagagagu

SEQ ID NO: 3504540 - RNA, 12 nt, Human
cacagagagucc

SEQ ID NO: 3504541 - RNA, 17 nt, Human
cacagagauucugaacu

SEQ ID NO: 3504542 - RNA, 21 nt, Human
cacagagcacuagguucaauu

SEQ ID NO: 3504543 - RNA, 20 nt, Human
cacagagccaaauugguaga

SEQ ID NO: 3504544 - RNA, 14 nt, Human
cacagagcggggac

SEQ ID NO: 3504545 - RNA, 13 nt, Human
cacagaggaagag

SEQ ID NO: 3504546 - RNA, 19 nt, Human
cacagaggacacagagaag

SEQ ID NO: 3504547 - RNA, 19 nt, Human
caccaacccaucagaagga

SEQ ID NO: 3504548 - RNA, 16 nt, Human
caccaacccucagggc

SEQ ID NO: 3504549 - RNA, 15 nt, Human
caccaacuuacaaaa

SEQ ID NO: 3504550 - RNA, 22 nt, Human
caccaagacuuguuuuaugcuc

SEQ ID NO: 3504551 - RNA, 13 nt, Human
caccaagcacagc

SEQ ID NO: 3504552 - RNA, 15 nt, Human
caccaagcacagcag

SEQ ID NO: 3504553 - RNA, 17 nt, Human
caccaagcacagcagcc

SEQ ID NO: 3504554 - RNA, 23 nt, Human
caccaagcccacaggugucccca

SEQ ID NO: 3504555 - RNA, 16 nt, Human
caccaagccuggucag

SEQ ID NO: 3504556 - RNA, 13 nt, Human
caccaagccuuga

SEQ ID NO: 3504557 - RNA, 15 nt, Human
caccaagcucacagu

SEQ ID NO: 3504558 - RNA, 19 nt, Human
caccaagcucacaguuccu

SEQ ID NO: 3504559 - RNA, 13 nt, Human
caccaagcugcug

SEQ ID NO: 3504560 - RNA, 14 nt, Human
caccaagcugugcc

SEQ ID NO: 3504561 - RNA, 18 nt, Human
caccaagcugugccaccc

SEQ ID NO: 3504562 - RNA, 20 nt, Human
caccaagcugugccacccug

SEQ ID NO: 3504563 - RNA, 11 nt, Human
caccaaggaaa

SEQ ID NO: 3504564 - RNA, 12 nt, Human
caccaaggaaac

SEQ ID NO: 3504565 - RNA, 19 nt, Human
caccaagggcgcaagagua

SEQ ID NO: 3504566 - RNA, 21 nt, Human
caccaaggucuucagccauca

SEQ ID NO: 3504567 - RNA, 22 nt, Human
caccaagugcggguccggcagc

SEQ ID NO: 3504568 - RNA, 22 nt, Human
caccaauguacccaccgggcca

SEQ ID NO: 3504569 - RNA, 23 nt, Human
caccaauguuucaagaggagccc

SEQ ID NO: 3504570 - RNA, 18 nt, Human
caccaauugauuuuaaac

SEQ ID NO: 3504571 - RNA, 12 nt, Human
caccacaaaaua

SEQ ID NO: 3504572 - RNA, 12 nt, Human
caccacacacaa

SEQ ID NO: 3504573 - RNA, 13 nt, Human
caccacacacaac

SEQ ID NO: 3504574 - RNA, 16 nt, Human
caccacacaucccagc

SEQ ID NO: 3504575 - RNA, 19 nt, Human
caccacacccagcccacuu

SEQ ID NO: 3504576 - RNA, 19 nt, Human
caccacacugauccagccc

SEQ ID NO: 3504577 - RNA, 16 nt, Human
caccacagacacacac

SEQ ID NO: 3504578 - RNA, 21 nt, Human
caccacagacacacacacgca

SEQ ID NO: 3504579 - RNA, 17 nt, Human
caccacagccagcaccu

SEQ ID NO: 3504580 - RNA, 17 nt, Human
caccacaguaaguuccu

SEQ ID NO: 3504581 - RNA, 18 nt, Human
caccacaugugcacaugc

SEQ ID NO: 3504582 - RNA, 21 nt, Human
caccaccaaaugccaagaaaa

SEQ ID NO: 3504583 - RNA, 13 nt, Human
caccaccacaccc

SEQ ID NO: 3504584 - RNA, 14 nt, Human
caccaccaccccua

SEQ ID NO: 3504585 - RNA, 18 nt, Human
caccaccacgguggucac

SEQ ID NO: 3504586 - RNA, 13 nt, Human
caccaccacuggc

SEQ ID NO: 3504587 - RNA, 15 nt, Human
caccaccacuggcca

SEQ ID NO: 3504588 - RNA, 16 nt, Human
caccaccccaacaaac

SEQ ID NO: 3504589 - RNA, 14 nt, Human
caccaccccccacu

SEQ ID NO: 3504590 - RNA, 22 nt, Human
caccacccuagucccuuccccu

SEQ ID NO: 3504591 - RNA, 13 nt, Human
caccaccucagag

SEQ ID NO: 3504592 - RNA, 13 nt, Human
caccaccucugug

SEQ ID NO: 3504593 - RNA, 14 nt, Human
caccaccucugugg

SEQ ID NO: 3504594 - RNA, 13 nt, Human
caccaccuuccca

SEQ ID NO: 3504595 - RNA, 16 nt, Human
caccaccuucccagcu

SEQ ID NO: 3504596 - RNA, 18 nt, Human
caccaccuucuucuccua

SEQ ID NO: 3504597 - RNA, 20 nt, Human
caccacgauguggcccuggc

SEQ ID NO: 3504598 - RNA, 19 nt, Human
caccacgcuggggucuggg

SEQ ID NO: 3504599 - RNA, 22 nt, Human
caccacggaccaaagggagucu

SEQ ID NO: 3504600 - RNA, 17 nt, Human
caccacgguagugccug

SEQ ID NO: 3504601 - RNA, 15 nt, Human
caccacuagccucag

SEQ ID NO: 3504602 - RNA, 13 nt, Human
caccacuauaaaa

SEQ ID NO: 3504603 - RNA, 14 nt, Human
caccacuccauucc

SEQ ID NO: 3504604 - RNA, 13 nt, Human
caccacucuggca

SEQ ID NO: 3504605 - RNA, 14 nt, Human
caccacucuggcag

SEQ ID NO: 3504606 - RNA, 18 nt, Human
caccacucuggcagccac

SEQ ID NO: 3504607 - RNA, 21 nt, Human
caccacucuggcagccacacu

SEQ ID NO: 3504608 - RNA, 18 nt, Human
caccacugcacuccagcc

SEQ ID NO: 3504609 - RNA, 23 nt, Human
caccacugcccccugcugccaug

SEQ ID NO: 3504610 - RNA, 14 nt, Human
caccacuggccacc

SEQ ID NO: 3504611 - RNA, 20 nt, Human
caccacuggccaccaggcug

SEQ ID NO: 3504612 - RNA, 21 nt, Human
caccacuggccaccaggcugg

SEQ ID NO: 3504613 - RNA, 12 nt, Human
caccagaauaaa

SEQ ID NO: 3504614 - RNA, 18 nt, Human
caccagaauugugcaaau

SEQ ID NO: 3504615 - RNA, 16 nt, Human
caccagacggggcugg

SEQ ID NO: 3504616 - RNA, 11 nt, Human
caccagagacc

SEQ ID NO: 3504617 - RNA, 21 nt, Human
caccagagagggacugacacc

SEQ ID NO: 3504618 - RNA, 20 nt, Human
caccagagcaaccucucacu

SEQ ID NO: 3504619 - RNA, 18 nt, Human
caccagagcagaugcaga

SEQ ID NO: 3504620 - RNA, 18 nt, Human
caccagagcccaccuugg

SEQ ID NO: 3504621 - RNA, 20 nt, Human
caccagaggcugcagaaggc

SEQ ID NO: 3504622 - RNA, 16 nt, Human
caccagauagcagagg

SEQ ID NO: 3504623 - RNA, 14 nt, Human
caccagaugagaau

SEQ ID NO: 3504624 - RNA, 11 nt, Human
caccagcacca

SEQ ID NO: 3504625 - RNA, 15 nt, Human
caccagcagccugga

SEQ ID NO: 3504626 - RNA, 16 nt, Human
caccagccaggcucug

SEQ ID NO: 3504627 - RNA, 19 nt, Human
caccagccaggcucugugc

SEQ ID NO: 3504628 - RNA, 18 nt, Human
caccagccccacugccag

SEQ ID NO: 3504629 - RNA, 20 nt, Human
caccagccccacugccagca

SEQ ID NO: 3504630 - RNA, 22 nt, Human
caccagccccacugccagcagc

SEQ ID NO: 3504631 - RNA, 15 nt, Human
caccagccccugccc

SEQ ID NO: 3504632 - RNA, 16 nt, Human
caccagccccugcccc

SEQ ID NO: 3504633 - RNA, 17 nt, Human
caccagccccugcccca

SEQ ID NO: 3504634 - RNA, 16 nt, Human
caccagcccggccugc

SEQ ID NO: 3504635 - RNA, 17 nt, Human
caccagcccggccugcu

SEQ ID NO: 3504636 - RNA, 21 nt, Human
caccagcccuuagcagggaaa

SEQ ID NO: 3504637 - RNA, 14 nt, Human
caccagccugcacu

SEQ ID NO: 3504638 - RNA, 20 nt, Human
caccagccuuucucccaggc

SEQ ID NO: 3504639 - RNA, 17 nt, Human
caccagcuccucccuug

SEQ ID NO: 3504640 - RNA, 22 nt, Human
caccagcucugccgucucugga

SEQ ID NO: 3504641 - RNA, 11 nt, Human
caccagcugca

SEQ ID NO: 3504642 - RNA, 17 nt, Human
caccagcugcaaagugu

SEQ ID NO: 3504643 - RNA, 12 nt, Human
caccagcugccu

SEQ ID NO: 3504644 - RNA, 22 nt, Human
caccagcuguucugucccuugg

SEQ ID NO: 3504645 - RNA, 11 nt, Human
caccaggaagg

SEQ ID NO: 3504646 - RNA, 14 nt, Human
caccaggagacaga

SEQ ID NO: 3504647 - RNA, 17 nt, Human
caccaggagucccuggu

SEQ ID NO: 3504648 - RNA, 22 nt, Human
caccaggcaccucacagaaaug

SEQ ID NO: 3504649 - RNA, 19 nt, Human
caccaggcacgaacccacc

SEQ ID NO: 3504650 - RNA, 14 nt, Human
caccaggcagccuc

SEQ ID NO: 3504651 - RNA, 18 nt, Human
caccaggcagccucuggg

SEQ ID NO: 3504652 - RNA, 13 nt, Human
caccaggccaccu

SEQ ID NO: 3504653 - RNA, 14 nt, Human
caccaggccaccuc

SEQ ID NO: 3504654 - RNA, 19 nt, Human
caccaggccaccuccccag

SEQ ID NO: 3504655 - RNA, 22 nt, Human
caccaggccaccuccccagcau

SEQ ID NO: 3504656 - RNA, 16 nt, Human
caccaggccguccucc

SEQ ID NO: 3504657 - RNA, 17 nt, Human
caccaggcuggcgcagc

SEQ ID NO: 3504658 - RNA, 20 nt, Human
caccaggcuggcgcagccaa

SEQ ID NO: 3504659 - RNA, 13 nt, Human
caccagggaagaa

SEQ ID NO: 3504660 - RNA, 16 nt, Human
caccagggaugguacu

SEQ ID NO: 3504661 - RNA, 18 nt, Human
caccagggcaucucuggg

SEQ ID NO: 3504662 - RNA, 20 nt, Human
caccagggcaucucugggcu

SEQ ID NO: 3504663 - RNA, 22 nt, Human
caccagggcaucucugggcugg

SEQ ID NO: 3504664 - RNA, 14 nt, Human
caccagggccagcc

SEQ ID NO: 3504665 - RNA, 18 nt, Human
caccaggggcaggcacag

SEQ ID NO: 3504666 - RNA, 19 nt, Human
caccaggggcaggcacagc

SEQ ID NO: 3504667 - RNA, 19 nt, Human
caccaggguugaccccaga

SEQ ID NO: 3504668 - RNA, 23 nt, Human
caccaggguuuaguuugcauuua

SEQ ID NO: 3504669 - RNA, 16 nt, Human
caccagguagaacaca

SEQ ID NO: 3504670 - RNA, 23 nt, Human
caccagucacaugaccugaucac

SEQ ID NO: 3504671 - RNA, 14 nt, Human
caccagucccuguc

SEQ ID NO: 3504672 - RNA, 20 nt, Human
caccagugaaugaaagucuu

SEQ ID NO: 3504673 - RNA, 14 nt, Human
caccagugccucuc

SEQ ID NO: 3504674 - RNA, 23 nt, Human
caccaguguguggcuuucagagc

SEQ ID NO: 3504675 - RNA, 16 nt, Human
caccauaagcuacugc

SEQ ID NO: 3504676 - RNA, 20 nt, Human
caccauaagcuacugccauc

SEQ ID NO: 3504677 - RNA, 21 nt, Human
caccauaagcuacugccaucc

SEQ ID NO: 3504678 - RNA, 18 nt, Human
caccauaggucaccuuua

SEQ ID NO: 3504679 - RNA, 14 nt, Human
caccauaugaauug

SEQ ID NO: 3504680 - RNA, 19 nt, Human
caccauaugaauuguacag

SEQ ID NO: 3504681 - RNA, 21 nt, Human
caccauauucagugcuguggc

SEQ ID NO: 3504682 - RNA, 14 nt, Human
caccaucaagccac

SEQ ID NO: 3504683 - RNA, 17 nt, Human
caccaucaagccaccaa

SEQ ID NO: 3504684 - RNA, 15 nt, Human
caccaucaugucugg

SEQ ID NO: 3504685 - RNA, 16 nt, Human
caccaucugcugucuu

SEQ ID NO: 3504686 - RNA, 23 nt, Human
caccaucuuaagagaugccucau

SEQ ID NO: 3504687 - RNA, 17 nt, Human
caccaugauuccuuuaa

SEQ ID NO: 3504688 - RNA, 17 nt, Human
augcaaccaagucacac

SEQ ID NO: 3504689 - RNA, 21 nt, Human
augcaaccaagucacacgcuu

SEQ ID NO: 3504690 - RNA, 15 nt, Human
augcaaccauuugaa

SEQ ID NO: 3504691 - RNA, 18 nt, Human
augcaagagugauugcag

SEQ ID NO: 3504692 - RNA, 18 nt, Human
caccccuguccucacugc

SEQ ID NO: 3504693 - RNA, 13 nt, Human
caccccugugcuc

SEQ ID NO: 3504694 - RNA, 17 nt, Human
caccccugugcuccgug

SEQ ID NO: 3504695 - RNA, 18 nt, Human
caccccuuauccaggacu

SEQ ID NO: 3504696 - RNA, 11 nt, Human
caccccuuccc

SEQ ID NO: 3504697 - RNA, 12 nt, Human
caccccuucccc

SEQ ID NO: 3504698 - RNA, 13 nt, Human
cacaccuccacag

SEQ ID NO: 3504699 - RNA, 14 nt, Human
cacaccucccugaa

SEQ ID NO: 3504700 - RNA, 22 nt, Human
cacaccuccucccacugcccac

SEQ ID NO: 3504701 - RNA, 12 nt, Human
cacaccuccucu

SEQ ID NO: 3504702 - RNA, 13 nt, Human
cacaccuccuggg

SEQ ID NO: 3504703 - RNA, 12 nt, Human
cacaccuggccc

SEQ ID NO: 3504704 - RNA, 16 nt, Human
cacaccuguaguccca

SEQ ID NO: 3504705 - RNA, 22 nt, Human
cacaccuuuuauugacacagaa

SEQ ID NO: 3504706 - RNA, 23 nt, Human
cacaccuuuuauugacacagaaa

SEQ ID NO: 3504707 - RNA, 15 nt, Human
cacacgcacacacac

SEQ ID NO: 3504708 - RNA, 21 nt, Human
cacacgcacgcacacacacaa

SEQ ID NO: 3504709 - RNA, 20 nt, Human
cacacgcaggaacucccagc

SEQ ID NO: 3504710 - RNA, 20 nt, Human
cacacgccucccacuggggu

SEQ ID NO: 3504711 - RNA, 18 nt, Human
cacacgcgcgcacacaca

SEQ ID NO: 3504712 - RNA, 21 nt, Human
cacacgcgcgcgcacacacac

SEQ ID NO: 3504713 - RNA, 14 nt, Human
cacacgcuuuugaa

SEQ ID NO: 3504714 - RNA, 21 nt, Human
cacacggaggcaucugcaccc

SEQ ID NO: 3504715 - RNA, 19 nt, Human
cacacguaaugaaacuugg

SEQ ID NO: 3504716 - RNA, 20 nt, Human
cacacguaaugaaacuugga

SEQ ID NO: 3504717 - RNA, 20 nt, Human
cacacgucugacccucucca

SEQ ID NO: 3504718 - RNA, 16 nt, Human
cacacgugcaauuugu

SEQ ID NO: 3504719 - RNA, 21 nt, Human
cacacuaaccuggguucccuu

SEQ ID NO: 3504720 - RNA, 14 nt, Human
cacacuacaccaca

SEQ ID NO: 3504721 - RNA, 17 nt, Human
cacacuacaccacacac

SEQ ID NO: 3504722 - RNA, 22 nt, Human
cacacuacaccacacacaacag

SEQ ID NO: 3504723 - RNA, 16 nt, Human
cacacuaccgaaugug

SEQ ID NO: 3504724 - RNA, 18 nt, Human
cacacuaucauaguuaac

SEQ ID NO: 3504725 - RNA, 19 nt, Human
cacacuauuaccaugagaa

SEQ ID NO: 3504726 - RNA, 20 nt, Human
cacacuauuaccaugagaag

SEQ ID NO: 3504727 - RNA, 19 nt, Human
cacacucaaaucaagaaac

SEQ ID NO: 3504728 - RNA, 17 nt, Human
cacacucagcacccccu

SEQ ID NO: 3504729 - RNA, 20 nt, Human
cacacucagcacccccuucu

SEQ ID NO: 3504730 - RNA, 22 nt, Human
cacacucagcacccccuucucu

SEQ ID NO: 3504731 - RNA, 22 nt, Human
cacacuccaagauauggacaca

SEQ ID NO: 3504732 - RNA, 14 nt, Human
cacacuccagcugg

SEQ ID NO: 3504733 - RNA, 15 nt, Human
cacacuccaucagcu

SEQ ID NO: 3504734 - RNA, 16 nt, Human
cacacucgcccgccca

SEQ ID NO: 3504735 - RNA, 19 nt, Human
cacacucugccagcaaaga

SEQ ID NO: 3504736 - RNA, 13 nt, Human
cacacugaagaag

SEQ ID NO: 3504737 - RNA, 14 nt, Human
cacacugaagaagc

SEQ ID NO: 3504738 - RNA, 13 nt, Human
cacacugaggcag

SEQ ID NO: 3504739 - RNA, 16 nt, Human
cacacugaggcaggga

SEQ ID NO: 3504740 - RNA, 14 nt, Human
cacacugaugcuua

SEQ ID NO: 3504741 - RNA, 18 nt, Human
cacacugaugcuuagaug

SEQ ID NO: 3504742 - RNA, 19 nt, Human
cacacuggacuccggcccu

SEQ ID NO: 3504743 - RNA, 20 nt, Human
cacacuggacuccggcccuc

SEQ ID NO: 3504744 - RNA, 19 nt, Human
cacacuggcucacccaguc

SEQ ID NO: 3504745 - RNA, 22 nt, Human
cacacuggggugccgccugccc

SEQ ID NO: 3504746 - RNA, 16 nt, Human
cacacugguacuuaga

SEQ ID NO: 3504747 - RNA, 23 nt, Human
cacacugguguggauuaaccugc

SEQ ID NO: 3504748 - RNA, 20 nt, Human
cacacugguucucaaugaaa

SEQ ID NO: 3504749 - RNA, 15 nt, Human
cacacuguaaauaug

SEQ ID NO: 3504750 - RNA, 15 nt, Human
cacacugugcuuucu

SEQ ID NO: 3504751 - RNA, 16 nt, Human
cacacuguguccuggu

SEQ ID NO: 3504752 - RNA, 16 nt, Human
cacacuuacuuuuucu

SEQ ID NO: 3504753 - RNA, 14 nt, Human
cacacuucaggcuc

SEQ ID NO: 3504754 - RNA, 21 nt, Human
cacacuucaggcucuucuccu

SEQ ID NO: 3504755 - RNA, 13 nt, Human
cacacuucccugg

SEQ ID NO: 3504756 - RNA, 15 nt, Human
cacacuucccuggcg

SEQ ID NO: 3504757 - RNA, 14 nt, Human
cacacuuccugucc

SEQ ID NO: 3504758 - RNA, 15 nt, Human
cacacuucugugaga

SEQ ID NO: 3504759 - RNA, 17 nt, Human
cacacuugagaggauga

SEQ ID NO: 3504760 - RNA, 13 nt, Human
cacacuugugugu

SEQ ID NO: 3504761 - RNA, 17 nt, Human
cacacuuguuccagcuc

SEQ ID NO: 3504762 - RNA, 20 nt, Human
cacacuuguuccagcucuuu

SEQ ID NO: 3504763 - RNA, 19 nt, Human
cacacuuuggcccagggug

SEQ ID NO: 3504764 - RNA, 17 nt, Human
cacacuuugguaccaga

SEQ ID NO: 3504765 - RNA, 14 nt, Human
cacagaaaauaagg

SEQ ID NO: 3504766 - RNA, 17 nt, Human
cacagaaaauaaggcac

SEQ ID NO: 3504767 - RNA, 23 nt, Human
cacagaaaauaaggcacccaucu

SEQ ID NO: 3504768 - RNA, 13 nt, Human
cacagaaaauaua

SEQ ID NO: 3504769 - RNA, 19 nt, Human
cacagaaaauauacuguaa

SEQ ID NO: 3504770 - RNA, 21 nt, Human
cacagaaaauauacuguaaag

SEQ ID NO: 3504771 - RNA, 20 nt, Human
cacagaaaauggaagacagc

SEQ ID NO: 3504772 - RNA, 11 nt, Human
cacagaaacac

SEQ ID NO: 3504773 - RNA, 17 nt, Human
cacagaaacacugccuu

SEQ ID NO: 3504774 - RNA, 18 nt, Human
cacagaaacacugccuuu

SEQ ID NO: 3504775 - RNA, 19 nt, Human
cacagaaaccucuacuaaa

SEQ ID NO: 3504776 - RNA, 13 nt, Human
cacagaaagagag

SEQ ID NO: 3504777 - RNA, 15 nt, Human
cacagaaagagagca

SEQ ID NO: 3504778 - RNA, 18 nt, Human
cacagaaauauauauaca

SEQ ID NO: 3504779 - RNA, 19 nt, Human
cacagaaauauauauacau

SEQ ID NO: 3504780 - RNA, 20 nt, Human
cacagaaaugcugcuggcca

SEQ ID NO: 3504781 - RNA, 19 nt, Human
cacagaagacuucccagcu

SEQ ID NO: 3504782 - RNA, 14 nt, Human
cacagaagccagga

SEQ ID NO: 3504783 - RNA, 23 nt, Human
cacagaagccaggagcaaauguu

SEQ ID NO: 3504784 - RNA, 23 nt, Human
cacagaaggggacugccaccucc

SEQ ID NO: 3504785 - RNA, 15 nt, Human
cacagaaguagcucu

SEQ ID NO: 3504786 - RNA, 16 nt, Human
cacagaauauuuuuau

SEQ ID NO: 3504787 - RNA, 18 nt, Human
cacagaauauuuuuauau

SEQ ID NO: 3504788 - RNA, 14 nt, Human
cacagacacacaca

SEQ ID NO: 3504789 - RNA, 22 nt, Human
cacagacacacacacgcacgca

SEQ ID NO: 3504790 - RNA, 17 nt, Human
cacagacaggaccccug

SEQ ID NO: 3504791 - RNA, 13 nt, Human
cacagacagguuu

SEQ ID NO: 3504792 - RNA, 22 nt, Human
cacagacagguuuucacauaaa

SEQ ID NO: 3504793 - RNA, 21 nt, Human
cacagacccugcccugugggc

SEQ ID NO: 3504794 - RNA, 20 nt, Human
cacagaccuggagccccugg

SEQ ID NO: 3504795 - RNA, 21 nt, Human
cacagaccuggagccccuggg

SEQ ID NO: 3504796 - RNA, 16 nt, Human
cacagacgucccucca

SEQ ID NO: 3504797 - RNA, 15 nt, Human
cacagacucauccug

SEQ ID NO: 3504798 - RNA, 16 nt, Human
cacagacucauccuga

SEQ ID NO: 3504799 - RNA, 19 nt, Human
cacagacugguuuugcaac

SEQ ID NO: 3504800 - RNA, 22 nt, Human
cacagacuguugucccugcacu

SEQ ID NO: 3504801 - RNA, 20 nt, Human
cacagacuuuagcuuucuga

SEQ ID NO: 3504802 - RNA, 23 nt, Human
cacagagaacuagugguggcucu

SEQ ID NO: 3504803 - RNA, 23 nt, Human
cacagagagggagagcagagaaa

SEQ ID NO: 3504804 - RNA, 14 nt, Human
cacagagcucucca

SEQ ID NO: 3504805 - RNA, 17 nt, Human
cacagagcucuccagcu

SEQ ID NO: 3504806 - RNA, 21 nt, Human
cacagagcucuccagcuccaa

SEQ ID NO: 3504807 - RNA, 21 nt, Human
cacagaggcagcccgcacacc

SEQ ID NO: 3504808 - RNA, 18 nt, Human
cacagaggcuucuucaga

SEQ ID NO: 3504809 - RNA, 17 nt, Human
cacagagucaaggccug

SEQ ID NO: 3504810 - RNA, 20 nt, Human
cacagagucaaggccugcuc

SEQ ID NO: 3504811 - RNA, 21 nt, Human
cacagagucaaggccugcucc

SEQ ID NO: 3504812 - RNA, 21 nt, Human
cacagaguguagccagguccc

SEQ ID NO: 3504813 - RNA, 23 nt, Human
cacagauauacuuuguggaccaa

SEQ ID NO: 3504814 - RNA, 14 nt, Human
cacagaucacagcu

SEQ ID NO: 3504815 - RNA, 17 nt, Human
cacagaugaaacacaaa

SEQ ID NO: 3504816 - RNA, 20 nt, Human
cacagaugggugcuuggagg

SEQ ID NO: 3504817 - RNA, 23 nt, Human
cacagaugggugcuuggaggaag

SEQ ID NO: 3504818 - RNA, 22 nt, Human
cacagaugugggcuuugauuuc

SEQ ID NO: 3504819 - RNA, 13 nt, Human
cacagauuggcca

SEQ ID NO: 3504820 - RNA, 22 nt, Human
cacagauuguuucuauacaaau

SEQ ID NO: 3504821 - RNA, 13 nt, Human
cacagauuuuaau

SEQ ID NO: 3504822 - RNA, 16 nt, Human
cacagauuuuaauugu

SEQ ID NO: 3504823 - RNA, 20 nt, Human
cacagcaacgaucacaaaug

SEQ ID NO: 3504824 - RNA, 22 nt, Human
cacagcaacgaucacaaaugac

SEQ ID NO: 3504825 - RNA, 16 nt, Human
cacagcaaggaggcug

SEQ ID NO: 3504826 - RNA, 22 nt, Human
cacagcaaggaggcuggcuggg

SEQ ID NO: 3504827 - RNA, 23 nt, Human
cacagcaaggaggcuggcugggg

SEQ ID NO: 3504828 - RNA, 15 nt, Human
cacagcaaggcaccu

SEQ ID NO: 3504829 - RNA, 15 nt, Human
cacagcacacucagc

SEQ ID NO: 3504830 - RNA, 23 nt, Human
cacagcacaugcuggccagccug

SEQ ID NO: 3504831 - RNA, 16 nt, Human
cacagcaccagaaugu

SEQ ID NO: 3504832 - RNA, 19 nt, Human
cacagcaccagaauguaua

SEQ ID NO: 3504833 - RNA, 15 nt, Human
cacagcagcauuuuu

SEQ ID NO: 3504834 - RNA, 13 nt, Human
cacagcaggcugc

SEQ ID NO: 3504835 - RNA, 21 nt, Human
cacagcaggcugccagugccu

SEQ ID NO: 3504836 - RNA, 13 nt, Human
auggccagcagca

SEQ ID NO: 3504837 - RNA, 13 nt, Human
auggccagccccu

SEQ ID NO: 3504838 - RNA, 14 nt, Human
auggccagcuggag

SEQ ID NO: 3504839 - RNA, 21 nt, Human
auggccaggaaguagcacagg

SEQ ID NO: 3504840 - RNA, 23 nt, Human
auggccaggaaguagcacaggcu

SEQ ID NO: 3504841 - RNA, 18 nt, Human
auggccaggauccucucc

SEQ ID NO: 3504842 - RNA, 19 nt, Human
auggcccauucuacuugcu

SEQ ID NO: 3504843 - RNA, 11 nt, Human
auggccccucu

SEQ ID NO: 3504844 - RNA, 13 nt, Human
auggcccugggcg

SEQ ID NO: 3504845 - RNA, 18 nt, Human
auggcccuucccacugga

SEQ ID NO: 3504846 - RNA, 14 nt, Human
auggccguggaugc

SEQ ID NO: 3504847 - RNA, 21 nt, Human
auggccucaagaucaaugaaa

SEQ ID NO: 3504848 - RNA, 14 nt, Human
auggccucagcugc

SEQ ID NO: 3504849 - RNA, 15 nt, Human
auggccucagcugcc

SEQ ID NO: 3504850 - RNA, 18 nt, Human
auggccucagcugccuca

SEQ ID NO: 3504851 - RNA, 13 nt, Human
auggccucaugug

SEQ ID NO: 3504852 - RNA, 13 nt, Human
auggccuccuccc

SEQ ID NO: 3504853 - RNA, 18 nt, Human
auggccucuucagaucuc

SEQ ID NO: 3504854 - RNA, 18 nt, Human
auggccugcaaacuggga

SEQ ID NO: 3504855 - RNA, 19 nt, Human
auggccugccuugaagcca

SEQ ID NO: 3504856 - RNA, 13 nt, Human
auggccuuugcuu

SEQ ID NO: 3504857 - RNA, 19 nt, Human
auggcgauucccauugaaa

SEQ ID NO: 3504858 - RNA, 17 nt, Human
auggcgcagugccucug

SEQ ID NO: 3504859 - RNA, 15 nt, Human
auggcgggugggggu

SEQ ID NO: 3504860 - RNA, 21 nt, Human
auggcguagagggugcugccc

SEQ ID NO: 3504861 - RNA, 22 nt, Human
auggcguccguggguugcuaac

SEQ ID NO: 3504862 - RNA, 24 nt, Human
auggcguccguggguugcuaacug

SEQ ID NO: 3504863 - RNA, 20 nt, Human
auggcgugucccucucggaa

SEQ ID NO: 3504864 - RNA, 18 nt, Human
auggcuaauguacugcau

SEQ ID NO: 3504865 - RNA, 20 nt, Human
auggcuaguaucaaaagaaa

SEQ ID NO: 3504866 - RNA, 21 nt, Human
auggcuauaggugcuacaaaa

SEQ ID NO: 3504867 - RNA, 19 nt, Human
auggcuauguuuuuaaugu

SEQ ID NO: 3504868 - RNA, 22 nt, Human
auggcuauuaacaauuaauugu

SEQ ID NO: 3504869 - RNA, 13 nt, Human
auggcuauuuuau

SEQ ID NO: 3504870 - RNA, 18 nt, Human
auggcucacuaugaaucu

SEQ ID NO: 3504871 - RNA, 19 nt, Human
auggcucacugcagccucg

SEQ ID NO: 3504872 - RNA, 15 nt, Human
auggcucagaggggg

SEQ ID NO: 3504873 - RNA, 23 nt, Human
auggcuccccuuuuucuuccuca

SEQ ID NO: 3504874 - RNA, 17 nt, Human
auggcucuggacucuaa

SEQ ID NO: 3504875 - RNA, 19 nt, Human
auggcucuggacucuaaag

SEQ ID NO: 3504876 - RNA, 15 nt, Human
auggcugcaguccuc

SEQ ID NO: 3504877 - RNA, 22 nt, Human
auggcugcugaagcugccugcu

SEQ ID NO: 3504878 - RNA, 15 nt, Human
auggcugcuguugcu

SEQ ID NO: 3504879 - RNA, 18 nt, Human
auggcuggagugauucug

SEQ ID NO: 3504880 - RNA, 16 nt, Human
auggcuggccacugca

SEQ ID NO: 3504881 - RNA, 21 nt, Human
auggcugggaacugcagaccu

SEQ ID NO: 3504882 - RNA, 23 nt, Human
auggcugggaacugcagaccugu

SEQ ID NO: 3504883 - RNA, 20 nt, Human
auggcugucucaaaccaagc

SEQ ID NO: 3504884 - RNA, 14 nt, Human
auggcugugaggau

SEQ ID NO: 3504885 - RNA, 18 nt, Human
auggcugugccucugccu

SEQ ID NO: 3504886 - RNA, 21 nt, Human
auggcuguguuugcagccugc

SEQ ID NO: 3504887 - RNA, 23 nt, Human
auggcuuccuggcaauagucaaa

SEQ ID NO: 3504888 - RNA, 18 nt, Human
auggcuuuauuuuuuuga

SEQ ID NO: 3504889 - RNA, 21 nt, Human
auggcuuucagaaaacgggaa

SEQ ID NO: 3504890 - RNA, 19 nt, Human
auggcuuuguauagaaccu

SEQ ID NO: 3504891 - RNA, 16 nt, Human
auggcuuuugugcauu

SEQ ID NO: 3504892 - RNA, 14 nt, Human
augggaaaagagau

SEQ ID NO: 3504893 - RNA, 18 nt, Human
augggaaacuuccaagac

SEQ ID NO: 3504894 - RNA, 14 nt, Human
augggaaagcauug

SEQ ID NO: 3504895 - RNA, 18 nt, Human
augggaaagccaccucuc

SEQ ID NO: 3504896 - RNA, 23 nt, Human
augggaaagccaccucucccuca

SEQ ID NO: 3504897 - RNA, 23 nt, Human
augggaaaggaggcaugccucug

SEQ ID NO: 3504898 - RNA, 17 nt, Human
augggaagacgaggccc

SEQ ID NO: 3504899 - RNA, 19 nt, Human
augggaagacgaggcccuc

SEQ ID NO: 3504900 - RNA, 16 nt, Human
augggaauaauugcuu

SEQ ID NO: 3504901 - RNA, 22 nt, Human
augggaauauaauauugucucu

SEQ ID NO: 3504902 - RNA, 13 nt, Human
cacgcacgcacac

SEQ ID NO: 3504903 - RNA, 15 nt, Human
cacgcacgcacacac

SEQ ID NO: 3504904 - RNA, 16 nt, Human
cacgcacgcacacaca

SEQ ID NO: 3504905 - RNA, 20 nt, Human
cacgcaggaacucccagcaa

SEQ ID NO: 3504906 - RNA, 20 nt, Human
cacgcaggagcacacccagc

SEQ ID NO: 3504907 - RNA, 13 nt, Human
cacgccacagccc

SEQ ID NO: 3504908 - RNA, 14 nt, Human
cacgccacagcccu

SEQ ID NO: 3504909 - RNA, 13 nt, Human
cacgccacugcac

SEQ ID NO: 3504910 - RNA, 15 nt, Human
cacgccacugcacua

SEQ ID NO: 3504911 - RNA, 22 nt, Human
cacgccagauucuuuccugagg

SEQ ID NO: 3504912 - RNA, 13 nt, Human
cacgcccccacug

SEQ ID NO: 3504913 - RNA, 21 nt, Human
cacgcccguccugccuguggc

SEQ ID NO: 3504914 - RNA, 16 nt, Human
cacgcccuccccuccc

SEQ ID NO: 3504915 - RNA, 20 nt, Human
cacgcccuccccuccccugc

SEQ ID NO: 3504916 - RNA, 21 nt, Human
cacgccuaugaucccagcacu

SEQ ID NO: 3504917 - RNA, 13 nt, Human
cacgccucccacu

SEQ ID NO: 3504918 - RNA, 18 nt, Human
cacgccucccacuggggu

SEQ ID NO: 3504919 - RNA, 22 nt, Human
cacgccucccacugggguccag

SEQ ID NO: 3504920 - RNA, 21 nt, Human
cacgccucucccuaggagaag

SEQ ID NO: 3504921 - RNA, 18 nt, Human
cacgccuguaaucccagc

SEQ ID NO: 3504922 - RNA, 19 nt, Human
cacgccuguaaucccagca

SEQ ID NO: 3504923 - RNA, 20 nt, Human
cacgccuguaaucccagcac

SEQ ID NO: 3504924 - RNA, 22 nt, Human
cacgccuguaaucccagcacuu

SEQ ID NO: 3504925 - RNA, 20 nt, Human
cacgccuguaauccuagcac

SEQ ID NO: 3504926 - RNA, 15 nt, Human
cacgccuuccccuca

SEQ ID NO: 3504927 - RNA, 21 nt, Human
cacgcgccccccucccagagg

SEQ ID NO: 3504928 - RNA, 15 nt, Human
cacgcgcgcacacac

SEQ ID NO: 3504929 - RNA, 15 nt, Human
cacgcgugcacacac

SEQ ID NO: 3504930 - RNA, 23 nt, Human
cacgcgugcacacaccagagccc

SEQ ID NO: 3504931 - RNA, 14 nt, Human
cacgcuccagcugc

SEQ ID NO: 3504932 - RNA, 16 nt, Human
cacgcuccccgccugu

SEQ ID NO: 3504933 - RNA, 21 nt, Human
cacgcuccuuucugaucuuca

SEQ ID NO: 3504934 - RNA, 22 nt, Human
cacgcugccuucgguacccacc

SEQ ID NO: 3504935 - RNA, 17 nt, Human
cacgcuggaccuugaac

SEQ ID NO: 3504936 - RNA, 18 nt, Human
cacgcuggagugcaguga

SEQ ID NO: 3504937 - RNA, 14 nt, Human
cacgcuggggaaga

SEQ ID NO: 3504938 - RNA, 18 nt, Human
cacgcuggguccuaauua

SEQ ID NO: 3504939 - RNA, 18 nt, Human
cacgcugucuccagaccc

SEQ ID NO: 3504940 - RNA, 13 nt, Human
cacgcuguucuaa

SEQ ID NO: 3504941 - RNA, 14 nt, Human
cacgcuucacagug

SEQ ID NO: 3504942 - RNA, 14 nt, Human
cacgcuucuccgga

SEQ ID NO: 3504943 - RNA, 16 nt, Human
cacggaagagccuugc

SEQ ID NO: 3504944 - RNA, 14 nt, Human
cacggaaguuuuca

SEQ ID NO: 3504945 - RNA, 17 nt, Human
cacggacaauaaaccuc

SEQ ID NO: 3504946 - RNA, 19 nt, Human
cacggacaauaaaccuccg

SEQ ID NO: 3504947 - RNA, 23 nt, Human
cacggacgcuggcuccccaaagg

SEQ ID NO: 3504948 - RNA, 15 nt, Human
cacggagccacuccu

SEQ ID NO: 3504949 - RNA, 17 nt, Human
cacggagccacuccucu

SEQ ID NO: 3504950 - RNA, 18 nt, Human
cacggagccacuccucug

SEQ ID NO: 3504951 - RNA, 23 nt, Human
cacggagccacuccucugacuca

SEQ ID NO: 3504952 - RNA, 19 nt, Human
cacggagcccagcccuccc

SEQ ID NO: 3504953 - RNA, 20 nt, Human
cacggagggugacgggggug

SEQ ID NO: 3504954 - RNA, 23 nt, Human
cacggagucguggggugugcugg

SEQ ID NO: 3504955 - RNA, 13 nt, Human
cacggcagccaca

SEQ ID NO: 3504956 - RNA, 23 nt, Human
cacggcaggacaacgaggaagcc

SEQ ID NO: 3504957 - RNA, 17 nt, Human
cacggccacacagcugc

SEQ ID NO: 3504958 - RNA, 20 nt, Human
cacggccacacagcugccgg

SEQ ID NO: 3504959 - RNA, 13 nt, Human
cacggccacauca

SEQ ID NO: 3504960 - RNA, 12 nt, Human
cacggccaggcc

SEQ ID NO: 3504961 - RNA, 15 nt, Human
cacggccaggccaga

SEQ ID NO: 3504962 - RNA, 17 nt, Human
cacggccaggccagagg

SEQ ID NO: 3504963 - RNA, 15 nt, Human
cacggccgcuccagg

SEQ ID NO: 3504964 - RNA, 14 nt, Human
cacggccuccuuuc

SEQ ID NO: 3504965 - RNA, 15 nt, Human
cacggcguuguaccu

SEQ ID NO: 3504966 - RNA, 16 nt, Human
cacggcuaagaggcug

SEQ ID NO: 3504967 - RNA, 15 nt, Human
cacggcucacugcag

SEQ ID NO: 3504968 - RNA, 16 nt, Human
cacggcucacugcagc

SEQ ID NO: 3504969 - RNA, 20 nt, Human
cacggcucacugcagccuca

SEQ ID NO: 3504970 - RNA, 20 nt, Human
cacggcucuagguggggcgg

SEQ ID NO: 3504971 - RNA, 13 nt, Human
cacggcugcugag

SEQ ID NO: 3504972 - RNA, 14 nt, Human
cacgggcagccugg

SEQ ID NO: 3504973 - RNA, 18 nt, Human
cacgggccuguccacagg

SEQ ID NO: 3504974 - RNA, 15 nt, Human
cacgggggccaagga

SEQ ID NO: 3504975 - RNA, 23 nt, Human
cacggugaauggcuuuguauaga

SEQ ID NO: 3504976 - RNA, 16 nt, Human
cacggugggccuugcu

SEQ ID NO: 3504977 - RNA, 18 nt, Human
cacgguuugaagccugga

SEQ ID NO: 3504978 - RNA, 19 nt, Human
cacgguuugaagccuggaa

SEQ ID NO: 3504979 - RNA, 20 nt, Human
cacgguuugaagccuggaac

SEQ ID NO: 3504980 - RNA, 16 nt, Human
augggguccuggccau

SEQ ID NO: 3504981 - RNA, 17 nt, Human
augggguccuggccauc

SEQ ID NO: 3504982 - RNA, 19 nt, Human
auggggucucucacagaca

SEQ ID NO: 3504983 - RNA, 20 nt, Human
auggggucucucacagacag

SEQ ID NO: 3504984 - RNA, 16 nt, Human
auggggucuguaaaau

SEQ ID NO: 3504985 - RNA, 15 nt, Human
auggggugggccucu

SEQ ID NO: 3504986 - RNA, 21 nt, Human
augggguuggcugggcccaga

SEQ ID NO: 3504987 - RNA, 14 nt, Human
auggguagcuucug

SEQ ID NO: 3504988 - RNA, 15 nt, Human
auggguagcuucuga

SEQ ID NO: 3504989 - RNA, 22 nt, Human
auggguagggcucugacaaagc

SEQ ID NO: 3504990 - RNA, 16 nt, Human
auggguaggguaaauc

SEQ ID NO: 3504991 - RNA, 17 nt, Human
auggguaggguaaauca

SEQ ID NO: 3504992 - RNA, 16 nt, Human
auggguaucaaacagc

SEQ ID NO: 3504993 - RNA, 19 nt, Human
auggguccaggauuccucu

SEQ ID NO: 3504994 - RNA, 15 nt, Human
augggucgcccauga

SEQ ID NO: 3504995 - RNA, 14 nt, Human
augggugaaggcug

SEQ ID NO: 3504996 - RNA, 15 nt, Human
augggugaaggcugg

SEQ ID NO: 3504997 - RNA, 17 nt, Human
augggugaaggcuggca

SEQ ID NO: 3504998 - RNA, 20 nt, Human
augggugcuuggaggaagga

SEQ ID NO: 3504999 - RNA, 23 nt, Human
augggugcuuggaggaaggaaac

SEQ ID NO: 3505000 - RNA, 13 nt, Human
auggguggaaagg

SEQ ID NO: 3505001 - RNA, 22 nt, Human
auggguuuuucccuguacagua

SEQ ID NO: 3505002 - RNA, 16 nt, Human
augguaaaauugcaug

SEQ ID NO: 3505003 - RNA, 13 nt, Human
augguaauaagca

SEQ ID NO: 3505004 - RNA, 22 nt, Human
augguacaaccuuuauucuuuu

SEQ ID NO: 3505005 - RNA, 19 nt, Human
augguacauuuuucaacuu

SEQ ID NO: 3505006 - RNA, 17 nt, Human
augguaccaaucaugaa

SEQ ID NO: 3505007 - RNA, 16 nt, Human
augguaccagaugcag

SEQ ID NO: 3505008 - RNA, 15 nt, Human
augguacccccuucu

SEQ ID NO: 3505009 - RNA, 21 nt, Human
augguacugacuuugcuugcu

SEQ ID NO: 3505010 - RNA, 13 nt, Human
augguagaccuuu

SEQ ID NO: 3505011 - RNA, 16 nt, Human
augguagucuaaccaa

SEQ ID NO: 3505012 - RNA, 21 nt, Human
augguagucuaaccaaaugca

SEQ ID NO: 3505013 - RNA, 17 nt, Human
augguaguuuuuucauc

SEQ ID NO: 3505014 - RNA, 18 nt, Human
augguaguuuuuucaucu

SEQ ID NO: 3505015 - RNA, 19 nt, Human
augguauagcaaauguuuu

SEQ ID NO: 3505016 - RNA, 16 nt, Human
augguauauauacaua

SEQ ID NO: 3505017 - RNA, 19 nt, Human
augguauauauacauauau

SEQ ID NO: 3505018 - RNA, 18 nt, Human
augguaucaaaauuacau

SEQ ID NO: 3505019 - RNA, 21 nt, Human
augguaucaaaauuacauaua

SEQ ID NO: 3505020 - RNA, 23 nt, Human
augguaucaauaaauagaccauu

SEQ ID NO: 3505021 - RNA, 14 nt, Human
augguauccagaau

SEQ ID NO: 3505022 - RNA, 18 nt, Human
augguaugcacaauucca

SEQ ID NO: 3505023 - RNA, 19 nt, Human
augguaugcacaauuccau

SEQ ID NO: 3505024 - RNA, 14 nt, Human
auggucacacacug

SEQ ID NO: 3505025 - RNA, 18 nt, Human
auggucacacacugaugc

SEQ ID NO: 3505026 - RNA, 20 nt, Human
auggucacacacugaugcuu

SEQ ID NO: 3505027 - RNA, 18 nt, Human
auggucagacacaaacaa

SEQ ID NO: 3505028 - RNA, 12 nt, Human
auggucagcucc

SEQ ID NO: 3505029 - RNA, 22 nt, Human
auggucaucuuuuucucuaaaa

SEQ ID NO: 3505030 - RNA, 20 nt, Human
augguccaauuaguuuccuu

SEQ ID NO: 3505031 - RNA, 16 nt, Human
augguccaggagaagg

SEQ ID NO: 3505032 - RNA, 18 nt, Human
augguccaggagaaggcc

SEQ ID NO: 3505033 - RNA, 19 nt, Human
auggucccacaucccuggg

SEQ ID NO: 3505034 - RNA, 20 nt, Human
auggucccacaucccugggc

SEQ ID NO: 3505035 - RNA, 14 nt, Human
auggucccauccag

SEQ ID NO: 3505036 - RNA, 20 nt, Human
auggucccauccaggcaguc

SEQ ID NO: 3505037 - RNA, 15 nt, Human
augguccgguguccu

SEQ ID NO: 3505038 - RNA, 21 nt, Human
augguccgugcuaaggacuug

SEQ ID NO: 3505039 - RNA, 14 nt, Human
auggucgcccagga

SEQ ID NO: 3505040 - RNA, 14 nt, Human
auggucucagaaac

SEQ ID NO: 3505041 - RNA, 18 nt, Human
auggucucagaaaccaaa

SEQ ID NO: 3505042 - RNA, 16 nt, Human
auggucuuacagcagg

SEQ ID NO: 3505043 - RNA, 17 nt, Human
auggucuuacagcaggc

SEQ ID NO: 3505044 - RNA, 14 nt, Human
auggugaaaaugua

SEQ ID NO: 3505045 - RNA, 17 nt, Human
auggugaaaauguacug

SEQ ID NO: 3505046 - RNA, 17 nt, Human
auggugaaauuuauuag

SEQ ID NO: 3505047 - RNA, 23 nt, Human
auggugacuuuugaaaagaggug

SEQ ID NO: 3505048 - RNA, 21 nt, Human
auggugagagaagccugugcc

SEQ ID NO: 3505049 - RNA, 17 nt, Human
auggugaugaaauguaa

SEQ ID NO: 3505050 - RNA, 12 nt, Human
auggugcaauga

SEQ ID NO: 3505051 - RNA, 16 nt, Human
auggugcaaugaccuu

SEQ ID NO: 3505052 - RNA, 18 nt, Human
auggugcaguugacagca

SEQ ID NO: 3505053 - RNA, 20 nt, Human
auggugccccaggaccagcu

SEQ ID NO: 3505054 - RNA, 16 nt, Human
auggugccuaguauug

SEQ ID NO: 3505055 - RNA, 12 nt, Human
auggugccucug

SEQ ID NO: 3505056 - RNA, 15 nt, Human
auggugccugagagg

SEQ ID NO: 3505057 - RNA, 20 nt, Human
auggugccugagaggcaggc

SEQ ID NO: 3505058 - RNA, 21 nt, Human
auggugccugagaggcaggca

SEQ ID NO: 3505059 - RNA, 13 nt, Human
auggugcugagaa

SEQ ID NO: 3505060 - RNA, 14 nt, Human
auggugcugagaag

SEQ ID NO: 3505061 - RNA, 16 nt, Human
auggugcugagaagcu

SEQ ID NO: 3505062 - RNA, 13 nt, Human
auggugcugggag

SEQ ID NO: 3505063 - RNA, 15 nt, Human
caccgaaaacguggc

SEQ ID NO: 3505064 - RNA, 21 nt, Human
caccgaaaacguggcugcuuc

SEQ ID NO: 3505065 - RNA, 15 nt, Human
caccgaagcccagag

SEQ ID NO: 3505066 - RNA, 21 nt, Human
caccgaagcccagagggucug

SEQ ID NO: 3505067 - RNA, 17 nt, Human
caccgagggcgaccccg

SEQ ID NO: 3505068 - RNA, 13 nt, Human
caccgaggggccu

SEQ ID NO: 3505069 - RNA, 12 nt, Human
caccgagugggg

SEQ ID NO: 3505070 - RNA, 14 nt, Human
caccgcagaaggaa

SEQ ID NO: 3505071 - RNA, 12 nt, Human
caccgcagacag

SEQ ID NO: 3505072 - RNA, 18 nt, Human
caccgcagacaggaccag

SEQ ID NO: 3505073 - RNA, 21 nt, Human
caccgcagacaggaccaggga

SEQ ID NO: 3505074 - RNA, 22 nt, Human
caccgcaugcccccucgugcca

SEQ ID NO: 3505075 - RNA, 13 nt, Human
caccgcccgucug

SEQ ID NO: 3505076 - RNA, 22 nt, Human
caccgccgacuuuguacccccc

SEQ ID NO: 3505077 - RNA, 18 nt, Human
caccgccggccagcuggg

SEQ ID NO: 3505078 - RNA, 17 nt, Human
caccgccuccuacagcc

SEQ ID NO: 3505079 - RNA, 23 nt, Human
caccgccuugcccagccuggaug

SEQ ID NO: 3505080 - RNA, 21 nt, Human
caccgcggcgcuucccagcac

SEQ ID NO: 3505081 - RNA, 13 nt, Human
caccgcuccccag

SEQ ID NO: 3505082 - RNA, 19 nt, Human
caccgcugcuccacgcgcu

SEQ ID NO: 3505083 - RNA, 17 nt, Human
caccggaccagccuggc

SEQ ID NO: 3505084 - RNA, 22 nt, Human
caccggagcuuucaaagaagga

SEQ ID NO: 3505085 - RNA, 16 nt, Human
caccggcucucaccug

SEQ ID NO: 3505086 - RNA, 14 nt, Human
caccggcuggccug

SEQ ID NO: 3505087 - RNA, 20 nt, Human
caccggcuggccuggccccu

SEQ ID NO: 3505088 - RNA, 22 nt, Human
caccgggcacucagaagacacu

SEQ ID NO: 3505089 - RNA, 13 nt, Human
caccgggccugga

SEQ ID NO: 3505090 - RNA, 20 nt, Human
caccggggacaggccgcagc

SEQ ID NO: 3505091 - RNA, 15 nt, Human
caccggggccucgga

SEQ ID NO: 3505092 - RNA, 14 nt, Human
caccggggccuggg

SEQ ID NO: 3505093 - RNA, 21 nt, Human
caccggggccugggcaggagg

SEQ ID NO: 3505094 - RNA, 15 nt, Human
caccgguccagcugg

SEQ ID NO: 3505095 - RNA, 16 nt, Human
caccgguccagcuggc

SEQ ID NO: 3505096 - RNA, 18 nt, Human
caccgguccagcuggccu

SEQ ID NO: 3505097 - RNA, 19 nt, Human
caccgguugcuucugggaa

SEQ ID NO: 3505098 - RNA, 18 nt, Human
caccguccgcccugcucc

SEQ ID NO: 3505099 - RNA, 15 nt, Human
caccguggaccuucc

SEQ ID NO: 3505100 - RNA, 16 nt, Human
caccguggaccuuccu

SEQ ID NO: 3505101 - RNA, 17 nt, Human
caccguggaccuuccug

SEQ ID NO: 3505102 - RNA, 17 nt, Human
caccguggaggaggaag

SEQ ID NO: 3505103 - RNA, 15 nt, Human
caccguggcuaagag

SEQ ID NO: 3505104 - RNA, 19 nt, Human
caccgugucaagcugcucu

SEQ ID NO: 3505105 - RNA, 14 nt, Human
caccguucauucag

SEQ ID NO: 3505106 - RNA, 13 nt, Human
caccguucugugc

SEQ ID NO: 3505107 - RNA, 21 nt, Human
caccguuggggauuggggaag

SEQ ID NO: 3505108 - RNA, 13 nt, Human
caccuaaagaaaa

SEQ ID NO: 3505109 - RNA, 18 nt, Human
caccuaagggacauguuu

SEQ ID NO: 3505110 - RNA, 15 nt, Human
caccuaagucucugu

SEQ ID NO: 3505111 - RNA, 17 nt, Human
caccuaagucucuguga

SEQ ID NO: 3505112 - RNA, 20 nt, Human
caccuaauccaggcagaucc

SEQ ID NO: 3505113 - RNA, 14 nt, Human
caccuaauguuuau

SEQ ID NO: 3505114 - RNA, 20 nt, Human
caccuaauguuuaugagcca

SEQ ID NO: 3505115 - RNA, 17 nt, Human
caccuaccaucagggac

SEQ ID NO: 3505116 - RNA, 18 nt, Human
caccuaccgaguucaagu

SEQ ID NO: 3505117 - RNA, 12 nt, Human
caccuacugagu

SEQ ID NO: 3505118 - RNA, 17 nt, Human
caccuagagccagacca

SEQ ID NO: 3505119 - RNA, 13 nt, Human
caccuagcugaau

SEQ ID NO: 3505120 - RNA, 21 nt, Human
caccuagcugaauguuuuucu

SEQ ID NO: 3505121 - RNA, 17 nt, Human
caccuaggaagccucag

SEQ ID NO: 3505122 - RNA, 15 nt, Human
caccuaguccaguga

SEQ ID NO: 3505123 - RNA, 14 nt, Human
caccuaguggcugu

SEQ ID NO: 3505124 - RNA, 15 nt, Human
caccuaguggcuguc

SEQ ID NO: 3505125 - RNA, 13 nt, Human
auguaaaaugauu

SEQ ID NO: 3505126 - RNA, 17 nt, Human
auguaaaauguugaaua

SEQ ID NO: 3505127 - RNA, 16 nt, Human
auguaaacagugccug

SEQ ID NO: 3505128 - RNA, 19 nt, Human
auguaaacuguuucuuuaa

SEQ ID NO: 3505129 - RNA, 20 nt, Human
auguaaacuguuucuuuaaa

SEQ ID NO: 3505130 - RNA, 14 nt, Human
auguaaagaaaugu

SEQ ID NO: 3505131 - RNA, 19 nt, Human
auguaaagaacauaaauaa

SEQ ID NO: 3505132 - RNA, 19 nt, Human
auguaaagacaaaaaacua

SEQ ID NO: 3505133 - RNA, 14 nt, Human
auguaaagauauuu

SEQ ID NO: 3505134 - RNA, 14 nt, Human
auguaaagcuuguc

SEQ ID NO: 3505135 - RNA, 18 nt, Human
auguaaaguauguaaaca

SEQ ID NO: 3505136 - RNA, 21 nt, Human
auguaaauaaccccauucuuu

SEQ ID NO: 3505137 - RNA, 22 nt, Human
auguaaauaaccccauucuuug

SEQ ID NO: 3505138 - RNA, 23 nt, Human
auguaaauaaccccauucuuugc

SEQ ID NO: 3505139 - RNA, 16 nt, Human
auguaaauaauucuuu

SEQ ID NO: 3505140 - RNA, 19 nt, Human
auguaaauauuuuaaagaa

SEQ ID NO: 3505141 - RNA, 21 nt, Human
auguaaauauuuuaaagaauu

SEQ ID NO: 3505142 - RNA, 23 nt, Human
auguaaaucccauuauucaaagu

SEQ ID NO: 3505143 - RNA, 23 nt, Human
auguaaaugucucacugagcacu

SEQ ID NO: 3505144 - RNA, 12 nt, Human
auguaaaugugc

SEQ ID NO: 3505145 - RNA, 20 nt, Human
auguaaauuaccaguaaagu

SEQ ID NO: 3505146 - RNA, 18 nt, Human
auguaaauugacuguacu

SEQ ID NO: 3505147 - RNA, 12 nt, Human
auguaaauuugu

SEQ ID NO: 3505148 - RNA, 13 nt, Human
auguaaauuugua

SEQ ID NO: 3505149 - RNA, 14 nt, Human
auguaaauuuguac

SEQ ID NO: 3505150 - RNA, 19 nt, Human
auguaaauuuguacuauuu

SEQ ID NO: 3505151 - RNA, 13 nt, Human
auguaacagucug

SEQ ID NO: 3505152 - RNA, 17 nt, Human
auguaacugccuagaaa

SEQ ID NO: 3505153 - RNA, 18 nt, Human
auguaacugccuagaaac

SEQ ID NO: 3505154 - RNA, 14 nt, Human
auguaacugcucuu

SEQ ID NO: 3505155 - RNA, 14 nt, Human
auguaacuuuugua

SEQ ID NO: 3505156 - RNA, 16 nt, Human
auguaagagcuuuaca

SEQ ID NO: 3505157 - RNA, 19 nt, Human
auguaagagcuuuacaaaa

SEQ ID NO: 3505158 - RNA, 17 nt, Human
auguaagauuauagauu

SEQ ID NO: 3505159 - RNA, 21 nt, Human
auguaagauuauagauucuaa

SEQ ID NO: 3505160 - RNA, 22 nt, Human
auguaagauuauagauucuaaa

SEQ ID NO: 3505161 - RNA, 15 nt, Human
auguaagcauacuuu

SEQ ID NO: 3505162 - RNA, 20 nt, Human
auguaaggaaugcuuggaau

SEQ ID NO: 3505163 - RNA, 14 nt, Human
auguaagggaaacu

SEQ ID NO: 3505164 - RNA, 13 nt, Human
auguaagguauau

SEQ ID NO: 3505165 - RNA, 14 nt, Human
auguaauaauguga

SEQ ID NO: 3505166 - RNA, 12 nt, Human
auguaauacuuc

SEQ ID NO: 3505167 - RNA, 17 nt, Human
auguaaugaaguaaagc

SEQ ID NO: 3505168 - RNA, 22 nt, Human
auguaaugaaguaaagccauua

SEQ ID NO: 3505169 - RNA, 18 nt, Human
auguaaugcgauuuuauu

SEQ ID NO: 3505170 - RNA, 21 nt, Human
auguaaugcgauuuuauuacu

SEQ ID NO: 3505171 - RNA, 16 nt, Human
auguaauggcaguuau

SEQ ID NO: 3505172 - RNA, 18 nt, Human
auguaauggcaguuauau

SEQ ID NO: 3505173 - RNA, 21 nt, Human
auguaaugugugguggccuca

SEQ ID NO: 3505174 - RNA, 22 nt, Human
auguaaugugugguggccucag

SEQ ID NO: 3505175 - RNA, 23 nt, Human
auguaauguuuucuuugcaaagu

SEQ ID NO: 3505176 - RNA, 15 nt, Human
auguaauuauuuaug

SEQ ID NO: 3505177 - RNA, 11 nt, Human
auguaauuguu

SEQ ID NO: 3505178 - RNA, 17 nt, Human
auguaauuuaaaugaaa

SEQ ID NO: 3505179 - RNA, 21 nt, Human
auguaauuucaggaggaauac

SEQ ID NO: 3505180 - RNA, 17 nt, Human
auguaauuuuguguaag

SEQ ID NO: 3505181 - RNA, 21 nt, Human
auguacaaaauaaaguuacau

SEQ ID NO: 3505182 - RNA, 20 nt, Human
auguacaauaagaacuucua

SEQ ID NO: 3505183 - RNA, 14 nt, Human
auguacaauauuuu

SEQ ID NO: 3505184 - RNA, 20 nt, Human
auguacaauauuuuaagcau

SEQ ID NO: 3505185 - RNA, 21 nt, Human
auguacaauauuuuaagcauu

SEQ ID NO: 3505186 - RNA, 23 nt, Human
auguacagagaacuaacacuauu

SEQ ID NO: 3505187 - RNA, 14 nt, Human
auguacagauucuu

SEQ ID NO: 3505188 - RNA, 15 nt, Human
auguacagauucuuu

SEQ ID NO: 3505189 - RNA, 16 nt, Human
auguacagucugucau

SEQ ID NO: 3505190 - RNA, 15 nt, Human
auguacaugagaagg

SEQ ID NO: 3505191 - RNA, 13 nt, Human
auguacauguauu

SEQ ID NO: 3505192 - RNA, 18 nt, Human
auguaccauuugcauggc

SEQ ID NO: 3505193 - RNA, 22 nt, Human
auguaccauuugcauggcucca

SEQ ID NO: 3505194 - RNA, 20 nt, Human
auguacccaccgggccacuc

SEQ ID NO: 3505195 - RNA, 18 nt, Human
auguacccucugaaauac

SEQ ID NO: 3505196 - RNA, 17 nt, Human
auguaccuccccugccu

SEQ ID NO: 3505197 - RNA, 15 nt, Human
auguaccucuuuuag

SEQ ID NO: 3505198 - RNA, 20 nt, Human
auguacgaugagaaauucaa

SEQ ID NO: 3505199 - RNA, 20 nt, Human
auguacuaggauacugcugc

SEQ ID NO: 3505200 - RNA, 17 nt, Human
auguacuaguacugugu

SEQ ID NO: 3505201 - RNA, 15 nt, Human
auguacuaguguucu

SEQ ID NO: 3505202 - RNA, 22 nt, Human
auguacuaguguucuguuuguu

SEQ ID NO: 3505203 - RNA, 17 nt, Human
auguacuccucuuuaca

SEQ ID NO: 3505204 - RNA, 14 nt, Human
auguacugagauuu

SEQ ID NO: 3505205 - RNA, 18 nt, Human
auguacugagccuuguaa

SEQ ID NO: 3505206 - RNA, 16 nt, Human
auguacugauugagaa

SEQ ID NO: 3505207 - RNA, 18 nt, Human
auguacugauugagaagu

SEQ ID NO: 3505208 - RNA, 16 nt, Human
auguacugauuucagu

SEQ ID NO: 3505209 - RNA, 13 nt, Human
auguacugcauua

SEQ ID NO: 3505210 - RNA, 12 nt, Human
auguacuguacu

SEQ ID NO: 3505211 - RNA, 18 nt, Human
auguacuugucaaagaag

SEQ ID NO: 3505212 - RNA, 19 nt, Human
auguacuugucaaagaagg

SEQ ID NO: 3505213 - RNA, 15 nt, Human
auguacuuuuuagua

SEQ ID NO: 3505214 - RNA, 14 nt, Human
auguagaaaauuug

SEQ ID NO: 3505215 - RNA, 19 nt, Human
auguagacuauauacaugu

SEQ ID NO: 3505216 - RNA, 20 nt, Human
auguagacuauauacaugug

SEQ ID NO: 3505217 - RNA, 12 nt, Human
auguagaggaga

SEQ ID NO: 3505218 - RNA, 19 nt, Human
auguagauaaacucagaaa

SEQ ID NO: 3505219 - RNA, 23 nt, Human
auguagauauugugaaguacaua

SEQ ID NO: 3505220 - RNA, 13 nt, Human
auguagauauuug

SEQ ID NO: 3505221 - RNA, 18 nt, Human
auguagauguaugcacac

SEQ ID NO: 3505222 - RNA, 21 nt, Human
auguagcaaaauacaugacau

SEQ ID NO: 3505223 - RNA, 15 nt, Human
cacuccuuccugccc

SEQ ID NO: 3505224 - RNA, 16 nt, Human
cacucgcccgcccacu

SEQ ID NO: 3505225 - RNA, 18 nt, Human
cacucgcccgcccacugu

SEQ ID NO: 3505226 - RNA, 22 nt, Human
cacucgcccgcccacuguccug

SEQ ID NO: 3505227 - RNA, 20 nt, Human
cacucgcuagcaguggcagg

SEQ ID NO: 3505228 - RNA, 13 nt, Human
cacucgcuucccc

SEQ ID NO: 3505229 - RNA, 16 nt, Human
cacucgcuucccccau

SEQ ID NO: 3505230 - RNA, 20 nt, Human
cacucgcuucccccauagcc

SEQ ID NO: 3505231 - RNA, 14 nt, Human
cacucggucccagu

SEQ ID NO: 3505232 - RNA, 13 nt, Human
cacucgucucccc

SEQ ID NO: 3505233 - RNA, 17 nt, Human
cacucgugcaucccuga

SEQ ID NO: 3505234 - RNA, 22 nt, Human
cacucgugugcaacagacaagu

SEQ ID NO: 3505235 - RNA, 13 nt, Human
cacucuaaagcaa

SEQ ID NO: 3505236 - RNA, 16 nt, Human
cacucuaacuguauau

SEQ ID NO: 3505237 - RNA, 21 nt, Human
cacucuaagauguuauauuuu

SEQ ID NO: 3505238 - RNA, 18 nt, Human
cacucuaagucauguaug

SEQ ID NO: 3505239 - RNA, 22 nt, Human
cacucuaagucauguauguuuc

SEQ ID NO: 3505240 - RNA, 17 nt, Human
cacucuacccuauacaa

SEQ ID NO: 3505241 - RNA, 19 nt, Human
cacucuacccucccacccc

SEQ ID NO: 3505242 - RNA, 15 nt, Human
cacucuagccugggc

SEQ ID NO: 3505243 - RNA, 22 nt, Human
cacucuaggggucaggcuccau

SEQ ID NO: 3505244 - RNA, 14 nt, Human
cacucucagaggcc

SEQ ID NO: 3505245 - RNA, 17 nt, Human
cacucucagaggcccca

SEQ ID NO: 3505246 - RNA, 13 nt, Human
cacucuccaucac

SEQ ID NO: 3505247 - RNA, 21 nt, Human
cacucuccccacacuaaccug

SEQ ID NO: 3505248 - RNA, 20 nt, Human
cacucucccccacccccucc

SEQ ID NO: 3505249 - RNA, 15 nt, Human
cacucuccugggccc

SEQ ID NO: 3505250 - RNA, 20 nt, Human
cacucuccugggccccuccc

SEQ ID NO: 3505251 - RNA, 21 nt, Human
cacucuccuugcuacccagaa

SEQ ID NO: 3505252 - RNA, 20 nt, Human
cacucucugaagaugaucau

SEQ ID NO: 3505253 - RNA, 23 nt, Human
cacucucugaagaugaucauuug

SEQ ID NO: 3505254 - RNA, 14 nt, Human
cacucucuggaagc

SEQ ID NO: 3505255 - RNA, 23 nt, Human
cacucugagacucgcgacaaugc

SEQ ID NO: 3505256 - RNA, 23 nt, Human
cacucugaguuuaccauuuguaa

SEQ ID NO: 3505257 - RNA, 16 nt, Human
cacucugauagaauua

SEQ ID NO: 3505258 - RNA, 15 nt, Human
cacucugcagacugc

SEQ ID NO: 3505259 - RNA, 17 nt, Human
cacucugccagcaaaga

SEQ ID NO: 3505260 - RNA, 15 nt, Human
cacucugccagggca

SEQ ID NO: 3505261 - RNA, 17 nt, Human
cacucugcuaccuugcc

SEQ ID NO: 3505262 - RNA, 12 nt, Human
cacucugcucug

SEQ ID NO: 3505263 - RNA, 14 nt, Human
cacucugcugcuua

SEQ ID NO: 3505264 - RNA, 15 nt, Human
cacucugcuucucug

SEQ ID NO: 3505265 - RNA, 17 nt, Human
cacucugcuucucugac

SEQ ID NO: 3505266 - RNA, 22 nt, Human
cacucuggcagcaccgccucuu

SEQ ID NO: 3505267 - RNA, 15 nt, Human
cacucuggcagccac

SEQ ID NO: 3505268 - RNA, 16 nt, Human
cacucuggcagccaca

SEQ ID NO: 3505269 - RNA, 15 nt, Human
auguugagagguucu

SEQ ID NO: 3505270 - RNA, 20 nt, Human
auguugagggaacagacagg

SEQ ID NO: 3505271 - RNA, 15 nt, Human
auguugauuucuagu

SEQ ID NO: 3505272 - RNA, 17 nt, Human
auguugauuuuuacugu

SEQ ID NO: 3505273 - RNA, 22 nt, Human
auguugcacacccacucagcuc

SEQ ID NO: 3505274 - RNA, 15 nt, Human
auguugcauagaaua

SEQ ID NO: 3505275 - RNA, 22 nt, Human
auguugccaaaaugguggccug

SEQ ID NO: 3505276 - RNA, 22 nt, Human
auguugccauccuaccgucuuu

SEQ ID NO: 3505277 - RNA, 18 nt, Human
auguugccauguguuuua

SEQ ID NO: 3505278 - RNA, 17 nt, Human
auguugcccaggcaggu

SEQ ID NO: 3505279 - RNA, 20 nt, Human
auguugcccuguugcugccu

SEQ ID NO: 3505280 - RNA, 15 nt, Human
cacuucuuccuuucu

SEQ ID NO: 3505281 - RNA, 21 nt, Human
cacuucuuucccuuccuccau

SEQ ID NO: 3505282 - RNA, 14 nt, Human
cacuugaaaccuuu

SEQ ID NO: 3505283 - RNA, 21 nt, Human
cacuugaaaccuuuuuuuauc

SEQ ID NO: 3505284 - RNA, 17 nt, Human
cacuugaaauucuuuca

SEQ ID NO: 3505285 - RNA, 21 nt, Human
cacuugaaccauaguuacugu

SEQ ID NO: 3505286 - RNA, 21 nt, Human
cacuugaacccgggaggcaga

SEQ ID NO: 3505287 - RNA, 15 nt, Human
cacuugaauccuagg

SEQ ID NO: 3505288 - RNA, 19 nt, Human
cacuugacaucaacugcau

SEQ ID NO: 3505289 - RNA, 15 nt, Human
cacuugagaugauuu

SEQ ID NO: 3505290 - RNA, 12 nt, Human
cacuugcaaccu

SEQ ID NO: 3505291 - RNA, 12 nt, Human
cacuugcauguc

SEQ ID NO: 3505292 - RNA, 12 nt, Human
cacuugccucuu

SEQ ID NO: 3505293 - RNA, 14 nt, Human
cacuugccucuucc

SEQ ID NO: 3505294 - RNA, 15 nt, Human
cacuugcuacccuga

SEQ ID NO: 3505295 - RNA, 20 nt, Human
cacuugcugcacucuugcac

SEQ ID NO: 3505296 - RNA, 14 nt, Human
cacuuggcagccuu

SEQ ID NO: 3505297 - RNA, 14 nt, Human
cacuuggcagcgcg

SEQ ID NO: 3505298 - RNA, 19 nt, Human
cacuuggcccaaguggcag

SEQ ID NO: 3505299 - RNA, 23 nt, Human
cacuuggcugcauaaauguggua

SEQ ID NO: 3505300 - RNA, 19 nt, Human
cacuuggggagauuugcca

SEQ ID NO: 3505301 - RNA, 22 nt, Human
cacuuggggcaccuugcuccuc

SEQ ID NO: 3505302 - RNA, 17 nt, Human
cacuugggggcucagca

SEQ ID NO: 3505303 - RNA, 15 nt, Human
cacuuggucugccag

SEQ ID NO: 3505304 - RNA, 16 nt, Human
cacuuggucugccagg

SEQ ID NO: 3505305 - RNA, 18 nt, Human
cacuuggucugccaggcc

SEQ ID NO: 3505306 - RNA, 17 nt, Human
cacuuggucugugagau

SEQ ID NO: 3505307 - RNA, 18 nt, Human
cacuuggucugugagaug

SEQ ID NO: 3505308 - RNA, 20 nt, Human
cacuuguaauuuuguaucuu

SEQ ID NO: 3505309 - RNA, 15 nt, Human
cacuuguagauuuga

SEQ ID NO: 3505310 - RNA, 14 nt, Human
cacuuguaggauaa

SEQ ID NO: 3505311 - RNA, 23 nt, Human
cacuuguaggauaagugaaaugg

SEQ ID NO: 3505312 - RNA, 20 nt, Human
cacuugucacugacacaaag

SEQ ID NO: 3505313 - RNA, 16 nt, Human
cacuugucaggagugu

SEQ ID NO: 3505314 - RNA, 22 nt, Human
cacuugucaggaguguguguga

SEQ ID NO: 3505315 - RNA, 15 nt, Human
cacuuguccagcuga

SEQ ID NO: 3505316 - RNA, 23 nt, Human
cacuuguccagcugagcgccagg

SEQ ID NO: 3505317 - RNA, 20 nt, Human
cacuuguccccaaauccgaa

SEQ ID NO: 3505318 - RNA, 23 nt, Human
cacuuguccccaaauccgaaccu

SEQ ID NO: 3505319 - RNA, 21 nt, Human
cacuugucggcuccagucccc

SEQ ID NO: 3505320 - RNA, 16 nt, Human
cacuugucucauuuua

SEQ ID NO: 3505321 - RNA, 18 nt, Human
cacuugugacuuuugcuu

SEQ ID NO: 3505322 - RNA, 19 nt, Human
cacuugugugugggcugug

SEQ ID NO: 3505323 - RNA, 21 nt, Human
cacuugugugugggcugugag

SEQ ID NO: 3505324 - RNA, 17 nt, Human
cacuuguguuuugcaag

SEQ ID NO: 3505325 - RNA, 18 nt, Human
cacuuguuccagcucuuu

SEQ ID NO: 3505326 - RNA, 14 nt, Human
cacuuguuguuuua

SEQ ID NO: 3505327 - RNA, 19 nt, Human
cacuuuaaaauaucuacau

SEQ ID NO: 3505328 - RNA, 21 nt, Human
cacuuuacaauguucauccca

SEQ ID NO: 3505329 - RNA, 15 nt, Human
cacuuuauuuacuuc

SEQ ID NO: 3505330 - RNA, 12 nt, Human
cacuuucaaaac

SEQ ID NO: 3505331 - RNA, 21 nt, Human
cacuuucaaucuucaauccuu

SEQ ID NO: 3505332 - RNA, 18 nt, Human
cacuuucagcugucuuuu

SEQ ID NO: 3505333 - RNA, 14 nt, Human
cacuuucaggaaca

SEQ ID NO: 3505334 - RNA, 14 nt, Human
cacuuucauugcca

SEQ ID NO: 3505335 - RNA, 17 nt, Human
cacuuucauugccagug

SEQ ID NO: 3505336 - RNA, 14 nt, Human
cacuuuccaaguca

SEQ ID NO: 3505337 - RNA, 12 nt, Human
cacuuuccacuu

SEQ ID NO: 3505338 - RNA, 22 nt, Human
cacuuuccacuucuuccuuucu

SEQ ID NO: 3505339 - RNA, 23 nt, Human
cacuuucuacaaugugaacuuua

SEQ ID NO: 3505340 - RNA, 22 nt, Human
cacuuucuagccagaggagaga

SEQ ID NO: 3505341 - RNA, 12 nt, Human
cacuuugaaaua

SEQ ID NO: 3505342 - RNA, 18 nt, Human
cacuuugaaauaccucau

SEQ ID NO: 3505343 - RNA, 15 nt, Human
cacuuugaaaugugu

SEQ ID NO: 3505344 - RNA, 18 nt, Human
cacuuugaagucuauaaa

SEQ ID NO: 3505345 - RNA, 17 nt, Human
cacuuugagccugggaa

SEQ ID NO: 3505346 - RNA, 19 nt, Human
cacuuugagccugggaaau

SEQ ID NO: 3505347 - RNA, 13 nt, Human
cacuuugcacauu

SEQ ID NO: 3505348 - RNA, 14 nt, Human
cacuuugcacauuu

SEQ ID NO: 3505349 - RNA, 15 nt, Human
cacuuugcacauuuu

SEQ ID NO: 3505350 - RNA, 19 nt, Human
cacuuugcacgacgcccuc

SEQ ID NO: 3505351 - RNA, 19 nt, Human
cacuuugcucuggguggaa

SEQ ID NO: 3505352 - RNA, 19 nt, Human
cacuuugcuuuaauauaaa

SEQ ID NO: 3505353 - RNA, 20 nt, Human
cacuuugcuuuaauauaaau

SEQ ID NO: 3505354 - RNA, 23 nt, Human
cacuuuggcuuauaauucuuuca

SEQ ID NO: 3505355 - RNA, 14 nt, Human
cacuuugggaggcc

SEQ ID NO: 3505356 - RNA, 23 nt, Human
cacuuugggaggccaaggagggc

SEQ ID NO: 3505357 - RNA, 14 nt, Human
cacuuuguugcaag

SEQ ID NO: 3505358 - RNA, 22 nt, Human
cacuuuguugcaagaugugaau

SEQ ID NO: 3505359 - RNA, 13 nt, Human
cacuuuucaguga

SEQ ID NO: 3505360 - RNA, 16 nt, Human
cacuuuuccaguauuu

SEQ ID NO: 3505361 - RNA, 21 nt, Human
cacuuuuucuuuacaaacaaa

SEQ ID NO: 3505362 - RNA, 16 nt, Human
cacuuuuugaacuaag

SEQ ID NO: 3505363 - RNA, 14 nt, Human
cacuuuuugcagcu

SEQ ID NO: 3505364 - RNA, 18 nt, Human
cacuuuuugcagcuuucu

SEQ ID NO: 3505365 - RNA, 22 nt, Human
cacuuuuuuggggguaaaaaau

SEQ ID NO: 3505366 - RNA, 11 nt, Human
cagaaaaaagg

SEQ ID NO: 3505367 - RNA, 16 nt, Human
cagaaaaacaauaaga

SEQ ID NO: 3505368 - RNA, 22 nt, Human
cagaaaaacaaugguaacauuu

SEQ ID NO: 3505369 - RNA, 22 nt, Human
cagaaaaaccaacaucuacaaa

SEQ ID NO: 3505370 - RNA, 15 nt, Human
cagaaaaaccuuggg

SEQ ID NO: 3505371 - RNA, 19 nt, Human
cagaaaaacguguugccuu

SEQ ID NO: 3505372 - RNA, 13 nt, Human
cagaaaacaaaac

SEQ ID NO: 3505373 - RNA, 15 nt, Human
cagaaaacaaaacug

SEQ ID NO: 3505374 - RNA, 14 nt, Human
cagaaaacaacaaa

SEQ ID NO: 3505375 - RNA, 16 nt, Human
cagaaaacaacaaaaa

SEQ ID NO: 3505376 - RNA, 13 nt, Human
cagaaaacagaaa

SEQ ID NO: 3505377 - RNA, 17 nt, Human
cagaaaacagaaaaaaa

SEQ ID NO: 3505378 - RNA, 12 nt, Human
cagaaaacauug

SEQ ID NO: 3505379 - RNA, 16 nt, Human
cagaaaacauuguucc

SEQ ID NO: 3505380 - RNA, 19 nt, Human
cagaaaacccuugggccag

SEQ ID NO: 3505381 - RNA, 23 nt, Human
cagaaaacccuugggccagaagu

SEQ ID NO: 3505382 - RNA, 16 nt, Human
cagaaaacgggaagcg

SEQ ID NO: 3505383 - RNA, 15 nt, Human
cagaaaacuuuaaaa

SEQ ID NO: 3505384 - RNA, 23 nt, Human
cagaaaagaaagcuacagaagaa

SEQ ID NO: 3505385 - RNA, 14 nt, Human
cagaaaaggacaga

SEQ ID NO: 3505386 - RNA, 17 nt, Human
cagaaaaguugaauuuu

SEQ ID NO: 3505387 - RNA, 20 nt, Human
cagaaaaguugaauuuuaca

SEQ ID NO: 3505388 - RNA, 23 nt, Human
cagaaaauaaggcacccaucugu

SEQ ID NO: 3505389 - RNA, 14 nt, Human
cagaaaauauguau

SEQ ID NO: 3505390 - RNA, 20 nt, Human
cagaaaauauguauuaacac

SEQ ID NO: 3505391 - RNA, 14 nt, Human
cagaaaaugaaaaa

SEQ ID NO: 3505392 - RNA, 19 nt, Human
cagaaaaugaacacagcag

SEQ ID NO: 3505393 - RNA, 18 nt, Human
cagaaaauguugagaauc

SEQ ID NO: 3505394 - RNA, 14 nt, Human
cagaaaauucugug

SEQ ID NO: 3505395 - RNA, 23 nt, Human
cagaaaauucugugccuuguuuu

SEQ ID NO: 3505396 - RNA, 16 nt, Human
cagaaaauugcacaau

SEQ ID NO: 3505397 - RNA, 15 nt, Human
cagaaacacccacag

SEQ ID NO: 3505398 - RNA, 17 nt, Human
cagaaacacccacaggc

SEQ ID NO: 3505399 - RNA, 21 nt, Human
cagaaacacccucacacuggg

SEQ ID NO: 3505400 - RNA, 14 nt, Human
cagaaacacugccu

SEQ ID NO: 3505401 - RNA, 15 nt, Human
cagaaacacugccuu

SEQ ID NO: 3505402 - RNA, 15 nt, Human
cagaaacagugaguu

SEQ ID NO: 3505403 - RNA, 17 nt, Human
cagaaacaucaguuacu

SEQ ID NO: 3505404 - RNA, 19 nt, Human
cagaaacaucaguuacucu

SEQ ID NO: 3505405 - RNA, 14 nt, Human
cagaaaccaguuau

SEQ ID NO: 3505406 - RNA, 16 nt, Human
cagaaacccugagcag

SEQ ID NO: 3505407 - RNA, 22 nt, Human
cagaaaccuauccucacugccc

SEQ ID NO: 3505408 - RNA, 18 nt, Human
cagaaaccuuccugcuga

SEQ ID NO: 3505409 - RNA, 17 nt, Human
cagaaacgccacauccc

SEQ ID NO: 3505410 - RNA, 19 nt, Human
cagaaacuguucccaccug

SEQ ID NO: 3505411 - RNA, 16 nt, Human
cagaaacuuguucuuc

SEQ ID NO: 3505412 - RNA, 18 nt, Human
cagaaacuuguucuucca

SEQ ID NO: 3505413 - RNA, 13 nt, Human
auguuuuguaaga

SEQ ID NO: 3505414 - RNA, 20 nt, Human
auguuuuguauacaaauaua

SEQ ID NO: 3505415 - RNA, 14 nt, Human
auguuuugugacua

SEQ ID NO: 3505416 - RNA, 19 nt, Human
auguuuugugacuauauag

SEQ ID NO: 3505417 - RNA, 22 nt, Human
auguuuugugcauuuguaaaug

SEQ ID NO: 3505418 - RNA, 18 nt, Human
auguuuugugggaacaga

SEQ ID NO: 3505419 - RNA, 14 nt, Human
auguuuuguuucug

SEQ ID NO: 3505420 - RNA, 23 nt, Human
auguuuuuaaaaguuucaaugug

SEQ ID NO: 3505421 - RNA, 16 nt, Human
auguuuuuaaaaucuu

SEQ ID NO: 3505422 - RNA, 16 nt, Human
auguuuuuaaauauau

SEQ ID NO: 3505423 - RNA, 15 nt, Human
auguuuuuaauaaaa

SEQ ID NO: 3505424 - RNA, 19 nt, Human
auguuuuuaauaaaagaaa

SEQ ID NO: 3505425 - RNA, 14 nt, Human
auguuuuuaaugua

SEQ ID NO: 3505426 - RNA, 18 nt, Human
auguuuuuauacaaaaua

SEQ ID NO: 3505427 - RNA, 16 nt, Human
auguuuuuaugauauc

SEQ ID NO: 3505428 - RNA, 16 nt, Human
auguuuuucaguucaa

SEQ ID NO: 3505429 - RNA, 17 nt, Human
auguuuuucaguucaaa

SEQ ID NO: 3505430 - RNA, 22 nt, Human
auguuuuucaguucaaagucau

SEQ ID NO: 3505431 - RNA, 15 nt, Human
auguuuuucaugaaa

SEQ ID NO: 3505432 - RNA, 14 nt, Human
auguuuuucuaaag

SEQ ID NO: 3505433 - RNA, 17 nt, Human
auguuuuugaaacagaa

SEQ ID NO: 3505434 - RNA, 12 nt, Human
auguuuuugaag

SEQ ID NO: 3505435 - RNA, 15 nt, Human
auguuuuugaaggca

SEQ ID NO: 3505436 - RNA, 22 nt, Human
auguuuuugaucaaaaacuauu

SEQ ID NO: 3505437 - RNA, 18 nt, Human
auguuuuuguacucugca

SEQ ID NO: 3505438 - RNA, 17 nt, Human
auguuuuuguguauuug

SEQ ID NO: 3505439 - RNA, 22 nt, Human
auguuuuuuaaaauauuuaucu

SEQ ID NO: 3505440 - RNA, 16 nt, Human
auguuuuuuauuaugc

SEQ ID NO: 3505441 - RNA, 12 nt, Human
auguuuuuugcc

SEQ ID NO: 3505442 - RNA, 12 nt, Human
auuaaaaaacaa

SEQ ID NO: 3505443 - RNA, 13 nt, Human
auuaaaaaagaua

SEQ ID NO: 3505444 - RNA, 20 nt, Human
auuaaaaaaucaguuguaca

SEQ ID NO: 3505445 - RNA, 16 nt, Human
cagaaguuaguuugua

SEQ ID NO: 3505446 - RNA, 18 nt, Human
cagaaguuaguuuguaua

SEQ ID NO: 3505447 - RNA, 14 nt, Human
cagaaguuuaaaua

SEQ ID NO: 3505448 - RNA, 15 nt, Human
cagaaguuucucagc

SEQ ID NO: 3505449 - RNA, 19 nt, Human
cagaaguuucucagcuccc

SEQ ID NO: 3505450 - RNA, 22 nt, Human
cagaaguuugagaucagccugg

SEQ ID NO: 3505451 - RNA, 16 nt, Human
cagaaguuugcacuau

SEQ ID NO: 3505452 - RNA, 18 nt, Human
cagaaguuugcacuaucu

SEQ ID NO: 3505453 - RNA, 19 nt, Human
cagaaguuugucaagucaa

SEQ ID NO: 3505454 - RNA, 16 nt, Human
cagaauaaagcaauuu

SEQ ID NO: 3505455 - RNA, 23 nt, Human
cagaauaaagcaauuuuccuuga

SEQ ID NO: 3505456 - RNA, 18 nt, Human
cagaauaaggcaggcauu

SEQ ID NO: 3505457 - RNA, 20 nt, Human
cagaauaaggcaggcauuga

SEQ ID NO: 3505458 - RNA, 23 nt, Human
cagaauaaguuauugcaguuuau

SEQ ID NO: 3505459 - RNA, 14 nt, Human
cagaauaaugaaug

SEQ ID NO: 3505460 - RNA, 18 nt, Human
cagaauaauguucuauug

SEQ ID NO: 3505461 - RNA, 15 nt, Human
cagaauacugaugga

SEQ ID NO: 3505462 - RNA, 19 nt, Human
cagaauagauagcacugaa

SEQ ID NO: 3505463 - RNA, 22 nt, Human
cagaauagccacauuuggaaua

SEQ ID NO: 3505464 - RNA, 12 nt, Human
cagaauaucugg

SEQ ID NO: 3505465 - RNA, 12 nt, Human
cagaauauguuu

SEQ ID NO: 3505466 - RNA, 18 nt, Human
cagaauauguuucaaacu

SEQ ID NO: 3505467 - RNA, 13 nt, Human
cagaauauugcuu

SEQ ID NO: 3505468 - RNA, 13 nt, Human
cagaauauuuuua

SEQ ID NO: 3505469 - RNA, 21 nt, Human
cagaauauuuuuauauuuccu

SEQ ID NO: 3505470 - RNA, 21 nt, Human
cagaaucauaugauucugcuu

SEQ ID NO: 3505471 - RNA, 20 nt, Human
cagaaucauugcuuaugaca

SEQ ID NO: 3505472 - RNA, 20 nt, Human
cagaaucccucuacauggac

SEQ ID NO: 3505473 - RNA, 15 nt, Human
cagaauccuggcccu

SEQ ID NO: 3505474 - RNA, 23 nt, Human
cagaaucgcuccaccuugcagcu

SEQ ID NO: 3505475 - RNA, 15 nt, Human
cagaaucuaaagcca

SEQ ID NO: 3505476 - RNA, 17 nt, Human
cagaaucucaaauaacu

SEQ ID NO: 3505477 - RNA, 15 nt, Human
cagaaucugaaugua

SEQ ID NO: 3505478 - RNA, 12 nt, Human
cagaaucuguau

SEQ ID NO: 3505479 - RNA, 13 nt, Human
cagaaucuuuguu

SEQ ID NO: 3505480 - RNA, 12 nt, Human
cagaaugaaaaa

SEQ ID NO: 3505481 - RNA, 13 nt, Human
cagaaugaaaaau

SEQ ID NO: 3505482 - RNA, 14 nt, Human
cagaaugaaaaaug

SEQ ID NO: 3505483 - RNA, 16 nt, Human
cagaaugaaaaaugaa

SEQ ID NO: 3505484 - RNA, 17 nt, Human
cagaaugaaaaaugaaa

SEQ ID NO: 3505485 - RNA, 18 nt, Human
cagaaugaaaaaugaaag

SEQ ID NO: 3505486 - RNA, 21 nt, Human
cagaaugaaaaaugaaagaug

SEQ ID NO: 3505487 - RNA, 23 nt, Human
cagaaugaaaaaugaaagaugau

SEQ ID NO: 3505488 - RNA, 18 nt, Human
cagaauggggugcaugaa

SEQ ID NO: 3505489 - RNA, 13 nt, Human
cagaauguaagug

SEQ ID NO: 3505490 - RNA, 18 nt, Human
cagaauguaagugggccc

SEQ ID NO: 3505491 - RNA, 14 nt, Human
cagaauguaucugu

SEQ ID NO: 3505492 - RNA, 12 nt, Human
cagaaugucaga

SEQ ID NO: 3505493 - RNA, 22 nt, Human
cagaaugucagauuccuuuccc

SEQ ID NO: 3505494 - RNA, 21 nt, Human
cagaaugucauuuugguacuu

SEQ ID NO: 3505495 - RNA, 14 nt, Human
cagaaugugauuuc

SEQ ID NO: 3505496 - RNA, 16 nt, Human
cagaauguuuuacugu

SEQ ID NO: 3505497 - RNA, 20 nt, Human
cagaauguuuuacugugaaa

SEQ ID NO: 3505498 - RNA, 15 nt, Human
cagaauuaaacuuuu

SEQ ID NO: 3505499 - RNA, 16 nt, Human
cagaauuaaacuuuua

SEQ ID NO: 3505500 - RNA, 14 nt, Human
cagaauuacuguaa

SEQ ID NO: 3505501 - RNA, 20 nt, Human
cagaauuaugauggaagaca

SEQ ID NO: 3505502 - RNA, 13 nt, Human
cagaauuauuuuu

SEQ ID NO: 3505503 - RNA, 14 nt, Human
cagaauucauucau

SEQ ID NO: 3505504 - RNA, 22 nt, Human
cagaauucauucauacuuaaaa

SEQ ID NO: 3505505 - RNA, 11 nt, Human
cagaauucuca

SEQ ID NO: 3505506 - RNA, 13 nt, Human
cagaauucugcua

SEQ ID NO: 3505507 - RNA, 15 nt, Human
cagaauugaaacacu

SEQ ID NO: 3505508 - RNA, 13 nt, Human
cagaauuggaaaa

SEQ ID NO: 3505509 - RNA, 17 nt, Human
cagaauuggaaaagacu

SEQ ID NO: 3505510 - RNA, 23 nt, Human
cagaauuggauacauacaccagc

SEQ ID NO: 3505511 - RNA, 19 nt, Human
cagaauugugcaaauggaa

SEQ ID NO: 3505512 - RNA, 16 nt, Human
cagaauugugucugca

SEQ ID NO: 3505513 - RNA, 18 nt, Human
cagaauugugucugcagg

SEQ ID NO: 3505514 - RNA, 20 nt, Human
cagaauuuuauacuuucccu

SEQ ID NO: 3505515 - RNA, 21 nt, Human
cagaauuuuauacuuucccua

SEQ ID NO: 3505516 - RNA, 16 nt, Human
cagaauuuuggaagau

SEQ ID NO: 3505517 - RNA, 18 nt, Human
cagaauuuuuuuuguugu

SEQ ID NO: 3505518 - RNA, 18 nt, Human
cagacaaaaacagccuca

SEQ ID NO: 3505519 - RNA, 20 nt, Human
cagacaaaagcgcuuuuccu

SEQ ID NO: 3505520 - RNA, 12 nt, Human
cagacaaagcgu

SEQ ID NO: 3505521 - RNA, 22 nt, Human
cagacaaagcgugguggacaug

SEQ ID NO: 3505522 - RNA, 20 nt, Human
cagacaacaaaccuguuucu

SEQ ID NO: 3505523 - RNA, 17 nt, Human
cagacaacacguuacua

SEQ ID NO: 3505524 - RNA, 16 nt, Human
cagacaacagaaguca

SEQ ID NO: 3505525 - RNA, 17 nt, Human
cagacaacagaagucau

SEQ ID NO: 3505526 - RNA, 22 nt, Human
cagacaagauuuuuuaauuguu

SEQ ID NO: 3505527 - RNA, 15 nt, Human
cagacaagcuguuga

SEQ ID NO: 3505528 - RNA, 21 nt, Human
cagacaagugacuguaucugu

SEQ ID NO: 3505529 - RNA, 18 nt, Human
cagacaauaaacccucag

SEQ ID NO: 3505530 - RNA, 20 nt, Human
cagacaauaaacccucagag

SEQ ID NO: 3505531 - RNA, 22 nt, Human
cagacaauaaacccucagagcc

SEQ ID NO: 3505532 - RNA, 22 nt, Human
cagacaauaugugagugccuuu

SEQ ID NO: 3505533 - RNA, 13 nt, Human
cagacacacacac

SEQ ID NO: 3505534 - RNA, 14 nt, Human
cagacacacacaca

SEQ ID NO: 3505535 - RNA, 16 nt, Human
cagacacacacacgca

SEQ ID NO: 3505536 - RNA, 14 nt, Human
cagacacaggcccg

SEQ ID NO: 3505537 - RNA, 17 nt, Human
cagacacagggacuuga

SEQ ID NO: 3505538 - RNA, 18 nt, Human
cagacacagggacuugaa

SEQ ID NO: 3505539 - RNA, 21 nt, Human
cagacacauguccaagaagcc

SEQ ID NO: 3505540 - RNA, 23 nt, Human
cagacacauguccaagaagccca

SEQ ID NO: 3505541 - RNA, 13 nt, Human
cagacacccaccc

SEQ ID NO: 3505542 - RNA, 14 nt, Human
cagacacccaggac

SEQ ID NO: 3505543 - RNA, 14 nt, Human
cagacacccucaac

SEQ ID NO: 3505544 - RNA, 15 nt, Human
cagacacccucaacc

SEQ ID NO: 3505545 - RNA, 21 nt, Human
cagacacccucaaccucuucu

SEQ ID NO: 3505546 - RNA, 15 nt, Human
cagacaccgccacau

SEQ ID NO: 3505547 - RNA, 22 nt, Human
cagacaccuugacagggcacac

SEQ ID NO: 3505548 - RNA, 19 nt, Human
cagacacuaacgaaauauc

SEQ ID NO: 3505549 - RNA, 12 nt, Human
cagacacuaagu

SEQ ID NO: 3505550 - RNA, 16 nt, Human
cagacacucugcucug

SEQ ID NO: 3505551 - RNA, 14 nt, Human
cagacacuuuggaa

SEQ ID NO: 3505552 - RNA, 20 nt, Human
cagacagaacuugaaugugu

SEQ ID NO: 3505553 - RNA, 15 nt, Human
cagacagacacacac

SEQ ID NO: 3505554 - RNA, 13 nt, Human
cagacagagccag

SEQ ID NO: 3505555 - RNA, 16 nt, Human
cagacagagccaggag

SEQ ID NO: 3505556 - RNA, 23 nt, Human
cagacagagccaggagaagcuca

SEQ ID NO: 3505557 - RNA, 14 nt, Human
cagacagaggauga

SEQ ID NO: 3505558 - RNA, 11 nt, Human
cagacagauga

SEQ ID NO: 3505559 - RNA, 22 nt, Human
caucucugggcuggaugagcuc

SEQ ID NO: 3505560 - RNA, 23 nt, Human
caucucugggcuggaugagcucc

SEQ ID NO: 3505561 - RNA, 18 nt, Human
caucucuguacuuugcuu

SEQ ID NO: 3505562 - RNA, 20 nt, Human
caucucugucccauucccug

SEQ ID NO: 3505563 - RNA, 21 nt, Human
caucucugucccauucccugg

SEQ ID NO: 3505564 - RNA, 23 nt, Human
caucucugucccauucccuggga

SEQ ID NO: 3505565 - RNA, 18 nt, Human
caucucuuagcuccccuc

SEQ ID NO: 3505566 - RNA, 13 nt, Human
caucucuuugaau

SEQ ID NO: 3505567 - RNA, 19 nt, Human
caucucuuugaauuuucug

SEQ ID NO: 3505568 - RNA, 14 nt, Human
caucugaaagccac

SEQ ID NO: 3505569 - RNA, 15 nt, Human
caucugaagagcaga

SEQ ID NO: 3505570 - RNA, 19 nt, Human
caucugaaggggcaaauuc

SEQ ID NO: 3505571 - RNA, 19 nt, Human
caucugaauuugcccuggg

SEQ ID NO: 3505572 - RNA, 15 nt, Human
caucugacacaaaaa

SEQ ID NO: 3505573 - RNA, 17 nt, Human
caucugaccagcagcgc

SEQ ID NO: 3505574 - RNA, 17 nt, Human
caucugacuaugacaua

SEQ ID NO: 3505575 - RNA, 18 nt, Human
caucugacucacaagaag

SEQ ID NO: 3505576 - RNA, 23 nt, Human
caucugagaaaagcuuugaaccc

SEQ ID NO: 3505577 - RNA, 15 nt, Human
caucugagcaagagc

SEQ ID NO: 3505578 - RNA, 18 nt, Human
caucugagcaagagcugg

SEQ ID NO: 3505579 - RNA, 16 nt, Human
caucugaggcauccag

SEQ ID NO: 3505580 - RNA, 17 nt, Human
caucugaggcauccagc

SEQ ID NO: 3505581 - RNA, 15 nt, Human
caucugagguuuuau

SEQ ID NO: 3505582 - RNA, 18 nt, Human
caucugaugccgugaucc

SEQ ID NO: 3505583 - RNA, 13 nt, Human
caucugauuugca

SEQ ID NO: 3505584 - RNA, 15 nt, Human
caucugauuugcaua

SEQ ID NO: 3505585 - RNA, 17 nt, Human
caucugcaccccuucuc

SEQ ID NO: 3505586 - RNA, 16 nt, Human
caucugcacccuucuu

SEQ ID NO: 3505587 - RNA, 22 nt, Human
caucugcacccuucuuuucuca

SEQ ID NO: 3505588 - RNA, 18 nt, Human
caucugcauugcccaguc

SEQ ID NO: 3505589 - RNA, 20 nt, Human
caucugcauuuucaccccac

SEQ ID NO: 3505590 - RNA, 13 nt, Human
caucugcccaggg

SEQ ID NO: 3505591 - RNA, 23 nt, Human
caucugcccaggggugcccccuc

SEQ ID NO: 3505592 - RNA, 16 nt, Human
caucugccccacaguc

SEQ ID NO: 3505593 - RNA, 22 nt, Human
caucugcgugacaauaaaacau

SEQ ID NO: 3505594 - RNA, 23 nt, Human
caucugcgugacaauaaaacauu

SEQ ID NO: 3505595 - RNA, 11 nt, Human
caucugcuccu

SEQ ID NO: 3505596 - RNA, 16 nt, Human
caucugcucuccuucc

SEQ ID NO: 3505597 - RNA, 18 nt, Human
caucugcucuccuuccug

SEQ ID NO: 3505598 - RNA, 12 nt, Human
caucugcugucu

SEQ ID NO: 3505599 - RNA, 16 nt, Human
caucuggaaaauaaaa

SEQ ID NO: 3505600 - RNA, 19 nt, Human
caucuggaaccaucagaaa

SEQ ID NO: 3505601 - RNA, 14 nt, Human
caucuggaagauca

SEQ ID NO: 3505602 - RNA, 21 nt, Human
caucuggaaggggaucccacc

SEQ ID NO: 3505603 - RNA, 22 nt, Human
caucuggaaguuaaagugaggc

SEQ ID NO: 3505604 - RNA, 16 nt, Human
caucuggaaucuggag

SEQ ID NO: 3505605 - RNA, 21 nt, Human
caucuggaaucuggagaccag

SEQ ID NO: 3505606 - RNA, 23 nt, Human
caguacacugucagcagggacug

SEQ ID NO: 3505607 - RNA, 17 nt, Human
caguacagugguucuac

SEQ ID NO: 3505608 - RNA, 14 nt, Human
caguacaugggaaa

SEQ ID NO: 3505609 - RNA, 16 nt, Human
caguacauuuaauuga

SEQ ID NO: 3505610 - RNA, 14 nt, Human
caguaccaucugaa

SEQ ID NO: 3505611 - RNA, 14 nt, Human
caguacccaccuga

SEQ ID NO: 3505612 - RNA, 15 nt, Human
caguacccaccugag

SEQ ID NO: 3505613 - RNA, 16 nt, Human
caguacccucucagcu

SEQ ID NO: 3505614 - RNA, 20 nt, Human
caguacccucucagcuccag

SEQ ID NO: 3505615 - RNA, 12 nt, Human
caguaccuccug

SEQ ID NO: 3505616 - RNA, 23 nt, Human
caguaccugagggucuguagguu

SEQ ID NO: 3505617 - RNA, 13 nt, Human
caguaccuggagg

SEQ ID NO: 3505618 - RNA, 18 nt, Human
caguacuucagcaagaga

SEQ ID NO: 3505619 - RNA, 19 nt, Human
caguacuucagcaagagag

SEQ ID NO: 3505620 - RNA, 12 nt, Human
caguacuuguca

SEQ ID NO: 3505621 - RNA, 22 nt, Human
caguagaacuccaggcccuccu

SEQ ID NO: 3505622 - RNA, 12 nt, Human
caguagaacugu

SEQ ID NO: 3505623 - RNA, 12 nt, Human
caguagacauuu

SEQ ID NO: 3505624 - RNA, 15 nt, Human
caguagacauuuuaa

SEQ ID NO: 3505625 - RNA, 16 nt, Human
caguagacauuuuaac

SEQ ID NO: 3505626 - RNA, 20 nt, Human
caguagacauuuuaacaaga

SEQ ID NO: 3505627 - RNA, 20 nt, Human
caguagaccuuguuacuucu

SEQ ID NO: 3505628 - RNA, 12 nt, Human
caguagagccag

SEQ ID NO: 3505629 - RNA, 16 nt, Human
caguagagucaucucc

SEQ ID NO: 3505630 - RNA, 23 nt, Human
caguagauuuucuuuaaaagaau

SEQ ID NO: 3505631 - RNA, 21 nt, Human
caguagcacaaguuauuuaaa

SEQ ID NO: 3505632 - RNA, 18 nt, Human
caguagcuuaagaaaaaa

SEQ ID NO: 3505633 - RNA, 22 nt, Human
caguaggagcccagcucugaaa

SEQ ID NO: 3505634 - RNA, 19 nt, Human
caguaggggcuuauaauaa

SEQ ID NO: 3505635 - RNA, 22 nt, Human
caguaggggcuuauaauaaagg

SEQ ID NO: 3505636 - RNA, 22 nt, Human
caguaggugcccagaauaaguu

SEQ ID NO: 3505637 - RNA, 15 nt, Human
caguagguuggcagu

SEQ ID NO: 3505638 - RNA, 23 nt, Human
caguagucucugugcuuugacuc

SEQ ID NO: 3505639 - RNA, 23 nt, Human
caguagucuugaugaccaaaguc

SEQ ID NO: 3505640 - RNA, 18 nt, Human
caguaguuuaaaaguucu

SEQ ID NO: 3505641 - RNA, 22 nt, Human
caguauaaaauuacaguggauu

SEQ ID NO: 3505642 - RNA, 17 nt, Human
caguauaaagaauagga

SEQ ID NO: 3505643 - RNA, 15 nt, Human
caguauaauuaacau

SEQ ID NO: 3505644 - RNA, 12 nt, Human
caguauaauucu

SEQ ID NO: 3505645 - RNA, 14 nt, Human
caguauacaguccu

SEQ ID NO: 3505646 - RNA, 12 nt, Human
caguauagaaua

SEQ ID NO: 3505647 - RNA, 14 nt, Human
caguaucaggccug

SEQ ID NO: 3505648 - RNA, 20 nt, Human
caguaucaugcccugugcaa

SEQ ID NO: 3505649 - RNA, 16 nt, Human
caguaucccacaucca

SEQ ID NO: 3505650 - RNA, 14 nt, Human
caguaucggcacug

SEQ ID NO: 3505651 - RNA, 16 nt, Human
caguaucggcacugua

SEQ ID NO: 3505652 - RNA, 16 nt, Human
caguaucuauauaugu

SEQ ID NO: 3505653 - RNA, 19 nt, Human
caguaucuauauaugugua

SEQ ID NO: 3505654 - RNA, 20 nt, Human
caguaucuauauauguguau

SEQ ID NO: 3505655 - RNA, 22 nt, Human
caguaucuauauauguguaugu

SEQ ID NO: 3505656 - RNA, 16 nt, Human
caguaucucaaacaau

SEQ ID NO: 3505657 - RNA, 16 nt, Human
caguaucucuucaguc

SEQ ID NO: 3505658 - RNA, 17 nt, Human
caguaucucuucagucu

SEQ ID NO: 3505659 - RNA, 19 nt, Human
caguaucucuucagucucu

SEQ ID NO: 3505660 - RNA, 18 nt, Human
caguaucuugaagacuuu

SEQ ID NO: 3505661 - RNA, 21 nt, Human
caguaucuugaagacuuuucu

SEQ ID NO: 3505662 - RNA, 14 nt, Human
caguaugaaaauaa

SEQ ID NO: 3505663 - RNA, 19 nt, Human
caguaugaauuauucaauu

SEQ ID NO: 3505664 - RNA, 21 nt, Human
caguauggguuagggaaaaca

SEQ ID NO: 3505665 - RNA, 15 nt, Human
caguaugguacauuu

SEQ ID NO: 3505666 - RNA, 17 nt, Human
caguaugguacauuuuu

SEQ ID NO: 3505667 - RNA, 21 nt, Human
caguauggucuaacacuggca

SEQ ID NO: 3505668 - RNA, 16 nt, Human
caguaugucccauagg

SEQ ID NO: 3505669 - RNA, 12 nt, Human
caguauguggaa

SEQ ID NO: 3505670 - RNA, 17 nt, Human
caguauguuuuacacug

SEQ ID NO: 3505671 - RNA, 20 nt, Human
caguauguuuuacacuguac

SEQ ID NO: 3505672 - RNA, 20 nt, Human
caguauuaaaggggggaggg

SEQ ID NO: 3505673 - RNA, 13 nt, Human
caguauuauaugu

SEQ ID NO: 3505674 - RNA, 15 nt, Human
caguauuauauguac

SEQ ID NO: 3505675 - RNA, 21 nt, Human
caguauucuagguagugcccu

SEQ ID NO: 3505676 - RNA, 20 nt, Human
caguauuguuuugguuugcu

SEQ ID NO: 3505677 - RNA, 14 nt, Human
caguauuuaacuaa

SEQ ID NO: 3505678 - RNA, 17 nt, Human
caguauuuaacuaauua

SEQ ID NO: 3505679 - RNA, 17 nt, Human
caguauuuagaagccaa

SEQ ID NO: 3505680 - RNA, 17 nt, Human
caguauuuauuuuguaa

SEQ ID NO: 3505681 - RNA, 15 nt, Human
caguauuucauugcc

SEQ ID NO: 3505682 - RNA, 12 nt, Human
caguauuuguaa

SEQ ID NO: 3505683 - RNA, 18 nt, Human
caguauuuguaauuaaaa

SEQ ID NO: 3505684 - RNA, 16 nt, Human
caguauuuguggggag

SEQ ID NO: 3505685 - RNA, 15 nt, Human
caguauuuuagugga

SEQ ID NO: 3505686 - RNA, 17 nt, Human
caguauuuuggagaaau

SEQ ID NO: 3505687 - RNA, 19 nt, Human
caguauuuugguucuuagu

SEQ ID NO: 3505688 - RNA, 14 nt, Human
caguauuuuguguc

SEQ ID NO: 3505689 - RNA, 13 nt, Human
caguauuuuuaaa

SEQ ID NO: 3505690 - RNA, 15 nt, Human
caguauuuuuaaagg

SEQ ID NO: 3505691 - RNA, 17 nt, Human
caguauuuuuaaaggca

SEQ ID NO: 3505692 - RNA, 19 nt, Human
caguauuuuuaaaggcauu

SEQ ID NO: 3505693 - RNA, 20 nt, Human
caguauuuuugcugcuucug

SEQ ID NO: 3505694 - RNA, 22 nt, Human
caguauuuuuguuguguucugu

SEQ ID NO: 3505695 - RNA, 17 nt, Human
caguauuuuuuuuuuua

SEQ ID NO: 3505696 - RNA, 15 nt, Human
cagucaaaacagaga

SEQ ID NO: 3505697 - RNA, 15 nt, Human
cagucaaaauaauuc

SEQ ID NO: 3505698 - RNA, 16 nt, Human
cagucaacaaacuauu

SEQ ID NO: 3505699 - RNA, 15 nt, Human
cagucaaccugggca

SEQ ID NO: 3505700 - RNA, 22 nt, Human
cagucaaccugggcaaagccua

SEQ ID NO: 3505701 - RNA, 22 nt, Human
cagucaagcuguugaagucuca

SEQ ID NO: 3505702 - RNA, 14 nt, Human
cagucaauuacaug

SEQ ID NO: 3505703 - RNA, 16 nt, Human
cagucacaaauuucuc

SEQ ID NO: 3505704 - RNA, 17 nt, Human
cagucuuaugcuuccag

SEQ ID NO: 3505705 - RNA, 17 nt, Human
cagucuuccacaaagaa

SEQ ID NO: 3505706 - RNA, 18 nt, Human
cagucuuccacaaagaaa

SEQ ID NO: 3505707 - RNA, 18 nt, Human
cagucuuccaccuggaag

SEQ ID NO: 3505708 - RNA, 21 nt, Human
cagucuuccauuugcaaggga

SEQ ID NO: 3505709 - RNA, 13 nt, Human
cagucuuccugac

SEQ ID NO: 3505710 - RNA, 15 nt, Human
cagucuugaauuucu

SEQ ID NO: 3505711 - RNA, 22 nt, Human
cagucuugaauuucuaaaaaac

SEQ ID NO: 3505712 - RNA, 23 nt, Human
cagucuugaauuucuaaaaaaca

SEQ ID NO: 3505713 - RNA, 16 nt, Human
cagucuuggcucacug

SEQ ID NO: 3505714 - RNA, 19 nt, Human
cagucuuuaaaggcccagc

SEQ ID NO: 3505715 - RNA, 21 nt, Human
cagucuuuaaaggcccagccc

SEQ ID NO: 3505716 - RNA, 22 nt, Human
cagucuuuaaaggcccagcccc

SEQ ID NO: 3505717 - RNA, 18 nt, Human
cagucuuucaugugugcc

SEQ ID NO: 3505718 - RNA, 14 nt, Human
cagucuuuuucugu

SEQ ID NO: 3505719 - RNA, 18 nt, Human
cagucuuuuucuguugua

SEQ ID NO: 3505720 - RNA, 19 nt, Human
cagucuuuuucuguuguaa

SEQ ID NO: 3505721 - RNA, 18 nt, Human
cagugaaaacaagugcug

SEQ ID NO: 3505722 - RNA, 20 nt, Human
cagugaaaacaagugcuggc

SEQ ID NO: 3505723 - RNA, 21 nt, Human
cagugaaaacaagugcuggca

SEQ ID NO: 3505724 - RNA, 12 nt, Human
cagugaaaaugu

SEQ ID NO: 3505725 - RNA, 18 nt, Human
cagugaaaauguaagcug

SEQ ID NO: 3505726 - RNA, 21 nt, Human
cagugaaaauguaagcuguuu

SEQ ID NO: 3505727 - RNA, 14 nt, Human
cagugaaccaaaga

SEQ ID NO: 3505728 - RNA, 20 nt, Human
cagugaaccaaagagacugg

SEQ ID NO: 3505729 - RNA, 21 nt, Human
cagugaaccaaagagacugga

SEQ ID NO: 3505730 - RNA, 23 nt, Human
cagugaaccaaagagacuggagc

SEQ ID NO: 3505731 - RNA, 14 nt, Human
cagugaagaaagcc

SEQ ID NO: 3505732 - RNA, 14 nt, Human
cagugaagacagaa

SEQ ID NO: 3505733 - RNA, 15 nt, Human
cagugaagacuauga

SEQ ID NO: 3505734 - RNA, 18 nt, Human
cagugaaguugcugcuuc

SEQ ID NO: 3505735 - RNA, 23 nt, Human
cagugaaguugcugcuucuccca

SEQ ID NO: 3505736 - RNA, 21 nt, Human
cagugaauuugcacuguuuaa

SEQ ID NO: 3505737 - RNA, 17 nt, Human
cagugaauuuuugcaau

SEQ ID NO: 3505738 - RNA, 18 nt, Human
cagugaauuuuugcaaua

SEQ ID NO: 3505739 - RNA, 20 nt, Human
cagugaauuuuugcaauaau

SEQ ID NO: 3505740 - RNA, 21 nt, Human
cagugaauuuuugcaauaaug

SEQ ID NO: 3505741 - RNA, 22 nt, Human
cagugaauuuuugcaauaaugc

SEQ ID NO: 3505742 - RNA, 23 nt, Human
cagugaauuuuugcaauaaugca

SEQ ID NO: 3505743 - RNA, 17 nt, Human
cagugacacgucucgcc

SEQ ID NO: 3505744 - RNA, 16 nt, Human
cagugacacuucagag

SEQ ID NO: 3505745 - RNA, 17 nt, Human
cagugacacuucagaga

SEQ ID NO: 3505746 - RNA, 13 nt, Human
cagugacccuggc

SEQ ID NO: 3505747 - RNA, 14 nt, Human
cagugaccugagga

SEQ ID NO: 3505748 - RNA, 18 nt, Human
cagugaccugaggaagcg

SEQ ID NO: 3505749 - RNA, 19 nt, Human
cagugaccugaggaagcgu

SEQ ID NO: 3505750 - RNA, 20 nt, Human
cagugaccuggaaggcccag

SEQ ID NO: 3505751 - RNA, 23 nt, Human
cagugaccuggaaggcccagcac

SEQ ID NO: 3505752 - RNA, 17 nt, Human
cagugacuccaggagag

SEQ ID NO: 3505753 - RNA, 21 nt, Human
cagugacuccaggagaggagc

SEQ ID NO: 3505754 - RNA, 21 nt, Human
cagugacucgggcuccugugc

SEQ ID NO: 3505755 - RNA, 20 nt, Human
cagugacuguggccaugguc

SEQ ID NO: 3505756 - RNA, 16 nt, Human
cagugacuucugagau

SEQ ID NO: 3505757 - RNA, 23 nt, Human
cagugagagaguggcuggggcau

SEQ ID NO: 3505758 - RNA, 23 nt, Human
cagugagccaagaucgcgccacu

SEQ ID NO: 3505759 - RNA, 13 nt, Human
cagugagccacuc

SEQ ID NO: 3505760 - RNA, 13 nt, Human
cagugagcugaga

SEQ ID NO: 3505761 - RNA, 14 nt, Human
cagugagcuggaga

SEQ ID NO: 3505762 - RNA, 18 nt, Human
cagugaggcucugcccuu

SEQ ID NO: 3505763 - RNA, 18 nt, Human
cagugagguccugggggc

SEQ ID NO: 3505764 - RNA, 21 nt, Human
cagugagguccugggggccug

SEQ ID NO: 3505765 - RNA, 23 nt, Human
cagugagguccugggggccugac

SEQ ID NO: 3505766 - RNA, 17 nt, Human
cagugagucucuucaga

SEQ ID NO: 3505767 - RNA, 17 nt, Human
cagugagugagccuggc

SEQ ID NO: 3505768 - RNA, 18 nt, Human
cagugagugagccuggcu

SEQ ID NO: 3505769 - RNA, 20 nt, Human
cagugagugagccuggcucu

SEQ ID NO: 3505770 - RNA, 18 nt, Human
cagugaguuacagcgaga

SEQ ID NO: 3505771 - RNA, 21 nt, Human
caugaccuccagcuuuccugu

SEQ ID NO: 3505772 - RNA, 14 nt, Human
caugaccugugacc

SEQ ID NO: 3505773 - RNA, 17 nt, Human
caugaccugugaccagc

SEQ ID NO: 3505774 - RNA, 17 nt, Human
caugacucggggguggg

SEQ ID NO: 3505775 - RNA, 19 nt, Human
caugacucuuuauugucug

SEQ ID NO: 3505776 - RNA, 22 nt, Human
caugacuugagaaacaaauaau

SEQ ID NO: 3505777 - RNA, 21 nt, Human
caugacuuguagcauauucuu

SEQ ID NO: 3505778 - RNA, 18 nt, Human
caugagaaauacaaaaau

SEQ ID NO: 3505779 - RNA, 12 nt, Human
caugagaaauua

SEQ ID NO: 3505780 - RNA, 16 nt, Human
caugagaacaaacaga

SEQ ID NO: 3505781 - RNA, 12 nt, Human
caugagaacaga

SEQ ID NO: 3505782 - RNA, 23 nt, Human
caugagaacagacuggccugagg

SEQ ID NO: 3505783 - RNA, 14 nt, Human
caugagaagagggc

SEQ ID NO: 3505784 - RNA, 16 nt, Human
caugagaagagggccu

SEQ ID NO: 3505785 - RNA, 18 nt, Human
caugagaagagggccugu

SEQ ID NO: 3505786 - RNA, 20 nt, Human
caugagaauaagagaaagaa

SEQ ID NO: 3505787 - RNA, 14 nt, Human
caugagacacaucu

SEQ ID NO: 3505788 - RNA, 19 nt, Human
caugagacacaucuccucc

SEQ ID NO: 3505789 - RNA, 17 nt, Human
caugagaccacuguuau

SEQ ID NO: 3505790 - RNA, 15 nt, Human
caugagacucagugc

SEQ ID NO: 3505791 - RNA, 17 nt, Human
caugagacucagugcag

SEQ ID NO: 3505792 - RNA, 18 nt, Human
caugagagcgcagcccgc

SEQ ID NO: 3505793 - RNA, 17 nt, Human
caugagaggcucugugc

SEQ ID NO: 3505794 - RNA, 20 nt, Human
caugagaucuaggugaggau

SEQ ID NO: 3505795 - RNA, 12 nt, Human
caugagaugugu

SEQ ID NO: 3505796 - RNA, 14 nt, Human
caugagaugugugg

SEQ ID NO: 3505797 - RNA, 15 nt, Human
caugagaugugugga

SEQ ID NO: 3505798 - RNA, 23 nt, Human
caugagauguguggacuguggca

SEQ ID NO: 3505799 - RNA, 16 nt, Human
caugagcaccccaagg

SEQ ID NO: 3505800 - RNA, 17 nt, Human
caugagcaucaggccag

SEQ ID NO: 3505801 - RNA, 20 nt, Human
caugagcaucaggccaggcc

SEQ ID NO: 3505802 - RNA, 20 nt, Human
caugagcauuggauacagca

SEQ ID NO: 3505803 - RNA, 16 nt, Human
caugagccgcccaagg

SEQ ID NO: 3505804 - RNA, 17 nt, Human
caugagccgcccaaggc

SEQ ID NO: 3505805 - RNA, 12 nt, Human
caugagccucag

SEQ ID NO: 3505806 - RNA, 17 nt, Human
caugagccucagcaucc

SEQ ID NO: 3505807 - RNA, 20 nt, Human
caugagccucagcauccugg

SEQ ID NO: 3505808 - RNA, 22 nt, Human
caugagccucagcauccuggca

SEQ ID NO: 3505809 - RNA, 22 nt, Human
caugagccugcuggaagcccag

SEQ ID NO: 3505810 - RNA, 13 nt, Human
caugagcuccaga

SEQ ID NO: 3505811 - RNA, 15 nt, Human
caugagcuccagacc

SEQ ID NO: 3505812 - RNA, 16 nt, Human
caugagcuccagaccc

SEQ ID NO: 3505813 - RNA, 19 nt, Human
caugagcuccagaccccca

SEQ ID NO: 3505814 - RNA, 21 nt, Human
caugaggaaagcaguugaaau

SEQ ID NO: 3505815 - RNA, 16 nt, Human
caugaggaacaaggca

SEQ ID NO: 3505816 - RNA, 18 nt, Human
caugaggaacuguagaug

SEQ ID NO: 3505817 - RNA, 22 nt, Human
caugaggaggggccccccugcc

SEQ ID NO: 3505818 - RNA, 15 nt, Human
caugaggaguugcug

SEQ ID NO: 3505819 - RNA, 22 nt, Human
caugaggccacugcugcuucuc

SEQ ID NO: 3505820 - RNA, 21 nt, Human
caugaggccucaguggacuuu

SEQ ID NO: 3505821 - RNA, 18 nt, Human
caugagggaucacagggc

SEQ ID NO: 3505822 - RNA, 20 nt, Human
caugagggaucacagggccc

SEQ ID NO: 3505823 - RNA, 22 nt, Human
caugagggguuccuccccucca

SEQ ID NO: 3505824 - RNA, 16 nt, Human
caugagguacugagag

SEQ ID NO: 3505825 - RNA, 14 nt, Human
caugagguaucuaa

SEQ ID NO: 3505826 - RNA, 23 nt, Human
caugaguagugggcuaugcagga

SEQ ID NO: 3505827 - RNA, 18 nt, Human
caugagucacuacgccug

SEQ ID NO: 3505828 - RNA, 17 nt, Human
caugagucccaguggga

SEQ ID NO: 3505829 - RNA, 18 nt, Human
caugaguccuugaaaaua

SEQ ID NO: 3505830 - RNA, 20 nt, Human
caugaguccuugaaaauauu

SEQ ID NO: 3505831 - RNA, 14 nt, Human
caugagugaauaaa

SEQ ID NO: 3505832 - RNA, 14 nt, Human
caugagugcgugcu

SEQ ID NO: 3505833 - RNA, 18 nt, Human
caugagugcgugcucagu

SEQ ID NO: 3505834 - RNA, 16 nt, Human
caugaguuaucaugaa

SEQ ID NO: 3505835 - RNA, 18 nt, Human
caugaguuccagaaagua

SEQ ID NO: 3505836 - RNA, 20 nt, Human
caugaguuccagaaaguaaa

SEQ ID NO: 3505837 - RNA, 21 nt, Human
caugaguuggggucuggcagc

SEQ ID NO: 3505838 - RNA, 22 nt, Human
caugaguuuuuucucuugggcu

SEQ ID NO: 3505839 - RNA, 14 nt, Human
caugauaugucagg

SEQ ID NO: 3505840 - RNA, 22 nt, Human
caugaucccuguguugucucua

SEQ ID NO: 3505841 - RNA, 13 nt, Human
caugauccugagu

SEQ ID NO: 3505842 - RNA, 15 nt, Human
caugaucucccugcc

SEQ ID NO: 3505843 - RNA, 16 nt, Human
caugaucucccugccg

SEQ ID NO: 3505844 - RNA, 17 nt, Human
caugaucucccugccgc

SEQ ID NO: 3505845 - RNA, 20 nt, Human
caugaucucccugccgccuc

SEQ ID NO: 3505846 - RNA, 21 nt, Human
caugaucuugugacauauuau

SEQ ID NO: 3505847 - RNA, 19 nt, Human
caauaaacauuucauuucc

SEQ ID NO: 3505848 - RNA, 16 nt, Human
caauaaaccaaugaac

SEQ ID NO: 3505849 - RNA, 20 nt, Human
caauaaacccucagagccuc

SEQ ID NO: 3505850 - RNA, 18 nt, Human
caauaaacgauuuaauuc

SEQ ID NO: 3505851 - RNA, 21 nt, Human
caauaaacgauuuaauucucu

SEQ ID NO: 3505852 - RNA, 18 nt, Human
caauaaacgcauuaucag

SEQ ID NO: 3505853 - RNA, 11 nt, Human
caauaaagcaa

SEQ ID NO: 3505854 - RNA, 17 nt, Human
caauaaagcaauaagaa

SEQ ID NO: 3505855 - RNA, 11 nt, Human
caauaaaguau

SEQ ID NO: 3505856 - RNA, 16 nt, Human
caauaaaguaucuaca

SEQ ID NO: 3505857 - RNA, 16 nt, Human
caauaaaguauuuaau

SEQ ID NO: 3505858 - RNA, 22 nt, Human
caauaaaguauuuaauuagugc

SEQ ID NO: 3505859 - RNA, 18 nt, Human
caauaaaguuugaucuuc

SEQ ID NO: 3505860 - RNA, 21 nt, Human
caauaaaguuugaucuuccuc

SEQ ID NO: 3505861 - RNA, 23 nt, Human
caauaaaguuugaucuuccucug

SEQ ID NO: 3505862 - RNA, 16 nt, Human
caauaaauagaccauu

SEQ ID NO: 3505863 - RNA, 18 nt, Human
caauaaaugguauagcaa

SEQ ID NO: 3505864 - RNA, 14 nt, Human
caauaaauguauuc

SEQ ID NO: 3505865 - RNA, 16 nt, Human
caauaaaugucuguug

SEQ ID NO: 3505866 - RNA, 17 nt, Human
caauaaaugugcuuaug

SEQ ID NO: 3505867 - RNA, 11 nt, Human
caauaaauuuu

SEQ ID NO: 3505868 - RNA, 15 nt, Human
caauaaauuuugaaa

SEQ ID NO: 3505869 - RNA, 14 nt, Human
caauaacacuaaaa

SEQ ID NO: 3505870 - RNA, 12 nt, Human
caauaacagcug

SEQ ID NO: 3505871 - RNA, 23 nt, Human
caauaacguuuaagccaaaacaa

SEQ ID NO: 3505872 - RNA, 19 nt, Human
caauaacuacuguguuccu

SEQ ID NO: 3505873 - RNA, 16 nt, Human
caauaacuccucccag

SEQ ID NO: 3505874 - RNA, 17 nt, Human
caauaacuccucccagg

SEQ ID NO: 3505875 - RNA, 18 nt, Human
caauaagcaucaaacucu

SEQ ID NO: 3505876 - RNA, 18 nt, Human
caauaaggucaaugccag

SEQ ID NO: 3505877 - RNA, 14 nt, Human
caauaauauauuuu

SEQ ID NO: 3505878 - RNA, 11 nt, Human
caauaaugcag

SEQ ID NO: 3505879 - RNA, 17 nt, Human
caauaaugcaguauggu

SEQ ID NO: 3505880 - RNA, 14 nt, Human
caauaauuucaggu

SEQ ID NO: 3505881 - RNA, 22 nt, Human
caauaauuucagguuuuguaaa

SEQ ID NO: 3505882 - RNA, 18 nt, Human
caauaauuuguggugauu

SEQ ID NO: 3505883 - RNA, 13 nt, Human
caauaauuuucua

SEQ ID NO: 3505884 - RNA, 14 nt, Human
caauaauuuucuac

SEQ ID NO: 3505885 - RNA, 15 nt, Human
caauacaaauggauu

SEQ ID NO: 3505886 - RNA, 17 nt, Human
caauacacuaguuguuu

SEQ ID NO: 3505887 - RNA, 23 nt, Human
caauacaucugagguccugugau

SEQ ID NO: 3505888 - RNA, 20 nt, Human
caauacccaaauccucucca

SEQ ID NO: 3505889 - RNA, 23 nt, Human
caauacccaaauccucuccagcu

SEQ ID NO: 3505890 - RNA, 15 nt, Human
caauaccucgagcca

SEQ ID NO: 3505891 - RNA, 19 nt, Human
caauaccugaaugcucugu

SEQ ID NO: 3505892 - RNA, 21 nt, Human
caauacguuugauaauaguuu

SEQ ID NO: 3505893 - RNA, 12 nt, Human
caauagaaacaa

SEQ ID NO: 3505894 - RNA, 22 nt, Human
caauagagacuguagauugcuu

SEQ ID NO: 3505895 - RNA, 19 nt, Human
caauagauauuuaccuuuu

SEQ ID NO: 3505896 - RNA, 20 nt, Human
caauagcaccccuacucaca

SEQ ID NO: 3505897 - RNA, 23 nt, Human
caauagcacuuucauugccagug

SEQ ID NO: 3505898 - RNA, 18 nt, Human
caauagccacuaaccuug

SEQ ID NO: 3505899 - RNA, 24 nt, Human
caauagccacuaaccuugccuggu

SEQ ID NO: 3505900 - RNA, 23 nt, Human
caauagcuuuacccucaggcaua

SEQ ID NO: 3505901 - RNA, 12 nt, Human
caauaggaaaaa

SEQ ID NO: 3505902 - RNA, 17 nt, Human
caauaggaaaaacugau

SEQ ID NO: 3505903 - RNA, 21 nt, Human
caauaggaaaaacugauuuuu

SEQ ID NO: 3505904 - RNA, 18 nt, Human
caauaggaaugcuaacag

SEQ ID NO: 3505905 - RNA, 14 nt, Human
caauagugucaucc

SEQ ID NO: 3505906 - RNA, 20 nt, Human
caauauaaaacuguacuuca

SEQ ID NO: 3505907 - RNA, 19 nt, Human
caauauaaccaauguuuaa

SEQ ID NO: 3505908 - RNA, 20 nt, Human
caauauaaccaauguuuaaa

SEQ ID NO: 3505909 - RNA, 15 nt, Human
caauauaauguuuuu

SEQ ID NO: 3505910 - RNA, 12 nt, Human
caauauagaaac

SEQ ID NO: 3505911 - RNA, 12 nt, Human
caauauagcaag

SEQ ID NO: 3505912 - RNA, 17 nt, Human
caauauauaaaaauaua

SEQ ID NO: 3505913 - RNA, 20 nt, Human
caauauauagcuggcaagaa

SEQ ID NO: 3505914 - RNA, 15 nt, Human
caauauauugaacuu

SEQ ID NO: 3505915 - RNA, 22 nt, Human
caauauauuuuguaugcaagca

SEQ ID NO: 3505916 - RNA, 13 nt, Human
caauaucagugcu

SEQ ID NO: 3505917 - RNA, 13 nt, Human
caauauccucgcu

SEQ ID NO: 3505918 - RNA, 19 nt, Human
caauauccucgcucccggg

SEQ ID NO: 3505919 - RNA, 13 nt, Human
caauauccuuugc

SEQ ID NO: 3505920 - RNA, 20 nt, Human
caauauccuuugccucaagg

SEQ ID NO: 3505921 - RNA, 17 nt, Human
caauaucuaauauauau

SEQ ID NO: 3505922 - RNA, 13 nt, Human
caauaucugaagc

SEQ ID NO: 3505923 - RNA, 23 nt, Human
caauaucuucguuaguaaucugu

SEQ ID NO: 3505924 - RNA, 16 nt, Human
caauaucuugcuugaa

SEQ ID NO: 3505925 - RNA, 19 nt, Human
caauaucuugcuugaacuu

SEQ ID NO: 3505926 - RNA, 13 nt, Human
caauaugaaguua

SEQ ID NO: 3505927 - RNA, 22 nt, Human
caauaugaaguuacuuucuuaa

SEQ ID NO: 3505928 - RNA, 15 nt, Human
caauaugcaguucug

SEQ ID NO: 3505929 - RNA, 18 nt, Human
caauaugggggccuuuug

SEQ ID NO: 3505930 - RNA, 16 nt, Human
caauauguauuaauau

SEQ ID NO: 3505931 - RNA, 13 nt, Human
caauauguauugu

SEQ ID NO: 3505932 - RNA, 16 nt, Human
caauaugugagugccu

SEQ ID NO: 3505933 - RNA, 20 nt, Human
caauaugugagugccuuuug

SEQ ID NO: 3505934 - RNA, 17 nt, Human
caauauguguuuacuuu

SEQ ID NO: 3505935 - RNA, 22 nt, Human
caauauuaaauacagacacuaa

SEQ ID NO: 3505936 - RNA, 17 nt, Human
caauauuaaugccuuua

SEQ ID NO: 3505937 - RNA, 22 nt, Human
caauauuauaauuuuuuucaau

SEQ ID NO: 3505938 - RNA, 21 nt, Human
caauauuauacuaagaaaaga

SEQ ID NO: 3505939 - RNA, 23 nt, Human
caauauuauacuaagaaaagaua

SEQ ID NO: 3505940 - RNA, 14 nt, Human
caauauucaauaaa

SEQ ID NO: 3505941 - RNA, 17 nt, Human
caauauucaauaaagcu

SEQ ID NO: 3505942 - RNA, 13 nt, Human
caauauuccugaa

SEQ ID NO: 3505943 - RNA, 15 nt, Human
caauauucucuguac

SEQ ID NO: 3505944 - RNA, 17 nt, Human
caauauucucuguacau

SEQ ID NO: 3505945 - RNA, 18 nt, Human
caauauucucuguacaua

SEQ ID NO: 3505946 - RNA, 14 nt, Human
caauauugaauuuu

SEQ ID NO: 3505947 - RNA, 18 nt, Human
caauauugaauuuuuccu

SEQ ID NO: 3505948 - RNA, 16 nt, Human
caauauugacauuugu

SEQ ID NO: 3505949 - RNA, 17 nt, Human
caauauugacauuugua

SEQ ID NO: 3505950 - RNA, 16 nt, Human
caauauugacuuuguc

SEQ ID NO: 3505951 - RNA, 16 nt, Human
caauauugauugggaa

SEQ ID NO: 3505952 - RNA, 23 nt, Human
caauauugauugggaaaacauuu

SEQ ID NO: 3505953 - RNA, 14 nt, Human
caauauuguacagu

SEQ ID NO: 3505954 - RNA, 15 nt, Human
caauauuguacaguu

SEQ ID NO: 3505955 - RNA, 17 nt, Human
caauauuguacaguuuu

SEQ ID NO: 3505956 - RNA, 12 nt, Human
caauauuguaua

SEQ ID NO: 3505957 - RNA, 19 nt, Human
caauauuguauauuuuuau

SEQ ID NO: 3505958 - RNA, 13 nt, Human
caauauuuaaaca

SEQ ID NO: 3505959 - RNA, 14 nt, Human
caauauuuaaacau

SEQ ID NO: 3505960 - RNA, 16 nt, Human
caauauuuaaggagau

SEQ ID NO: 3505961 - RNA, 19 nt, Human
caauauuuaaggagaugua

SEQ ID NO: 3505962 - RNA, 19 nt, Human
caauauuuauuauuuucac

SEQ ID NO: 3505963 - RNA, 14 nt, Human
caauauuuauugua

SEQ ID NO: 3505964 - RNA, 22 nt, Human
caauauuucagauaaucacaau

SEQ ID NO: 3505965 - RNA, 21 nt, Human
caauauuucugcuuucuuuga

SEQ ID NO: 3505966 - RNA, 23 nt, Human
caauauuucugcuuucuuugauu

SEQ ID NO: 3505967 - RNA, 19 nt, Human
caauauuugaauuuuaaau

SEQ ID NO: 3505968 - RNA, 14 nt, Human
caauauuuguagaa

SEQ ID NO: 3505969 - RNA, 19 nt, Human
caauauuugugugcuaaac

SEQ ID NO: 3505970 - RNA, 16 nt, Human
caauauuuguuacugu

SEQ ID NO: 3505971 - RNA, 21 nt, Human
caauauuuuaugguuauguuu

SEQ ID NO: 3505972 - RNA, 16 nt, Human
caauauuuucuuuaau

SEQ ID NO: 3505973 - RNA, 19 nt, Human
caaucaaucuugcauguaa

SEQ ID NO: 3505974 - RNA, 21 nt, Human
caaucagagaccaggcccugg

SEQ ID NO: 3505975 - RNA, 14 nt, Human
caaucagcacugaa

SEQ ID NO: 3505976 - RNA, 15 nt, Human
caaucagcuccuucc

SEQ ID NO: 3505977 - RNA, 17 nt, Human
caaucaguccccuccca

SEQ ID NO: 3505978 - RNA, 20 nt, Human
cauaaauaugcagugauaug

SEQ ID NO: 3505979 - RNA, 16 nt, Human
cauaaauccuugauga

SEQ ID NO: 3505980 - RNA, 14 nt, Human
cauaaaucugugaa

SEQ ID NO: 3505981 - RNA, 16 nt, Human
cauaaaucugugaacu

SEQ ID NO: 3505982 - RNA, 14 nt, Human
cauaaaugaggaaa

SEQ ID NO: 3505983 - RNA, 15 nt, Human
cauaaaugcagccca

SEQ ID NO: 3505984 - RNA, 22 nt, Human
cauaaauuauuugauuauuuaa

SEQ ID NO: 3505985 - RNA, 16 nt, Human
cauaaauucaacuuug

SEQ ID NO: 3505986 - RNA, 15 nt, Human
cauaacaacuucaua

SEQ ID NO: 3505987 - RNA, 14 nt, Human
cauaacaauuccuc

SEQ ID NO: 3505988 - RNA, 17 nt, Human
cauaacaauuccucuac

SEQ ID NO: 3505989 - RNA, 22 nt, Human
cauaacaggguaaauuauucag

SEQ ID NO: 3505990 - RNA, 15 nt, Human
cauaacauccagagc

SEQ ID NO: 3505991 - RNA, 15 nt, Human
cauaaccacugcuuc

SEQ ID NO: 3505992 - RNA, 14 nt, Human
caugugucccagaa

SEQ ID NO: 3505993 - RNA, 21 nt, Human
caugugucccagaagaugacu

SEQ ID NO: 3505994 - RNA, 13 nt, Human
caugugugcgugu

SEQ ID NO: 3505995 - RNA, 17 nt, Human
caugugugcucuucuuc

SEQ ID NO: 3505996 - RNA, 18 nt, Human
caugugugcucuucuucu

SEQ ID NO: 3505997 - RNA, 13 nt, Human
cauguguggaagu

SEQ ID NO: 3505998 - RNA, 14 nt, Human
cauguguggacuca

SEQ ID NO: 3505999 - RNA, 13 nt, Human
cauguguguauau

SEQ ID NO: 3506000 - RNA, 16 nt, Human
cauguguguauauaug

SEQ ID NO: 3506001 - RNA, 19 nt, Human
cauguguguauauaugugu

SEQ ID NO: 3506002 - RNA, 16 nt, Human
cauguguuaaguauuu

SEQ ID NO: 3506003 - RNA, 15 nt, Human
cauguguuauguuuu

SEQ ID NO: 3506004 - RNA, 14 nt, Human
cauguguuccaagg

SEQ ID NO: 3506005 - RNA, 20 nt, Human
cauguguuuuaauuccaaua

SEQ ID NO: 3506006 - RNA, 13 nt, Human
cauguuaaaccau

SEQ ID NO: 3506007 - RNA, 19 nt, Human
cauguuaaguccucccuga

SEQ ID NO: 3506008 - RNA, 22 nt, Human
cauguuaauccuagcugugugc

SEQ ID NO: 3506009 - RNA, 18 nt, Human
cauguuaauugauagaau

SEQ ID NO: 3506010 - RNA, 16 nt, Human
cauguuacauaagaua

SEQ ID NO: 3506011 - RNA, 17 nt, Human
cauguuaccuccuauaa

SEQ ID NO: 3506012 - RNA, 17 nt, Human
cauguuacugaccagca

SEQ ID NO: 3506013 - RNA, 21 nt, Human
cauguuacuggauaaauuguu

SEQ ID NO: 3506014 - RNA, 13 nt, Human
cauguuagccagg

SEQ ID NO: 3506015 - RNA, 18 nt, Human
cauguuaggaaaauuuca

SEQ ID NO: 3506016 - RNA, 17 nt, Human
cauguuaguaauaccuc

SEQ ID NO: 3506017 - RNA, 19 nt, Human
cauguuaguaauaccucua

SEQ ID NO: 3506018 - RNA, 21 nt, Human
cauguuaguuaccuuauaguu

SEQ ID NO: 3506019 - RNA, 14 nt, Human
cauguuauauauuu

SEQ ID NO: 3506020 - RNA, 22 nt, Human
cauguuauauauuuuuuguagg

SEQ ID NO: 3506021 - RNA, 14 nt, Human
cauguuaugauaaa

SEQ ID NO: 3506022 - RNA, 13 nt, Human
cauguuauguuua

SEQ ID NO: 3506023 - RNA, 14 nt, Human
cauguuauuuguaa

SEQ ID NO: 3506024 - RNA, 22 nt, Human
cauguucacaccgcugcacuca

SEQ ID NO: 3506025 - RNA, 12 nt, Human
cauguuccuuca

SEQ ID NO: 3506026 - RNA, 23 nt, Human
cauguuccuucaagaucauguac

SEQ ID NO: 3506027 - RNA, 20 nt, Human
cauguucugcccccagccca

SEQ ID NO: 3506028 - RNA, 14 nt, Human
cauguucugcuuuc

SEQ ID NO: 3506029 - RNA, 16 nt, Human
cauguucuugcaguca

SEQ ID NO: 3506030 - RNA, 17 nt, Human
cauguugaucauguacu

SEQ ID NO: 3506031 - RNA, 22 nt, Human
cauguugcacacccacucagcu

SEQ ID NO: 3506032 - RNA, 22 nt, Human
cauguugcccccgugagccaau

SEQ ID NO: 3506033 - RNA, 16 nt, Human
cauguugcugaggagu

SEQ ID NO: 3506034 - RNA, 13 nt, Human
cauguugcugcca

SEQ ID NO: 3506035 - RNA, 18 nt, Human
cauguugcuguuuccagu

SEQ ID NO: 3506036 - RNA, 13 nt, Human
cauguuggccagg

SEQ ID NO: 3506037 - RNA, 15 nt, Human
cauguuggccaggcu

SEQ ID NO: 3506038 - RNA, 22 nt, Human
cauguuggccaggcugcucuca

SEQ ID NO: 3506039 - RNA, 21 nt, Human
cauguugggaaacuuggcucg

SEQ ID NO: 3506040 - RNA, 17 nt, Human
cauguuggucaggcugg

SEQ ID NO: 3506041 - RNA, 22 nt, Human
cauguugguugcacuuuguagu

SEQ ID NO: 3506042 - RNA, 19 nt, Human
cauguuguaaugcugcacu

SEQ ID NO: 3506043 - RNA, 23 nt, Human
cauguuguagauacaaucagcug

SEQ ID NO: 3506044 - RNA, 19 nt, Human
cauguugugccucccuggu

SEQ ID NO: 3506045 - RNA, 14 nt, Human
cauguuguuaaaau

SEQ ID NO: 3506046 - RNA, 15 nt, Human
cauguuuaugagaaa

SEQ ID NO: 3506047 - RNA, 12 nt, Human
cauguuuauuac

SEQ ID NO: 3506048 - RNA, 22 nt, Human
cauguuuauuacaguauaauua

SEQ ID NO: 3506049 - RNA, 19 nt, Human
cauguuuauuuuucuuguc

SEQ ID NO: 3506050 - RNA, 13 nt, Human
cauguuucauguu

SEQ ID NO: 3506051 - RNA, 16 nt, Human
cauguuucauguuuug

SEQ ID NO: 3506052 - RNA, 17 nt, Human
cauguuucauguuuugu

SEQ ID NO: 3506053 - RNA, 12 nt, Human
cauguuuccagc

SEQ ID NO: 3506054 - RNA, 15 nt, Human
cauguuuccagcauu

SEQ ID NO: 3506055 - RNA, 16 nt, Human
cauguuuccagcauuc

SEQ ID NO: 3506056 - RNA, 18 nt, Human
cauguuugagcucagacc

SEQ ID NO: 3506057 - RNA, 20 nt, Human
cauguuugcaccuuucuagu

SEQ ID NO: 3506058 - RNA, 14 nt, Human
cauguuugccuaga

SEQ ID NO: 3506059 - RNA, 14 nt, Human
cauguuuggaagac

SEQ ID NO: 3506060 - RNA, 20 nt, Human
cauguuuggugcauagaacu

SEQ ID NO: 3506061 - RNA, 13 nt, Human
cauguuuguaaaa

SEQ ID NO: 3506062 - RNA, 14 nt, Human
cauguuugugauug

SEQ ID NO: 3506063 - RNA, 13 nt, Human
cauguuuuaacaa

SEQ ID NO: 3506064 - RNA, 17 nt, Human
cauguuuucaacugcca

SEQ ID NO: 3506065 - RNA, 15 nt, Human
cauguuuuccauugu

SEQ ID NO: 3506066 - RNA, 17 nt, Human
cauguuuuccauuguuu

SEQ ID NO: 3506067 - RNA, 21 nt, Human
cauguuuuccauuguuugaaa

SEQ ID NO: 3506068 - RNA, 17 nt, Human
cauguuuugauaaagua

SEQ ID NO: 3506069 - RNA, 12 nt, Human
cauguuuuguau

SEQ ID NO: 3506070 - RNA, 13 nt, Human
cauguuuuguaua

SEQ ID NO: 3506071 - RNA, 15 nt, Human
cauguuuuguauaca

SEQ ID NO: 3506072 - RNA, 15 nt, Human
cauguuuugugacua

SEQ ID NO: 3506073 - RNA, 18 nt, Human
cauguuuuucuucucccu

SEQ ID NO: 3506074 - RNA, 19 nt, Human
cauguuuuucuucucccuc

SEQ ID NO: 3506075 - RNA, 22 nt, Human
cauuaaaaaaaaaaaaaaaagu

SEQ ID NO: 3506076 - RNA, 22 nt, Human
cauuaaaaaugcauauacuuua

SEQ ID NO: 3506077 - RNA, 14 nt, Human
cauuaaaaauggaa

SEQ ID NO: 3506078 - RNA, 22 nt, Human
cauuaaaacaauauuguuucua

SEQ ID NO: 3506079 - RNA, 19 nt, Human
cauuaaaacugaagucuga

SEQ ID NO: 3506080 - RNA, 14 nt, Human
cauuaaaacugcuu

SEQ ID NO: 3506081 - RNA, 23 nt, Human
cauuaaaacuuaaccgcaucaga

SEQ ID NO: 3506082 - RNA, 15 nt, Human
cauuaaacaugacuc

SEQ ID NO: 3506083 - RNA, 19 nt, Human
cauuaaaccaucucccugg

SEQ ID NO: 3506084 - RNA, 22 nt, Human
cauuaaaccugucuccacugug

SEQ ID NO: 3506085 - RNA, 13 nt, Human
cauuaaacuuuuu

SEQ ID NO: 3506086 - RNA, 11 nt, Human
cauuaaagaag

SEQ ID NO: 3506087 - RNA, 22 nt, Human
cauuaaagcauuuacuuugaau

SEQ ID NO: 3506088 - RNA, 18 nt, Human
cauuaaaggcuucucucu

SEQ ID NO: 3506089 - RNA, 21 nt, Human
cauuaaaggcuucucucucac

SEQ ID NO: 3506090 - RNA, 24 nt, Human
cauuaaaggcuucucucucaccag

SEQ ID NO: 3506091 - RNA, 13 nt, Human
cauuaaagucuga

SEQ ID NO: 3506092 - RNA, 17 nt, Human
cauuaaagucugaauca

SEQ ID NO: 3506093 - RNA, 18 nt, Human
cauuaaaugacucuuccc

SEQ ID NO: 3506094 - RNA, 20 nt, Human
cauuaaauuacagaaauuua

SEQ ID NO: 3506095 - RNA, 13 nt, Human
cauuaaauucaca

SEQ ID NO: 3506096 - RNA, 17 nt, Human
cauuaaauucacaaacu

SEQ ID NO: 3506097 - RNA, 13 nt, Human
cauuaacacaaag

SEQ ID NO: 3506098 - RNA, 21 nt, Human
cauuaacaguuuuccaugaaa

SEQ ID NO: 3506099 - RNA, 16 nt, Human
cauuaaccgaugcuuu

SEQ ID NO: 3506100 - RNA, 18 nt, Human
cauuaacucauuagacug

SEQ ID NO: 3506101 - RNA, 17 nt, Human
cauuaagaaaaucauau

SEQ ID NO: 3506102 - RNA, 21 nt, Human
cauuaagaauguugguuuacu

SEQ ID NO: 3506103 - RNA, 17 nt, Human
cauuaaggccacaucca

SEQ ID NO: 3506104 - RNA, 14 nt, Human
cauuaaguaaucaa

SEQ ID NO: 3506105 - RNA, 14 nt, Human
cauuaauaauaaau

SEQ ID NO: 3506106 - RNA, 17 nt, Human
cauuaauagcagccuuu

SEQ ID NO: 3506107 - RNA, 22 nt, Human
cauuaaucaaucaucuguguga

SEQ ID NO: 3506108 - RNA, 22 nt, Human
cauuaauccacauguuucagag

SEQ ID NO: 3506109 - RNA, 21 nt, Human
cauuaaugccugcuuuuugga

SEQ ID NO: 3506110 - RNA, 22 nt, Human
cauuaaugccugcuuuuuggaa

SEQ ID NO: 3506111 - RNA, 13 nt, Human
cauuaauguguug

SEQ ID NO: 3506112 - RNA, 21 nt, Human
cauuaauguuaauucagcacu

SEQ ID NO: 3506113 - RNA, 14 nt, Human
cauuaauguugauu

SEQ ID NO: 3506114 - RNA, 21 nt, Human
cauuaauuauuauugcuguug

SEQ ID NO: 3506115 - RNA, 12 nt, Human
cauuaauuuaaa

SEQ ID NO: 3506116 - RNA, 16 nt, Human
cauuaauuuuuuuuca

SEQ ID NO: 3506117 - RNA, 21 nt, Human
cauuacaagccuggaaaaaaa

SEQ ID NO: 3506118 - RNA, 23 nt, Human
cauuacaaucgagacugcaaugu

SEQ ID NO: 3506119 - RNA, 13 nt, Human
cauuacagagagg

SEQ ID NO: 3506120 - RNA, 20 nt, Human
cauuacagagaggagaaaca

SEQ ID NO: 3506121 - RNA, 21 nt, Human
cauuacagugggugccccccu

SEQ ID NO: 3506122 - RNA, 21 nt, Human
cauuacauuccuugauaaugu

SEQ ID NO: 3506123 - RNA, 19 nt, Human
cauuacauuguuuaaagaa

SEQ ID NO: 3506124 - RNA, 16 nt, Human
cauuaccacucaggca

SEQ ID NO: 3506125 - RNA, 18 nt, Human
cauuaccagacgguucac

SEQ ID NO: 3506126 - RNA, 20 nt, Human
cauuaccagacgguucacca

SEQ ID NO: 3506127 - RNA, 18 nt, Human
cauuaccgcguuguaaaa

SEQ ID NO: 3506128 - RNA, 22 nt, Human
cauuaccgcguuguaaaauaua

SEQ ID NO: 3506129 - RNA, 17 nt, Human
cauuaccuuacugugga

SEQ ID NO: 3506130 - RNA, 19 nt, Human
cauuaccuuuuaccagcuu

SEQ ID NO: 3506131 - RNA, 15 nt, Human
cauuacuauaagaac

SEQ ID NO: 3506132 - RNA, 14 nt, Human
cauuacucuuguaa

SEQ ID NO: 3506133 - RNA, 20 nt, Human
caaucaguccccucccaucu

SEQ ID NO: 3506134 - RNA, 14 nt, Human
caaucauaugugau

SEQ ID NO: 3506135 - RNA, 15 nt, Human
caaucauugcugaaa

SEQ ID NO: 3506136 - RNA, 16 nt, Human
caaucauugcugaaaa

SEQ ID NO: 3506137 - RNA, 16 nt, Human
cauuguucaauuagaa

SEQ ID NO: 3506138 - RNA, 18 nt, Human
cauuguucaauuagaaua

SEQ ID NO: 3506139 - RNA, 20 nt, Human
cauuguucuuauucuggcau

SEQ ID NO: 3506140 - RNA, 13 nt, Human
cauuguugagcua

SEQ ID NO: 3506141 - RNA, 20 nt, Human
cauuguugagcuauugcugu

SEQ ID NO: 3506142 - RNA, 17 nt, Human
cauuguuggacauuugg

SEQ ID NO: 3506143 - RNA, 19 nt, Human
cauuguuguuuuuuuaaua

SEQ ID NO: 3506144 - RNA, 12 nt, Human
cauuguuuaaaa

SEQ ID NO: 3506145 - RNA, 12 nt, Human
cauuguuucugu

SEQ ID NO: 3506146 - RNA, 14 nt, Human
cauuguuugaaaca

SEQ ID NO: 3506147 - RNA, 18 nt, Human
cauuguuugaaacaaaga

SEQ ID NO: 3506148 - RNA, 20 nt, Human
cauuguuugaaacaaagaag

SEQ ID NO: 3506149 - RNA, 21 nt, Human
cauuguuugaaacaaagaagg

SEQ ID NO: 3506150 - RNA, 22 nt, Human
cauuguuugaaacaaagaaggu

SEQ ID NO: 3506151 - RNA, 19 nt, Human
cauuguuugcuuauuguuc

SEQ ID NO: 3506152 - RNA, 17 nt, Human
cauuguuuggagacauu

SEQ ID NO: 3506153 - RNA, 22 nt, Human
cauuguuugucugucuucauag

SEQ ID NO: 3506154 - RNA, 16 nt, Human
cauuguuuuaaaaaga

SEQ ID NO: 3506155 - RNA, 17 nt, Human
cauuguuuuaaaaagaa

SEQ ID NO: 3506156 - RNA, 16 nt, Human
cauuguuuugaauauu

SEQ ID NO: 3506157 - RNA, 18 nt, Human
cauuuaaaacagacacug

SEQ ID NO: 3506158 - RNA, 23 nt, Human
cauuuaaaacagacacuggcaug

SEQ ID NO: 3506159 - RNA, 21 nt, Human
cauuuaaaacauuaaaauaua

SEQ ID NO: 3506160 - RNA, 12 nt, Human
cauuuaaaagau

SEQ ID NO: 3506161 - RNA, 21 nt, Human
cauuuaaaagauacaguuacu

SEQ ID NO: 3506162 - RNA, 15 nt, Human
cauuuaaaauugcua

SEQ ID NO: 3506163 - RNA, 13 nt, Human
cauuuaaacagau

SEQ ID NO: 3506164 - RNA, 14 nt, Human
cauuuaaacagaug

SEQ ID NO: 3506165 - RNA, 18 nt, Human
cauuuaaagcauugcugu

SEQ ID NO: 3506166 - RNA, 19 nt, Human
cauuuaaagcuuauuaaaa

SEQ ID NO: 3506167 - RNA, 16 nt, Human
cauuuaaauguguaca

SEQ ID NO: 3506168 - RNA, 12 nt, Human
cauuuaaauuuu

SEQ ID NO: 3506169 - RNA, 18 nt, Human
cauuuaaauuuuuuuccu

SEQ ID NO: 3506170 - RNA, 23 nt, Human
cauuuaaccccccuguacacaac

SEQ ID NO: 3506171 - RNA, 18 nt, Human
cauuuaagaauugccagu

SEQ ID NO: 3506172 - RNA, 17 nt, Human
cauuuaagagacaguca

SEQ ID NO: 3506173 - RNA, 14 nt, Human
cauuuaagggaaaa

SEQ ID NO: 3506174 - RNA, 16 nt, Human
cauuuaagggaaaaau

SEQ ID NO: 3506175 - RNA, 19 nt, Human
cauuuaagggaaaaauaua

SEQ ID NO: 3506176 - RNA, 20 nt, Human
cauuuaagggaaagaaaaug

SEQ ID NO: 3506177 - RNA, 12 nt, Human
cauuuaauaaua

SEQ ID NO: 3506178 - RNA, 13 nt, Human
cauuuaauaauau

SEQ ID NO: 3506179 - RNA, 12 nt, Human
cauuuaauaauu

SEQ ID NO: 3506180 - RNA, 16 nt, Human
cauuuaauaauuauau

SEQ ID NO: 3506181 - RNA, 20 nt, Human
cauuuaauguagccauggga

SEQ ID NO: 3506182 - RNA, 22 nt, Human
cauuuaauguagccaugggacc

SEQ ID NO: 3506183 - RNA, 19 nt, Human
cauuuaauuuagugaucuu

SEQ ID NO: 3506184 - RNA, 15 nt, Human
cauuuacaaacugaa

SEQ ID NO: 3506185 - RNA, 19 nt, Human
cauuuacaaacugaagagu

SEQ ID NO: 3506186 - RNA, 12 nt, Human
cauuuacacuuu

SEQ ID NO: 3506187 - RNA, 12 nt, Human
cauuuacaugua

SEQ ID NO: 3506188 - RNA, 19 nt, Human
cauuuacuaaacauaugau

SEQ ID NO: 3506189 - RNA, 18 nt, Human
cauuuacucuaaaaacug

SEQ ID NO: 3506190 - RNA, 13 nt, Human
cauuuacuuaaga

SEQ ID NO: 3506191 - RNA, 19 nt, Human
cacagacccugcccugugg

SEQ ID NO: 3506192 - RNA, 20 nt, Human
cacagacccugcccuguggg

SEQ ID NO: 3506193 - RNA, 22 nt, Human
cacagacccugcccugugggcc

SEQ ID NO: 3506194 - RNA, 24 nt, Human
cacagaccuggagccccugggugg

SEQ ID NO: 3506195 - RNA, 23 nt, Human
cacagacuauugacaucagcauc

SEQ ID NO: 3506196 - RNA, 13 nt, Human
cacagacuauuuu

SEQ ID NO: 3506197 - RNA, 14 nt, Human
cacagacuauuuuu

SEQ ID NO: 3506198 - RNA, 18 nt, Human
cacagacucaaaugcuca

SEQ ID NO: 3506199 - RNA, 22 nt, Human
cacagacucauccugaacagca

SEQ ID NO: 3506200 - RNA, 21 nt, Human
cacagagaaaguacuucucca

SEQ ID NO: 3506201 - RNA, 15 nt, Human
cacagagaagacaaa

SEQ ID NO: 3506202 - RNA, 13 nt, Human
cacagagaagcug

SEQ ID NO: 3506203 - RNA, 14 nt, Human
cacagagaagcugg

SEQ ID NO: 3506204 - RNA, 15 nt, Human
cacagagaagcuggg

SEQ ID NO: 3506205 - RNA, 21 nt, Human
cacagagacauuccuccgagc

SEQ ID NO: 3506206 - RNA, 22 nt, Human
cacagagacccccggaacaagc

SEQ ID NO: 3506207 - RNA, 12 nt, Human
cacagagagaaa

SEQ ID NO: 3506208 - RNA, 18 nt, Human
cacagagagacagacuug

SEQ ID NO: 3506209 - RNA, 20 nt, Human
cacagagagacagacuugag

SEQ ID NO: 3506210 - RNA, 22 nt, Human
cacagagagacagacuugagaa

SEQ ID NO: 3506211 - RNA, 19 nt, Human
cacagagagggagagcaga

SEQ ID NO: 3506212 - RNA, 22 nt, Human
cacagagagggggccaccuccc

SEQ ID NO: 3506213 - RNA, 16 nt, Human
cacagagagucccacu

SEQ ID NO: 3506214 - RNA, 13 nt, Human
cacagagcgggga

SEQ ID NO: 3506215 - RNA, 18 nt, Human
cacagagcucuccagcuc

SEQ ID NO: 3506216 - RNA, 21 nt, Human
cacagagcuuuggucugugug

SEQ ID NO: 3506217 - RNA, 22 nt, Human
cacagagcuuuggucugugugu

SEQ ID NO: 3506218 - RNA, 16 nt, Human
cacagaggaagagcag

SEQ ID NO: 3506219 - RNA, 13 nt, Human
cacagaggcugcc

SEQ ID NO: 3506220 - RNA, 16 nt, Human
cacagagggcgugugc

SEQ ID NO: 3506221 - RNA, 16 nt, Human
cacagaguaagacauu

SEQ ID NO: 3506222 - RNA, 15 nt, Human
cacagagucaaggcc

SEQ ID NO: 3506223 - RNA, 18 nt, Human
cacagaguggucuuucug

SEQ ID NO: 3506224 - RNA, 19 nt, Human
cacagagugugcuggagga

SEQ ID NO: 3506225 - RNA, 22 nt, Human
cacagaguuguuacauuuuuaa

SEQ ID NO: 3506226 - RNA, 18 nt, Human
cacagauagaccuuuuuu

SEQ ID NO: 3506227 - RNA, 18 nt, Human
cacagaucacagcuucag

SEQ ID NO: 3506228 - RNA, 19 nt, Human
cacagaucacagcuucagc

SEQ ID NO: 3506229 - RNA, 13 nt, Human
cacagaugcucca

SEQ ID NO: 3506230 - RNA, 17 nt, Human
cacagauggauuugccu

SEQ ID NO: 3506231 - RNA, 14 nt, Human
cacagauggccagc

SEQ ID NO: 3506232 - RNA, 14 nt, Human
cacagaugggugcu

SEQ ID NO: 3506233 - RNA, 23 nt, Human
cacagauguucgguuuuuuuccu

SEQ ID NO: 3506234 - RNA, 14 nt, Human
cacagauuguuucu

SEQ ID NO: 3506235 - RNA, 15 nt, Human
cacagauuguuucua

SEQ ID NO: 3506236 - RNA, 16 nt, Human
cacagauuugagcuca

SEQ ID NO: 3506237 - RNA, 17 nt, Human
cacagauuugagcucag

SEQ ID NO: 3506238 - RNA, 18 nt, Human
cacagauuugagcucagc

SEQ ID NO: 3506239 - RNA, 14 nt, Human
cacagauuuuaauu

SEQ ID NO: 3506240 - RNA, 15 nt, Human
cacagauuuuaauug

SEQ ID NO: 3506241 - RNA, 17 nt, Human
cacagcaaccccaggcu

SEQ ID NO: 3506242 - RNA, 18 nt, Human
cacagcaaccccaggcug

SEQ ID NO: 3506243 - RNA, 14 nt, Human
cacagcacaaauua

SEQ ID NO: 3506244 - RNA, 16 nt, Human
cacagcacaaauuagu

SEQ ID NO: 3506245 - RNA, 18 nt, Human
cacagcacaaauuaguua

SEQ ID NO: 3506246 - RNA, 14 nt, Human
cacagcacaugcug

SEQ ID NO: 3506247 - RNA, 20 nt, Human
cacagcacaugcuggccagc

SEQ ID NO: 3506248 - RNA, 21 nt, Human
cacagcacuugaguaaaauac

SEQ ID NO: 3506249 - RNA, 12 nt, Human
cacagcagcauu

SEQ ID NO: 3506250 - RNA, 14 nt, Human
cacagcagcauuuu

SEQ ID NO: 3506251 - RNA, 21 nt, Human
cacagcagccuccaacacaag

SEQ ID NO: 3506252 - RNA, 12 nt, Human
cacagcagccug

SEQ ID NO: 3506253 - RNA, 19 nt, Human
cacagcagcugaacagcca

SEQ ID NO: 3506254 - RNA, 19 nt, Human
cacagcagcuucaccagag

SEQ ID NO: 3506255 - RNA, 21 nt, Human
cacagcagcuucaccagagca

SEQ ID NO: 3506256 - RNA, 22 nt, Human
cacagcagcuucaccagagcau

SEQ ID NO: 3506257 - RNA, 15 nt, Human
cacagcaggcugcca

SEQ ID NO: 3506258 - RNA, 17 nt, Human
cacagcaggcugccagu

SEQ ID NO: 3506259 - RNA, 16 nt, Human
cacagcagugagacug

SEQ ID NO: 3506260 - RNA, 19 nt, Human
cacagcaucucagcucauc

SEQ ID NO: 3506261 - RNA, 13 nt, Human
cacagcaugugua

SEQ ID NO: 3506262 - RNA, 14 nt, Human
cacagcauuucaag

SEQ ID NO: 3506263 - RNA, 14 nt, Human
cacagccaaggacu

SEQ ID NO: 3506264 - RNA, 12 nt, Human
cacagccacaca

SEQ ID NO: 3506265 - RNA, 13 nt, Human
cacagccacacac

SEQ ID NO: 3506266 - RNA, 14 nt, Human
cacagccacacaca

SEQ ID NO: 3506267 - RNA, 20 nt, Human
cacagccacacacacagaaa

SEQ ID NO: 3506268 - RNA, 23 nt, Human
cacagccacacacacagaaaaua

SEQ ID NO: 3506269 - RNA, 13 nt, Human
cacagccagaacc

SEQ ID NO: 3506270 - RNA, 19 nt, Human
cacagccagaaccccgagc

SEQ ID NO: 3506271 - RNA, 18 nt, Human
cacagccagacuggcaca

SEQ ID NO: 3506272 - RNA, 20 nt, Human
cacagccagcaccuggcauc

SEQ ID NO: 3506273 - RNA, 22 nt, Human
cacagccagggggaugccacuc

SEQ ID NO: 3506274 - RNA, 20 nt, Human
cacagccaggugccuuggag

SEQ ID NO: 3506275 - RNA, 19 nt, Human
cacagccaucccagccuug

SEQ ID NO: 3506276 - RNA, 14 nt, Human
cacagcccacgucc

SEQ ID NO: 3506277 - RNA, 12 nt, Human
cacagcccagcc

SEQ ID NO: 3506278 - RNA, 23 nt, Human
cacagcccagccacggacgcugg

SEQ ID NO: 3506279 - RNA, 15 nt, Human
cacagcccagcuugg

SEQ ID NO: 3506280 - RNA, 15 nt, Human
cacagcccgcaugca

SEQ ID NO: 3506281 - RNA, 11 nt, Human
cacagcccucc

SEQ ID NO: 3506282 - RNA, 21 nt, Human
caugaagaggaugcugugaaa

SEQ ID NO: 3506283 - RNA, 19 nt, Human
caugaagauguagaggaga

SEQ ID NO: 3506284 - RNA, 21 nt, Human
caugaagccacgggugccaga

SEQ ID NO: 3506285 - RNA, 13 nt, Human
caugaagccuuuu

SEQ ID NO: 3506286 - RNA, 16 nt, Human
caugaagccuuuugaa

SEQ ID NO: 3506287 - RNA, 13 nt, Human
caugaaggaaacu

SEQ ID NO: 3506288 - RNA, 14 nt, Human
caugaaggagugaa

SEQ ID NO: 3506289 - RNA, 20 nt, Human
caugaagguaaauaaaaaga

SEQ ID NO: 3506290 - RNA, 22 nt, Human
caugaagguaaauaaaaagaaa

SEQ ID NO: 3506291 - RNA, 15 nt, Human
caugaagguuucuga

SEQ ID NO: 3506292 - RNA, 15 nt, Human
caugaaguaauaugc

SEQ ID NO: 3506293 - RNA, 14 nt, Human
caugaaguauuuuu

SEQ ID NO: 3506294 - RNA, 21 nt, Human
caugaaguauuuuuucaguau

SEQ ID NO: 3506295 - RNA, 16 nt, Human
caugaauccaguccag

SEQ ID NO: 3506296 - RNA, 15 nt, Human
caugaaucgcuucuc

SEQ ID NO: 3506297 - RNA, 17 nt, Human
caugaaucuuuguuuca

SEQ ID NO: 3506298 - RNA, 22 nt, Human
caugaaugguauggaacucucu

SEQ ID NO: 3506299 - RNA, 17 nt, Human
caugaauguaaauuugu

SEQ ID NO: 3506300 - RNA, 22 nt, Human
caugaauguaaauuuguacuau

SEQ ID NO: 3506301 - RNA, 13 nt, Human
caugaauguauca

SEQ ID NO: 3506302 - RNA, 21 nt, Human
caugaauuaccuggauguucu

SEQ ID NO: 3506303 - RNA, 16 nt, Human
caugaauuaguuuuau

SEQ ID NO: 3506304 - RNA, 20 nt, Human
caugaauuauuacaguguuu

SEQ ID NO: 3506305 - RNA, 18 nt, Human
caugaauucuuaugcuua

SEQ ID NO: 3506306 - RNA, 15 nt, Human
caugaauuuuacaug

SEQ ID NO: 3506307 - RNA, 18 nt, Human
caugaauuuuagcuuuug

SEQ ID NO: 3506308 - RNA, 16 nt, Human
caugacaacuucuaau

SEQ ID NO: 3506309 - RNA, 21 nt, Human
caugacaacuuugccagcuuu

SEQ ID NO: 3506310 - RNA, 14 nt, Human
caugacacgaauau

SEQ ID NO: 3506311 - RNA, 23 nt, Human
caugacacgaauauugcugaugg

SEQ ID NO: 3506312 - RNA, 15 nt, Human
caugacagaaaauau

SEQ ID NO: 3506313 - RNA, 19 nt, Human
caugacagaaaauauguau

SEQ ID NO: 3506314 - RNA, 13 nt, Human
caugacagccugc

SEQ ID NO: 3506315 - RNA, 14 nt, Human
caugacagccugca

SEQ ID NO: 3506316 - RNA, 18 nt, Human
caugacagccugcagcag

SEQ ID NO: 3506317 - RNA, 20 nt, Human
caugacagccugcagcagga

SEQ ID NO: 3506318 - RNA, 19 nt, Human
caugacauguuauauauuu

SEQ ID NO: 3506319 - RNA, 17 nt, Human
caugacauuuaccagca

SEQ ID NO: 3506320 - RNA, 17 nt, Human
caugaccacauagcaug

SEQ ID NO: 3506321 - RNA, 18 nt, Human
caugaccagaagggaaac

SEQ ID NO: 3506322 - RNA, 12 nt, Human
caugaccagcaa

SEQ ID NO: 3506323 - RNA, 15 nt, Human
caugaccagcaaaua

SEQ ID NO: 3506324 - RNA, 18 nt, Human
caugaccauacugaggga

SEQ ID NO: 3506325 - RNA, 13 nt, Human
caugacccacccc

SEQ ID NO: 3506326 - RNA, 17 nt, Human
caugacccaccccugug

SEQ ID NO: 3506327 - RNA, 19 nt, Human
caugacccaggcugggcaa

SEQ ID NO: 3506328 - RNA, 14 nt, Human
caugaccuccagcu

SEQ ID NO: 3506329 - RNA, 15 nt, Human
caugaccuccagcuu

SEQ ID NO: 3506330 - RNA, 22 nt, Human
caugaccuccagcuuuccugua

SEQ ID NO: 3506331 - RNA, 20 nt, Human
caugaccuuauccuuccucu

SEQ ID NO: 3506332 - RNA, 14 nt, Human
caugacuauggaua

SEQ ID NO: 3506333 - RNA, 18 nt, Human
caugacucuugacucuug

SEQ ID NO: 3506334 - RNA, 18 nt, Human
caugacucuuuauugucu

SEQ ID NO: 3506335 - RNA, 23 nt, Human
caugacugcauuuuacuguacag

SEQ ID NO: 3506336 - RNA, 12 nt, Human
caugacugcuug

SEQ ID NO: 3506337 - RNA, 14 nt, Human
caugacugcuugcc

SEQ ID NO: 3506338 - RNA, 16 nt, Human
caugacugcuugcccu

SEQ ID NO: 3506339 - RNA, 15 nt, Human
caugacuuuuccaug

SEQ ID NO: 3506340 - RNA, 13 nt, Human
caugagaaauaca

SEQ ID NO: 3506341 - RNA, 22 nt, Human
caugagaaauacaaaaauacuc

SEQ ID NO: 3506342 - RNA, 15 nt, Human
caugagaagagggcc

SEQ ID NO: 3506343 - RNA, 19 nt, Human
caugagaccacuguuauca

SEQ ID NO: 3506344 - RNA, 22 nt, Human
caugagacccuggugccuggcu

SEQ ID NO: 3506345 - RNA, 19 nt, Human
caugagacucagugcagau

SEQ ID NO: 3506346 - RNA, 14 nt, Human
caugagaggaggca

SEQ ID NO: 3506347 - RNA, 16 nt, Human
caugagaggaggcagc

SEQ ID NO: 3506348 - RNA, 21 nt, Human
caugagaggaggcagcaggac

SEQ ID NO: 3506349 - RNA, 18 nt, Human
caugagauaauaugcaga

SEQ ID NO: 3506350 - RNA, 22 nt, Human
caugagaugauacauccaaagc

SEQ ID NO: 3506351 - RNA, 13 nt, Human
caugagcaucagg

SEQ ID NO: 3506352 - RNA, 15 nt, Human
caugagcaucaggcc

SEQ ID NO: 3506353 - RNA, 16 nt, Human
caugagcaucaggcca

SEQ ID NO: 3506354 - RNA, 23 nt, Human
caugagcaucaggccaggcccuc

SEQ ID NO: 3506355 - RNA, 16 nt, Human
cauuugugcuagaaau

SEQ ID NO: 3506356 - RNA, 20 nt, Human
cauuugugcuagaaauuuuc

SEQ ID NO: 3506357 - RNA, 21 nt, Human
cauuugugcuagaaauuuuca

SEQ ID NO: 3506358 - RNA, 23 nt, Human
cauuuguggguuuuuauuuccua

SEQ ID NO: 3506359 - RNA, 19 nt, Human
cauuuguguacacagucag

SEQ ID NO: 3506360 - RNA, 14 nt, Human
cauuugugucaaug

SEQ ID NO: 3506361 - RNA, 15 nt, Human
cauuugugucaaugg

SEQ ID NO: 3506362 - RNA, 22 nt, Human
cauuugugugugugcaagugug

SEQ ID NO: 3506363 - RNA, 16 nt, Human
cauuuguguugaagag

SEQ ID NO: 3506364 - RNA, 20 nt, Human
cauuuguguugaagagguuu

SEQ ID NO: 3506365 - RNA, 13 nt, Human
cauuuguuaaaau

SEQ ID NO: 3506366 - RNA, 18 nt, Human
cauuuguuaaaauuauca

SEQ ID NO: 3506367 - RNA, 17 nt, Human
cauuuguugguuuauca

SEQ ID NO: 3506368 - RNA, 17 nt, Human
cauuuguuuauguaauu

SEQ ID NO: 3506369 - RNA, 22 nt, Human
cauuuguuucuuucucugagga

SEQ ID NO: 3506370 - RNA, 17 nt, Human
cauuuguuugaacugau

SEQ ID NO: 3506371 - RNA, 22 nt, Human
cauuuguuugaacugauaaaga

SEQ ID NO: 3506372 - RNA, 16 nt, Human
cauuuguuuguuuucc

SEQ ID NO: 3506373 - RNA, 18 nt, Human
cauuuguuuguuuuccuu

SEQ ID NO: 3506374 - RNA, 17 nt, Human
cauuuguuuuguuuaca

SEQ ID NO: 3506375 - RNA, 13 nt, Human
cauuuuaaaaagu

SEQ ID NO: 3506376 - RNA, 16 nt, Human
cauuuuaaacaaaaua

SEQ ID NO: 3506377 - RNA, 15 nt, Human
cauuuuaaauaaaag

SEQ ID NO: 3506378 - RNA, 18 nt, Human
cauuuuaacaagaagaug

SEQ ID NO: 3506379 - RNA, 11 nt, Human
cauuuuaacau

SEQ ID NO: 3506380 - RNA, 14 nt, Human
cauuuuaauuuuaa

SEQ ID NO: 3506381 - RNA, 15 nt, Human
cauuuuaauuuuaaa

SEQ ID NO: 3506382 - RNA, 22 nt, Human
cauuuuacaguuacuuuuccuu

SEQ ID NO: 3506383 - RNA, 18 nt, Human
cauuuuacauuaaauuuu

SEQ ID NO: 3506384 - RNA, 22 nt, Human
cauuuuacuguacagauugcug

SEQ ID NO: 3506385 - RNA, 15 nt, Human
cauuuuagacaguaa

SEQ ID NO: 3506386 - RNA, 23 nt, Human
cauuuuaggaaaaaaaaaagcau

SEQ ID NO: 3506387 - RNA, 17 nt, Human
cauuuuagucacuuuuu

SEQ ID NO: 3506388 - RNA, 22 nt, Human
cauuuuauaaagugcuugugua

SEQ ID NO: 3506389 - RNA, 23 nt, Human
cauuuuauaaagugcuuguguaa

SEQ ID NO: 3506390 - RNA, 17 nt, Human
cauuuuauaaaucgcuu

SEQ ID NO: 3506391 - RNA, 18 nt, Human
cauuuuauaaaucgcuuu

SEQ ID NO: 3506392 - RNA, 21 nt, Human
cauuuuauaaaucgcuuuuga

SEQ ID NO: 3506393 - RNA, 16 nt, Human
cauuuuauaugucaaa

SEQ ID NO: 3506394 - RNA, 15 nt, Human
cauuuuauauuagaa

SEQ ID NO: 3506395 - RNA, 13 nt, Human
cauuuuauauuga

SEQ ID NO: 3506396 - RNA, 16 nt, Human
cauuuuauauugaaaa

SEQ ID NO: 3506397 - RNA, 19 nt, Human
cauuuuauuuuauuaugca

SEQ ID NO: 3506398 - RNA, 23 nt, Human
cauuuuauuuuauuaugcaugaa

SEQ ID NO: 3506399 - RNA, 16 nt, Human
cauuuucaccccaccc

SEQ ID NO: 3506400 - RNA, 14 nt, Human
cauuuucagacugc

SEQ ID NO: 3506401 - RNA, 19 nt, Human
cauuuuccauauccuggug

SEQ ID NO: 3506402 - RNA, 17 nt, Human
cauuuuccccccacucu

SEQ ID NO: 3506403 - RNA, 20 nt, Human
cauuuuccccccacucuccc

SEQ ID NO: 3506404 - RNA, 17 nt, Human
cauuuuccuacaggcag

SEQ ID NO: 3506405 - RNA, 17 nt, Human
cauuuucuaagaaacau

SEQ ID NO: 3506406 - RNA, 23 nt, Human
cauuuucuaagaaacauuuauau

SEQ ID NO: 3506407 - RNA, 18 nt, Human
cauuuucuagauacaaua

SEQ ID NO: 3506408 - RNA, 20 nt, Human
cauuuucuagauacaauaaa

SEQ ID NO: 3506409 - RNA, 12 nt, Human
cauuuucucccu

SEQ ID NO: 3506410 - RNA, 13 nt, Human
cauuuucucccug

SEQ ID NO: 3506411 - RNA, 16 nt, Human
cauuuucucuuagaaa

SEQ ID NO: 3506412 - RNA, 14 nt, Human
cauuuucugcaagc

SEQ ID NO: 3506413 - RNA, 15 nt, Human
cauuuucugcaagcc

SEQ ID NO: 3506414 - RNA, 22 nt, Human
cauuuucuucagagagcuaaau

SEQ ID NO: 3506415 - RNA, 17 nt, Human
cauuuucuuuuuuaacc

SEQ ID NO: 3506416 - RNA, 20 nt, Human
cauuuugaaauuguuccuug

SEQ ID NO: 3506417 - RNA, 15 nt, Human
cauuuugaagcuaau

SEQ ID NO: 3506418 - RNA, 14 nt, Human
cauuuugaccuacu

SEQ ID NO: 3506419 - RNA, 21 nt, Human
cauuuugagcugaaaugcugc

SEQ ID NO: 3506420 - RNA, 23 nt, Human
cauuuugagcugaaaugcugcau

SEQ ID NO: 3506421 - RNA, 22 nt, Human
cauuuugcagcagugagucucu

SEQ ID NO: 3506422 - RNA, 15 nt, Human
cauuuugcauucaaa

SEQ ID NO: 3506423 - RNA, 13 nt, Human
cauuuugccaaaa

SEQ ID NO: 3506424 - RNA, 18 nt, Human
cauuuugcuuuaauuuua

SEQ ID NO: 3506425 - RNA, 20 nt, Human
cauuuuggagaguuuccuga

SEQ ID NO: 3506426 - RNA, 11 nt, Human
cauuauuauua

SEQ ID NO: 3506427 - RNA, 14 nt, Human
cauuauucaaaguu

SEQ ID NO: 3506428 - RNA, 21 nt, Human
cauuauucaaaguugccuaaa

SEQ ID NO: 3506429 - RNA, 14 nt, Human
cauuauucauuuag

SEQ ID NO: 3506430 - RNA, 24 nt, Human
cauuauucucugcuauauauaaaa

SEQ ID NO: 3506431 - RNA, 15 nt, Human
cauuauucucuuuua

SEQ ID NO: 3506432 - RNA, 14 nt, Human
cauuauuggaauua

SEQ ID NO: 3506433 - RNA, 17 nt, Human
cauuauuggaauuaacc

SEQ ID NO: 3506434 - RNA, 18 nt, Human
cauuauuggaauuaaccu

SEQ ID NO: 3506435 - RNA, 22 nt, Human
cauuauuggaauuaaccuggug

SEQ ID NO: 3506436 - RNA, 14 nt, Human
cauuauuuauaugg

SEQ ID NO: 3506437 - RNA, 15 nt, Human
cauuauuuauguauu

SEQ ID NO: 3506438 - RNA, 22 nt, Human
cauuauuuauguauugugcaau

SEQ ID NO: 3506439 - RNA, 13 nt, Human
cauuauuuauuaa

SEQ ID NO: 3506440 - RNA, 17 nt, Human
cauuauuuauuaaauuu

SEQ ID NO: 3506441 - RNA, 13 nt, Human
cauuauuucuagu

SEQ ID NO: 3506442 - RNA, 20 nt, Human
cauuauuugagaagcugcuc

SEQ ID NO: 3506443 - RNA, 14 nt, Human
cauuauuugcaugu

SEQ ID NO: 3506444 - RNA, 11 nt, Human
cauuauuuuau

SEQ ID NO: 3506445 - RNA, 14 nt, Human
cauuauuuuauuau

SEQ ID NO: 3506446 - RNA, 16 nt, Human
cauuauuuuauuauga

SEQ ID NO: 3506447 - RNA, 14 nt, Human
cauuauuuuccaga

SEQ ID NO: 3506448 - RNA, 22 nt, Human
cauuauuuuuccacuuuguucu

SEQ ID NO: 3506449 - RNA, 16 nt, Human
cauucaaaaguugaaa

SEQ ID NO: 3506450 - RNA, 23 nt, Human
cauucaaaugggugauauccuga

SEQ ID NO: 3506451 - RNA, 14 nt, Human
cauucaaauuuguc

SEQ ID NO: 3506452 - RNA, 17 nt, Human
cauucaagucagcucuu

SEQ ID NO: 3506453 - RNA, 23 nt, Human
cauucaaguguaaaauauuuuga

SEQ ID NO: 3506454 - RNA, 16 nt, Human
cauucaauacaagugu

SEQ ID NO: 3506455 - RNA, 21 nt, Human
cauucaauuucaggcucccca

SEQ ID NO: 3506456 - RNA, 14 nt, Human
cauucacccagaca

SEQ ID NO: 3506457 - RNA, 13 nt, Human
cauucaccugccc

SEQ ID NO: 3506458 - RNA, 19 nt, Human
cauucacuucacugugcug

SEQ ID NO: 3506459 - RNA, 14 nt, Human
cauucacuucauaa

SEQ ID NO: 3506460 - RNA, 12 nt, Human
cauucagaaaug

SEQ ID NO: 3506461 - RNA, 20 nt, Human
cauucagaaauguugagucu

SEQ ID NO: 3506462 - RNA, 13 nt, Human
cauucagagucag

SEQ ID NO: 3506463 - RNA, 22 nt, Human
cauucagagucagccaggacca

SEQ ID NO: 3506464 - RNA, 20 nt, Human
cauucagauaugauucaaau

SEQ ID NO: 3506465 - RNA, 16 nt, Human
cauucagaucacugaa

SEQ ID NO: 3506466 - RNA, 17 nt, Human
cauucagaucacugaau

SEQ ID NO: 3506467 - RNA, 21 nt, Human
cauucagaucacugaauuuau

SEQ ID NO: 3506468 - RNA, 20 nt, Human
cauucagcagcaaauuuuca

SEQ ID NO: 3506469 - RNA, 12 nt, Human
cauucaggaacc

SEQ ID NO: 3506470 - RNA, 19 nt, Human
cauucaggaaccuggacca

SEQ ID NO: 3506471 - RNA, 17 nt, Human
cauucaggacugcuggu

SEQ ID NO: 3506472 - RNA, 18 nt, Human
cauucaguauauaaaaua

SEQ ID NO: 3506473 - RNA, 22 nt, Human
cauucauacuuaaaaauuuauu

SEQ ID NO: 3506474 - RNA, 18 nt, Human
cauucauauuacaauauu

SEQ ID NO: 3506475 - RNA, 21 nt, Human
cauucauuagucauguuuauc

SEQ ID NO: 3506476 - RNA, 14 nt, Human
cauucauuuuauau

SEQ ID NO: 3506477 - RNA, 23 nt, Human
cauuccaaaggggaccccuauga

SEQ ID NO: 3506478 - RNA, 18 nt, Human
cauuccaacaaaggguuu

SEQ ID NO: 3506479 - RNA, 23 nt, Human
cauuccaacagcucaagucuucc

SEQ ID NO: 3506480 - RNA, 18 nt, Human
cauuccaagacucuagag

SEQ ID NO: 3506481 - RNA, 14 nt, Human
cauuccaagccuga

SEQ ID NO: 3506482 - RNA, 16 nt, Human
cauuccaugugcccag

SEQ ID NO: 3506483 - RNA, 14 nt, Human
cauuccauugccua

SEQ ID NO: 3506484 - RNA, 18 nt, Human
cauucccagcucuacccu

SEQ ID NO: 3506485 - RNA, 20 nt, Human
cauuccccaggaggccagcc

SEQ ID NO: 3506486 - RNA, 17 nt, Human
cauuccccagguggcug

SEQ ID NO: 3506487 - RNA, 15 nt, Human
cauucccccagugcg

SEQ ID NO: 3506488 - RNA, 16 nt, Human
cauucccgcaguggga

SEQ ID NO: 3506489 - RNA, 22 nt, Human
cauucccgcagugggagcaaac

SEQ ID NO: 3506490 - RNA, 20 nt, Human
cauuccgcagcccccacccc

SEQ ID NO: 3506491 - RNA, 16 nt, Human
cauuccguugucugug

SEQ ID NO: 3506492 - RNA, 14 nt, Human
cauuccuaaaaugc

SEQ ID NO: 3506493 - RNA, 18 nt, Human
cauuccuaaacuaucuuu

SEQ ID NO: 3506494 - RNA, 20 nt, Human
cauuccuaacacagcaugug

SEQ ID NO: 3506495 - RNA, 23 nt, Human
cauuccucaccuuuucccgggga

SEQ ID NO: 3506496 - RNA, 18 nt, Human
cauuccucaugaauguaa

SEQ ID NO: 3506497 - RNA, 12 nt, Human
cauuccuccagg

SEQ ID NO: 3506498 - RNA, 13 nt, Human
cauuccuccaggu

SEQ ID NO: 3506499 - RNA, 13 nt, Human
cauuccugaagaa

SEQ ID NO: 3506500 - RNA, 15 nt, Human
cauuccugccugucu

SEQ ID NO: 3506501 - RNA, 17 nt, Human
cauuccuggaaaccaca

SEQ ID NO: 3506502 - RNA, 21 nt, Human
cauuccugggaaauauucccu

SEQ ID NO: 3506503 - RNA, 18 nt, Human
cauuccugguacccagcc

SEQ ID NO: 3506504 - RNA, 21 nt, Human
cauuccugguacccagccauc

SEQ ID NO: 3506505 - RNA, 23 nt, Human
cauuccugguacccagccaucug

SEQ ID NO: 3506506 - RNA, 13 nt, Human
cauuccuguauuc

SEQ ID NO: 3506507 - RNA, 16 nt, Human
cauuccuucuuugaua

SEQ ID NO: 3506508 - RNA, 18 nt, Human
cauuccuucuuugauaau

SEQ ID NO: 3506509 - RNA, 19 nt, Human
cauuccuucuuugauaaug

SEQ ID NO: 3506510 - RNA, 20 nt, Human
cauuccuugauaauguugug

SEQ ID NO: 3506511 - RNA, 18 nt, Human
cauuccuuuuuauuuaua

SEQ ID NO: 3506512 - RNA, 16 nt, Human
cauucgaucucauuca

SEQ ID NO: 3506513 - RNA, 16 nt, Human
cauucgcgcucugcuc

SEQ ID NO: 3506514 - RNA, 14 nt, Human
cauucguucugugg

SEQ ID NO: 3506515 - RNA, 21 nt, Human
cauucguuguguuuuuuaaga

SEQ ID NO: 3506516 - RNA, 13 nt, Human
cauucuaaugaug

SEQ ID NO: 3506517 - RNA, 17 nt, Human
cauucuacacagagcag

SEQ ID NO: 3506518 - RNA, 11 nt, Human
cauucuacuug

SEQ ID NO: 3506519 - RNA, 12 nt, Human
cauucuacuugc

SEQ ID NO: 3506520 - RNA, 14 nt, Human
cauucuacuugcuc

SEQ ID NO: 3506521 - RNA, 17 nt, Human
cauucuacuugcucugg

SEQ ID NO: 3506522 - RNA, 22 nt, Human
cauucuacuugcucuggaccug

SEQ ID NO: 3506523 - RNA, 17 nt, Human
cauucuaggcucacugc

SEQ ID NO: 3506524 - RNA, 23 nt, Human
cauucuagguaggggcccacuuc

SEQ ID NO: 3506525 - RNA, 15 nt, Human
cauucuaucaagccc

SEQ ID NO: 3506526 - RNA, 16 nt, Human
cauucuauugccuucu

SEQ ID NO: 3506527 - RNA, 14 nt, Human
cauucuauuguuaa

SEQ ID NO: 3506528 - RNA, 13 nt, Human
cauucucacuccu

SEQ ID NO: 3506529 - RNA, 14 nt, Human
cauucucacuccua

SEQ ID NO: 3506530 - RNA, 16 nt, Human
cauucucacuccuacc

SEQ ID NO: 3506531 - RNA, 17 nt, Human
cauucucacuccuaccu

SEQ ID NO: 3506532 - RNA, 13 nt, Human
cauucucaguuuu

SEQ ID NO: 3506533 - RNA, 18 nt, Human
cauucucaguuuuucuua

SEQ ID NO: 3506534 - RNA, 23 nt, Human
cauucucauaauuccuacagcac

SEQ ID NO: 3506535 - RNA, 17 nt, Human
cauucucaucugcaccc

SEQ ID NO: 3506536 - RNA, 20 nt, Human
cauucucaucugcacccuuc

SEQ ID NO: 3506537 - RNA, 19 nt, Human
cauucucauggagaaguua

SEQ ID NO: 3506538 - RNA, 13 nt, Human
cauucucauugaa

SEQ ID NO: 3506539 - RNA, 15 nt, Human
cauucucauuggaaa

SEQ ID NO: 3506540 - RNA, 13 nt, Human
cauucuccaccug

SEQ ID NO: 3506541 - RNA, 18 nt, Human
cauucuccaccugccagg

SEQ ID NO: 3506542 - RNA, 17 nt, Human
cauucuccauuuguuau

SEQ ID NO: 3506543 - RNA, 15 nt, Human
cauucucccagguac

SEQ ID NO: 3506544 - RNA, 23 nt, Human
cauucucccagguaccagcugcg

SEQ ID NO: 3506545 - RNA, 22 nt, Human
cauucuccccaguguaugucuu

SEQ ID NO: 3506546 - RNA, 21 nt, Human
cauucuccuaucaccugucuu

SEQ ID NO: 3506547 - RNA, 13 nt, Human
cauucuccugccu

SEQ ID NO: 3506548 - RNA, 16 nt, Human
cauucuccuuguguua

SEQ ID NO: 3506549 - RNA, 15 nt, Human
cauucuccuuguugu

SEQ ID NO: 3506550 - RNA, 16 nt, Human
cauucucucuccuguc

SEQ ID NO: 3506551 - RNA, 20 nt, Human
cauucucucuccuguccaac

SEQ ID NO: 3506552 - RNA, 13 nt, Human
cauucucugaaga

SEQ ID NO: 3506553 - RNA, 14 nt, Human
cauucucugucuca

SEQ ID NO: 3506554 - RNA, 11 nt, Human
cauucugaaug

SEQ ID NO: 3506555 - RNA, 15 nt, Human
cauucugaaugcuuc

SEQ ID NO: 3506556 - RNA, 18 nt, Human
cauucugaaugcuucuaa

SEQ ID NO: 3506557 - RNA, 23 nt, Human
cauucugacucgguuucuccaaa

SEQ ID NO: 3506558 - RNA, 22 nt, Human
cauucugauucgaaugacacug

SEQ ID NO: 3506559 - RNA, 11 nt, Human
cauucugcaag

SEQ ID NO: 3506560 - RNA, 19 nt, Human
cauucugcauugcuagaua

SEQ ID NO: 3506561 - RNA, 21 nt, Human
cauucugcauugcuagauaaa

SEQ ID NO: 3506562 - RNA, 17 nt, Human
cauucugccucucuagg

SEQ ID NO: 3506563 - RNA, 15 nt, Human
cauucugccugccca

SEQ ID NO: 3506564 - RNA, 20 nt, Human
cauucugcuuucaucuuggu

SEQ ID NO: 3506565 - RNA, 16 nt, Human
cauucuggaagugacu

SEQ ID NO: 3506566 - RNA, 17 nt, Human
cauucuggucucgucuu

SEQ ID NO: 3506567 - RNA, 16 nt, Human
cauucugugaucauuu

SEQ ID NO: 3506568 - RNA, 12 nt, Human
cauucuuacuaa

SEQ ID NO: 3506569 - RNA, 18 nt, Human
cauucuuacuaaaaagua

SEQ ID NO: 3506570 - RNA, 22 nt, Human
cauucuuacuaaaaaguauaaa

SEQ ID NO: 3506571 - RNA, 22 nt, Human
caccauuauaaugaauuuagug

SEQ ID NO: 3506572 - RNA, 21 nt, Human
cauuguaaaugugcuuuuaaa

SEQ ID NO: 3506573 - RNA, 21 nt, Human
cauuguaagcguauggcuuua

SEQ ID NO: 3506574 - RNA, 18 nt, Human
cauuguaauguuacugau

SEQ ID NO: 3506575 - RNA, 13 nt, Human
cauuguacaguuu

SEQ ID NO: 3506576 - RNA, 14 nt, Human
cauuguacaguuug

SEQ ID NO: 3506577 - RNA, 20 nt, Human
cauuguacaguuuguuuaca

SEQ ID NO: 3506578 - RNA, 20 nt, Human
cauuguacgaagaguauuuu

SEQ ID NO: 3506579 - RNA, 16 nt, Human
cauuguagagcuucug

SEQ ID NO: 3506580 - RNA, 15 nt, Human
cauuguagugcuuug

SEQ ID NO: 3506581 - RNA, 14 nt, Human
cauuguauauaugu

SEQ ID NO: 3506582 - RNA, 16 nt, Human
cauuguauauaugugu

SEQ ID NO: 3506583 - RNA, 18 nt, Human
cauuguaucugucuuucc

SEQ ID NO: 3506584 - RNA, 15 nt, Human
cauuguaugaugugu

SEQ ID NO: 3506585 - RNA, 17 nt, Human
cauuguaugauguguug

SEQ ID NO: 3506586 - RNA, 16 nt, Human
cauuguauguaucuau

SEQ ID NO: 3506587 - RNA, 20 nt, Human
cacccucguggacaccugcc

SEQ ID NO: 3506588 - RNA, 16 nt, Human
cacccucuaaauggga

SEQ ID NO: 3506589 - RNA, 14 nt, Human
cacccucuauccca

SEQ ID NO: 3506590 - RNA, 16 nt, Human
cacccucuaucccaau

SEQ ID NO: 3506591 - RNA, 18 nt, Human
cacccucugagcuuugca

SEQ ID NO: 3506592 - RNA, 13 nt, Human
cacccucuguacc

SEQ ID NO: 3506593 - RNA, 21 nt, Human
cacccucuuccuacuggucuc

SEQ ID NO: 3506594 - RNA, 14 nt, Human
cacccucuuccugu

SEQ ID NO: 3506595 - RNA, 15 nt, Human
cacccucuuccugug

SEQ ID NO: 3506596 - RNA, 14 nt, Human
cacccugagccggc

SEQ ID NO: 3506597 - RNA, 22 nt, Human
cacccugaggagucugaggucc

SEQ ID NO: 3506598 - RNA, 19 nt, Human
cacccugaggccucuggaa

SEQ ID NO: 3506599 - RNA, 11 nt, Human
cacccugaggg

SEQ ID NO: 3506600 - RNA, 11 nt, Human
cacccugcaag

SEQ ID NO: 3506601 - RNA, 18 nt, Human
cacccugccuuaucuugc

SEQ ID NO: 3506602 - RNA, 16 nt, Human
cacccugcugagucug

SEQ ID NO: 3506603 - RNA, 16 nt, Human
cacccugcuuggccca

SEQ ID NO: 3506604 - RNA, 18 nt, Human
cacccugcuuggcccagg

SEQ ID NO: 3506605 - RNA, 15 nt, Human
cacccuggauuugca

SEQ ID NO: 3506606 - RNA, 21 nt, Human
cacccugggcccugggcugga

SEQ ID NO: 3506607 - RNA, 22 nt, Human
cacccugggcucugugggcugc

SEQ ID NO: 3506608 - RNA, 16 nt, Human
cacccuguaccucauc

SEQ ID NO: 3506609 - RNA, 22 nt, Human
cacccuguaccucaucccauga

SEQ ID NO: 3506610 - RNA, 23 nt, Human
cacccuguacuguucugugucuu

SEQ ID NO: 3506611 - RNA, 18 nt, Human
cacccugucccccagcuc

SEQ ID NO: 3506612 - RNA, 22 nt, Human
cacccugucccccagcucuggu

SEQ ID NO: 3506613 - RNA, 17 nt, Human
cacccugucuaaaaaac

SEQ ID NO: 3506614 - RNA, 14 nt, Human
cacccugucugccc

SEQ ID NO: 3506615 - RNA, 18 nt, Human
cacccugugauggggccc

SEQ ID NO: 3506616 - RNA, 22 nt, Human
cacccugugauggggcccugcc

SEQ ID NO: 3506617 - RNA, 23 nt, Human
cacccugugauggggcccugccu

SEQ ID NO: 3506618 - RNA, 15 nt, Human
cacccugugcagaag

SEQ ID NO: 3506619 - RNA, 15 nt, Human
cacccuguggcccug

SEQ ID NO: 3506620 - RNA, 20 nt, Human
cacccuguggcccuggcucu

SEQ ID NO: 3506621 - RNA, 16 nt, Human
cacccuguuccugcug

SEQ ID NO: 3506622 - RNA, 19 nt, Human
cacccuguuuggauuuuua

SEQ ID NO: 3506623 - RNA, 20 nt, Human
cacccuuaacccaaggagca

SEQ ID NO: 3506624 - RNA, 14 nt, Human
cacccuuagaaaau

SEQ ID NO: 3506625 - RNA, 15 nt, Human
cacccuuagaaaaug

SEQ ID NO: 3506626 - RNA, 19 nt, Human
cacccuuagaaaauguguc

SEQ ID NO: 3506627 - RNA, 22 nt, Human
cacccuucacauacccuccccc

SEQ ID NO: 3506628 - RNA, 22 nt, Human
cacccuuccccuccuucucccu

SEQ ID NO: 3506629 - RNA, 13 nt, Human
cacccuuccuucu

SEQ ID NO: 3506630 - RNA, 21 nt, Human
cacccuucucccacucuccua

SEQ ID NO: 3506631 - RNA, 15 nt, Human
cacccuucuuuccuc

SEQ ID NO: 3506632 - RNA, 12 nt, Human
cacccuugccca

SEQ ID NO: 3506633 - RNA, 14 nt, Human
cacccuuggacuug

SEQ ID NO: 3506634 - RNA, 16 nt, Human
cacccuuggagcucug

SEQ ID NO: 3506635 - RNA, 19 nt, Human
cacccuuggaggcugucuu

SEQ ID NO: 3506636 - RNA, 20 nt, Human
cacccuuggaggcugucuuc

SEQ ID NO: 3506637 - RNA, 21 nt, Human
cacccuuggaggcugucuucu

SEQ ID NO: 3506638 - RNA, 15 nt, Human
cacccuuuuccagcu

SEQ ID NO: 3506639 - RNA, 14 nt, Human
caccgaaaaacuaa

SEQ ID NO: 3506640 - RNA, 18 nt, Human
caccgaaaacguggcugc

SEQ ID NO: 3506641 - RNA, 22 nt, Human
caccgaaaacguggcugcuuca

SEQ ID NO: 3506642 - RNA, 14 nt, Human
caccgaagcccaga

SEQ ID NO: 3506643 - RNA, 22 nt, Human
caccgaaguggacuggccccug

SEQ ID NO: 3506644 - RNA, 18 nt, Human
caccgacgcgucuccugu

SEQ ID NO: 3506645 - RNA, 21 nt, Human
caccgagaguagccgagagcc

SEQ ID NO: 3506646 - RNA, 16 nt, Human
caccgaggggccuuug

SEQ ID NO: 3506647 - RNA, 13 nt, Human
caccgcagaagga

SEQ ID NO: 3506648 - RNA, 15 nt, Human
caccgcagaaggaag

SEQ ID NO: 3506649 - RNA, 14 nt, Human
caccgcagacagga

SEQ ID NO: 3506650 - RNA, 19 nt, Human
caccgcaugcccccucgug

SEQ ID NO: 3506651 - RNA, 21 nt, Human
caccgccacaauaaagaucgc

SEQ ID NO: 3506652 - RNA, 14 nt, Human
caccgcccaucagg

SEQ ID NO: 3506653 - RNA, 14 nt, Human
caccgccccuggcc

SEQ ID NO: 3506654 - RNA, 15 nt, Human
caccgccccuggccg

SEQ ID NO: 3506655 - RNA, 13 nt, Human
caccgccucuucc

SEQ ID NO: 3506656 - RNA, 17 nt, Human
caccgccucuucccgcc

SEQ ID NO: 3506657 - RNA, 15 nt, Human
caccgccuugcccag

SEQ ID NO: 3506658 - RNA, 18 nt, Human
caccgcuccccagcccag

SEQ ID NO: 3506659 - RNA, 20 nt, Human
caccgcuccccagcccaggg

SEQ ID NO: 3506660 - RNA, 12 nt, Human
caccgcugccua

SEQ ID NO: 3506661 - RNA, 13 nt, Human
caccgcugccuaa

SEQ ID NO: 3506662 - RNA, 19 nt, Human
caccgcugccuaaguggcu

SEQ ID NO: 3506663 - RNA, 22 nt, Human
caccgcuuccggcuccugugcu

SEQ ID NO: 3506664 - RNA, 18 nt, Human
caccgcuucugccuuuuc

SEQ ID NO: 3506665 - RNA, 19 nt, Human
caccgcuuuuguucucgca

SEQ ID NO: 3506666 - RNA, 18 nt, Human
caccggccgauggagaca

SEQ ID NO: 3506667 - RNA, 12 nt, Human
caccggcgcgcu

SEQ ID NO: 3506668 - RNA, 21 nt, Human
caccggcucucaccuggcccu

SEQ ID NO: 3506669 - RNA, 17 nt, Human
caccggcuggccuggcc

SEQ ID NO: 3506670 - RNA, 15 nt, Human
caccgggcacucaga

SEQ ID NO: 3506671 - RNA, 14 nt, Human
caccgggcagggcc

SEQ ID NO: 3506672 - RNA, 23 nt, Human
caccgggccacuccuuccugccc

SEQ ID NO: 3506673 - RNA, 18 nt, Human
caccgguugcuucuggga

SEQ ID NO: 3506674 - RNA, 21 nt, Human
caccgguugcuucugggaagg

SEQ ID NO: 3506675 - RNA, 19 nt, Human
caccguaaagugagcaugc

SEQ ID NO: 3506676 - RNA, 16 nt, Human
caccguccccucccag

SEQ ID NO: 3506677 - RNA, 14 nt, Human
caccguccgcccug

SEQ ID NO: 3506678 - RNA, 16 nt, Human
caccguccgcccugcu

SEQ ID NO: 3506679 - RNA, 24 nt, Human
caccgugcccagcccuaaacauca

SEQ ID NO: 3506680 - RNA, 15 nt, Human
caccgugccuggcca

SEQ ID NO: 3506681 - RNA, 15 nt, Human
caccgugggcaggga

SEQ ID NO: 3506682 - RNA, 16 nt, Human
caccguguaaaccaaa

SEQ ID NO: 3506683 - RNA, 18 nt, Human
caccguguaaaccaaagc

SEQ ID NO: 3506684 - RNA, 20 nt, Human
caccgugucaagcugcucug

SEQ ID NO: 3506685 - RNA, 13 nt, Human
caccguugucuca

SEQ ID NO: 3506686 - RNA, 14 nt, Human
caccguugucucau

SEQ ID NO: 3506687 - RNA, 19 nt, Human
caccguugucucaugccag

SEQ ID NO: 3506688 - RNA, 17 nt, Human
caccuaaagcagccagc

SEQ ID NO: 3506689 - RNA, 20 nt, Human
caccuaaagguguauuuaaa

SEQ ID NO: 3506690 - RNA, 21 nt, Human
caccuaaagguguauuuaaac

SEQ ID NO: 3506691 - RNA, 13 nt, Human
caccuaagggaca

SEQ ID NO: 3506692 - RNA, 19 nt, Human
caccuaagggacauguuuu

SEQ ID NO: 3506693 - RNA, 16 nt, Human
caccuaagucucugug

SEQ ID NO: 3506694 - RNA, 17 nt, Human
caccuaauccaggcaga

SEQ ID NO: 3506695 - RNA, 21 nt, Human
caccuaauccaggcagaucca

SEQ ID NO: 3506696 - RNA, 21 nt, Human
caccuaauguuuaugagccag

SEQ ID NO: 3506697 - RNA, 13 nt, Human
caccuacagugua

SEQ ID NO: 3506698 - RNA, 17 nt, Human
caccuacaguguacagu

SEQ ID NO: 3506699 - RNA, 18 nt, Human
caccuacauguuauucua

SEQ ID NO: 3506700 - RNA, 16 nt, Human
caccuaccccugacuu

SEQ ID NO: 3506701 - RNA, 20 nt, Human
caccuacuacaucgcccucc

SEQ ID NO: 3506702 - RNA, 17 nt, Human
caccuacucacacaggc

SEQ ID NO: 3506703 - RNA, 18 nt, Human
caccuacucacacaggca

SEQ ID NO: 3506704 - RNA, 17 nt, Human
caccuagaaacuuguua

SEQ ID NO: 3506705 - RNA, 23 nt, Human
caccuagaacacuaacucaccag

SEQ ID NO: 3506706 - RNA, 20 nt, Human
caccuagcaauuccaucacc

SEQ ID NO: 3506707 - RNA, 15 nt, Human
caccuagcugugcaa

SEQ ID NO: 3506708 - RNA, 18 nt, Human
caccuaggaagccucaga

SEQ ID NO: 3506709 - RNA, 17 nt, Human
caccuaggccacuccuc

SEQ ID NO: 3506710 - RNA, 18 nt, Human
caccuaggccacuccucc

SEQ ID NO: 3506711 - RNA, 19 nt, Human
caccuaggccacuccucca

SEQ ID NO: 3506712 - RNA, 18 nt, Human
caccuaggcuaggguggg

SEQ ID NO: 3506713 - RNA, 19 nt, Human
caccuaggcuagggugggg

SEQ ID NO: 3506714 - RNA, 17 nt, Human
caccuaguggcugucca

SEQ ID NO: 3506715 - RNA, 14 nt, Human
caccuauaaaacag

SEQ ID NO: 3506716 - RNA, 19 nt, Human
caccuauaaaacaggucaa

SEQ ID NO: 3506717 - RNA, 18 nt, Human
ccagagaagccccuuccc

SEQ ID NO: 3506718 - RNA, 19 nt, Human
ccagagaagugacagggaa

SEQ ID NO: 3506719 - RNA, 22 nt, Human
ccagagaagugacagggaagcu

SEQ ID NO: 3506720 - RNA, 16 nt, Human
ccagagaauucuuaga

SEQ ID NO: 3506721 - RNA, 16 nt, Human
ccagagacacaagccu

SEQ ID NO: 3506722 - RNA, 19 nt, Human
ccagagacacagcccccac

SEQ ID NO: 3506723 - RNA, 12 nt, Human
ccagagacccag

SEQ ID NO: 3506724 - RNA, 14 nt, Human
ccagagacccagcg

SEQ ID NO: 3506725 - RNA, 21 nt, Human
ccagagacccagcggacacac

SEQ ID NO: 3506726 - RNA, 18 nt, Human
ccagagaccguccucacc

SEQ ID NO: 3506727 - RNA, 16 nt, Human
ccagagacuuuguaga

SEQ ID NO: 3506728 - RNA, 17 nt, Human
ccagagagaagagcccc

SEQ ID NO: 3506729 - RNA, 19 nt, Human
ccagagagaagagccccac

SEQ ID NO: 3506730 - RNA, 23 nt, Human
ccagagagaagagccccacucuc

SEQ ID NO: 3506731 - RNA, 20 nt, Human
ccagagagagaagugccccu

SEQ ID NO: 3506732 - RNA, 22 nt, Human
ccagagagagaagugccccugc

SEQ ID NO: 3506733 - RNA, 21 nt, Human
ccagagagcaacucugagauc

SEQ ID NO: 3506734 - RNA, 19 nt, Human
ccagagagggacugacacc

SEQ ID NO: 3506735 - RNA, 23 nt, Human
ccagagaggguggugaccucugc

SEQ ID NO: 3506736 - RNA, 14 nt, Human
ccagagaguccugu

SEQ ID NO: 3506737 - RNA, 15 nt, Human
ccagagaguggcucc

SEQ ID NO: 3506738 - RNA, 18 nt, Human
ccagagaguggcuccucc

SEQ ID NO: 3506739 - RNA, 22 nt, Human
ccagagaguggcuccucccggu

SEQ ID NO: 3506740 - RNA, 20 nt, Human
ccagagaugccuccaccgcu

SEQ ID NO: 3506741 - RNA, 21 nt, Human
ccagagaugggacugggaggg

SEQ ID NO: 3506742 - RNA, 23 nt, Human
ccagagaugggacugggagggcc

SEQ ID NO: 3506743 - RNA, 12 nt, Human
ccagagauguca

SEQ ID NO: 3506744 - RNA, 13 nt, Human
ccagagcaaaaua

SEQ ID NO: 3506745 - RNA, 16 nt, Human
ccagagcaaccucuca

SEQ ID NO: 3506746 - RNA, 19 nt, Human
ccagagcaaccucucacuc

SEQ ID NO: 3506747 - RNA, 21 nt, Human
ccagagcaaccucucacuccc

SEQ ID NO: 3506748 - RNA, 16 nt, Human
ccagagcaagcuuuuu

SEQ ID NO: 3506749 - RNA, 14 nt, Human
ccagagcacuguau

SEQ ID NO: 3506750 - RNA, 22 nt, Human
ccagagcagaugcagagagcca

SEQ ID NO: 3506751 - RNA, 23 nt, Human
ccagagcagaugcagagagccau

SEQ ID NO: 3506752 - RNA, 14 nt, Human
ccagagcaggaggc

SEQ ID NO: 3506753 - RNA, 15 nt, Human
ccagagcaggaggcc

SEQ ID NO: 3506754 - RNA, 19 nt, Human
ccagagcaggaggccccug

SEQ ID NO: 3506755 - RNA, 23 nt, Human
ccagagcaggaggccccuggccc

SEQ ID NO: 3506756 - RNA, 12 nt, Human
ccagagcagggu

SEQ ID NO: 3506757 - RNA, 20 nt, Human
ccagagcauuacgugagcca

SEQ ID NO: 3506758 - RNA, 22 nt, Human
ccagagcauuacgugagccagg

SEQ ID NO: 3506759 - RNA, 23 nt, Human
ccagagcauuacgugagccaggu

SEQ ID NO: 3506760 - RNA, 19 nt, Human
ccagagcauuccagucagg

SEQ ID NO: 3506761 - RNA, 23 nt, Human
ccagagcauuccagucaggcucu

SEQ ID NO: 3506762 - RNA, 13 nt, Human
ccagagccaaggg

SEQ ID NO: 3506763 - RNA, 14 nt, Human
ccagagccacacau

SEQ ID NO: 3506764 - RNA, 16 nt, Human
ccagagccacacaugg

SEQ ID NO: 3506765 - RNA, 15 nt, Human
ccagagccacaguuc

SEQ ID NO: 3506766 - RNA, 13 nt, Human
ccagagccaugga

SEQ ID NO: 3506767 - RNA, 16 nt, Human
ccagagcccaccuugg

SEQ ID NO: 3506768 - RNA, 22 nt, Human
ccagagcccaccuuggcucaag

SEQ ID NO: 3506769 - RNA, 13 nt, Human
ccagagcccagcu

SEQ ID NO: 3506770 - RNA, 15 nt, Human
ccagagcccagcucc

SEQ ID NO: 3506771 - RNA, 16 nt, Human
ccagagcccagcucca

SEQ ID NO: 3506772 - RNA, 14 nt, Human
ccagagcccaggcu

SEQ ID NO: 3506773 - RNA, 18 nt, Human
ccagagccccacacggag

SEQ ID NO: 3506774 - RNA, 16 nt, Human
ccagagccccacagcc

SEQ ID NO: 3506775 - RNA, 17 nt, Human
ccagagccccacagccc

SEQ ID NO: 3506776 - RNA, 18 nt, Human
ccagagccuggggcucua

SEQ ID NO: 3506777 - RNA, 20 nt, Human
ccagagccuggggcucuaac

SEQ ID NO: 3506778 - RNA, 19 nt, Human
ccagagcggaggcugugug

SEQ ID NO: 3506779 - RNA, 20 nt, Human
ccagagcuacccgcagaguu

SEQ ID NO: 3506780 - RNA, 12 nt, Human
ccagagcuccuc

SEQ ID NO: 3506781 - RNA, 15 nt, Human
ccagagcuccuccuu

SEQ ID NO: 3506782 - RNA, 13 nt, Human
ccagagcucugga

SEQ ID NO: 3506783 - RNA, 11 nt, Human
ccagagcugcc

SEQ ID NO: 3506784 - RNA, 23 nt, Human
ccagagcugcuuccccgucaccu

SEQ ID NO: 3506785 - RNA, 14 nt, Human
ccagagcugggagg

SEQ ID NO: 3506786 - RNA, 23 nt, Human
ccagagcuguuuauggccucagc

SEQ ID NO: 3506787 - RNA, 14 nt, Human
ccagaggaacuguc

SEQ ID NO: 3506788 - RNA, 19 nt, Human
ccagaggaacuguccagag

SEQ ID NO: 3506789 - RNA, 18 nt, Human
ccagaggaauccuggcag

SEQ ID NO: 3506790 - RNA, 19 nt, Human
ccagaggaauccuggcagc

SEQ ID NO: 3506791 - RNA, 13 nt, Human
ccagaggagacau

SEQ ID NO: 3506792 - RNA, 19 nt, Human
cacucaaggcggugcuuga

SEQ ID NO: 3506793 - RNA, 22 nt, Human
cacucaaugcagccagaccuau

SEQ ID NO: 3506794 - RNA, 16 nt, Human
cacucacacagccagg

SEQ ID NO: 3506795 - RNA, 13 nt, Human
cacucacacagga

SEQ ID NO: 3506796 - RNA, 14 nt, Human
cacucacacaggac

SEQ ID NO: 3506797 - RNA, 19 nt, Human
cacucacagaccuggagcc

SEQ ID NO: 3506798 - RNA, 23 nt, Human
cacucacagaccuggagccccug

SEQ ID NO: 3506799 - RNA, 15 nt, Human
cacucacagagucaa

SEQ ID NO: 3506800 - RNA, 22 nt, Human
cacucacagagucaaggccugc

SEQ ID NO: 3506801 - RNA, 19 nt, Human
cacucacauuuauucugcu

SEQ ID NO: 3506802 - RNA, 20 nt, Human
cacucacauuuauucugcuc

SEQ ID NO: 3506803 - RNA, 21 nt, Human
cacucaccaguguccccucca

SEQ ID NO: 3506804 - RNA, 16 nt, Human
cacucacccaugugcc

SEQ ID NO: 3506805 - RNA, 21 nt, Human
cacucacccaugugccaaggu

SEQ ID NO: 3506806 - RNA, 22 nt, Human
cacucacccaugugccaaggug

SEQ ID NO: 3506807 - RNA, 17 nt, Human
cacucagaagacacuga

SEQ ID NO: 3506808 - RNA, 19 nt, Human
cacucagaagacacugaug

SEQ ID NO: 3506809 - RNA, 22 nt, Human
cacucagaagacacugaugggc

SEQ ID NO: 3506810 - RNA, 22 nt, Human
cacucagaagccugggggccug

SEQ ID NO: 3506811 - RNA, 16 nt, Human
cacucagagacaugca

SEQ ID NO: 3506812 - RNA, 18 nt, Human
cacucagagacaugcaga

SEQ ID NO: 3506813 - RNA, 12 nt, Human
cacucagagcag

SEQ ID NO: 3506814 - RNA, 17 nt, Human
cacucagagcagucugu

SEQ ID NO: 3506815 - RNA, 21 nt, Human
cacucagagcagucugugacu

SEQ ID NO: 3506816 - RNA, 13 nt, Human
cacucagcaccac

SEQ ID NO: 3506817 - RNA, 16 nt, Human
cacucagcaccacuca

SEQ ID NO: 3506818 - RNA, 18 nt, Human
cacucagcaccacucaag

SEQ ID NO: 3506819 - RNA, 21 nt, Human
cacucagcacccccuucucug

SEQ ID NO: 3506820 - RNA, 16 nt, Human
cacucagccacccuga

SEQ ID NO: 3506821 - RNA, 18 nt, Human
cacucagccacccugagu

SEQ ID NO: 3506822 - RNA, 22 nt, Human
cacucagccccuaggaguauau

SEQ ID NO: 3506823 - RNA, 12 nt, Human
cacucagcuguu

SEQ ID NO: 3506824 - RNA, 21 nt, Human
cacucagcuguucagauugga

SEQ ID NO: 3506825 - RNA, 19 nt, Human
cacucaggaggcugaggca

SEQ ID NO: 3506826 - RNA, 21 nt, Human
cacucaggaggcugaggcagg

SEQ ID NO: 3506827 - RNA, 19 nt, Human
cacucaggccaacaagcca

SEQ ID NO: 3506828 - RNA, 16 nt, Human
cacucaggccugcgag

SEQ ID NO: 3506829 - RNA, 13 nt, Human
cacucaggcugga

SEQ ID NO: 3506830 - RNA, 16 nt, Human
cacucaggucuguuuu

SEQ ID NO: 3506831 - RNA, 16 nt, Human
cacucaguccauagca

SEQ ID NO: 3506832 - RNA, 14 nt, Human
cacucaugcugaaa

SEQ ID NO: 3506833 - RNA, 15 nt, Human
cacucauuccuguag

SEQ ID NO: 3506834 - RNA, 19 nt, Human
cacucauugaccugaggcc

SEQ ID NO: 3506835 - RNA, 20 nt, Human
cacucauugaccugaggccc

SEQ ID NO: 3506836 - RNA, 16 nt, Human
cacucauugcugagcc

SEQ ID NO: 3506837 - RNA, 19 nt, Human
cacucauugcugagccucu

SEQ ID NO: 3506838 - RNA, 13 nt, Human
cacucauuucauc

SEQ ID NO: 3506839 - RNA, 17 nt, Human
cacucauuucaucucau

SEQ ID NO: 3506840 - RNA, 21 nt, Human
cacuccaaccuaaccuguguc

SEQ ID NO: 3506841 - RNA, 15 nt, Human
cacuccaagccagca

SEQ ID NO: 3506842 - RNA, 16 nt, Human
cacuccaagcccagcc

SEQ ID NO: 3506843 - RNA, 21 nt, Human
cacuccaagcccagcccaugg

SEQ ID NO: 3506844 - RNA, 23 nt, Human
cacuccaauaggugcugagugua

SEQ ID NO: 3506845 - RNA, 21 nt, Human
cacuccaaugucugcugagga

SEQ ID NO: 3506846 - RNA, 18 nt, Human
cacuccaauuaaggauuu

SEQ ID NO: 3506847 - RNA, 14 nt, Human
cacuccaccaccca

SEQ ID NO: 3506848 - RNA, 12 nt, Human
cacuccacccuc

SEQ ID NO: 3506849 - RNA, 18 nt, Human
cacuccacccuccaccuu

SEQ ID NO: 3506850 - RNA, 14 nt, Human
cacuccagaccccu

SEQ ID NO: 3506851 - RNA, 17 nt, Human
cacuccagaccccuggc

SEQ ID NO: 3506852 - RNA, 13 nt, Human
cacuccagccuga

SEQ ID NO: 3506853 - RNA, 15 nt, Human
cacuccagccugagc

SEQ ID NO: 3506854 - RNA, 21 nt, Human
cacuccagccugagcaacaga

SEQ ID NO: 3506855 - RNA, 14 nt, Human
cacuccagccuggg

SEQ ID NO: 3506856 - RNA, 15 nt, Human
cacuccagccugggc

SEQ ID NO: 3506857 - RNA, 16 nt, Human
cacuccagccugggcg

SEQ ID NO: 3506858 - RNA, 23 nt, Human
cacuccagccugggcgacagagc

SEQ ID NO: 3506859 - RNA, 15 nt, Human
cacuccagccugggu

SEQ ID NO: 3506860 - RNA, 13 nt, Human
cacuccagcuccu

SEQ ID NO: 3506861 - RNA, 22 nt, Human
aaacuguuagcacuguugaugu

SEQ ID NO: 3506862 - RNA, 21 nt, Human
aaacuguucccaccugcugga

SEQ ID NO: 3506863 - RNA, 19 nt, Human
aaacuguuggaauggauuu

SEQ ID NO: 3506864 - RNA, 14 nt, Human
aaacuguuugaaaa

SEQ ID NO: 3506865 - RNA, 16 nt, Human
aaacuuaaauguuauu

SEQ ID NO: 3506866 - RNA, 17 nt, Human
aaacuuaacauauuuac

SEQ ID NO: 3506867 - RNA, 14 nt, Human
aaacuuaagaaaca

SEQ ID NO: 3506868 - RNA, 14 nt, Human
aaacuuaaucuaaa

SEQ ID NO: 3506869 - RNA, 16 nt, Human
aaacuuaauuuaauau

SEQ ID NO: 3506870 - RNA, 20 nt, Human
aaacuuaccuaagugacauu

SEQ ID NO: 3506871 - RNA, 15 nt, Human
aaacuuacuauuuug

SEQ ID NO: 3506872 - RNA, 17 nt, Human
aaacuuagugacaaaau

SEQ ID NO: 3506873 - RNA, 16 nt, Human
aaacuuaguuugugaa

SEQ ID NO: 3506874 - RNA, 16 nt, Human
aaacuuaucuuacaaa

SEQ ID NO: 3506875 - RNA, 12 nt, Human
aaacuuaugaau

SEQ ID NO: 3506876 - RNA, 14 nt, Human
aaacuuaugaaugu

SEQ ID NO: 3506877 - RNA, 23 nt, Human
aaacuuauuuuuuucugauugua

SEQ ID NO: 3506878 - RNA, 12 nt, Human
aaacuucagaag

SEQ ID NO: 3506879 - RNA, 22 nt, Human
aaacuucaguuucacagaaaau

SEQ ID NO: 3506880 - RNA, 16 nt, Human
aaacuucauguaauuu

SEQ ID NO: 3506881 - RNA, 17 nt, Human
aaacuucauucucguga

SEQ ID NO: 3506882 - RNA, 22 nt, Human
aaacuuccagugcaacacugaa

SEQ ID NO: 3506883 - RNA, 23 nt, Human
aaacuuccaugaggccaaacguu

SEQ ID NO: 3506884 - RNA, 17 nt, Human
aaacuucguuuaaugaa

SEQ ID NO: 3506885 - RNA, 15 nt, Human
aaacuucuuaaauau

SEQ ID NO: 3506886 - RNA, 13 nt, Human
aaacuugaaaaua

SEQ ID NO: 3506887 - RNA, 14 nt, Human
aaacuugaaaauau

SEQ ID NO: 3506888 - RNA, 19 nt, Human
aaacuugaauucauagaaa

SEQ ID NO: 3506889 - RNA, 19 nt, Human
aaacuugcaucacuuaacg

SEQ ID NO: 3506890 - RNA, 12 nt, Human
aaacuugggcac

SEQ ID NO: 3506891 - RNA, 23 nt, Human
aaacuuggugacuugauccacua

SEQ ID NO: 3506892 - RNA, 16 nt, Human
aaacuuguauuaugug

SEQ ID NO: 3506893 - RNA, 15 nt, Human
aaacuuguuagaaau

SEQ ID NO: 3506894 - RNA, 14 nt, Human
aaacuuguuauugu

SEQ ID NO: 3506895 - RNA, 18 nt, Human
aaacuuguuauugugaau

SEQ ID NO: 3506896 - RNA, 19 nt, Human
aaacuuguuauugugaaug

SEQ ID NO: 3506897 - RNA, 22 nt, Human
aaacuuguuauugugaaugauu

SEQ ID NO: 3506898 - RNA, 16 nt, Human
aaacuuguucuuccaa

SEQ ID NO: 3506899 - RNA, 15 nt, Human
aaacuuguugaauuu

SEQ ID NO: 3506900 - RNA, 19 nt, Human
aaacuuguuugcugugaac

SEQ ID NO: 3506901 - RNA, 20 nt, Human
aaacuuuaaaaaauauuuau

SEQ ID NO: 3506902 - RNA, 18 nt, Human
aaacuuuaauauguauuu

SEQ ID NO: 3506903 - RNA, 20 nt, Human
aaacuuuacccaaaaacuaa

SEQ ID NO: 3506904 - RNA, 14 nt, Human
aaacuuuaccuuuu

SEQ ID NO: 3506905 - RNA, 17 nt, Human
aaacuuuaccuuuuuua

SEQ ID NO: 3506906 - RNA, 18 nt, Human
aaacuuuacuaagaugac

SEQ ID NO: 3506907 - RNA, 21 nt, Human
aaacuuuacuaagaugacauu

SEQ ID NO: 3506908 - RNA, 12 nt, Human
aaacuuuacuau

SEQ ID NO: 3506909 - RNA, 18 nt, Human
aaacuuuacuauggcccu

SEQ ID NO: 3506910 - RNA, 19 nt, Human
aaacuuuaggguaaaaauu

SEQ ID NO: 3506911 - RNA, 16 nt, Human
aaacuuuauacauuag

SEQ ID NO: 3506912 - RNA, 23 nt, Human
aaacuuuauacauuaguaaaugu

SEQ ID NO: 3506913 - RNA, 15 nt, Human
aaacuuuaucacuua

SEQ ID NO: 3506914 - RNA, 15 nt, Human
aaacuuuauuuuaua

SEQ ID NO: 3506915 - RNA, 21 nt, Human
aaacuuuauuuuauauaauaa

SEQ ID NO: 3506916 - RNA, 19 nt, Human
aaacuuucuuaauauuuuu

SEQ ID NO: 3506917 - RNA, 13 nt, Human
aaacuuugaaaua

SEQ ID NO: 3506918 - RNA, 22 nt, Human
aaacuuugagaucuaaaaauaa

SEQ ID NO: 3506919 - RNA, 13 nt, Human
aaacuuuuaacug

SEQ ID NO: 3506920 - RNA, 12 nt, Human
aaacuuuucuca

SEQ ID NO: 3506921 - RNA, 11 nt, Human
aaacuuuucug

SEQ ID NO: 3506922 - RNA, 13 nt, Human
aaacuuuucugcu

SEQ ID NO: 3506923 - RNA, 17 nt, Human
aaacuuuuuuauuuaaa

SEQ ID NO: 3506924 - RNA, 13 nt, Human
aaacuuuuuuuca

SEQ ID NO: 3506925 - RNA, 15 nt, Human
aaacuuuuuuucaau

SEQ ID NO: 3506926 - RNA, 18 nt, Human
aaacuuuuuuucaaugug

SEQ ID NO: 3506927 - RNA, 15 nt, Human
aaacuuuuuuucugu

SEQ ID NO: 3506928 - RNA, 9 nt, Human
aaagaaaaa

SEQ ID NO: 3506929 - RNA, 19 nt, Human
aaagaaaaaaaaaagaaga

SEQ ID NO: 3506930 - RNA, 16 nt, Human
aaagaaaaaaauguca

SEQ ID NO: 3506931 - RNA, 12 nt, Human
aaagaaaauaaa

SEQ ID NO: 3506932 - RNA, 21 nt, Human
aaagaaaauaaaaaaaagaaa

SEQ ID NO: 3506933 - RNA, 18 nt, Human
aaagaaaaugauacagca

SEQ ID NO: 3506934 - RNA, 13 nt, Human
aaagaaaauuaca

SEQ ID NO: 3506935 - RNA, 12 nt, Human
aaagaaaauuga

SEQ ID NO: 3506936 - RNA, 15 nt, Human
aaagaaaccacuucu

SEQ ID NO: 3506937 - RNA, 14 nt, Human
aaagaaagaaggaa

SEQ ID NO: 3506938 - RNA, 12 nt, Human
aaagaaagagag

SEQ ID NO: 3506939 - RNA, 16 nt, Human
aaagaaagagagaaaa

SEQ ID NO: 3506940 - RNA, 16 nt, Human
aaagaaagaggaaaag

SEQ ID NO: 3506941 - RNA, 13 nt, Human
aaagaaaguguau

SEQ ID NO: 3506942 - RNA, 13 nt, Human
aaagaaauaaacc

SEQ ID NO: 3506943 - RNA, 14 nt, Human
aaagaaauaaccac

SEQ ID NO: 3506944 - RNA, 21 nt, Human
aaagaaauaaccacugcaagu

SEQ ID NO: 3506945 - RNA, 12 nt, Human
aaagaaauaauu

SEQ ID NO: 3506946 - RNA, 16 nt, Human
aaagaaaucauguuau

SEQ ID NO: 3506947 - RNA, 23 nt, Human
aaagaaauccauaucuuaaagaa

SEQ ID NO: 3506948 - RNA, 20 nt, Human
aaagaaauccggagaagcug

SEQ ID NO: 3506949 - RNA, 21 nt, Human
aaagaaaucuauagaaagugu

SEQ ID NO: 3506950 - RNA, 14 nt, Human
aaagaaaugaacau

SEQ ID NO: 3506951 - RNA, 16 nt, Human
aaagaaaugaacauuc

SEQ ID NO: 3506952 - RNA, 14 nt, Human
aaagaaaugcaaaa

SEQ ID NO: 3506953 - RNA, 15 nt, Human
aaagaaaugcacaau

SEQ ID NO: 3506954 - RNA, 22 nt, Human
aaagaaauuagggcucuaauuu

SEQ ID NO: 3506955 - RNA, 17 nt, Human
aaagaaauuuacuauau

SEQ ID NO: 3506956 - RNA, 15 nt, Human
aaagaacaguaaaca

SEQ ID NO: 3506957 - RNA, 18 nt, Human
aaagaacauggacuugua

SEQ ID NO: 3506958 - RNA, 21 nt, Human
aaagaacauggacuuguauau

SEQ ID NO: 3506959 - RNA, 18 nt, Human
ccagccaaacccugucug

SEQ ID NO: 3506960 - RNA, 18 nt, Human
ccagccaaccccugugga

SEQ ID NO: 3506961 - RNA, 17 nt, Human
ccagccaacucugggaa

SEQ ID NO: 3506962 - RNA, 22 nt, Human
ccagccaacuuuugcauguuuu

SEQ ID NO: 3506963 - RNA, 19 nt, Human
ccagccacacuugaaccua

SEQ ID NO: 3506964 - RNA, 13 nt, Human
ccagccaccccgg

SEQ ID NO: 3506965 - RNA, 14 nt, Human
ccagccacguggag

SEQ ID NO: 3506966 - RNA, 22 nt, Human
ccagccacucgggaggcugaga

SEQ ID NO: 3506967 - RNA, 11 nt, Human
ccagccacucu

SEQ ID NO: 3506968 - RNA, 23 nt, Human
ccagccagaacguggcucugcug

SEQ ID NO: 3506969 - RNA, 18 nt, Human
ccagccagauccucuugg

SEQ ID NO: 3506970 - RNA, 14 nt, Human
ccagccagcagcag

SEQ ID NO: 3506971 - RNA, 16 nt, Human
ccagccagcagccagc

SEQ ID NO: 3506972 - RNA, 23 nt, Human
ccagccagcagccagcucucagc

SEQ ID NO: 3506973 - RNA, 14 nt, Human
ccagccagccacuc

SEQ ID NO: 3506974 - RNA, 13 nt, Human
ccagccagcgccu

SEQ ID NO: 3506975 - RNA, 17 nt, Human
ccagccagcgccucccu

SEQ ID NO: 3506976 - RNA, 20 nt, Human
ccagccagcgccucccucca

SEQ ID NO: 3506977 - RNA, 22 nt, Human
ccagccagcgccucccuccacc

SEQ ID NO: 3506978 - RNA, 18 nt, Human
ccagccaggcccagccga

SEQ ID NO: 3506979 - RNA, 17 nt, Human
ccagccaggccccaggc

SEQ ID NO: 3506980 - RNA, 13 nt, Human
ccagccaggcccu

SEQ ID NO: 3506981 - RNA, 19 nt, Human
ccagccaggcucugugcug

SEQ ID NO: 3506982 - RNA, 19 nt, Human
ccagccagggcucaaucuc

SEQ ID NO: 3506983 - RNA, 14 nt, Human
ccagccagggcugc

SEQ ID NO: 3506984 - RNA, 23 nt, Human
ccagccagugaccugaggaagcg

SEQ ID NO: 3506985 - RNA, 22 nt, Human
ccagccauacuuaucucucugu

SEQ ID NO: 3506986 - RNA, 20 nt, Human
ccagccaucaagagacugag

SEQ ID NO: 3506987 - RNA, 23 nt, Human
ccagccaucaccuuagaccacca

SEQ ID NO: 3506988 - RNA, 16 nt, Human
ccagccaucugcccag

SEQ ID NO: 3506989 - RNA, 19 nt, Human
ccagccaucugcccagggg

SEQ ID NO: 3506990 - RNA, 17 nt, Human
ccagccaugccagcugg

SEQ ID NO: 3506991 - RNA, 16 nt, Human
ccagccaugucugcau

SEQ ID NO: 3506992 - RNA, 23 nt, Human
ccagcccaaaggggacaggccuc

SEQ ID NO: 3506993 - RNA, 18 nt, Human
ccagcccaauccagguac

SEQ ID NO: 3506994 - RNA, 17 nt, Human
ccagcccacccccggca

SEQ ID NO: 3506995 - RNA, 18 nt, Human
ccagcccacccuccuguc

SEQ ID NO: 3506996 - RNA, 22 nt, Human
ccagcccacccuccugucuucc

SEQ ID NO: 3506997 - RNA, 12 nt, Human
ccagcccacugg

SEQ ID NO: 3506998 - RNA, 14 nt, Human
ccagcccagagaca

SEQ ID NO: 3506999 - RNA, 14 nt, Human
ccagcccagcccag

SEQ ID NO: 3507000 - RNA, 16 nt, Human
ccagcccagccccacu

SEQ ID NO: 3507001 - RNA, 12 nt, Human
ccagcccagcug

SEQ ID NO: 3507002 - RNA, 14 nt, Human
ccagcccagcugcu

SEQ ID NO: 3507003 - RNA, 17 nt, Human
ccagcccagcugcucug

SEQ ID NO: 3507004 - RNA, 19 nt, Human
ccagcccagcugcucugcc

SEQ ID NO: 3507005 - RNA, 23 nt, Human
ccagcccagcugcucugcccaga

SEQ ID NO: 3507006 - RNA, 19 nt, Human
ccagcccagggcuccugca

SEQ ID NO: 3507007 - RNA, 16 nt, Human
ccacuccugcucugcu

SEQ ID NO: 3507008 - RNA, 18 nt, Human
ccacucgcuucccccaua

SEQ ID NO: 3507009 - RNA, 23 nt, Human
ccacucgggaggcugagacagga

SEQ ID NO: 3507010 - RNA, 15 nt, Human
ccacucuaaagcaaa

SEQ ID NO: 3507011 - RNA, 19 nt, Human
ccacucuaccagugcaggc

SEQ ID NO: 3507012 - RNA, 22 nt, Human
cacugugacacacuacaccaca

SEQ ID NO: 3507013 - RNA, 23 nt, Human
cacugugacccccagcuccggcc

SEQ ID NO: 3507014 - RNA, 20 nt, Human
cacugugcacaucugugucu

SEQ ID NO: 3507015 - RNA, 22 nt, Human
cacugugcacaucugugucuug

SEQ ID NO: 3507016 - RNA, 16 nt, Human
cacugugccaugugcc

SEQ ID NO: 3507017 - RNA, 17 nt, Human
cacugugcccagcccgg

SEQ ID NO: 3507018 - RNA, 22 nt, Human
cacugugcccagcccggaccuu

SEQ ID NO: 3507019 - RNA, 17 nt, Human
cacugugcccuggugga

SEQ ID NO: 3507020 - RNA, 20 nt, Human
cacugugccucagagaccag

SEQ ID NO: 3507021 - RNA, 22 nt, Human
cacugugccuuugcaaaucagu

SEQ ID NO: 3507022 - RNA, 19 nt, Human
cacugugcuaauaacagug

SEQ ID NO: 3507023 - RNA, 21 nt, Human
cacugugcuaauaacagugca

SEQ ID NO: 3507024 - RNA, 15 nt, Human
cacugugcucagggc

SEQ ID NO: 3507025 - RNA, 20 nt, Human
cacugugcugagucugaagg

SEQ ID NO: 3507026 - RNA, 21 nt, Human
cacugugcugagucugaaggc

SEQ ID NO: 3507027 - RNA, 20 nt, Human
cacugugcuguuguuaugau

SEQ ID NO: 3507028 - RNA, 21 nt, Human
cacugugcuguuguuaugaug

SEQ ID NO: 3507029 - RNA, 23 nt, Human
cacugugcuguuguuaugaugug

SEQ ID NO: 3507030 - RNA, 17 nt, Human
cacugugcuuucuauug

SEQ ID NO: 3507031 - RNA, 23 nt, Human
cacugugcuuucuauuguacaga

SEQ ID NO: 3507032 - RNA, 23 nt, Human
cacuguggaacuaauaaauacau

SEQ ID NO: 3507033 - RNA, 12 nt, Human
cacuguggccuu

SEQ ID NO: 3507034 - RNA, 24 nt, Human
cacuguggguagacacacaugaag

SEQ ID NO: 3507035 - RNA, 19 nt, Human
cacugugguaaaugccaca

SEQ ID NO: 3507036 - RNA, 15 nt, Human
cacuguggugucugu

SEQ ID NO: 3507037 - RNA, 17 nt, Human
cacuguguauauuugau

SEQ ID NO: 3507038 - RNA, 12 nt, Human
cacuguguccug

SEQ ID NO: 3507039 - RNA, 17 nt, Human
cacuguguccuggugcu

SEQ ID NO: 3507040 - RNA, 17 nt, Human
cacuguguuccuuccgc

SEQ ID NO: 3507041 - RNA, 14 nt, Human
cacuguuauuuuca

SEQ ID NO: 3507042 - RNA, 16 nt, Human
cacuguucaugcuggc

SEQ ID NO: 3507043 - RNA, 17 nt, Human
cacuguucaugcuggcg

SEQ ID NO: 3507044 - RNA, 20 nt, Human
cacuguucccucugcuccug

SEQ ID NO: 3507045 - RNA, 22 nt, Human
cacuguucucugcccuccaaga

SEQ ID NO: 3507046 - RNA, 16 nt, Human
cacuguugaaaauuau

SEQ ID NO: 3507047 - RNA, 18 nt, Human
cacuguugaaaauuauuu

SEQ ID NO: 3507048 - RNA, 21 nt, Human
cacuguugaaaauuauuuuaa

SEQ ID NO: 3507049 - RNA, 13 nt, Human
cacuguugaauuu

SEQ ID NO: 3507050 - RNA, 18 nt, Human
cacuguugcccaggcugg

SEQ ID NO: 3507051 - RNA, 23 nt, Human
cacuguugcccaggcuggcgugc

SEQ ID NO: 3507052 - RNA, 16 nt, Human
cacuguuuaaucauag

SEQ ID NO: 3507053 - RNA, 20 nt, Human
cacuguuuagaacacacaca

SEQ ID NO: 3507054 - RNA, 20 nt, Human
cacuguuuagauuugccaua

SEQ ID NO: 3507055 - RNA, 19 nt, Human
cacuguuuauacacugugu

SEQ ID NO: 3507056 - RNA, 19 nt, Human
cacuguuucaaacuuuacu

SEQ ID NO: 3507057 - RNA, 22 nt, Human
cacuguuucacuacucagcaug

SEQ ID NO: 3507058 - RNA, 12 nt, Human
cacuguuucucu

SEQ ID NO: 3507059 - RNA, 18 nt, Human
cacuguuucucuugagcu

SEQ ID NO: 3507060 - RNA, 20 nt, Human
cacuguuucucuugagcugg

SEQ ID NO: 3507061 - RNA, 21 nt, Human
cacuguuucucuugagcuggc

SEQ ID NO: 3507062 - RNA, 15 nt, Human
cacuguuucuugcuu

SEQ ID NO: 3507063 - RNA, 24 nt, Human
cacuguuucuugcuuguaccucug

SEQ ID NO: 3507064 - RNA, 16 nt, Human
cacuguuuucuagugu

SEQ ID NO: 3507065 - RNA, 19 nt, Human
cacuguuuuuccauaguuu

SEQ ID NO: 3507066 - RNA, 16 nt, Human
cacuuaaaaaaugucc

SEQ ID NO: 3507067 - RNA, 13 nt, Human
cacuuaagagaau

SEQ ID NO: 3507068 - RNA, 22 nt, Human
cacuuaagagaauauuuuaagu

SEQ ID NO: 3507069 - RNA, 17 nt, Human
cacuuaaguuagccucc

SEQ ID NO: 3507070 - RNA, 12 nt, Human
cacuuaauguau

SEQ ID NO: 3507071 - RNA, 13 nt, Human
cacuuaauucugu

SEQ ID NO: 3507072 - RNA, 15 nt, Human
cacuuaauucuguuc

SEQ ID NO: 3507073 - RNA, 18 nt, Human
cacuuacacuuuaugcac

SEQ ID NO: 3507074 - RNA, 19 nt, Human
cacuuacagauaggccuuc

SEQ ID NO: 3507075 - RNA, 13 nt, Human
cacuuacauauau

SEQ ID NO: 3507076 - RNA, 14 nt, Human
cacuuacauuuaca

SEQ ID NO: 3507077 - RNA, 18 nt, Human
cacuuaccucucuguguu

SEQ ID NO: 3507078 - RNA, 21 nt, Human
cacuuaccugaguugaagagg

SEQ ID NO: 3507079 - RNA, 13 nt, Human
cacuuaccuucaa

SEQ ID NO: 3507080 - RNA, 15 nt, Human
cacuuaccuucaaua

SEQ ID NO: 3507081 - RNA, 18 nt, Human
cacuuaccuucaauaaag

SEQ ID NO: 3507082 - RNA, 15 nt, Human
cacuuacugguagga

SEQ ID NO: 3507083 - RNA, 17 nt, Human
cacuuacuguaagacau

SEQ ID NO: 3507084 - RNA, 19 nt, Human
cacuuacuguaagacauua

SEQ ID NO: 3507085 - RNA, 18 nt, Human
cacuuacuguuguccuau

SEQ ID NO: 3507086 - RNA, 17 nt, Human
cacuuacuuacccucac

SEQ ID NO: 3507087 - RNA, 21 nt, Human
cacuuacuuuuucuggucucu

SEQ ID NO: 3507088 - RNA, 17 nt, Human
cacuuagaaauugcauu

SEQ ID NO: 3507089 - RNA, 20 nt, Human
cacuuagaaauugcauuucc

SEQ ID NO: 3507090 - RNA, 21 nt, Human
cacuuagcuggagaugucucu

SEQ ID NO: 3507091 - RNA, 19 nt, Human
cacuuaucauuagaaucuu

SEQ ID NO: 3507092 - RNA, 19 nt, Human
cacuuauguuauacaauac

SEQ ID NO: 3507093 - RNA, 13 nt, Human
cacuuauugcuuu

SEQ ID NO: 3507094 - RNA, 14 nt, Human
cacuuauuucauaa

SEQ ID NO: 3507095 - RNA, 11 nt, Human
cacuucaaacu

SEQ ID NO: 3507096 - RNA, 14 nt, Human
cacuucaaacuacu

SEQ ID NO: 3507097 - RNA, 18 nt, Human
cacuucaaauucaaauaa

SEQ ID NO: 3507098 - RNA, 21 nt, Human
cacuucaagugaccaccagga

SEQ ID NO: 3507099 - RNA, 18 nt, Human
cacuucaauaauugucca

SEQ ID NO: 3507100 - RNA, 15 nt, Human
cacuucacagagugu

SEQ ID NO: 3507101 - RNA, 19 nt, Human
cacuucacagagugugcug

SEQ ID NO: 3507102 - RNA, 12 nt, Human
cacuucacugug

SEQ ID NO: 3507103 - RNA, 13 nt, Human
cacuucacugugc

SEQ ID NO: 3507104 - RNA, 15 nt, Human
cacuucagagagcug

SEQ ID NO: 3507105 - RNA, 14 nt, Human
cacuucaggcucuu

SEQ ID NO: 3507106 - RNA, 15 nt, Human
cacuucaggcucuuc

SEQ ID NO: 3507107 - RNA, 21 nt, Human
cacuucagggcagauuuuagu

SEQ ID NO: 3507108 - RNA, 22 nt, Human
cacuucagggcagauuuuaguu

SEQ ID NO: 3507109 - RNA, 18 nt, Human
cacuucaucuucucagcu

SEQ ID NO: 3507110 - RNA, 19 nt, Human
cacuucauguaaaguguca

SEQ ID NO: 3507111 - RNA, 12 nt, Human
cacuucccugcu

SEQ ID NO: 3507112 - RNA, 13 nt, Human
cacuucccuggcg

SEQ ID NO: 3507113 - RNA, 13 nt, Human
cacuucccugggc

SEQ ID NO: 3507114 - RNA, 19 nt, Human
cacuucccugggcaaauga

SEQ ID NO: 3507115 - RNA, 21 nt, Human
cacuuccucucgcggcccuca

SEQ ID NO: 3507116 - RNA, 11 nt, Human
cacuuccugcc

SEQ ID NO: 3507117 - RNA, 13 nt, Human
cacuuccugccua

SEQ ID NO: 3507118 - RNA, 12 nt, Human
cacuuccugucc

SEQ ID NO: 3507119 - RNA, 24 nt, Human
cacuuccuguuugggccccucucc

SEQ ID NO: 3507120 - RNA, 12 nt, Human
cacuuccuugcc

SEQ ID NO: 3507121 - RNA, 21 nt, Human
cacuucggccaggucacacga

SEQ ID NO: 3507122 - RNA, 23 nt, Human
cacuucgggaggucgaggcagga

SEQ ID NO: 3507123 - RNA, 20 nt, Human
cacuucguucgcagagcuuu

SEQ ID NO: 3507124 - RNA, 19 nt, Human
cacuucucaggacacaggc

SEQ ID NO: 3507125 - RNA, 18 nt, Human
cacuucucaucacacaca

SEQ ID NO: 3507126 - RNA, 19 nt, Human
cacuucucaucacacacau

SEQ ID NO: 3507127 - RNA, 21 nt, Human
cacuucucaucacacacaugg

SEQ ID NO: 3507128 - RNA, 21 nt, Human
cacuucucuuaaacuugugaa

SEQ ID NO: 3507129 - RNA, 13 nt, Human
cacuucucuuccu

SEQ ID NO: 3507130 - RNA, 11 nt, Human
cacuucugcac

SEQ ID NO: 3507131 - RNA, 22 nt, Human
cacuucugccauauucuguugg

SEQ ID NO: 3507132 - RNA, 22 nt, Human
cacuucuggauauagcuaggug

SEQ ID NO: 3507133 - RNA, 18 nt, Human
cacuucuggguggggcag

SEQ ID NO: 3507134 - RNA, 19 nt, Human
cacuucuuacaauaauucu

SEQ ID NO: 3507135 - RNA, 12 nt, Human
cacuucuucugu

SEQ ID NO: 3507136 - RNA, 15 nt, Human
cacuucuucugucca

SEQ ID NO: 3507137 - RNA, 20 nt, Human
cacuucuucuguccaagcag

SEQ ID NO: 3507138 - RNA, 23 nt, Human
cacuucuucuuggucuuauuuau

SEQ ID NO: 3507139 - RNA, 18 nt, Human
cacuucuuguuccccacu

SEQ ID NO: 3507140 - RNA, 23 nt, Human
cacuugaacccgggaggcagagg

SEQ ID NO: 3507141 - RNA, 19 nt, Human
cacuugaagccaucuaaag

SEQ ID NO: 3507142 - RNA, 20 nt, Human
cacuugagaauuacccuuuu

SEQ ID NO: 3507143 - RNA, 13 nt, Human
cacuugaguccag

SEQ ID NO: 3507144 - RNA, 23 nt, Human
cacuugaguggagguuuauaguu

SEQ ID NO: 3507145 - RNA, 15 nt, Human
cacuugauucauaaa

SEQ ID NO: 3507146 - RNA, 14 nt, Human
cacuugauuccuug

SEQ ID NO: 3507147 - RNA, 22 nt, Human
cacuugcagacucuacagaggc

SEQ ID NO: 3507148 - RNA, 14 nt, Human
cacuugcccugcuc

SEQ ID NO: 3507149 - RNA, 17 nt, Human
cacuugcccugcucccu

SEQ ID NO: 3507150 - RNA, 22 nt, Human
cacuugccgcgucgcccuccca

SEQ ID NO: 3507151 - RNA, 20 nt, Human
cagaaacaccuagaucagaa

SEQ ID NO: 3507152 - RNA, 12 nt, Human
cagaaacacugc

SEQ ID NO: 3507153 - RNA, 18 nt, Human
cagaaacacugccuuuuu

SEQ ID NO: 3507154 - RNA, 19 nt, Human
cagaaacacugccuuuuua

SEQ ID NO: 3507155 - RNA, 18 nt, Human
cagaaacaggugcaucug

SEQ ID NO: 3507156 - RNA, 22 nt, Human
cagaaacaucaguuacucugaa

SEQ ID NO: 3507157 - RNA, 23 nt, Human
cagaaacaucaguuacucugaag

SEQ ID NO: 3507158 - RNA, 12 nt, Human
cagaaacuagaa

SEQ ID NO: 3507159 - RNA, 20 nt, Human
cagaaagacugagcucaagg

SEQ ID NO: 3507160 - RNA, 19 nt, Human
cagaaagauggaugugcuu

SEQ ID NO: 3507161 - RNA, 21 nt, Human
cagaaagauggaugugcuuug

SEQ ID NO: 3507162 - RNA, 18 nt, Human
cagaaagcagaacaguga

SEQ ID NO: 3507163 - RNA, 15 nt, Human
cagaaagcagaggcu

SEQ ID NO: 3507164 - RNA, 23 nt, Human
cagaaagcaguugagacaagaaa

SEQ ID NO: 3507165 - RNA, 22 nt, Human
cagaaagccccacccaggccag

SEQ ID NO: 3507166 - RNA, 12 nt, Human
cagaaaggagac

SEQ ID NO: 3507167 - RNA, 15 nt, Human
cagaaaggcuuuuua

SEQ ID NO: 3507168 - RNA, 15 nt, Human
cagaaagggagggcu

SEQ ID NO: 3507169 - RNA, 22 nt, Human
cagaaagggagggcucugaggc

SEQ ID NO: 3507170 - RNA, 23 nt, Human
cagaaagggagggcucugaggcg

SEQ ID NO: 3507171 - RNA, 22 nt, Human
cagaaagggcaacaauaaaaua

SEQ ID NO: 3507172 - RNA, 16 nt, Human
cagaaagguucugccc

SEQ ID NO: 3507173 - RNA, 17 nt, Human
cagaaagguucugcccg

SEQ ID NO: 3507174 - RNA, 20 nt, Human
cagaaaguaauuucuucuca

SEQ ID NO: 3507175 - RNA, 20 nt, Human
ccacucuaccagugcaggcu

SEQ ID NO: 3507176 - RNA, 18 nt, Human
ccacucuacccucccacc

SEQ ID NO: 3507177 - RNA, 19 nt, Human
ccacucuacccucccaccc

SEQ ID NO: 3507178 - RNA, 21 nt, Human
ccacucuacccucccaccccc

SEQ ID NO: 3507179 - RNA, 11 nt, Human
ccacucucaga

SEQ ID NO: 3507180 - RNA, 17 nt, Human
ccacucucauuccccag

SEQ ID NO: 3507181 - RNA, 19 nt, Human
ccacucucauuccccaggu

SEQ ID NO: 3507182 - RNA, 12 nt, Human
ccacucucccca

SEQ ID NO: 3507183 - RNA, 16 nt, Human
ccacucuccccacacu

SEQ ID NO: 3507184 - RNA, 14 nt, Human
ccacucuccuaggc

SEQ ID NO: 3507185 - RNA, 13 nt, Human
ccacucucuuccc

SEQ ID NO: 3507186 - RNA, 14 nt, Human
ccacucucuucccu

SEQ ID NO: 3507187 - RNA, 15 nt, Human
ccacucucuucccuu

SEQ ID NO: 3507188 - RNA, 23 nt, Human
ccacucugcucugaugcaucaga

SEQ ID NO: 3507189 - RNA, 17 nt, Human
ccacucugcuucucuga

SEQ ID NO: 3507190 - RNA, 20 nt, Human
ccacucugcuucucugacuu

SEQ ID NO: 3507191 - RNA, 18 nt, Human
ccacucuggauucagccu

SEQ ID NO: 3507192 - RNA, 19 nt, Human
ccacucuggauucagccuu

SEQ ID NO: 3507193 - RNA, 20 nt, Human
ccacucuggauucagccuuc

SEQ ID NO: 3507194 - RNA, 12 nt, Human
ccacucuggcag

SEQ ID NO: 3507195 - RNA, 14 nt, Human
ccacucuggcagcc

SEQ ID NO: 3507196 - RNA, 18 nt, Human
ccacucuggcagccacac

SEQ ID NO: 3507197 - RNA, 22 nt, Human
ccacucuggcagccacacuucu

SEQ ID NO: 3507198 - RNA, 12 nt, Human
ccacucuguaau

SEQ ID NO: 3507199 - RNA, 11 nt, Human
ccacucugugc

SEQ ID NO: 3507200 - RNA, 19 nt, Human
ccacugaaaaaauauaugu

SEQ ID NO: 3507201 - RNA, 10 nt, Human
ccacugaaga

SEQ ID NO: 3507202 - RNA, 12 nt, Human
ccacugaagagg

SEQ ID NO: 3507203 - RNA, 19 nt, Human
ccacugaagauagaagaaa

SEQ ID NO: 3507204 - RNA, 18 nt, Human
ccacugaagcccauuucu

SEQ ID NO: 3507205 - RNA, 19 nt, Human
ccacugacagccucccacc

SEQ ID NO: 3507206 - RNA, 17 nt, Human
ccacugacugcagggac

SEQ ID NO: 3507207 - RNA, 19 nt, Human
ccacugagagaucugcugu

SEQ ID NO: 3507208 - RNA, 11 nt, Human
ccacugagcuc

SEQ ID NO: 3507209 - RNA, 16 nt, Human
ccacugaugcuguucu

SEQ ID NO: 3507210 - RNA, 23 nt, Human
ccacugcaaguccuuuuguaaag

SEQ ID NO: 3507211 - RNA, 23 nt, Human
ccacugcacagagcucuccagcu

SEQ ID NO: 3507212 - RNA, 11 nt, Human
ccacugcaccc

SEQ ID NO: 3507213 - RNA, 17 nt, Human
ccacugcacccccuccu

SEQ ID NO: 3507214 - RNA, 20 nt, Human
ccacugcacccccuccugcu

SEQ ID NO: 3507215 - RNA, 21 nt, Human
ccacugcacccccuccugcug

SEQ ID NO: 3507216 - RNA, 14 nt, Human
ccacugcaccgggc

SEQ ID NO: 3507217 - RNA, 17 nt, Human
ccacugcaccgggccac

SEQ ID NO: 3507218 - RNA, 19 nt, Human
ccacugcacuauagccuag

SEQ ID NO: 3507219 - RNA, 20 nt, Human
ccacugcacuauagccuagg

SEQ ID NO: 3507220 - RNA, 15 nt, Human
ccacugcacuccagc

SEQ ID NO: 3507221 - RNA, 18 nt, Human
ccacugcacuccagccug

SEQ ID NO: 3507222 - RNA, 19 nt, Human
ccacugcacuccagccugg

SEQ ID NO: 3507223 - RNA, 20 nt, Human
ccacugcacuccagccuggg

SEQ ID NO: 3507224 - RNA, 20 nt, Human
ccacugcacucuagccggag

SEQ ID NO: 3507225 - RNA, 18 nt, Human
ccacugcagaagacagua

SEQ ID NO: 3507226 - RNA, 14 nt, Human
ccacugcaggcccc

SEQ ID NO: 3507227 - RNA, 17 nt, Human
ccacugcaggccccgcu

SEQ ID NO: 3507228 - RNA, 19 nt, Human
ccacugcauaccaaccugg

SEQ ID NO: 3507229 - RNA, 21 nt, Human
ccacugcaucguuucaucuuc

SEQ ID NO: 3507230 - RNA, 23 nt, Human
ccacugcaucguuucaucuucca

SEQ ID NO: 3507231 - RNA, 15 nt, Human
ccacugccagcagca

SEQ ID NO: 3507232 - RNA, 16 nt, Human
ccacugccagcagcag

SEQ ID NO: 3507233 - RNA, 15 nt, Human
ccacugcccaccccc

SEQ ID NO: 3507234 - RNA, 16 nt, Human
ccacugcccacccccu

SEQ ID NO: 3507235 - RNA, 17 nt, Human
ccacugcccacuggccg

SEQ ID NO: 3507236 - RNA, 18 nt, Human
ccacugcccgagcuggug

SEQ ID NO: 3507237 - RNA, 22 nt, Human
ccacugcccgagcuggugcauu

SEQ ID NO: 3507238 - RNA, 14 nt, Human
ccacugccuacugc

SEQ ID NO: 3507239 - RNA, 16 nt, Human
ccacugccuacugcau

SEQ ID NO: 3507240 - RNA, 19 nt, Human
ccacugccucagguuccua

SEQ ID NO: 3507241 - RNA, 17 nt, Human
ccacugccucugccuua

SEQ ID NO: 3507242 - RNA, 20 nt, Human
ccacugccucuggaauugcu

SEQ ID NO: 3507243 - RNA, 12 nt, Human
ccacugccugcc

SEQ ID NO: 3507244 - RNA, 17 nt, Human
ccacugccugcccaccc

SEQ ID NO: 3507245 - RNA, 14 nt, Human
ccacugccuucgcu

SEQ ID NO: 3507246 - RNA, 16 nt, Human
ccacugcgaccacaag

SEQ ID NO: 3507247 - RNA, 24 nt, Human
ccacugcucccuaagccagccugg

SEQ ID NO: 3507248 - RNA, 11 nt, Human
ccacugcucug

SEQ ID NO: 3507249 - RNA, 20 nt, Human
ccacugcugauauuuucucu

SEQ ID NO: 3507250 - RNA, 14 nt, Human
ccacugcuuaccua

SEQ ID NO: 3507251 - RNA, 13 nt, Human
ccacuggccacca

SEQ ID NO: 3507252 - RNA, 16 nt, Human
ccacuggccaccaggc

SEQ ID NO: 3507253 - RNA, 19 nt, Human
ccacuggccaccaggcugg

SEQ ID NO: 3507254 - RNA, 20 nt, Human
ccacuggccaccaggcuggc

SEQ ID NO: 3507255 - RNA, 16 nt, Human
ccacuggcuggacaaa

SEQ ID NO: 3507256 - RNA, 23 nt, Human
ccacuggcuggacaaacugcacc

SEQ ID NO: 3507257 - RNA, 15 nt, Human
ccacuggcugugggc

SEQ ID NO: 3507258 - RNA, 18 nt, Human
ccacuggcugugggcucc

SEQ ID NO: 3507259 - RNA, 20 nt, Human
ccacuggcugugggcucccu

SEQ ID NO: 3507260 - RNA, 17 nt, Human
ccacugggaccaacccu

SEQ ID NO: 3507261 - RNA, 11 nt, Human
ccacugggagg

SEQ ID NO: 3507262 - RNA, 12 nt, Human
ccacuggggaaa

SEQ ID NO: 3507263 - RNA, 22 nt, Human
ccacuggggaaauaacagcugu

SEQ ID NO: 3507264 - RNA, 15 nt, Human
ccacuggggcucaga

SEQ ID NO: 3507265 - RNA, 18 nt, Human
ccacuguacuugcucuug

SEQ ID NO: 3507266 - RNA, 19 nt, Human
ccacugucacuguuucucu

SEQ ID NO: 3507267 - RNA, 12 nt, Human
ccacuguccugg

SEQ ID NO: 3507268 - RNA, 15 nt, Human
ccacuguccugggcc

SEQ ID NO: 3507269 - RNA, 20 nt, Human
ccacuguccugggccugcag

SEQ ID NO: 3507270 - RNA, 21 nt, Human
ccacuguccugggccugcaga

SEQ ID NO: 3507271 - RNA, 15 nt, Human
ccacugugccaugug

SEQ ID NO: 3507272 - RNA, 16 nt, Human
ccacugugccaugugc

SEQ ID NO: 3507273 - RNA, 19 nt, Human
ccacugugccucagagacc

SEQ ID NO: 3507274 - RNA, 22 nt, Human
ccacugugccucagagaccagg

SEQ ID NO: 3507275 - RNA, 20 nt, Human
ccacugugccuuugcaaauc

SEQ ID NO: 3507276 - RNA, 12 nt, Human
ccacuguguaua

SEQ ID NO: 3507277 - RNA, 13 nt, Human
ccacuguguuccu

SEQ ID NO: 3507278 - RNA, 22 nt, Human
ccacuguuucucuugagcuggc

SEQ ID NO: 3507279 - RNA, 15 nt, Human
ccacuguuucuugcu

SEQ ID NO: 3507280 - RNA, 20 nt, Human
ccacuguuucuugcuuguac

SEQ ID NO: 3507281 - RNA, 17 nt, Human
ccacuuaaaaaaugucc

SEQ ID NO: 3507282 - RNA, 16 nt, Human
ccacuuaaaaauuaaa

SEQ ID NO: 3507283 - RNA, 13 nt, Human
ccacuuaaaaugu

SEQ ID NO: 3507284 - RNA, 15 nt, Human
ccacuuauagccucu

SEQ ID NO: 3507285 - RNA, 22 nt, Human
ccacuuauuccccauucuuccu

SEQ ID NO: 3507286 - RNA, 17 nt, Human
ccacuucaagugaccac

SEQ ID NO: 3507287 - RNA, 20 nt, Human
ccacuucaaugcacauggug

SEQ ID NO: 3507288 - RNA, 21 nt, Human
ccacuuccaggggaaccugcc

SEQ ID NO: 3507289 - RNA, 23 nt, Human
ccacuucccagguaagcaggagg

SEQ ID NO: 3507290 - RNA, 17 nt, Human
ccacuucccugacacug

SEQ ID NO: 3507291 - RNA, 18 nt, Human
ccacuucggccaggucac

SEQ ID NO: 3507292 - RNA, 14 nt, Human
ccacuucucaucac

SEQ ID NO: 3507293 - RNA, 19 nt, Human
ccacuucucaucacacaca

SEQ ID NO: 3507294 - RNA, 16 nt, Human
ccacuucugacagccu

SEQ ID NO: 3507295 - RNA, 18 nt, Human
ccacuucugacagccuca

SEQ ID NO: 3507296 - RNA, 17 nt, Human
ccauuuccccagggcac

SEQ ID NO: 3507297 - RNA, 13 nt, Human
ccauuuccugaga

SEQ ID NO: 3507298 - RNA, 17 nt, Human
ccauuuccuuaugcugu

SEQ ID NO: 3507299 - RNA, 22 nt, Human
ccauuucgugagccccaucuuc

SEQ ID NO: 3507300 - RNA, 19 nt, Human
ccauuucuaaaggccucuu

SEQ ID NO: 3507301 - RNA, 21 nt, Human
ccauuucuaaaggccucuucc

SEQ ID NO: 3507302 - RNA, 18 nt, Human
ccauuucuacucucccau

SEQ ID NO: 3507303 - RNA, 14 nt, Human
ccauuucuauuuau

SEQ ID NO: 3507304 - RNA, 16 nt, Human
ccauuucucacugaga

SEQ ID NO: 3507305 - RNA, 13 nt, Human
ccauuucuccaga

SEQ ID NO: 3507306 - RNA, 13 nt, Human
ccauuucuccguu

SEQ ID NO: 3507307 - RNA, 14 nt, Human
ccauuucugccuuu

SEQ ID NO: 3507308 - RNA, 12 nt, Human
ccauuugauacc

SEQ ID NO: 3507309 - RNA, 20 nt, Human
ccauuugcaauaacagcugc

SEQ ID NO: 3507310 - RNA, 22 nt, Human
ccauuugcaauaacagcugcaa

SEQ ID NO: 3507311 - RNA, 15 nt, Human
ccauuugcauuuguu

SEQ ID NO: 3507312 - RNA, 22 nt, Human
ccauuugcauuuguuuauguaa

SEQ ID NO: 3507313 - RNA, 22 nt, Human
ccauuugccaauuuuccuacuc

SEQ ID NO: 3507314 - RNA, 18 nt, Human
ccauuugcuacuguacau

SEQ ID NO: 3507315 - RNA, 16 nt, Human
ccauuugcuuuuucac

SEQ ID NO: 3507316 - RNA, 18 nt, Human
ccauuuggagggccuggg

SEQ ID NO: 3507317 - RNA, 16 nt, Human
ccauuuggcaucccug

SEQ ID NO: 3507318 - RNA, 19 nt, Human
ccauuuggcaucccugggc

SEQ ID NO: 3507319 - RNA, 13 nt, Human
ccauuuguaauuu

SEQ ID NO: 3507320 - RNA, 14 nt, Human
ccauuuguaauuug

SEQ ID NO: 3507321 - RNA, 13 nt, Human
ccauuuguacuga

SEQ ID NO: 3507322 - RNA, 15 nt, Human
ccauuugucccaagu

SEQ ID NO: 3507323 - RNA, 15 nt, Human
ccauuuguuaauauc

SEQ ID NO: 3507324 - RNA, 13 nt, Human
ccauuuguuuauu

SEQ ID NO: 3507325 - RNA, 22 nt, Human
ccauuuuaaaguuaguaucuuu

SEQ ID NO: 3507326 - RNA, 20 nt, Human
ccauuuuaagucccugucac

SEQ ID NO: 3507327 - RNA, 23 nt, Human
ccauuuuaagucccugucaccuc

SEQ ID NO: 3507328 - RNA, 14 nt, Human
ccauuuuaauuuua

SEQ ID NO: 3507329 - RNA, 21 nt, Human
ccauuuuaauuuuaaagugca

SEQ ID NO: 3507330 - RNA, 22 nt, Human
ccauuuuccuacaggcagucuc

SEQ ID NO: 3507331 - RNA, 23 nt, Human
ccauuuuccuacaggcagucucu

SEQ ID NO: 3507332 - RNA, 23 nt, Human
ccauuuucuuauugcgcugcuac

SEQ ID NO: 3507333 - RNA, 14 nt, Human
ccauuuugcaaaau

SEQ ID NO: 3507334 - RNA, 19 nt, Human
ccauuuuggugucuuucuc

SEQ ID NO: 3507335 - RNA, 20 nt, Human
ccauuuuggugucuuucucu

SEQ ID NO: 3507336 - RNA, 21 nt, Human
ccauuuuggugucuuucucuu

SEQ ID NO: 3507337 - RNA, 22 nt, Human
ccauuuuggugucuuucucuuu

SEQ ID NO: 3507338 - RNA, 16 nt, Human
ccauuuugugaagccc

SEQ ID NO: 3507339 - RNA, 19 nt, Human
ccauuuugugaagcccugu

SEQ ID NO: 3507340 - RNA, 18 nt, Human
ccauuuuguuauugacua

SEQ ID NO: 3507341 - RNA, 23 nt, Human
ccauuuuguuauugacuaacagg

SEQ ID NO: 3507342 - RNA, 15 nt, Human
ccauuuuuacuguua

SEQ ID NO: 3507343 - RNA, 21 nt, Human
ccauuuuuauuucaaaauaua

SEQ ID NO: 3507344 - RNA, 18 nt, Human
ccauuuuucaaagcaauu

SEQ ID NO: 3507345 - RNA, 12 nt, Human
ccauuuuuccuu

SEQ ID NO: 3507346 - RNA, 19 nt, Human
ccauuuuucuuccaggaug

SEQ ID NO: 3507347 - RNA, 19 nt, Human
ccauuuuuuaaggaaacaa

SEQ ID NO: 3507348 - RNA, 20 nt, Human
ccauuuuuuauauuucaagu

SEQ ID NO: 3507349 - RNA, 14 nt, Human
cccaaaaccacagc

SEQ ID NO: 3507350 - RNA, 21 nt, Human
cccaaaaccacagcccuguca

SEQ ID NO: 3507351 - RNA, 20 nt, Human
cccaaaacucuccucugcug

SEQ ID NO: 3507352 - RNA, 18 nt, Human
cccaaaauuuauuuuaua

SEQ ID NO: 3507353 - RNA, 17 nt, Human
cccaaacaaauaugcaa

SEQ ID NO: 3507354 - RNA, 13 nt, Human
cccaaacccuagg

SEQ ID NO: 3507355 - RNA, 12 nt, Human
cccaaaccugga

SEQ ID NO: 3507356 - RNA, 22 nt, Human
cccaaacuguucaagaaauaau

SEQ ID NO: 3507357 - RNA, 21 nt, Human
cccaaagcaagcaagaggccg

SEQ ID NO: 3507358 - RNA, 16 nt, Human
cccaaagcugagccug

SEQ ID NO: 3507359 - RNA, 18 nt, Human
cccaaagcugagccugca

SEQ ID NO: 3507360 - RNA, 16 nt, Human
cccaaagcuuuccugc

SEQ ID NO: 3507361 - RNA, 14 nt, Human
cccaaaggacucca

SEQ ID NO: 3507362 - RNA, 18 nt, Human
cccaaaggacuccaccca

SEQ ID NO: 3507363 - RNA, 18 nt, Human
cccaaaggggacaggccu

SEQ ID NO: 3507364 - RNA, 15 nt, Human
cccaaagugcugaga

SEQ ID NO: 3507365 - RNA, 18 nt, Human
cccaaauaacuucagucc

SEQ ID NO: 3507366 - RNA, 18 nt, Human
cccaaauccgaaccuccu

SEQ ID NO: 3507367 - RNA, 16 nt, Human
cccaaaucucuuccac

SEQ ID NO: 3507368 - RNA, 14 nt, Human
cccaaaugagccau

SEQ ID NO: 3507369 - RNA, 23 nt, Human
cccaaauggaaaugggcagagca

SEQ ID NO: 3507370 - RNA, 18 nt, Human
cccaacacaaggugggca

SEQ ID NO: 3507371 - RNA, 16 nt, Human
cccaacaccagccccu

SEQ ID NO: 3507372 - RNA, 13 nt, Human
cccaacacgggua

SEQ ID NO: 3507373 - RNA, 12 nt, Human
cccaacacugug

SEQ ID NO: 3507374 - RNA, 19 nt, Human
cccaacacugugcccuggu

SEQ ID NO: 3507375 - RNA, 20 nt, Human
cccaacacugugcccuggug

SEQ ID NO: 3507376 - RNA, 19 nt, Human
cccaacagcgacauagccc

SEQ ID NO: 3507377 - RNA, 15 nt, Human
cccaacagcuggacc

SEQ ID NO: 3507378 - RNA, 17 nt, Human
cccaacaggaggacaau

SEQ ID NO: 3507379 - RNA, 18 nt, Human
cccaacaggaggacaauu

SEQ ID NO: 3507380 - RNA, 16 nt, Human
cccaacagugugaagu

SEQ ID NO: 3507381 - RNA, 20 nt, Human
cccaaccaggcaccucuucc

SEQ ID NO: 3507382 - RNA, 12 nt, Human
aaagcugccagc

SEQ ID NO: 3507383 - RNA, 13 nt, Human
aaagcugccagcc

SEQ ID NO: 3507384 - RNA, 24 nt, Human
aaagcugcccacuguuucucuuga

SEQ ID NO: 3507385 - RNA, 15 nt, Human
aaagcugccuguagu

SEQ ID NO: 3507386 - RNA, 15 nt, Human
aaagcugcuaaaucu

SEQ ID NO: 3507387 - RNA, 18 nt, Human
aaagcugcuaaaucuccu

SEQ ID NO: 3507388 - RNA, 14 nt, Human
aaagcugcugugau

SEQ ID NO: 3507389 - RNA, 18 nt, Human
aaagcugguuuaauguuu

SEQ ID NO: 3507390 - RNA, 17 nt, Human
aaagcuguauuuugaaa

SEQ ID NO: 3507391 - RNA, 15 nt, Human
aaagcuguuaaacug

SEQ ID NO: 3507392 - RNA, 18 nt, Human
aaagcuguuaaacuguua

SEQ ID NO: 3507393 - RNA, 14 nt, Human
aaagcuguuccuug

SEQ ID NO: 3507394 - RNA, 14 nt, Human
aaagcuguucuucc

SEQ ID NO: 3507395 - RNA, 16 nt, Human
aaagcuguucuuccug

SEQ ID NO: 3507396 - RNA, 17 nt, Human
aaagcuguucuuccugg

SEQ ID NO: 3507397 - RNA, 15 nt, Human
aaagcuuaaaacuuu

SEQ ID NO: 3507398 - RNA, 11 nt, Human
aaagcuucccc

SEQ ID NO: 3507399 - RNA, 20 nt, Human
aaagcuucuuaauuaauuug

SEQ ID NO: 3507400 - RNA, 20 nt, Human
aaagcuuggauuaaauacau

SEQ ID NO: 3507401 - RNA, 20 nt, Human
aaagcuuuaugauuuucaua

SEQ ID NO: 3507402 - RNA, 18 nt, Human
aaagcuuuauuaccagug

SEQ ID NO: 3507403 - RNA, 23 nt, Human
aaagcuuucaugucccagaacuu

SEQ ID NO: 3507404 - RNA, 14 nt, Human
aaagcuuuccugcc

SEQ ID NO: 3507405 - RNA, 22 nt, Human
aaagcuuuccugccccaggccu

SEQ ID NO: 3507406 - RNA, 14 nt, Human
aaagcuuuccugga

SEQ ID NO: 3507407 - RNA, 12 nt, Human
aaagcuuucugc

SEQ ID NO: 3507408 - RNA, 20 nt, Human
aaagcuuuguuuguucuugu

SEQ ID NO: 3507409 - RNA, 14 nt, Human
aaagcuuuuaugag

SEQ ID NO: 3507410 - RNA, 14 nt, Human
aaagcuuuugcaua

SEQ ID NO: 3507411 - RNA, 17 nt, Human
aaagcuuuuuccuccug

SEQ ID NO: 3507412 - RNA, 12 nt, Human
aaaggaaaaaaa

SEQ ID NO: 3507413 - RNA, 15 nt, Human
aaaggaaaaaaagac

SEQ ID NO: 3507414 - RNA, 16 nt, Human
aaaggaaaaaaagacu

SEQ ID NO: 3507415 - RNA, 12 nt, Human
aaaggaaaagaa

SEQ ID NO: 3507416 - RNA, 13 nt, Human
aaaggaaaagaaa

SEQ ID NO: 3507417 - RNA, 17 nt, Human
aaaggaaaagaaaaaaa

SEQ ID NO: 3507418 - RNA, 13 nt, Human
aaaggaaaagaca

SEQ ID NO: 3507419 - RNA, 11 nt, Human
aaaggaaagag

SEQ ID NO: 3507420 - RNA, 22 nt, Human
aaaggaaagagggagguaagga

SEQ ID NO: 3507421 - RNA, 15 nt, Human
aaaggaaagcugugu

SEQ ID NO: 3507422 - RNA, 18 nt, Human
aaaggaaagcuguguuua

SEQ ID NO: 3507423 - RNA, 17 nt, Human
aaaggaaaucucacccc

SEQ ID NO: 3507424 - RNA, 13 nt, Human
aaaggaagacuag

SEQ ID NO: 3507425 - RNA, 15 nt, Human
aaaggaagcacucug

SEQ ID NO: 3507426 - RNA, 22 nt, Human
aaaggaagcauuguaaaauaau

SEQ ID NO: 3507427 - RNA, 12 nt, Human
aaaggaagccaa

SEQ ID NO: 3507428 - RNA, 14 nt, Human
aaaggaagccaaag

SEQ ID NO: 3507429 - RNA, 13 nt, Human
aaaggaagcuuuc

SEQ ID NO: 3507430 - RNA, 20 nt, Human
aaaggaagguucugguguga

SEQ ID NO: 3507431 - RNA, 19 nt, Human
aaaggaaugcaaagaugaa

SEQ ID NO: 3507432 - RNA, 15 nt, Human
aaaggacaauuucaa

SEQ ID NO: 3507433 - RNA, 19 nt, Human
aaaggacagaguaugaaca

SEQ ID NO: 3507434 - RNA, 17 nt, Human
aaaggacaggcagaaag

SEQ ID NO: 3507435 - RNA, 14 nt, Human
aaaggacauuaugu

SEQ ID NO: 3507436 - RNA, 15 nt, Human
aaaggacauuaugug

SEQ ID NO: 3507437 - RNA, 16 nt, Human
aaaggacucugggguu

SEQ ID NO: 3507438 - RNA, 13 nt, Human
aaaggacuguaau

SEQ ID NO: 3507439 - RNA, 13 nt, Human
aaaggacugugau

SEQ ID NO: 3507440 - RNA, 19 nt, Human
aaaggagacaaguuccaug

SEQ ID NO: 3507441 - RNA, 19 nt, Human
aaaggagacuguguuuggu

SEQ ID NO: 3507442 - RNA, 16 nt, Human
ccagcuggggcguggg

SEQ ID NO: 3507443 - RNA, 19 nt, Human
ccagcuggggcguggggag

SEQ ID NO: 3507444 - RNA, 16 nt, Human
ccagcugggucaggca

SEQ ID NO: 3507445 - RNA, 18 nt, Human
ccagcugggucaggcagg

SEQ ID NO: 3507446 - RNA, 16 nt, Human
ccagcuggguuggaaa

SEQ ID NO: 3507447 - RNA, 15 nt, Human
ccagcugucaagggc

SEQ ID NO: 3507448 - RNA, 19 nt, Human
ccagcuguccccccacucc

SEQ ID NO: 3507449 - RNA, 15 nt, Human
ccagcugugagccuu

SEQ ID NO: 3507450 - RNA, 16 nt, Human
ccagcugugagccuug

SEQ ID NO: 3507451 - RNA, 18 nt, Human
ccagcugugagccuuggc

SEQ ID NO: 3507452 - RNA, 20 nt, Human
ccagcugugcucuggacagg

SEQ ID NO: 3507453 - RNA, 15 nt, Human
ccagcugugcuuaug

SEQ ID NO: 3507454 - RNA, 22 nt, Human
ccagcuguggguacagagaggu

SEQ ID NO: 3507455 - RNA, 17 nt, Human
ccagcuguucagcuggu

SEQ ID NO: 3507456 - RNA, 19 nt, Human
ccagcuucacuucugacuc

SEQ ID NO: 3507457 - RNA, 19 nt, Human
ccagcuucauguggcuucc

SEQ ID NO: 3507458 - RNA, 13 nt, Human
ccagcuuccagca

SEQ ID NO: 3507459 - RNA, 16 nt, Human
ccagcuuccagcagga

SEQ ID NO: 3507460 - RNA, 13 nt, Human
ccagcuucccgag

SEQ ID NO: 3507461 - RNA, 13 nt, Human
ccagcuuccuuca

SEQ ID NO: 3507462 - RNA, 15 nt, Human
ccagcuucuccaggc

SEQ ID NO: 3507463 - RNA, 16 nt, Human
ccagcuucuccaggcu

SEQ ID NO: 3507464 - RNA, 17 nt, Human
ccagcuucuccaggcuc

SEQ ID NO: 3507465 - RNA, 21 nt, Human
ccagcuucugguacucuccua

SEQ ID NO: 3507466 - RNA, 18 nt, Human
ccagcuugaaaccuucac

SEQ ID NO: 3507467 - RNA, 17 nt, Human
ccagcuugcgaauaaca

SEQ ID NO: 3507468 - RNA, 23 nt, Human
ccagcuugcucuucagugggaga

SEQ ID NO: 3507469 - RNA, 18 nt, Human
ccagcuugggcccagcug

SEQ ID NO: 3507470 - RNA, 19 nt, Human
ccagcuugggcccagcugg

SEQ ID NO: 3507471 - RNA, 21 nt, Human
ccagcuugggcccagcugggc

SEQ ID NO: 3507472 - RNA, 16 nt, Human
ccagcuuguaggagcu

SEQ ID NO: 3507473 - RNA, 15 nt, Human
ccagcuuguuauuua

SEQ ID NO: 3507474 - RNA, 19 nt, Human
ccagcuuguuuacaugcuu

SEQ ID NO: 3507475 - RNA, 21 nt, Human
ccagcuuguuuacaugcuuau

SEQ ID NO: 3507476 - RNA, 18 nt, Human
ccagcuuucuccccgcua

SEQ ID NO: 3507477 - RNA, 20 nt, Human
ccagcuuugcuaccaaagca

SEQ ID NO: 3507478 - RNA, 13 nt, Human
ccagcuuuuccca

SEQ ID NO: 3507479 - RNA, 13 nt, Human
ccaggaaaaagga

SEQ ID NO: 3507480 - RNA, 20 nt, Human
ccaggaaacuccacaucugc

SEQ ID NO: 3507481 - RNA, 22 nt, Human
ccaggaaacuccacaucugccu

SEQ ID NO: 3507482 - RNA, 23 nt, Human
ccaggaaacuccacaucugccuu

SEQ ID NO: 3507483 - RNA, 17 nt, Human
ccaggaaacucuugcua

SEQ ID NO: 3507484 - RNA, 23 nt, Human
ccaggaaaggcuccaggagcagc

SEQ ID NO: 3507485 - RNA, 12 nt, Human
ccaggaagccag

SEQ ID NO: 3507486 - RNA, 15 nt, Human
ccaggaagccgugcc

SEQ ID NO: 3507487 - RNA, 15 nt, Human
ccaggaagucucauc

SEQ ID NO: 3507488 - RNA, 20 nt, Human
ccaggaauauugucauccuu

SEQ ID NO: 3507489 - RNA, 20 nt, Human
ccaggaauggagccugcacg

SEQ ID NO: 3507490 - RNA, 14 nt, Human
ccaggaauuuccca

SEQ ID NO: 3507491 - RNA, 17 nt, Human
ccaggaauuucccagga

SEQ ID NO: 3507492 - RNA, 20 nt, Human
ccaggaauuugggacccugc

SEQ ID NO: 3507493 - RNA, 19 nt, Human
ccaggacaccacacccagc

SEQ ID NO: 3507494 - RNA, 18 nt, Human
ccaggacaccgggcaggg

SEQ ID NO: 3507495 - RNA, 20 nt, Human
ccaggacaggagaugcugug

SEQ ID NO: 3507496 - RNA, 15 nt, Human
ccaggacaggaucca

SEQ ID NO: 3507497 - RNA, 17 nt, Human
ccaggacaggauccagg

SEQ ID NO: 3507498 - RNA, 13 nt, Human
ccaggacaggccc

SEQ ID NO: 3507499 - RNA, 14 nt, Human
ccaggacaggcccg

SEQ ID NO: 3507500 - RNA, 20 nt, Human
ccaggacaggcugcggcccc

SEQ ID NO: 3507501 - RNA, 16 nt, Human
ccaggaccacaggcuc

SEQ ID NO: 3507502 - RNA, 18 nt, Human
ccaggaccacaggcucag

SEQ ID NO: 3507503 - RNA, 14 nt, Human
ccaggaccagcuca

SEQ ID NO: 3507504 - RNA, 16 nt, Human
ccaggaccagcugggg

SEQ ID NO: 3507505 - RNA, 14 nt, Human
ccaggacccugaag

SEQ ID NO: 3507506 - RNA, 16 nt, Human
ccaggacccugaaggg

SEQ ID NO: 3507507 - RNA, 18 nt, Human
ccaggacccugaaggggc

SEQ ID NO: 3507508 - RNA, 16 nt, Human
ccaggacccugccagg

SEQ ID NO: 3507509 - RNA, 17 nt, Human
ccaggacccugccaggc

SEQ ID NO: 3507510 - RNA, 18 nt, Human
ccaggacccugccaggca

SEQ ID NO: 3507511 - RNA, 19 nt, Human
ccaggacccuggacccagc

SEQ ID NO: 3507512 - RNA, 16 nt, Human
ccaggacgccacucau

SEQ ID NO: 3507513 - RNA, 22 nt, Human
ccaggacgccacucauuucauc

SEQ ID NO: 3507514 - RNA, 23 nt, Human
ccaggacgccacucauuucaucu

SEQ ID NO: 3507515 - RNA, 20 nt, Human
ccaggacgcuucugaaugcu

SEQ ID NO: 3507516 - RNA, 21 nt, Human
ccaggacggggccggccaggu

SEQ ID NO: 3507517 - RNA, 18 nt, Human
ccaggacuauagcccagg

SEQ ID NO: 3507518 - RNA, 20 nt, Human
ccaggacuauauuugggccu

SEQ ID NO: 3507519 - RNA, 21 nt, Human
ccaggacuauauuugggccug

SEQ ID NO: 3507520 - RNA, 16 nt, Human
ccaggacucccuccuc

SEQ ID NO: 3507521 - RNA, 18 nt, Human
ccaggacucccuccucac

SEQ ID NO: 3507522 - RNA, 22 nt, Human
ccaggacucugaccccagcauu

SEQ ID NO: 3507523 - RNA, 17 nt, Human
ccaggacucugcagccu

SEQ ID NO: 3507524 - RNA, 20 nt, Human
ccaggacucugcagccucag

SEQ ID NO: 3507525 - RNA, 22 nt, Human
ccaggacucugcagccucagag

SEQ ID NO: 3507526 - RNA, 13 nt, Human
ccaggacugagcc

SEQ ID NO: 3507527 - RNA, 16 nt, Human
ccaggacuguuucaaa

SEQ ID NO: 3507528 - RNA, 21 nt, Human
ccaggagaaccacuacaugca

SEQ ID NO: 3507529 - RNA, 23 nt, Human
ccaggagaaccacuacaugcagc

SEQ ID NO: 3507530 - RNA, 20 nt, Human
ccaggagaagaaagagguga

SEQ ID NO: 3507531 - RNA, 13 nt, Human
ccaggagaagcuc

SEQ ID NO: 3507532 - RNA, 18 nt, Human
ccaggagaagcucagcug

SEQ ID NO: 3507533 - RNA, 23 nt, Human
ccaggagaauaaaagaaauuccu

SEQ ID NO: 3507534 - RNA, 12 nt, Human
ccaggagagaga

SEQ ID NO: 3507535 - RNA, 17 nt, Human
ccaggagagagaaagcc

SEQ ID NO: 3507536 - RNA, 21 nt, Human
ccaggagagagaaagccaggc

SEQ ID NO: 3507537 - RNA, 20 nt, Human
ccaggagagccagcccuccc

SEQ ID NO: 3507538 - RNA, 21 nt, Human
ccaggagagcuuagggucuca

SEQ ID NO: 3507539 - RNA, 16 nt, Human
ccaggagcacggcucu

SEQ ID NO: 3507540 - RNA, 12 nt, Human
ccaggagcagcc

SEQ ID NO: 3507541 - RNA, 16 nt, Human
ccaggagcagccacau

SEQ ID NO: 3507542 - RNA, 11 nt, Human
ccaggagccca

SEQ ID NO: 3507543 - RNA, 13 nt, Human
ccaggagcccauu

SEQ ID NO: 3507544 - RNA, 16 nt, Human
ccaggagccccgaggc

SEQ ID NO: 3507545 - RNA, 16 nt, Human
ccaggagccugcccag

SEQ ID NO: 3507546 - RNA, 18 nt, Human
ccaggagcuccagugucc

SEQ ID NO: 3507547 - RNA, 17 nt, Human
cagacccccaccccuuc

SEQ ID NO: 3507548 - RNA, 23 nt, Human
cagacccccaccccuuccccacu

SEQ ID NO: 3507549 - RNA, 13 nt, Human
cagacccccacuc

SEQ ID NO: 3507550 - RNA, 16 nt, Human
cagacccccacucuca

SEQ ID NO: 3507551 - RNA, 20 nt, Human
cagacccccucuagaaauuu

SEQ ID NO: 3507552 - RNA, 17 nt, Human
cagaccccucuggccag

SEQ ID NO: 3507553 - RNA, 21 nt, Human
cagaccccucuggccaggaug

SEQ ID NO: 3507554 - RNA, 13 nt, Human
cagaccccuggcu

SEQ ID NO: 3507555 - RNA, 14 nt, Human
cagaccccuggcuu

SEQ ID NO: 3507556 - RNA, 13 nt, Human
cagaccccuuggc

SEQ ID NO: 3507557 - RNA, 14 nt, Human
cagacccggcugcg

SEQ ID NO: 3507558 - RNA, 16 nt, Human
cagacccugcccugug

SEQ ID NO: 3507559 - RNA, 17 nt, Human
cagacccugcccugugg

SEQ ID NO: 3507560 - RNA, 13 nt, Human
cagacccuggagg

SEQ ID NO: 3507561 - RNA, 18 nt, Human
cagaccuaaugcuccuug

SEQ ID NO: 3507562 - RNA, 14 nt, Human
cagaccuccccagc

SEQ ID NO: 3507563 - RNA, 18 nt, Human
cagaccuccccagccccu

SEQ ID NO: 3507564 - RNA, 12 nt, Human
cagaccugagcu

SEQ ID NO: 3507565 - RNA, 22 nt, Human
cagaccugagcuccccaccacc

SEQ ID NO: 3507566 - RNA, 22 nt, Human
cagaccugauccuggaggccca

SEQ ID NO: 3507567 - RNA, 23 nt, Human
cagaccugauccuggaggcccag

SEQ ID NO: 3507568 - RNA, 13 nt, Human
cagaccugccucu

SEQ ID NO: 3507569 - RNA, 16 nt, Human
cagaccugccucuucc

SEQ ID NO: 3507570 - RNA, 17 nt, Human
cagaccuggagccccug

SEQ ID NO: 3507571 - RNA, 22 nt, Human
cagaccuggagccccugggugg

SEQ ID NO: 3507572 - RNA, 12 nt, Human
cagaccuguccu

SEQ ID NO: 3507573 - RNA, 13 nt, Human
cagaccuuuuauc

SEQ ID NO: 3507574 - RNA, 15 nt, Human
cagaccuuuuuuagg

SEQ ID NO: 3507575 - RNA, 17 nt, Human
cagacgcacgugggucu

SEQ ID NO: 3507576 - RNA, 14 nt, Human
cagacgccuggcug

SEQ ID NO: 3507577 - RNA, 16 nt, Human
cagacgccuggcugcu

SEQ ID NO: 3507578 - RNA, 17 nt, Human
cagacgccuggcugcug

SEQ ID NO: 3507579 - RNA, 21 nt, Human
cagacgcucauucagcaucug

SEQ ID NO: 3507580 - RNA, 19 nt, Human
cagacggaaggguaaacaa

SEQ ID NO: 3507581 - RNA, 20 nt, Human
cagacggaaggguaaacaau

SEQ ID NO: 3507582 - RNA, 17 nt, Human
cagacguaggggagggg

SEQ ID NO: 3507583 - RNA, 21 nt, Human
cagacuaagccagcaccggac

SEQ ID NO: 3507584 - RNA, 23 nt, Human
cagacuaagccagcaccggacca

SEQ ID NO: 3507585 - RNA, 14 nt, Human
cagacuacacagga

SEQ ID NO: 3507586 - RNA, 21 nt, Human
cagacuacagcuggggugcag

SEQ ID NO: 3507587 - RNA, 20 nt, Human
cccaggccaucuuccaggug

SEQ ID NO: 3507588 - RNA, 17 nt, Human
cccaggccccaugaccu

SEQ ID NO: 3507589 - RNA, 21 nt, Human
cccaggccccaugaccuccag

SEQ ID NO: 3507590 - RNA, 22 nt, Human
cccaggccccgaggacccagac

SEQ ID NO: 3507591 - RNA, 23 nt, Human
cccaggccccgaggacccagacc

SEQ ID NO: 3507592 - RNA, 12 nt, Human
cccaggccccug

SEQ ID NO: 3507593 - RNA, 21 nt, Human
cccaggccccugccacccugg

SEQ ID NO: 3507594 - RNA, 16 nt, Human
cccaggccccuggagg

SEQ ID NO: 3507595 - RNA, 13 nt, Human
cccaggccgcagc

SEQ ID NO: 3507596 - RNA, 21 nt, Human
cccaggccggccagccucacc

SEQ ID NO: 3507597 - RNA, 14 nt, Human
cagauccagggaca

SEQ ID NO: 3507598 - RNA, 20 nt, Human
cagaucccacuuuugccaga

SEQ ID NO: 3507599 - RNA, 22 nt, Human
cagaucccagcuucggcauuug

SEQ ID NO: 3507600 - RNA, 18 nt, Human
cagaucccaggccccugg

SEQ ID NO: 3507601 - RNA, 21 nt, Human
cagaucccaggccccuggagg

SEQ ID NO: 3507602 - RNA, 15 nt, Human
cagauccccaagccu

SEQ ID NO: 3507603 - RNA, 19 nt, Human
cagauccccaagccuggca

SEQ ID NO: 3507604 - RNA, 16 nt, Human
cagauccucacaacca

SEQ ID NO: 3507605 - RNA, 14 nt, Human
cagauccucuuggu

SEQ ID NO: 3507606 - RNA, 23 nt, Human
cagauccuggguacugaaagccu

SEQ ID NO: 3507607 - RNA, 23 nt, Human
cagaucucccacaugccaggggc

SEQ ID NO: 3507608 - RNA, 14 nt, Human
cagaucuccuggca

SEQ ID NO: 3507609 - RNA, 22 nt, Human
cagaucugacaugauuccuucc

SEQ ID NO: 3507610 - RNA, 23 nt, Human
cagaucugacaugauuccuuccu

SEQ ID NO: 3507611 - RNA, 24 nt, Human
cagaucugacaugauuccuuccug

SEQ ID NO: 3507612 - RNA, 23 nt, Human
cagaucugauuuguaacccacug

SEQ ID NO: 3507613 - RNA, 17 nt, Human
cagaucugccuaaggac

SEQ ID NO: 3507614 - RNA, 20 nt, Human
cagaucugccuaaggacuuc

SEQ ID NO: 3507615 - RNA, 19 nt, Human
cagaucuggaaccucagcc

SEQ ID NO: 3507616 - RNA, 16 nt, Human
cagaucuggaauguga

SEQ ID NO: 3507617 - RNA, 23 nt, Human
cagaucuggggcagcacccuaua

SEQ ID NO: 3507618 - RNA, 18 nt, Human
cagaucugucugauagga

SEQ ID NO: 3507619 - RNA, 12 nt, Human
cagaucugugcc

SEQ ID NO: 3507620 - RNA, 15 nt, Human
cagaucugugcccca

SEQ ID NO: 3507621 - RNA, 23 nt, Human
cagaucuguuuugugguuuggaa

SEQ ID NO: 3507622 - RNA, 14 nt, Human
cagaucuuggacuc

SEQ ID NO: 3507623 - RNA, 15 nt, Human
cagaucuuggacuca

SEQ ID NO: 3507624 - RNA, 18 nt, Human
cagaucuuucuccuugaa

SEQ ID NO: 3507625 - RNA, 14 nt, Human
cagaugaaaauuug

SEQ ID NO: 3507626 - RNA, 20 nt, Human
cagaugaacucuuagaaaug

SEQ ID NO: 3507627 - RNA, 22 nt, Human
cagaugaacucuuucuggccug

SEQ ID NO: 3507628 - RNA, 23 nt, Human
cagaugaacucuuucuggccugc

SEQ ID NO: 3507629 - RNA, 14 nt, Human
cagaugaauaaacu

SEQ ID NO: 3507630 - RNA, 14 nt, Human
cagaugaccccucc

SEQ ID NO: 3507631 - RNA, 21 nt, Human
cagaugagaacaaagcuguua

SEQ ID NO: 3507632 - RNA, 16 nt, Human
cagaugagcagaagcu

SEQ ID NO: 3507633 - RNA, 16 nt, Human
cagaugaggcuuucca

SEQ ID NO: 3507634 - RNA, 18 nt, Human
cagaugaucaacucuucg

SEQ ID NO: 3507635 - RNA, 14 nt, Human
cagaugauccauga

SEQ ID NO: 3507636 - RNA, 19 nt, Human
cagaugaugagaauuucua

SEQ ID NO: 3507637 - RNA, 17 nt, Human
cagaugcaaagaggcaa

SEQ ID NO: 3507638 - RNA, 13 nt, Human
cagaugcaccagc

SEQ ID NO: 3507639 - RNA, 13 nt, Human
cagaugcagcucu

SEQ ID NO: 3507640 - RNA, 13 nt, Human
cagaugcagggca

SEQ ID NO: 3507641 - RNA, 18 nt, Human
cagaugccacuucuaaga

SEQ ID NO: 3507642 - RNA, 18 nt, Human
cagaugccagagcaaagg

SEQ ID NO: 3507643 - RNA, 15 nt, Human
cagaugccccagagc

SEQ ID NO: 3507644 - RNA, 12 nt, Human
cagaugcccgag

SEQ ID NO: 3507645 - RNA, 12 nt, Human
cagaugccuggg

SEQ ID NO: 3507646 - RNA, 13 nt, Human
cagaugcguccca

SEQ ID NO: 3507647 - RNA, 22 nt, Human
cagaugcgucccaagauguuga

SEQ ID NO: 3507648 - RNA, 11 nt, Human
cagaugcucaa

SEQ ID NO: 3507649 - RNA, 15 nt, Human
cagaugcuccaagau

SEQ ID NO: 3507650 - RNA, 19 nt, Human
cagaugcuccaagauucua

SEQ ID NO: 3507651 - RNA, 20 nt, Human
cagaugcuccaagauucuag

SEQ ID NO: 3507652 - RNA, 22 nt, Human
cagaugcuccaagauucuagau

SEQ ID NO: 3507653 - RNA, 23 nt, Human
cagaugcuccaagauucuagaug

SEQ ID NO: 3507654 - RNA, 12 nt, Human
cagaugcucuga

SEQ ID NO: 3507655 - RNA, 13 nt, Human
cagaugcugaugu

SEQ ID NO: 3507656 - RNA, 14 nt, Human
cagaugcugauguu

SEQ ID NO: 3507657 - RNA, 16 nt, Human
cagaugcugauguuca

SEQ ID NO: 3507658 - RNA, 18 nt, Human
cagaugcuggucaugugu

SEQ ID NO: 3507659 - RNA, 12 nt, Human
cagaugcuucug

SEQ ID NO: 3507660 - RNA, 13 nt, Human
cagaugcuucugg

SEQ ID NO: 3507661 - RNA, 17 nt, Human
cagaugcuucugggaga

SEQ ID NO: 3507662 - RNA, 14 nt, Human
cagaugcuuuccug

SEQ ID NO: 3507663 - RNA, 21 nt, Human
cagaugcuuuccugcacauua

SEQ ID NO: 3507664 - RNA, 21 nt, Human
cagauggaaaauucauuuuuu

SEQ ID NO: 3507665 - RNA, 20 nt, Human
cagauggaaccgcaggaagc

SEQ ID NO: 3507666 - RNA, 21 nt, Human
cagauggaaccgcaggaagcu

SEQ ID NO: 3507667 - RNA, 18 nt, Human
cagauggacuccagccug

SEQ ID NO: 3507668 - RNA, 22 nt, Human
cagauggauuugccugugccac

SEQ ID NO: 3507669 - RNA, 16 nt, Human
cagauggcauguguuu

SEQ ID NO: 3507670 - RNA, 22 nt, Human
cagauggcauguguuuacuuua

SEQ ID NO: 3507671 - RNA, 20 nt, Human
cagaugggaggaaagagagc

SEQ ID NO: 3507672 - RNA, 15 nt, Human
cagauggggccucug

SEQ ID NO: 3507673 - RNA, 22 nt, Human
cagaugguuuuauaaucugauu

SEQ ID NO: 3507674 - RNA, 12 nt, Human
cagauguaaugu

SEQ ID NO: 3507675 - RNA, 13 nt, Human
cagauguaauguu

SEQ ID NO: 3507676 - RNA, 22 nt, Human
cagaugucuucugccuguuaua

SEQ ID NO: 3507677 - RNA, 16 nt, Human
cagaugugacuguaua

SEQ ID NO: 3507678 - RNA, 20 nt, Human
cagaugugcuauaaucuguu

SEQ ID NO: 3507679 - RNA, 12 nt, Human
cagauguggcua

SEQ ID NO: 3507680 - RNA, 20 nt, Human
cagauguggcuacugacaua

SEQ ID NO: 3507681 - RNA, 20 nt, Human
cagaugugguaacuguuaaa

SEQ ID NO: 3507682 - RNA, 14 nt, Human
cagauguuuaaaac

SEQ ID NO: 3507683 - RNA, 15 nt, Human
cagauguuuccagac

SEQ ID NO: 3507684 - RNA, 23 nt, Human
cagauguuuccagacuuccuuga

SEQ ID NO: 3507685 - RNA, 14 nt, Human
cagauuaaacuuca

SEQ ID NO: 3507686 - RNA, 21 nt, Human
cagauuacugcuuuaaucaga

SEQ ID NO: 3507687 - RNA, 22 nt, Human
cagauuaucuauuugugugugu

SEQ ID NO: 3507688 - RNA, 19 nt, Human
cagauuaugagacacagga

SEQ ID NO: 3507689 - RNA, 21 nt, Human
cagauuaugagacacaggaug

SEQ ID NO: 3507690 - RNA, 12 nt, Human
cagauuauucac

SEQ ID NO: 3507691 - RNA, 23 nt, Human
cagauuauucacugauuugacau

SEQ ID NO: 3507692 - RNA, 18 nt, Human
cagauuauuuuggaaagu

SEQ ID NO: 3507693 - RNA, 14 nt, Human
cagauucaggcauu

SEQ ID NO: 3507694 - RNA, 15 nt, Human
cagauucaggcauuu

SEQ ID NO: 3507695 - RNA, 17 nt, Human
cagauucagucuugccu

SEQ ID NO: 3507696 - RNA, 21 nt, Human
cagauuccaggcgaugugcaa

SEQ ID NO: 3507697 - RNA, 21 nt, Human
cagauucccagagcaaaauaa

SEQ ID NO: 3507698 - RNA, 16 nt, Human
cagauuccccuguguc

SEQ ID NO: 3507699 - RNA, 20 nt, Human
cagauucuaggaccuguguc

SEQ ID NO: 3507700 - RNA, 22 nt, Human
cagauucuuuccugaggcuggg

SEQ ID NO: 3507701 - RNA, 18 nt, Human
cagauucuuuuaugugau

SEQ ID NO: 3507702 - RNA, 20 nt, Human
cagauugcaacaggcugggc

SEQ ID NO: 3507703 - RNA, 21 nt, Human
cagauugcaacaggcugggcu

SEQ ID NO: 3507704 - RNA, 18 nt, Human
cagauugcaugugacucu

SEQ ID NO: 3507705 - RNA, 21 nt, Human
cagauugcaugugacucugaa

SEQ ID NO: 3507706 - RNA, 16 nt, Human
cagauugccuguuucu

SEQ ID NO: 3507707 - RNA, 19 nt, Human
cagauugcugaauggaguu

SEQ ID NO: 3507708 - RNA, 15 nt, Human
cagauuggaaggaga

SEQ ID NO: 3507709 - RNA, 22 nt, Human
cagauuggaaggagacacagau

SEQ ID NO: 3507710 - RNA, 23 nt, Human
cagauuggaaggagacacagaug

SEQ ID NO: 3507711 - RNA, 21 nt, Human
cagauuggcucacacugagaa

SEQ ID NO: 3507712 - RNA, 21 nt, Human
cagauuguaucaugugcuaga

SEQ ID NO: 3507713 - RNA, 15 nt, Human
cagauugucuuaauu

SEQ ID NO: 3507714 - RNA, 15 nt, Human
cagauuucacucucc

SEQ ID NO: 3507715 - RNA, 20 nt, Human
cagauuucacucuccuuggu

SEQ ID NO: 3507716 - RNA, 21 nt, Human
cagauuucagucuuuuccugu

SEQ ID NO: 3507717 - RNA, 16 nt, Human
cagauuucauaccuca

SEQ ID NO: 3507718 - RNA, 14 nt, Human
cagauuuccagccu

SEQ ID NO: 3507719 - RNA, 24 nt, Human
cagauuuccagucuccaccaggaa

SEQ ID NO: 3507720 - RNA, 21 nt, Human
cagauuugaagacaaaaauac

SEQ ID NO: 3507721 - RNA, 23 nt, Human
cagauuugaagacaaaaauacuc

SEQ ID NO: 3507722 - RNA, 13 nt, Human
cagauuugagcuc

SEQ ID NO: 3507723 - RNA, 14 nt, Human
cagauuugagcuca

SEQ ID NO: 3507724 - RNA, 20 nt, Human
cagauuugcuaauuuauccu

SEQ ID NO: 3507725 - RNA, 19 nt, Human
cagauuuggaaagacugga

SEQ ID NO: 3507726 - RNA, 14 nt, Human
cagauuugggcugg

SEQ ID NO: 3507727 - RNA, 18 nt, Human
cagauuugggcuggaaca

SEQ ID NO: 3507728 - RNA, 24 nt, Human
cagauuugucuuuuuguuguaaaa

SEQ ID NO: 3507729 - RNA, 24 nt, Human
cagauuugugaacucagccaagca

SEQ ID NO: 3507730 - RNA, 23 nt, Human
ccaucuuuuuaaccucuguucag

SEQ ID NO: 3507731 - RNA, 21 nt, Human
ccaugaaaacguuuuauugug

SEQ ID NO: 3507732 - RNA, 22 nt, Human
ccaugaacagaaaacauucuga

SEQ ID NO: 3507733 - RNA, 12 nt, Human
ccaugaagacag

SEQ ID NO: 3507734 - RNA, 14 nt, Human
ccaugaagacagga

SEQ ID NO: 3507735 - RNA, 15 nt, Human
ccaugaagccacagc

SEQ ID NO: 3507736 - RNA, 16 nt, Human
ccaugaagccacagcc

SEQ ID NO: 3507737 - RNA, 19 nt, Human
ccaugaaucgcuucucuuu

SEQ ID NO: 3507738 - RNA, 18 nt, Human
ccaugaauguaucaggaa

SEQ ID NO: 3507739 - RNA, 22 nt, Human
ccaugacaacuucuaauugcca

SEQ ID NO: 3507740 - RNA, 21 nt, Human
ccaugacaggccugaagauau

SEQ ID NO: 3507741 - RNA, 17 nt, Human
ccaugacccaccccugu

SEQ ID NO: 3507742 - RNA, 18 nt, Human
ccaugacccaccccugug

SEQ ID NO: 3507743 - RNA, 18 nt, Human
ccaugacccugccucucc

SEQ ID NO: 3507744 - RNA, 21 nt, Human
ccaugacccugccucucccag

SEQ ID NO: 3507745 - RNA, 20 nt, Human
ccaugaccuccagcuuuccu

SEQ ID NO: 3507746 - RNA, 13 nt, Human
ccaugacugcuug

SEQ ID NO: 3507747 - RNA, 19 nt, Human
ccaugacugcuugcccuaa

SEQ ID NO: 3507748 - RNA, 22 nt, Human
ccaugacugcuugcccuaagca

SEQ ID NO: 3507749 - RNA, 18 nt, Human
ccaugacuugagaaacaa

SEQ ID NO: 3507750 - RNA, 13 nt, Human
cccaggccuccag

SEQ ID NO: 3507751 - RNA, 20 nt, Human
cccaggccuccagcucagca

SEQ ID NO: 3507752 - RNA, 18 nt, Human
cccaggccuccuacagcu

SEQ ID NO: 3507753 - RNA, 18 nt, Human
cccaggcgccccuucccc

SEQ ID NO: 3507754 - RNA, 13 nt, Human
cccaggcgggagc

SEQ ID NO: 3507755 - RNA, 23 nt, Human
cccaggcuccgcccuuagucccc

SEQ ID NO: 3507756 - RNA, 17 nt, Human
cccaggcucguggacug

SEQ ID NO: 3507757 - RNA, 22 nt, Human
cccaggcucguggacugagugg

SEQ ID NO: 3507758 - RNA, 11 nt, Human
cccaggcugga

SEQ ID NO: 3507759 - RNA, 20 nt, Human
cccaggcuggccagccccac

SEQ ID NO: 3507760 - RNA, 23 nt, Human
cccaggcuggccagccccacagc

SEQ ID NO: 3507761 - RNA, 18 nt, Human
cccaggcuggcgugcagu

SEQ ID NO: 3507762 - RNA, 20 nt, Human
cccaggcuggcgugcagugg

SEQ ID NO: 3507763 - RNA, 12 nt, Human
cccaggcuggga

SEQ ID NO: 3507764 - RNA, 14 nt, Human
cccaggcugggaac

SEQ ID NO: 3507765 - RNA, 13 nt, Human
cccaggcugggca

SEQ ID NO: 3507766 - RNA, 22 nt, Human
cccaggcugugcagcgcagcug

SEQ ID NO: 3507767 - RNA, 23 nt, Human
cccaggcugugcagcgcagcugg

SEQ ID NO: 3507768 - RNA, 20 nt, Human
cccaggcuuagucacugaga

SEQ ID NO: 3507769 - RNA, 17 nt, Human
cccagggaagcagcagc

SEQ ID NO: 3507770 - RNA, 20 nt, Human
cccagggacaccagccaggc

SEQ ID NO: 3507771 - RNA, 18 nt, Human
cccagggagaggccauga

SEQ ID NO: 3507772 - RNA, 15 nt, Human
cccagggagcggaaa

SEQ ID NO: 3507773 - RNA, 22 nt, Human
cccagggagcggaaagcagcuc

SEQ ID NO: 3507774 - RNA, 18 nt, Human
cccagggaggccgaagcu

SEQ ID NO: 3507775 - RNA, 13 nt, Human
cccagggcacagg

SEQ ID NO: 3507776 - RNA, 18 nt, Human
cccagggcagccagggag

SEQ ID NO: 3507777 - RNA, 19 nt, Human
cccagggcaucuugcuggc

SEQ ID NO: 3507778 - RNA, 13 nt, Human
cccagggcccaga

SEQ ID NO: 3507779 - RNA, 17 nt, Human
cccagggcccagagccc

SEQ ID NO: 3507780 - RNA, 20 nt, Human
cccagggcccagagcccagc

SEQ ID NO: 3507781 - RNA, 19 nt, Human
cccagggccugagccuggc

SEQ ID NO: 3507782 - RNA, 21 nt, Human
cccagggcuacccucccccag

SEQ ID NO: 3507783 - RNA, 15 nt, Human
cccagggcucagccu

SEQ ID NO: 3507784 - RNA, 16 nt, Human
cccagggcucagccug

SEQ ID NO: 3507785 - RNA, 20 nt, Human
cccagggcucagccuggugg

SEQ ID NO: 3507786 - RNA, 15 nt, Human
cccagggcuccugca

SEQ ID NO: 3507787 - RNA, 16 nt, Human
cccagggcucugcccc

SEQ ID NO: 3507788 - RNA, 14 nt, Human
cccagggcugggag

SEQ ID NO: 3507789 - RNA, 13 nt, Human
cccaggggagagg

SEQ ID NO: 3507790 - RNA, 21 nt, Human
cccaggggagagggucuggag

SEQ ID NO: 3507791 - RNA, 23 nt, Human
cccaggggagagggucuggagaa

SEQ ID NO: 3507792 - RNA, 16 nt, Human
cccaggggcagcccca

SEQ ID NO: 3507793 - RNA, 23 nt, Human
cccaggggcauguauuggccugg

SEQ ID NO: 3507794 - RNA, 14 nt, Human
cccaggggcucccu

SEQ ID NO: 3507795 - RNA, 16 nt, Human
cccaggggcucccucc

SEQ ID NO: 3507796 - RNA, 21 nt, Human
cccaggggcuggcuucaggag

SEQ ID NO: 3507797 - RNA, 22 nt, Human
cccagggggucucacccaugca

SEQ ID NO: 3507798 - RNA, 15 nt, Human
cccaggggucccagc

SEQ ID NO: 3507799 - RNA, 16 nt, Human
cccaggggucccagcc

SEQ ID NO: 3507800 - RNA, 21 nt, Human
cccaggggugcccccuccucu

SEQ ID NO: 3507801 - RNA, 13 nt, Human
cccaggguagccc

SEQ ID NO: 3507802 - RNA, 16 nt, Human
cccaggguagcccgcc

SEQ ID NO: 3507803 - RNA, 21 nt, Human
cccaggguagcccgccugcca

SEQ ID NO: 3507804 - RNA, 22 nt, Human
cccaggguagcccgccugccag

SEQ ID NO: 3507805 - RNA, 23 nt, Human
cccaggguagcccgccugccagu

SEQ ID NO: 3507806 - RNA, 16 nt, Human
cccaggguccugggag

SEQ ID NO: 3507807 - RNA, 17 nt, Human
cccaggguccugggagg

SEQ ID NO: 3507808 - RNA, 18 nt, Human
cccagggucuucccuacc

SEQ ID NO: 3507809 - RNA, 19 nt, Human
cccagggugagguggcaug

SEQ ID NO: 3507810 - RNA, 13 nt, Human
cccaggguggcca

SEQ ID NO: 3507811 - RNA, 14 nt, Human
cccaggguggccac

SEQ ID NO: 3507812 - RNA, 14 nt, Human
cccaggguucccgc

SEQ ID NO: 3507813 - RNA, 19 nt, Human
cccagguaagcaggaggag

SEQ ID NO: 3507814 - RNA, 15 nt, Human
cccagguaccagcug

SEQ ID NO: 3507815 - RNA, 17 nt, Human
cccagguccagcucugg

SEQ ID NO: 3507816 - RNA, 20 nt, Human
cccagguccucugauaccca

SEQ ID NO: 3507817 - RNA, 16 nt, Human
cccaggugauauuuuu

SEQ ID NO: 3507818 - RNA, 20 nt, Human
cccaggugcagccagaggca

SEQ ID NO: 3507819 - RNA, 22 nt, Human
cccaggugcuaggaacacuccu

SEQ ID NO: 3507820 - RNA, 21 nt, Human
cccagguggaaggcagacagc

SEQ ID NO: 3507821 - RNA, 22 nt, Human
cccagguggcugacccaguccc

SEQ ID NO: 3507822 - RNA, 14 nt, Human
cccagguggcugug

SEQ ID NO: 3507823 - RNA, 21 nt, Human
cccagguguuaacauuccaag

SEQ ID NO: 3507824 - RNA, 18 nt, Human
cccagguuggagugcagu

SEQ ID NO: 3507825 - RNA, 14 nt, Human
cccagguuggcucu

SEQ ID NO: 3507826 - RNA, 18 nt, Human
cccagguuggcucugcca

SEQ ID NO: 3507827 - RNA, 13 nt, Human
cccagguuucuau

SEQ ID NO: 3507828 - RNA, 13 nt, Human
cccagguuucugg

SEQ ID NO: 3507829 - RNA, 13 nt, Human
cccaguaaaauug

SEQ ID NO: 3507830 - RNA, 17 nt, Human
cccaguaaaauugccau

SEQ ID NO: 3507831 - RNA, 15 nt, Human
cccaguaacucaucu

SEQ ID NO: 3507832 - RNA, 18 nt, Human
cccaguacaccccaccuc

SEQ ID NO: 3507833 - RNA, 14 nt, Human
cccaguaccuccug

SEQ ID NO: 3507834 - RNA, 21 nt, Human
cccaguaucucuucagucucu

SEQ ID NO: 3507835 - RNA, 17 nt, Human
cccagucagccucucuc

SEQ ID NO: 3507836 - RNA, 19 nt, Human
cccagucagccucucuccc

SEQ ID NO: 3507837 - RNA, 20 nt, Human
cccagucagccucucuccca

SEQ ID NO: 3507838 - RNA, 21 nt, Human
cccagucagccucucucccag

SEQ ID NO: 3507839 - RNA, 17 nt, Human
cccagucccagcagcca

SEQ ID NO: 3507840 - RNA, 19 nt, Human
cccagucccagcagccagc

SEQ ID NO: 3507841 - RNA, 23 nt, Human
cccaguccccaccccugccccca

SEQ ID NO: 3507842 - RNA, 12 nt, Human
cccagucccugg

SEQ ID NO: 3507843 - RNA, 16 nt, Human
cccagucccuggggga

SEQ ID NO: 3507844 - RNA, 15 nt, Human
cccaguccucuccca

SEQ ID NO: 3507845 - RNA, 13 nt, Human
cccaguccuggcc

SEQ ID NO: 3507846 - RNA, 14 nt, Human
cccaguccuggccu

SEQ ID NO: 3507847 - RNA, 20 nt, Human
cccaguccuggccuggcuuc

SEQ ID NO: 3507848 - RNA, 22 nt, Human
cccaguccuggccuggcuucuc

SEQ ID NO: 3507849 - RNA, 17 nt, Human
cccaguccuuccaccuc

SEQ ID NO: 3507850 - RNA, 13 nt, Human
cccagucgcccuu

SEQ ID NO: 3507851 - RNA, 15 nt, Human
cccagucuacccaga

SEQ ID NO: 3507852 - RNA, 16 nt, Human
cccagucucugcucca

SEQ ID NO: 3507853 - RNA, 10 nt, Human
cccagucugg

SEQ ID NO: 3507854 - RNA, 18 nt, Human
cccagucuggaaugcagu

SEQ ID NO: 3507855 - RNA, 15 nt, Human
cccagugaaaacuag

SEQ ID NO: 3507856 - RNA, 19 nt, Human
cccagugacacuucagaga

SEQ ID NO: 3507857 - RNA, 15 nt, Human
cccagugcagaaugu

SEQ ID NO: 3507858 - RNA, 12 nt, Human
cccagugcaugg

SEQ ID NO: 3507859 - RNA, 19 nt, Human
cccagugcaugguggccag

SEQ ID NO: 3507860 - RNA, 19 nt, Human
cccagugcccccacugacc

SEQ ID NO: 3507861 - RNA, 16 nt, Human
cccagugcccuggggc

SEQ ID NO: 3507862 - RNA, 17 nt, Human
cccagugcccuggggcu

SEQ ID NO: 3507863 - RNA, 17 nt, Human
cccagugccgagaagga

SEQ ID NO: 3507864 - RNA, 16 nt, Human
cccaguggcagggcac

SEQ ID NO: 3507865 - RNA, 22 nt, Human
cccaguggcagggcacagggcc

SEQ ID NO: 3507866 - RNA, 21 nt, Human
cccaguggccucaacccuccc

SEQ ID NO: 3507867 - RNA, 16 nt, Human
cccaguggcugcugcc

SEQ ID NO: 3507868 - RNA, 17 nt, Human
cccaguggcugcugccc

SEQ ID NO: 3507869 - RNA, 15 nt, Human
cccagugggaggcgc

SEQ ID NO: 3507870 - RNA, 20 nt, Human
cccagugggaggcgcgagcc

SEQ ID NO: 3507871 - RNA, 20 nt, Human
cccagugggaggggcaggcu

SEQ ID NO: 3507872 - RNA, 20 nt, Human
cccagugguuccuaauccuc

SEQ ID NO: 3507873 - RNA, 16 nt, Human
cccaguguuguuugua

SEQ ID NO: 3507874 - RNA, 17 nt, Human
cagcagaaggggguggu

SEQ ID NO: 3507875 - RNA, 18 nt, Human
cagcagacagagccagga

SEQ ID NO: 3507876 - RNA, 20 nt, Human
cagcagacagagccaggaga

SEQ ID NO: 3507877 - RNA, 21 nt, Human
cagcagacagagccaggagaa

SEQ ID NO: 3507878 - RNA, 17 nt, Human
cagcagacucagcucug

SEQ ID NO: 3507879 - RNA, 18 nt, Human
cagcagacucagcucuga

SEQ ID NO: 3507880 - RNA, 21 nt, Human
cagcagacucagcucugacau

SEQ ID NO: 3507881 - RNA, 18 nt, Human
cagcagacugaucaggac

SEQ ID NO: 3507882 - RNA, 23 nt, Human
cagcagagagguuugcaguccca

SEQ ID NO: 3507883 - RNA, 21 nt, Human
cagcagaucccagcucacguc

SEQ ID NO: 3507884 - RNA, 17 nt, Human
cagcagaugcuguuuaa

SEQ ID NO: 3507885 - RNA, 15 nt, Human
cagcagauuggaagg

SEQ ID NO: 3507886 - RNA, 15 nt, Human
cagcagcaagaaaaa

SEQ ID NO: 3507887 - RNA, 22 nt, Human
cagcagcaagaaaaaaaaaugc

SEQ ID NO: 3507888 - RNA, 22 nt, Human
cagcagcaccugcccuaccugc

SEQ ID NO: 3507889 - RNA, 13 nt, Human
cagcagcagcagg

SEQ ID NO: 3507890 - RNA, 14 nt, Human
cagcagcagcccug

SEQ ID NO: 3507891 - RNA, 13 nt, Human
cagcagcagguga

SEQ ID NO: 3507892 - RNA, 22 nt, Human
cagcagcaucucuaccuucucc

SEQ ID NO: 3507893 - RNA, 10 nt, Human
cagcagccag

SEQ ID NO: 3507894 - RNA, 12 nt, Human
cagcagccagcc

SEQ ID NO: 3507895 - RNA, 23 nt, Human
cagcagccagccaaacacacaga

SEQ ID NO: 3507896 - RNA, 15 nt, Human
cagcagccagcccug

SEQ ID NO: 3507897 - RNA, 17 nt, Human
cagcagccagcccugcc

SEQ ID NO: 3507898 - RNA, 20 nt, Human
cagcagccagcccugccugg

SEQ ID NO: 3507899 - RNA, 23 nt, Human
cagcagccagcccugccuggagg

SEQ ID NO: 3507900 - RNA, 14 nt, Human
cagcagccagcucu

SEQ ID NO: 3507901 - RNA, 18 nt, Human
cagcagccagcucucagc

SEQ ID NO: 3507902 - RNA, 21 nt, Human
cagcagccaucauaggaaggg

SEQ ID NO: 3507903 - RNA, 18 nt, Human
cagcagcccaagcuuccc

SEQ ID NO: 3507904 - RNA, 14 nt, Human
aaaggugauaucca

SEQ ID NO: 3507905 - RNA, 21 nt, Human
aaaggugccugugaggcaggg

SEQ ID NO: 3507906 - RNA, 18 nt, Human
aaagguggugaggcaaua

SEQ ID NO: 3507907 - RNA, 13 nt, Human
aaagguguauuua

SEQ ID NO: 3507908 - RNA, 12 nt, Human
aaaggugucuuc

SEQ ID NO: 3507909 - RNA, 16 nt, Human
aaaggugucuuccucc

SEQ ID NO: 3507910 - RNA, 18 nt, Human
aaaggugucuuccuccca

SEQ ID NO: 3507911 - RNA, 19 nt, Human
aaaggugugagacugggaa

SEQ ID NO: 3507912 - RNA, 14 nt, Human
aaagguguuguccc

SEQ ID NO: 3507913 - RNA, 14 nt, Human
aaagguucuucauc

SEQ ID NO: 3507914 - RNA, 16 nt, Human
aaagguucuuugugua

SEQ ID NO: 3507915 - RNA, 16 nt, Human
aaagguugaauaauau

SEQ ID NO: 3507916 - RNA, 17 nt, Human
aaagguugaauaauaua

SEQ ID NO: 3507917 - RNA, 19 nt, Human
aaagguuguuuugaaacug

SEQ ID NO: 3507918 - RNA, 13 nt, Human
aaagguuuaaaug

SEQ ID NO: 3507919 - RNA, 14 nt, Human
aaagguuuaaauga

SEQ ID NO: 3507920 - RNA, 21 nt, Human
aaagguuuaaaugaacaagag

SEQ ID NO: 3507921 - RNA, 18 nt, Human
aaagguuuaugaaaaaga

SEQ ID NO: 3507922 - RNA, 19 nt, Human
aaagguuuaugaaaaagaa

SEQ ID NO: 3507923 - RNA, 21 nt, Human
aaagguuuggaaggagcagaa

SEQ ID NO: 3507924 - RNA, 21 nt, Human
aaaguaaaccacaaaaaaaua

SEQ ID NO: 3507925 - RNA, 23 nt, Human
aaaguaaagcuaaaaugauuuua

SEQ ID NO: 3507926 - RNA, 15 nt, Human
aaaguaacucauuug

SEQ ID NO: 3507927 - RNA, 18 nt, Human
aaaguaacucauuuguua

SEQ ID NO: 3507928 - RNA, 19 nt, Human
aaaguaagcccuugaagau

SEQ ID NO: 3507929 - RNA, 14 nt, Human
aaaguaaggugcag

SEQ ID NO: 3507930 - RNA, 22 nt, Human
aaaguaauuuggaaauuagguu

SEQ ID NO: 3507931 - RNA, 19 nt, Human
aaaguacaaccauagagga

SEQ ID NO: 3507932 - RNA, 17 nt, Human
aaaguacacucugcugu

SEQ ID NO: 3507933 - RNA, 13 nt, Human
aaaguacagaauu

SEQ ID NO: 3507934 - RNA, 15 nt, Human
aaaguacagaauuug

SEQ ID NO: 3507935 - RNA, 12 nt, Human
aaaguacauuua

SEQ ID NO: 3507936 - RNA, 11 nt, Human
aaaguacugua

SEQ ID NO: 3507937 - RNA, 19 nt, Human
aaaguacuucuccacccug

SEQ ID NO: 3507938 - RNA, 21 nt, Human
aaaguacuucuccacccugcu

SEQ ID NO: 3507939 - RNA, 23 nt, Human
aaaguacuucuccacccugcucu

SEQ ID NO: 3507940 - RNA, 16 nt, Human
aaaguacuuguaguuc

SEQ ID NO: 3507941 - RNA, 18 nt, Human
aaaguagaacuuuguaua

SEQ ID NO: 3507942 - RNA, 21 nt, Human
aaaguagaacuuuguauaguu

SEQ ID NO: 3507943 - RNA, 22 nt, Human
aaaguagaagucuuagauguau

SEQ ID NO: 3507944 - RNA, 20 nt, Human
aaaguagacaaucauuguuu

SEQ ID NO: 3507945 - RNA, 12 nt, Human
aaaguaguacuu

SEQ ID NO: 3507946 - RNA, 20 nt, Human
aaaguauaauguuuauuaaa

SEQ ID NO: 3507947 - RNA, 22 nt, Human
aaaguauaauguuuauuaaaug

SEQ ID NO: 3507948 - RNA, 22 nt, Human
aaaguauauauauauauuauau

SEQ ID NO: 3507949 - RNA, 14 nt, Human
aaaguauauauuua

SEQ ID NO: 3507950 - RNA, 23 nt, Human
aaaguauauauuuauuuaagcuu

SEQ ID NO: 3507951 - RNA, 14 nt, Human
aaaguaucauggaa

SEQ ID NO: 3507952 - RNA, 21 nt, Human
aaaguauccugcuucugauau

SEQ ID NO: 3507953 - RNA, 15 nt, Human
aaaguaucgggggcu

SEQ ID NO: 3507954 - RNA, 20 nt, Human
aaaguaucgggggcuggggc

SEQ ID NO: 3507955 - RNA, 18 nt, Human
aaaguaugcauuauuaaa

SEQ ID NO: 3507956 - RNA, 19 nt, Human
aaaguaugguauugaaacu

SEQ ID NO: 3507957 - RNA, 20 nt, Human
aaaguauguaaaguauguaa

SEQ ID NO: 3507958 - RNA, 16 nt, Human
aaaguauguauuauuu

SEQ ID NO: 3507959 - RNA, 17 nt, Human
aaaguauguuagugcaa

SEQ ID NO: 3507960 - RNA, 19 nt, Human
aaaguauguucuaaccuuu

SEQ ID NO: 3507961 - RNA, 18 nt, Human
aaaguauuaagcauauau

SEQ ID NO: 3507962 - RNA, 16 nt, Human
aaaguauucuuuuucu

SEQ ID NO: 3507963 - RNA, 19 nt, Human
aaaguauuuaauuagugcu

SEQ ID NO: 3507964 - RNA, 10 nt, Human
aaaguauuuu

SEQ ID NO: 3507965 - RNA, 19 nt, Human
aaaguauuuuauucuuauu

SEQ ID NO: 3507966 - RNA, 14 nt, Human
aaaguauuuugaag

SEQ ID NO: 3507967 - RNA, 21 nt, Human
aaaguauuuugaaguuuacau

SEQ ID NO: 3507968 - RNA, 22 nt, Human
aaaguauuuugaaguuuacauu

SEQ ID NO: 3507969 - RNA, 18 nt, Human
aaagucaaaaggugccug

SEQ ID NO: 3507970 - RNA, 13 nt, Human
aaagucagagaca

SEQ ID NO: 3507971 - RNA, 15 nt, Human
aaagucaugauguuu

SEQ ID NO: 3507972 - RNA, 16 nt, Human
aaagucauuaaagaca

SEQ ID NO: 3507973 - RNA, 14 nt, Human
aaagucauuggcuu

SEQ ID NO: 3507974 - RNA, 18 nt, Human
aaaguccuuuuuuuccau

SEQ ID NO: 3507975 - RNA, 16 nt, Human
aaagucuaaaguuuac

SEQ ID NO: 3507976 - RNA, 22 nt, Human
aaagucuaaaguuuacaguaaa

SEQ ID NO: 3507977 - RNA, 12 nt, Human
aaagucuccagc

SEQ ID NO: 3507978 - RNA, 15 nt, Human
aaagucucuaauucu

SEQ ID NO: 3507979 - RNA, 18 nt, Human
aaagucucuaauucuauu

SEQ ID NO: 3507980 - RNA, 12 nt, Human
aaagucucuauu

SEQ ID NO: 3507981 - RNA, 20 nt, Human
aaagucucuggaauuugaaa

SEQ ID NO: 3507982 - RNA, 22 nt, Human
aaagucucuggaauuugaaaca

SEQ ID NO: 3507983 - RNA, 11 nt, Human
aaagucugcaa

SEQ ID NO: 3507984 - RNA, 13 nt, Human
aaagucuugcugu

SEQ ID NO: 3507985 - RNA, 23 nt, Human
aaagucuugcuguggucucuuug

SEQ ID NO: 3507986 - RNA, 23 nt, Human
aaagucuugugacuagugcugaa

SEQ ID NO: 3507987 - RNA, 14 nt, Human
aaagugaauaaacu

SEQ ID NO: 3507988 - RNA, 15 nt, Human
aaagugaauaaacuu

SEQ ID NO: 3507989 - RNA, 15 nt, Human
aaagugaauuugaau

SEQ ID NO: 3507990 - RNA, 20 nt, Human
aaagugaauuugaaugaaaa

SEQ ID NO: 3507991 - RNA, 22 nt, Human
aaagugaauuugaaugaaaaau

SEQ ID NO: 3507992 - RNA, 19 nt, Human
aaagugagaaaacugugac

SEQ ID NO: 3507993 - RNA, 23 nt, Human
aaagugagacuuugaggguguau

SEQ ID NO: 3507994 - RNA, 14 nt, Human
aaagugagagcacg

SEQ ID NO: 3507995 - RNA, 19 nt, Human
aaagugaggccacugaaga

SEQ ID NO: 3507996 - RNA, 20 nt, Human
aaagugagggccgagugaga

SEQ ID NO: 3507997 - RNA, 21 nt, Human
aaagugaugggcuuucucuuu

SEQ ID NO: 3507998 - RNA, 12 nt, Human
aaagugauuucu

SEQ ID NO: 3507999 - RNA, 13 nt, Human
aaagugcacaccu

SEQ ID NO: 3508000 - RNA, 18 nt, Human
aaagugcauauuuaucca

SEQ ID NO: 3508001 - RNA, 19 nt, Human
aaagugccaguauuuuaaa

SEQ ID NO: 3508002 - RNA, 14 nt, Human
aaagugccuuucag

SEQ ID NO: 3508003 - RNA, 19 nt, Human
aaagugccuuucaggaucu

SEQ ID NO: 3508004 - RNA, 20 nt, Human
aaagugccuuucaggaucua

SEQ ID NO: 3508005 - RNA, 17 nt, Human
aaagugcuaagguucua

SEQ ID NO: 3508006 - RNA, 18 nt, Human
aaagugcuaagguucuaa

SEQ ID NO: 3508007 - RNA, 20 nt, Human
aaagugcuaagguucuaagg

SEQ ID NO: 3508008 - RNA, 23 nt, Human
aaagugcuaagguucuaaggccu

SEQ ID NO: 3508009 - RNA, 20 nt, Human
aaagugcugcagggcuuuaa

SEQ ID NO: 3508010 - RNA, 22 nt, Human
aaagugcugcagggcuuuaaaa

SEQ ID NO: 3508011 - RNA, 15 nt, Human
aaagugcuuguguaa

SEQ ID NO: 3508012 - RNA, 16 nt, Human
aaagugcuuguguaau

SEQ ID NO: 3508013 - RNA, 21 nt, Human
aaagugcuuuccagaauaaua

SEQ ID NO: 3508014 - RNA, 14 nt, Human
aaaguggaaggaaa

SEQ ID NO: 3508015 - RNA, 18 nt, Human
aaaguggaauuucuuguu

SEQ ID NO: 3508016 - RNA, 19 nt, Human
aaaguggaauuucuuguuu

SEQ ID NO: 3508017 - RNA, 19 nt, Human
aaaguggcaagaccaaaau

SEQ ID NO: 3508018 - RNA, 18 nt, Human
cccacauccaacuccagc

SEQ ID NO: 3508019 - RNA, 13 nt, Human
cccacaucccagg

SEQ ID NO: 3508020 - RNA, 14 nt, Human
cccacaucccaggc

SEQ ID NO: 3508021 - RNA, 23 nt, Human
cccacaucccugggccugcugcu

SEQ ID NO: 3508022 - RNA, 17 nt, Human
cccacauguguccaucc

SEQ ID NO: 3508023 - RNA, 18 nt, Human
cccacauguguccauccc

SEQ ID NO: 3508024 - RNA, 14 nt, Human
cccacauuaaagaa

SEQ ID NO: 3508025 - RNA, 20 nt, Human
cccacauuggaagagcagca

SEQ ID NO: 3508026 - RNA, 14 nt, Human
cccacauuggaccc

SEQ ID NO: 3508027 - RNA, 23 nt, Human
cccacauuugugccgacacuguu

SEQ ID NO: 3508028 - RNA, 21 nt, Human
cccaccaacaucccauugccc

SEQ ID NO: 3508029 - RNA, 11 nt, Human
cccaccacaca

SEQ ID NO: 3508030 - RNA, 13 nt, Human
cccaccacacauc

SEQ ID NO: 3508031 - RNA, 12 nt, Human
cccaccacagca

SEQ ID NO: 3508032 - RNA, 13 nt, Human
cccaccacagcag

SEQ ID NO: 3508033 - RNA, 18 nt, Human
cccaccaccccagcugcu

SEQ ID NO: 3508034 - RNA, 14 nt, Human
cccaccagugccuc

SEQ ID NO: 3508035 - RNA, 16 nt, Human
cccaccagugccucuc

SEQ ID NO: 3508036 - RNA, 23 nt, Human
cccaccagugccucucccugcug

SEQ ID NO: 3508037 - RNA, 12 nt, Human
cccaccaucugc

SEQ ID NO: 3508038 - RNA, 16 nt, Human
cccacccaagcuuggc

SEQ ID NO: 3508039 - RNA, 18 nt, Human
cccacccaagggccuggc

SEQ ID NO: 3508040 - RNA, 22 nt, Human
cccacccaagggccuggccuga

SEQ ID NO: 3508041 - RNA, 22 nt, Human
cccacccacaauccuauucucg

SEQ ID NO: 3508042 - RNA, 14 nt, Human
cccacccacaugug

SEQ ID NO: 3508043 - RNA, 15 nt, Human
cccacccacauguga

SEQ ID NO: 3508044 - RNA, 12 nt, Human
cccacccaggag

SEQ ID NO: 3508045 - RNA, 20 nt, Human
cccacccagucucugcucca

SEQ ID NO: 3508046 - RNA, 19 nt, Human
cccaccccaaccugcucuc

SEQ ID NO: 3508047 - RNA, 12 nt, Human
cccaccccacac

SEQ ID NO: 3508048 - RNA, 15 nt, Human
cccaccccacccccu

SEQ ID NO: 3508049 - RNA, 17 nt, Human
cccaccccauggccggc

SEQ ID NO: 3508050 - RNA, 17 nt, Human
cccaccccauucccgca

SEQ ID NO: 3508051 - RNA, 14 nt, Human
cccacccccggcag

SEQ ID NO: 3508052 - RNA, 12 nt, Human
cccacccccuca

SEQ ID NO: 3508053 - RNA, 16 nt, Human
cccacccccugcccug

SEQ ID NO: 3508054 - RNA, 19 nt, Human
cccacccccugcccugcac

SEQ ID NO: 3508055 - RNA, 19 nt, Human
cccacccccuucagugccc

SEQ ID NO: 3508056 - RNA, 23 nt, Human
cccacccccuucagugcccacca

SEQ ID NO: 3508057 - RNA, 19 nt, Human
cccacccccuucucugcuc

SEQ ID NO: 3508058 - RNA, 13 nt, Human
cccaccccgggga

SEQ ID NO: 3508059 - RNA, 14 nt, Human
cccaccccggggac

SEQ ID NO: 3508060 - RNA, 17 nt, Human
cccaccccggggacccu

SEQ ID NO: 3508061 - RNA, 18 nt, Human
cccaccccggggacccug

SEQ ID NO: 3508062 - RNA, 12 nt, Human
cccaccccugca

SEQ ID NO: 3508063 - RNA, 15 nt, Human
cccaccccugcacag

SEQ ID NO: 3508064 - RNA, 16 nt, Human
cccaccccugccccca

SEQ ID NO: 3508065 - RNA, 15 nt, Human
cccaccccuggaaga

SEQ ID NO: 3508066 - RNA, 22 nt, Human
cccaccccugggggcucucaug

SEQ ID NO: 3508067 - RNA, 12 nt, Human
cccaccccugug

SEQ ID NO: 3508068 - RNA, 15 nt, Human
cccaccccuucccca

SEQ ID NO: 3508069 - RNA, 16 nt, Human
cccacccgaugcugcu

SEQ ID NO: 3508070 - RNA, 16 nt, Human
cccacccucagcaccc

SEQ ID NO: 3508071 - RNA, 17 nt, Human
cccacccucagcacccc

SEQ ID NO: 3508072 - RNA, 18 nt, Human
cccacccucccuggagug

SEQ ID NO: 3508073 - RNA, 13 nt, Human
cccacccuccugg

SEQ ID NO: 3508074 - RNA, 21 nt, Human
cccacccucggggaugugucc

SEQ ID NO: 3508075 - RNA, 13 nt, Human
cccacccucuucc

SEQ ID NO: 3508076 - RNA, 14 nt, Human
cccacccugcugcc

SEQ ID NO: 3508077 - RNA, 15 nt, Human
cccacccugcugcug

SEQ ID NO: 3508078 - RNA, 13 nt, Human
cccacccuggccu

SEQ ID NO: 3508079 - RNA, 14 nt, Human
cccacccugggacc

SEQ ID NO: 3508080 - RNA, 14 nt, Human
cccacccugggccc

SEQ ID NO: 3508081 - RNA, 15 nt, Human
cccacccugggcucu

SEQ ID NO: 3508082 - RNA, 18 nt, Human
cccacccuggugggccaa

SEQ ID NO: 3508083 - RNA, 12 nt, Human
cccacccuguuc

SEQ ID NO: 3508084 - RNA, 16 nt, Human
cccacccuguuccugc

SEQ ID NO: 3508085 - RNA, 19 nt, Human
cccacccuguuccugcugc

SEQ ID NO: 3508086 - RNA, 20 nt, Human
cccaccgcagacaggaccag

SEQ ID NO: 3508087 - RNA, 17 nt, Human
cccaccgggccacuccu

SEQ ID NO: 3508088 - RNA, 18 nt, Human
cccaccgggccacuccuu

SEQ ID NO: 3508089 - RNA, 15 nt, Human
cccaccguccgcccu

SEQ ID NO: 3508090 - RNA, 21 nt, Human
cccaccguccgcccugcuccu

SEQ ID NO: 3508091 - RNA, 23 nt, Human
cccaccguccgcccugcuccucc

SEQ ID NO: 3508092 - RNA, 17 nt, Human
cccaccguugucucaug

SEQ ID NO: 3508093 - RNA, 14 nt, Human
cccaccuaccuuca

SEQ ID NO: 3508094 - RNA, 20 nt, Human
cccaccuaccuucaaagcug

SEQ ID NO: 3508095 - RNA, 21 nt, Human
cccaccuagaacacuaacuca

SEQ ID NO: 3508096 - RNA, 16 nt, Human
cccaccuaugugccaa

SEQ ID NO: 3508097 - RNA, 21 nt, Human
cccaccucaaaugggucuggg

SEQ ID NO: 3508098 - RNA, 15 nt, Human
cccaccucagccucc

SEQ ID NO: 3508099 - RNA, 17 nt, Human
cccaccucagccucccg

SEQ ID NO: 3508100 - RNA, 17 nt, Human
cccaccucagccuccug

SEQ ID NO: 3508101 - RNA, 14 nt, Human
cccaccuccagccc

SEQ ID NO: 3508102 - RNA, 10 nt, Human
cccaccuccc

SEQ ID NO: 3508103 - RNA, 15 nt, Human
ccccuccaauccugc

SEQ ID NO: 3508104 - RNA, 17 nt, Human
ccccuccaauccugccc

SEQ ID NO: 3508105 - RNA, 11 nt, Human
ccccuccagcu

SEQ ID NO: 3508106 - RNA, 12 nt, Human
ccccuccaugug

SEQ ID NO: 3508107 - RNA, 21 nt, Human
ccccucccacacccaaagcug

SEQ ID NO: 3508108 - RNA, 16 nt, Human
ccccucccaccacagc

SEQ ID NO: 3508109 - RNA, 12 nt, Human
ccccucccaccc

SEQ ID NO: 3508110 - RNA, 17 nt, Human
ccccucccacccccagc

SEQ ID NO: 3508111 - RNA, 14 nt, Human
ccccucccagaggc

SEQ ID NO: 3508112 - RNA, 13 nt, Human
ccccucccaggga

SEQ ID NO: 3508113 - RNA, 14 nt, Human
ccccucccagggcc

SEQ ID NO: 3508114 - RNA, 14 nt, Human
ccccucccaucugg

SEQ ID NO: 3508115 - RNA, 11 nt, Human
ccccucccauu

SEQ ID NO: 3508116 - RNA, 15 nt, Human
ccccuccccagggga

SEQ ID NO: 3508117 - RNA, 21 nt, Human
ccccuccccaugcagguggug

SEQ ID NO: 3508118 - RNA, 15 nt, Human
ccccucccccaaccc

SEQ ID NO: 3508119 - RNA, 13 nt, Human
ccccuccccugcu

SEQ ID NO: 3508120 - RNA, 17 nt, Human
ccccucccgccccuucc

SEQ ID NO: 3508121 - RNA, 14 nt, Human
ccccucccucucca

SEQ ID NO: 3508122 - RNA, 13 nt, Human
ccccucccucugu

SEQ ID NO: 3508123 - RNA, 14 nt, Human
ccccucccucuguc

SEQ ID NO: 3508124 - RNA, 12 nt, Human
ccccucccuggc

SEQ ID NO: 3508125 - RNA, 17 nt, Human
ccccucccuggccuguu

SEQ ID NO: 3508126 - RNA, 12 nt, Human
ccccucccuuuc

SEQ ID NO: 3508127 - RNA, 15 nt, Human
ccccucccuuucucc

SEQ ID NO: 3508128 - RNA, 23 nt, Human
ccccuccuaccccucccagcuga

SEQ ID NO: 3508129 - RNA, 12 nt, Human
ccccuccucacu

SEQ ID NO: 3508130 - RNA, 12 nt, Human
ccccuccuccac

SEQ ID NO: 3508131 - RNA, 18 nt, Human
ccccuccuccuggacucc

SEQ ID NO: 3508132 - RNA, 21 nt, Human
ccccuccucuagcuguggggg

SEQ ID NO: 3508133 - RNA, 11 nt, Human
ccccuccucuc

SEQ ID NO: 3508134 - RNA, 13 nt, Human
ccccuccucuccc

SEQ ID NO: 3508135 - RNA, 13 nt, Human
ccccuccucucug

SEQ ID NO: 3508136 - RNA, 17 nt, Human
ccccuccucucugcccu

SEQ ID NO: 3508137 - RNA, 13 nt, Human
ccccuccugcugc

SEQ ID NO: 3508138 - RNA, 11 nt, Human
ccccuccuggg

SEQ ID NO: 3508139 - RNA, 20 nt, Human
ccccuccuucccagcugccc

SEQ ID NO: 3508140 - RNA, 12 nt, Human
ccccuccuucuc

SEQ ID NO: 3508141 - RNA, 15 nt, Human
ccccuccuugggcac

SEQ ID NO: 3508142 - RNA, 22 nt, Human
ccccucgcccagucccagcagc

SEQ ID NO: 3508143 - RNA, 23 nt, Human
ccccucgcccagucccagcagcc

SEQ ID NO: 3508144 - RNA, 15 nt, Human
ccccucgugccaguc

SEQ ID NO: 3508145 - RNA, 15 nt, Human
ccccucucagcccuc

SEQ ID NO: 3508146 - RNA, 16 nt, Human
ccccucucaggagcca

SEQ ID NO: 3508147 - RNA, 20 nt, Human
ccccucuccaggcgccggcg

SEQ ID NO: 3508148 - RNA, 14 nt, Human
ccccucucccugca

SEQ ID NO: 3508149 - RNA, 18 nt, Human
ccccucucccugcauggc

SEQ ID NO: 3508150 - RNA, 12 nt, Human
ccccucucccuu

SEQ ID NO: 3508151 - RNA, 19 nt, Human
ccccucuccuuccugugug

SEQ ID NO: 3508152 - RNA, 12 nt, Human
ccccucucuccu

SEQ ID NO: 3508153 - RNA, 11 nt, Human
ccccucucugg

SEQ ID NO: 3508154 - RNA, 20 nt, Human
ccccucugaaaguuguacau

SEQ ID NO: 3508155 - RNA, 19 nt, Human
ccccucugcacccagaaca

SEQ ID NO: 3508156 - RNA, 15 nt, Human
ccccucugcccagcu

SEQ ID NO: 3508157 - RNA, 17 nt, Human
ccccucugcccagcuug

SEQ ID NO: 3508158 - RNA, 13 nt, Human
ccccucugcccug

SEQ ID NO: 3508159 - RNA, 14 nt, Human
ccccucugcccugc

SEQ ID NO: 3508160 - RNA, 15 nt, Human
ccccucugcccugcg

SEQ ID NO: 3508161 - RNA, 20 nt, Human
ccccucugcccugcggguca

SEQ ID NO: 3508162 - RNA, 23 nt, Human
ccccucugcccugcgggucacag

SEQ ID NO: 3508163 - RNA, 13 nt, Human
ccccucuggccag

SEQ ID NO: 3508164 - RNA, 16 nt, Human
ccccucuggcuccagc

SEQ ID NO: 3508165 - RNA, 12 nt, Human
ccccucuucccu

SEQ ID NO: 3508166 - RNA, 15 nt, Human
cccagcauucucagg

SEQ ID NO: 3508167 - RNA, 18 nt, Human
cccagcauugcugguucu

SEQ ID NO: 3508168 - RNA, 20 nt, Human
cccagcauuuuacugauuca

SEQ ID NO: 3508169 - RNA, 14 nt, Human
cccagccacucccc

SEQ ID NO: 3508170 - RNA, 17 nt, Human
cccagccagaguuccug

SEQ ID NO: 3508171 - RNA, 18 nt, Human
cccagccagaguuccugc

SEQ ID NO: 3508172 - RNA, 20 nt, Human
cccagccagcaguucagagc

SEQ ID NO: 3508173 - RNA, 11 nt, Human
cccagccagcg

SEQ ID NO: 3508174 - RNA, 23 nt, Human
cccagccagcgucggucugugcc

SEQ ID NO: 3508175 - RNA, 13 nt, Human
cccagccaggccc

SEQ ID NO: 3508176 - RNA, 14 nt, Human
cccagccaggcccu

SEQ ID NO: 3508177 - RNA, 21 nt, Human
cccagccagggcucaaucucu

SEQ ID NO: 3508178 - RNA, 15 nt, Human
cccagccaucugccc

SEQ ID NO: 3508179 - RNA, 16 nt, Human
cccagccaucugccca

SEQ ID NO: 3508180 - RNA, 20 nt, Human
cccagccaucugcccagggg

SEQ ID NO: 3508181 - RNA, 22 nt, Human
cccagccaugccagcuggccuu

SEQ ID NO: 3508182 - RNA, 13 nt, Human
cccagcccaaagg

SEQ ID NO: 3508183 - RNA, 19 nt, Human
cccagcccaauccagguac

SEQ ID NO: 3508184 - RNA, 15 nt, Human
cccagcccacccccg

SEQ ID NO: 3508185 - RNA, 15 nt, Human
cccagcccacccucc

SEQ ID NO: 3508186 - RNA, 17 nt, Human
cccagcccacuucugcc

SEQ ID NO: 3508187 - RNA, 12 nt, Human
cccagcccagag

SEQ ID NO: 3508188 - RNA, 14 nt, Human
cccagcccagagac

SEQ ID NO: 3508189 - RNA, 20 nt, Human
cccagcccagauuccccugu

SEQ ID NO: 3508190 - RNA, 16 nt, Human
cccagcccagcuggug

SEQ ID NO: 3508191 - RNA, 13 nt, Human
cccagcccaucuu

SEQ ID NO: 3508192 - RNA, 22 nt, Human
cccagcccauucucucuccugu

SEQ ID NO: 3508193 - RNA, 23 nt, Human
cccagccccaaaacucuccucug

SEQ ID NO: 3508194 - RNA, 13 nt, Human
cccagccccaaug

SEQ ID NO: 3508195 - RNA, 16 nt, Human
cccagccccacuccuc

SEQ ID NO: 3508196 - RNA, 12 nt, Human
cccagccccagc

SEQ ID NO: 3508197 - RNA, 18 nt, Human
cccagccccauccucugu

SEQ ID NO: 3508198 - RNA, 19 nt, Human
cccagccccauccucugua

SEQ ID NO: 3508199 - RNA, 12 nt, Human
cccagcccccac

SEQ ID NO: 3508200 - RNA, 24 nt, Human
cccagcccccacagugcugucuga

SEQ ID NO: 3508201 - RNA, 15 nt, Human
cccagcccccuuugg

SEQ ID NO: 3508202 - RNA, 17 nt, Human
cccagccccgacuccag

SEQ ID NO: 3508203 - RNA, 18 nt, Human
cccagccccgacuccagc

SEQ ID NO: 3508204 - RNA, 19 nt, Human
cccagccccgacuccagcc

SEQ ID NO: 3508205 - RNA, 15 nt, Human
cccagccccggggug

SEQ ID NO: 3508206 - RNA, 20 nt, Human
cccagccccgguggcugggc

SEQ ID NO: 3508207 - RNA, 11 nt, Human
cccagccccua

SEQ ID NO: 3508208 - RNA, 18 nt, Human
cccagccccuagcccagg

SEQ ID NO: 3508209 - RNA, 16 nt, Human
cccagccccugccccu

SEQ ID NO: 3508210 - RNA, 14 nt, Human
cccagcccggcucc

SEQ ID NO: 3508211 - RNA, 18 nt, Human
cccagcccuauggaugug

SEQ ID NO: 3508212 - RNA, 15 nt, Human
cccagcccucauccc

SEQ ID NO: 3508213 - RNA, 16 nt, Human
cccagcccucaucccg

SEQ ID NO: 3508214 - RNA, 22 nt, Human
cccagcccugcagcaaggagga

SEQ ID NO: 3508215 - RNA, 11 nt, Human
cccagcccugg

SEQ ID NO: 3508216 - RNA, 12 nt, Human
cccagcccuggc

SEQ ID NO: 3508217 - RNA, 21 nt, Human
cccagcccuggucucagcagc

SEQ ID NO: 3508218 - RNA, 22 nt, Human
cccagcccuuugggaggcugag

SEQ ID NO: 3508219 - RNA, 22 nt, Human
cccagccgacccccucucccug

SEQ ID NO: 3508220 - RNA, 14 nt, Human
cccagccgcucgga

SEQ ID NO: 3508221 - RNA, 14 nt, Human
cccagccgcugccc

SEQ ID NO: 3508222 - RNA, 23 nt, Human
cccagccgcuuggcgaugccagc

SEQ ID NO: 3508223 - RNA, 20 nt, Human
cccagccggccucucuggcc

SEQ ID NO: 3508224 - RNA, 22 nt, Human
cccagccggccucucuggccuc

SEQ ID NO: 3508225 - RNA, 15 nt, Human
cccagccuaugagca

SEQ ID NO: 3508226 - RNA, 13 nt, Human
cccagccucagcg

SEQ ID NO: 3508227 - RNA, 16 nt, Human
cccagccucaguccuc

SEQ ID NO: 3508228 - RNA, 15 nt, Human
cccagccucuaggga

SEQ ID NO: 3508229 - RNA, 21 nt, Human
cccagccucucuuccuauccc

SEQ ID NO: 3508230 - RNA, 13 nt, Human
cccagccucuuuc

SEQ ID NO: 3508231 - RNA, 16 nt, Human
cccagccucuuucccu

SEQ ID NO: 3508232 - RNA, 23 nt, Human
cccagccugcgccugcugcaugc

SEQ ID NO: 3508233 - RNA, 11 nt, Human
cccagccugcu

SEQ ID NO: 3508234 - RNA, 14 nt, Human
cccagccugcuagc

SEQ ID NO: 3508235 - RNA, 15 nt, Human
cccagccugcuagcu

SEQ ID NO: 3508236 - RNA, 20 nt, Human
cccagccuggccacgcagcc

SEQ ID NO: 3508237 - RNA, 13 nt, Human
cccagccugggcc

SEQ ID NO: 3508238 - RNA, 15 nt, Human
cccagccugggccca

SEQ ID NO: 3508239 - RNA, 23 nt, Human
cccagccugggcccaucucccug

SEQ ID NO: 3508240 - RNA, 14 nt, Human
cccagccugggccu

SEQ ID NO: 3508241 - RNA, 10 nt, Human
cccagccugu

SEQ ID NO: 3508242 - RNA, 17 nt, Human
cccagcgagcccuggug

SEQ ID NO: 3508243 - RNA, 23 nt, Human
cccagcgagcccugguggcagug

SEQ ID NO: 3508244 - RNA, 21 nt, Human
cccagcgcugacgugucagga

SEQ ID NO: 3508245 - RNA, 15 nt, Human
cccagcggacacacg

SEQ ID NO: 3508246 - RNA, 16 nt, Human
cccagcggcaucaggc

SEQ ID NO: 3508247 - RNA, 18 nt, Human
cccagcggccccucccac

SEQ ID NO: 3508248 - RNA, 19 nt, Human
cccagcggccccucccaca

SEQ ID NO: 3508249 - RNA, 17 nt, Human
cccagcggcuggugcag

SEQ ID NO: 3508250 - RNA, 16 nt, Human
cccagcuaagaaccug

SEQ ID NO: 3508251 - RNA, 18 nt, Human
cccagcuaaucuguaggg

SEQ ID NO: 3508252 - RNA, 22 nt, Human
cccagcuacccuuuuucuccag

SEQ ID NO: 3508253 - RNA, 14 nt, Human
cccagcuaccucaa

SEQ ID NO: 3508254 - RNA, 17 nt, Human
cccagcuacucagaagc

SEQ ID NO: 3508255 - RNA, 21 nt, Human
cccagcuacucagaagccuga

SEQ ID NO: 3508256 - RNA, 15 nt, Human
cccagcuacucagga

SEQ ID NO: 3508257 - RNA, 22 nt, Human
cccagcuacucgggaggcugag

SEQ ID NO: 3508258 - RNA, 16 nt, Human
cccagcuacuugggaa

SEQ ID NO: 3508259 - RNA, 18 nt, Human
cccagcuacuugggaagc

SEQ ID NO: 3508260 - RNA, 19 nt, Human
cccagcuacuugggaagcu

SEQ ID NO: 3508261 - RNA, 18 nt, Human
cccagcuacuugggaggc

SEQ ID NO: 3508262 - RNA, 23 nt, Human
cccagcuacuugggaggcugagg

SEQ ID NO: 3508263 - RNA, 18 nt, Human
cccagcuaggaagagcag

SEQ ID NO: 3508264 - RNA, 23 nt, Human
cccagcuaggaagagcaggacuc

SEQ ID NO: 3508265 - RNA, 12 nt, Human
cccagcucagca

SEQ ID NO: 3508266 - RNA, 17 nt, Human
cccagcucaggggcagc

SEQ ID NO: 3508267 - RNA, 18 nt, Human
cccagcucagucuucccu

SEQ ID NO: 3508268 - RNA, 14 nt, Human
cccagcuccacccc

SEQ ID NO: 3508269 - RNA, 11 nt, Human
cccagcuccag

SEQ ID NO: 3508270 - RNA, 17 nt, Human
cccagcuccagggccag

SEQ ID NO: 3508271 - RNA, 18 nt, Human
cccagcuccagggccaga

SEQ ID NO: 3508272 - RNA, 14 nt, Human
cccagcucccagga

SEQ ID NO: 3508273 - RNA, 14 nt, Human
cccagcucuagaca

SEQ ID NO: 3508274 - RNA, 23 nt, Human
cccagcucuagacaacccugcaa

SEQ ID NO: 3508275 - RNA, 12 nt, Human
cccagcucuccc

SEQ ID NO: 3508276 - RNA, 11 nt, Human
cccgcuugccu

SEQ ID NO: 3508277 - RNA, 22 nt, Human
cccgcuugccucggcuccugcu

SEQ ID NO: 3508278 - RNA, 15 nt, Human
cccgcuuguccagcg

SEQ ID NO: 3508279 - RNA, 19 nt, Human
cccggaauuccgucaccac

SEQ ID NO: 3508280 - RNA, 23 nt, Human
cccggagaagugugccuucucuc

SEQ ID NO: 3508281 - RNA, 20 nt, Human
cccggagcuaacacuggccc

SEQ ID NO: 3508282 - RNA, 22 nt, Human
cccggagcugccccucucuggg

SEQ ID NO: 3508283 - RNA, 15 nt, Human
cccggaggaaaucug

SEQ ID NO: 3508284 - RNA, 22 nt, Human
cccggaggaaaucugcagaggg

SEQ ID NO: 3508285 - RNA, 16 nt, Human
cccggauucugggagg

SEQ ID NO: 3508286 - RNA, 17 nt, Human
cccggcacccucuggcc

SEQ ID NO: 3508287 - RNA, 14 nt, Human
cccggcaggcccug

SEQ ID NO: 3508288 - RNA, 15 nt, Human
cccggcaggcccugc

SEQ ID NO: 3508289 - RNA, 18 nt, Human
cccggcaggcccugcagu

SEQ ID NO: 3508290 - RNA, 19 nt, Human
cccggcaggcccugcagug

SEQ ID NO: 3508291 - RNA, 20 nt, Human
cccggcaugagacucagugc

SEQ ID NO: 3508292 - RNA, 23 nt, Human
cccggcaugagacucagugcaga

SEQ ID NO: 3508293 - RNA, 13 nt, Human
cccggccaccucu

SEQ ID NO: 3508294 - RNA, 15 nt, Human
cccggccaccucugc

SEQ ID NO: 3508295 - RNA, 16 nt, Human
cccggccccagccaga

SEQ ID NO: 3508296 - RNA, 15 nt, Human
cccggcccccugccc

SEQ ID NO: 3508297 - RNA, 13 nt, Human
cccggcccccugg

SEQ ID NO: 3508298 - RNA, 21 nt, Human
cccggcccccuggucucuggu

SEQ ID NO: 3508299 - RNA, 16 nt, Human
cccggccccugcuggu

SEQ ID NO: 3508300 - RNA, 18 nt, Human
cccggccgccgcccugcu

SEQ ID NO: 3508301 - RNA, 18 nt, Human
cccggccucagcaccccu

SEQ ID NO: 3508302 - RNA, 15 nt, Human
cccggcgcccucugu

SEQ ID NO: 3508303 - RNA, 16 nt, Human
cccggcgcccucuguc

SEQ ID NO: 3508304 - RNA, 18 nt, Human
cccggcgcccucuguccu

SEQ ID NO: 3508305 - RNA, 19 nt, Human
cccggcgcgguggcucacg

SEQ ID NO: 3508306 - RNA, 22 nt, Human
cccggcgcgguggcucacgccu

SEQ ID NO: 3508307 - RNA, 11 nt, Human
cccggcuccag

SEQ ID NO: 3508308 - RNA, 13 nt, Human
cccggcuccaggc

SEQ ID NO: 3508309 - RNA, 13 nt, Human
cccggcuccuggu

SEQ ID NO: 3508310 - RNA, 17 nt, Human
cccggcugguuuuguaa

SEQ ID NO: 3508311 - RNA, 18 nt, Human
cccggcuuuggugcgggg

SEQ ID NO: 3508312 - RNA, 15 nt, Human
cccccuccugcugca

SEQ ID NO: 3508313 - RNA, 19 nt, Human
cccccuccuucccagcugc

SEQ ID NO: 3508314 - RNA, 17 nt, Human
cccccucucaggagcca

SEQ ID NO: 3508315 - RNA, 13 nt, Human
cccccucugcccu

SEQ ID NO: 3508316 - RNA, 21 nt, Human
cccccugcaaagcccagcuug

SEQ ID NO: 3508317 - RNA, 12 nt, Human
cccccugcagcu

SEQ ID NO: 3508318 - RNA, 23 nt, Human
cccccugcagcuuguagccagcc

SEQ ID NO: 3508319 - RNA, 13 nt, Human
cccccugcccucc

SEQ ID NO: 3508320 - RNA, 22 nt, Human
cccccugcccucguggccagcc

SEQ ID NO: 3508321 - RNA, 12 nt, Human
cccccugcccug

SEQ ID NO: 3508322 - RNA, 14 nt, Human
cccccugcccugca

SEQ ID NO: 3508323 - RNA, 15 nt, Human
cccccugcuggcucu

SEQ ID NO: 3508324 - RNA, 20 nt, Human
cccccugcuggcucuucugc

SEQ ID NO: 3508325 - RNA, 19 nt, Human
cccccuggccucugugccu

SEQ ID NO: 3508326 - RNA, 22 nt, Human
cccccuggccucugugccuucu

SEQ ID NO: 3508327 - RNA, 19 nt, Human
cccccuggggcuucuccug

SEQ ID NO: 3508328 - RNA, 20 nt, Human
cccccuggggcuucuccuga

SEQ ID NO: 3508329 - RNA, 23 nt, Human
cccccugguggacaguccuggga

SEQ ID NO: 3508330 - RNA, 20 nt, Human
cccccuguacacaacucacu

SEQ ID NO: 3508331 - RNA, 12 nt, Human
cagcucucccuc

SEQ ID NO: 3508332 - RNA, 18 nt, Human
cagcucucccucuggccc

SEQ ID NO: 3508333 - RNA, 21 nt, Human
cagcucucccucuggcccugc

SEQ ID NO: 3508334 - RNA, 23 nt, Human
cagcucucccucuggcccugccu

SEQ ID NO: 3508335 - RNA, 14 nt, Human
cagcucucugcccu

SEQ ID NO: 3508336 - RNA, 15 nt, Human
cagcucucugcccug

SEQ ID NO: 3508337 - RNA, 21 nt, Human
cagcucucugcccuguguacu

SEQ ID NO: 3508338 - RNA, 20 nt, Human
cagcucugacauucugauuc

SEQ ID NO: 3508339 - RNA, 11 nt, Human
cagcucugacu

SEQ ID NO: 3508340 - RNA, 15 nt, Human
cagcucugcaagaau

SEQ ID NO: 3508341 - RNA, 19 nt, Human
cagcucugccgucucugga

SEQ ID NO: 3508342 - RNA, 22 nt, Human
cagcucugcuugccgaaacugg

SEQ ID NO: 3508343 - RNA, 23 nt, Human
cagcucuggacagccccacccug

SEQ ID NO: 3508344 - RNA, 14 nt, Human
cagcucuggagggg

SEQ ID NO: 3508345 - RNA, 18 nt, Human
cagcucuggcauggcuag

SEQ ID NO: 3508346 - RNA, 20 nt, Human
cagcucuggcucacagacug

SEQ ID NO: 3508347 - RNA, 14 nt, Human
cagcucuggcuucc

SEQ ID NO: 3508348 - RNA, 16 nt, Human
cagcucuguccuggga

SEQ ID NO: 3508349 - RNA, 18 nt, Human
cagcucuguccugggagu

SEQ ID NO: 3508350 - RNA, 21 nt, Human
cagcucuguguugccaugugu

SEQ ID NO: 3508351 - RNA, 13 nt, Human
cagcucuucaucu

SEQ ID NO: 3508352 - RNA, 14 nt, Human
cagcucuucaucug

SEQ ID NO: 3508353 - RNA, 12 nt, Human
cagcucuuccug

SEQ ID NO: 3508354 - RNA, 13 nt, Human
cagcucuuccugg

SEQ ID NO: 3508355 - RNA, 23 nt, Human
cagcucuuccuggacaggccagg

SEQ ID NO: 3508356 - RNA, 14 nt, Human
cagcucuucuccag

SEQ ID NO: 3508357 - RNA, 23 nt, Human
cagcucuucuccaggcuguaucc

SEQ ID NO: 3508358 - RNA, 23 nt, Human
cagcucuucugccggcccugggg

SEQ ID NO: 3508359 - RNA, 16 nt, Human
cagcucuugcccuucc

SEQ ID NO: 3508360 - RNA, 20 nt, Human
cagcucuugcccuucccugu

SEQ ID NO: 3508361 - RNA, 21 nt, Human
cagcucuugcccuucccuguc

SEQ ID NO: 3508362 - RNA, 23 nt, Human
cagcucuugcccuucccuguccc

SEQ ID NO: 3508363 - RNA, 14 nt, Human
cagcucuugcuaau

SEQ ID NO: 3508364 - RNA, 16 nt, Human
cagcucuuggcuccac

SEQ ID NO: 3508365 - RNA, 14 nt, Human
cagcucuuuccucc

SEQ ID NO: 3508366 - RNA, 16 nt, Human
cagcucuuuccuccuu

SEQ ID NO: 3508367 - RNA, 17 nt, Human
cagcucuuuccuccuuc

SEQ ID NO: 3508368 - RNA, 22 nt, Human
cagcucuuugaaauagucugug

SEQ ID NO: 3508369 - RNA, 15 nt, Human
cagcugaaauacuga

SEQ ID NO: 3508370 - RNA, 13 nt, Human
cagcugaaauuga

SEQ ID NO: 3508371 - RNA, 17 nt, Human
cagcugaaauugaaaag

SEQ ID NO: 3508372 - RNA, 14 nt, Human
cagcugaaccuggg

SEQ ID NO: 3508373 - RNA, 20 nt, Human
cagcugaaugccuccugugg

SEQ ID NO: 3508374 - RNA, 16 nt, Human
cagcugaauuaucuau

SEQ ID NO: 3508375 - RNA, 16 nt, Human
cagcugacaguccucu

SEQ ID NO: 3508376 - RNA, 18 nt, Human
cagcugacaguccucucc

SEQ ID NO: 3508377 - RNA, 13 nt, Human
cagcugacuaaac

SEQ ID NO: 3508378 - RNA, 14 nt, Human
cagcugagcgccag

SEQ ID NO: 3508379 - RNA, 15 nt, Human
cagcugauacaaauu

SEQ ID NO: 3508380 - RNA, 23 nt, Human
cagcugauacaaauugcagacug

SEQ ID NO: 3508381 - RNA, 20 nt, Human
cagcugauacuucauuuaaa

SEQ ID NO: 3508382 - RNA, 22 nt, Human
cagcugaugacucaagauuccc

SEQ ID NO: 3508383 - RNA, 20 nt, Human
cagcugauguuggaagagaa

SEQ ID NO: 3508384 - RNA, 18 nt, Human
cagcugauuuuaacaaua

SEQ ID NO: 3508385 - RNA, 20 nt, Human
cagcugcaagguacucuggu

SEQ ID NO: 3508386 - RNA, 22 nt, Human
cagcugcaagguacucugguga

SEQ ID NO: 3508387 - RNA, 14 nt, Human
cagcugcaccagag

SEQ ID NO: 3508388 - RNA, 19 nt, Human
cagcugcaccagagcaacc

SEQ ID NO: 3508389 - RNA, 17 nt, Human
cagcugcaccccuuccu

SEQ ID NO: 3508390 - RNA, 18 nt, Human
cagcugcacugaugcugc

SEQ ID NO: 3508391 - RNA, 12 nt, Human
cagcugccaccu

SEQ ID NO: 3508392 - RNA, 19 nt, Human
cagcugccaggagcacggc

SEQ ID NO: 3508393 - RNA, 16 nt, Human
cagcugcccccagagc

SEQ ID NO: 3508394 - RNA, 20 nt, Human
cagcugcccccgcucauggg

SEQ ID NO: 3508395 - RNA, 15 nt, Human
cagcugcccuauggg

SEQ ID NO: 3508396 - RNA, 21 nt, Human
cagcugcccuuccgcagugug

SEQ ID NO: 3508397 - RNA, 17 nt, Human
cagcugccgaccagagc

SEQ ID NO: 3508398 - RNA, 22 nt, Human
cagcugccggucgcccuuugcu

SEQ ID NO: 3508399 - RNA, 16 nt, Human
cagcugccuccccucc

SEQ ID NO: 3508400 - RNA, 21 nt, Human
cagcugccucugccacugacu

SEQ ID NO: 3508401 - RNA, 20 nt, Human
cagcugccuuagcuucagga

SEQ ID NO: 3508402 - RNA, 15 nt, Human
cagcugcgcgggcuu

SEQ ID NO: 3508403 - RNA, 22 nt, Human
cagcugcgguccacccaggagc

SEQ ID NO: 3508404 - RNA, 16 nt, Human
cagcugcuauccccau

SEQ ID NO: 3508405 - RNA, 18 nt, Human
cagcugcuauccccaucu

SEQ ID NO: 3508406 - RNA, 15 nt, Human
cagcugcuccccucc

SEQ ID NO: 3508407 - RNA, 16 nt, Human
cagcugcuccccuccc

SEQ ID NO: 3508408 - RNA, 18 nt, Human
cagcugcuccccucccuc

SEQ ID NO: 3508409 - RNA, 12 nt, Human
cagcugcucugc

SEQ ID NO: 3508410 - RNA, 20 nt, Human
cagcugcucugcccagagcu

SEQ ID NO: 3508411 - RNA, 21 nt, Human
cagcugcucugcccagagcug

SEQ ID NO: 3508412 - RNA, 21 nt, Human
cagcugcugaaacaacaaaua

SEQ ID NO: 3508413 - RNA, 21 nt, Human
cagcugcugagauccuggacu

SEQ ID NO: 3508414 - RNA, 14 nt, Human
cagcugcuggagac

SEQ ID NO: 3508415 - RNA, 15 nt, Human
cagcugcuggagacu

SEQ ID NO: 3508416 - RNA, 13 nt, Human
cagcugcugucuu

SEQ ID NO: 3508417 - RNA, 15 nt, Human
cagcugcuugggcuu

SEQ ID NO: 3508418 - RNA, 19 nt, Human
cagcugcuugggcuucauc

SEQ ID NO: 3508419 - RNA, 16 nt, Human
cagcugcuuguguccc

SEQ ID NO: 3508420 - RNA, 15 nt, Human
cagcugcuuucuucu

SEQ ID NO: 3508421 - RNA, 14 nt, Human
cagcugcuuuguua

SEQ ID NO: 3508422 - RNA, 23 nt, Human
cagcugcuuuugucuaugggacu

SEQ ID NO: 3508423 - RNA, 17 nt, Human
cagcuggaauuaugcug

SEQ ID NO: 3508424 - RNA, 23 nt, Human
cagcuggacucugcaucccagca

SEQ ID NO: 3508425 - RNA, 16 nt, Human
cagcuggagaagaccc

SEQ ID NO: 3508426 - RNA, 14 nt, Human
cagcuggcagcaga

SEQ ID NO: 3508427 - RNA, 18 nt, Human
cagcuggcccgugacaga

SEQ ID NO: 3508428 - RNA, 19 nt, Human
cagcuggcccgugacagac

SEQ ID NO: 3508429 - RNA, 17 nt, Human
cagcuggccgucacuug

SEQ ID NO: 3508430 - RNA, 15 nt, Human
cagcuggccuggaca

SEQ ID NO: 3508431 - RNA, 16 nt, Human
cagcuggccuggacag

SEQ ID NO: 3508432 - RNA, 17 nt, Human
cagcuggccuggacagu

SEQ ID NO: 3508433 - RNA, 12 nt, Human
cagcuggcucua

SEQ ID NO: 3508434 - RNA, 16 nt, Human
cagcuggcucuacuuc

SEQ ID NO: 3508435 - RNA, 15 nt, Human
cagcugggagaaggg

SEQ ID NO: 3508436 - RNA, 19 nt, Human
cagcugggaucugacugca

SEQ ID NO: 3508437 - RNA, 22 nt, Human
cagcugggaucugacugcacgu

SEQ ID NO: 3508438 - RNA, 14 nt, Human
cagcugggcccaac

SEQ ID NO: 3508439 - RNA, 17 nt, Human
cagcugggcccaacccu

SEQ ID NO: 3508440 - RNA, 15 nt, Human
cagcugggcucugcc

SEQ ID NO: 3508441 - RNA, 12 nt, Human
cagcugggcugu

SEQ ID NO: 3508442 - RNA, 14 nt, Human
cagcugggcugugg

SEQ ID NO: 3508443 - RNA, 21 nt, Human
cagcuggggccaggcuggguc

SEQ ID NO: 3508444 - RNA, 19 nt, Human
cagcuggggcguggggagg

SEQ ID NO: 3508445 - RNA, 16 nt, Human
cagcuggggugcaggg

SEQ ID NO: 3508446 - RNA, 23 nt, Human
cagcuggggugcagggauguggg

SEQ ID NO: 3508447 - RNA, 22 nt, Human
cagcugggguggggaccucagg

SEQ ID NO: 3508448 - RNA, 18 nt, Human
cagcugggucaggcaggg

SEQ ID NO: 3508449 - RNA, 17 nt, Human
cagcuggguggcacugc

SEQ ID NO: 3508450 - RNA, 18 nt, Human
cagcuggguggcacugcc

SEQ ID NO: 3508451 - RNA, 21 nt, Human
cagcuggguggcacugccaug

SEQ ID NO: 3508452 - RNA, 18 nt, Human
cagcuggugcccugcuuu

SEQ ID NO: 3508453 - RNA, 19 nt, Human
cagcuggugguaucugagu

SEQ ID NO: 3508454 - RNA, 14 nt, Human
cagcugguguagcu

SEQ ID NO: 3508455 - RNA, 19 nt, Human
cagcuguaagaagagacug

SEQ ID NO: 3508456 - RNA, 19 nt, Human
ccccuucuccccugcacug

SEQ ID NO: 3508457 - RNA, 13 nt, Human
ccccuucucucau

SEQ ID NO: 3508458 - RNA, 21 nt, Human
ccccuucucucccugccagag

SEQ ID NO: 3508459 - RNA, 14 nt, Human
ccccuucucuccuc

SEQ ID NO: 3508460 - RNA, 15 nt, Human
ccccuucucuccucc

SEQ ID NO: 3508461 - RNA, 12 nt, Human
ccccuucucugc

SEQ ID NO: 3508462 - RNA, 13 nt, Human
ccccuucucugcu

SEQ ID NO: 3508463 - RNA, 22 nt, Human
ccccuucucugcuccaccacau

SEQ ID NO: 3508464 - RNA, 17 nt, Human
ccccuucugacccaugc

SEQ ID NO: 3508465 - RNA, 14 nt, Human
ccccuucugcucag

SEQ ID NO: 3508466 - RNA, 21 nt, Human
ccccuucugcucagcucuggg

SEQ ID NO: 3508467 - RNA, 23 nt, Human
ccccuucugggcaucuguucugg

SEQ ID NO: 3508468 - RNA, 23 nt, Human
ccccuugacaacuggcaggcagg

SEQ ID NO: 3508469 - RNA, 16 nt, Human
ccccuugccagcugcu

SEQ ID NO: 3508470 - RNA, 20 nt, Human
ccccuugcccagggcucagc

SEQ ID NO: 3508471 - RNA, 18 nt, Human
ccccuugggcccacaccu

SEQ ID NO: 3508472 - RNA, 13 nt, Human
ccccuugggcggc

SEQ ID NO: 3508473 - RNA, 18 nt, Human
ccccuuguccuuucccuu

SEQ ID NO: 3508474 - RNA, 18 nt, Human
ccccuuucccgggcuguc

SEQ ID NO: 3508475 - RNA, 13 nt, Human
ccccuuugggccc

SEQ ID NO: 3508476 - RNA, 18 nt, Human
ccccuuugggcccaggga

SEQ ID NO: 3508477 - RNA, 14 nt, Human
ccccuuugggcccu

SEQ ID NO: 3508478 - RNA, 17 nt, Human
ccccuuugggcccugca

SEQ ID NO: 3508479 - RNA, 19 nt, Human
ccccuuugggcccugcaug

SEQ ID NO: 3508480 - RNA, 13 nt, Human
ccccuuugugcug

SEQ ID NO: 3508481 - RNA, 15 nt, Human
ccccuuugugcugug

SEQ ID NO: 3508482 - RNA, 19 nt, Human
ccccuuuucagcuucugcu

SEQ ID NO: 3508483 - RNA, 22 nt, Human
ccccuuuucagcuucugcuggg

SEQ ID NO: 3508484 - RNA, 19 nt, Human
ccccuuuucuuuucuaccc

SEQ ID NO: 3508485 - RNA, 20 nt, Human
ccccuuuucuuuucuacccu

SEQ ID NO: 3508486 - RNA, 18 nt, Human
ccccuuuuuacuccccuu

SEQ ID NO: 3508487 - RNA, 22 nt, Human
cccgaaagaggcacccuuccau

SEQ ID NO: 3508488 - RNA, 18 nt, Human
cccgaagggcccccacau

SEQ ID NO: 3508489 - RNA, 23 nt, Human
cccgaagguuauggucaauccca

SEQ ID NO: 3508490 - RNA, 16 nt, Human
cccgaauagcugggac

SEQ ID NO: 3508491 - RNA, 17 nt, Human
cccgaauagcugggacu

SEQ ID NO: 3508492 - RNA, 15 nt, Human
cccgacagccuggca

SEQ ID NO: 3508493 - RNA, 17 nt, Human
cccgacuccagccagcg

SEQ ID NO: 3508494 - RNA, 20 nt, Human
cccgacuccagccagcgccu

SEQ ID NO: 3508495 - RNA, 12 nt, Human
cccgagcagcug

SEQ ID NO: 3508496 - RNA, 15 nt, Human
cccgagcagcugagc

SEQ ID NO: 3508497 - RNA, 19 nt, Human
cccgagcagcugagcaggg

SEQ ID NO: 3508498 - RNA, 15 nt, Human
cccgagccuggcucc

SEQ ID NO: 3508499 - RNA, 11 nt, Human
cccgagcuggg

SEQ ID NO: 3508500 - RNA, 20 nt, Human
cccgagcugggggccaugag

SEQ ID NO: 3508501 - RNA, 18 nt, Human
caggaaggggguccaccc

SEQ ID NO: 3508502 - RNA, 23 nt, Human
caggaaggggguccacccagcaa

SEQ ID NO: 3508503 - RNA, 12 nt, Human
caggaaguacug

SEQ ID NO: 3508504 - RNA, 16 nt, Human
caggaaguacuggaga

SEQ ID NO: 3508505 - RNA, 19 nt, Human
caggaaguacuuccaccuc

SEQ ID NO: 3508506 - RNA, 15 nt, Human
caggaaguagaggag

SEQ ID NO: 3508507 - RNA, 20 nt, Human
caggaaguagcacaggcuga

SEQ ID NO: 3508508 - RNA, 22 nt, Human
caggaaguagcacaggcugagu

SEQ ID NO: 3508509 - RNA, 12 nt, Human
caggaauaaggc

SEQ ID NO: 3508510 - RNA, 17 nt, Human
caggaauauuuuccaaa

SEQ ID NO: 3508511 - RNA, 18 nt, Human
caggaaucaagagcugcc

SEQ ID NO: 3508512 - RNA, 20 nt, Human
caggaaugaagccuuagcca

SEQ ID NO: 3508513 - RNA, 14 nt, Human
caggaaugaucucu

SEQ ID NO: 3508514 - RNA, 23 nt, Human
caggaauggagccugcacgguga

SEQ ID NO: 3508515 - RNA, 17 nt, Human
caggaauguguggcaga

SEQ ID NO: 3508516 - RNA, 23 nt, Human
caggaauguguggccugcacagu

SEQ ID NO: 3508517 - RNA, 18 nt, Human
caggaauguuaaagucag

SEQ ID NO: 3508518 - RNA, 17 nt, Human
caggaauuucccaggac

SEQ ID NO: 3508519 - RNA, 18 nt, Human
caggaauuucccaggacc

SEQ ID NO: 3508520 - RNA, 19 nt, Human
caggaauuugggacccugc

SEQ ID NO: 3508521 - RNA, 20 nt, Human
caggaauuugggacccugcu

SEQ ID NO: 3508522 - RNA, 17 nt, Human
caggacaaugucugaac

SEQ ID NO: 3508523 - RNA, 13 nt, Human
caggacacaggcc

SEQ ID NO: 3508524 - RNA, 22 nt, Human
caggacaccacacccagccuca

SEQ ID NO: 3508525 - RNA, 15 nt, Human
caggacacggggcag

SEQ ID NO: 3508526 - RNA, 13 nt, Human
caggacagaugcc

SEQ ID NO: 3508527 - RNA, 13 nt, Human
caggacaggcccg

SEQ ID NO: 3508528 - RNA, 18 nt, Human
caggacaggcugcggccc

SEQ ID NO: 3508529 - RNA, 21 nt, Human
caggacagugcuucagccuga

SEQ ID NO: 3508530 - RNA, 14 nt, Human
caggacauuucucu

SEQ ID NO: 3508531 - RNA, 18 nt, Human
caggacauuucucuaaga

SEQ ID NO: 3508532 - RNA, 16 nt, Human
caggaccacaaaaaug

SEQ ID NO: 3508533 - RNA, 15 nt, Human
caggaccacaggcuc

SEQ ID NO: 3508534 - RNA, 19 nt, Human
caggaccacaggcucaggc

SEQ ID NO: 3508535 - RNA, 15 nt, Human
caggaccagaagcuc

SEQ ID NO: 3508536 - RNA, 10 nt, Human
caggaccagc

SEQ ID NO: 3508537 - RNA, 15 nt, Human
caggaccagcccacg

SEQ ID NO: 3508538 - RNA, 17 nt, Human
caggaccagcccacgcu

SEQ ID NO: 3508539 - RNA, 17 nt, Human
caggaccagcucaggac

SEQ ID NO: 3508540 - RNA, 20 nt, Human
caggaccagcucaggacaga

SEQ ID NO: 3508541 - RNA, 12 nt, Human
caggaccagcug

SEQ ID NO: 3508542 - RNA, 15 nt, Human
caggaccagcugggg

SEQ ID NO: 3508543 - RNA, 23 nt, Human
caggaccagcuggggcgugggga

SEQ ID NO: 3508544 - RNA, 19 nt, Human
caggaccagucccagagca

SEQ ID NO: 3508545 - RNA, 16 nt, Human
caggaccaugggacca

SEQ ID NO: 3508546 - RNA, 20 nt, Human
caggacccaccaugucugcc

SEQ ID NO: 3508547 - RNA, 13 nt, Human
caggacccagagg

SEQ ID NO: 3508548 - RNA, 14 nt, Human
caggacccccuucc

SEQ ID NO: 3508549 - RNA, 20 nt, Human
caggaccccugcaguucccc

SEQ ID NO: 3508550 - RNA, 12 nt, Human
caggacccucgc

SEQ ID NO: 3508551 - RNA, 13 nt, Human
caggacccucgcc

SEQ ID NO: 3508552 - RNA, 16 nt, Human
caggacccucgccgga

SEQ ID NO: 3508553 - RNA, 20 nt, Human
caggacccucgcuggccccc

SEQ ID NO: 3508554 - RNA, 21 nt, Human
caggacccucgcuggccccca

SEQ ID NO: 3508555 - RNA, 13 nt, Human
caggacccugaag

SEQ ID NO: 3508556 - RNA, 15 nt, Human
caggacccugaaggg

SEQ ID NO: 3508557 - RNA, 17 nt, Human
caggacccugaaggggc

SEQ ID NO: 3508558 - RNA, 17 nt, Human
caggacccugccaggca

SEQ ID NO: 3508559 - RNA, 22 nt, Human
caggacccuggacccagccaga

SEQ ID NO: 3508560 - RNA, 22 nt, Human
caggaccucagaguccaggccc

SEQ ID NO: 3508561 - RNA, 17 nt, Human
caggaccuccaagccac

SEQ ID NO: 3508562 - RNA, 17 nt, Human
caggaccucgugccacc

SEQ ID NO: 3508563 - RNA, 18 nt, Human
caggaccucgugccaccc

SEQ ID NO: 3508564 - RNA, 14 nt, Human
caggaccugccugu

SEQ ID NO: 3508565 - RNA, 15 nt, Human
caggaccugccugua

SEQ ID NO: 3508566 - RNA, 16 nt, Human
caggaccuggcugcca

SEQ ID NO: 3508567 - RNA, 20 nt, Human
caggaccugggaccuccccu

SEQ ID NO: 3508568 - RNA, 22 nt, Human
caggaccuucgggcugugcccg

SEQ ID NO: 3508569 - RNA, 20 nt, Human
caggaccuuuugaaguaguu

SEQ ID NO: 3508570 - RNA, 14 nt, Human
caggacgagaugac

SEQ ID NO: 3508571 - RNA, 16 nt, Human
caggacgccacucauu

SEQ ID NO: 3508572 - RNA, 17 nt, Human
caggacgccacucauuu

SEQ ID NO: 3508573 - RNA, 14 nt, Human
caggacgcuucuga

SEQ ID NO: 3508574 - RNA, 20 nt, Human
caggacggggccggccaggu

SEQ ID NO: 3508575 - RNA, 22 nt, Human
caggacggggccggccaggugg

SEQ ID NO: 3508576 - RNA, 18 nt, Human
caggacuauagcccaggu

SEQ ID NO: 3508577 - RNA, 16 nt, Human
caggacucagaagccu

SEQ ID NO: 3508578 - RNA, 17 nt, Human
caggacucagcucccca

SEQ ID NO: 3508579 - RNA, 21 nt, Human
caggacucagcuccccagagu

SEQ ID NO: 3508580 - RNA, 15 nt, Human
caggacuccccaggc

SEQ ID NO: 3508581 - RNA, 18 nt, Human
caggacuccccaggccag

SEQ ID NO: 3508582 - RNA, 16 nt, Human
caggacucccuccuca

SEQ ID NO: 3508583 - RNA, 23 nt, Human
caggacucccuccucaccucugg

SEQ ID NO: 3508584 - RNA, 11 nt, Human
caggacucugc

SEQ ID NO: 3508585 - RNA, 13 nt, Human
caggacucugcag

SEQ ID NO: 3508586 - RNA, 16 nt, Human
caggacucugcagccu

SEQ ID NO: 3508587 - RNA, 21 nt, Human
caggacucugcagccucagag

SEQ ID NO: 3508588 - RNA, 20 nt, Human
caggacucugcccagaccac

SEQ ID NO: 3508589 - RNA, 18 nt, Human
caggacugaauugucccc

SEQ ID NO: 3508590 - RNA, 14 nt, Human
caggacugagcccc

SEQ ID NO: 3508591 - RNA, 18 nt, Human
caggacugagccccgcag

SEQ ID NO: 3508592 - RNA, 18 nt, Human
caggacugggagccccca

SEQ ID NO: 3508593 - RNA, 21 nt, Human
caggacugggagcccccagcc

SEQ ID NO: 3508594 - RNA, 12 nt, Human
caggacugggcc

SEQ ID NO: 3508595 - RNA, 20 nt, Human
caggacugggccacuucugg

SEQ ID NO: 3508596 - RNA, 19 nt, Human
caggacuuaacggcuccag

SEQ ID NO: 3508597 - RNA, 15 nt, Human
caggacuuccccgga

SEQ ID NO: 3508598 - RNA, 23 nt, Human
caggacuuggucugauuucagga

SEQ ID NO: 3508599 - RNA, 20 nt, Human
caggagaacucauguuauuu

SEQ ID NO: 3508600 - RNA, 12 nt, Human
caggagaagaaa

SEQ ID NO: 3508601 - RNA, 20 nt, Human
ccggacuuucggaguugggg

SEQ ID NO: 3508602 - RNA, 23 nt, Human
ccggacuuucggaguuggggguc

SEQ ID NO: 3508603 - RNA, 14 nt, Human
ccggagagccagcu

SEQ ID NO: 3508604 - RNA, 12 nt, Human
ccggagaggaag

SEQ ID NO: 3508605 - RNA, 18 nt, Human
ccggagaggccucgaccc

SEQ ID NO: 3508606 - RNA, 14 nt, Human
ccggagauguagca

SEQ ID NO: 3508607 - RNA, 17 nt, Human
ccggagauguagcaaaa

SEQ ID NO: 3508608 - RNA, 17 nt, Human
ccggagcuaacacuggc

SEQ ID NO: 3508609 - RNA, 19 nt, Human
ccggagcugccccucucug

SEQ ID NO: 3508610 - RNA, 22 nt, Human
ccggagcugccccucucugggc

SEQ ID NO: 3508611 - RNA, 21 nt, Human
ccggagcuuucaaagaaggaa

SEQ ID NO: 3508612 - RNA, 18 nt, Human
ccggaggguguuuaugua

SEQ ID NO: 3508613 - RNA, 16 nt, Human
ccggaucugagggaga

SEQ ID NO: 3508614 - RNA, 14 nt, Human
ccggaugugcuuuu

SEQ ID NO: 3508615 - RNA, 23 nt, Human
ccggcaauaaaagcccaggagcc

SEQ ID NO: 3508616 - RNA, 19 nt, Human
ccggcacagaugcuccagg

SEQ ID NO: 3508617 - RNA, 20 nt, Human
ccggcacccccugcagcuug

SEQ ID NO: 3508618 - RNA, 15 nt, Human
ccggcacuccaugcu

SEQ ID NO: 3508619 - RNA, 16 nt, Human
ccggcagcagccccca

SEQ ID NO: 3508620 - RNA, 15 nt, Human
ccggcagccccagcc

SEQ ID NO: 3508621 - RNA, 16 nt, Human
ccggcagccccagccu

SEQ ID NO: 3508622 - RNA, 20 nt, Human
ccggcagccccagccugcua

SEQ ID NO: 3508623 - RNA, 12 nt, Human
ccggcaggcccu

SEQ ID NO: 3508624 - RNA, 16 nt, Human
ccggcaggcccugcag

SEQ ID NO: 3508625 - RNA, 20 nt, Human
ccggcaggcccugcaguguu

SEQ ID NO: 3508626 - RNA, 21 nt, Human
ccggcaggcccugcaguguuc

SEQ ID NO: 3508627 - RNA, 21 nt, Human
ccggcagggcgggcagagggc

SEQ ID NO: 3508628 - RNA, 17 nt, Human
ccggcauggacaaugga

SEQ ID NO: 3508629 - RNA, 14 nt, Human
ccggcauggcuggg

SEQ ID NO: 3508630 - RNA, 14 nt, Human
ccggcaugggaaag

SEQ ID NO: 3508631 - RNA, 15 nt, Human
ccggccaauggaaac

SEQ ID NO: 3508632 - RNA, 12 nt, Human
ccggccaccucu

SEQ ID NO: 3508633 - RNA, 15 nt, Human
ccggccaccucugcg

SEQ ID NO: 3508634 - RNA, 16 nt, Human
ccggccaccugcggug

SEQ ID NO: 3508635 - RNA, 11 nt, Human
ccggccagcca

SEQ ID NO: 3508636 - RNA, 11 nt, Human
ccggccagccc

SEQ ID NO: 3508637 - RNA, 19 nt, Human
ccggccagcugggaucuga

SEQ ID NO: 3508638 - RNA, 13 nt, Human
ccggccaggccac

SEQ ID NO: 3508639 - RNA, 17 nt, Human
ccggccaggugccuccu

SEQ ID NO: 3508640 - RNA, 15 nt, Human
ccggccaggugggcg

SEQ ID NO: 3508641 - RNA, 17 nt, Human
ccggccccagccagagu

SEQ ID NO: 3508642 - RNA, 13 nt, Human
ccggcccccuggu

SEQ ID NO: 3508643 - RNA, 15 nt, Human
ccggcccccuggucu

SEQ ID NO: 3508644 - RNA, 20 nt, Human
ccggcccccuggucucuggu

SEQ ID NO: 3508645 - RNA, 17 nt, Human
ccggccccucccccuga

SEQ ID NO: 3508646 - RNA, 17 nt, Human
ccggcccgcgccacagg

SEQ ID NO: 3508647 - RNA, 19 nt, Human
ccggcccugggcucggagg

SEQ ID NO: 3508648 - RNA, 24 nt, Human
ccggcccugggcucggaggcugcc

SEQ ID NO: 3508649 - RNA, 13 nt, Human
ccggcccuggggc

SEQ ID NO: 3508650 - RNA, 15 nt, Human
ccggcccugugugca

SEQ ID NO: 3508651 - RNA, 17 nt, Human
ccggcccugugugcagg

SEQ ID NO: 3508652 - RNA, 17 nt, Human
ccggccgcuccaccagc

SEQ ID NO: 3508653 - RNA, 21 nt, Human
ccggccugaugacagagcgag

SEQ ID NO: 3508654 - RNA, 15 nt, Human
ccggccugccaggag

SEQ ID NO: 3508655 - RNA, 18 nt, Human
ccggccugccaggaggac

SEQ ID NO: 3508656 - RNA, 17 nt, Human
ccggcgagcccugugga

SEQ ID NO: 3508657 - RNA, 16 nt, Human
ccggcgggcgggccgg

SEQ ID NO: 3508658 - RNA, 13 nt, Human
ccggcgucagccu

SEQ ID NO: 3508659 - RNA, 15 nt, Human
ccggcgucagccucc

SEQ ID NO: 3508660 - RNA, 17 nt, Human
ccggcgucagccuccag

SEQ ID NO: 3508661 - RNA, 20 nt, Human
ccggcgucagccuccagccu

SEQ ID NO: 3508662 - RNA, 23 nt, Human
ccggcgucagccuccagccucug

SEQ ID NO: 3508663 - RNA, 16 nt, Human
ccggcgugguggaaga

SEQ ID NO: 3508664 - RNA, 22 nt, Human
ccggcgugguggaagaggggac

SEQ ID NO: 3508665 - RNA, 23 nt, Human
ccggcuaugggggcacugaggac

SEQ ID NO: 3508666 - RNA, 19 nt, Human
ccggcucccaccgaggcgc

SEQ ID NO: 3508667 - RNA, 14 nt, Human
ccggcucccagccu

SEQ ID NO: 3508668 - RNA, 16 nt, Human
ccggcucuggcucucc

SEQ ID NO: 3508669 - RNA, 17 nt, Human
ccggcucuggcucuccc

SEQ ID NO: 3508670 - RNA, 14 nt, Human
ccggcucuuuccuu

SEQ ID NO: 3508671 - RNA, 15 nt, Human
ccggcugcagaggcc

SEQ ID NO: 3508672 - RNA, 12 nt, Human
ccggcugcccuu

SEQ ID NO: 3508673 - RNA, 22 nt, Human
ccggcugcuuuucccuaagcca

SEQ ID NO: 3508674 - RNA, 12 nt, Human
ccggcuggccug

SEQ ID NO: 3508675 - RNA, 17 nt, Human
ccggcuggccuggcccc

SEQ ID NO: 3508676 - RNA, 18 nt, Human
ccggcuggccuggccccu

SEQ ID NO: 3508677 - RNA, 23 nt, Human
ccggcugguuuuguaagaugcug

SEQ ID NO: 3508678 - RNA, 15 nt, Human
ccggcugugcuggga

SEQ ID NO: 3508679 - RNA, 15 nt, Human
ccggcuuccuuuccc

SEQ ID NO: 3508680 - RNA, 23 nt, Human
ccggcuuccuuucccaagccuuc

SEQ ID NO: 3508681 - RNA, 17 nt, Human
ccggcuugccacacccc

SEQ ID NO: 3508682 - RNA, 15 nt, Human
ccggcuuucaggagc

SEQ ID NO: 3508683 - RNA, 18 nt, Human
ccgggaaccuccccagcc

SEQ ID NO: 3508684 - RNA, 20 nt, Human
ccgggaaccuccccagccug

SEQ ID NO: 3508685 - RNA, 21 nt, Human
ccgggaaccuccccagccugc

SEQ ID NO: 3508686 - RNA, 17 nt, Human
ccgggaagccacccucc

SEQ ID NO: 3508687 - RNA, 15 nt, Human
ccgggacccccagga

SEQ ID NO: 3508688 - RNA, 15 nt, Human
ccgggaccccgagcc

SEQ ID NO: 3508689 - RNA, 20 nt, Human
ccgggacucacuggcagccc

SEQ ID NO: 3508690 - RNA, 22 nt, Human
ccgggacucacuggcagcccca

SEQ ID NO: 3508691 - RNA, 23 nt, Human
ccgggagccuaggaccacucagc

SEQ ID NO: 3508692 - RNA, 22 nt, Human
ccgggaggcagagguugcagug

SEQ ID NO: 3508693 - RNA, 16 nt, Human
ccgggaugggagccgg

SEQ ID NO: 3508694 - RNA, 22 nt, Human
ccgggcacucagaagacacuga

SEQ ID NO: 3508695 - RNA, 20 nt, Human
ccgggcagggcucccacaga

SEQ ID NO: 3508696 - RNA, 13 nt, Human
ccgggccacuccu

SEQ ID NO: 3508697 - RNA, 19 nt, Human
ccgggccacuccuuccugc

SEQ ID NO: 3508698 - RNA, 21 nt, Human
ccgggccacuccuuccugccc

SEQ ID NO: 3508699 - RNA, 14 nt, Human
ccgggccagggcug

SEQ ID NO: 3508700 - RNA, 15 nt, Human
ccgggccagggcugc

SEQ ID NO: 3508701 - RNA, 14 nt, Human
ccgggccccugggc

SEQ ID NO: 3508702 - RNA, 16 nt, Human
ccgggccccugggcuu

SEQ ID NO: 3508703 - RNA, 15 nt, Human
cccugccccccagcc

SEQ ID NO: 3508704 - RNA, 20 nt, Human
cccugccccccagcccuccu

SEQ ID NO: 3508705 - RNA, 17 nt, Human
cccugcccccugcagga

SEQ ID NO: 3508706 - RNA, 23 nt, Human
cccugccccucccuucaaccauu

SEQ ID NO: 3508707 - RNA, 19 nt, Human
cccugccccuccucucccu

SEQ ID NO: 3508708 - RNA, 12 nt, Human
cccugccccugc

SEQ ID NO: 3508709 - RNA, 17 nt, Human
cccugcccggcugcgga

SEQ ID NO: 3508710 - RNA, 17 nt, Human
cccugcccguguacaua

SEQ ID NO: 3508711 - RNA, 20 nt, Human
cccugcccguucuugaaaug

SEQ ID NO: 3508712 - RNA, 16 nt, Human
cccugcccuagcucca

SEQ ID NO: 3508713 - RNA, 11 nt, Human
cccugcccucu

SEQ ID NO: 3508714 - RNA, 15 nt, Human
cccugcccuggucca

SEQ ID NO: 3508715 - RNA, 11 nt, Human
cccugcccugu

SEQ ID NO: 3508716 - RNA, 20 nt, Human
cccugccgucaccaccaccc

SEQ ID NO: 3508717 - RNA, 12 nt, Human
cccugccuccac

SEQ ID NO: 3508718 - RNA, 17 nt, Human
cccugccuccugccggc

SEQ ID NO: 3508719 - RNA, 16 nt, Human
cccugccuccuuugug

SEQ ID NO: 3508720 - RNA, 20 nt, Human
cccugccucucccaggcagg

SEQ ID NO: 3508721 - RNA, 21 nt, Human
cccugccucuccgccccugag

SEQ ID NO: 3508722 - RNA, 13 nt, Human
cccugccucucug

SEQ ID NO: 3508723 - RNA, 16 nt, Human
cccugccucucugcag

SEQ ID NO: 3508724 - RNA, 22 nt, Human
cccugccucucugcaggucccu

SEQ ID NO: 3508725 - RNA, 13 nt, Human
cccugccugaggg

SEQ ID NO: 3508726 - RNA, 22 nt, Human
cccugccugagggccccucugc

SEQ ID NO: 3508727 - RNA, 15 nt, Human
cccugccugccgucu

SEQ ID NO: 3508728 - RNA, 14 nt, Human
cccugccuggagga

SEQ ID NO: 3508729 - RNA, 16 nt, Human
cccugccuggaggacc

SEQ ID NO: 3508730 - RNA, 17 nt, Human
cccugccuggaggaccu

SEQ ID NO: 3508731 - RNA, 18 nt, Human
cccugccuggaggaccug

SEQ ID NO: 3508732 - RNA, 19 nt, Human
cccugccuggaggaccuga

SEQ ID NO: 3508733 - RNA, 21 nt, Human
cccugccuggaggaccugagc

SEQ ID NO: 3508734 - RNA, 22 nt, Human
cccugccuggaggaccugagcc

SEQ ID NO: 3508735 - RNA, 21 nt, Human
cccugccuggcccccaaccuc

SEQ ID NO: 3508736 - RNA, 17 nt, Human
cccugcgaaggggcccu

SEQ ID NO: 3508737 - RNA, 21 nt, Human
cccugcgaaggggcccugguc

SEQ ID NO: 3508738 - RNA, 22 nt, Human
cccugcgccugugaugcugggc

SEQ ID NO: 3508739 - RNA, 18 nt, Human
cccugcgccuuuccuuuu

SEQ ID NO: 3508740 - RNA, 16 nt, Human
cccugcgcucucuuug

SEQ ID NO: 3508741 - RNA, 19 nt, Human
cccugcuccagaagauagc

SEQ ID NO: 3508742 - RNA, 17 nt, Human
cccugcucccacagaac

SEQ ID NO: 3508743 - RNA, 17 nt, Human
cccugcucccucccauc

SEQ ID NO: 3508744 - RNA, 18 nt, Human
cccugcuccucccuggcu

SEQ ID NO: 3508745 - RNA, 21 nt, Human
cccugcuccucccuggcugcc

SEQ ID NO: 3508746 - RNA, 21 nt, Human
ccuaaauccauuuggaaaucu

SEQ ID NO: 3508747 - RNA, 13 nt, Human
ccuaaauuuaaaa

SEQ ID NO: 3508748 - RNA, 13 nt, Human
ccuaaauuuaaug

SEQ ID NO: 3508749 - RNA, 19 nt, Human
ccuaaauuuaaugcugccu

SEQ ID NO: 3508750 - RNA, 22 nt, Human
ccuaaauuuuccuguccucuuu

SEQ ID NO: 3508751 - RNA, 22 nt, Human
ccuaacaacauuguagccucaa

SEQ ID NO: 3508752 - RNA, 18 nt, Human
ccuaacacagcaugugua

SEQ ID NO: 3508753 - RNA, 17 nt, Human
ccuaacauucgaucuca

SEQ ID NO: 3508754 - RNA, 14 nt, Human
ccuaaccccuucca

SEQ ID NO: 3508755 - RNA, 15 nt, Human
ccuaaccccuuuccu

SEQ ID NO: 3508756 - RNA, 13 nt, Human
ccuaacccuuugu

SEQ ID NO: 3508757 - RNA, 13 nt, Human
ccuaaccugccga

SEQ ID NO: 3508758 - RNA, 16 nt, Human
ccuaacugaagagaca

SEQ ID NO: 3508759 - RNA, 11 nt, Human
ccuaacuguau

SEQ ID NO: 3508760 - RNA, 14 nt, Human
ccuaacuuuucaau

SEQ ID NO: 3508761 - RNA, 15 nt, Human
ccuaagaaauaugug

SEQ ID NO: 3508762 - RNA, 19 nt, Human
ccuaagaaauaugugagau

SEQ ID NO: 3508763 - RNA, 17 nt, Human
ccuaagaaucuuuagag

SEQ ID NO: 3508764 - RNA, 20 nt, Human
ccuaagaccggcggccauga

SEQ ID NO: 3508765 - RNA, 18 nt, Human
ccuaagaguugagcucuc

SEQ ID NO: 3508766 - RNA, 21 nt, Human
ccuaagauauacuuguuuuug

SEQ ID NO: 3508767 - RNA, 16 nt, Human
ccuaagcaucuaaguu

SEQ ID NO: 3508768 - RNA, 16 nt, Human
ccuaagccagccuggu

SEQ ID NO: 3508769 - RNA, 16 nt, Human
ccuaagccagcugccc

SEQ ID NO: 3508770 - RNA, 19 nt, Human
ccuaagccuguggcugugg

SEQ ID NO: 3508771 - RNA, 18 nt, Human
ccuaagcuggagugcagu

SEQ ID NO: 3508772 - RNA, 13 nt, Human
ccuaaggacacac

SEQ ID NO: 3508773 - RNA, 14 nt, Human
ccuaaggacacacu

SEQ ID NO: 3508774 - RNA, 15 nt, Human
ccuaaggacacacua

SEQ ID NO: 3508775 - RNA, 11 nt, Human
ccuaaggacuu

SEQ ID NO: 3508776 - RNA, 16 nt, Human
ccuaaggacuucuuua

SEQ ID NO: 3508777 - RNA, 16 nt, Human
ccuaaggaucucucag

SEQ ID NO: 3508778 - RNA, 23 nt, Human
ccuaaggcacccacaaauaaaug

SEQ ID NO: 3508779 - RNA, 23 nt, Human
ccuaagggacauguuuugauaaa

SEQ ID NO: 3508780 - RNA, 18 nt, Human
ccuaagggauccugccug

SEQ ID NO: 3508781 - RNA, 21 nt, Human
ccuaagggucgaaagcucuag

SEQ ID NO: 3508782 - RNA, 14 nt, Human
ccuaaguacuguaa

SEQ ID NO: 3508783 - RNA, 13 nt, Human
ccuaagucucugu

SEQ ID NO: 3508784 - RNA, 15 nt, Human
ccuaagucucuguga

SEQ ID NO: 3508785 - RNA, 20 nt, Human
ccuaaguuucaguugauuuu

SEQ ID NO: 3508786 - RNA, 15 nt, Human
ccuaauaaaaaggug

SEQ ID NO: 3508787 - RNA, 14 nt, Human
ccuaauaaaacuga

SEQ ID NO: 3508788 - RNA, 16 nt, Human
ccuaauaaaacugaug

SEQ ID NO: 3508789 - RNA, 22 nt, Human
ccuaauaaaacugaugugaaac

SEQ ID NO: 3508790 - RNA, 14 nt, Human
ccuaauaaagcugu

SEQ ID NO: 3508791 - RNA, 16 nt, Human
ccuaauaaaguucugu

SEQ ID NO: 3508792 - RNA, 19 nt, Human
ccuaauaauaucccacugg

SEQ ID NO: 3508793 - RNA, 16 nt, Human
ccuaauacauuaaagc

SEQ ID NO: 3508794 - RNA, 17 nt, Human
ccuaauaucaaaugcag

SEQ ID NO: 3508795 - RNA, 18 nt, Human
ccuaaucacucagagcag

SEQ ID NO: 3508796 - RNA, 17 nt, Human
ccuaaucaggcugaggu

SEQ ID NO: 3508797 - RNA, 21 nt, Human
ccuaauccaggcagauccagg

SEQ ID NO: 3508798 - RNA, 16 nt, Human
ccuaauccccuucucc

SEQ ID NO: 3508799 - RNA, 22 nt, Human
ccuaaucccugggcauugcuuu

SEQ ID NO: 3508800 - RNA, 14 nt, Human
ccuaaucucauacc

SEQ ID NO: 3508801 - RNA, 14 nt, Human
ccuaaucuucugaa

SEQ ID NO: 3508802 - RNA, 20 nt, Human
ccuaaugcgcaggcuggccc

SEQ ID NO: 3508803 - RNA, 21 nt, Human
ccuaaugcgcaggcuggcccu

SEQ ID NO: 3508804 - RNA, 16 nt, Human
ccuaaugcuccuuguu

SEQ ID NO: 3508805 - RNA, 17 nt, Human
ccuaaugucuucauaaa

SEQ ID NO: 3508806 - RNA, 12 nt, Human
ccuaauguguuu

SEQ ID NO: 3508807 - RNA, 13 nt, Human
ccuaauguguuua

SEQ ID NO: 3508808 - RNA, 23 nt, Human
ccuaauuagagcagaugaccccu

SEQ ID NO: 3508809 - RNA, 16 nt, Human
ccuaauucaauucaaa

SEQ ID NO: 3508810 - RNA, 15 nt, Human
ccuaauuccacagcu

SEQ ID NO: 3508811 - RNA, 18 nt, Human
ccuaauucgaugaaggcu

SEQ ID NO: 3508812 - RNA, 14 nt, Human
ccuaauuucuccuc

SEQ ID NO: 3508813 - RNA, 16 nt, Human
ccuaauuucuccuccc

SEQ ID NO: 3508814 - RNA, 17 nt, Human
ccuaauuucuccucccu

SEQ ID NO: 3508815 - RNA, 23 nt, Human
ccuaauuucuccucccuuccuuu

SEQ ID NO: 3508816 - RNA, 18 nt, Human
ccuacaagagcagccugu

SEQ ID NO: 3508817 - RNA, 21 nt, Human
ccuacaagagcagccuguggc

SEQ ID NO: 3508818 - RNA, 18 nt, Human
ccuacaagauuuagaaaa

SEQ ID NO: 3508819 - RNA, 19 nt, Human
ccuacaagauuuagaaaaa

SEQ ID NO: 3508820 - RNA, 13 nt, Human
ccuacaaggccua

SEQ ID NO: 3508821 - RNA, 23 nt, Human
ccuacacaggacagggguuccuu

SEQ ID NO: 3508822 - RNA, 21 nt, Human
ccuacagaaaaaccuuggguu

SEQ ID NO: 3508823 - RNA, 23 nt, Human
ccuacagaggucucugccggcuc

SEQ ID NO: 3508824 - RNA, 12 nt, Human
ccuacagcacua

SEQ ID NO: 3508825 - RNA, 18 nt, Human
ccuacagcacuacugggu

SEQ ID NO: 3508826 - RNA, 21 nt, Human
ccuacagcacuacuggguguc

SEQ ID NO: 3508827 - RNA, 15 nt, Human
ccuacaggcagucuc

SEQ ID NO: 3508828 - RNA, 18 nt, Human
ccuacagggggucuggcu

SEQ ID NO: 3508829 - RNA, 19 nt, Human
ccuacagggggucuggcug

SEQ ID NO: 3508830 - RNA, 21 nt, Human
ccuacagggggucuggcuggu

SEQ ID NO: 3508831 - RNA, 20 nt, Human
ccuacaguuuuaacugugga

SEQ ID NO: 3508832 - RNA, 19 nt, Human
ccuacaugaaacagaaaca

SEQ ID NO: 3508833 - RNA, 17 nt, Human
ccuacaugcuuugugaa

SEQ ID NO: 3508834 - RNA, 22 nt, Human
ccuacauguauuuguuugcaua

SEQ ID NO: 3508835 - RNA, 15 nt, Human
ccuaccaaccucuga

SEQ ID NO: 3508836 - RNA, 15 nt, Human
ccuaccaaugcaugc

SEQ ID NO: 3508837 - RNA, 14 nt, Human
ccuaccacaguguc

SEQ ID NO: 3508838 - RNA, 17 nt, Human
ccuaccaccccuuccug

SEQ ID NO: 3508839 - RNA, 18 nt, Human
ccuaccaccccuuccugu

SEQ ID NO: 3508840 - RNA, 20 nt, Human
ccuaccacccgguccccacu

SEQ ID NO: 3508841 - RNA, 13 nt, Human
ccuaccacugucu

SEQ ID NO: 3508842 - RNA, 16 nt, Human
ccuaccagcgcccgcu

SEQ ID NO: 3508843 - RNA, 19 nt, Human
ccuaccagcgcccgcuggg

SEQ ID NO: 3508844 - RNA, 22 nt, Human
ccuaccaucagggacaggauga

SEQ ID NO: 3508845 - RNA, 19 nt, Human
ccuacccauccccgcagug

SEQ ID NO: 3508846 - RNA, 17 nt, Human
ccuaccccaauuccuug

SEQ ID NO: 3508847 - RNA, 18 nt, Human
ccuaccccaauuccuugu

SEQ ID NO: 3508848 - RNA, 19 nt, Human
ccuaccccacaccaggccg

SEQ ID NO: 3508849 - RNA, 21 nt, Human
ccuaccccacaccaggccguc

SEQ ID NO: 3508850 - RNA, 13 nt, Human
ccuaccccuggcu

SEQ ID NO: 3508851 - RNA, 18 nt, Human
ccuacccuaaccaaguuc

SEQ ID NO: 3508852 - RNA, 14 nt, Human
ccuacccucgggcc

SEQ ID NO: 3508853 - RNA, 18 nt, Human
ccuacccucgggcccacc

SEQ ID NO: 3508854 - RNA, 19 nt, Human
ccuacccucgggcccaccu

SEQ ID NO: 3508855 - RNA, 16 nt, Human
ccuaccgagucucuuc

SEQ ID NO: 3508856 - RNA, 17 nt, Human
ccuaccgagucucuucu

SEQ ID NO: 3508857 - RNA, 20 nt, Human
ccuaccgagucucuucucca

SEQ ID NO: 3508858 - RNA, 21 nt, Human
ccuaccgagucucuucuccac

SEQ ID NO: 3508859 - RNA, 23 nt, Human
ccuaccgagucucuucuccacug

SEQ ID NO: 3508860 - RNA, 20 nt, Human
ccuaccggcaauuuccggcc

SEQ ID NO: 3508861 - RNA, 19 nt, Human
ccuaccuaacccagaaaau

SEQ ID NO: 3508862 - RNA, 13 nt, Human
ccuaccucagccu

SEQ ID NO: 3508863 - RNA, 21 nt, Human
ccuaccucagccuagacccuc

SEQ ID NO: 3508864 - RNA, 12 nt, Human
ccuaccucaggu

SEQ ID NO: 3508865 - RNA, 14 nt, Human
ccuaccucagguug

SEQ ID NO: 3508866 - RNA, 14 nt, Human
ccuaccugcccugg

SEQ ID NO: 3508867 - RNA, 14 nt, Human
ccuaccugugccug

SEQ ID NO: 3508868 - RNA, 22 nt, Human
cccuggcuuuucacugcuggcu

SEQ ID NO: 3508869 - RNA, 14 nt, Human
cccugggagacaga

SEQ ID NO: 3508870 - RNA, 15 nt, Human
cccugggaggcucug

SEQ ID NO: 3508871 - RNA, 16 nt, Human
cccugggaggcucugg

SEQ ID NO: 3508872 - RNA, 17 nt, Human
cccugggaggcucugga

SEQ ID NO: 3508873 - RNA, 23 nt, Human
cccugggagggacaugcuuagca

SEQ ID NO: 3508874 - RNA, 20 nt, Human
cccugggaucugguggucag

SEQ ID NO: 3508875 - RNA, 15 nt, Human
cccugggauguccac

SEQ ID NO: 3508876 - RNA, 12 nt, Human
cccugggccagg

SEQ ID NO: 3508877 - RNA, 13 nt, Human
cccugggcccugg

SEQ ID NO: 3508878 - RNA, 14 nt, Human
cccugggccugcug

SEQ ID NO: 3508879 - RNA, 15 nt, Human
cccugggccugcugc

SEQ ID NO: 3508880 - RNA, 16 nt, Human
cccugggccugcugcu

SEQ ID NO: 3508881 - RNA, 17 nt, Human
cccugggcucggaggcu

SEQ ID NO: 3508882 - RNA, 13 nt, Human
cccugggcucugc

SEQ ID NO: 3508883 - RNA, 14 nt, Human
cccugggcucugug

SEQ ID NO: 3508884 - RNA, 21 nt, Human
cccugggcuuggccugcugug

SEQ ID NO: 3508885 - RNA, 22 nt, Human
cccugggcuuggccugcuguga

SEQ ID NO: 3508886 - RNA, 19 nt, Human
cccuggggacagcaagggc

SEQ ID NO: 3508887 - RNA, 12 nt, Human
cccuggggccug

SEQ ID NO: 3508888 - RNA, 20 nt, Human
cccuggggccugacugcuca

SEQ ID NO: 3508889 - RNA, 21 nt, Human
cccuggggccugacugcucag

SEQ ID NO: 3508890 - RNA, 23 nt, Human
cccuggggccuggaccugccucc

SEQ ID NO: 3508891 - RNA, 13 nt, Human
aaaaaaaaaccaa

SEQ ID NO: 3508892 - RNA, 10 nt, Human
aaaaaaaaga

SEQ ID NO: 3508893 - RNA, 11 nt, Human
aaaaaaaagcu

SEQ ID NO: 3508894 - RNA, 13 nt, Human
aaaaaaaauuacu

SEQ ID NO: 3508895 - RNA, 13 nt, Human
aaaaaaacauucu

SEQ ID NO: 3508896 - RNA, 11 nt, Human
aaaaaaaccac

SEQ ID NO: 3508897 - RNA, 11 nt, Human
aaaaaaacuuu

SEQ ID NO: 3508898 - RNA, 10 nt, Human
aaaaaaagaa

SEQ ID NO: 3508899 - RNA, 13 nt, Human
aaaaaaagaaaau

SEQ ID NO: 3508900 - RNA, 12 nt, Human
aaaaaaagauga

SEQ ID NO: 3508901 - RNA, 12 nt, Human
aaaaaaagcaug

SEQ ID NO: 3508902 - RNA, 13 nt, Human
aaaaaaagcaugu

SEQ ID NO: 3508903 - RNA, 12 nt, Human
aaaaaaaguauu

SEQ ID NO: 3508904 - RNA, 13 nt, Human
aaaaaaauacuug

SEQ ID NO: 3508905 - RNA, 12 nt, Human
aaaaaaaugaca

SEQ ID NO: 3508906 - RNA, 11 nt, Human
aaaaaaaugcc

SEQ ID NO: 3508907 - RNA, 13 nt, Human
aaaaaaauguauu

SEQ ID NO: 3508908 - RNA, 15 nt, Human
aaaaaacagaggcca

SEQ ID NO: 3508909 - RNA, 10 nt, Human
aaaaaagaaa

SEQ ID NO: 3508910 - RNA, 12 nt, Human
aaaaaagaaaug

SEQ ID NO: 3508911 - RNA, 12 nt, Human
aaaaaagaaugu

SEQ ID NO: 3508912 - RNA, 14 nt, Human
aaaaaagaauguca

SEQ ID NO: 3508913 - RNA, 12 nt, Human
aaaaaagaggaa

SEQ ID NO: 3508914 - RNA, 13 nt, Human
aaaaaagcugaau

SEQ ID NO: 3508915 - RNA, 19 nt, Human
aaaaaagcuuuaugauuuu

SEQ ID NO: 3508916 - RNA, 11 nt, Human
aaaaaaggaaa

SEQ ID NO: 3508917 - RNA, 16 nt, Human
aaaaaagucaccaaau

SEQ ID NO: 3508918 - RNA, 13 nt, Human
aaaaaagucagag

SEQ ID NO: 3508919 - RNA, 13 nt, Human
aaaaaaguuauau

SEQ ID NO: 3508920 - RNA, 17 nt, Human
agacacaggcccggcuc

SEQ ID NO: 3508921 - RNA, 21 nt, Human
agacacaggcccggcuccagg

SEQ ID NO: 3508922 - RNA, 22 nt, Human
agacacaggcccggcuccaggc

SEQ ID NO: 3508923 - RNA, 16 nt, Human
agacacagggacuuga

SEQ ID NO: 3508924 - RNA, 20 nt, Human
agacacagggacuugaaguu

SEQ ID NO: 3508925 - RNA, 21 nt, Human
agacacagucauacugucacu

SEQ ID NO: 3508926 - RNA, 19 nt, Human
agacacaucgcacugugga

SEQ ID NO: 3508927 - RNA, 14 nt, Human
agacacaugccagg

SEQ ID NO: 3508928 - RNA, 21 nt, Human
agacacaugccagggccaugu

SEQ ID NO: 3508929 - RNA, 16 nt, Human
agacacauguccaaga

SEQ ID NO: 3508930 - RNA, 24 nt, Human
agacacauguccaagaagcccagg

SEQ ID NO: 3508931 - RNA, 15 nt, Human
agacaccaaaguucu

SEQ ID NO: 3508932 - RNA, 16 nt, Human
agacaccaaaguucua

SEQ ID NO: 3508933 - RNA, 21 nt, Human
agacaccaucuuuugugagau

SEQ ID NO: 3508934 - RNA, 15 nt, Human
agacacccaggacuu

SEQ ID NO: 3508935 - RNA, 14 nt, Human
agacacccuggcag

SEQ ID NO: 3508936 - RNA, 12 nt, Human
agacaccucaga

SEQ ID NO: 3508937 - RNA, 15 nt, Human
agacaccucagagcc

SEQ ID NO: 3508938 - RNA, 16 nt, Human
agacaccugcaccucc

SEQ ID NO: 3508939 - RNA, 17 nt, Human
agacaccugcaccuccc

SEQ ID NO: 3508940 - RNA, 20 nt, Human
agacaccugcaccucccccc

SEQ ID NO: 3508941 - RNA, 17 nt, Human
agacaccuugacagggc

SEQ ID NO: 3508942 - RNA, 22 nt, Human
agacaccuuggacauccuccuc

SEQ ID NO: 3508943 - RNA, 20 nt, Human
agacacgcacggcagccaca

SEQ ID NO: 3508944 - RNA, 22 nt, Human
agacacgccuuccccucagcca

SEQ ID NO: 3508945 - RNA, 21 nt, Human
agacacggagcccagcccucc

SEQ ID NO: 3508946 - RNA, 21 nt, Human
agacacggaucugagaaucuu

SEQ ID NO: 3508947 - RNA, 14 nt, Human
agacacucugcucu

SEQ ID NO: 3508948 - RNA, 15 nt, Human
agacacucugcucug

SEQ ID NO: 3508949 - RNA, 13 nt, Human
agacacucuggcu

SEQ ID NO: 3508950 - RNA, 18 nt, Human
agacacugaaaaaucuaa

SEQ ID NO: 3508951 - RNA, 13 nt, Human
agacacugaaaua

SEQ ID NO: 3508952 - RNA, 20 nt, Human
agacacugaaauauacacac

SEQ ID NO: 3508953 - RNA, 20 nt, Human
agacacuggcugccagcuau

SEQ ID NO: 3508954 - RNA, 12 nt, Human
agacacugguuu

SEQ ID NO: 3508955 - RNA, 20 nt, Human
agacacugguuuacacuuua

SEQ ID NO: 3508956 - RNA, 20 nt, Human
agacacuucuaaaugaagug

SEQ ID NO: 3508957 - RNA, 23 nt, Human
agacacuuuggaaguuuguguuc

SEQ ID NO: 3508958 - RNA, 15 nt, Human
agacagaaaaaacug

SEQ ID NO: 3508959 - RNA, 17 nt, Human
agacagaaccuuguuau

SEQ ID NO: 3508960 - RNA, 17 nt, Human
agacagaagcaggcugg

SEQ ID NO: 3508961 - RNA, 12 nt, Human
agacagaaucuc

SEQ ID NO: 3508962 - RNA, 20 nt, Human
agacagaaucucagucuguc

SEQ ID NO: 3508963 - RNA, 14 nt, Human
agacagacacacac

SEQ ID NO: 3508964 - RNA, 19 nt, Human
agacagagaauaugucugc

SEQ ID NO: 3508965 - RNA, 16 nt, Human
agacagagaccuccug

SEQ ID NO: 3508966 - RNA, 21 nt, Human
agacagagaccuccugccucc

SEQ ID NO: 3508967 - RNA, 20 nt, Human
agacagagaggacuguaggg

SEQ ID NO: 3508968 - RNA, 16 nt, Human
agacagagccaggaga

SEQ ID NO: 3508969 - RNA, 20 nt, Human
agacagagccaggagaagcu

SEQ ID NO: 3508970 - RNA, 22 nt, Human
agacagagccccacccucagau

SEQ ID NO: 3508971 - RNA, 24 nt, Human
agacagagccccacccucagaugc

SEQ ID NO: 3508972 - RNA, 19 nt, Human
agacagagcccugugaggc

SEQ ID NO: 3508973 - RNA, 13 nt, Human
agacagagcuaca

SEQ ID NO: 3508974 - RNA, 15 nt, Human
agacagagcuacaca

SEQ ID NO: 3508975 - RNA, 15 nt, Human
agacagagcucacaa

SEQ ID NO: 3508976 - RNA, 15 nt, Human
agacagaggcccuca

SEQ ID NO: 3508977 - RNA, 19 nt, Human
agacagagucucacuguug

SEQ ID NO: 3508978 - RNA, 20 nt, Human
agacagagucucacuguugc

SEQ ID NO: 3508979 - RNA, 19 nt, Human
agacagagucuuacucugu

SEQ ID NO: 3508980 - RNA, 21 nt, Human
agacagauaccuccaacccug

SEQ ID NO: 3508981 - RNA, 23 nt, Human
agacagauaccuccaacccugcc

SEQ ID NO: 3508982 - RNA, 19 nt, Human
agacagaugccccagagcu

SEQ ID NO: 3508983 - RNA, 12 nt, Human
agacagcagcuc

SEQ ID NO: 3508984 - RNA, 14 nt, Human
agacagcaggcagc

SEQ ID NO: 3508985 - RNA, 23 nt, Human
agacagcccaggauacuggcaca

SEQ ID NO: 3508986 - RNA, 18 nt, Human
agacagccccagagcagg

SEQ ID NO: 3508987 - RNA, 16 nt, Human
agacagcccgggcucu

SEQ ID NO: 3508988 - RNA, 13 nt, Human
agacagcccucca

SEQ ID NO: 3508989 - RNA, 11 nt, Human
agacagccugu

SEQ ID NO: 3508990 - RNA, 14 nt, Human
agacagcugccugg

SEQ ID NO: 3508991 - RNA, 15 nt, Human
agacagcugccuggg

SEQ ID NO: 3508992 - RNA, 16 nt, Human
agacagcugccuggga

SEQ ID NO: 3508993 - RNA, 19 nt, Human
agacaggaaaauccucugg

SEQ ID NO: 3508994 - RNA, 15 nt, Human
agacaggaccaggga

SEQ ID NO: 3508995 - RNA, 22 nt, Human
agacaggaccccugcaguuccc

SEQ ID NO: 3508996 - RNA, 15 nt, Human
agacaggagacaaaa

SEQ ID NO: 3508997 - RNA, 23 nt, Human
agacaggagaccuggcacuggau

SEQ ID NO: 3508998 - RNA, 14 nt, Human
agacaggagggcaa

SEQ ID NO: 3508999 - RNA, 19 nt, Human
agacaggagggcaagggcc

SEQ ID NO: 3509000 - RNA, 20 nt, Human
agacaggcaagcaccuccug

SEQ ID NO: 3509001 - RNA, 15 nt, Human
agacaggcucuuagc

SEQ ID NO: 3509002 - RNA, 19 nt, Human
agacagggucaaaguguuu

SEQ ID NO: 3509003 - RNA, 21 nt, Human
agacaggguuuggcugugucu

SEQ ID NO: 3509004 - RNA, 21 nt, Human
agacaggguuuugccauguug

SEQ ID NO: 3509005 - RNA, 22 nt, Human
agacaggucccuccccuucucu

SEQ ID NO: 3509006 - RNA, 18 nt, Human
agacaguauauaacuaac

SEQ ID NO: 3509007 - RNA, 13 nt, Human
agacagucccugc

SEQ ID NO: 3509008 - RNA, 15 nt, Human
agacagucccugcca

SEQ ID NO: 3509009 - RNA, 18 nt, Human
agacaguccuaacaauau

SEQ ID NO: 3509010 - RNA, 14 nt, Human
agacagugaaagaa

SEQ ID NO: 3509011 - RNA, 13 nt, Human
agacagugggaaa

SEQ ID NO: 3509012 - RNA, 14 nt, Human
agacagugggaaau

SEQ ID NO: 3509013 - RNA, 16 nt, Human
agacaguguauguaga

SEQ ID NO: 3509014 - RNA, 17 nt, Human
agacaguguauguagaa

SEQ ID NO: 3509015 - RNA, 21 nt, Human
agacaguguauguagaagcau

SEQ ID NO: 3509016 - RNA, 14 nt, Human
agacaguucaagaa

SEQ ID NO: 3509017 - RNA, 20 nt, Human
agacaguugggugagaacaa

SEQ ID NO: 3509018 - RNA, 14 nt, Human
agacaguuggguuu

SEQ ID NO: 3509019 - RNA, 21 nt, Human
agacaguuucuuagcuuuuua

SEQ ID NO: 3509020 - RNA, 16 nt, Human
agacaguuuguaaaug

SEQ ID NO: 3509021 - RNA, 21 nt, Human
agacaguuuguaaauguuauu

SEQ ID NO: 3509022 - RNA, 21 nt, Human
agacaguuuugagaacguaaa

SEQ ID NO: 3509023 - RNA, 14 nt, Human
agacauaaaggaaa

SEQ ID NO: 3509024 - RNA, 21 nt, Human
agacauaaaggaaaagacaca

SEQ ID NO: 3509025 - RNA, 23 nt, Human
agacauaaaggaaaagacacauu

SEQ ID NO: 3509026 - RNA, 18 nt, Human
agacauaaccacugcuuc

SEQ ID NO: 3509027 - RNA, 18 nt, Human
agacauacgaaacacaaa

SEQ ID NO: 3509028 - RNA, 23 nt, Human
agacauacuaaccagcagaaaug

SEQ ID NO: 3509029 - RNA, 13 nt, Human
agacauacuugaa

SEQ ID NO: 3509030 - RNA, 19 nt, Human
agacauacuugaagggcca

SEQ ID NO: 3509031 - RNA, 21 nt, Human
agacauagaauuaacacauga

SEQ ID NO: 3509032 - RNA, 18 nt, Human
agacauaggccaugaaaa

SEQ ID NO: 3509033 - RNA, 19 nt, Human
agacauaggccaugaaaaa

SEQ ID NO: 3509034 - RNA, 20 nt, Human
agacaucaugaauuuuacau

SEQ ID NO: 3509035 - RNA, 22 nt, Human
agacauccauaaagaagcaaua

SEQ ID NO: 3509036 - RNA, 21 nt, Human
agacauccauguuuguaaaac

SEQ ID NO: 3509037 - RNA, 22 nt, Human
agacauccauguuuguaaaacu

SEQ ID NO: 3509038 - RNA, 16 nt, Human
agacaucucugcaccc

SEQ ID NO: 3509039 - RNA, 14 nt, Human
agacaugaagggaa

SEQ ID NO: 3509040 - RNA, 19 nt, Human
agacauggagacuccugcc

SEQ ID NO: 3509041 - RNA, 15 nt, Human
agacauggagguucu

SEQ ID NO: 3509042 - RNA, 17 nt, Human
agacauggagguucuaa

SEQ ID NO: 3509043 - RNA, 20 nt, Human
agacauggagguucuaaggc

SEQ ID NO: 3509044 - RNA, 21 nt, Human
agacauggagguucuaaggcc

SEQ ID NO: 3509045 - RNA, 22 nt, Human
agacauggcuugccacagcucu

SEQ ID NO: 3509046 - RNA, 20 nt, Human
agacauggcuuucagaaaac

SEQ ID NO: 3509047 - RNA, 12 nt, Human
agacauggggag

SEQ ID NO: 3509048 - RNA, 19 nt, Human
agacauguagguguuuguu

SEQ ID NO: 3509049 - RNA, 22 nt, Human
agacauguagguguuuguucau

SEQ ID NO: 3509050 - RNA, 13 nt, Human
agacaugugacau

SEQ ID NO: 3509051 - RNA, 15 nt, Human
agacauguuuuagac

SEQ ID NO: 3509052 - RNA, 12 nt, Human
agacauuaaauc

SEQ ID NO: 3509053 - RNA, 14 nt, Human
agacauuaaaucua

SEQ ID NO: 3509054 - RNA, 15 nt, Human
agacauuaaaucuau

SEQ ID NO: 3509055 - RNA, 22 nt, Human
agacauuaaaucuaugaaguau

SEQ ID NO: 3509056 - RNA, 18 nt, Human
agacauuccaaaacgaag

SEQ ID NO: 3509057 - RNA, 17 nt, Human
agacauuccugggcaca

SEQ ID NO: 3509058 - RNA, 20 nt, Human
agacauucucgcuucccuga

SEQ ID NO: 3509059 - RNA, 19 nt, Human
agacauucugccaggcccc

SEQ ID NO: 3509060 - RNA, 12 nt, Human
agacauucuguc

SEQ ID NO: 3509061 - RNA, 15 nt, Human
agacauuggcaccua

SEQ ID NO: 3509062 - RNA, 18 nt, Human
agacauugggucuauucc

SEQ ID NO: 3509063 - RNA, 19 nt, Human
agacauugggucuauucca

SEQ ID NO: 3509064 - RNA, 23 nt, Human
agacauugggucuauuccagcuc

SEQ ID NO: 3509065 - RNA, 13 nt, Human
agacauugucaau

SEQ ID NO: 3509066 - RNA, 22 nt, Human
agacauuguuuugccaacauug

SEQ ID NO: 3509067 - RNA, 14 nt, Human
agacauuucuuuuc

SEQ ID NO: 3509068 - RNA, 22 nt, Human
agacauuucuuuucuuuuuaca

SEQ ID NO: 3509069 - RNA, 15 nt, Human
aggaauaaugggcuu

SEQ ID NO: 3509070 - RNA, 18 nt, Human
aggaauaauuauuuauuu

SEQ ID NO: 3509071 - RNA, 22 nt, Human
aggaauaauuauuuauuuaaua

SEQ ID NO: 3509072 - RNA, 15 nt, Human
aggaauaccuguccc

SEQ ID NO: 3509073 - RNA, 18 nt, Human
aggaauaccugucccccu

SEQ ID NO: 3509074 - RNA, 19 nt, Human
aggaauauagauuaaauca

SEQ ID NO: 3509075 - RNA, 17 nt, Human
aggaauauauggcagag

SEQ ID NO: 3509076 - RNA, 23 nt, Human
aggaauauauggcagaguuguaa

SEQ ID NO: 3509077 - RNA, 20 nt, Human
aggaauaugacggaagaaca

SEQ ID NO: 3509078 - RNA, 19 nt, Human
aggaauauuauauuuggau

SEQ ID NO: 3509079 - RNA, 20 nt, Human
aggaauauuauauuuggaug

SEQ ID NO: 3509080 - RNA, 20 nt, Human
agacauuuguuauuuuggaa

SEQ ID NO: 3509081 - RNA, 16 nt, Human
agacauuuuaacaaga

SEQ ID NO: 3509082 - RNA, 20 nt, Human
agacauuuuaacaagaagau

SEQ ID NO: 3509083 - RNA, 21 nt, Human
agacauuuuaacaagaagaug

SEQ ID NO: 3509084 - RNA, 22 nt, Human
agacauuuuuccguuugcuuuu

SEQ ID NO: 3509085 - RNA, 13 nt, Human
agaccaaaauaaa

SEQ ID NO: 3509086 - RNA, 17 nt, Human
agaccaaaaugacaaug

SEQ ID NO: 3509087 - RNA, 18 nt, Human
agaccaaaaugacaauga

SEQ ID NO: 3509088 - RNA, 16 nt, Human
agaccaaacagugcug

SEQ ID NO: 3509089 - RNA, 13 nt, Human
agaccaaacuuca

SEQ ID NO: 3509090 - RNA, 21 nt, Human
agaccaacguuacucagggcu

SEQ ID NO: 3509091 - RNA, 22 nt, Human
agaccaacguuacucagggcuc

SEQ ID NO: 3509092 - RNA, 21 nt, Human
agaccaagauggcccauccug

SEQ ID NO: 3509093 - RNA, 14 nt, Human
agaccaaggaacaa

SEQ ID NO: 3509094 - RNA, 17 nt, Human
agaccaaggcgggagca

SEQ ID NO: 3509095 - RNA, 23 nt, Human
agaccaaggcgggagcaucucuu

SEQ ID NO: 3509096 - RNA, 23 nt, Human
agaccaccagggcaucucugggc

SEQ ID NO: 3509097 - RNA, 12 nt, Human
agaccaccucuc

SEQ ID NO: 3509098 - RNA, 19 nt, Human
agaccacgcccguccugcc

SEQ ID NO: 3509099 - RNA, 14 nt, Human
agaccagagcucug

SEQ ID NO: 3509100 - RNA, 17 nt, Human
agaccagagcucuggag

SEQ ID NO: 3509101 - RNA, 18 nt, Human
agaccagagcucuggagc

SEQ ID NO: 3509102 - RNA, 14 nt, Human
agaccagccuggcc

SEQ ID NO: 3509103 - RNA, 15 nt, Human
agaccagccuggcca

SEQ ID NO: 3509104 - RNA, 19 nt, Human
agaccagccuggccaacau

SEQ ID NO: 3509105 - RNA, 22 nt, Human
agaccagccugggcaacaaagu

SEQ ID NO: 3509106 - RNA, 16 nt, Human
agaccaggcugugucc

SEQ ID NO: 3509107 - RNA, 22 nt, Human
agaccaguugaauaaaagugca

SEQ ID NO: 3509108 - RNA, 18 nt, Human
agaccaguugggagcacu

SEQ ID NO: 3509109 - RNA, 21 nt, Human
agaccaucccugaaggccccg

SEQ ID NO: 3509110 - RNA, 12 nt, Human
agaccauggaca

SEQ ID NO: 3509111 - RNA, 22 nt, Human
agaccauggacacuacacccag

SEQ ID NO: 3509112 - RNA, 20 nt, Human
agaccauguggagacuucau

SEQ ID NO: 3509113 - RNA, 19 nt, Human
agaccauuggggcucccag

SEQ ID NO: 3509114 - RNA, 15 nt, Human
agaccauuuaacaug

SEQ ID NO: 3509115 - RNA, 19 nt, Human
agacccaaaaggcagaagc

SEQ ID NO: 3509116 - RNA, 22 nt, Human
agacccaagcugccuccccucu

SEQ ID NO: 3509117 - RNA, 16 nt, Human
agacccaaggaggaaa

SEQ ID NO: 3509118 - RNA, 17 nt, Human
agacccaccccaccugc

SEQ ID NO: 3509119 - RNA, 21 nt, Human
agacccaccccaccugcaggg

SEQ ID NO: 3509120 - RNA, 17 nt, Human
agacccagcccucaucc

SEQ ID NO: 3509121 - RNA, 14 nt, Human
agacccagcggaca

SEQ ID NO: 3509122 - RNA, 15 nt, Human
agacccauuccuauu

SEQ ID NO: 3509123 - RNA, 16 nt, Human
agacccauuccuauuu

SEQ ID NO: 3509124 - RNA, 15 nt, Human
agacccauuccuucc

SEQ ID NO: 3509125 - RNA, 18 nt, Human
agaccccaagaggaaguu

SEQ ID NO: 3509126 - RNA, 16 nt, Human
agaccccacccaagcu

SEQ ID NO: 3509127 - RNA, 15 nt, Human
agacccccacaccuc

SEQ ID NO: 3509128 - RNA, 13 nt, Human
agacccccacccc

SEQ ID NO: 3509129 - RNA, 17 nt, Human
agacccccaccccuucc

SEQ ID NO: 3509130 - RNA, 23 nt, Human
agacccccccccccaacagaaca

SEQ ID NO: 3509131 - RNA, 24 nt, Human
agaccccuaacccuuugugugcuc

SEQ ID NO: 3509132 - RNA, 21 nt, Human
agaccccucuggccaggaugg

SEQ ID NO: 3509133 - RNA, 12 nt, Human
agaccccuggcc

SEQ ID NO: 3509134 - RNA, 12 nt, Human
agaccccuggcu

SEQ ID NO: 3509135 - RNA, 13 nt, Human
agaccccugucuu

SEQ ID NO: 3509136 - RNA, 15 nt, Human
agacccgaggaaacu

SEQ ID NO: 3509137 - RNA, 17 nt, Human
agacccuaaacauccau

SEQ ID NO: 3509138 - RNA, 20 nt, Human
agacccucaugcugccaaua

SEQ ID NO: 3509139 - RNA, 21 nt, Human
agacccucaugcugccaauau

SEQ ID NO: 3509140 - RNA, 17 nt, Human
agacccucugccaccag

SEQ ID NO: 3509141 - RNA, 20 nt, Human
agacccucuugcccauccug

SEQ ID NO: 3509142 - RNA, 19 nt, Human
agacccugcccugugggcc

SEQ ID NO: 3509143 - RNA, 12 nt, Human
agacccuggagg

SEQ ID NO: 3509144 - RNA, 13 nt, Human
agacccuggagga

SEQ ID NO: 3509145 - RNA, 17 nt, Human
agacccugggugggcuc

SEQ ID NO: 3509146 - RNA, 19 nt, Human
agacccugggugggcucug

SEQ ID NO: 3509147 - RNA, 13 nt, Human
agacccugucucu

SEQ ID NO: 3509148 - RNA, 17 nt, Human
agacccuuauuacacgg

SEQ ID NO: 3509149 - RNA, 13 nt, Human
agacccuuguggu

SEQ ID NO: 3509150 - RNA, 21 nt, Human
agaccgagcgcuuucuggaaa

SEQ ID NO: 3509151 - RNA, 15 nt, Human
agaccgaucggcggc

SEQ ID NO: 3509152 - RNA, 22 nt, Human
agaccgcucucuuuucuguacu

SEQ ID NO: 3509153 - RNA, 12 nt, Human
agaccggaagcu

SEQ ID NO: 3509154 - RNA, 18 nt, Human
agaccggaagcuccuggu

SEQ ID NO: 3509155 - RNA, 15 nt, Human
agaccggccugccag

SEQ ID NO: 3509156 - RNA, 18 nt, Human
agaccggccugccaggag

SEQ ID NO: 3509157 - RNA, 15 nt, Human
agaccguccucaccc

SEQ ID NO: 3509158 - RNA, 18 nt, Human
agaccguccucaccccug

SEQ ID NO: 3509159 - RNA, 20 nt, Human
agaccguccucaccccuguc

SEQ ID NO: 3509160 - RNA, 16 nt, Human
agaccgucuuccucca

SEQ ID NO: 3509161 - RNA, 19 nt, Human
agaccuaacgagaaauaga

SEQ ID NO: 3509162 - RNA, 14 nt, Human
agaccuacaggcug

SEQ ID NO: 3509163 - RNA, 21 nt, Human
agaccuacagggggucuggcu

SEQ ID NO: 3509164 - RNA, 18 nt, Human
agaccuacuguucuaaag

SEQ ID NO: 3509165 - RNA, 22 nt, Human
agaccuacuguucuaaagcucu

SEQ ID NO: 3509166 - RNA, 14 nt, Human
agaccuagggagga

SEQ ID NO: 3509167 - RNA, 15 nt, Human
agaccuagggaggac

SEQ ID NO: 3509168 - RNA, 16 nt, Human
agaccuauguaagaau

SEQ ID NO: 3509169 - RNA, 16 nt, Human
agaccuauuugacaua

SEQ ID NO: 3509170 - RNA, 18 nt, Human
agaccucagccaugagga

SEQ ID NO: 3509171 - RNA, 18 nt, Human
agaccucagugccuuccu

SEQ ID NO: 3509172 - RNA, 15 nt, Human
agaccucaucaggau

SEQ ID NO: 3509173 - RNA, 17 nt, Human
agaccuccccagccccu

SEQ ID NO: 3509174 - RNA, 23 nt, Human
agaccuccccagccccuagccca

SEQ ID NO: 3509175 - RNA, 15 nt, Human
agaccugaauucuuu

SEQ ID NO: 3509176 - RNA, 18 nt, Human
agaccugacucaggcauc

SEQ ID NO: 3509177 - RNA, 14 nt, Human
agaccugauccugg

SEQ ID NO: 3509178 - RNA, 22 nt, Human
agaccugauccuggaggcccag

SEQ ID NO: 3509179 - RNA, 16 nt, Human
agaccugccccuccuc

SEQ ID NO: 3509180 - RNA, 20 nt, Human
agaccugcugagggaccagc

SEQ ID NO: 3509181 - RNA, 19 nt, Human
agaccugcuuuuugaaaug

SEQ ID NO: 3509182 - RNA, 20 nt, Human
agaccugcuuuuugaaauga

SEQ ID NO: 3509183 - RNA, 22 nt, Human
agaccugcuuuuugaaaugaaa

SEQ ID NO: 3509184 - RNA, 14 nt, Human
agaccugucuccug

SEQ ID NO: 3509185 - RNA, 15 nt, Human
agaccugucuccugg

SEQ ID NO: 3509186 - RNA, 13 nt, Human
agaccuuccauaa

SEQ ID NO: 3509187 - RNA, 18 nt, Human
agaccuucuaggacgcca

SEQ ID NO: 3509188 - RNA, 18 nt, Human
agaccuucuccaaaugag

SEQ ID NO: 3509189 - RNA, 19 nt, Human
agaccuucuccaaaugaga

SEQ ID NO: 3509190 - RNA, 15 nt, Human
agaccuucuccuuca

SEQ ID NO: 3509191 - RNA, 21 nt, Human
agaccuucuccuucaccuuug

SEQ ID NO: 3509192 - RNA, 23 nt, Human
agaccuucuccuucaccuuuguc

SEQ ID NO: 3509193 - RNA, 15 nt, Human
agaccuuguguguau

SEQ ID NO: 3509194 - RNA, 18 nt, Human
agaccuuguuacuucuga

SEQ ID NO: 3509195 - RNA, 19 nt, Human
agaccuuguuacuucugag

SEQ ID NO: 3509196 - RNA, 21 nt, Human
agaccuuguucacacucucac

SEQ ID NO: 3509197 - RNA, 12 nt, Human
agaccuuuucaa

SEQ ID NO: 3509198 - RNA, 14 nt, Human
agaccuuuuuuagg

SEQ ID NO: 3509199 - RNA, 21 nt, Human
agaccuuuuuuuuuuuuccaa

SEQ ID NO: 3509200 - RNA, 18 nt, Human
agacgaaacauuuguucu

SEQ ID NO: 3509201 - RNA, 21 nt, Human
agacgacaaggaaaggcaaau

SEQ ID NO: 3509202 - RNA, 13 nt, Human
agacgacaggcga

SEQ ID NO: 3509203 - RNA, 23 nt, Human
agacgaggcccucgggcccagcc

SEQ ID NO: 3509204 - RNA, 20 nt, Human
agacgccaccauuccuggaa

SEQ ID NO: 3509205 - RNA, 13 nt, Human
agacgccugagga

SEQ ID NO: 3509206 - RNA, 13 nt, Human
agacgccuggcug

SEQ ID NO: 3509207 - RNA, 14 nt, Human
agacgccuuacugg

SEQ ID NO: 3509208 - RNA, 15 nt, Human
agacgcugcugucac

SEQ ID NO: 3509209 - RNA, 16 nt, Human
agacgcugugcugccc

SEQ ID NO: 3509210 - RNA, 22 nt, Human
agacgcugugcugcccugccca

SEQ ID NO: 3509211 - RNA, 20 nt, Human
agacggaaggguaaacaaua

SEQ ID NO: 3509212 - RNA, 22 nt, Human
agacggagcccuggcaugucaa

SEQ ID NO: 3509213 - RNA, 19 nt, Human
agacggagucccaccuugg

SEQ ID NO: 3509214 - RNA, 15 nt, Human
agacggagucucgcu

SEQ ID NO: 3509215 - RNA, 14 nt, Human
agacggauugcauu

SEQ ID NO: 3509216 - RNA, 13 nt, Human
agacggggcugga

SEQ ID NO: 3509217 - RNA, 19 nt, Human
agacgguucaccagccucu

SEQ ID NO: 3509218 - RNA, 17 nt, Human
agacgugauuuugcugu

SEQ ID NO: 3509219 - RNA, 21 nt, Human
agacgugcacgcacacugucu

SEQ ID NO: 3509220 - RNA, 22 nt, Human
agacgugcacgcacacugucug

SEQ ID NO: 3509221 - RNA, 14 nt, Human
agacguguuugugu

SEQ ID NO: 3509222 - RNA, 16 nt, Human
agacguuuauaaacag

SEQ ID NO: 3509223 - RNA, 12 nt, Human
agacuaaaagau

SEQ ID NO: 3509224 - RNA, 14 nt, Human
aggaagccucagau

SEQ ID NO: 3509225 - RNA, 22 nt, Human
aggaagccucagauuccuuccc

SEQ ID NO: 3509226 - RNA, 18 nt, Human
aggaagccugauuaaaga

SEQ ID NO: 3509227 - RNA, 16 nt, Human
aggaagcucagacugg

SEQ ID NO: 3509228 - RNA, 20 nt, Human
aggaagcucagacugguuga

SEQ ID NO: 3509229 - RNA, 14 nt, Human
aggaagcucagggc

SEQ ID NO: 3509230 - RNA, 22 nt, Human
aggaagcuccaguccugcucuc

SEQ ID NO: 3509231 - RNA, 17 nt, Human
aggaagcugcuccgugc

SEQ ID NO: 3509232 - RNA, 20 nt, Human
aggaagcuuucucugcuuca

SEQ ID NO: 3509233 - RNA, 22 nt, Human
aggaagcuuuggugagaaccug

SEQ ID NO: 3509234 - RNA, 18 nt, Human
aggaaggaaacccagcuc

SEQ ID NO: 3509235 - RNA, 15 nt, Human
aggaaggagagccug

SEQ ID NO: 3509236 - RNA, 12 nt, Human
aggaaggagcug

SEQ ID NO: 3509237 - RNA, 15 nt, Human
aggaaggagcugccu

SEQ ID NO: 3509238 - RNA, 16 nt, Human
aggaaggagcugccug

SEQ ID NO: 3509239 - RNA, 22 nt, Human
aggagccugcuggucacagccu

SEQ ID NO: 3509240 - RNA, 14 nt, Human
aggagccugugaca

SEQ ID NO: 3509241 - RNA, 19 nt, Human
aggagccuuuuuaaaacac

SEQ ID NO: 3509242 - RNA, 14 nt, Human
aggagcgagcaugu

SEQ ID NO: 3509243 - RNA, 13 nt, Human
aggagcgcaagau

SEQ ID NO: 3509244 - RNA, 17 nt, Human
aggagcgcaagauagau

SEQ ID NO: 3509245 - RNA, 21 nt, Human
aggagcuaaggcucuaugagu

SEQ ID NO: 3509246 - RNA, 17 nt, Human
aggagcuaccugugugg

SEQ ID NO: 3509247 - RNA, 23 nt, Human
aggagcucacuguggugucugug

SEQ ID NO: 3509248 - RNA, 14 nt, Human
aggagcuccagugu

SEQ ID NO: 3509249 - RNA, 15 nt, Human
aggagcuccccuccc

SEQ ID NO: 3509250 - RNA, 13 nt, Human
aggagcugagaau

SEQ ID NO: 3509251 - RNA, 15 nt, Human
aggagcugauacuuu

SEQ ID NO: 3509252 - RNA, 14 nt, Human
aggagcugcccaga

SEQ ID NO: 3509253 - RNA, 18 nt, Human
aggagcugccuuggcuca

SEQ ID NO: 3509254 - RNA, 22 nt, Human
aggagcugccuuggcucagaca

SEQ ID NO: 3509255 - RNA, 16 nt, Human
aggagcugcuggcuug

SEQ ID NO: 3509256 - RNA, 17 nt, Human
aggagcugcuggcuugc

SEQ ID NO: 3509257 - RNA, 18 nt, Human
aggagcugggagccgggc

SEQ ID NO: 3509258 - RNA, 18 nt, Human
aggagcugggauccuaag

SEQ ID NO: 3509259 - RNA, 13 nt, Human
aggagcugggccc

SEQ ID NO: 3509260 - RNA, 20 nt, Human
aggagcuggggaucccuccc

SEQ ID NO: 3509261 - RNA, 17 nt, Human
aggagcuuaccucccac

SEQ ID NO: 3509262 - RNA, 14 nt, Human
aggagcuucugggg

SEQ ID NO: 3509263 - RNA, 23 nt, Human
aggagcuuugacucaggagccug

SEQ ID NO: 3509264 - RNA, 21 nt, Human
aggaggaauaagcucccaggg

SEQ ID NO: 3509265 - RNA, 15 nt, Human
aggaggaauacugaa

SEQ ID NO: 3509266 - RNA, 17 nt, Human
aggaggaaugcuggacu

SEQ ID NO: 3509267 - RNA, 13 nt, Human
aggaggacaauuc

SEQ ID NO: 3509268 - RNA, 14 nt, Human
aggaggacaauuca

SEQ ID NO: 3509269 - RNA, 14 nt, Human
aggaggacccagga

SEQ ID NO: 3509270 - RNA, 13 nt, Human
aggaggagccugu

SEQ ID NO: 3509271 - RNA, 16 nt, Human
aggaggagcuucuggg

SEQ ID NO: 3509272 - RNA, 23 nt, Human
aggaggagggucggugccuucaa

SEQ ID NO: 3509273 - RNA, 21 nt, Human
aggaggagguuuaggucaaga

SEQ ID NO: 3509274 - RNA, 20 nt, Human
aggaggaugucccugggcca

SEQ ID NO: 3509275 - RNA, 20 nt, Human
aggaggauugcuugagccca

SEQ ID NO: 3509276 - RNA, 18 nt, Human
aggaggcaccuacacuca

SEQ ID NO: 3509277 - RNA, 20 nt, Human
aggaggcagaaagcagaggc

SEQ ID NO: 3509278 - RNA, 12 nt, Human
aggaggccaccu

SEQ ID NO: 3509279 - RNA, 14 nt, Human
aggaggccaccucc

SEQ ID NO: 3509280 - RNA, 15 nt, Human
aggaggccagccuug

SEQ ID NO: 3509281 - RNA, 12 nt, Human
aggaggccccug

SEQ ID NO: 3509282 - RNA, 18 nt, Human
aggaggccccuggcccag

SEQ ID NO: 3509283 - RNA, 20 nt, Human
aggaggcucaacaauaaaac

SEQ ID NO: 3509284 - RNA, 12 nt, Human
aggaggcuccag

SEQ ID NO: 3509285 - RNA, 13 nt, Human
aggaggcuccaga

SEQ ID NO: 3509286 - RNA, 18 nt, Human
aggaggcuccagagggca

SEQ ID NO: 3509287 - RNA, 18 nt, Human
aggaggcuccaggcagca

SEQ ID NO: 3509288 - RNA, 16 nt, Human
aggaggcuggaggaag

SEQ ID NO: 3509289 - RNA, 21 nt, Human
aggaggcuggaggaagggggg

SEQ ID NO: 3509290 - RNA, 14 nt, Human
aggaggcuggcugg

SEQ ID NO: 3509291 - RNA, 13 nt, Human
aggaggcuggcuu

SEQ ID NO: 3509292 - RNA, 21 nt, Human
aggaggcugggacgcucugcu

SEQ ID NO: 3509293 - RNA, 20 nt, Human
aggaggcuuggaaagcauca

SEQ ID NO: 3509294 - RNA, 14 nt, Human
aggagggacaaagg

SEQ ID NO: 3509295 - RNA, 21 nt, Human
aggagggacaaaggagccugu

SEQ ID NO: 3509296 - RNA, 19 nt, Human
aggagggacagucucacca

SEQ ID NO: 3509297 - RNA, 15 nt, Human
aggagggagagggag

SEQ ID NO: 3509298 - RNA, 22 nt, Human
aggagggaggcaggggaggggu

SEQ ID NO: 3509299 - RNA, 22 nt, Human
aggagggcgugacucacccaag

SEQ ID NO: 3509300 - RNA, 21 nt, Human
aggagggcguucuuaggcugc

SEQ ID NO: 3509301 - RNA, 19 nt, Human
aggaggggaaaaaaauguu

SEQ ID NO: 3509302 - RNA, 16 nt, Human
aggaggggaagcugca

SEQ ID NO: 3509303 - RNA, 21 nt, Human
aggaggggccccccugcccug

SEQ ID NO: 3509304 - RNA, 13 nt, Human
aggaggggccgcu

SEQ ID NO: 3509305 - RNA, 16 nt, Human
aggaggggcuguaaaa

SEQ ID NO: 3509306 - RNA, 19 nt, Human
aggagggggccgggcgcgg

SEQ ID NO: 3509307 - RNA, 14 nt, Human
aggaggggggaggg

SEQ ID NO: 3509308 - RNA, 23 nt, Human
aggaggggggagggaagggagcc

SEQ ID NO: 3509309 - RNA, 15 nt, Human
aggaggguacagcug

SEQ ID NO: 3509310 - RNA, 17 nt, Human
aggaggguacagcuggg

SEQ ID NO: 3509311 - RNA, 18 nt, Human
aggaggguacagcugggc

SEQ ID NO: 3509312 - RNA, 16 nt, Human
aggagggucggugccu

SEQ ID NO: 3509313 - RNA, 17 nt, Human
aggagggucggugccuu

SEQ ID NO: 3509314 - RNA, 21 nt, Human
aggagggucggugccuucaag

SEQ ID NO: 3509315 - RNA, 15 nt, Human
aggagggucuagagg

SEQ ID NO: 3509316 - RNA, 20 nt, Human
aggagggucuagaggccuga

SEQ ID NO: 3509317 - RNA, 13 nt, Human
aggaggguggggg

SEQ ID NO: 3509318 - RNA, 18 nt, Human
aggaggguuagggagggg

SEQ ID NO: 3509319 - RNA, 14 nt, Human
aggaggucucuaag

SEQ ID NO: 3509320 - RNA, 13 nt, Human
aggaggugaggga

SEQ ID NO: 3509321 - RNA, 21 nt, Human
aggagguggcagcccuguagg

SEQ ID NO: 3509322 - RNA, 15 nt, Human
aggaggugucucagg

SEQ ID NO: 3509323 - RNA, 20 nt, Human
aggaggugucucaggcugcc

SEQ ID NO: 3509324 - RNA, 13 nt, Human
aggaggugugagg

SEQ ID NO: 3509325 - RNA, 14 nt, Human
aggagguuuggaug

SEQ ID NO: 3509326 - RNA, 16 nt, Human
aggaguaaaauucagu

SEQ ID NO: 3509327 - RNA, 21 nt, Human
aggaguaaaauucaguuuuuu

SEQ ID NO: 3509328 - RNA, 11 nt, Human
aggaguaacaa

SEQ ID NO: 3509329 - RNA, 14 nt, Human
aggaguagcugagc

SEQ ID NO: 3509330 - RNA, 17 nt, Human
aggagucacugagacca

SEQ ID NO: 3509331 - RNA, 22 nt, Human
aggaguccaggccauggaggca

SEQ ID NO: 3509332 - RNA, 17 nt, Human
aggagucccaaggaaag

SEQ ID NO: 3509333 - RNA, 22 nt, Human
aggagucccacuccaagccagc

SEQ ID NO: 3509334 - RNA, 19 nt, Human
aggagucugagguccugag

SEQ ID NO: 3509335 - RNA, 22 nt, Human
aggagucugagguccugagcac

SEQ ID NO: 3509336 - RNA, 23 nt, Human
aggagucugagguccugagcacu

SEQ ID NO: 3509337 - RNA, 23 nt, Human
aggagugaaaccuuuagggcagc

SEQ ID NO: 3509338 - RNA, 21 nt, Human
aggagugagaucauuuucuua

SEQ ID NO: 3509339 - RNA, 22 nt, Human
aggagugaggaaggcaggaaga

SEQ ID NO: 3509340 - RNA, 18 nt, Human
aggaguggaggaggccug

SEQ ID NO: 3509341 - RNA, 21 nt, Human
aggagugggaaaacacugcca

SEQ ID NO: 3509342 - RNA, 22 nt, Human
aggaguggguggggaguggggg

SEQ ID NO: 3509343 - RNA, 16 nt, Human
aggaguguggccacgu

SEQ ID NO: 3509344 - RNA, 16 nt, Human
aggaguuaagaguagc

SEQ ID NO: 3509345 - RNA, 17 nt, Human
aggaguuagaggccagc

SEQ ID NO: 3509346 - RNA, 20 nt, Human
aggaguuagaggccagccug

SEQ ID NO: 3509347 - RNA, 12 nt, Human
aggaguucaaug

SEQ ID NO: 3509348 - RNA, 18 nt, Human
aggaguucaaugaucuag

SEQ ID NO: 3509349 - RNA, 23 nt, Human
aggaguucagggucauagcaugc

SEQ ID NO: 3509350 - RNA, 15 nt, Human
aggaguuccuaacca

SEQ ID NO: 3509351 - RNA, 17 nt, Human
aggaguucgaggcugca

SEQ ID NO: 3509352 - RNA, 15 nt, Human
aggaguucugcucau

SEQ ID NO: 3509353 - RNA, 19 nt, Human
aggaguuucgagguagagu

SEQ ID NO: 3509354 - RNA, 18 nt, Human
aggaguuucguuuucaaa

SEQ ID NO: 3509355 - RNA, 22 nt, Human
aggaguuucuuuagcugacaga

SEQ ID NO: 3509356 - RNA, 16 nt, Human
aggaguuugagaccag

SEQ ID NO: 3509357 - RNA, 18 nt, Human
aggaguuuggccagaagu

SEQ ID NO: 3509358 - RNA, 15 nt, Human
aggaguuuugcaaag

SEQ ID NO: 3509359 - RNA, 12 nt, Human
aggauaaaauaa

SEQ ID NO: 3509360 - RNA, 18 nt, Human
aggauaauuagcaucuca

SEQ ID NO: 3509361 - RNA, 21 nt, Human
aggauacaugugccgaaugug

SEQ ID NO: 3509362 - RNA, 15 nt, Human
aggauaccauauaca

SEQ ID NO: 3509363 - RNA, 22 nt, Human
aggauaccauauacagcucaga

SEQ ID NO: 3509364 - RNA, 18 nt, Human
aggauacuggcacagagg

SEQ ID NO: 3509365 - RNA, 18 nt, Human
aggauacuguaacacuuu

SEQ ID NO: 3509366 - RNA, 14 nt, Human
aggauagagacugg

SEQ ID NO: 3509367 - RNA, 16 nt, Human
aggauagauaacucuu

SEQ ID NO: 3509368 - RNA, 21 nt, Human
aggauagaugcuggcccaggg

SEQ ID NO: 3509369 - RNA, 17 nt, Human
aggaugucccugggcca

SEQ ID NO: 3509370 - RNA, 21 nt, Human
aggaugucccugggccagggu

SEQ ID NO: 3509371 - RNA, 23 nt, Human
aggaugucccugggccagggucu

SEQ ID NO: 3509372 - RNA, 21 nt, Human
aggaugugauauauaagugua

SEQ ID NO: 3509373 - RNA, 20 nt, Human
aggaugugauuguggaaugg

SEQ ID NO: 3509374 - RNA, 16 nt, Human
aggaugugcugcagug

SEQ ID NO: 3509375 - RNA, 15 nt, Human
aggaugugggcagcu

SEQ ID NO: 3509376 - RNA, 14 nt, Human
aggaugugugcaug

SEQ ID NO: 3509377 - RNA, 16 nt, Human
aggaugugugcaugug

SEQ ID NO: 3509378 - RNA, 13 nt, Human
aggauguguuugc

SEQ ID NO: 3509379 - RNA, 18 nt, Human
aggauguguuugcuuucu

SEQ ID NO: 3509380 - RNA, 15 nt, Human
aggauguucugggac

SEQ ID NO: 3509381 - RNA, 20 nt, Human
aggauguucugggacacagu

SEQ ID NO: 3509382 - RNA, 14 nt, Human
aggauguuuuucau

SEQ ID NO: 3509383 - RNA, 16 nt, Human
aggauuacaugcaugu

SEQ ID NO: 3509384 - RNA, 15 nt, Human
aggauuaguuuagaa

SEQ ID NO: 3509385 - RNA, 16 nt, Human
aggauuaguuuagaac

SEQ ID NO: 3509386 - RNA, 15 nt, Human
aggauuauggaaaaa

SEQ ID NO: 3509387 - RNA, 13 nt, Human
aggauuauugaua

SEQ ID NO: 3509388 - RNA, 17 nt, Human
aggauucacaccccacc

SEQ ID NO: 3509389 - RNA, 16 nt, Human
aggauucagccggagg

SEQ ID NO: 3509390 - RNA, 19 nt, Human
aggauuccucuuuucucug

SEQ ID NO: 3509391 - RNA, 12 nt, Human
aggauucuuccu

SEQ ID NO: 3509392 - RNA, 16 nt, Human
aggauucuuccucccu

SEQ ID NO: 3509393 - RNA, 22 nt, Human
aggauugaagagcauugcaugg

SEQ ID NO: 3509394 - RNA, 21 nt, Human
aggauugcgagagaugugugu

SEQ ID NO: 3509395 - RNA, 18 nt, Human
aggauugcuugagcccag

SEQ ID NO: 3509396 - RNA, 13 nt, Human
aggauuguaaaaa

SEQ ID NO: 3509397 - RNA, 20 nt, Human
aggauuguugaaucuauuuc

SEQ ID NO: 3509398 - RNA, 15 nt, Human
aggauuuaaaaacug

SEQ ID NO: 3509399 - RNA, 19 nt, Human
aggauuuaaaaacuggaac

SEQ ID NO: 3509400 - RNA, 17 nt, Human
aggauuuauuuaaaaua

SEQ ID NO: 3509401 - RNA, 16 nt, Human
aggauuucaagccugc

SEQ ID NO: 3509402 - RNA, 13 nt, Human
aggauuucguggg

SEQ ID NO: 3509403 - RNA, 23 nt, Human
aggauuugcacagaagcacaugc

SEQ ID NO: 3509404 - RNA, 17 nt, Human
aggauuuuaugcuuuaa

SEQ ID NO: 3509405 - RNA, 21 nt, Human
aggauuuuggauguugagagg

SEQ ID NO: 3509406 - RNA, 15 nt, Human
aggcaaaaacaaaga

SEQ ID NO: 3509407 - RNA, 17 nt, Human
aggcaaaauugcaaauc

SEQ ID NO: 3509408 - RNA, 19 nt, Human
aggcaaacauuuucucuua

SEQ ID NO: 3509409 - RNA, 19 nt, Human
aggcaaaggguccagaagg

SEQ ID NO: 3509410 - RNA, 20 nt, Human
aggcaaaggguccagaagga

SEQ ID NO: 3509411 - RNA, 22 nt, Human
aggcaaauuugcauuaaauuac

SEQ ID NO: 3509412 - RNA, 19 nt, Human
aggcaacaguuugacauuu

SEQ ID NO: 3509413 - RNA, 17 nt, Human
aggcaacugaggcagac

SEQ ID NO: 3509414 - RNA, 19 nt, Human
aggcaacuucaguccuggg

SEQ ID NO: 3509415 - RNA, 16 nt, Human
aggcaacuugggaacu

SEQ ID NO: 3509416 - RNA, 17 nt, Human
aggcaagagggggugga

SEQ ID NO: 3509417 - RNA, 18 nt, Human
aggcaagcaccuccugcc

SEQ ID NO: 3509418 - RNA, 19 nt, Human
aggcaagcaccuccugccu

SEQ ID NO: 3509419 - RNA, 21 nt, Human
aggcaagcugaaauuuuagaa

SEQ ID NO: 3509420 - RNA, 15 nt, Human
aggcaaggcaggugc

SEQ ID NO: 3509421 - RNA, 22 nt, Human
aggcaaggcuguggaccaugga

SEQ ID NO: 3509422 - RNA, 19 nt, Human
aggcaaggggugccuggga

SEQ ID NO: 3509423 - RNA, 13 nt, Human
aggcaaggucugg

SEQ ID NO: 3509424 - RNA, 15 nt, Human
aggcaaguuucuagc

SEQ ID NO: 3509425 - RNA, 19 nt, Human
aggcaaugucaggaacaga

SEQ ID NO: 3509426 - RNA, 23 nt, Human
aggcaaugucaggaacagaagga

SEQ ID NO: 3509427 - RNA, 21 nt, Human
aggcaauuagacacuuuggaa

SEQ ID NO: 3509428 - RNA, 19 nt, Human
aggcacacaaggggcccuu

SEQ ID NO: 3509429 - RNA, 21 nt, Human
aggcacacacugugcuuucua

SEQ ID NO: 3509430 - RNA, 11 nt, Human
aggcacacagc

SEQ ID NO: 3509431 - RNA, 15 nt, Human
aggcacacagcuacu

SEQ ID NO: 3509432 - RNA, 15 nt, Human
aggcacacuucuucu

SEQ ID NO: 3509433 - RNA, 14 nt, Human
aggcacagcaaacu

SEQ ID NO: 3509434 - RNA, 12 nt, Human
aggcacagcaca

SEQ ID NO: 3509435 - RNA, 20 nt, Human
aggcacagccggggccugcc

SEQ ID NO: 3509436 - RNA, 13 nt, Human
aggcacagcugag

SEQ ID NO: 3509437 - RNA, 15 nt, Human
aggcacaggaugcug

SEQ ID NO: 3509438 - RNA, 13 nt, Human
aggcacaggcagg

SEQ ID NO: 3509439 - RNA, 15 nt, Human
aggcacagggagaag

SEQ ID NO: 3509440 - RNA, 22 nt, Human
aggcacaggucaggggugacac

SEQ ID NO: 3509441 - RNA, 17 nt, Human
aggcacagugaaggcug

SEQ ID NO: 3509442 - RNA, 18 nt, Human
aggcacauggaauauauu

SEQ ID NO: 3509443 - RNA, 17 nt, Human
aggcacauggaggagcu

SEQ ID NO: 3509444 - RNA, 18 nt, Human
aggcaccaaaagaaguaa

SEQ ID NO: 3509445 - RNA, 22 nt, Human
agagcuuucuucccgaacccca

SEQ ID NO: 3509446 - RNA, 14 nt, Human
agagcuuucuuuca

SEQ ID NO: 3509447 - RNA, 15 nt, Human
agagcuuuucagauu

SEQ ID NO: 3509448 - RNA, 13 nt, Human
agaggaaaaauau

SEQ ID NO: 3509449 - RNA, 14 nt, Human
agaggaaaagaaau

SEQ ID NO: 3509450 - RNA, 18 nt, Human
agaggaaaaguaaggugc

SEQ ID NO: 3509451 - RNA, 22 nt, Human
agaggaaaaguaaggugcaguu

SEQ ID NO: 3509452 - RNA, 16 nt, Human
agaggaaagcaaagga

SEQ ID NO: 3509453 - RNA, 14 nt, Human
agaggaaauaagaa

SEQ ID NO: 3509454 - RNA, 12 nt, Human
agaggaaaucac

SEQ ID NO: 3509455 - RNA, 21 nt, Human
agaggaacagcacuggggagu

SEQ ID NO: 3509456 - RNA, 13 nt, Human
agaggaacugggc

SEQ ID NO: 3509457 - RNA, 17 nt, Human
agaggaacuguccagag

SEQ ID NO: 3509458 - RNA, 18 nt, Human
agaggaacuguccagaga

SEQ ID NO: 3509459 - RNA, 22 nt, Human
agaggaagaauuuguuaucagu

SEQ ID NO: 3509460 - RNA, 16 nt, Human
agaggaaggagaggag

SEQ ID NO: 3509461 - RNA, 20 nt, Human
agaggaaggggccagaggcu

SEQ ID NO: 3509462 - RNA, 16 nt, Human
agaggaaguucagauc

SEQ ID NO: 3509463 - RNA, 18 nt, Human
agaggaaguucagaucuu

SEQ ID NO: 3509464 - RNA, 22 nt, Human
agaggaaucacucuuguggaug

SEQ ID NO: 3509465 - RNA, 19 nt, Human
agaggaauccaugaagaau

SEQ ID NO: 3509466 - RNA, 15 nt, Human
agaggaauccuggca

SEQ ID NO: 3509467 - RNA, 13 nt, Human
agaggaaugaaaa

SEQ ID NO: 3509468 - RNA, 16 nt, Human
agaggacaagggaaau

SEQ ID NO: 3509469 - RNA, 23 nt, Human
agaggacagaucaauggcgcagu

SEQ ID NO: 3509470 - RNA, 20 nt, Human
agaggacaguauuugugggg

SEQ ID NO: 3509471 - RNA, 15 nt, Human
agaggaccagggccu

SEQ ID NO: 3509472 - RNA, 15 nt, Human
agaggaccagugagu

SEQ ID NO: 3509473 - RNA, 13 nt, Human
agaggacccccug

SEQ ID NO: 3509474 - RNA, 15 nt, Human
agaggaccggcggcu

SEQ ID NO: 3509475 - RNA, 22 nt, Human
agaggaccuguauuuaagcaaa

SEQ ID NO: 3509476 - RNA, 14 nt, Human
agaggacgggaggc

SEQ ID NO: 3509477 - RNA, 16 nt, Human
agaggacgugggcggc

SEQ ID NO: 3509478 - RNA, 18 nt, Human
agaggacucgcuuguaaa

SEQ ID NO: 3509479 - RNA, 23 nt, Human
agaggacucgcuuguaaauacca

SEQ ID NO: 3509480 - RNA, 15 nt, Human
agaggagaaacacau

SEQ ID NO: 3509481 - RNA, 12 nt, Human
agaggagagagg

SEQ ID NO: 3509482 - RNA, 16 nt, Human
agaggagagaggaccc

SEQ ID NO: 3509483 - RNA, 12 nt, Human
agaggagagcca

SEQ ID NO: 3509484 - RNA, 13 nt, Human
agaggagagccag

SEQ ID NO: 3509485 - RNA, 23 nt, Human
agaggagagccagagaagugaca

SEQ ID NO: 3509486 - RNA, 12 nt, Human
agaggagaggag

SEQ ID NO: 3509487 - RNA, 15 nt, Human
agaggagaggagaga

SEQ ID NO: 3509488 - RNA, 16 nt, Human
agaggagaggagagag

SEQ ID NO: 3509489 - RNA, 12 nt, Human
agaggagccaga

SEQ ID NO: 3509490 - RNA, 15 nt, Human
agaggagccagacag

SEQ ID NO: 3509491 - RNA, 17 nt, Human
agaggagccagacagac

SEQ ID NO: 3509492 - RNA, 23 nt, Human
agaggagcccccacccuguuccu

SEQ ID NO: 3509493 - RNA, 14 nt, Human
agaggagccuuuuu

SEQ ID NO: 3509494 - RNA, 23 nt, Human
agaggagccuuuuuaaaacacau

SEQ ID NO: 3509495 - RNA, 19 nt, Human
agaggagcgggaccugugg

SEQ ID NO: 3509496 - RNA, 20 nt, Human
agaggagcgggaccuguggc

SEQ ID NO: 3509497 - RNA, 20 nt, Human
agaggagcugggagccgggc

SEQ ID NO: 3509498 - RNA, 14 nt, Human
agaggaggaggagg

SEQ ID NO: 3509499 - RNA, 16 nt, Human
agaggaggcagcagga

SEQ ID NO: 3509500 - RNA, 23 nt, Human
agaggagggagcaucagugcccu

SEQ ID NO: 3509501 - RNA, 19 nt, Human
agaggagggcgugacucac

SEQ ID NO: 3509502 - RNA, 22 nt, Human
agaggaggggccgcugccaccc

SEQ ID NO: 3509503 - RNA, 20 nt, Human
agaggaguacaggugaagca

SEQ ID NO: 3509504 - RNA, 14 nt, Human
agaggagucagaga

SEQ ID NO: 3509505 - RNA, 22 nt, Human
agaggagugcguggcccaccag

SEQ ID NO: 3509506 - RNA, 12 nt, Human
agaggaguucaa

SEQ ID NO: 3509507 - RNA, 14 nt, Human
agaggaguucaaug

SEQ ID NO: 3509508 - RNA, 17 nt, Human
agaggaguucaaugauc

SEQ ID NO: 3509509 - RNA, 23 nt, Human
agaggaguucaaugaucuagguu

SEQ ID NO: 3509510 - RNA, 20 nt, Human
agaggaugaauguaugugca

SEQ ID NO: 3509511 - RNA, 13 nt, Human
agaggaugagagc

SEQ ID NO: 3509512 - RNA, 19 nt, Human
agaggaugucucaaacuuc

SEQ ID NO: 3509513 - RNA, 13 nt, Human
agaggaugugcaa

SEQ ID NO: 3509514 - RNA, 16 nt, Human
aggcagccagcaucug

SEQ ID NO: 3509515 - RNA, 14 nt, Human
aggcagccaggcca

SEQ ID NO: 3509516 - RNA, 14 nt, Human
aggcagccagggcu

SEQ ID NO: 3509517 - RNA, 18 nt, Human
aggcagccagugcccuga

SEQ ID NO: 3509518 - RNA, 22 nt, Human
aggcagccagugcccugagcca

SEQ ID NO: 3509519 - RNA, 19 nt, Human
aggcagccccauucugccu

SEQ ID NO: 3509520 - RNA, 13 nt, Human
aggcagccuccag

SEQ ID NO: 3509521 - RNA, 21 nt, Human
aggcagccuccagccugccca

SEQ ID NO: 3509522 - RNA, 13 nt, Human
aggcagccucugg

SEQ ID NO: 3509523 - RNA, 21 nt, Human
aggcagccucugggggguggc

SEQ ID NO: 3509524 - RNA, 20 nt, Human
aggcagccucugucaggccu

SEQ ID NO: 3509525 - RNA, 21 nt, Human
aggcagccucugucaggccuu

SEQ ID NO: 3509526 - RNA, 14 nt, Human
aggcagcgccaagc

SEQ ID NO: 3509527 - RNA, 20 nt, Human
aggcagcgccaagcaaccug

SEQ ID NO: 3509528 - RNA, 18 nt, Human
aggcagcuggaugagacu

SEQ ID NO: 3509529 - RNA, 19 nt, Human
aggcaggacaugcugaagc

SEQ ID NO: 3509530 - RNA, 21 nt, Human
aggcaggacaugcugaagcca

SEQ ID NO: 3509531 - RNA, 15 nt, Human
aggcaggagacuggc

SEQ ID NO: 3509532 - RNA, 19 nt, Human
aggcaggauuggggaagag

SEQ ID NO: 3509533 - RNA, 23 nt, Human
aggcaggauuggggaagagagcc

SEQ ID NO: 3509534 - RNA, 21 nt, Human
aggcaggcaccuagcaauucc

SEQ ID NO: 3509535 - RNA, 15 nt, Human
aggcaggcagggcuc

SEQ ID NO: 3509536 - RNA, 16 nt, Human
aggcaggcagggcucu

SEQ ID NO: 3509537 - RNA, 19 nt, Human
aggcaggcauggcccuggg

SEQ ID NO: 3509538 - RNA, 13 nt, Human
aggcaggcauuga

SEQ ID NO: 3509539 - RNA, 18 nt, Human
aggcaggcuaaggcgugg

SEQ ID NO: 3509540 - RNA, 13 nt, Human
aggcagggaaguc

SEQ ID NO: 3509541 - RNA, 23 nt, Human
aggcagggagacgguuuccaggg

SEQ ID NO: 3509542 - RNA, 16 nt, Human
aggcagggaggcagcc

SEQ ID NO: 3509543 - RNA, 16 nt, Human
aggcagggcaaaugac

SEQ ID NO: 3509544 - RNA, 20 nt, Human
aggcagggcaggaccagccc

SEQ ID NO: 3509545 - RNA, 21 nt, Human
aggcagggcaggaccagccca

SEQ ID NO: 3509546 - RNA, 22 nt, Human
aggcagggcaggaccagcccac

SEQ ID NO: 3509547 - RNA, 20 nt, Human
aggcagggccuugcccagag

SEQ ID NO: 3509548 - RNA, 22 nt, Human
aggcagggccuugcccagagau

SEQ ID NO: 3509549 - RNA, 23 nt, Human
aggcagggccuugcccagagaug

SEQ ID NO: 3509550 - RNA, 19 nt, Human
aggcagggcucuccuggcu

SEQ ID NO: 3509551 - RNA, 21 nt, Human
aggcagggcucuccuggcuuc

SEQ ID NO: 3509552 - RNA, 14 nt, Human
aggcaggggaaugu

SEQ ID NO: 3509553 - RNA, 22 nt, Human
aggcaggggcccugcagcucuc

SEQ ID NO: 3509554 - RNA, 16 nt, Human
aggcaggggugggggu

SEQ ID NO: 3509555 - RNA, 22 nt, Human
aggcagggguggggguggaggc

SEQ ID NO: 3509556 - RNA, 23 nt, Human
aggcagggguggggguggaggcu

SEQ ID NO: 3509557 - RNA, 18 nt, Human
aggcagggucucacucug

SEQ ID NO: 3509558 - RNA, 19 nt, Human
aggcagggucucacucugu

SEQ ID NO: 3509559 - RNA, 22 nt, Human
aggcaggguuuuaucucugucu

SEQ ID NO: 3509560 - RNA, 14 nt, Human
aggcagguagccag

SEQ ID NO: 3509561 - RNA, 11 nt, Human
aggcagguccc

SEQ ID NO: 3509562 - RNA, 13 nt, Human
aggcaggucccca

SEQ ID NO: 3509563 - RNA, 15 nt, Human
aggcagguccccaga

SEQ ID NO: 3509564 - RNA, 23 nt, Human
aggcaggugaucugcugcagagc

SEQ ID NO: 3509565 - RNA, 21 nt, Human
aggcaggugccccucucucca

SEQ ID NO: 3509566 - RNA, 14 nt, Human
aggcaggugccucc

SEQ ID NO: 3509567 - RNA, 15 nt, Human
aggcaggugccucca

SEQ ID NO: 3509568 - RNA, 23 nt, Human
aggcaguaggacaaggugcaggc

SEQ ID NO: 3509569 - RNA, 20 nt, Human
aggcagucgggggcuggccu

SEQ ID NO: 3509570 - RNA, 23 nt, Human
aggcagucgggggcuggccuagg

SEQ ID NO: 3509571 - RNA, 11 nt, Human
aggcagucucu

SEQ ID NO: 3509572 - RNA, 16 nt, Human
aggcagucucucucuu

SEQ ID NO: 3509573 - RNA, 16 nt, Human
aggcaguggggcuggg

SEQ ID NO: 3509574 - RNA, 21 nt, Human
aggcagugucauuugcucugc

SEQ ID NO: 3509575 - RNA, 18 nt, Human
aggcaguuaccauuaaac

SEQ ID NO: 3509576 - RNA, 24 nt, Human
aggcaguuaccauuaaaccaucuc

SEQ ID NO: 3509577 - RNA, 18 nt, Human
aggcaguuagagaugccu

SEQ ID NO: 3509578 - RNA, 22 nt, Human
aggcaguugagaaaauuugaau

SEQ ID NO: 3509579 - RNA, 20 nt, Human
aggcaguugcccagccucuu

SEQ ID NO: 3509580 - RNA, 19 nt, Human
aggcaguuuagugcaucuu

SEQ ID NO: 3509581 - RNA, 16 nt, Human
aggcauaggccugggu

SEQ ID NO: 3509582 - RNA, 19 nt, Human
aggcauaggccugggugcu

SEQ ID NO: 3509583 - RNA, 17 nt, Human
aggcauaugcuucuuua

SEQ ID NO: 3509584 - RNA, 18 nt, Human
aggcauaugcuucuuuaa

SEQ ID NO: 3509585 - RNA, 19 nt, Human
aggcauaugcuucuuuaaa

SEQ ID NO: 3509586 - RNA, 16 nt, Human
aggcaucaugcagagu

SEQ ID NO: 3509587 - RNA, 16 nt, Human
aggcaucccaggggac

SEQ ID NO: 3509588 - RNA, 17 nt, Human
aggcaucgcaauguaag

SEQ ID NO: 3509589 - RNA, 13 nt, Human
aggcaucuaucug

SEQ ID NO: 3509590 - RNA, 22 nt, Human
aggcaucucuguacuuugcuug

SEQ ID NO: 3509591 - RNA, 21 nt, Human
aggcaugaagagcaaaaauau

SEQ ID NO: 3509592 - RNA, 22 nt, Human
aggcaugagggaucacagggcc

SEQ ID NO: 3509593 - RNA, 13 nt, Human
aggcaugccucug

SEQ ID NO: 3509594 - RNA, 21 nt, Human
aggcaugccucugauauggga

SEQ ID NO: 3509595 - RNA, 15 nt, Human
aggcaugccugugug

SEQ ID NO: 3509596 - RNA, 18 nt, Human
aggcauggacuucuggau

SEQ ID NO: 3509597 - RNA, 12 nt, Human
aggcauggcccu

SEQ ID NO: 3509598 - RNA, 21 nt, Human
aggcaugggugcaaggaaaau

SEQ ID NO: 3509599 - RNA, 12 nt, Human
aggcaugguggc

SEQ ID NO: 3509600 - RNA, 22 nt, Human
aggcaugucccaugugagcugc

SEQ ID NO: 3509601 - RNA, 20 nt, Human
aggcaugugaugagaggaaa

SEQ ID NO: 3509602 - RNA, 21 nt, Human
aggcaugugaugagaggaaau

SEQ ID NO: 3509603 - RNA, 22 nt, Human
agagggcuuccucuagaagcca

SEQ ID NO: 3509604 - RNA, 14 nt, Human
agagggcuugugaa

SEQ ID NO: 3509605 - RNA, 18 nt, Human
agaggggaaaagcugaac

SEQ ID NO: 3509606 - RNA, 22 nt, Human
agaggggaaaccaguguagccu

SEQ ID NO: 3509607 - RNA, 18 nt, Human
agaggggacucugggcua

SEQ ID NO: 3509608 - RNA, 13 nt, Human
agaggggaggcca

SEQ ID NO: 3509609 - RNA, 14 nt, Human
agaggggcagcccu

SEQ ID NO: 3509610 - RNA, 15 nt, Human
agaggggcagcccuu

SEQ ID NO: 3509611 - RNA, 18 nt, Human
agaggggcagcccuugcu

SEQ ID NO: 3509612 - RNA, 14 nt, Human
agaggggccugcca

SEQ ID NO: 3509613 - RNA, 17 nt, Human
agaggggccugccaccu

SEQ ID NO: 3509614 - RNA, 13 nt, Human
agaggggcugucc

SEQ ID NO: 3509615 - RNA, 22 nt, Human
agagggggacugcugcugccug

SEQ ID NO: 3509616 - RNA, 14 nt, Human
agaggggggcugcc

SEQ ID NO: 3509617 - RNA, 17 nt, Human
agaggggguggccuccc

SEQ ID NO: 3509618 - RNA, 20 nt, Human
agagggguacauuucccugu

SEQ ID NO: 3509619 - RNA, 13 nt, Human
agaggggugcaga

SEQ ID NO: 3509620 - RNA, 19 nt, Human
agaggggugcagaggcugu

SEQ ID NO: 3509621 - RNA, 23 nt, Human
agaggggugcagaggcuguggcu

SEQ ID NO: 3509622 - RNA, 16 nt, Human
agaggguauuuuugua

SEQ ID NO: 3509623 - RNA, 22 nt, Human
agagggugacaagauagagagc

SEQ ID NO: 3509624 - RNA, 20 nt, Human
agagggugaguccuccagaa

SEQ ID NO: 3509625 - RNA, 19 nt, Human
agagggugauaauagaaga

SEQ ID NO: 3509626 - RNA, 14 nt, Human
agagggugcugccc

SEQ ID NO: 3509627 - RNA, 20 nt, Human
agaggguggugaccucugcc

SEQ ID NO: 3509628 - RNA, 16 nt, Human
agagguaaaaguguga

SEQ ID NO: 3509629 - RNA, 16 nt, Human
agagguaacagaacag

SEQ ID NO: 3509630 - RNA, 17 nt, Human
agagguacacuugugaa

SEQ ID NO: 3509631 - RNA, 21 nt, Human
agagguaucuuacuuuccucu

SEQ ID NO: 3509632 - RNA, 17 nt, Human
agagguauuaaaacuaa

SEQ ID NO: 3509633 - RNA, 16 nt, Human
agaggucaagcccagg

SEQ ID NO: 3509634 - RNA, 19 nt, Human
agagguccacaacacacag

SEQ ID NO: 3509635 - RNA, 13 nt, Human
agagguccagccc

SEQ ID NO: 3509636 - RNA, 14 nt, Human
agagguccagccca

SEQ ID NO: 3509637 - RNA, 15 nt, Human
agagguccagcccau

SEQ ID NO: 3509638 - RNA, 17 nt, Human
agagguccagcccaucu

SEQ ID NO: 3509639 - RNA, 23 nt, Human
agaggugaccccagggcacagga

SEQ ID NO: 3509640 - RNA, 16 nt, Human
agaggugcacuugggg

SEQ ID NO: 3509641 - RNA, 22 nt, Human
agaggugcacuuggggcacagg

SEQ ID NO: 3509642 - RNA, 18 nt, Human
agaggugccagcaacuga

SEQ ID NO: 3509643 - RNA, 15 nt, Human
agagguggaaaaaca

SEQ ID NO: 3509644 - RNA, 12 nt, Human
agaggugggcag

SEQ ID NO: 3509645 - RNA, 14 nt, Human
agaggugggcaggu

SEQ ID NO: 3509646 - RNA, 13 nt, Human
agaggugggccag

SEQ ID NO: 3509647 - RNA, 22 nt, Human
agaggugugcaagagagggaug

SEQ ID NO: 3509648 - RNA, 20 nt, Human
agagguuaagguggguacgg

SEQ ID NO: 3509649 - RNA, 13 nt, Human
agagguucaaaga

SEQ ID NO: 3509650 - RNA, 13 nt, Human
agagguuucagug

SEQ ID NO: 3509651 - RNA, 20 nt, Human
agagguuuggcuccugccca

SEQ ID NO: 3509652 - RNA, 19 nt, Human
agagguuuuaaagugauua

SEQ ID NO: 3509653 - RNA, 16 nt, Human
agagguuuuguuguuu

SEQ ID NO: 3509654 - RNA, 19 nt, Human
agagguuuuguuguuuuau

SEQ ID NO: 3509655 - RNA, 12 nt, Human
agagguuuuucu

SEQ ID NO: 3509656 - RNA, 20 nt, Human
agaguaauccaagcaaaugu

SEQ ID NO: 3509657 - RNA, 15 nt, Human
agggauggccguugg

SEQ ID NO: 3509658 - RNA, 17 nt, Human
agggauggggccacagc

SEQ ID NO: 3509659 - RNA, 12 nt, Human
agggauguauuu

SEQ ID NO: 3509660 - RNA, 18 nt, Human
agggauuacccaagcaaa

SEQ ID NO: 3509661 - RNA, 16 nt, Human
agggauucaggcugcu

SEQ ID NO: 3509662 - RNA, 17 nt, Human
agggauucucacaauag

SEQ ID NO: 3509663 - RNA, 16 nt, Human
agggauugcugccacu

SEQ ID NO: 3509664 - RNA, 17 nt, Human
agggauuguuucuguuu

SEQ ID NO: 3509665 - RNA, 22 nt, Human
agggauuuggggcucagagugg

SEQ ID NO: 3509666 - RNA, 13 nt, Human
agggcaaagccag

SEQ ID NO: 3509667 - RNA, 15 nt, Human
agggcaaagccaggu

SEQ ID NO: 3509668 - RNA, 21 nt, Human
agggcaaauccagucccaaug

SEQ ID NO: 3509669 - RNA, 22 nt, Human
agggcaaaugacaugcacugac

SEQ ID NO: 3509670 - RNA, 18 nt, Human
agggcaacagaucaguaa

SEQ ID NO: 3509671 - RNA, 14 nt, Human
agggcaagggccau

SEQ ID NO: 3509672 - RNA, 21 nt, Human
agggcaaggguuaaggccuga

SEQ ID NO: 3509673 - RNA, 19 nt, Human
agggcaauuaauuccuuca

SEQ ID NO: 3509674 - RNA, 16 nt, Human
agggcacaaagauggg

SEQ ID NO: 3509675 - RNA, 14 nt, Human
agggcacacacugu

SEQ ID NO: 3509676 - RNA, 20 nt, Human
agggcacaccgggcacucag

SEQ ID NO: 3509677 - RNA, 12 nt, Human
agggcacaggag

SEQ ID NO: 3509678 - RNA, 17 nt, Human
agggcacaggagcuacc

SEQ ID NO: 3509679 - RNA, 20 nt, Human
agggcacaggagcuaccugu

SEQ ID NO: 3509680 - RNA, 19 nt, Human
agggcacagggccuggccc

SEQ ID NO: 3509681 - RNA, 20 nt, Human
agggcaccaagcccacaggu

SEQ ID NO: 3509682 - RNA, 14 nt, Human
agggcaccaggggu

SEQ ID NO: 3509683 - RNA, 21 nt, Human
agggcaccaucacaauacaga

SEQ ID NO: 3509684 - RNA, 21 nt, Human
agggcacccuaguucuaccuc

SEQ ID NO: 3509685 - RNA, 18 nt, Human
agggcacugacggacuca

SEQ ID NO: 3509686 - RNA, 15 nt, Human
agggcacugggcugu

SEQ ID NO: 3509687 - RNA, 16 nt, Human
agggcacugggcuguu

SEQ ID NO: 3509688 - RNA, 18 nt, Human
agggcacugggcuguugu

SEQ ID NO: 3509689 - RNA, 16 nt, Human
agggcacuucacagag

SEQ ID NO: 3509690 - RNA, 23 nt, Human
agggcacuucacagagugugcug

SEQ ID NO: 3509691 - RNA, 19 nt, Human
agggcagaaagguucugcc

SEQ ID NO: 3509692 - RNA, 15 nt, Human
agggcagaaugaauc

SEQ ID NO: 3509693 - RNA, 20 nt, Human
agggcagacuggggcauccu

SEQ ID NO: 3509694 - RNA, 17 nt, Human
agggcagaggcuggagg

SEQ ID NO: 3509695 - RNA, 20 nt, Human
agggcagaggcuggaggcag

SEQ ID NO: 3509696 - RNA, 19 nt, Human
agggcagagugagacccag

SEQ ID NO: 3509697 - RNA, 15 nt, Human
agggcagaguuacuu

SEQ ID NO: 3509698 - RNA, 14 nt, Human
agggcagcagccag

SEQ ID NO: 3509699 - RNA, 14 nt, Human
agggcagcagggcu

SEQ ID NO: 3509700 - RNA, 15 nt, Human
agggcagcagggcua

SEQ ID NO: 3509701 - RNA, 14 nt, Human
agggcagccaggga

SEQ ID NO: 3509702 - RNA, 15 nt, Human
agggcagccagggag

SEQ ID NO: 3509703 - RNA, 23 nt, Human
agggcagccagggagagcccagg

SEQ ID NO: 3509704 - RNA, 12 nt, Human
agggcagcccca

SEQ ID NO: 3509705 - RNA, 20 nt, Human
agggcagccgucaccccugc

SEQ ID NO: 3509706 - RNA, 15 nt, Human
agggcagcugggccc

SEQ ID NO: 3509707 - RNA, 18 nt, Human
agggcagcugggcccaac

SEQ ID NO: 3509708 - RNA, 18 nt, Human
agggcaggaaggagagcc

SEQ ID NO: 3509709 - RNA, 19 nt, Human
agggcaggaaggagagccu

SEQ ID NO: 3509710 - RNA, 23 nt, Human
agggcaggaaggagagccugcug

SEQ ID NO: 3509711 - RNA, 16 nt, Human
agggcaggaccagccc

SEQ ID NO: 3509712 - RNA, 18 nt, Human
agggcaggaccagcccac

SEQ ID NO: 3509713 - RNA, 19 nt, Human
agggcaggaccagcccacg

SEQ ID NO: 3509714 - RNA, 11 nt, Human
agggcaggcau

SEQ ID NO: 3509715 - RNA, 12 nt, Human
agggcagggccc

SEQ ID NO: 3509716 - RNA, 15 nt, Human
agggcaguaccugag

SEQ ID NO: 3509717 - RNA, 22 nt, Human
agggcagugcuagugagcuggg

SEQ ID NO: 3509718 - RNA, 13 nt, Human
agggcaguggagg

SEQ ID NO: 3509719 - RNA, 16 nt, Human
agggcaguguuuccuu

SEQ ID NO: 3509720 - RNA, 23 nt, Human
agggcaguucgcagccacccuga

SEQ ID NO: 3509721 - RNA, 14 nt, Human
agggcauaaaacag

SEQ ID NO: 3509722 - RNA, 14 nt, Human
agggcauaaaguaa

SEQ ID NO: 3509723 - RNA, 15 nt, Human
agggcauaaaguaaa

SEQ ID NO: 3509724 - RNA, 19 nt, Human
agggcauaaaguaaauaca

SEQ ID NO: 3509725 - RNA, 15 nt, Human
agggcauaaugauga

SEQ ID NO: 3509726 - RNA, 19 nt, Human
agggcauaaugaugauggg

SEQ ID NO: 3509727 - RNA, 18 nt, Human
agggcauccuucugccuu

SEQ ID NO: 3509728 - RNA, 13 nt, Human
agggcaucuccag

SEQ ID NO: 3509729 - RNA, 22 nt, Human
agggcaucuccaggaaggcggg

SEQ ID NO: 3509730 - RNA, 14 nt, Human
agggcaucuccugu

SEQ ID NO: 3509731 - RNA, 15 nt, Human
agggcaucucugggc

SEQ ID NO: 3509732 - RNA, 17 nt, Human
agggcaucuuagcuucu

SEQ ID NO: 3509733 - RNA, 18 nt, Human
agggcaucuugcuggcua

SEQ ID NO: 3509734 - RNA, 22 nt, Human
agggcaucuugguccaggaaau

SEQ ID NO: 3509735 - RNA, 13 nt, Human
agggcaugaaaug

SEQ ID NO: 3509736 - RNA, 14 nt, Human
agggcaugaaauga

SEQ ID NO: 3509737 - RNA, 22 nt, Human
agggcaugccacgugggcucau

SEQ ID NO: 3509738 - RNA, 21 nt, Human
agggcaugccccggccaccuc

SEQ ID NO: 3509739 - RNA, 20 nt, Human
agggccaaaauauuuggaau

SEQ ID NO: 3509740 - RNA, 20 nt, Human
agggccaaacgcugagccac

SEQ ID NO: 3509741 - RNA, 22 nt, Human
agggccaaacgcugagccaccu

SEQ ID NO: 3509742 - RNA, 13 nt, Human
agggccaaagaac

SEQ ID NO: 3509743 - RNA, 17 nt, Human
agggccaacccuucucc

SEQ ID NO: 3509744 - RNA, 16 nt, Human
agggccaagacuuggc

SEQ ID NO: 3509745 - RNA, 21 nt, Human
agggccaagcccagcacugcu

SEQ ID NO: 3509746 - RNA, 19 nt, Human
agggccacaucccacugcc

SEQ ID NO: 3509747 - RNA, 22 nt, Human
agggccaccuacaauacaucug

SEQ ID NO: 3509748 - RNA, 15 nt, Human
agggccacgcuccag

SEQ ID NO: 3509749 - RNA, 16 nt, Human
agggccacgcuccagc

SEQ ID NO: 3509750 - RNA, 19 nt, Human
agggccacgugccaggccc

SEQ ID NO: 3509751 - RNA, 14 nt, Human
agggccacugaaga

SEQ ID NO: 3509752 - RNA, 15 nt, Human
agggccagagccagg

SEQ ID NO: 3509753 - RNA, 17 nt, Human
agggccaggacugagcc

SEQ ID NO: 3509754 - RNA, 10 nt, Human
agggccaggc

SEQ ID NO: 3509755 - RNA, 14 nt, Human
agggccaggcaggu

SEQ ID NO: 3509756 - RNA, 21 nt, Human
agggccaggcaggugccugga

SEQ ID NO: 3509757 - RNA, 21 nt, Human
agggccaguggggccugugga

SEQ ID NO: 3509758 - RNA, 15 nt, Human
agggccaugaacuuu

SEQ ID NO: 3509759 - RNA, 18 nt, Human
agggccaugcugaaggga

SEQ ID NO: 3509760 - RNA, 19 nt, Human
agggccaugcugaggccug

SEQ ID NO: 3509761 - RNA, 20 nt, Human
agggccaugcugaggccugg

SEQ ID NO: 3509762 - RNA, 21 nt, Human
agggccaugcugaggccuggg

SEQ ID NO: 3509763 - RNA, 21 nt, Human
agggccauugaacucugagag

SEQ ID NO: 3509764 - RNA, 17 nt, Human
agggcccaagucccugu

SEQ ID NO: 3509765 - RNA, 23 nt, Human
agggcccacuuguauccucuggu

SEQ ID NO: 3509766 - RNA, 14 nt, Human
agggcccagagcag

SEQ ID NO: 3509767 - RNA, 19 nt, Human
agggcccagagcccagcuc

SEQ ID NO: 3509768 - RNA, 14 nt, Human
agggcccaggcagg

SEQ ID NO: 3509769 - RNA, 18 nt, Human
agggcccaugggagggag

SEQ ID NO: 3509770 - RNA, 18 nt, Human
agggccccagcacuaaag

SEQ ID NO: 3509771 - RNA, 13 nt, Human
agggcccccacag

SEQ ID NO: 3509772 - RNA, 18 nt, Human
agggcccccacaguugcu

SEQ ID NO: 3509773 - RNA, 11 nt, Human
agggccccucu

SEQ ID NO: 3509774 - RNA, 12 nt, Human
agggccccucuc

SEQ ID NO: 3509775 - RNA, 21 nt, Human
agggccccucugcccagcuug

SEQ ID NO: 3509776 - RNA, 17 nt, Human
agggcccgcaccgacca

SEQ ID NO: 3509777 - RNA, 13 nt, Human
agggcccuaccug

SEQ ID NO: 3509778 - RNA, 16 nt, Human
agggcccugagcucgg

SEQ ID NO: 3509779 - RNA, 18 nt, Human
agggcccugagcugaggg

SEQ ID NO: 3509780 - RNA, 15 nt, Human
agggcccugugucug

SEQ ID NO: 3509781 - RNA, 22 nt, Human
agggccgaccagaggagccuuu

SEQ ID NO: 3509782 - RNA, 20 nt, Human
agggccgacuaagagaaguu

SEQ ID NO: 3509783 - RNA, 20 nt, Human
agggccgcccgggcccagag

SEQ ID NO: 3509784 - RNA, 18 nt, Human
agggccggggaacuggcc

SEQ ID NO: 3509785 - RNA, 17 nt, Human
agggccguaccccaccc

SEQ ID NO: 3509786 - RNA, 20 nt, Human
agggccuagcugcuacaaag

SEQ ID NO: 3509787 - RNA, 20 nt, Human
agggccucaaaggcccgcuc

SEQ ID NO: 3509788 - RNA, 15 nt, Human
agggccuccagcccu

SEQ ID NO: 3509789 - RNA, 16 nt, Human
agggccugaggucugg

SEQ ID NO: 3509790 - RNA, 22 nt, Human
agggccugaggucuggcugcuu

SEQ ID NO: 3509791 - RNA, 14 nt, Human
agggccugaugggg

SEQ ID NO: 3509792 - RNA, 21 nt, Human
agggccugaugggguggaagg

SEQ ID NO: 3509793 - RNA, 20 nt, Human
agggccugcaggaccugccu

SEQ ID NO: 3509794 - RNA, 22 nt, Human
agggccugcaggaccugccugu

SEQ ID NO: 3509795 - RNA, 13 nt, Human
agggccugcugga

SEQ ID NO: 3509796 - RNA, 21 nt, Human
agggccugcuggaggccucag

SEQ ID NO: 3509797 - RNA, 22 nt, Human
agggccugcuggaggccucagg

SEQ ID NO: 3509798 - RNA, 23 nt, Human
agggccugcuggaggccucaggu

SEQ ID NO: 3509799 - RNA, 12 nt, Human
agggccuggccu

SEQ ID NO: 3509800 - RNA, 13 nt, Human
agggccuggccug

SEQ ID NO: 3509801 - RNA, 14 nt, Human
agggccuggccuga

SEQ ID NO: 3509802 - RNA, 22 nt, Human
agauguuucuuuuguauguaaa

SEQ ID NO: 3509803 - RNA, 19 nt, Human
agauguuugauagauuuuc

SEQ ID NO: 3509804 - RNA, 15 nt, Human
agauguuugucagau

SEQ ID NO: 3509805 - RNA, 24 nt, Human
agauguuugucagauaugauaugu

SEQ ID NO: 3509806 - RNA, 22 nt, Human
agauguuuuaccguaauaauua

SEQ ID NO: 3509807 - RNA, 19 nt, Human
agauguuuugguagauuaa

SEQ ID NO: 3509808 - RNA, 15 nt, Human
agauuaaaaauuaua

SEQ ID NO: 3509809 - RNA, 16 nt, Human
agauuaaacugaguga

SEQ ID NO: 3509810 - RNA, 17 nt, Human
agauuaaauauagauua

SEQ ID NO: 3509811 - RNA, 14 nt, Human
agauuaagaaauag

SEQ ID NO: 3509812 - RNA, 15 nt, Human
agauuaagaaauaga

SEQ ID NO: 3509813 - RNA, 16 nt, Human
agauuaagagccauau

SEQ ID NO: 3509814 - RNA, 18 nt, Human
agauuaaggugaugugau

SEQ ID NO: 3509815 - RNA, 11 nt, Human
agauuaauauu

SEQ ID NO: 3509816 - RNA, 20 nt, Human
agauuacaaaucagaaguca

SEQ ID NO: 3509817 - RNA, 16 nt, Human
agauuacuuagaggaa

SEQ ID NO: 3509818 - RNA, 20 nt, Human
aggggcccaaggcggccccu

SEQ ID NO: 3509819 - RNA, 14 nt, Human
aggggcccacaggg

SEQ ID NO: 3509820 - RNA, 16 nt, Human
aggggccccccugccc

SEQ ID NO: 3509821 - RNA, 18 nt, Human
aggggccccccugcccug

SEQ ID NO: 3509822 - RNA, 13 nt, Human
aggggcccggcca

SEQ ID NO: 3509823 - RNA, 15 nt, Human
aggggcccggccagc

SEQ ID NO: 3509824 - RNA, 19 nt, Human
aggggcccggccagccaug

SEQ ID NO: 3509825 - RNA, 21 nt, Human
aggggcccguugucucccugg

SEQ ID NO: 3509826 - RNA, 17 nt, Human
aggggcccuggagcagc

SEQ ID NO: 3509827 - RNA, 12 nt, Human
aggggccgcccu

SEQ ID NO: 3509828 - RNA, 15 nt, Human
aggggccggcccugu

SEQ ID NO: 3509829 - RNA, 21 nt, Human
aggggccggcccugugugcag

SEQ ID NO: 3509830 - RNA, 23 nt, Human
aggggccuaggccucagccagag

SEQ ID NO: 3509831 - RNA, 22 nt, Human
aggggccuccaugggccccagg

SEQ ID NO: 3509832 - RNA, 13 nt, Human
aggggccugagca

SEQ ID NO: 3509833 - RNA, 14 nt, Human
aggggccugagcag

SEQ ID NO: 3509834 - RNA, 19 nt, Human
aggggccugccaccuggac

SEQ ID NO: 3509835 - RNA, 22 nt, Human
aggggccugccaccuggacccc

SEQ ID NO: 3509836 - RNA, 13 nt, Human
aggggccuggaga

SEQ ID NO: 3509837 - RNA, 13 nt, Human
aggggccuggcag

SEQ ID NO: 3509838 - RNA, 15 nt, Human
aggggccuggcagcc

SEQ ID NO: 3509839 - RNA, 23 nt, Human
aggggccuggcagccgugccuuc

SEQ ID NO: 3509840 - RNA, 22 nt, Human
aggggccuuagggcacugggcu

SEQ ID NO: 3509841 - RNA, 14 nt, Human
aggggcgcccaccu

SEQ ID NO: 3509842 - RNA, 23 nt, Human
aggggcgccgcaaaccacacugg

SEQ ID NO: 3509843 - RNA, 22 nt, Human
aggggcgcuggcccagccggcc

SEQ ID NO: 3509844 - RNA, 19 nt, Human
aggggcgggacccaggcac

SEQ ID NO: 3509845 - RNA, 17 nt, Human
aggggcuacaagaggga

SEQ ID NO: 3509846 - RNA, 18 nt, Human
aggggcuagcuaagccaa

SEQ ID NO: 3509847 - RNA, 16 nt, Human
aggggcuccuuuccau

SEQ ID NO: 3509848 - RNA, 17 nt, Human
aggggcucuggagagaa

SEQ ID NO: 3509849 - RNA, 21 nt, Human
aggggcucuggagagaaacaa

SEQ ID NO: 3509850 - RNA, 15 nt, Human
aggggcugcuuccuc

SEQ ID NO: 3509851 - RNA, 18 nt, Human
aggggcugcuuccuccug

SEQ ID NO: 3509852 - RNA, 19 nt, Human
aggggcuggccuuccugcc

SEQ ID NO: 3509853 - RNA, 18 nt, Human
aggggcuggggacuugug

SEQ ID NO: 3509854 - RNA, 12 nt, Human
aggggcuucagg

SEQ ID NO: 3509855 - RNA, 16 nt, Human
aggggcuucaggucca

SEQ ID NO: 3509856 - RNA, 23 nt, Human
aggggcuugguguuuguaagaaa

SEQ ID NO: 3509857 - RNA, 15 nt, Human
agggggaagaagcag

SEQ ID NO: 3509858 - RNA, 20 nt, Human
agggggagaaaaggaaaaga

SEQ ID NO: 3509859 - RNA, 15 nt, Human
agggggagagggcug

SEQ ID NO: 3509860 - RNA, 22 nt, Human
agggggagcugggccuggucuc

SEQ ID NO: 3509861 - RNA, 16 nt, Human
agggggaggggaaguc

SEQ ID NO: 3509862 - RNA, 20 nt, Human
agggggauccgacugcuuug

SEQ ID NO: 3509863 - RNA, 17 nt, Human
agggggcaucuggccuu

SEQ ID NO: 3509864 - RNA, 15 nt, Human
agggggccaccuccc

SEQ ID NO: 3509865 - RNA, 15 nt, Human
agggggcgccugugg

SEQ ID NO: 3509866 - RNA, 12 nt, Human
agggggcggccu

SEQ ID NO: 3509867 - RNA, 13 nt, Human
agggggcuccugg

SEQ ID NO: 3509868 - RNA, 22 nt, Human
agggggcugcucccaccuggcu

SEQ ID NO: 3509869 - RNA, 14 nt, Human
agggggcugcugcu

SEQ ID NO: 3509870 - RNA, 12 nt, Human
agggggcuggag

SEQ ID NO: 3509871 - RNA, 16 nt, Human
agggggcuggaggagc

SEQ ID NO: 3509872 - RNA, 17 nt, Human
agggggcuggaggagcc

SEQ ID NO: 3509873 - RNA, 18 nt, Human
agggggcuggaggagccc

SEQ ID NO: 3509874 - RNA, 19 nt, Human
agggggcuggaggagccca

SEQ ID NO: 3509875 - RNA, 14 nt, Human
aggggggaagauca

SEQ ID NO: 3509876 - RNA, 14 nt, Human
aggggggagcuggg

SEQ ID NO: 3509877 - RNA, 23 nt, Human
agggggucguggagagcuaggag

SEQ ID NO: 3509878 - RNA, 15 nt, Human
agggggucuggcugg

SEQ ID NO: 3509879 - RNA, 17 nt, Human
aggggguggccucccaa

SEQ ID NO: 3509880 - RNA, 20 nt, Human
aggggguggccucccaacuc

SEQ ID NO: 3509881 - RNA, 16 nt, Human
aggggguuugggggcu

SEQ ID NO: 3509882 - RNA, 22 nt, Human
aggggguuugggggcuugcaag

SEQ ID NO: 3509883 - RNA, 19 nt, Human
agggguaauauauugcugc

SEQ ID NO: 3509884 - RNA, 17 nt, Human
agggguaggcagagccu

SEQ ID NO: 3509885 - RNA, 14 nt, Human
agggguaggggcug

SEQ ID NO: 3509886 - RNA, 15 nt, Human
agggguaugucuuua

SEQ ID NO: 3509887 - RNA, 14 nt, Human
aggggucaaagaaa

SEQ ID NO: 3509888 - RNA, 21 nt, Human
aggggucaaguuauuaauuuc

SEQ ID NO: 3509889 - RNA, 15 nt, Human
aggggucaggcucca

SEQ ID NO: 3509890 - RNA, 14 nt, Human
aggggucagggacc

SEQ ID NO: 3509891 - RNA, 18 nt, Human
aggggucccagccacccc

SEQ ID NO: 3509892 - RNA, 14 nt, Human
aggggucccuagca

SEQ ID NO: 3509893 - RNA, 23 nt, Human
aggggucccuagcagcccacccu

SEQ ID NO: 3509894 - RNA, 15 nt, Human
aggggucggcugacc

SEQ ID NO: 3509895 - RNA, 18 nt, Human
aggggucuccaggaggag

SEQ ID NO: 3509896 - RNA, 14 nt, Human
aggggucucccugg

SEQ ID NO: 3509897 - RNA, 15 nt, Human
aggggucucccuggc

SEQ ID NO: 3509898 - RNA, 17 nt, Human
aggggugauuucagaga

SEQ ID NO: 3509899 - RNA, 20 nt, Human
agggguggcugccucauuua

SEQ ID NO: 3509900 - RNA, 21 nt, Human
agggguggcugccucauuuag

SEQ ID NO: 3509901 - RNA, 18 nt, Human
aggggugggacacccugu

SEQ ID NO: 3509902 - RNA, 14 nt, Human
aggggugggcuggu

SEQ ID NO: 3509903 - RNA, 19 nt, Human
agggguggggguggaggcu

SEQ ID NO: 3509904 - RNA, 21 nt, Human
agggguggguuccucuucccc

SEQ ID NO: 3509905 - RNA, 18 nt, Human
aggggugguccugacuca

SEQ ID NO: 3509906 - RNA, 15 nt, Human
agggguguggcuccu

SEQ ID NO: 3509907 - RNA, 18 nt, Human
agggguucccuugagggc

SEQ ID NO: 3509908 - RNA, 21 nt, Human
agggguucccuugagggcugc

SEQ ID NO: 3509909 - RNA, 24 nt, Human
agggguucccuuuuuuggcugcug

SEQ ID NO: 3509910 - RNA, 23 nt, Human
agggguugagcagggauccuggu

SEQ ID NO: 3509911 - RNA, 16 nt, Human
agggguugccacaggc

SEQ ID NO: 3509912 - RNA, 23 nt, Human
agggguugccacaggccucccug

SEQ ID NO: 3509913 - RNA, 21 nt, Human
agggguugcuccgccuggccu

SEQ ID NO: 3509914 - RNA, 16 nt, Human
agggguuggggaaaca

SEQ ID NO: 3509915 - RNA, 18 nt, Human
agggguuggggugacagu

SEQ ID NO: 3509916 - RNA, 15 nt, Human
agggguuuacaguga

SEQ ID NO: 3509917 - RNA, 23 nt, Human
agggguuucagaauuuugcauug

SEQ ID NO: 3509918 - RNA, 15 nt, Human
agggguuucuaacac

SEQ ID NO: 3509919 - RNA, 21 nt, Human
agggguuugccauuugauacc

SEQ ID NO: 3509920 - RNA, 22 nt, Human
aggguaaauaaaccacugugcg

SEQ ID NO: 3509921 - RNA, 14 nt, Human
aggguaaggugccu

SEQ ID NO: 3509922 - RNA, 21 nt, Human
aggguacaaaaaauucaguga

SEQ ID NO: 3509923 - RNA, 13 nt, Human
aggguacagcugg

SEQ ID NO: 3509924 - RNA, 14 nt, Human
aggguacauggugc

SEQ ID NO: 3509925 - RNA, 17 nt, Human
aggguacauggugcugg

SEQ ID NO: 3509926 - RNA, 13 nt, Human
aggguacauuuau

SEQ ID NO: 3509927 - RNA, 19 nt, Human
aggguaccuugaacacugg

SEQ ID NO: 3509928 - RNA, 13 nt, Human
aggguacuaaauu

SEQ ID NO: 3509929 - RNA, 21 nt, Human
aggguaggagguuuggauggg

SEQ ID NO: 3509930 - RNA, 21 nt, Human
aggguauauuuuccuauauua

SEQ ID NO: 3509931 - RNA, 16 nt, Human
aggguaucaggugcug

SEQ ID NO: 3509932 - RNA, 20 nt, Human
aggguauccaaguuggacug

SEQ ID NO: 3509933 - RNA, 21 nt, Human
aggguauccaaguuggacugg

SEQ ID NO: 3509934 - RNA, 20 nt, Human
agggucaacaucuuuuacau

SEQ ID NO: 3509935 - RNA, 17 nt, Human
agggucagccagggccu

SEQ ID NO: 3509936 - RNA, 13 nt, Human
agggucaggaagg

SEQ ID NO: 3509937 - RNA, 21 nt, Human
agggucaggaaggaugagcau

SEQ ID NO: 3509938 - RNA, 22 nt, Human
agggucaggaaggaugagcauu

SEQ ID NO: 3509939 - RNA, 13 nt, Human
agggucaggccuu

SEQ ID NO: 3509940 - RNA, 22 nt, Human
agggucaggccuuugagcucag

SEQ ID NO: 3509941 - RNA, 17 nt, Human
aggguccaacauagagc

SEQ ID NO: 3509942 - RNA, 18 nt, Human
aggguccaaccagaccug

SEQ ID NO: 3509943 - RNA, 19 nt, Human
aggguccaaccagaccugg

SEQ ID NO: 3509944 - RNA, 23 nt, Human
aggguccacaggaagugaagaau

SEQ ID NO: 3509945 - RNA, 20 nt, Human
agggucccauuucucacuga

SEQ ID NO: 3509946 - RNA, 20 nt, Human
agcagagaccaucccugaag

SEQ ID NO: 3509947 - RNA, 15 nt, Human
agcagagagaugcgg

SEQ ID NO: 3509948 - RNA, 18 nt, Human
agcagagcaagucugcag

SEQ ID NO: 3509949 - RNA, 15 nt, Human
agcagagcucugccg

SEQ ID NO: 3509950 - RNA, 13 nt, Human
agcagaggaccag

SEQ ID NO: 3509951 - RNA, 14 nt, Human
agcagaggaccagg

SEQ ID NO: 3509952 - RNA, 17 nt, Human
agcagaggaccagggcc

SEQ ID NO: 3509953 - RNA, 14 nt, Human
agcagaggcacugg

SEQ ID NO: 3509954 - RNA, 15 nt, Human
agcagaggcacuggg

SEQ ID NO: 3509955 - RNA, 17 nt, Human
agcagaggcacuggggg

SEQ ID NO: 3509956 - RNA, 20 nt, Human
agcagaggggcagaggccca

SEQ ID NO: 3509957 - RNA, 14 nt, Human
agcagaggggcuga

SEQ ID NO: 3509958 - RNA, 18 nt, Human
agcagagugcacagcugu

SEQ ID NO: 3509959 - RNA, 19 nt, Human
agcagagugcacagcuguc

SEQ ID NO: 3509960 - RNA, 14 nt, Human
agcagaguuaaauc

SEQ ID NO: 3509961 - RNA, 18 nt, Human
agcagaguuaaaucucaa

SEQ ID NO: 3509962 - RNA, 16 nt, Human
agcagaucccagcuca

SEQ ID NO: 3509963 - RNA, 21 nt, Human
agcagaugcaaagaggcaaga

SEQ ID NO: 3509964 - RNA, 17 nt, Human
agcagaugcagagagcc

SEQ ID NO: 3509965 - RNA, 14 nt, Human
agcagaugcugguc

SEQ ID NO: 3509966 - RNA, 19 nt, Human
agcagauggagaccccuug

SEQ ID NO: 3509967 - RNA, 16 nt, Human
agcagauuauucacug

SEQ ID NO: 3509968 - RNA, 20 nt, Human
agcagauuauucacugauuu

SEQ ID NO: 3509969 - RNA, 17 nt, Human
agcagauuggaaggaga

SEQ ID NO: 3509970 - RNA, 22 nt, Human
agcagauuggaaggagacacag

SEQ ID NO: 3509971 - RNA, 21 nt, Human
agcagauuuuaauuuugaaua

SEQ ID NO: 3509972 - RNA, 17 nt, Human
agcagauuuuaggaaau

SEQ ID NO: 3509973 - RNA, 17 nt, Human
agcagcaaaaauauaaa

SEQ ID NO: 3509974 - RNA, 16 nt, Human
agcagcaacuuguccu

SEQ ID NO: 3509975 - RNA, 19 nt, Human
agcagcaccguucugugca

SEQ ID NO: 3509976 - RNA, 19 nt, Human
agcagcaccugcccuaccu

SEQ ID NO: 3509977 - RNA, 22 nt, Human
agcagcaccugcccuaccugcc

SEQ ID NO: 3509978 - RNA, 14 nt, Human
agcagcacuuauaa

SEQ ID NO: 3509979 - RNA, 12 nt, Human
agcagcagcagg

SEQ ID NO: 3509980 - RNA, 16 nt, Human
agcagcagcaggugau

SEQ ID NO: 3509981 - RNA, 21 nt, Human
agcagcagcccaagcuucccu

SEQ ID NO: 3509982 - RNA, 13 nt, Human
agcagcagccucg

SEQ ID NO: 3509983 - RNA, 22 nt, Human
agcagcaggaggggggagggaa

SEQ ID NO: 3509984 - RNA, 13 nt, Human
agcagcaggugau

SEQ ID NO: 3509985 - RNA, 18 nt, Human
agcagcagugaaaacaag

SEQ ID NO: 3509986 - RNA, 20 nt, Human
agcagcaucucuaccuucuc

SEQ ID NO: 3509987 - RNA, 20 nt, Human
agcagccaagggaugaaaga

SEQ ID NO: 3509988 - RNA, 21 nt, Human
agcagccacauuccugaugcu

SEQ ID NO: 3509989 - RNA, 15 nt, Human
agcagccagcccugc

SEQ ID NO: 3509990 - RNA, 15 nt, Human
agcagccagcucuca

SEQ ID NO: 3509991 - RNA, 16 nt, Human
agcagccagcucucag

SEQ ID NO: 3509992 - RNA, 17 nt, Human
agcagccagcucucagc

SEQ ID NO: 3509993 - RNA, 18 nt, Human
agcagccagcucucagcc

SEQ ID NO: 3509994 - RNA, 12 nt, Human
agcagcccaaau

SEQ ID NO: 3509995 - RNA, 13 nt, Human
agcagcccaaauu

SEQ ID NO: 3509996 - RNA, 23 nt, Human
agcagccccacaccagggccagc

SEQ ID NO: 3509997 - RNA, 15 nt, Human
agcagccccgggagg

SEQ ID NO: 3509998 - RNA, 18 nt, Human
agcagcccuaaggaucuc

SEQ ID NO: 3509999 - RNA, 12 nt, Human
agcagcccuccu

SEQ ID NO: 3510000 - RNA, 13 nt, Human
agcagcccuccuc

SEQ ID NO: 3510001 - RNA, 16 nt, Human
agcagcccuccucacc

SEQ ID NO: 3510002 - RNA, 18 nt, Human
agcagcccuccucacccc

SEQ ID NO: 3510003 - RNA, 13 nt, Human
agcagcccuuggc

SEQ ID NO: 3510004 - RNA, 20 nt, Human
agcagccucagaacaaagug

SEQ ID NO: 3510005 - RNA, 17 nt, Human
agcagccucgccccugg

SEQ ID NO: 3510006 - RNA, 15 nt, Human
agcagccucucccca

SEQ ID NO: 3510007 - RNA, 20 nt, Human
agcagccucuccccaggucc

SEQ ID NO: 3510008 - RNA, 12 nt, Human
agcagccucuga

SEQ ID NO: 3510009 - RNA, 19 nt, Human
agcagccugagcaacucuu

SEQ ID NO: 3510010 - RNA, 23 nt, Human
agcagccugagcaacucuugauu

SEQ ID NO: 3510011 - RNA, 16 nt, Human
agcagccuggacccug

SEQ ID NO: 3510012 - RNA, 20 nt, Human
agcagccuggacccugugga

SEQ ID NO: 3510013 - RNA, 15 nt, Human
agcagccuggagccc

SEQ ID NO: 3510014 - RNA, 15 nt, Human
agcagcgagccugcu

SEQ ID NO: 3510015 - RNA, 15 nt, Human
agcagcgccuuuccc

SEQ ID NO: 3510016 - RNA, 16 nt, Human
agcagcgguggccucu

SEQ ID NO: 3510017 - RNA, 14 nt, Human
agguucuaacccua

SEQ ID NO: 3510018 - RNA, 12 nt, Human
agguucuaaggc

SEQ ID NO: 3510019 - RNA, 13 nt, Human
agguucuaaggcc

SEQ ID NO: 3510020 - RNA, 19 nt, Human
agguucuaaggccuaggau

SEQ ID NO: 3510021 - RNA, 22 nt, Human
agguucuaaggccuaggauucu

SEQ ID NO: 3510022 - RNA, 19 nt, Human
agguucuagguuucaaaga

SEQ ID NO: 3510023 - RNA, 15 nt, Human
agguucuauuuggaa

SEQ ID NO: 3510024 - RNA, 13 nt, Human
agguucuccaaca

SEQ ID NO: 3510025 - RNA, 22 nt, Human
agguucuccguuagcuccugug

SEQ ID NO: 3510026 - RNA, 18 nt, Human
agguucucucucacugcc

SEQ ID NO: 3510027 - RNA, 14 nt, Human
agguucugccugcu

SEQ ID NO: 3510028 - RNA, 16 nt, Human
agguucuuacugcuug

SEQ ID NO: 3510029 - RNA, 15 nt, Human
agguucuucagaagu

SEQ ID NO: 3510030 - RNA, 20 nt, Human
agguugaagaccuaaccagg

SEQ ID NO: 3510031 - RNA, 23 nt, Human
agguugaagccaaguggggugcu

SEQ ID NO: 3510032 - RNA, 17 nt, Human
agguugaagccaugucu

SEQ ID NO: 3510033 - RNA, 15 nt, Human
agguugacaggaggu

SEQ ID NO: 3510034 - RNA, 20 nt, Human
agguugagcaauuucccccu

SEQ ID NO: 3510035 - RNA, 24 nt, Human
agguugagcucuucuuaaaguauu

SEQ ID NO: 3510036 - RNA, 17 nt, Human
agguugaggggcuccug

SEQ ID NO: 3510037 - RNA, 11 nt, Human
agguugauaac

SEQ ID NO: 3510038 - RNA, 12 nt, Human
agguugauaacu

SEQ ID NO: 3510039 - RNA, 15 nt, Human
agguugauaacuuug

SEQ ID NO: 3510040 - RNA, 16 nt, Human
agguugauaacuuugc

SEQ ID NO: 3510041 - RNA, 17 nt, Human
agguugcacacuuuggu

SEQ ID NO: 3510042 - RNA, 14 nt, Human
agguugcagugagc

SEQ ID NO: 3510043 - RNA, 15 nt, Human
agguuggaagagaau

SEQ ID NO: 3510044 - RNA, 15 nt, Human
agguuggagcccagg

SEQ ID NO: 3510045 - RNA, 15 nt, Human
agguuggcucugcca

SEQ ID NO: 3510046 - RNA, 21 nt, Human
agguuggcucugccaguccug

SEQ ID NO: 3510047 - RNA, 22 nt, Human
agguugggaaugaggcuugcug

SEQ ID NO: 3510048 - RNA, 23 nt, Human
agguugggagaaugucaguaugu

SEQ ID NO: 3510049 - RNA, 14 nt, Human
agguugggauggga

SEQ ID NO: 3510050 - RNA, 22 nt, Human
agguugggugcugcuaauucuu

SEQ ID NO: 3510051 - RNA, 17 nt, Human
agguuguaguaaagaaa

SEQ ID NO: 3510052 - RNA, 22 nt, Human
agguuguggccuuugcgcuccu

SEQ ID NO: 3510053 - RNA, 13 nt, Human
agguuuaaaugaa

SEQ ID NO: 3510054 - RNA, 15 nt, Human
agguuuaaaugaaca

SEQ ID NO: 3510055 - RNA, 19 nt, Human
agguuuaaaugaacaagag

SEQ ID NO: 3510056 - RNA, 22 nt, Human
agguuuaaaugaacaagagaag

SEQ ID NO: 3510057 - RNA, 16 nt, Human
agguuuacaauuuaca

SEQ ID NO: 3510058 - RNA, 22 nt, Human
agguuuacaauuuacaaagugu

SEQ ID NO: 3510059 - RNA, 23 nt, Human
agguuuacaauuuacaaagugug

SEQ ID NO: 3510060 - RNA, 14 nt, Human
agguuuacagaauu

SEQ ID NO: 3510061 - RNA, 20 nt, Human
agguuuaggcugguggccca

SEQ ID NO: 3510062 - RNA, 21 nt, Human
agguuuaggcugguggcccag

SEQ ID NO: 3510063 - RNA, 21 nt, Human
agguuuaugaaaaagaagaau

SEQ ID NO: 3510064 - RNA, 12 nt, Human
agguuuauuguu

SEQ ID NO: 3510065 - RNA, 17 nt, Human
agguuuauuuuucuguu

SEQ ID NO: 3510066 - RNA, 17 nt, Human
agguuucaaagaugcug

SEQ ID NO: 3510067 - RNA, 21 nt, Human
agguuucauacucuagauuuu

SEQ ID NO: 3510068 - RNA, 17 nt, Human
agguuucguuucuguau

SEQ ID NO: 3510069 - RNA, 21 nt, Human
agguuucugaguuccugcaug

SEQ ID NO: 3510070 - RNA, 23 nt, Human
agguuucuggucucuaggcuggg

SEQ ID NO: 3510071 - RNA, 17 nt, Human
agguuugagaagcacug

SEQ ID NO: 3510072 - RNA, 22 nt, Human
agguuuggaaggagcagaaaac

SEQ ID NO: 3510073 - RNA, 14 nt, Human
agguuuggcuccug

SEQ ID NO: 3510074 - RNA, 16 nt, Human
agguuugggaccccug

SEQ ID NO: 3510075 - RNA, 17 nt, Human
agguuugguccagccug

SEQ ID NO: 3510076 - RNA, 19 nt, Human
agguuuggugcaaaguauu

SEQ ID NO: 3510077 - RNA, 16 nt, Human
agguuuggugugugga

SEQ ID NO: 3510078 - RNA, 12 nt, Human
agguuuguauau

SEQ ID NO: 3510079 - RNA, 17 nt, Human
agguuuuaaagugauua

SEQ ID NO: 3510080 - RNA, 22 nt, Human
agguuuuaauuuaguaaaccaa

SEQ ID NO: 3510081 - RNA, 18 nt, Human
agguuuuagguucuaaag

SEQ ID NO: 3510082 - RNA, 19 nt, Human
agguuuuagguucuaaagu

SEQ ID NO: 3510083 - RNA, 19 nt, Human
agguuuucacauaaaugca

SEQ ID NO: 3510084 - RNA, 22 nt, Human
agguuuuccccucuuuuguuaa

SEQ ID NO: 3510085 - RNA, 22 nt, Human
agguuuuccucuucuauuuugu

SEQ ID NO: 3510086 - RNA, 11 nt, Human
agguuuuccug

SEQ ID NO: 3510087 - RNA, 17 nt, Human
agguuuucuuuuaagaa

SEQ ID NO: 3510088 - RNA, 23 nt, Human
agguuuuggaucuugaauguggu

SEQ ID NO: 3510089 - RNA, 17 nt, Human
agguuuuguuguuuuau

SEQ ID NO: 3510090 - RNA, 16 nt, Human
agguuuuguuugcuau

SEQ ID NO: 3510091 - RNA, 19 nt, Human
agcaggggcuacaagaggg

SEQ ID NO: 3510092 - RNA, 20 nt, Human
agcaggggcuacaagaggga

SEQ ID NO: 3510093 - RNA, 18 nt, Human
agcaggguagucugguuu

SEQ ID NO: 3510094 - RNA, 16 nt, Human
agcagggucugggcag

SEQ ID NO: 3510095 - RNA, 19 nt, Human
agcagggucuuuucaucug

SEQ ID NO: 3510096 - RNA, 23 nt, Human
agcagggucuuuucaucugggaa

SEQ ID NO: 3510097 - RNA, 15 nt, Human
agcagggugcugugg

SEQ ID NO: 3510098 - RNA, 21 nt, Human
agcagguccccagcuuuggcu

SEQ ID NO: 3510099 - RNA, 22 nt, Human
agcaggugauuggaccaggcca

SEQ ID NO: 3510100 - RNA, 20 nt, Human
agcaggugcugcuacccucc

SEQ ID NO: 3510101 - RNA, 13 nt, Human
agcagguggggag

SEQ ID NO: 3510102 - RNA, 14 nt, Human
agcagguggggagg

SEQ ID NO: 3510103 - RNA, 16 nt, Human
agcagguucccaagcu

SEQ ID NO: 3510104 - RNA, 15 nt, Human
agcaguaagggaaca

SEQ ID NO: 3510105 - RNA, 14 nt, Human
agcaguacaauaaa

SEQ ID NO: 3510106 - RNA, 21 nt, Human
agcaguagaaauaauaugcau

SEQ ID NO: 3510107 - RNA, 17 nt, Human
agcaguagacauuuuaa

SEQ ID NO: 3510108 - RNA, 15 nt, Human
agcaguauauguuaa

SEQ ID NO: 3510109 - RNA, 12 nt, Human
agcaguauuuuu

SEQ ID NO: 3510110 - RNA, 23 nt, Human
agcagucacuuuuccugugcugu

SEQ ID NO: 3510111 - RNA, 19 nt, Human
agcagucaggaaagagaac

SEQ ID NO: 3510112 - RNA, 12 nt, Human
agcaguccuugg

SEQ ID NO: 3510113 - RNA, 13 nt, Human
agcaguccuuggc

SEQ ID NO: 3510114 - RNA, 18 nt, Human
agcaguccuuggccugcu

SEQ ID NO: 3510115 - RNA, 19 nt, Human
agcagucucugccuugccu

SEQ ID NO: 3510116 - RNA, 20 nt, Human
agcagucuuaugcuuccaga

SEQ ID NO: 3510117 - RNA, 17 nt, Human
agcagugaaaacaagug

SEQ ID NO: 3510118 - RNA, 16 nt, Human
agcagugagaaaaagc

SEQ ID NO: 3510119 - RNA, 22 nt, Human
agcagugagaaaaagcuccugu

SEQ ID NO: 3510120 - RNA, 14 nt, Human
agcagugagccgca

SEQ ID NO: 3510121 - RNA, 16 nt, Human
agcagugagucucuuc

SEQ ID NO: 3510122 - RNA, 15 nt, Human
agcagugauauucuu

SEQ ID NO: 3510123 - RNA, 19 nt, Human
agcagugauauucuuuguu

SEQ ID NO: 3510124 - RNA, 21 nt, Human
agcagugauauucuuuguuaa

SEQ ID NO: 3510125 - RNA, 13 nt, Human
agcagugcaggca

SEQ ID NO: 3510126 - RNA, 20 nt, Human
agcagugcaugcugucccuu

SEQ ID NO: 3510127 - RNA, 23 nt, Human
agcagugccuuccauaauuauga

SEQ ID NO: 3510128 - RNA, 12 nt, Human
agcaguggacac

SEQ ID NO: 3510129 - RNA, 15 nt, Human
agcaguggcaggcag

SEQ ID NO: 3510130 - RNA, 13 nt, Human
agcaguggcuggu

SEQ ID NO: 3510131 - RNA, 16 nt, Human
agcaguggcuggucca

SEQ ID NO: 3510132 - RNA, 17 nt, Human
agcaguggcugguccag

SEQ ID NO: 3510133 - RNA, 17 nt, Human
agcagugggcuccuggc

SEQ ID NO: 3510134 - RNA, 13 nt, Human
agcagugucauca

SEQ ID NO: 3510135 - RNA, 17 nt, Human
agcagugucuuccauaa

SEQ ID NO: 3510136 - RNA, 22 nt, Human
agcagugucuuccauaauguau

SEQ ID NO: 3510137 - RNA, 22 nt, Human
agcaguuaacuuuaagacugag

SEQ ID NO: 3510138 - RNA, 20 nt, Human
agcaguucaccuauuucaaa

SEQ ID NO: 3510139 - RNA, 17 nt, Human
agcaguucagagcugcc

SEQ ID NO: 3510140 - RNA, 19 nt, Human
agcaguucagagcugcccu

SEQ ID NO: 3510141 - RNA, 23 nt, Human
agcaguucagagcugcccucucc

SEQ ID NO: 3510142 - RNA, 23 nt, Human
agcaguucugcaaauagaaaaca

SEQ ID NO: 3510143 - RNA, 16 nt, Human
agcaguucugcagagg

SEQ ID NO: 3510144 - RNA, 12 nt, Human
agcaguucuguu

SEQ ID NO: 3510145 - RNA, 13 nt, Human
agcaguugaaaag

SEQ ID NO: 3510146 - RNA, 21 nt, Human
agcaguugaaaagacuccaaa

SEQ ID NO: 3510147 - RNA, 19 nt, Human
agcaguugagacaagaaaa

SEQ ID NO: 3510148 - RNA, 23 nt, Human
agcaguugagucgucaucacuuu

SEQ ID NO: 3510149 - RNA, 22 nt, Human
agcaguugcugguaaaaugaag

SEQ ID NO: 3510150 - RNA, 13 nt, Human
agcaguuguguca

SEQ ID NO: 3510151 - RNA, 17 nt, Human
agcaguuguuauuacau

SEQ ID NO: 3510152 - RNA, 14 nt, Human
agcaguuucaauaa

SEQ ID NO: 3510153 - RNA, 15 nt, Human
agcaguuucaauaaa

SEQ ID NO: 3510154 - RNA, 17 nt, Human
agcaguuucaauaaagu

SEQ ID NO: 3510155 - RNA, 15 nt, Human
agcaguuugaaauug

SEQ ID NO: 3510156 - RNA, 20 nt, Human
agcaguuugguuucuagcau

SEQ ID NO: 3510157 - RNA, 22 nt, Human
agcaguuugguuucuagcauga

SEQ ID NO: 3510158 - RNA, 17 nt, Human
agcaguuuucaagucaa

SEQ ID NO: 3510159 - RNA, 19 nt, Human
agcauaaaaauuagccaag

SEQ ID NO: 3510160 - RNA, 17 nt, Human
agcauaaaagaugaaag

SEQ ID NO: 3510161 - RNA, 23 nt, Human
agcauaaaagaugaaagagcagu

SEQ ID NO: 3510162 - RNA, 11 nt, Human
agcauaaagaa

SEQ ID NO: 3510163 - RNA, 23 nt, Human
agcauaaagcucaaaugaaaugu

SEQ ID NO: 3510164 - RNA, 14 nt, Human
agcauaaaugcaaa

SEQ ID NO: 3510165 - RNA, 23 nt, Human
agcauaaauguugacaugggaca

SEQ ID NO: 3510166 - RNA, 20 nt, Human
agcauaacaagguccaagau

SEQ ID NO: 3510167 - RNA, 21 nt, Human
agcauaauacuugcuuuggaa

SEQ ID NO: 3510168 - RNA, 16 nt, Human
agcauaauuuaaaaau

SEQ ID NO: 3510169 - RNA, 21 nt, Human
agcauaauuuaaaaauauauu

SEQ ID NO: 3510170 - RNA, 22 nt, Human
agcauaauuuaaaaauauauuu

SEQ ID NO: 3510171 - RNA, 13 nt, Human
agcauacauuuau

SEQ ID NO: 3510172 - RNA, 20 nt, Human
agcauacauuuauaauguuu

SEQ ID NO: 3510173 - RNA, 17 nt, Human
agcauaccuuuauugug

SEQ ID NO: 3510174 - RNA, 15 nt, Human
agcauacguacacau

SEQ ID NO: 3510175 - RNA, 19 nt, Human
agcauacguacacauuuua

SEQ ID NO: 3510176 - RNA, 20 nt, Human
agcauacguacacauuuuau

SEQ ID NO: 3510177 - RNA, 21 nt, Human
agcauacuggcuucaccauca

SEQ ID NO: 3510178 - RNA, 13 nt, Human
agcauacuuugua

SEQ ID NO: 3510179 - RNA, 16 nt, Human
agcauagaaaccacua

SEQ ID NO: 3510180 - RNA, 13 nt, Human
agggucccaagcu

SEQ ID NO: 3510181 - RNA, 19 nt, Human
agggucccaagcugggccc

SEQ ID NO: 3510182 - RNA, 18 nt, Human
aggguccccaccugggac

SEQ ID NO: 3510183 - RNA, 22 nt, Human
agggucccugguggcagcucac

SEQ ID NO: 3510184 - RNA, 15 nt, Human
aggguccuccacaau

SEQ ID NO: 3510185 - RNA, 16 nt, Human
aggguccugcagccug

SEQ ID NO: 3510186 - RNA, 22 nt, Human
aggguccugcuauuucccaagc

SEQ ID NO: 3510187 - RNA, 14 nt, Human
aggguccuggcucc

SEQ ID NO: 3510188 - RNA, 16 nt, Human
aggguccuggcuccug

SEQ ID NO: 3510189 - RNA, 15 nt, Human
aggguccuggggaac

SEQ ID NO: 3510190 - RNA, 21 nt, Human
aggguccuggggaaccugacc

SEQ ID NO: 3510191 - RNA, 23 nt, Human
aggguccuggggaaccugacccc

SEQ ID NO: 3510192 - RNA, 17 nt, Human
aggguccuucccucucc

SEQ ID NO: 3510193 - RNA, 17 nt, Human
aggguccuuuugacacu

SEQ ID NO: 3510194 - RNA, 18 nt, Human
agggucgaaagcucuaga

SEQ ID NO: 3510195 - RNA, 19 nt, Human
agggucuagggagagaccc

SEQ ID NO: 3510196 - RNA, 20 nt, Human
agggucucacuauguugccc

SEQ ID NO: 3510197 - RNA, 21 nt, Human
agggucucacuauguugccca

SEQ ID NO: 3510198 - RNA, 16 nt, Human
agggucucacucuguc

SEQ ID NO: 3510199 - RNA, 22 nt, Human
agggucucacucugucgcccag

SEQ ID NO: 3510200 - RNA, 16 nt, Human
agggucucaggguguc

SEQ ID NO: 3510201 - RNA, 16 nt, Human
agggucucuagugcug

SEQ ID NO: 3510202 - RNA, 18 nt, Human
agggucucuagugcugug

SEQ ID NO: 3510203 - RNA, 16 nt, Human
agggucucugcugccg

SEQ ID NO: 3510204 - RNA, 14 nt, Human
agggucugcucuuu

SEQ ID NO: 3510205 - RNA, 20 nt, Human
agggucugcucuuucucugc

SEQ ID NO: 3510206 - RNA, 19 nt, Human
agggucuggagaagcagug

SEQ ID NO: 3510207 - RNA, 22 nt, Human
agggucugggaaaugagcaggg

SEQ ID NO: 3510208 - RNA, 17 nt, Human
agggucugggcaggacu

SEQ ID NO: 3510209 - RNA, 23 nt, Human
agggucugggggcacaagacuga

SEQ ID NO: 3510210 - RNA, 19 nt, Human
agggucuguagguugcaca

SEQ ID NO: 3510211 - RNA, 17 nt, Human
agggucuguuuggacug

SEQ ID NO: 3510212 - RNA, 15 nt, Human
agggucuugggaaau

SEQ ID NO: 3510213 - RNA, 21 nt, Human
agggucuugguuccagccugc

SEQ ID NO: 3510214 - RNA, 22 nt, Human
agggucuugguuccagccugcc

SEQ ID NO: 3510215 - RNA, 21 nt, Human
agggucuuucucaaagaaaua

SEQ ID NO: 3510216 - RNA, 14 nt, Human
agggugagagcugc

SEQ ID NO: 3510217 - RNA, 20 nt, Human
agggugaguuggcuuaccug

SEQ ID NO: 3510218 - RNA, 22 nt, Human
agggugaugggaaagcauugua

SEQ ID NO: 3510219 - RNA, 20 nt, Human
agggugcaguaucaugcccu

SEQ ID NO: 3510220 - RNA, 14 nt, Human
agggugcccagaac

SEQ ID NO: 3510221 - RNA, 22 nt, Human
agggugcuacguacaugugagg

SEQ ID NO: 3510222 - RNA, 17 nt, Human
agggugcugcuucccuc

SEQ ID NO: 3510223 - RNA, 22 nt, Human
aggguggacuuagaaagcaggg

SEQ ID NO: 3510224 - RNA, 14 nt, Human
aggguggcccuugc

SEQ ID NO: 3510225 - RNA, 19 nt, Human
agggugggagagcccagcc

SEQ ID NO: 3510226 - RNA, 15 nt, Human
agggugggagugggc

SEQ ID NO: 3510227 - RNA, 17 nt, Human
agggugggcuugugggg

SEQ ID NO: 3510228 - RNA, 23 nt, Human
agggugggggccaccugccugcg

SEQ ID NO: 3510229 - RNA, 17 nt, Human
agggugggugcucagaa

SEQ ID NO: 3510230 - RNA, 20 nt, Human
agggugggugcucagaauaa

SEQ ID NO: 3510231 - RNA, 16 nt, Human
aggguggugaccucug

SEQ ID NO: 3510232 - RNA, 18 nt, Human
aggguggugaccucugcc

SEQ ID NO: 3510233 - RNA, 15 nt, Human
agggugguggagcca

SEQ ID NO: 3510234 - RNA, 17 nt, Human
agguccaaugagcuuuc

SEQ ID NO: 3510235 - RNA, 19 nt, Human
agguccaaugagcuuucug

SEQ ID NO: 3510236 - RNA, 17 nt, Human
agguccacaacacacag

SEQ ID NO: 3510237 - RNA, 19 nt, Human
agguccacaacacacagau

SEQ ID NO: 3510238 - RNA, 20 nt, Human
agguccacaggucuagacua

SEQ ID NO: 3510239 - RNA, 11 nt, Human
agguccagccc

SEQ ID NO: 3510240 - RNA, 12 nt, Human
agguccagccca

SEQ ID NO: 3510241 - RNA, 16 nt, Human
aggucccaaggcaagg

SEQ ID NO: 3510242 - RNA, 14 nt, Human
aggucccaccucca

SEQ ID NO: 3510243 - RNA, 15 nt, Human
aggucccaccuccag

SEQ ID NO: 3510244 - RNA, 12 nt, Human
aggucccaggca

SEQ ID NO: 3510245 - RNA, 11 nt, Human
agguccccaga

SEQ ID NO: 3510246 - RNA, 11 nt, Human
aggucccuaau

SEQ ID NO: 3510247 - RNA, 17 nt, Human
aggucccuaauaaagcu

SEQ ID NO: 3510248 - RNA, 23 nt, Human
aggucccuaauaaagcugugugg

SEQ ID NO: 3510249 - RNA, 18 nt, Human
agguccgguguucuaaga

SEQ ID NO: 3510250 - RNA, 21 nt, Human
agguccucaguguccucaggg

SEQ ID NO: 3510251 - RNA, 20 nt, Human
agguccucuggagcccuaac

SEQ ID NO: 3510252 - RNA, 13 nt, Human
agguccucuguca

SEQ ID NO: 3510253 - RNA, 18 nt, Human
agguccugagcacugcca

SEQ ID NO: 3510254 - RNA, 21 nt, Human
agguccugagcacugccagga

SEQ ID NO: 3510255 - RNA, 19 nt, Human
agguccugauuucuagaac

SEQ ID NO: 3510256 - RNA, 20 nt, Human
agguccugcagucuggcuga

SEQ ID NO: 3510257 - RNA, 17 nt, Human
agguccugggggccuga

SEQ ID NO: 3510258 - RNA, 20 nt, Human
agguccugguggggcagcuc

SEQ ID NO: 3510259 - RNA, 22 nt, Human
agguccugguggggcagcuccu

SEQ ID NO: 3510260 - RNA, 12 nt, Human
agguccuugccc

SEQ ID NO: 3510261 - RNA, 19 nt, Human
aggucgggaguuggagacc

SEQ ID NO: 3510262 - RNA, 13 nt, Human
aggucgggcucag

SEQ ID NO: 3510263 - RNA, 19 nt, Human
aggucgggcucagcucugg

SEQ ID NO: 3510264 - RNA, 22 nt, Human
aggucuaggaacauacuucagc

SEQ ID NO: 3510265 - RNA, 20 nt, Human
aggucuauuuaaaaaaaaag

SEQ ID NO: 3510266 - RNA, 22 nt, Human
aggucucaacccuuuugucugc

SEQ ID NO: 3510267 - RNA, 13 nt, Human
aggucucacgggc

SEQ ID NO: 3510268 - RNA, 14 nt, Human
aggucucagccccu

SEQ ID NO: 3510269 - RNA, 13 nt, Human
aggucucccugga

SEQ ID NO: 3510270 - RNA, 12 nt, Human
aggucuccucca

SEQ ID NO: 3510271 - RNA, 18 nt, Human
aggucuccuccaccgcca

SEQ ID NO: 3510272 - RNA, 23 nt, Human
aggucuccuccaccgccauggcu

SEQ ID NO: 3510273 - RNA, 12 nt, Human
aggucuccucuu

SEQ ID NO: 3510274 - RNA, 17 nt, Human
aggucuccucuuaaaaa

SEQ ID NO: 3510275 - RNA, 21 nt, Human
aggucucuguugacuggcugu

SEQ ID NO: 3510276 - RNA, 16 nt, Human
aggucucuuccccucu

SEQ ID NO: 3510277 - RNA, 18 nt, Human
aggucucuucucccagaa

SEQ ID NO: 3510278 - RNA, 16 nt, Human
aggucucuugagggag

SEQ ID NO: 3510279 - RNA, 13 nt, Human
aggucugaguugu

SEQ ID NO: 3510280 - RNA, 22 nt, Human
aggucuggagaagcucccagga

SEQ ID NO: 3510281 - RNA, 16 nt, Human
aggucuggcugcuugc

SEQ ID NO: 3510282 - RNA, 19 nt, Human
aggucugggagaggcagag

SEQ ID NO: 3510283 - RNA, 21 nt, Human
aggucugggcuagguagaaaa

SEQ ID NO: 3510284 - RNA, 15 nt, Human
aggucuguucuuucc

SEQ ID NO: 3510285 - RNA, 16 nt, Human
aggucuguucuuucca

SEQ ID NO: 3510286 - RNA, 23 nt, Human
aggucuguucuuuccaaaguaca

SEQ ID NO: 3510287 - RNA, 20 nt, Human
aggucuguuuaaaguggcaa

SEQ ID NO: 3510288 - RNA, 15 nt, Human
aggucuguuugcugu

SEQ ID NO: 3510289 - RNA, 17 nt, Human
aggucuguuugcuguug

SEQ ID NO: 3510290 - RNA, 16 nt, Human
aggucuugaacuccug

SEQ ID NO: 3510291 - RNA, 20 nt, Human
aggucuugaacuccuggccu

SEQ ID NO: 3510292 - RNA, 21 nt, Human
aggucuugaacuccuggccuc

SEQ ID NO: 3510293 - RNA, 22 nt, Human
aggucuugaacuccuggccuca

SEQ ID NO: 3510294 - RNA, 20 nt, Human
aggucuugauuuguuuuaga

SEQ ID NO: 3510295 - RNA, 23 nt, Human
aggucuugcucuccuagguagcc

SEQ ID NO: 3510296 - RNA, 20 nt, Human
aggucuuuguaagaacuaaa

SEQ ID NO: 3510297 - RNA, 14 nt, Human
aggucuuuugacau

SEQ ID NO: 3510298 - RNA, 18 nt, Human
aggucuuuugacaugugg

SEQ ID NO: 3510299 - RNA, 21 nt, Human
aggucuuuugacauguggaaa

SEQ ID NO: 3510300 - RNA, 14 nt, Human
aggucuuuuuuuaa

SEQ ID NO: 3510301 - RNA, 17 nt, Human
aggugaaacauuuucuc

SEQ ID NO: 3510302 - RNA, 21 nt, Human
aggugaaagggagcuaucagg

SEQ ID NO: 3510303 - RNA, 14 nt, Human
aggugaacauuggu

SEQ ID NO: 3510304 - RNA, 21 nt, Human
aggugaacauugguucuuuca

SEQ ID NO: 3510305 - RNA, 23 nt, Human
aggugaaggaauauauggcagag

SEQ ID NO: 3510306 - RNA, 18 nt, Human
aggugaaggaggcuccag

SEQ ID NO: 3510307 - RNA, 18 nt, Human
aggugacagugagguccu

SEQ ID NO: 3510308 - RNA, 15 nt, Human
aggugacaugugaaa

SEQ ID NO: 3510309 - RNA, 16 nt, Human
aggugacaugugaaac

SEQ ID NO: 3510310 - RNA, 24 nt, Human
aggugaccccagggcacaggagcu

SEQ ID NO: 3510311 - RNA, 16 nt, Human
aggugaccuucuggga

SEQ ID NO: 3510312 - RNA, 20 nt, Human
aggugaccuugcaacuucau

SEQ ID NO: 3510313 - RNA, 22 nt, Human
aggugacugggcccugccucug

SEQ ID NO: 3510314 - RNA, 15 nt, Human
aggugacugucuggg

SEQ ID NO: 3510315 - RNA, 13 nt, Human
aggugagaaacug

SEQ ID NO: 3510316 - RNA, 21 nt, Human
aggugagaagcagaggaagga

SEQ ID NO: 3510317 - RNA, 15 nt, Human
aggugagaccaccuc

SEQ ID NO: 3510318 - RNA, 21 nt, Human
aggugagcaaccaguuggcua

SEQ ID NO: 3510319 - RNA, 13 nt, Human
aggugagggaugu

SEQ ID NO: 3510320 - RNA, 20 nt, Human
aggugaguuugagcugccuu

SEQ ID NO: 3510321 - RNA, 21 nt, Human
aggugaguuugagcugccuuc

SEQ ID NO: 3510322 - RNA, 15 nt, Human
aggugauaaaaucau

SEQ ID NO: 3510323 - RNA, 15 nt, Human
aggugauaagggaaa

SEQ ID NO: 3510324 - RNA, 16 nt, Human
aggugauagcauugcu

SEQ ID NO: 3510325 - RNA, 18 nt, Human
aggugauagcauugcuuu

SEQ ID NO: 3510326 - RNA, 14 nt, Human
aggugauccaccca

SEQ ID NO: 3510327 - RNA, 20 nt, Human
aggugauccacccaccucag

SEQ ID NO: 3510328 - RNA, 21 nt, Human
aggugauccauguaacugccu

SEQ ID NO: 3510329 - RNA, 22 nt, Human
aggugaucugcugcagagcagu

SEQ ID NO: 3510330 - RNA, 16 nt, Human
aggugauuaacuugga

SEQ ID NO: 3510331 - RNA, 19 nt, Human
aggugcaauuucaagguuc

SEQ ID NO: 3510332 - RNA, 16 nt, Human
aggugcacaagcucca

SEQ ID NO: 3510333 - RNA, 17 nt, Human
aggugcacaagcuccaa

SEQ ID NO: 3510334 - RNA, 23 nt, Human
aggugcacagacgucccuccacg

SEQ ID NO: 3510335 - RNA, 22 nt, Human
aggugcacuuggggcacaggga

SEQ ID NO: 3510336 - RNA, 12 nt, Human
aggugcagaggu

SEQ ID NO: 3510337 - RNA, 20 nt, Human
aggugcagagugcccagaac

SEQ ID NO: 3510338 - RNA, 16 nt, Human
agcauagaaggcaggu

SEQ ID NO: 3510339 - RNA, 20 nt, Human
agcauaggugauccauguaa

SEQ ID NO: 3510340 - RNA, 15 nt, Human
agcauauaaaauggc

SEQ ID NO: 3510341 - RNA, 15 nt, Human
agcauauauuuuuau

SEQ ID NO: 3510342 - RNA, 18 nt, Human
agcauauauuuuuauauu

SEQ ID NO: 3510343 - RNA, 20 nt, Human
agcauauauuuuuauauuua

SEQ ID NO: 3510344 - RNA, 13 nt, Human
agcauaucugccu

SEQ ID NO: 3510345 - RNA, 15 nt, Human
agcauaucugccuuu

SEQ ID NO: 3510346 - RNA, 17 nt, Human
agcauaucugccuuuau

SEQ ID NO: 3510347 - RNA, 16 nt, Human
agcauaugaggaugca

SEQ ID NO: 3510348 - RNA, 21 nt, Human
agcauaugaguuucauagcua

SEQ ID NO: 3510349 - RNA, 18 nt, Human
agcauauuuguauaguug

SEQ ID NO: 3510350 - RNA, 13 nt, Human
agcaucaagccac

SEQ ID NO: 3510351 - RNA, 15 nt, Human
agcaucacaguuuug

SEQ ID NO: 3510352 - RNA, 14 nt, Human
agcaucaccucagg

SEQ ID NO: 3510353 - RNA, 19 nt, Human
agcaucaccucaggccagg

SEQ ID NO: 3510354 - RNA, 15 nt, Human
agcaucaccugccug

SEQ ID NO: 3510355 - RNA, 14 nt, Human
agcaucacuuaaaa

SEQ ID NO: 3510356 - RNA, 18 nt, Human
agcaucacuuaaaacacg

SEQ ID NO: 3510357 - RNA, 17 nt, Human
agcaucacuugggauua

SEQ ID NO: 3510358 - RNA, 16 nt, Human
agcaucaggccaggcc

SEQ ID NO: 3510359 - RNA, 18 nt, Human
agcaucaggccaggcccu

SEQ ID NO: 3510360 - RNA, 21 nt, Human
agcaucaggccaggcccucug

SEQ ID NO: 3510361 - RNA, 17 nt, Human
agcaucagggggaagaa

SEQ ID NO: 3510362 - RNA, 13 nt, Human
agcaucaugccuc

SEQ ID NO: 3510363 - RNA, 15 nt, Human
agcaucaugccucug

SEQ ID NO: 3510364 - RNA, 16 nt, Human
agcaucaugccucuga

SEQ ID NO: 3510365 - RNA, 21 nt, Human
agcaucaugccucugaggcca

SEQ ID NO: 3510366 - RNA, 19 nt, Human
agcaucauuuugcauucaa

SEQ ID NO: 3510367 - RNA, 22 nt, Human
agcaucccaggaucgcaagagc

SEQ ID NO: 3510368 - RNA, 12 nt, Human
agcaucccccaa

SEQ ID NO: 3510369 - RNA, 17 nt, Human
agcauccccuugaacuc

SEQ ID NO: 3510370 - RNA, 13 nt, Human
agcaucccggagg

SEQ ID NO: 3510371 - RNA, 15 nt, Human
agcaucccucaccca

SEQ ID NO: 3510372 - RNA, 21 nt, Human
agcaucccuugaccaggccug

SEQ ID NO: 3510373 - RNA, 15 nt, Human
agcauccuaagaaau

SEQ ID NO: 3510374 - RNA, 16 nt, Human
agcauccuaagaaaua

SEQ ID NO: 3510375 - RNA, 16 nt, Human
agcauccucaguuccu

SEQ ID NO: 3510376 - RNA, 13 nt, Human
agcauccuggaau

SEQ ID NO: 3510377 - RNA, 13 nt, Human
agcauccuggcac

SEQ ID NO: 3510378 - RNA, 17 nt, Human
agcauccuggcacccgg

SEQ ID NO: 3510379 - RNA, 19 nt, Human
agccccacccucagaugca

SEQ ID NO: 3510380 - RNA, 14 nt, Human
agccccacucucag

SEQ ID NO: 3510381 - RNA, 22 nt, Human
agccccacucucagaggcccca

SEQ ID NO: 3510382 - RNA, 17 nt, Human
agccccacugccagcag

SEQ ID NO: 3510383 - RNA, 12 nt, Human
agccccagagca

SEQ ID NO: 3510384 - RNA, 15 nt, Human
agccccagcacuaac

SEQ ID NO: 3510385 - RNA, 13 nt, Human
agccccagccagg

SEQ ID NO: 3510386 - RNA, 23 nt, Human
agccccagcccagcccagcugcu

SEQ ID NO: 3510387 - RNA, 14 nt, Human
agccccagcccccu

SEQ ID NO: 3510388 - RNA, 18 nt, Human
agccccagcccccuuugg

SEQ ID NO: 3510389 - RNA, 14 nt, Human
agccccagccugcu

SEQ ID NO: 3510390 - RNA, 12 nt, Human
agccccagcuga

SEQ ID NO: 3510391 - RNA, 20 nt, Human
agccccaggcaggcugugcg

SEQ ID NO: 3510392 - RNA, 15 nt, Human
agccccaggccucug

SEQ ID NO: 3510393 - RNA, 17 nt, Human
agccccagugacagcua

SEQ ID NO: 3510394 - RNA, 16 nt, Human
agccccagugcccaca

SEQ ID NO: 3510395 - RNA, 17 nt, Human
agccccauccucuguac

SEQ ID NO: 3510396 - RNA, 15 nt, Human
agccccauccugccg

SEQ ID NO: 3510397 - RNA, 16 nt, Human
agccccaucuagggga

SEQ ID NO: 3510398 - RNA, 17 nt, Human
agccccaucugugcauu

SEQ ID NO: 3510399 - RNA, 14 nt, Human
agccccaucuucac

SEQ ID NO: 3510400 - RNA, 16 nt, Human
agccccaugcuggagc

SEQ ID NO: 3510401 - RNA, 22 nt, Human
aguauucugccuuugcagaaac

SEQ ID NO: 3510402 - RNA, 14 nt, Human
aguauucuucucuu

SEQ ID NO: 3510403 - RNA, 15 nt, Human
aguauucuugucaaa

SEQ ID NO: 3510404 - RNA, 15 nt, Human
aguauugacaaaaug

SEQ ID NO: 3510405 - RNA, 16 nt, Human
aguauugacaaaaugu

SEQ ID NO: 3510406 - RNA, 16 nt, Human
aguauugauucugcuu

SEQ ID NO: 3510407 - RNA, 17 nt, Human
aguauugcaucuguaua

SEQ ID NO: 3510408 - RNA, 14 nt, Human
aguauugccaaaca

SEQ ID NO: 3510409 - RNA, 15 nt, Human
aguauugccaaacau

SEQ ID NO: 3510410 - RNA, 18 nt, Human
aguauuguaaauuauauu

SEQ ID NO: 3510411 - RNA, 16 nt, Human
aguauuguaaugagug

SEQ ID NO: 3510412 - RNA, 15 nt, Human
aguauuguacaaagu

SEQ ID NO: 3510413 - RNA, 22 nt, Human
aguauuguacaaaguauuaagc

SEQ ID NO: 3510414 - RNA, 23 nt, Human
aguauuguacaaaguauuaagca

SEQ ID NO: 3510415 - RNA, 12 nt, Human
aguauuguuguc

SEQ ID NO: 3510416 - RNA, 13 nt, Human
aguauuguugucc

SEQ ID NO: 3510417 - RNA, 19 nt, Human
aguauuguuguccuuuuca

SEQ ID NO: 3510418 - RNA, 24 nt, Human
aguauuguuguccuuuucauaggu

SEQ ID NO: 3510419 - RNA, 17 nt, Human
aguauuuaacuaauuau

SEQ ID NO: 3510420 - RNA, 18 nt, Human
aguauuuaagccuaaaga

SEQ ID NO: 3510421 - RNA, 21 nt, Human
aguauuuaagccuaaagauuu

SEQ ID NO: 3510422 - RNA, 16 nt, Human
aguauuuaauuagugc

SEQ ID NO: 3510423 - RNA, 17 nt, Human
aguauuuaauuagugcu

SEQ ID NO: 3510424 - RNA, 21 nt, Human
aguauuuaauucauguugccu

SEQ ID NO: 3510425 - RNA, 15 nt, Human
aguauuuagaagcca

SEQ ID NO: 3510426 - RNA, 15 nt, Human
aguauuuauauauuu

SEQ ID NO: 3510427 - RNA, 13 nt, Human
aguauuuaugggu

SEQ ID NO: 3510428 - RNA, 16 nt, Human
aguauuuauuuaugua

SEQ ID NO: 3510429 - RNA, 18 nt, Human
aguauuuauuuuguaauu

SEQ ID NO: 3510430 - RNA, 22 nt, Human
aguauuuauuuuguaauuauga

SEQ ID NO: 3510431 - RNA, 14 nt, Human
aguauuucagugua

SEQ ID NO: 3510432 - RNA, 18 nt, Human
aguauuuccacuuguucu

SEQ ID NO: 3510433 - RNA, 13 nt, Human
aguauuucuauga

SEQ ID NO: 3510434 - RNA, 16 nt, Human
aguauuucuaugaaau

SEQ ID NO: 3510435 - RNA, 17 nt, Human
aguauuucuaugaaaua

SEQ ID NO: 3510436 - RNA, 18 nt, Human
aguauuucuaugaaauau

SEQ ID NO: 3510437 - RNA, 22 nt, Human
aguauuucuaugaaauauuaug

SEQ ID NO: 3510438 - RNA, 17 nt, Human
aguauuugaaaacagaa

SEQ ID NO: 3510439 - RNA, 12 nt, Human
aguauuugaauu

SEQ ID NO: 3510440 - RNA, 21 nt, Human
aguauuugaauuaaaacuucu

SEQ ID NO: 3510441 - RNA, 16 nt, Human
aguauuugagaguucu

SEQ ID NO: 3510442 - RNA, 17 nt, Human
aguauuugauucaaaau

SEQ ID NO: 3510443 - RNA, 19 nt, Human
aguauuugauucaaaauau

SEQ ID NO: 3510444 - RNA, 14 nt, Human
aguauuugugggga

SEQ ID NO: 3510445 - RNA, 13 nt, Human
aguauuuguuaau

SEQ ID NO: 3510446 - RNA, 14 nt, Human
aguauuuucccaau

SEQ ID NO: 3510447 - RNA, 13 nt, Human
aguauuuugaagu

SEQ ID NO: 3510448 - RNA, 14 nt, Human
aguauuuugaaguu

SEQ ID NO: 3510449 - RNA, 15 nt, Human
aguauuuugaaguuu

SEQ ID NO: 3510450 - RNA, 19 nt, Human
aguauuuugaaguuuacau

SEQ ID NO: 3510451 - RNA, 21 nt, Human
aguauuuugaaguuuacauuu

SEQ ID NO: 3510452 - RNA, 23 nt, Human
aguauuuugguucuuaguucuca

SEQ ID NO: 3510453 - RNA, 15 nt, Human
aguauuuuguguccu

SEQ ID NO: 3510454 - RNA, 17 nt, Human
aguauuuuguuucagug

SEQ ID NO: 3510455 - RNA, 13 nt, Human
aguauuuuugaca

SEQ ID NO: 3510456 - RNA, 16 nt, Human
aguauuuuuguauuca

SEQ ID NO: 3510457 - RNA, 20 nt, Human
aguauuuuuuacauuuuaca

SEQ ID NO: 3510458 - RNA, 14 nt, Human
aguauuuuuucaag

SEQ ID NO: 3510459 - RNA, 20 nt, Human
aguauuuuuuuaucuuggga

SEQ ID NO: 3510460 - RNA, 12 nt, Human
agucaaaaagaa

SEQ ID NO: 3510461 - RNA, 14 nt, Human
agucaaaaagaacc

SEQ ID NO: 3510462 - RNA, 17 nt, Human
agucaaaacuacaaauc

SEQ ID NO: 3510463 - RNA, 16 nt, Human
agucaaaacucaaaug

SEQ ID NO: 3510464 - RNA, 21 nt, Human
agucaaaaggugccugugagg

SEQ ID NO: 3510465 - RNA, 14 nt, Human
agucaaaauaauuc

SEQ ID NO: 3510466 - RNA, 22 nt, Human
agucaaaauauuuuuaaaagau

SEQ ID NO: 3510467 - RNA, 17 nt, Human
agucaaaccauaaacuu

SEQ ID NO: 3510468 - RNA, 21 nt, Human
agucaaaguaaaacuugcugc

SEQ ID NO: 3510469 - RNA, 20 nt, Human
agucaaaguugaaaauucau

SEQ ID NO: 3510470 - RNA, 23 nt, Human
agucaaaugguaggcauuuccua

SEQ ID NO: 3510471 - RNA, 18 nt, Human
agucaaauuaauaaucuu

SEQ ID NO: 3510472 - RNA, 15 nt, Human
agucaaauuguguga

SEQ ID NO: 3510473 - RNA, 19 nt, Human
agucaaauugugugaaagg

SEQ ID NO: 3510474 - RNA, 23 nt, Human
agucaaauugugugaaagguacu

SEQ ID NO: 3510475 - RNA, 22 nt, Human
agucaaauuugaaaauaauugu

SEQ ID NO: 3510476 - RNA, 14 nt, Human
agucaacaagccug

SEQ ID NO: 3510477 - RNA, 22 nt, Human
agucaacaguaaaccacugaaa

SEQ ID NO: 3510478 - RNA, 14 nt, Human
agucaacagugaaa

SEQ ID NO: 3510479 - RNA, 14 nt, Human
agucaaccugggca

SEQ ID NO: 3510480 - RNA, 12 nt, Human
agucaagaaaaa

SEQ ID NO: 3510481 - RNA, 15 nt, Human
agucaagaagaaaaa

SEQ ID NO: 3510482 - RNA, 15 nt, Human
agucaagagcauccu

SEQ ID NO: 3510483 - RNA, 20 nt, Human
agucaagcuccuccucccug

SEQ ID NO: 3510484 - RNA, 15 nt, Human
agucaaggccugcuc

SEQ ID NO: 3510485 - RNA, 16 nt, Human
agucaaggcuuagacc

SEQ ID NO: 3510486 - RNA, 12 nt, Human
agucaauacaua

SEQ ID NO: 3510487 - RNA, 12 nt, Human
agucaaucaagu

SEQ ID NO: 3510488 - RNA, 18 nt, Human
agucaaucaagucuguuu

SEQ ID NO: 3510489 - RNA, 14 nt, Human
agucaaucauuucu

SEQ ID NO: 3510490 - RNA, 15 nt, Human
agucaaucauuucuc

SEQ ID NO: 3510491 - RNA, 23 nt, Human
agucaauguuuucaguucucuug

SEQ ID NO: 3510492 - RNA, 13 nt, Human
agucacaaaggaa

SEQ ID NO: 3510493 - RNA, 16 nt, Human
agucacaagagcccag

SEQ ID NO: 3510494 - RNA, 18 nt, Human
agucacaauguucuuuau

SEQ ID NO: 3510495 - RNA, 23 nt, Human
agucacacaguauuacuucugcu

SEQ ID NO: 3510496 - RNA, 18 nt, Human
agucacacauuacaaagu

SEQ ID NO: 3510497 - RNA, 19 nt, Human
agucacacgggggcagcug

SEQ ID NO: 3510498 - RNA, 22 nt, Human
agucacagagauaauucuagcu

SEQ ID NO: 3510499 - RNA, 13 nt, Human
agucacagccacc

SEQ ID NO: 3510500 - RNA, 14 nt, Human
agucacaucacagg

SEQ ID NO: 3510501 - RNA, 19 nt, Human
agucacauuccugaacagg

SEQ ID NO: 3510502 - RNA, 21 nt, Human
agucaccaaauagugugaaau

SEQ ID NO: 3510503 - RNA, 13 nt, Human
agucaccaagccc

SEQ ID NO: 3510504 - RNA, 13 nt, Human
agucaccaggaau

SEQ ID NO: 3510505 - RNA, 17 nt, Human
agucacccaugaagaca

SEQ ID NO: 3510506 - RNA, 20 nt, Human
agucacccaugaagacagga

SEQ ID NO: 3510507 - RNA, 13 nt, Human
agucaccccagga

SEQ ID NO: 3510508 - RNA, 20 nt, Human
agucacccggcccccaugca

SEQ ID NO: 3510509 - RNA, 15 nt, Human
agucacccuagcccu

SEQ ID NO: 3510510 - RNA, 15 nt, Human
agucaccucauggaa

SEQ ID NO: 3510511 - RNA, 13 nt, Human
agucaccuuccag

SEQ ID NO: 3510512 - RNA, 14 nt, Human
agucaccuucccuu

SEQ ID NO: 3510513 - RNA, 16 nt, Human
agucaccuuuuaaauc

SEQ ID NO: 3510514 - RNA, 18 nt, Human
agucacgcaugcaguguu

SEQ ID NO: 3510515 - RNA, 18 nt, Human
agucacguggaggagcag

SEQ ID NO: 3510516 - RNA, 21 nt, Human
agucacuaaaaggaagacagu

SEQ ID NO: 3510517 - RNA, 16 nt, Human
agucacugagacagcc

SEQ ID NO: 3510518 - RNA, 17 nt, Human
agucacugagacagccc

SEQ ID NO: 3510519 - RNA, 13 nt, Human
agucacugagacc

SEQ ID NO: 3510520 - RNA, 23 nt, Human
agucacugagaccaaggcuuucu

SEQ ID NO: 3510521 - RNA, 16 nt, Human
agucacugauguacaa

SEQ ID NO: 3510522 - RNA, 18 nt, Human
agucacugcaaaaccagg

SEQ ID NO: 3510523 - RNA, 20 nt, Human
agucacugccacuuugcaca

SEQ ID NO: 3510524 - RNA, 17 nt, Human
agucacugccucucccu

SEQ ID NO: 3510525 - RNA, 21 nt, Human
agcccuaaccccuuccagauc

SEQ ID NO: 3510526 - RNA, 16 nt, Human
agcccuaaggaucucu

SEQ ID NO: 3510527 - RNA, 17 nt, Human
agcccuaagguccuaag

SEQ ID NO: 3510528 - RNA, 18 nt, Human
agcccuacagagcugugg

SEQ ID NO: 3510529 - RNA, 16 nt, Human
agcccuacucccugca

SEQ ID NO: 3510530 - RNA, 17 nt, Human
agcccuacucccugcag

SEQ ID NO: 3510531 - RNA, 20 nt, Human
agcccuacucccugcagaug

SEQ ID NO: 3510532 - RNA, 17 nt, Human
agcccuagagccugccu

SEQ ID NO: 3510533 - RNA, 16 nt, Human
agcccuauggaugugg

SEQ ID NO: 3510534 - RNA, 13 nt, Human
agcccucaaagug

SEQ ID NO: 3510535 - RNA, 17 nt, Human
agcccucaauugugaaa

SEQ ID NO: 3510536 - RNA, 23 nt, Human
agcccucacacacccugucugcc

SEQ ID NO: 3510537 - RNA, 17 nt, Human
agcccucacccuggggc

SEQ ID NO: 3510538 - RNA, 14 nt, Human
agcccucagaaccc

SEQ ID NO: 3510539 - RNA, 16 nt, Human
agcccucaucccgagc

SEQ ID NO: 3510540 - RNA, 23 nt, Human
agcccucaucuugaagggcccag

SEQ ID NO: 3510541 - RNA, 21 nt, Human
agcccuccaucuaaacugccc

SEQ ID NO: 3510542 - RNA, 11 nt, Human
agcccucccca

SEQ ID NO: 3510543 - RNA, 13 nt, Human
agcccucccugcc

SEQ ID NO: 3510544 - RNA, 15 nt, Human
agcccucccugcccc

SEQ ID NO: 3510545 - RNA, 14 nt, Human
agcccucccugucc

SEQ ID NO: 3510546 - RNA, 19 nt, Human
agcccucccuguccuccuc

SEQ ID NO: 3510547 - RNA, 22 nt, Human
agcccucccuguccuccucgga

SEQ ID NO: 3510548 - RNA, 23 nt, Human
agcccuccgccauucucaagccc

SEQ ID NO: 3510549 - RNA, 11 nt, Human
agcccuccuuc

SEQ ID NO: 3510550 - RNA, 17 nt, Human
agcccuccuuccacgga

SEQ ID NO: 3510551 - RNA, 18 nt, Human
agcccucucacugugucc

SEQ ID NO: 3510552 - RNA, 12 nt, Human
agcccucucccu

SEQ ID NO: 3510553 - RNA, 13 nt, Human
agcccugacccug

SEQ ID NO: 3510554 - RNA, 17 nt, Human
agcccugacccugugga

SEQ ID NO: 3510555 - RNA, 19 nt, Human
agcccugacgcaaugaaaa

SEQ ID NO: 3510556 - RNA, 19 nt, Human
agcccugagaaagcccugu

SEQ ID NO: 3510557 - RNA, 15 nt, Human
agcccugagcuuucu

SEQ ID NO: 3510558 - RNA, 23 nt, Human
agcccugaggacagaugccuccu

SEQ ID NO: 3510559 - RNA, 17 nt, Human
agcccugaggaggccuu

SEQ ID NO: 3510560 - RNA, 22 nt, Human
agcccugaggugaaagggagcu

SEQ ID NO: 3510561 - RNA, 22 nt, Human
agcccugagguuugaaucugac

SEQ ID NO: 3510562 - RNA, 14 nt, Human
agucaggggcagcu

SEQ ID NO: 3510563 - RNA, 14 nt, Human
agucagguccaauu

SEQ ID NO: 3510564 - RNA, 18 nt, Human
agucaguacccaccaccu

SEQ ID NO: 3510565 - RNA, 17 nt, Human
agucaguauuguuuugg

SEQ ID NO: 3510566 - RNA, 22 nt, Human
agucagucgccuuucagcaggc

SEQ ID NO: 3510567 - RNA, 19 nt, Human
agucagucugcacuuaaau

SEQ ID NO: 3510568 - RNA, 13 nt, Human
agucauaaaccuu

SEQ ID NO: 3510569 - RNA, 15 nt, Human
agucauaaaccuuaa

SEQ ID NO: 3510570 - RNA, 14 nt, Human
agucauagaaauag

SEQ ID NO: 3510571 - RNA, 14 nt, Human
agucauagaagaac

SEQ ID NO: 3510572 - RNA, 16 nt, Human
agucauagaagaacua

SEQ ID NO: 3510573 - RNA, 13 nt, Human
agucaucaucagg

SEQ ID NO: 3510574 - RNA, 15 nt, Human
agucaucauucccuu

SEQ ID NO: 3510575 - RNA, 13 nt, Human
agucauccagucu

SEQ ID NO: 3510576 - RNA, 17 nt, Human
agucaucgaguggccca

SEQ ID NO: 3510577 - RNA, 22 nt, Human
agucaucguaggugauuugaag

SEQ ID NO: 3510578 - RNA, 15 nt, Human
agucaucucaaccau

SEQ ID NO: 3510579 - RNA, 17 nt, Human
agucaucuccaucagcu

SEQ ID NO: 3510580 - RNA, 18 nt, Human
agucaucuccaucagcug

SEQ ID NO: 3510581 - RNA, 21 nt, Human
agucaucuugaccaagcagga

SEQ ID NO: 3510582 - RNA, 11 nt, Human
agucaucuugc

SEQ ID NO: 3510583 - RNA, 13 nt, Human
agucaucuugcua

SEQ ID NO: 3510584 - RNA, 23 nt, Human
agucaucuugcuaccaguauuua

SEQ ID NO: 3510585 - RNA, 14 nt, Human
agucaugaacacau

SEQ ID NO: 3510586 - RNA, 19 nt, Human
agucaugaacacaucagcu

SEQ ID NO: 3510587 - RNA, 22 nt, Human
agucaugagcugagcagggaga

SEQ ID NO: 3510588 - RNA, 15 nt, Human
agucaugaucucccu

SEQ ID NO: 3510589 - RNA, 16 nt, Human
agucaugaucucccug

SEQ ID NO: 3510590 - RNA, 20 nt, Human
agucaugaucucccugccgc

SEQ ID NO: 3510591 - RNA, 21 nt, Human
agucaugaucucccugccgcc

SEQ ID NO: 3510592 - RNA, 15 nt, Human
agucaugaugaauca

SEQ ID NO: 3510593 - RNA, 17 nt, Human
agucaugauguuuuuaa

SEQ ID NO: 3510594 - RNA, 20 nt, Human
agucaugauguuuuuaaaau

SEQ ID NO: 3510595 - RNA, 23 nt, Human
agucaugauguuuuuaaaaucuu

SEQ ID NO: 3510596 - RNA, 17 nt, Human
agucaugcaaaggcugg

SEQ ID NO: 3510597 - RNA, 18 nt, Human
agucaugcaaaggcuggg

SEQ ID NO: 3510598 - RNA, 13 nt, Human
agucaugcucccc

SEQ ID NO: 3510599 - RNA, 14 nt, Human
agucaugcuccccu

SEQ ID NO: 3510600 - RNA, 21 nt, Human
agucaugcuccccugugccag

SEQ ID NO: 3510601 - RNA, 19 nt, Human
agucauggagaaccaccua

SEQ ID NO: 3510602 - RNA, 13 nt, Human
agucauguauguu

SEQ ID NO: 3510603 - RNA, 15 nt, Human
agucauguuccuuca

SEQ ID NO: 3510604 - RNA, 18 nt, Human
agucauuaaauuacuaua

SEQ ID NO: 3510605 - RNA, 16 nt, Human
agucauuagacuccuc

SEQ ID NO: 3510606 - RNA, 20 nt, Human
agucauuauagaucccccag

SEQ ID NO: 3510607 - RNA, 15 nt, Human
agucauucagauaug

SEQ ID NO: 3510608 - RNA, 23 nt, Human
agucauucagauaugauucaaau

SEQ ID NO: 3510609 - RNA, 20 nt, Human
agucauuccuucuuuuuaaa

SEQ ID NO: 3510610 - RNA, 17 nt, Human
agucauucguucugugg

SEQ ID NO: 3510611 - RNA, 20 nt, Human
agucauucucauugaauuau

SEQ ID NO: 3510612 - RNA, 21 nt, Human
agucauuggcuuuauccucuu

SEQ ID NO: 3510613 - RNA, 12 nt, Human
agucauuguaau

SEQ ID NO: 3510614 - RNA, 17 nt, Human
agucauuguaauguugu

SEQ ID NO: 3510615 - RNA, 13 nt, Human
agucauuuaauaa

SEQ ID NO: 3510616 - RNA, 14 nt, Human
agucauuucugauu

SEQ ID NO: 3510617 - RNA, 16 nt, Human
agucauuugagucucu

SEQ ID NO: 3510618 - RNA, 14 nt, Human
agucauuugcugag

SEQ ID NO: 3510619 - RNA, 15 nt, Human
agucauuuucaagac

SEQ ID NO: 3510620 - RNA, 22 nt, Human
agucauuuuuacaauguaauua

SEQ ID NO: 3510621 - RNA, 13 nt, Human
aguccaaaauacu

SEQ ID NO: 3510622 - RNA, 20 nt, Human
aguccaacguggggcagcac

SEQ ID NO: 3510623 - RNA, 22 nt, Human
aguccaacguggggcagcacag

SEQ ID NO: 3510624 - RNA, 14 nt, Human
aguccaagaaucca

SEQ ID NO: 3510625 - RNA, 16 nt, Human
aguccaagaccagacu

SEQ ID NO: 3510626 - RNA, 14 nt, Human
aguccaagcuggga

SEQ ID NO: 3510627 - RNA, 22 nt, Human
aguccaagggguccccuccagg

SEQ ID NO: 3510628 - RNA, 23 nt, Human
aguccaagggguccccuccagga

SEQ ID NO: 3510629 - RNA, 13 nt, Human
aguccaauaagac

SEQ ID NO: 3510630 - RNA, 17 nt, Human
aguccaaugucuuuuua

SEQ ID NO: 3510631 - RNA, 15 nt, Human
aguccaauuuuaauu

SEQ ID NO: 3510632 - RNA, 14 nt, Human
aguccacaaaauaa

SEQ ID NO: 3510633 - RNA, 18 nt, Human
aguccacccuugguuccu

SEQ ID NO: 3510634 - RNA, 15 nt, Human
aguccaccugaggaa

SEQ ID NO: 3510635 - RNA, 20 nt, Human
aguccacucccagugcuugc

SEQ ID NO: 3510636 - RNA, 15 nt, Human
aguccagauuuacac

SEQ ID NO: 3510637 - RNA, 16 nt, Human
aguccagauuuacacu

SEQ ID NO: 3510638 - RNA, 18 nt, Human
aguccagauuuacacugg

SEQ ID NO: 3510639 - RNA, 13 nt, Human
aguccagccugga

SEQ ID NO: 3510640 - RNA, 22 nt, Human
aguccaggcuuuuuuaucaugu

SEQ ID NO: 3510641 - RNA, 18 nt, Human
aguccagguccugguggg

SEQ ID NO: 3510642 - RNA, 19 nt, Human
aguccagguccuggugggg

SEQ ID NO: 3510643 - RNA, 17 nt, Human
aguccaguccaguccua

SEQ ID NO: 3510644 - RNA, 15 nt, Human
aguccagucucuucu

SEQ ID NO: 3510645 - RNA, 17 nt, Human
aguccagugaccugcug

SEQ ID NO: 3510646 - RNA, 15 nt, Human
aguccauaccuuaua

SEQ ID NO: 3510647 - RNA, 21 nt, Human
aguccauauuucaauuuccaa

SEQ ID NO: 3510648 - RNA, 16 nt, Human
aguccaucagccucca

SEQ ID NO: 3510649 - RNA, 20 nt, Human
aguccauuuauauaugaaaa

SEQ ID NO: 3510650 - RNA, 20 nt, Human
agucccaagcggugucucuc

SEQ ID NO: 3510651 - RNA, 14 nt, Human
agucccaaggaaag

SEQ ID NO: 3510652 - RNA, 17 nt, Human
agucccaaggaaagccc

SEQ ID NO: 3510653 - RNA, 19 nt, Human
agucccaccuuggcugcag

SEQ ID NO: 3510654 - RNA, 21 nt, Human
agucccaccuuggcugcaggg

SEQ ID NO: 3510655 - RNA, 23 nt, Human
agucccacugccucagguuccua

SEQ ID NO: 3510656 - RNA, 12 nt, Human
agucccagagca

SEQ ID NO: 3510657 - RNA, 12 nt, Human
agucccagcagc

SEQ ID NO: 3510658 - RNA, 15 nt, Human
agucccagcagccag

SEQ ID NO: 3510659 - RNA, 16 nt, Human
agucccagcagccagc

SEQ ID NO: 3510660 - RNA, 18 nt, Human
agucccagcagccagcca

SEQ ID NO: 3510661 - RNA, 19 nt, Human
agucccaggcugagccuca

SEQ ID NO: 3510662 - RNA, 20 nt, Human
agucccaggcugagccucag

SEQ ID NO: 3510663 - RNA, 19 nt, Human
agucccagguuggcucugc

SEQ ID NO: 3510664 - RNA, 23 nt, Human
agucccagguuggcucugccagu

SEQ ID NO: 3510665 - RNA, 18 nt, Human
agucccaucccugcguga

SEQ ID NO: 3510666 - RNA, 22 nt, Human
aguccccacagauaacugaaaa

SEQ ID NO: 3510667 - RNA, 13 nt, Human
aguccccagaacu

SEQ ID NO: 3510668 - RNA, 14 nt, Human
aguccccagaacuc

SEQ ID NO: 3510669 - RNA, 13 nt, Human
aguccccagagaa

SEQ ID NO: 3510670 - RNA, 23 nt, Human
aguugauaaagauuuuuuaauaa

SEQ ID NO: 3510671 - RNA, 16 nt, Human
aguugauacuacaguu

SEQ ID NO: 3510672 - RNA, 15 nt, Human
aguugauagcacaga

SEQ ID NO: 3510673 - RNA, 19 nt, Human
aguugauagcacagacccu

SEQ ID NO: 3510674 - RNA, 20 nt, Human
aguugauagcacagacccug

SEQ ID NO: 3510675 - RNA, 22 nt, Human
aguugauagcacagacccugcc

SEQ ID NO: 3510676 - RNA, 19 nt, Human
aguugauauagaacagugc

SEQ ID NO: 3510677 - RNA, 21 nt, Human
aguugauauguuuuauuucau

SEQ ID NO: 3510678 - RNA, 14 nt, Human
aguugaucucccca

SEQ ID NO: 3510679 - RNA, 13 nt, Human
aguugaucuggaa

SEQ ID NO: 3510680 - RNA, 15 nt, Human
aguugaucuggaacc

SEQ ID NO: 3510681 - RNA, 21 nt, Human
aguugaucuggaacccagacu

SEQ ID NO: 3510682 - RNA, 15 nt, Human
aguugaugaaaugga

SEQ ID NO: 3510683 - RNA, 14 nt, Human
aguugauguaucca

SEQ ID NO: 3510684 - RNA, 16 nt, Human
aguugauguugcauuu

SEQ ID NO: 3510685 - RNA, 16 nt, Human
aguugauuuucuggau

SEQ ID NO: 3510686 - RNA, 17 nt, Human
aguugcaauaauacuuc

SEQ ID NO: 3510687 - RNA, 15 nt, Human
aguugcaauagaaca

SEQ ID NO: 3510688 - RNA, 17 nt, Human
aguugcacacucacugg

SEQ ID NO: 3510689 - RNA, 14 nt, Human
aguugcacagcauc

SEQ ID NO: 3510690 - RNA, 16 nt, Human
aguugcacggcugcug

SEQ ID NO: 3510691 - RNA, 15 nt, Human
aguugcacucaggug

SEQ ID NO: 3510692 - RNA, 15 nt, Human
aguugcacugauauu

SEQ ID NO: 3510693 - RNA, 16 nt, Human
aguugcagacucaguu

SEQ ID NO: 3510694 - RNA, 17 nt, Human
aguugcagacucaguuu

SEQ ID NO: 3510695 - RNA, 10 nt, Human
aguugcagcc

SEQ ID NO: 3510696 - RNA, 17 nt, Human
aguugcagucacucuag

SEQ ID NO: 3510697 - RNA, 21 nt, Human
aguugcauggcaucaccucca

SEQ ID NO: 3510698 - RNA, 15 nt, Human
aguugcauguaguaa

SEQ ID NO: 3510699 - RNA, 23 nt, Human
aguugcauuuuaacccuauuuua

SEQ ID NO: 3510700 - RNA, 18 nt, Human
aguugccaagacaaauca

SEQ ID NO: 3510701 - RNA, 19 nt, Human
aguugccaccaccucugug

SEQ ID NO: 3510702 - RNA, 19 nt, Human
aguugcccagccucuuucc

SEQ ID NO: 3510703 - RNA, 16 nt, Human
aguugcccaucuuguu

SEQ ID NO: 3510704 - RNA, 11 nt, Human
aguugccuaaa

SEQ ID NO: 3510705 - RNA, 15 nt, Human
aguugccuaaaucca

SEQ ID NO: 3510706 - RNA, 19 nt, Human
aguugccuaaauccauuug

SEQ ID NO: 3510707 - RNA, 23 nt, Human
aguugccuaaauccauuuggaaa

SEQ ID NO: 3510708 - RNA, 21 nt, Human
aguugccuaagcauugccugg

SEQ ID NO: 3510709 - RNA, 16 nt, Human
aguugcguggacucug

SEQ ID NO: 3510710 - RNA, 15 nt, Human
aguugcuaaacacug

SEQ ID NO: 3510711 - RNA, 13 nt, Human
aguugcuauuuuu

SEQ ID NO: 3510712 - RNA, 15 nt, Human
aguugcuauuuuugu

SEQ ID NO: 3510713 - RNA, 17 nt, Human
aguugcucuaugcuuuc

SEQ ID NO: 3510714 - RNA, 21 nt, Human
aguugcucuaugcuuuccaaa

SEQ ID NO: 3510715 - RNA, 12 nt, Human
aguugcugagag

SEQ ID NO: 3510716 - RNA, 16 nt, Human
aguugcugcaaaccug

SEQ ID NO: 3510717 - RNA, 18 nt, Human
aguugcugcuucucccag

SEQ ID NO: 3510718 - RNA, 17 nt, Human
aguugcugguaaaauga

SEQ ID NO: 3510719 - RNA, 14 nt, Human
aguugcuuguaaaa

SEQ ID NO: 3510720 - RNA, 13 nt, Human
aguugcuuuucag

SEQ ID NO: 3510721 - RNA, 13 nt, Human
aguuggacuaaau

SEQ ID NO: 3510722 - RNA, 13 nt, Human
aguuggacugggu

SEQ ID NO: 3510723 - RNA, 17 nt, Human
aguuggacuggguugcg

SEQ ID NO: 3510724 - RNA, 17 nt, Human
aguuggaguagaaugua

SEQ ID NO: 3510725 - RNA, 19 nt, Human
aguuggaguucauucauau

SEQ ID NO: 3510726 - RNA, 20 nt, Human
aguuggaguuuuuuguacca

SEQ ID NO: 3510727 - RNA, 16 nt, Human
aguuggcaugcauccc

SEQ ID NO: 3510728 - RNA, 16 nt, Human
aguuggccagagagcc

SEQ ID NO: 3510729 - RNA, 15 nt, Human
aguuggcuuaccugg

SEQ ID NO: 3510730 - RNA, 13 nt, Human
aguuggcuucuaa

SEQ ID NO: 3510731 - RNA, 13 nt, Human
aguugggagcacu

SEQ ID NO: 3510732 - RNA, 17 nt, Human
aguuggggacagaacuc

SEQ ID NO: 3510733 - RNA, 18 nt, Human
aguugggggucagugcug

SEQ ID NO: 3510734 - RNA, 17 nt, Human
aguuggggucuggcagc

SEQ ID NO: 3510735 - RNA, 17 nt, Human
aguuggguguauugugc

SEQ ID NO: 3510736 - RNA, 15 nt, Human
aguugguaacuuuug

SEQ ID NO: 3510737 - RNA, 13 nt, Human
aguuggugacaga

SEQ ID NO: 3510738 - RNA, 22 nt, Human
aguuggugagaaaccuguaucu

SEQ ID NO: 3510739 - RNA, 23 nt, Human
aguuggugagaaaccuguaucuu

SEQ ID NO: 3510740 - RNA, 24 nt, Human
aguuggugagaaaccuguaucuuu

SEQ ID NO: 3510741 - RNA, 14 nt, Human
aguuggugucuuuc

SEQ ID NO: 3510742 - RNA, 13 nt, Human
aguugguguguuu

SEQ ID NO: 3510743 - RNA, 23 nt, Human
aguugguguguuuuugggauguc

SEQ ID NO: 3510744 - RNA, 16 nt, Human
aguugguugugucuuu

SEQ ID NO: 3510745 - RNA, 12 nt, Human
aguuguaaagua

SEQ ID NO: 3510746 - RNA, 18 nt, Human
aguuguaaauaauuuauu

SEQ ID NO: 3510747 - RNA, 22 nt, Human
aguuguaaauauauaaauauau

SEQ ID NO: 3510748 - RNA, 21 nt, Human
aguuguaacauucuauuucaa

SEQ ID NO: 3510749 - RNA, 11 nt, Human
aguuguacaug

SEQ ID NO: 3510750 - RNA, 18 nt, Human
aguuguaccgcaauguga

SEQ ID NO: 3510751 - RNA, 19 nt, Human
aguuguaccgcaaugugac

SEQ ID NO: 3510752 - RNA, 13 nt, Human
aguuguagaaugu

SEQ ID NO: 3510753 - RNA, 20 nt, Human
aguuguagaauguauuguac

SEQ ID NO: 3510754 - RNA, 16 nt, Human
aguuguaucucuuuug

SEQ ID NO: 3510755 - RNA, 15 nt, Human
aguuguaugaucugu

SEQ ID NO: 3510756 - RNA, 20 nt, Human
aguuguauuuaacagaaauu

SEQ ID NO: 3510757 - RNA, 22 nt, Human
aguuguauuuaacagaaauugu

SEQ ID NO: 3510758 - RNA, 19 nt, Human
aguugucaagucucugcug

SEQ ID NO: 3510759 - RNA, 23 nt, Human
aguugucacugcuuuuggccugg

SEQ ID NO: 3510760 - RNA, 13 nt, Human
aguugucagguua

SEQ ID NO: 3510761 - RNA, 20 nt, Human
aguuguccauauuuucacag

SEQ ID NO: 3510762 - RNA, 22 nt, Human
aguugucucugaugcagcuuau

SEQ ID NO: 3510763 - RNA, 18 nt, Human
aguugugacaacuuccug

SEQ ID NO: 3510764 - RNA, 21 nt, Human
agugacacuucagagagcugg

SEQ ID NO: 3510765 - RNA, 22 nt, Human
agugacacuucagagagcuggu

SEQ ID NO: 3510766 - RNA, 17 nt, Human
agugacagacaggcucu

SEQ ID NO: 3510767 - RNA, 19 nt, Human
agugacagggaagcuacag

SEQ ID NO: 3510768 - RNA, 22 nt, Human
agugacagggaagcuacagguu

SEQ ID NO: 3510769 - RNA, 20 nt, Human
agugacaguggauugcauuu

SEQ ID NO: 3510770 - RNA, 19 nt, Human
agugacaguugcagcccuu

SEQ ID NO: 3510771 - RNA, 20 nt, Human
agugacauaauauauucuau

SEQ ID NO: 3510772 - RNA, 22 nt, Human
agugacauaauauauucuauuu

SEQ ID NO: 3510773 - RNA, 14 nt, Human
agugaccaaggagg

SEQ ID NO: 3510774 - RNA, 15 nt, Human
agugacccuggcucc

SEQ ID NO: 3510775 - RNA, 16 nt, Human
agugacccuggcuccu

SEQ ID NO: 3510776 - RNA, 13 nt, Human
agugacccuuccc

SEQ ID NO: 3510777 - RNA, 18 nt, Human
agugaccucagcuuugau

SEQ ID NO: 3510778 - RNA, 16 nt, Human
agugaccugaggaagc

SEQ ID NO: 3510779 - RNA, 19 nt, Human
agugacgaaaacauugucc

SEQ ID NO: 3510780 - RNA, 14 nt, Human
agugacgugcaccu

SEQ ID NO: 3510781 - RNA, 16 nt, Human
agugacuaaaccauug

SEQ ID NO: 3510782 - RNA, 16 nt, Human
agugacuaauggcaug

SEQ ID NO: 3510783 - RNA, 15 nt, Human
agugacucgggcucc

SEQ ID NO: 3510784 - RNA, 17 nt, Human
agugacucgggcuccug

SEQ ID NO: 3510785 - RNA, 21 nt, Human
agugacucgggcuccugugcc

SEQ ID NO: 3510786 - RNA, 14 nt, Human
agugacucuccagg

SEQ ID NO: 3510787 - RNA, 21 nt, Human
agugacugauggcuaauguac

SEQ ID NO: 3510788 - RNA, 15 nt, Human
agugacuguaucugu

SEQ ID NO: 3510789 - RNA, 16 nt, Human
agugacuguaucugug

SEQ ID NO: 3510790 - RNA, 19 nt, Human
agugacuguucaagagcac

SEQ ID NO: 3510791 - RNA, 21 nt, Human
agugacuuagcagaugcuggu

SEQ ID NO: 3510792 - RNA, 13 nt, Human
agugacuucugag

SEQ ID NO: 3510793 - RNA, 14 nt, Human
agugacuucugaga

SEQ ID NO: 3510794 - RNA, 17 nt, Human
agugacuucugagaucu

SEQ ID NO: 3510795 - RNA, 15 nt, Human
agugacuugcccagu

SEQ ID NO: 3510796 - RNA, 18 nt, Human
agugacuugugucccaug

SEQ ID NO: 3510797 - RNA, 12 nt, Human
agugagaagaau

SEQ ID NO: 3510798 - RNA, 14 nt, Human
agugagaagaauau

SEQ ID NO: 3510799 - RNA, 15 nt, Human
agugagacaaaauuu

SEQ ID NO: 3510800 - RNA, 13 nt, Human
agugagacagaag

SEQ ID NO: 3510801 - RNA, 13 nt, Human
agugagacagacu

SEQ ID NO: 3510802 - RNA, 21 nt, Human
agugagacccagcccucaucc

SEQ ID NO: 3510803 - RNA, 21 nt, Human
agugagacccugucucaaaaa

SEQ ID NO: 3510804 - RNA, 16 nt, Human
agugagacucugucuc

SEQ ID NO: 3510805 - RNA, 22 nt, Human
agugagagacauuaacucauua

SEQ ID NO: 3510806 - RNA, 22 nt, Human
agugagagagaugggagcuccu

SEQ ID NO: 3510807 - RNA, 12 nt, Human
agugagagcaga

SEQ ID NO: 3510808 - RNA, 16 nt, Human
agugagauagcauugu

SEQ ID NO: 3510809 - RNA, 16 nt, Human
agugagaugcauucuu

SEQ ID NO: 3510810 - RNA, 14 nt, Human
agugagcacuaagg

SEQ ID NO: 3510811 - RNA, 17 nt, Human
agugagcaguguuagcu

SEQ ID NO: 3510812 - RNA, 21 nt, Human
agugagcaugcuuucugaacu

SEQ ID NO: 3510813 - RNA, 22 nt, Human
agugagccgcaucuucuccauc

SEQ ID NO: 3510814 - RNA, 13 nt, Human
agugagccuggcu

SEQ ID NO: 3510815 - RNA, 18 nt, Human
agugcccucucccacccu

SEQ ID NO: 3510816 - RNA, 22 nt, Human
agugcccucucccacccucuuc

SEQ ID NO: 3510817 - RNA, 13 nt, Human
agugcccugagcc

SEQ ID NO: 3510818 - RNA, 15 nt, Human
agugcccugagccag

SEQ ID NO: 3510819 - RNA, 20 nt, Human
agugcccugagccagggucu

SEQ ID NO: 3510820 - RNA, 22 nt, Human
agugcccuggggcugaucucag

SEQ ID NO: 3510821 - RNA, 21 nt, Human
agugccgagaaggaagccucc

SEQ ID NO: 3510822 - RNA, 17 nt, Human
agugccgccgccucgcc

SEQ ID NO: 3510823 - RNA, 20 nt, Human
agugccgccgccucgcccac

SEQ ID NO: 3510824 - RNA, 22 nt, Human
agugccguguguugcaugcagc

SEQ ID NO: 3510825 - RNA, 14 nt, Human
agugccuaaaauaa

SEQ ID NO: 3510826 - RNA, 14 nt, Human
agugccuauugaua

SEQ ID NO: 3510827 - RNA, 12 nt, Human
agugccucuggu

SEQ ID NO: 3510828 - RNA, 12 nt, Human
agugccugcuga

SEQ ID NO: 3510829 - RNA, 18 nt, Human
agugccugggaauguauu

SEQ ID NO: 3510830 - RNA, 18 nt, Human
agugccuuaccuccugcc

SEQ ID NO: 3510831 - RNA, 15 nt, Human
agugccuuauggaac

SEQ ID NO: 3510832 - RNA, 16 nt, Human
agugccuuauggaaca

SEQ ID NO: 3510833 - RNA, 16 nt, Human
agugccuuccauaauu

SEQ ID NO: 3510834 - RNA, 21 nt, Human
agugccuuggggaauuuccuc

SEQ ID NO: 3510835 - RNA, 22 nt, Human
agugccuuucugcaguuuuuca

SEQ ID NO: 3510836 - RNA, 17 nt, Human
agugccuuugcagcuca

SEQ ID NO: 3510837 - RNA, 18 nt, Human
agugccuuugcagcucag

SEQ ID NO: 3510838 - RNA, 20 nt, Human
agugccuuugcagcucagaa

SEQ ID NO: 3510839 - RNA, 19 nt, Human
agugccuuuugcagaagag

SEQ ID NO: 3510840 - RNA, 14 nt, Human
agugcgaguaugug

SEQ ID NO: 3510841 - RNA, 15 nt, Human
agugcgaguaugugu

SEQ ID NO: 3510842 - RNA, 18 nt, Human
agugcgauguuucaggag

SEQ ID NO: 3510843 - RNA, 16 nt, Human
agugcggguccggcag

SEQ ID NO: 3510844 - RNA, 15 nt, Human
agugcguccacgagc

SEQ ID NO: 3510845 - RNA, 14 nt, Human
agugcgugaaugua

SEQ ID NO: 3510846 - RNA, 16 nt, Human
agugcgugccguguga

SEQ ID NO: 3510847 - RNA, 13 nt, Human
agugcguguguag

SEQ ID NO: 3510848 - RNA, 16 nt, Human
agugcguguguagagu

SEQ ID NO: 3510849 - RNA, 14 nt, Human
agugcuaagguucu

SEQ ID NO: 3510850 - RNA, 14 nt, Human
agugcuacugaaag

SEQ ID NO: 3510851 - RNA, 21 nt, Human
agugcuagugagcugggcaug

SEQ ID NO: 3510852 - RNA, 13 nt, Human
agugcuauauaua

SEQ ID NO: 3510853 - RNA, 14 nt, Human
agugcuauauauau

SEQ ID NO: 3510854 - RNA, 19 nt, Human
agugcuauauauauaaaua

SEQ ID NO: 3510855 - RNA, 18 nt, Human
agugcucacccacaccau

SEQ ID NO: 3510856 - RNA, 17 nt, Human
agugcucauuucaggau

SEQ ID NO: 3510857 - RNA, 12 nt, Human
agugcuccagcc

SEQ ID NO: 3510858 - RNA, 14 nt, Human
agugcuccccucug

SEQ ID NO: 3510859 - RNA, 14 nt, Human
agugcucgcuguug

SEQ ID NO: 3510860 - RNA, 18 nt, Human
agugcucgcuguugcuga

SEQ ID NO: 3510861 - RNA, 20 nt, Human
agugcucgcuguugcugaau

SEQ ID NO: 3510862 - RNA, 20 nt, Human
agugcucgcuuucuauguag

SEQ ID NO: 3510863 - RNA, 12 nt, Human
agugcucugaua

SEQ ID NO: 3510864 - RNA, 16 nt, Human
agugcucugaucccuc

SEQ ID NO: 3510865 - RNA, 17 nt, Human
agugcucuuuucuccuc

SEQ ID NO: 3510866 - RNA, 14 nt, Human
agugcugaacagug

SEQ ID NO: 3510867 - RNA, 13 nt, Human
agugcugaagcuu

SEQ ID NO: 3510868 - RNA, 16 nt, Human
agugcugaagcuuauu

SEQ ID NO: 3510869 - RNA, 21 nt, Human
agugcugagauuacaggcaug

SEQ ID NO: 3510870 - RNA, 15 nt, Human
agugcugcacucaaa

SEQ ID NO: 3510871 - RNA, 18 nt, Human
agugcugcagcucccugg

SEQ ID NO: 3510872 - RNA, 13 nt, Human
agugcugcauuua

SEQ ID NO: 3510873 - RNA, 16 nt, Human
agugcugccugucccc

SEQ ID NO: 3510874 - RNA, 15 nt, Human
agugcugcugaagau

SEQ ID NO: 3510875 - RNA, 18 nt, Human
agugcugcuuugccaaau

SEQ ID NO: 3510876 - RNA, 19 nt, Human
agugcuggagucuccugag

SEQ ID NO: 3510877 - RNA, 22 nt, Human
agugcugggauggaggggagug

SEQ ID NO: 3510878 - RNA, 20 nt, Human
agugcugggauuacaagcgu

SEQ ID NO: 3510879 - RNA, 20 nt, Human
agugcugggauuacaggcau

SEQ ID NO: 3510880 - RNA, 20 nt, Human
agugcugggauuacaggcgu

SEQ ID NO: 3510881 - RNA, 19 nt, Human
agugcugggauuacaggug

SEQ ID NO: 3510882 - RNA, 15 nt, Human
agugcuguauaaaau

SEQ ID NO: 3510883 - RNA, 19 nt, Human
agugcuguauaaaaucagc

SEQ ID NO: 3510884 - RNA, 21 nt, Human
agugcugucugaucugugcuu

SEQ ID NO: 3510885 - RNA, 12 nt, Human
agugcugugaaa

SEQ ID NO: 3510886 - RNA, 20 nt, Human
agugcuguuuuguuauauaa

SEQ ID NO: 3510887 - RNA, 16 nt, Human
agugcuuaaaaaucau

SEQ ID NO: 3510888 - RNA, 17 nt, Human
agugcuucagccugagg

SEQ ID NO: 3510889 - RNA, 14 nt, Human
agugcuucuuacua

SEQ ID NO: 3510890 - RNA, 19 nt, Human
agugcuugaguuuggggaa

SEQ ID NO: 3510891 - RNA, 14 nt, Human
agugcuuggcccag

SEQ ID NO: 3510892 - RNA, 18 nt, Human
agugcuuggcccaggagu

SEQ ID NO: 3510893 - RNA, 19 nt, Human
agugcuuguguaauuuaug

SEQ ID NO: 3510894 - RNA, 13 nt, Human
agugcuuuaaugg

SEQ ID NO: 3510895 - RNA, 22 nt, Human
agugcuuuaccaauugaaguaa

SEQ ID NO: 3510896 - RNA, 12 nt, Human
aguggaaaaaca

SEQ ID NO: 3510897 - RNA, 18 nt, Human
aguggaaaaauagccugc

SEQ ID NO: 3510898 - RNA, 19 nt, Human
aguggaaaaauagccugcc

SEQ ID NO: 3510899 - RNA, 16 nt, Human
aguggaaacauuuaua

SEQ ID NO: 3510900 - RNA, 15 nt, Human
aguggaaauguucua

SEQ ID NO: 3510901 - RNA, 14 nt, Human
aguggaaauucagg

SEQ ID NO: 3510902 - RNA, 12 nt, Human
aguggaaggaaa

SEQ ID NO: 3510903 - RNA, 18 nt, Human
aguggaaguaguggagcc

SEQ ID NO: 3510904 - RNA, 20 nt, Human
aguggaaguauguauauuaa

SEQ ID NO: 3510905 - RNA, 22 nt, Human
aguggaauaguauccuccaggu

SEQ ID NO: 3510906 - RNA, 23 nt, Human
aguggaauaguauccuccagguu

SEQ ID NO: 3510907 - RNA, 16 nt, Human
aguggaccaggacagg

SEQ ID NO: 3510908 - RNA, 19 nt, Human
aguggacccugaaaugugu

SEQ ID NO: 3510909 - RNA, 22 nt, Human
aguggaccgcccuuuuccccua

SEQ ID NO: 3510910 - RNA, 17 nt, Human
aguggaccuuaggccuu

SEQ ID NO: 3510911 - RNA, 20 nt, Human
aguggaccuuaggccuuccu

SEQ ID NO: 3510912 - RNA, 18 nt, Human
aguggacucuuugguggc

SEQ ID NO: 3510913 - RNA, 22 nt, Human
aguggacuggccucaaagcaag

SEQ ID NO: 3510914 - RNA, 21 nt, Human
aguggacuguucccugaggug

SEQ ID NO: 3510915 - RNA, 15 nt, Human
aguggacuuuccacc

SEQ ID NO: 3510916 - RNA, 19 nt, Human
aguggacuuuccacccccu

SEQ ID NO: 3510917 - RNA, 16 nt, Human
aguggagaauuauaua

SEQ ID NO: 3510918 - RNA, 17 nt, Human
aguggaggcacuuuagg

SEQ ID NO: 3510919 - RNA, 23 nt, Human
aguggaggugggcugggcccucu

SEQ ID NO: 3510920 - RNA, 23 nt, Human
aguggagguuaaggcugaggaaa

SEQ ID NO: 3510921 - RNA, 17 nt, Human
aguggagguuuauaguu

SEQ ID NO: 3510922 - RNA, 14 nt, Human
aguggagucugcca

SEQ ID NO: 3510923 - RNA, 19 nt, Human
aguggagucugccacccag

SEQ ID NO: 3510924 - RNA, 22 nt, Human
aguugugaguuuaccuuguaua

SEQ ID NO: 3510925 - RNA, 18 nt, Human
aguugugcacauggcuua

SEQ ID NO: 3510926 - RNA, 18 nt, Human
aguugugccuuuuauagc

SEQ ID NO: 3510927 - RNA, 19 nt, Human
aguugugcuuguuuacagc

SEQ ID NO: 3510928 - RNA, 20 nt, Human
aguuguggaaagccucugcu

SEQ ID NO: 3510929 - RNA, 20 nt, Human
aguuguggagagugcaacag

SEQ ID NO: 3510930 - RNA, 17 nt, Human
aguuguggauuucaguu

SEQ ID NO: 3510931 - RNA, 20 nt, Human
aguuguggugugaguaucag

SEQ ID NO: 3510932 - RNA, 18 nt, Human
aguuguguacucuggccu

SEQ ID NO: 3510933 - RNA, 20 nt, Human
aguuguguuuguugcuggcu

SEQ ID NO: 3510934 - RNA, 17 nt, Human
aguuguguuuuuuaaga

SEQ ID NO: 3510935 - RNA, 21 nt, Human
aguuguguuuuuuaagauggc

SEQ ID NO: 3510936 - RNA, 13 nt, Human
aguuguuacauuu

SEQ ID NO: 3510937 - RNA, 22 nt, Human
aguuguuagugugucuuagugu

SEQ ID NO: 3510938 - RNA, 19 nt, Human
aguuguuauuacauccuug

SEQ ID NO: 3510939 - RNA, 13 nt, Human
aguuguucugaaa

SEQ ID NO: 3510940 - RNA, 17 nt, Human
aguuguucugaaauguc

SEQ ID NO: 3510941 - RNA, 15 nt, Human
aguuguuucauugac

SEQ ID NO: 3510942 - RNA, 11 nt, Human
aguuguuugau

SEQ ID NO: 3510943 - RNA, 13 nt, Human
aguuguuugaugc

SEQ ID NO: 3510944 - RNA, 23 nt, Human
aguuguuugauucagacagcugc

SEQ ID NO: 3510945 - RNA, 16 nt, Human
aguuguuuguuuuugc

SEQ ID NO: 3510946 - RNA, 18 nt, Human
aguuguuuguuuuugcuu

SEQ ID NO: 3510947 - RNA, 15 nt, Human
aguuguuuuuguaua

SEQ ID NO: 3510948 - RNA, 16 nt, Human
aguuguuuuuguauau

SEQ ID NO: 3510949 - RNA, 18 nt, Human
aguuguuuuuguauauug

SEQ ID NO: 3510950 - RNA, 15 nt, Human
aguuuaaaacacauu

SEQ ID NO: 3510951 - RNA, 16 nt, Human
aguuuaaaacaguauu

SEQ ID NO: 3510952 - RNA, 18 nt, Human
aguuuaaaacaguauuua

SEQ ID NO: 3510953 - RNA, 21 nt, Human
aguuuaaaagcacgacagugg

SEQ ID NO: 3510954 - RNA, 13 nt, Human
aguuuaaaaugua

SEQ ID NO: 3510955 - RNA, 18 nt, Human
aguuuaaauauuaagcau

SEQ ID NO: 3510956 - RNA, 14 nt, Human
aguuuaaauuguaa

SEQ ID NO: 3510957 - RNA, 16 nt, Human
aguuuaaucagaggaa

SEQ ID NO: 3510958 - RNA, 22 nt, Human
aguuuaauggugccuucauuug

SEQ ID NO: 3510959 - RNA, 16 nt, Human
aguuuaauugaaagaa

SEQ ID NO: 3510960 - RNA, 11 nt, Human
aguugagcccc

SEQ ID NO: 3510961 - RNA, 13 nt, Human
aguugagcuauga

SEQ ID NO: 3510962 - RNA, 16 nt, Human
aguugaggaacuguac

SEQ ID NO: 3510963 - RNA, 16 nt, Human
aguugaggacuucuug

SEQ ID NO: 3510964 - RNA, 13 nt, Human
aguugaggccacu

SEQ ID NO: 3510965 - RNA, 23 nt, Human
aguugauacuugaauaaccaucu

SEQ ID NO: 3510966 - RNA, 21 nt, Human
aguugauagcacagacccugc

SEQ ID NO: 3510967 - RNA, 15 nt, Human
aguugauauagaaca

SEQ ID NO: 3510968 - RNA, 17 nt, Human
aguugauauagaacagu

SEQ ID NO: 3510969 - RNA, 21 nt, Human
aguugauaugccuuuucccaa

SEQ ID NO: 3510970 - RNA, 18 nt, Human
aguugaucuggaacccag

SEQ ID NO: 3510971 - RNA, 19 nt, Human
aguugaucuggaacccaga

SEQ ID NO: 3510972 - RNA, 13 nt, Human
aguugauucagcu

SEQ ID NO: 3510973 - RNA, 15 nt, Human
aguugauucagcucu

SEQ ID NO: 3510974 - RNA, 17 nt, Human
aguugauucagcucugc

SEQ ID NO: 3510975 - RNA, 14 nt, Human
aguugauugagaag

SEQ ID NO: 3510976 - RNA, 21 nt, Human
aguugauuuuacaauugaaau

SEQ ID NO: 3510977 - RNA, 19 nt, Human
auaacucauuuguuguuug

SEQ ID NO: 3510978 - RNA, 14 nt, Human
auaacuccucccag

SEQ ID NO: 3510979 - RNA, 18 nt, Human
auaacuccucccaggguu

SEQ ID NO: 3510980 - RNA, 12 nt, Human
auaacucuguaa

SEQ ID NO: 3510981 - RNA, 19 nt, Human
auaacucuguaaaaacacu

SEQ ID NO: 3510982 - RNA, 22 nt, Human
auaacucuguggcauuauugca

SEQ ID NO: 3510983 - RNA, 15 nt, Human
auaacugaaaaugug

SEQ ID NO: 3510984 - RNA, 20 nt, Human
auaacugaaaauuauuuaaa

SEQ ID NO: 3510985 - RNA, 18 nt, Human
auaacugaaggagaaggu

SEQ ID NO: 3510986 - RNA, 18 nt, Human
auaacugacaaaucaagu

SEQ ID NO: 3510987 - RNA, 16 nt, Human
auaacugacuuaguuc

SEQ ID NO: 3510988 - RNA, 13 nt, Human
auaacugcccagc

SEQ ID NO: 3510989 - RNA, 17 nt, Human
auaacugccuugaaccu

SEQ ID NO: 3510990 - RNA, 23 nt, Human
auaacugccuugaaccugugagu

SEQ ID NO: 3510991 - RNA, 15 nt, Human
auaacuggaaaacag

SEQ ID NO: 3510992 - RNA, 17 nt, Human
auaacuggaaaacagaa

SEQ ID NO: 3510993 - RNA, 21 nt, Human
auaacuggaaaacagaacacu

SEQ ID NO: 3510994 - RNA, 18 nt, Human
auaacuggaacacucuau

SEQ ID NO: 3510995 - RNA, 23 nt, Human
auaacuggaacacucuauaacaa

SEQ ID NO: 3510996 - RNA, 17 nt, Human
auaacuguaauuauuug

SEQ ID NO: 3510997 - RNA, 18 nt, Human
auaacuguauuugaaaua

SEQ ID NO: 3510998 - RNA, 18 nt, Human
auaacuguuauuuauaau

SEQ ID NO: 3510999 - RNA, 20 nt, Human
auaacuguuauuuauaauca

SEQ ID NO: 3511000 - RNA, 21 nt, Human
auaacuguuuauauguguuga

SEQ ID NO: 3511001 - RNA, 16 nt, Human
auaacuuaaaauauuu

SEQ ID NO: 3511002 - RNA, 13 nt, Human
auaacuucagucc

SEQ ID NO: 3511003 - RNA, 22 nt, Human
auaacuucaguccugcuccaga

SEQ ID NO: 3511004 - RNA, 14 nt, Human
auaacuuccacagg

SEQ ID NO: 3511005 - RNA, 16 nt, Human
auaacuucuuaaaagu

SEQ ID NO: 3511006 - RNA, 16 nt, Human
auaacuugaugcaugu

SEQ ID NO: 3511007 - RNA, 17 nt, Human
auaacuugaugcaugug

SEQ ID NO: 3511008 - RNA, 16 nt, Human
auaacuuuaacuucug

SEQ ID NO: 3511009 - RNA, 17 nt, Human
auaacuuugacuuucuu

SEQ ID NO: 3511010 - RNA, 14 nt, Human
auaacuuugcuugc

SEQ ID NO: 3511011 - RNA, 12 nt, Human
auaacuuuuuau

SEQ ID NO: 3511012 - RNA, 22 nt, Human
auaacuuuuuauauucucagca

SEQ ID NO: 3511013 - RNA, 11 nt, Human
auaagaaaaac

SEQ ID NO: 3511014 - RNA, 16 nt, Human
auaagaaaaaucaugu

SEQ ID NO: 3511015 - RNA, 17 nt, Human
auaagaaaaaucauguu

SEQ ID NO: 3511016 - RNA, 23 nt, Human
auaagaaaaccaccccuuagauu

SEQ ID NO: 3511017 - RNA, 11 nt, Human
auaagaaaaga

SEQ ID NO: 3511018 - RNA, 14 nt, Human
auaagaaagccuga

SEQ ID NO: 3511019 - RNA, 22 nt, Human
auaagaaauaaugcuacaauuu

SEQ ID NO: 3511020 - RNA, 16 nt, Human
auaagaacuuugagcu

SEQ ID NO: 3511021 - RNA, 21 nt, Human
auaagaagggauggauuccaa

SEQ ID NO: 3511022 - RNA, 21 nt, Human
auaagaauaaaauguugaaaa

SEQ ID NO: 3511023 - RNA, 18 nt, Human
auaagaauggagcaguac

SEQ ID NO: 3511024 - RNA, 18 nt, Human
auaagaaugguugccuua

SEQ ID NO: 3511025 - RNA, 16 nt, Human
auaagaauucagacau

SEQ ID NO: 3511026 - RNA, 17 nt, Human
auaagacauaacguuuu

SEQ ID NO: 3511027 - RNA, 22 nt, Human
auaagaccaccaccucagagua

SEQ ID NO: 3511028 - RNA, 17 nt, Human
auaagacggauuuauuu

SEQ ID NO: 3511029 - RNA, 15 nt, Human
auaagagaaucaaca

SEQ ID NO: 3511030 - RNA, 16 nt, Human
auaagagagucauaaa

SEQ ID NO: 3511031 - RNA, 15 nt, Human
auaagagcucaggau

SEQ ID NO: 3511032 - RNA, 19 nt, Human
auaagagggcacacacugu

SEQ ID NO: 3511033 - RNA, 16 nt, Human
auaagaguagaaacug

SEQ ID NO: 3511034 - RNA, 20 nt, Human
auaagauauuuuauuuugaa

SEQ ID NO: 3511035 - RNA, 15 nt, Human
auaagauauuuuuca

SEQ ID NO: 3511036 - RNA, 18 nt, Human
auaagauauuuuucauga

SEQ ID NO: 3511037 - RNA, 19 nt, Human
auaagauccuagauccuaa

SEQ ID NO: 3511038 - RNA, 17 nt, Human
auaagaucuuuuauuuu

SEQ ID NO: 3511039 - RNA, 17 nt, Human
auaagauuagaaugaaa

SEQ ID NO: 3511040 - RNA, 12 nt, Human
auaagauuccaa

SEQ ID NO: 3511041 - RNA, 20 nt, Human
auaagcaaaaacaaaaagaa

SEQ ID NO: 3511042 - RNA, 14 nt, Human
auaagcaaauuuca

SEQ ID NO: 3511043 - RNA, 19 nt, Human
auaagcaaauuucaaaaga

SEQ ID NO: 3511044 - RNA, 17 nt, Human
auaagcaagagagaugu

SEQ ID NO: 3511045 - RNA, 14 nt, Human
auaagcacugugcu

SEQ ID NO: 3511046 - RNA, 16 nt, Human
auaagcaucaaacucu

SEQ ID NO: 3511047 - RNA, 23 nt, Human
auaagcauggagaacagugauuu

SEQ ID NO: 3511048 - RNA, 16 nt, Human
auaagcauugaaauua

SEQ ID NO: 3511049 - RNA, 18 nt, Human
auaagccaauuuuucugc

SEQ ID NO: 3511050 - RNA, 14 nt, Human
auaagccagacauc

SEQ ID NO: 3511051 - RNA, 18 nt, Human
auaagccaguguugccua

SEQ ID NO: 3511052 - RNA, 16 nt, Human
auaagcuacuagcaaa

SEQ ID NO: 3511053 - RNA, 14 nt, Human
auaagcuacugcca

SEQ ID NO: 3511054 - RNA, 16 nt, Human
auaagcuacugccauc

SEQ ID NO: 3511055 - RNA, 15 nt, Human
auaagcuaguugaau

SEQ ID NO: 3511056 - RNA, 23 nt, Human
auaagcuaguugaauacuugaac

SEQ ID NO: 3511057 - RNA, 18 nt, Human
auaagcuauuugauguaa

SEQ ID NO: 3511058 - RNA, 14 nt, Human
auaagcucuaguuc

SEQ ID NO: 3511059 - RNA, 13 nt, Human
auaaggaaaagcu

SEQ ID NO: 3511060 - RNA, 19 nt, Human
auaaggacaugaugcuuuu

SEQ ID NO: 3511061 - RNA, 12 nt, Human
auaaggacugca

SEQ ID NO: 3511062 - RNA, 22 nt, Human
auaaggaucagaacagcagagg

SEQ ID NO: 3511063 - RNA, 16 nt, Human
auaaggccucauccuc

SEQ ID NO: 3511064 - RNA, 17 nt, Human
auaaggccuuaauaugu

SEQ ID NO: 3511065 - RNA, 15 nt, Human
auaagggaaaaauca

SEQ ID NO: 3511066 - RNA, 16 nt, Human
auaagggaaaaaucaa

SEQ ID NO: 3511067 - RNA, 13 nt, Human
auaagggaaaaga

SEQ ID NO: 3511068 - RNA, 18 nt, Human
auaagggguuugccauuu

SEQ ID NO: 3511069 - RNA, 21 nt, Human
auaagggguuugccauuugau

SEQ ID NO: 3511070 - RNA, 16 nt, Human
auaagguaaaaugcca

SEQ ID NO: 3511071 - RNA, 17 nt, Human
auaaggugcucucuuuc

SEQ ID NO: 3511072 - RNA, 19 nt, Human
auaagguguuuucugugua

SEQ ID NO: 3511073 - RNA, 12 nt, Human
auaaguaagaaa

SEQ ID NO: 3511074 - RNA, 19 nt, Human
auaaguaagaaaauauuuu

SEQ ID NO: 3511075 - RNA, 19 nt, Human
auaaguacuguguacagaa

SEQ ID NO: 3511076 - RNA, 19 nt, Human
auaaguauuuaauucaugu

SEQ ID NO: 3511077 - RNA, 15 nt, Human
auaaguauuuauaau

SEQ ID NO: 3511078 - RNA, 18 nt, Human
auaaguauuucaaauugg

SEQ ID NO: 3511079 - RNA, 14 nt, Human
auaagucaacagua

SEQ ID NO: 3511080 - RNA, 15 nt, Human
auaagucaacaguaa

SEQ ID NO: 3511081 - RNA, 14 nt, Human
auaagucauguucc

SEQ ID NO: 3511082 - RNA, 14 nt, Human
auaagucuaaauaa

SEQ ID NO: 3511083 - RNA, 14 nt, Human
auaagucugauuua

SEQ ID NO: 3511084 - RNA, 14 nt, Human
auaagugaaaaucu

SEQ ID NO: 3511085 - RNA, 21 nt, Human
auaagugaaauggauacuaca

SEQ ID NO: 3511086 - RNA, 15 nt, Human
auaagugaauaauaa

SEQ ID NO: 3511087 - RNA, 20 nt, Human
auaagugcacacagaaauau

SEQ ID NO: 3511088 - RNA, 23 nt, Human
auaagugcacacagaaauauaua

SEQ ID NO: 3511089 - RNA, 13 nt, Human
auaagugcuguau

SEQ ID NO: 3511090 - RNA, 20 nt, Human
auaagugcuguauaaaauca

SEQ ID NO: 3511091 - RNA, 19 nt, Human
auaaguggccuugacacau

SEQ ID NO: 3511092 - RNA, 21 nt, Human
auaaguggccuugacacauua

SEQ ID NO: 3511093 - RNA, 15 nt, Human
auaaguggugugugu

SEQ ID NO: 3511094 - RNA, 19 nt, Human
auaaguguacauaugugcu

SEQ ID NO: 3511095 - RNA, 21 nt, Human
auaaguguguggucccaaguu

SEQ ID NO: 3511096 - RNA, 16 nt, Human
auaaguuauugcaguu

SEQ ID NO: 3511097 - RNA, 20 nt, Human
auaaguuauuuuuguacaug

SEQ ID NO: 3511098 - RNA, 13 nt, Human
auaaguuggaaac

SEQ ID NO: 3511099 - RNA, 17 nt, Human
auaaguuggaaacacua

SEQ ID NO: 3511100 - RNA, 19 nt, Human
auaaguuggaaacacuaaa

SEQ ID NO: 3511101 - RNA, 22 nt, Human
auaaguuuauuucuuaaaucua

SEQ ID NO: 3511102 - RNA, 21 nt, Human
auaaguuucugggaccucagu

SEQ ID NO: 3511103 - RNA, 15 nt, Human
auaaguuugaaggaa

SEQ ID NO: 3511104 - RNA, 13 nt, Human
auaaguuuuaugu

SEQ ID NO: 3511105 - RNA, 16 nt, Human
agcugcccuaaauaac

SEQ ID NO: 3511106 - RNA, 22 nt, Human
agcugcccuaaauaacccuuca

SEQ ID NO: 3511107 - RNA, 17 nt, Human
agcugcccuaugggccu

SEQ ID NO: 3511108 - RNA, 17 nt, Human
agcugcccucuccuggg

SEQ ID NO: 3511109 - RNA, 18 nt, Human
agcugccgaccagagccc

SEQ ID NO: 3511110 - RNA, 19 nt, Human
agcugccggucgcccuuug

SEQ ID NO: 3511111 - RNA, 13 nt, Human
agcugccuaagag

SEQ ID NO: 3511112 - RNA, 21 nt, Human
agcugccuagauucagggaaa

SEQ ID NO: 3511113 - RNA, 15 nt, Human
agcugccuagcaagc

SEQ ID NO: 3511114 - RNA, 19 nt, Human
agcugccuagcaagcuggc

SEQ ID NO: 3511115 - RNA, 20 nt, Human
agcugccuagcaagcuggcc

SEQ ID NO: 3511116 - RNA, 16 nt, Human
agcugccuccccuccu

SEQ ID NO: 3511117 - RNA, 17 nt, Human
agcugccuccccuccuc

SEQ ID NO: 3511118 - RNA, 20 nt, Human
agcugccuccccuccucugc

SEQ ID NO: 3511119 - RNA, 18 nt, Human
agcugccucccuguccac

SEQ ID NO: 3511120 - RNA, 19 nt, Human
agcugccucugccacugac

SEQ ID NO: 3511121 - RNA, 19 nt, Human
agcugccucuucccucuuc

SEQ ID NO: 3511122 - RNA, 12 nt, Human
agcugccugcuu

SEQ ID NO: 3511123 - RNA, 20 nt, Human
agcugccuggaagagcagcc

SEQ ID NO: 3511124 - RNA, 10 nt, Human
agcugccugu

SEQ ID NO: 3511125 - RNA, 22 nt, Human
agcugccuguaguuaggaaaua

SEQ ID NO: 3511126 - RNA, 14 nt, Human
agcugccugugccu

SEQ ID NO: 3511127 - RNA, 18 nt, Human
agcugccuguucagcucc

SEQ ID NO: 3511128 - RNA, 13 nt, Human
agcugccuuagcu

SEQ ID NO: 3511129 - RNA, 17 nt, Human
agcugccuuagcuucag

SEQ ID NO: 3511130 - RNA, 23 nt, Human
agcugccuuagcuucaggaaccu

SEQ ID NO: 3511131 - RNA, 22 nt, Human
agcugccuugagccuuaaaacc

SEQ ID NO: 3511132 - RNA, 18 nt, Human
agcugcgcuugcuuuucu

SEQ ID NO: 3511133 - RNA, 19 nt, Human
aguugcaaggcaaauguuu

SEQ ID NO: 3511134 - RNA, 17 nt, Human
aguugcaauagaacaga

SEQ ID NO: 3511135 - RNA, 19 nt, Human
aguugcaauugaauuaaau

SEQ ID NO: 3511136 - RNA, 12 nt, Human
aguugcacagca

SEQ ID NO: 3511137 - RNA, 13 nt, Human
aguugcacagcau

SEQ ID NO: 3511138 - RNA, 15 nt, Human
aguugcacagcaucu

SEQ ID NO: 3511139 - RNA, 17 nt, Human
aguugcacagcaucuca

SEQ ID NO: 3511140 - RNA, 22 nt, Human
aguugcagacucaguuugucag

SEQ ID NO: 3511141 - RNA, 23 nt, Human
aguugcagacucaguuugucaga

SEQ ID NO: 3511142 - RNA, 15 nt, Human
aguugcagcuguuuu

SEQ ID NO: 3511143 - RNA, 14 nt, Human
aguugcaucagaaa

SEQ ID NO: 3511144 - RNA, 20 nt, Human
aguugcauggcaucaccucc

SEQ ID NO: 3511145 - RNA, 17 nt, Human
aguugcauguaguaaca

SEQ ID NO: 3511146 - RNA, 22 nt, Human
aguugcauguaguaacacuaau

SEQ ID NO: 3511147 - RNA, 14 nt, Human
aguugccaagacaa

SEQ ID NO: 3511148 - RNA, 17 nt, Human
aguugccaagacaaauc

SEQ ID NO: 3511149 - RNA, 19 nt, Human
aguugccccgucucuguuc

SEQ ID NO: 3511150 - RNA, 20 nt, Human
aguugccccgucucuguucc

SEQ ID NO: 3511151 - RNA, 16 nt, Human
aguugccuaaauccau

SEQ ID NO: 3511152 - RNA, 20 nt, Human
aguugcgacggagagaaaaa

SEQ ID NO: 3511153 - RNA, 15 nt, Human
aguugcuauuugaac

SEQ ID NO: 3511154 - RNA, 16 nt, Human
aguugcucaaaaagaa

SEQ ID NO: 3511155 - RNA, 17 nt, Human
aguugcugggagcugaa

SEQ ID NO: 3511156 - RNA, 15 nt, Human
aguugcugguaaaau

SEQ ID NO: 3511157 - RNA, 18 nt, Human
aguugcugguaaaaugaa

SEQ ID NO: 3511158 - RNA, 21 nt, Human
aguugcugguaaaaugaagaa

SEQ ID NO: 3511159 - RNA, 23 nt, Human
aguugcugucagucuugaccucu

SEQ ID NO: 3511160 - RNA, 20 nt, Human
aguuggaaacacuaaauguu

SEQ ID NO: 3511161 - RNA, 21 nt, Human
aguuggaaacacuaaauguua

SEQ ID NO: 3511162 - RNA, 22 nt, Human
aguuggaaacacuaaauguuaa

SEQ ID NO: 3511163 - RNA, 23 nt, Human
aguuggaaacacuaaauguuaaa

SEQ ID NO: 3511164 - RNA, 14 nt, Human
aguuggaaauauuc

SEQ ID NO: 3511165 - RNA, 20 nt, Human
aguuggacuaaaugccuagu

SEQ ID NO: 3511166 - RNA, 16 nt, Human
aguuggaguagaaugu

SEQ ID NO: 3511167 - RNA, 21 nt, Human
aguuggcagaaauacagucuu

SEQ ID NO: 3511168 - RNA, 18 nt, Human
aguuggcuggaugaaauu

SEQ ID NO: 3511169 - RNA, 17 nt, Human
aguuggcuuaccuggcc

SEQ ID NO: 3511170 - RNA, 18 nt, Human
aguuggcuuaccuggccc

SEQ ID NO: 3511171 - RNA, 22 nt, Human
aguuggcuucuguuucuaguug

SEQ ID NO: 3511172 - RNA, 23 nt, Human
aguugggaacuucagauggaccu

SEQ ID NO: 3511173 - RNA, 18 nt, Human
aguugggacuacaggcgu

SEQ ID NO: 3511174 - RNA, 13 nt, Human
aguugggcuuccu

SEQ ID NO: 3511175 - RNA, 15 nt, Human
aguugggcuugcuau

SEQ ID NO: 3511176 - RNA, 16 nt, Human
aguuggggacacaugu

SEQ ID NO: 3511177 - RNA, 21 nt, Human
aguuggguggaugccuggugg

SEQ ID NO: 3511178 - RNA, 15 nt, Human
aguugggugucuccu

SEQ ID NO: 3511179 - RNA, 16 nt, Human
aguugggugucuccuu

SEQ ID NO: 3511180 - RNA, 17 nt, Human
aguugguaagcuuccag

SEQ ID NO: 3511181 - RNA, 22 nt, Human
aguugguaagcuuccaggaaaa

SEQ ID NO: 3511182 - RNA, 17 nt, Human
aguugguacacaacuag

SEQ ID NO: 3511183 - RNA, 19 nt, Human
aguugguauuaauaaaaag

SEQ ID NO: 3511184 - RNA, 13 nt, Human
aguuggucccccu

SEQ ID NO: 3511185 - RNA, 17 nt, Human
aguuggucccccuucca

SEQ ID NO: 3511186 - RNA, 18 nt, Human
aguuggucccccuuccau

SEQ ID NO: 3511187 - RNA, 13 nt, Human
aguuguaaaguau

SEQ ID NO: 3511188 - RNA, 18 nt, Human
aguuguaaaguauguauu

SEQ ID NO: 3511189 - RNA, 22 nt, Human
aguuguaaauaauuuauuuaau

SEQ ID NO: 3511190 - RNA, 14 nt, Human
aguuguaaauauau

SEQ ID NO: 3511191 - RNA, 15 nt, Human
aguuguaaauauaua

SEQ ID NO: 3511192 - RNA, 17 nt, Human
aguuguaaauauauaaa

SEQ ID NO: 3511193 - RNA, 18 nt, Human
aguuguaaauauauaaau

SEQ ID NO: 3511194 - RNA, 16 nt, Human
aguuguaacuuauauu

SEQ ID NO: 3511195 - RNA, 13 nt, Human
aguuguacuuuaa

SEQ ID NO: 3511196 - RNA, 20 nt, Human
aguuguacuuuaaaaauuua

SEQ ID NO: 3511197 - RNA, 17 nt, Human
aguuguagaauguauug

SEQ ID NO: 3511198 - RNA, 16 nt, Human
aguuguagcagauugu

SEQ ID NO: 3511199 - RNA, 18 nt, Human
aguuguagcagauuguuu

SEQ ID NO: 3511200 - RNA, 21 nt, Human
aguuguaggcgaaucauuugu

SEQ ID NO: 3511201 - RNA, 20 nt, Human
aguuguaucagcacgugugg

SEQ ID NO: 3511202 - RNA, 14 nt, Human
aguuguaucucuuu

SEQ ID NO: 3511203 - RNA, 18 nt, Human
aguuguaugaucugugcc

SEQ ID NO: 3511204 - RNA, 19 nt, Human
aguuguauuuaacagaaau

SEQ ID NO: 3511205 - RNA, 15 nt, Human
aguugucacugcuuu

SEQ ID NO: 3511206 - RNA, 21 nt, Human
aguugucacugcuuuuggccu

SEQ ID NO: 3511207 - RNA, 19 nt, Human
aguugucccgauuguaacu

SEQ ID NO: 3511208 - RNA, 14 nt, Human
aguugucucucuuc

SEQ ID NO: 3511209 - RNA, 12 nt, Human
aguugucucuga

SEQ ID NO: 3511210 - RNA, 17 nt, Human
aguugucucugaugcag

SEQ ID NO: 3511211 - RNA, 20 nt, Human
aguugugaaaguuuugagua

SEQ ID NO: 3511212 - RNA, 15 nt, Human
aguugugcacgcaga

SEQ ID NO: 3511213 - RNA, 14 nt, Human
aguugugcagcuuu

SEQ ID NO: 3511214 - RNA, 20 nt, Human
aguugugcagcuuuugguca

SEQ ID NO: 3511215 - RNA, 15 nt, Human
aguugugccuuuuau

SEQ ID NO: 3511216 - RNA, 19 nt, Human
aguugugccuuuuauagcu

SEQ ID NO: 3511217 - RNA, 21 nt, Human
aguugugccuuuuauagcuau

SEQ ID NO: 3511218 - RNA, 23 nt, Human
aguugugccuuuuauagcuauua

SEQ ID NO: 3511219 - RNA, 14 nt, Human
aguugugcuugagc

SEQ ID NO: 3511220 - RNA, 19 nt, Human
aguuguggugcugacaaag

SEQ ID NO: 3511221 - RNA, 15 nt, Human
aguuguggugugagu

SEQ ID NO: 3511222 - RNA, 16 nt, Human
aguuguguacucuggc

SEQ ID NO: 3511223 - RNA, 21 nt, Human
aguugugugaauaccccaaga

SEQ ID NO: 3511224 - RNA, 14 nt, Human
aguugugugacccu

SEQ ID NO: 3511225 - RNA, 14 nt, Human
aguuguguuguucu

SEQ ID NO: 3511226 - RNA, 14 nt, Human
aguuguguuucaac

SEQ ID NO: 3511227 - RNA, 23 nt, Human
aguuguguuucaacggaaagugc

SEQ ID NO: 3511228 - RNA, 16 nt, Human
aguuguguuugaagca

SEQ ID NO: 3511229 - RNA, 16 nt, Human
aguuguuaauaaaagu

SEQ ID NO: 3511230 - RNA, 15 nt, Human
aguuguuacauuuuu

SEQ ID NO: 3511231 - RNA, 22 nt, Human
aguuguuacauuuuuaagugcu

SEQ ID NO: 3511232 - RNA, 19 nt, Human
aguuguuacuaacuaaacu

SEQ ID NO: 3511233 - RNA, 22 nt, Human
aguuguuacuaacuaaacucuc

SEQ ID NO: 3511234 - RNA, 15 nt, Human
aguuguuagauuaag

SEQ ID NO: 3511235 - RNA, 17 nt, Human
aguuguuagugugucuu

SEQ ID NO: 3511236 - RNA, 23 nt, Human
aguuguucgggccaaggaccuga

SEQ ID NO: 3511237 - RNA, 19 nt, Human
aguuguuggccuccggccu

SEQ ID NO: 3511238 - RNA, 12 nt, Human
aguuguuguaac

SEQ ID NO: 3511239 - RNA, 14 nt, Human
aguuguuguagaga

SEQ ID NO: 3511240 - RNA, 23 nt, Human
aguuguuucuagacuauaaaugu

SEQ ID NO: 3511241 - RNA, 13 nt, Human
aguuguuugcaug

SEQ ID NO: 3511242 - RNA, 20 nt, Human
aguuguuuuuguauauuggu

SEQ ID NO: 3511243 - RNA, 21 nt, Human
aguuuaaaaucaucagaaagg

SEQ ID NO: 3511244 - RNA, 14 nt, Human
aguuuaaaauguau

SEQ ID NO: 3511245 - RNA, 15 nt, Human
aguuuaaaauguaua

SEQ ID NO: 3511246 - RNA, 21 nt, Human
aguuuaaagcucgaaaacaau

SEQ ID NO: 3511247 - RNA, 17 nt, Human
aguuuaaauuguaauag

SEQ ID NO: 3511248 - RNA, 12 nt, Human
aguuuaacacaa

SEQ ID NO: 3511249 - RNA, 23 nt, Human
agcuguacaaauauaagaauaaa

SEQ ID NO: 3511250 - RNA, 19 nt, Human
agcuguacuucuugaauau

SEQ ID NO: 3511251 - RNA, 20 nt, Human
agcuguacuucuugaauaua

SEQ ID NO: 3511252 - RNA, 20 nt, Human
agcuguaggugugcgggacc

SEQ ID NO: 3511253 - RNA, 23 nt, Human
agcuguaguagcccuuucugugu

SEQ ID NO: 3511254 - RNA, 11 nt, Human
agcuguagugg

SEQ ID NO: 3511255 - RNA, 18 nt, Human
agcuguaugauucccagc

SEQ ID NO: 3511256 - RNA, 15 nt, Human
agcuguauugaauca

SEQ ID NO: 3511257 - RNA, 16 nt, Human
agcuguauugucugaa

SEQ ID NO: 3511258 - RNA, 18 nt, Human
agcugucacaacuugugu

SEQ ID NO: 3511259 - RNA, 18 nt, Human
agcugucaccaaggaaac

SEQ ID NO: 3511260 - RNA, 23 nt, Human
agcugucccaucuggucauuugg

SEQ ID NO: 3511261 - RNA, 22 nt, Human
agcuguccccccacucccucac

SEQ ID NO: 3511262 - RNA, 23 nt, Human
agcuguccccccacucccucaca

SEQ ID NO: 3511263 - RNA, 15 nt, Human
agcugucccugcccu

SEQ ID NO: 3511264 - RNA, 20 nt, Human
agcugucccugucaccaagc

SEQ ID NO: 3511265 - RNA, 16 nt, Human
agcuguccugcagcaa

SEQ ID NO: 3511266 - RNA, 21 nt, Human
agcuguccuuuuuccucucca

SEQ ID NO: 3511267 - RNA, 16 nt, Human
agcugugaccugcuga

SEQ ID NO: 3511268 - RNA, 19 nt, Human
agcugugaccugcugagcu

SEQ ID NO: 3511269 - RNA, 20 nt, Human
agcugugaccugcugagcuc

SEQ ID NO: 3511270 - RNA, 18 nt, Human
agcugugagacaguggga

SEQ ID NO: 3511271 - RNA, 19 nt, Human
agcugugagacagugggaa

SEQ ID NO: 3511272 - RNA, 18 nt, Human
agcugugcagguggggag

SEQ ID NO: 3511273 - RNA, 13 nt, Human
agcugugccaccc

SEQ ID NO: 3511274 - RNA, 19 nt, Human
agcugugccacccugggcu

SEQ ID NO: 3511275 - RNA, 21 nt, Human
agcugugccacccugggcucu

SEQ ID NO: 3511276 - RNA, 15 nt, Human
agcugugcucagaag

SEQ ID NO: 3511277 - RNA, 23 nt, Human
agcugugcucuggacaggcaugu

SEQ ID NO: 3511278 - RNA, 19 nt, Human
agcugugcuuaugguacca

SEQ ID NO: 3511279 - RNA, 22 nt, Human
agcugugcuuaugguaccagau

SEQ ID NO: 3511280 - RNA, 19 nt, Human
agcuguggacuuuguucac

SEQ ID NO: 3511281 - RNA, 23 nt, Human
agcugugggcaaaagaguguaaa

SEQ ID NO: 3511282 - RNA, 22 nt, Human
agcugugguuuucuuuugccau

SEQ ID NO: 3511283 - RNA, 21 nt, Human
agcuguguccaaaaccgccag

SEQ ID NO: 3511284 - RNA, 23 nt, Human
agcuguguccuaguucuugaaca

SEQ ID NO: 3511285 - RNA, 14 nt, Human
agcugugugaaaua

SEQ ID NO: 3511286 - RNA, 21 nt, Human
agcugugugaauaccugcuca

SEQ ID NO: 3511287 - RNA, 23 nt, Human
agcugugugacauuuggagaggg

SEQ ID NO: 3511288 - RNA, 20 nt, Human
agcugugugcucuccaagcc

SEQ ID NO: 3511289 - RNA, 22 nt, Human
agcuguguguuuggaagacuau

SEQ ID NO: 3511290 - RNA, 15 nt, Human
agcuguguuguugcu

SEQ ID NO: 3511291 - RNA, 20 nt, Human
aguuuauuuguugagagugu

SEQ ID NO: 3511292 - RNA, 15 nt, Human
aguuuauuuuaagac

SEQ ID NO: 3511293 - RNA, 16 nt, Human
aguuuauuuuuaaaga

SEQ ID NO: 3511294 - RNA, 14 nt, Human
aguuucaaaaaucu

SEQ ID NO: 3511295 - RNA, 22 nt, Human
aguuucaaaaaucugaagauug

SEQ ID NO: 3511296 - RNA, 22 nt, Human
aguuucaaguauccuuguugac

SEQ ID NO: 3511297 - RNA, 22 nt, Human
aguuucaaguuuuaaaguucau

SEQ ID NO: 3511298 - RNA, 16 nt, Human
aguuucaaugugauuc

SEQ ID NO: 3511299 - RNA, 12 nt, Human
aguuucagagaa

SEQ ID NO: 3511300 - RNA, 17 nt, Human
aguuucagaguauauug

SEQ ID NO: 3511301 - RNA, 14 nt, Human
aguuucagauauau

SEQ ID NO: 3511302 - RNA, 17 nt, Human
aguuucagcuuaaaaua

SEQ ID NO: 3511303 - RNA, 11 nt, Human
aguuucaggug

SEQ ID NO: 3511304 - RNA, 15 nt, Human
aguuucaggugacau

SEQ ID NO: 3511305 - RNA, 16 nt, Human
aguuucauauaaagua

SEQ ID NO: 3511306 - RNA, 17 nt, Human
aguuuccauagcaacag

SEQ ID NO: 3511307 - RNA, 17 nt, Human
aguuuccccaccaguga

SEQ ID NO: 3511308 - RNA, 23 nt, Human
aguuuccccaccagugaaugaaa

SEQ ID NO: 3511309 - RNA, 20 nt, Human
aguuuccgugcguggcacuc

SEQ ID NO: 3511310 - RNA, 17 nt, Human
aguuuccucaggcugcu

SEQ ID NO: 3511311 - RNA, 18 nt, Human
aguuuccucaggcugcug

SEQ ID NO: 3511312 - RNA, 20 nt, Human
aguuuccucaggcugcugga

SEQ ID NO: 3511313 - RNA, 15 nt, Human
aguuuccuuggcugg

SEQ ID NO: 3511314 - RNA, 20 nt, Human
aguuucguuucuguuuuuua

SEQ ID NO: 3511315 - RNA, 16 nt, Human
aguuucguuuucaaaa

SEQ ID NO: 3511316 - RNA, 13 nt, Human
aguuucuaaaauu

SEQ ID NO: 3511317 - RNA, 16 nt, Human
aguuucuaaacuggag

SEQ ID NO: 3511318 - RNA, 18 nt, Human
aguuucuaaacuggagac

SEQ ID NO: 3511319 - RNA, 20 nt, Human
aguuucuaaacuggagacug

SEQ ID NO: 3511320 - RNA, 14 nt, Human
aguuucuaagauuc

SEQ ID NO: 3511321 - RNA, 17 nt, Human
aguuucuaagauucuaa

SEQ ID NO: 3511322 - RNA, 19 nt, Human
aguuucuaagauucuaaag

SEQ ID NO: 3511323 - RNA, 12 nt, Human
aguuucucagcu

SEQ ID NO: 3511324 - RNA, 14 nt, Human
aguuucucagcucc

SEQ ID NO: 3511325 - RNA, 15 nt, Human
aguuucucagcuccc

SEQ ID NO: 3511326 - RNA, 13 nt, Human
aguuucuccaagc

SEQ ID NO: 3511327 - RNA, 15 nt, Human
aguuucuccaagcag

SEQ ID NO: 3511328 - RNA, 14 nt, Human
aguuucucuuuuca

SEQ ID NO: 3511329 - RNA, 19 nt, Human
aguuucugaguuuuaccaa

SEQ ID NO: 3511330 - RNA, 16 nt, Human
aguuucuggcccuggc

SEQ ID NO: 3511331 - RNA, 17 nt, Human
aguuucugggaccucag

SEQ ID NO: 3511332 - RNA, 13 nt, Human
aguuucugugguu

SEQ ID NO: 3511333 - RNA, 21 nt, Human
aguuucugugguuggcuggga

SEQ ID NO: 3511334 - RNA, 22 nt, Human
aguuucuguucuguggaaagug

SEQ ID NO: 3511335 - RNA, 23 nt, Human
aguuucuguucuguggaaagugu

SEQ ID NO: 3511336 - RNA, 17 nt, Human
aguuucuguuugauucu

SEQ ID NO: 3511337 - RNA, 19 nt, Human
aguuucuguuugauucuuu

SEQ ID NO: 3511338 - RNA, 14 nt, Human
aguuucuuagcuuu

SEQ ID NO: 3511339 - RNA, 16 nt, Human
aguuucuuuauuuugu

SEQ ID NO: 3511340 - RNA, 21 nt, Human
aguuucuuuccugccuucuuc

SEQ ID NO: 3511341 - RNA, 13 nt, Human
aguuucuuuggga

SEQ ID NO: 3511342 - RNA, 17 nt, Human
aguuugaaaagcaauau

SEQ ID NO: 3511343 - RNA, 21 nt, Human
aguuugaaaagcaauauugua

SEQ ID NO: 3511344 - RNA, 12 nt, Human
aguuugaaauuc

SEQ ID NO: 3511345 - RNA, 13 nt, Human
aguuugaaauucu

SEQ ID NO: 3511346 - RNA, 17 nt, Human
aguuugaaauucugaau

SEQ ID NO: 3511347 - RNA, 18 nt, Human
aguuugaaauucugaauu

SEQ ID NO: 3511348 - RNA, 19 nt, Human
aguuugaaauucugaauuu

SEQ ID NO: 3511349 - RNA, 15 nt, Human
aguuugaacuucaua

SEQ ID NO: 3511350 - RNA, 18 nt, Human
aguuugaaggaaacaguu

SEQ ID NO: 3511351 - RNA, 19 nt, Human
aguuugaaugcugcaaguu

SEQ ID NO: 3511352 - RNA, 15 nt, Human
aguuugaauguuaaa

SEQ ID NO: 3511353 - RNA, 16 nt, Human
aguuugaauguuaaau

SEQ ID NO: 3511354 - RNA, 21 nt, Human
aguuugaauguuaaauaaauu

SEQ ID NO: 3511355 - RNA, 14 nt, Human
aguuugagcugccu

SEQ ID NO: 3511356 - RNA, 18 nt, Human
aguuugaggaaauuugca

SEQ ID NO: 3511357 - RNA, 17 nt, Human
aguuugaggauuaguuu

SEQ ID NO: 3511358 - RNA, 17 nt, Human
aguuugaggcugcagcg

SEQ ID NO: 3511359 - RNA, 14 nt, Human
aguuugaucuuccu

SEQ ID NO: 3511360 - RNA, 21 nt, Human
aguuugaucuuccucugcuaa

SEQ ID NO: 3511361 - RNA, 23 nt, Human
aguuugaucuuccucugcuaaau

SEQ ID NO: 3511362 - RNA, 16 nt, Human
aguuugaugaggcccu

SEQ ID NO: 3511363 - RNA, 17 nt, Human
aguuugauuaaauucuu

SEQ ID NO: 3511364 - RNA, 17 nt, Human
aguuugauuauucagug

SEQ ID NO: 3511365 - RNA, 18 nt, Human
aguuugauuauucagugu

SEQ ID NO: 3511366 - RNA, 16 nt, Human
aguuugcaccuguccc

SEQ ID NO: 3511367 - RNA, 18 nt, Human
aguuugcacucaaaucuu

SEQ ID NO: 3511368 - RNA, 22 nt, Human
aguuugcagaaaagcaccugcc

SEQ ID NO: 3511369 - RNA, 15 nt, Human
aguuugcauuccuga

SEQ ID NO: 3511370 - RNA, 20 nt, Human
aguuugccccguucuguuug

SEQ ID NO: 3511371 - RNA, 21 nt, Human
aguuugcccugguuucacugg

SEQ ID NO: 3511372 - RNA, 16 nt, Human
aguuugcuaauguuuc

SEQ ID NO: 3511373 - RNA, 13 nt, Human
aguuugcuuagaa

SEQ ID NO: 3511374 - RNA, 15 nt, Human
aguuugcuuugcccu

SEQ ID NO: 3511375 - RNA, 22 nt, Human
aguuuggagagagcagacuggc

SEQ ID NO: 3511376 - RNA, 21 nt, Human
aguuuggagagucagaucuuu

SEQ ID NO: 3511377 - RNA, 12 nt, Human
aguuuggaggaa

SEQ ID NO: 3511378 - RNA, 22 nt, Human
aguuuggauauguaaaacauuu

SEQ ID NO: 3511379 - RNA, 16 nt, Human
aguuuggcaaacucuc

SEQ ID NO: 3511380 - RNA, 16 nt, Human
aguuuggcaauaguuu

SEQ ID NO: 3511381 - RNA, 17 nt, Human
aguuuggcaauaguuug

SEQ ID NO: 3511382 - RNA, 14 nt, Human
aguuuggccagaag

SEQ ID NO: 3511383 - RNA, 23 nt, Human
aguuugggaucccugucuuuccu

SEQ ID NO: 3511384 - RNA, 12 nt, Human
aguuugggcuuc

SEQ ID NO: 3511385 - RNA, 17 nt, Human
aguuugggcuucagccu

SEQ ID NO: 3511386 - RNA, 21 nt, Human
aguuuggggcaagucauguaa

SEQ ID NO: 3511387 - RNA, 16 nt, Human
aguuugguguguccuc

SEQ ID NO: 3511388 - RNA, 14 nt, Human
aguuuguaaauguu

SEQ ID NO: 3511389 - RNA, 20 nt, Human
aguuuguaaauguuauuucu

SEQ ID NO: 3511390 - RNA, 23 nt, Human
aguuuguaaauguuauuucugca

SEQ ID NO: 3511391 - RNA, 22 nt, Human
aguuuguacagacguaugcuua

SEQ ID NO: 3511392 - RNA, 16 nt, Human
auaagcucagaaucca

SEQ ID NO: 3511393 - RNA, 15 nt, Human
auaaggaaaaguuua

SEQ ID NO: 3511394 - RNA, 18 nt, Human
auaaggaaagcaauaaau

SEQ ID NO: 3511395 - RNA, 24 nt, Human
auaaggaaaucaacuugcuuauca

SEQ ID NO: 3511396 - RNA, 12 nt, Human
auaaggaagaaa

SEQ ID NO: 3511397 - RNA, 14 nt, Human
auaaggaagaaaca

SEQ ID NO: 3511398 - RNA, 20 nt, Human
auaaggaucagaacagcaga

SEQ ID NO: 3511399 - RNA, 13 nt, Human
auaaggcaggcau

SEQ ID NO: 3511400 - RNA, 12 nt, Human
auaagggaagua

SEQ ID NO: 3511401 - RNA, 23 nt, Human
auaagggacugauguuugugcag

SEQ ID NO: 3511402 - RNA, 20 nt, Human
auaagggagcguagaaucug

SEQ ID NO: 3511403 - RNA, 19 nt, Human
auaagggcaaauuggagaa

SEQ ID NO: 3511404 - RNA, 18 nt, Human
auaaggguaucuggugac

SEQ ID NO: 3511405 - RNA, 18 nt, Human
auaagguaaaaugccaug

SEQ ID NO: 3511406 - RNA, 20 nt, Human
auaagguuucguuucuguau

SEQ ID NO: 3511407 - RNA, 22 nt, Human
auaaguaacuuuauucuugaaa

SEQ ID NO: 3511408 - RNA, 15 nt, Human
auaaguaagaaaaua

SEQ ID NO: 3511409 - RNA, 18 nt, Human
auaaguaagaaaauauuu

SEQ ID NO: 3511410 - RNA, 17 nt, Human
auaaguaauucaagaaa

SEQ ID NO: 3511411 - RNA, 13 nt, Human
auaaguacugugu

SEQ ID NO: 3511412 - RNA, 15 nt, Human
auaaguauacaguuc

SEQ ID NO: 3511413 - RNA, 14 nt, Human
auaaguauuuggaa

SEQ ID NO: 3511414 - RNA, 16 nt, Human
auaaguauuuggaauu

SEQ ID NO: 3511415 - RNA, 16 nt, Human
auaagucaacaguaaa

SEQ ID NO: 3511416 - RNA, 17 nt, Human
auaagucaacaguaaac

SEQ ID NO: 3511417 - RNA, 16 nt, Human
auaagucauguuccuu

SEQ ID NO: 3511418 - RNA, 11 nt, Human
auaagucugau

SEQ ID NO: 3511419 - RNA, 13 nt, Human
auaagucugauuu

SEQ ID NO: 3511420 - RNA, 15 nt, Human
auaagugaagugaua

SEQ ID NO: 3511421 - RNA, 19 nt, Human
auaagugcacacagaaaua

SEQ ID NO: 3511422 - RNA, 21 nt, Human
auaagugcuauugcagagccg

SEQ ID NO: 3511423 - RNA, 17 nt, Human
auaagugcuguauaaaa

SEQ ID NO: 3511424 - RNA, 18 nt, Human
auaagugcuguauaaaau

SEQ ID NO: 3511425 - RNA, 19 nt, Human
auaagugcuguauaaaauc

SEQ ID NO: 3511426 - RNA, 20 nt, Human
auaaguggaggcacuuuagg

SEQ ID NO: 3511427 - RNA, 13 nt, Human
auaaguguacaua

SEQ ID NO: 3511428 - RNA, 14 nt, Human
auaaguguacauau

SEQ ID NO: 3511429 - RNA, 20 nt, Human
auaaguguacauaugugcug

SEQ ID NO: 3511430 - RNA, 16 nt, Human
auaaguguauuuuuca

SEQ ID NO: 3511431 - RNA, 22 nt, Human
auaaguguguguuuuucauaaa

SEQ ID NO: 3511432 - RNA, 17 nt, Human
auaaguguucugucuga

SEQ ID NO: 3511433 - RNA, 22 nt, Human
auaaguuaacuuccaauuuaca

SEQ ID NO: 3511434 - RNA, 21 nt, Human
auaaguuauugcaguuuauca

SEQ ID NO: 3511435 - RNA, 24 nt, Human
auaaguuauugcaguuuaucauuc

SEQ ID NO: 3511436 - RNA, 12 nt, Human
auaaguuauuuu

SEQ ID NO: 3511437 - RNA, 22 nt, Human
auaaguuauuuuuguacauguu

SEQ ID NO: 3511438 - RNA, 18 nt, Human
auaaguucaaauucuucu

SEQ ID NO: 3511439 - RNA, 16 nt, Human
auaaguucacaaaaug

SEQ ID NO: 3511440 - RNA, 13 nt, Human
auaaguucauaca

SEQ ID NO: 3511441 - RNA, 15 nt, Human
auaaguucauacauu

SEQ ID NO: 3511442 - RNA, 21 nt, Human
auaaguucauacauuguacga

SEQ ID NO: 3511443 - RNA, 20 nt, Human
auaaguucuuaugccauguu

SEQ ID NO: 3511444 - RNA, 12 nt, Human
auaaguuuauuu

SEQ ID NO: 3511445 - RNA, 17 nt, Human
auaaguuugcaauuugg

SEQ ID NO: 3511446 - RNA, 19 nt, Human
auaauaaaaaauuaugaca

SEQ ID NO: 3511447 - RNA, 15 nt, Human
auaauaaaaauauau

SEQ ID NO: 3511448 - RNA, 23 nt, Human
auaauaaagaauagcuuuaauga

SEQ ID NO: 3511449 - RNA, 11 nt, Human
auaauaaagga

SEQ ID NO: 3511450 - RNA, 12 nt, Human
auaauaaaguau

SEQ ID NO: 3511451 - RNA, 15 nt, Human
auaauaaauguacau

SEQ ID NO: 3511452 - RNA, 13 nt, Human
auaauaaauuaaa

SEQ ID NO: 3511453 - RNA, 15 nt, Human
auaauaaauugcaug

SEQ ID NO: 3511454 - RNA, 17 nt, Human
auaauaagcaggauguu

SEQ ID NO: 3511455 - RNA, 15 nt, Human
auaauaagcuaaaga

SEQ ID NO: 3511456 - RNA, 17 nt, Human
auaauaaggaaaaguuu

SEQ ID NO: 3511457 - RNA, 13 nt, Human
auaauaauacaag

SEQ ID NO: 3511458 - RNA, 12 nt, Human
auaauaauauau

SEQ ID NO: 3511459 - RNA, 15 nt, Human
auaauaauauuguuu

SEQ ID NO: 3511460 - RNA, 18 nt, Human
auaauaauauuguuuuuc

SEQ ID NO: 3511461 - RNA, 22 nt, Human
auaauacacaaaaucaaauaau

SEQ ID NO: 3511462 - RNA, 18 nt, Human
auaauacaccacuacauu

SEQ ID NO: 3511463 - RNA, 22 nt, Human
auaauacacuaauuccuuucua

SEQ ID NO: 3511464 - RNA, 13 nt, Human
auaauacacuugc

SEQ ID NO: 3511465 - RNA, 17 nt, Human
auaauacagccaaagau

SEQ ID NO: 3511466 - RNA, 19 nt, Human
auaauacaguaucucaggg

SEQ ID NO: 3511467 - RNA, 18 nt, Human
auaauaccucaauguuug

SEQ ID NO: 3511468 - RNA, 20 nt, Human
auaauacugaaccacuugua

SEQ ID NO: 3511469 - RNA, 21 nt, Human
auaauacugcugagauacaua

SEQ ID NO: 3511470 - RNA, 14 nt, Human
auaauacuuuguau

SEQ ID NO: 3511471 - RNA, 18 nt, Human
auaauacuuuguauacaa

SEQ ID NO: 3511472 - RNA, 21 nt, Human
auaauacuuuguauacaagua

SEQ ID NO: 3511473 - RNA, 14 nt, Human
auaauaguuuacau

SEQ ID NO: 3511474 - RNA, 11 nt, Human
auaauauaaaa

SEQ ID NO: 3511475 - RNA, 12 nt, Human
auaauauaaaaa

SEQ ID NO: 3511476 - RNA, 13 nt, Human
auaauauaaaaaa

SEQ ID NO: 3511477 - RNA, 13 nt, Human
auaauauacuugu

SEQ ID NO: 3511478 - RNA, 20 nt, Human
auaauauacuuguggacuaa

SEQ ID NO: 3511479 - RNA, 18 nt, Human
auaauaucuuugugauaa

SEQ ID NO: 3511480 - RNA, 12 nt, Human
auaauaugagaa

SEQ ID NO: 3511481 - RNA, 12 nt, Human
auaauaugcaca

SEQ ID NO: 3511482 - RNA, 21 nt, Human
auaauaugcugccaaauuuug

SEQ ID NO: 3511483 - RNA, 13 nt, Human
auaauauggcuau

SEQ ID NO: 3511484 - RNA, 13 nt, Human
auaauauuacugu

SEQ ID NO: 3511485 - RNA, 14 nt, Human
auaauauugaaaau

SEQ ID NO: 3511486 - RNA, 21 nt, Human
auaauauugaaaauugaaaag

SEQ ID NO: 3511487 - RNA, 22 nt, Human
auaauauuguuugguaaauguu

SEQ ID NO: 3511488 - RNA, 19 nt, Human
auaauauuuuacauacacu

SEQ ID NO: 3511489 - RNA, 14 nt, Human
auaauauuuuuaau

SEQ ID NO: 3511490 - RNA, 21 nt, Human
auaaucaagagccuuaaaaca

SEQ ID NO: 3511491 - RNA, 21 nt, Human
auaaucagcaagaauuugauc

SEQ ID NO: 3511492 - RNA, 21 nt, Human
auagguccagaaguccuuaug

SEQ ID NO: 3511493 - RNA, 13 nt, Human
auaggucucuucu

SEQ ID NO: 3511494 - RNA, 18 nt, Human
auaggucucuucucccag

SEQ ID NO: 3511495 - RNA, 19 nt, Human
auaggucucuucucccaga

SEQ ID NO: 3511496 - RNA, 18 nt, Human
auaggugagaaaaaaaca

SEQ ID NO: 3511497 - RNA, 20 nt, Human
auaggugauccauguaacug

SEQ ID NO: 3511498 - RNA, 23 nt, Human
auaggugauccauguaacugccu

SEQ ID NO: 3511499 - RNA, 19 nt, Human
auaggugauguuugcucuu

SEQ ID NO: 3511500 - RNA, 21 nt, Human
auaggugcuacaaaaacacag

SEQ ID NO: 3511501 - RNA, 23 nt, Human
auaggugcuacaaaaacacagca

SEQ ID NO: 3511502 - RNA, 22 nt, Human
auaggugcuuauucucaaagca

SEQ ID NO: 3511503 - RNA, 20 nt, Human
auagguugccaauaauacac

SEQ ID NO: 3511504 - RNA, 15 nt, Human
auagguuuaauaauu

SEQ ID NO: 3511505 - RNA, 18 nt, Human
auagguuuggacaaaaug

SEQ ID NO: 3511506 - RNA, 23 nt, Human
auagguuuuccccucuuuuguua

SEQ ID NO: 3511507 - RNA, 16 nt, Human
auagguuuuguuugcu

SEQ ID NO: 3511508 - RNA, 21 nt, Human
auagguuuuguuugcuaucuu

SEQ ID NO: 3511509 - RNA, 22 nt, Human
auagguuuuguuugcuaucuua

SEQ ID NO: 3511510 - RNA, 18 nt, Human
auaguaacaucaaagauu

SEQ ID NO: 3511511 - RNA, 13 nt, Human
auaguaacuccca

SEQ ID NO: 3511512 - RNA, 23 nt, Human
auaguaauauaauacacaaaauc

SEQ ID NO: 3511513 - RNA, 17 nt, Human
auaguaaugaguuuaaa

SEQ ID NO: 3511514 - RNA, 17 nt, Human
auaguaauuuguaaagu

SEQ ID NO: 3511515 - RNA, 19 nt, Human
auaguaauuuguaaaguug

SEQ ID NO: 3511516 - RNA, 23 nt, Human
auaguacuagagauauuuuguaa

SEQ ID NO: 3511517 - RNA, 17 nt, Human
auaguagcauacauuua

SEQ ID NO: 3511518 - RNA, 16 nt, Human
auaguauaucuggaca

SEQ ID NO: 3511519 - RNA, 16 nt, Human
auaguauauuaaaaau

SEQ ID NO: 3511520 - RNA, 18 nt, Human
auaguauccuccagguuu

SEQ ID NO: 3511521 - RNA, 22 nt, Human
auaguauccuccagguuuuuca

SEQ ID NO: 3511522 - RNA, 19 nt, Human
auaguaugaguaaugcuua

SEQ ID NO: 3511523 - RNA, 20 nt, Human
auaguaugcacuauauacau

SEQ ID NO: 3511524 - RNA, 20 nt, Human
auaguauuugaaaacagaaa

SEQ ID NO: 3511525 - RNA, 12 nt, Human
auaguauuugau

SEQ ID NO: 3511526 - RNA, 18 nt, Human
auaguauuuuuauauuua

SEQ ID NO: 3511527 - RNA, 20 nt, Human
auagucaaaccauaaacuuc

SEQ ID NO: 3511528 - RNA, 18 nt, Human
auagucaaauugugugaa

SEQ ID NO: 3511529 - RNA, 14 nt, Human
auagucaagacgaa

SEQ ID NO: 3511530 - RNA, 21 nt, Human
auagucaagacgaacauguag

SEQ ID NO: 3511531 - RNA, 19 nt, Human
auagucuagacuaaaagau

SEQ ID NO: 3511532 - RNA, 15 nt, Human
auagucuaguguagu

SEQ ID NO: 3511533 - RNA, 21 nt, Human
auagucucuuuaaaaggaaag

SEQ ID NO: 3511534 - RNA, 13 nt, Human
auagucuggcugu

SEQ ID NO: 3511535 - RNA, 13 nt, Human
auagucuuucagu

SEQ ID NO: 3511536 - RNA, 16 nt, Human
auagucuuuggagaaa

SEQ ID NO: 3511537 - RNA, 22 nt, Human
auauacauacuuacaugugugu

SEQ ID NO: 3511538 - RNA, 14 nt, Human
auauacauauauau

SEQ ID NO: 3511539 - RNA, 21 nt, Human
auauacauguguguauauaug

SEQ ID NO: 3511540 - RNA, 18 nt, Human
auauacauguuuauguaa

SEQ ID NO: 3511541 - RNA, 20 nt, Human
auauaccacucuuuaccuuu

SEQ ID NO: 3511542 - RNA, 18 nt, Human
auauaccuauaaugugug

SEQ ID NO: 3511543 - RNA, 21 nt, Human
auauaccuauaauguguguau

SEQ ID NO: 3511544 - RNA, 19 nt, Human
auauacucaagagugguau

SEQ ID NO: 3511545 - RNA, 13 nt, Human
auauacucauuag

SEQ ID NO: 3511546 - RNA, 19 nt, Human
auauacucauuagaauuac

SEQ ID NO: 3511547 - RNA, 14 nt, Human
auauacuguaaaga

SEQ ID NO: 3511548 - RNA, 19 nt, Human
auauacuguaaagaaagag

SEQ ID NO: 3511549 - RNA, 21 nt, Human
auauacuguaaagaaagagag

SEQ ID NO: 3511550 - RNA, 18 nt, Human
auauacuguucuucauuu

SEQ ID NO: 3511551 - RNA, 15 nt, Human
auauacuuaaaugga

SEQ ID NO: 3511552 - RNA, 14 nt, Human
auauacuuguggac

SEQ ID NO: 3511553 - RNA, 14 nt, Human
auauacuuguuuuu

SEQ ID NO: 3511554 - RNA, 20 nt, Human
auauagaaguauaaagaauu

SEQ ID NO: 3511555 - RNA, 17 nt, Human
auauagaauuagcuuuu

SEQ ID NO: 3511556 - RNA, 18 nt, Human
auauagagucauuguaau

SEQ ID NO: 3511557 - RNA, 20 nt, Human
auauagaucacauaacagaa

SEQ ID NO: 3511558 - RNA, 15 nt, Human
auauagauuaaauca

SEQ ID NO: 3511559 - RNA, 14 nt, Human
auauagauuagaaa

SEQ ID NO: 3511560 - RNA, 23 nt, Human
auauagauuauaacuugucuaaa

SEQ ID NO: 3511561 - RNA, 20 nt, Human
auauagcaaaacuuuuaaac

SEQ ID NO: 3511562 - RNA, 22 nt, Human
auauagcaaaacuuuuaaacua

SEQ ID NO: 3511563 - RNA, 17 nt, Human
auauagcaagacauuau

SEQ ID NO: 3511564 - RNA, 16 nt, Human
auauagcccagccagg

SEQ ID NO: 3511565 - RNA, 12 nt, Human
auauagccuuua

SEQ ID NO: 3511566 - RNA, 17 nt, Human
auauagcugaucaguuu

SEQ ID NO: 3511567 - RNA, 18 nt, Human
auauagcugaucaguuuu

SEQ ID NO: 3511568 - RNA, 14 nt, Human
auauagcuguacaa

SEQ ID NO: 3511569 - RNA, 17 nt, Human
auauagcuguacaaaua

SEQ ID NO: 3511570 - RNA, 16 nt, Human
auauaggaacuuaaau

SEQ ID NO: 3511571 - RNA, 22 nt, Human
auauaggcuauuuucuaaagac

SEQ ID NO: 3511572 - RNA, 15 nt, Human
auauagguugugcaa

SEQ ID NO: 3511573 - RNA, 22 nt, Human
auauagguugugcaaauuaaca

SEQ ID NO: 3511574 - RNA, 18 nt, Human
auauagguuuuguuugcu

SEQ ID NO: 3511575 - RNA, 21 nt, Human
auauagguuuuguuugcuauc

SEQ ID NO: 3511576 - RNA, 16 nt, Human
auauaguuccuaagaa

SEQ ID NO: 3511577 - RNA, 23 nt, Human
auauaguuuuacuuuuaaacugu

SEQ ID NO: 3511578 - RNA, 18 nt, Human
auauauaaaauaaauaua

SEQ ID NO: 3511579 - RNA, 20 nt, Human
auauauaaaauaaauauaua

SEQ ID NO: 3511580 - RNA, 17 nt, Human
auauauaaagaauauau

SEQ ID NO: 3511581 - RNA, 11 nt, Human
auauauaaaua

SEQ ID NO: 3511582 - RNA, 16 nt, Human
auauauaaauaaauau

SEQ ID NO: 3511583 - RNA, 14 nt, Human
auauauaaauauau

SEQ ID NO: 3511584 - RNA, 18 nt, Human
auauauaaauauauauaa

SEQ ID NO: 3511585 - RNA, 15 nt, Human
auauauaaauguaua

SEQ ID NO: 3511586 - RNA, 17 nt, Human
auauauaacaaugcugu

SEQ ID NO: 3511587 - RNA, 18 nt, Human
auauauaacauauaugga

SEQ ID NO: 3511588 - RNA, 14 nt, Human
auauauaagaaaga

SEQ ID NO: 3511589 - RNA, 17 nt, Human
auauauaagaaagacau

SEQ ID NO: 3511590 - RNA, 20 nt, Human
auauauaaguguacauaugu

SEQ ID NO: 3511591 - RNA, 13 nt, Human
auauauaauauau

SEQ ID NO: 3511592 - RNA, 19 nt, Human
auauauaauucuguacaua

SEQ ID NO: 3511593 - RNA, 17 nt, Human
auauauacaaaaagaaa

SEQ ID NO: 3511594 - RNA, 16 nt, Human
auauauacaguaacuu

SEQ ID NO: 3511595 - RNA, 10 nt, Human
auauauacau

SEQ ID NO: 3511596 - RNA, 14 nt, Human
auauauacauacac

SEQ ID NO: 3511597 - RNA, 14 nt, Human
auauauacuauuaa

SEQ ID NO: 3511598 - RNA, 19 nt, Human
auauauacucaagaguggu

SEQ ID NO: 3511599 - RNA, 14 nt, Human
auauauagcauuua

SEQ ID NO: 3511600 - RNA, 20 nt, Human
auauauagcuggcaagaaug

SEQ ID NO: 3511601 - RNA, 20 nt, Human
auauauaggcuauuuucuaa

SEQ ID NO: 3511602 - RNA, 15 nt, Human
auauauagugcuaua

SEQ ID NO: 3511603 - RNA, 12 nt, Human
auauauauaaag

SEQ ID NO: 3511604 - RNA, 13 nt, Human
auauauauaaagu

SEQ ID NO: 3511605 - RNA, 14 nt, Human
auauauauaaauaa

SEQ ID NO: 3511606 - RNA, 14 nt, Human
auauauauaaauau

SEQ ID NO: 3511607 - RNA, 15 nt, Human
auauauauauaaaga

SEQ ID NO: 3511608 - RNA, 15 nt, Human
auauauauauauaaa

SEQ ID NO: 3511609 - RNA, 14 nt, Human
auauauauauauac

SEQ ID NO: 3511610 - RNA, 15 nt, Human
auauauauauauauu

SEQ ID NO: 3511611 - RNA, 13 nt, Human
auauauauauauc

SEQ ID NO: 3511612 - RNA, 14 nt, Human
auauauauccucug

SEQ ID NO: 3511613 - RNA, 15 nt, Human
auauauaucuauaua

SEQ ID NO: 3511614 - RNA, 15 nt, Human
auauauaugaauaaa

SEQ ID NO: 3511615 - RNA, 16 nt, Human
auauauaugugugugu

SEQ ID NO: 3511616 - RNA, 18 nt, Human
auauauauguugauuucu

SEQ ID NO: 3511617 - RNA, 19 nt, Human
auauauauuauaaauauau

SEQ ID NO: 3511618 - RNA, 14 nt, Human
auauauauuauacu

SEQ ID NO: 3511619 - RNA, 23 nt, Human
auauauauucuauuacauuuuca

SEQ ID NO: 3511620 - RNA, 23 nt, Human
auauauauucuggcugauaaaag

SEQ ID NO: 3511621 - RNA, 10 nt, Human
auauauauuu

SEQ ID NO: 3511622 - RNA, 14 nt, Human
auauaucaguuuga

SEQ ID NO: 3511623 - RNA, 15 nt, Human
auauaucaguuugau

SEQ ID NO: 3511624 - RNA, 15 nt, Human
auauaucaugaguga

SEQ ID NO: 3511625 - RNA, 16 nt, Human
auauaucccagaaauu

SEQ ID NO: 3511626 - RNA, 23 nt, Human
auauauccuuuucuucuauguag

SEQ ID NO: 3511627 - RNA, 16 nt, Human
auauaucuaucuauuu

SEQ ID NO: 3511628 - RNA, 18 nt, Human
auauaucuaucuauuuga

SEQ ID NO: 3511629 - RNA, 14 nt, Human
auauaucuaucuua

SEQ ID NO: 3511630 - RNA, 14 nt, Human
auauaucucaaauu

SEQ ID NO: 3511631 - RNA, 19 nt, Human
auauaucucaaauuguaau

SEQ ID NO: 3511632 - RNA, 16 nt, Human
auauaucucuauuuga

SEQ ID NO: 3511633 - RNA, 17 nt, Human
auauaucugcuucagug

SEQ ID NO: 3511634 - RNA, 18 nt, Human
auauaucugcuucagugg

SEQ ID NO: 3511635 - RNA, 16 nt, Human
auauaugaaaacuaua

SEQ ID NO: 3511636 - RNA, 19 nt, Human
auauaugcacuauguauau

SEQ ID NO: 3511637 - RNA, 20 nt, Human
auauaugcacuuaauuuguu

SEQ ID NO: 3511638 - RNA, 13 nt, Human
auauaugcauaua

SEQ ID NO: 3511639 - RNA, 16 nt, Human
auauaugccuuuuucc

SEQ ID NO: 3511640 - RNA, 13 nt, Human
auauaugcuaagu

SEQ ID NO: 3511641 - RNA, 17 nt, Human
auauauggcagaguugu

SEQ ID NO: 3511642 - RNA, 16 nt, Human
auauauggcauuugca

SEQ ID NO: 3511643 - RNA, 21 nt, Human
auauauggggaugguaguuuu

SEQ ID NO: 3511644 - RNA, 22 nt, Human
auauauggggaugguaguuuuu

SEQ ID NO: 3511645 - RNA, 16 nt, Human
auauauggucuaaugu

SEQ ID NO: 3511646 - RNA, 10 nt, Human
auauauguau

SEQ ID NO: 3511647 - RNA, 19 nt, Human
auauauguauauauaugca

SEQ ID NO: 3511648 - RNA, 20 nt, Human
auauauguauuauuuauaau

SEQ ID NO: 3511649 - RNA, 13 nt, Human
auauauguauuuu

SEQ ID NO: 3511650 - RNA, 19 nt, Human
auauauguguauauauaca

SEQ ID NO: 3511651 - RNA, 20 nt, Human
auauauguguauauauacau

SEQ ID NO: 3511652 - RNA, 23 nt, Human
auauauguguauauauacauaca

SEQ ID NO: 3511653 - RNA, 13 nt, Human
auauaugugugcc

SEQ ID NO: 3511654 - RNA, 16 nt, Human
auauauguguguguau

SEQ ID NO: 3511655 - RNA, 16 nt, Human
auauauguguguuuaa

SEQ ID NO: 3511656 - RNA, 18 nt, Human
auauauguguguuuaaau

SEQ ID NO: 3511657 - RNA, 16 nt, Human
auacaacacaaagaga

SEQ ID NO: 3511658 - RNA, 17 nt, Human
auacaacaccaaaaaau

SEQ ID NO: 3511659 - RNA, 15 nt, Human
auacaacagugcuaa

SEQ ID NO: 3511660 - RNA, 20 nt, Human
auacaacauguagcugaguu

SEQ ID NO: 3511661 - RNA, 22 nt, Human
auacaacccuggcauuaugucc

SEQ ID NO: 3511662 - RNA, 17 nt, Human
auacaaccucccucuug

SEQ ID NO: 3511663 - RNA, 23 nt, Human
auacaaccucccucuuguuuugu

SEQ ID NO: 3511664 - RNA, 18 nt, Human
auacaaccugcuugggug

SEQ ID NO: 3511665 - RNA, 16 nt, Human
auacaaccuucauuua

SEQ ID NO: 3511666 - RNA, 19 nt, Human
auacaaccuucauuuaaaa

SEQ ID NO: 3511667 - RNA, 18 nt, Human
auacaagauaagcuucca

SEQ ID NO: 3511668 - RNA, 20 nt, Human
auacaagguauaauaaaauu

SEQ ID NO: 3511669 - RNA, 13 nt, Human
auacaaguuucau

SEQ ID NO: 3511670 - RNA, 14 nt, Human
auacaaguuucauc

SEQ ID NO: 3511671 - RNA, 14 nt, Human
auacaauaaauugc

SEQ ID NO: 3511672 - RNA, 21 nt, Human
auacaauauauaaaaauauau

SEQ ID NO: 3511673 - RNA, 15 nt, Human
auacaauaucaucca

SEQ ID NO: 3511674 - RNA, 21 nt, Human
auacaaucagcugcuuuguua

SEQ ID NO: 3511675 - RNA, 18 nt, Human
auacaaucauagcauugu

SEQ ID NO: 3511676 - RNA, 16 nt, Human
auacaaugaugcuauu

SEQ ID NO: 3511677 - RNA, 14 nt, Human
auacaaugcugugc

SEQ ID NO: 3511678 - RNA, 19 nt, Human
auacaauuuuguuucugua

SEQ ID NO: 3511679 - RNA, 20 nt, Human
auacaauuuuuuuuauuagu

SEQ ID NO: 3511680 - RNA, 15 nt, Human
auacacaacacacac

SEQ ID NO: 3511681 - RNA, 10 nt, Human
auacacacac

SEQ ID NO: 3511682 - RNA, 19 nt, Human
auacacacacacacacagc

SEQ ID NO: 3511683 - RNA, 15 nt, Human
auauaacacauuuuu

SEQ ID NO: 3511684 - RNA, 15 nt, Human
auauaacaugaaaug

SEQ ID NO: 3511685 - RNA, 16 nt, Human
auauaaccaauguuua

SEQ ID NO: 3511686 - RNA, 17 nt, Human
auauaaccaauguuuaa

SEQ ID NO: 3511687 - RNA, 20 nt, Human
auauaaccaauguuuaaaaa

SEQ ID NO: 3511688 - RNA, 13 nt, Human
auauaacuaacaa

SEQ ID NO: 3511689 - RNA, 18 nt, Human
auauaacuauugcccagg

SEQ ID NO: 3511690 - RNA, 13 nt, Human
auauaacugccuu

SEQ ID NO: 3511691 - RNA, 20 nt, Human
auauaacuuauauuguaaga

SEQ ID NO: 3511692 - RNA, 15 nt, Human
auauaacuuuagaaa

SEQ ID NO: 3511693 - RNA, 16 nt, Human
auauaagccuuuuaua

SEQ ID NO: 3511694 - RNA, 22 nt, Human
auauaagggaaguaguuaucau

SEQ ID NO: 3511695 - RNA, 14 nt, Human
auauaaguaaagug

SEQ ID NO: 3511696 - RNA, 18 nt, Human
auauaagugcuguauaaa

SEQ ID NO: 3511697 - RNA, 18 nt, Human
auauaaguguacauaugu

SEQ ID NO: 3511698 - RNA, 15 nt, Human
auauaauaaaguauu

SEQ ID NO: 3511699 - RNA, 17 nt, Human
auauaauaaaguauucc

SEQ ID NO: 3511700 - RNA, 20 nt, Human
auauaauaaaguauuccacc

SEQ ID NO: 3511701 - RNA, 21 nt, Human
auauaauaaauguacauuaau

SEQ ID NO: 3511702 - RNA, 16 nt, Human
auauaauacacaaaau

SEQ ID NO: 3511703 - RNA, 17 nt, Human
auauaauacacaaaauc

SEQ ID NO: 3511704 - RNA, 20 nt, Human
auauaauauauuuguguauu

SEQ ID NO: 3511705 - RNA, 20 nt, Human
auauaauaucuaaaguuaua

SEQ ID NO: 3511706 - RNA, 14 nt, Human
auauaaucauuauu

SEQ ID NO: 3511707 - RNA, 11 nt, Human
auauaaugaac

SEQ ID NO: 3511708 - RNA, 19 nt, Human
auauaaugaauaaaucauu

SEQ ID NO: 3511709 - RNA, 19 nt, Human
auauaauggaagagaaauc

SEQ ID NO: 3511710 - RNA, 21 nt, Human
auauaauguuguuauuuaaag

SEQ ID NO: 3511711 - RNA, 22 nt, Human
auauaauguuguuauuuaaaga

SEQ ID NO: 3511712 - RNA, 11 nt, Human
auauaauuaug

SEQ ID NO: 3511713 - RNA, 18 nt, Human
auauaauucacucaagca

SEQ ID NO: 3511714 - RNA, 13 nt, Human
auauaauucugua

SEQ ID NO: 3511715 - RNA, 17 nt, Human
auauaauucuguacaua

SEQ ID NO: 3511716 - RNA, 19 nt, Human
auauaauucuguacauagc

SEQ ID NO: 3511717 - RNA, 21 nt, Human
auauaauuguuuuuuaucuuu

SEQ ID NO: 3511718 - RNA, 15 nt, Human
auauacaaaacuuua

SEQ ID NO: 3511719 - RNA, 16 nt, Human
auauacaaaacuuuau

SEQ ID NO: 3511720 - RNA, 12 nt, Human
auauacacacac

SEQ ID NO: 3511721 - RNA, 13 nt, Human
auauacacacaca

SEQ ID NO: 3511722 - RNA, 18 nt, Human
auauacacacacaaagag

SEQ ID NO: 3511723 - RNA, 19 nt, Human
auauacacaggauccuauu

SEQ ID NO: 3511724 - RNA, 14 nt, Human
auauacagaggaaa

SEQ ID NO: 3511725 - RNA, 17 nt, Human
auauacagaugaaaauu

SEQ ID NO: 3511726 - RNA, 18 nt, Human
auauacagaugaaaauuu

SEQ ID NO: 3511727 - RNA, 15 nt, Human
auauacauacuuaca

SEQ ID NO: 3511728 - RNA, 16 nt, Human
auauacaugaagaaua

SEQ ID NO: 3511729 - RNA, 19 nt, Human
auauacaugaagaauagaa

SEQ ID NO: 3511730 - RNA, 13 nt, Human
auauacaugugug

SEQ ID NO: 3511731 - RNA, 18 nt, Human
auauacauguguguauau

SEQ ID NO: 3511732 - RNA, 21 nt, Human
auauacauguuuauguaaaca

SEQ ID NO: 3511733 - RNA, 18 nt, Human
auauacauucuuuaucuu

SEQ ID NO: 3511734 - RNA, 17 nt, Human
auauaccaaagcacauu

SEQ ID NO: 3511735 - RNA, 14 nt, Human
auauaccaaauuaa

SEQ ID NO: 3511736 - RNA, 16 nt, Human
auauaccaaauuaaaa

SEQ ID NO: 3511737 - RNA, 17 nt, Human
auauacccccccaugca

SEQ ID NO: 3511738 - RNA, 17 nt, Human
auauaccuauaaugugu

SEQ ID NO: 3511739 - RNA, 19 nt, Human
auauaccuauaaugugugu

SEQ ID NO: 3511740 - RNA, 16 nt, Human
auauacgaacaaaaca

SEQ ID NO: 3511741 - RNA, 20 nt, Human
auauacgugaaaauuauuug

SEQ ID NO: 3511742 - RNA, 22 nt, Human
auauacuaagauguucacugug

SEQ ID NO: 3511743 - RNA, 12 nt, Human
auauacuguaaa

SEQ ID NO: 3511744 - RNA, 23 nt, Human
auauacuguaaagaaagagagaa

SEQ ID NO: 3511745 - RNA, 21 nt, Human
auauacuuguggacuaaaaga

SEQ ID NO: 3511746 - RNA, 22 nt, Human
auauacuugugguuuucaaauu

SEQ ID NO: 3511747 - RNA, 20 nt, Human
auauacuuguuguuuaaugu

SEQ ID NO: 3511748 - RNA, 14 nt, Human
auauacuuugugga

SEQ ID NO: 3511749 - RNA, 17 nt, Human
auauagaaguauaaaga

SEQ ID NO: 3511750 - RNA, 12 nt, Human
auauagaauugc

SEQ ID NO: 3511751 - RNA, 21 nt, Human
auauagaauugcaauuuuaac

SEQ ID NO: 3511752 - RNA, 13 nt, Human
auauagagauguu

SEQ ID NO: 3511753 - RNA, 14 nt, Human
auauagagauguuu

SEQ ID NO: 3511754 - RNA, 15 nt, Human
auauagagauguuuu

SEQ ID NO: 3511755 - RNA, 16 nt, Human
auauagagauguuuuu

SEQ ID NO: 3511756 - RNA, 19 nt, Human
auauagagucauuguaaug

SEQ ID NO: 3511757 - RNA, 22 nt, Human
auauagagucauuguaauguug

SEQ ID NO: 3511758 - RNA, 13 nt, Human
auauagauuagaa

SEQ ID NO: 3511759 - RNA, 16 nt, Human
auauagauuagaaaaa

SEQ ID NO: 3511760 - RNA, 17 nt, Human
auauagauuagaaaaau

SEQ ID NO: 3511761 - RNA, 15 nt, Human
auauagauuauaacu

SEQ ID NO: 3511762 - RNA, 19 nt, Human
auauagcaaaacuuuuaaa

SEQ ID NO: 3511763 - RNA, 19 nt, Human
auauagcagcaaaaauaua

SEQ ID NO: 3511764 - RNA, 20 nt, Human
auauagcagcaaaaauauaa

SEQ ID NO: 3511765 - RNA, 23 nt, Human
auauagccauugaucauaaacug

SEQ ID NO: 3511766 - RNA, 23 nt, Human
auauagcuaggugacauauacau

SEQ ID NO: 3511767 - RNA, 21 nt, Human
auauagcuauuuuuauggaau

SEQ ID NO: 3511768 - RNA, 13 nt, Human
auauagcuggcaa

SEQ ID NO: 3511769 - RNA, 20 nt, Human
auauagcuguacaaauauaa

SEQ ID NO: 3511770 - RNA, 18 nt, Human
auauagcuugaaacauag

SEQ ID NO: 3511771 - RNA, 19 nt, Human
auauaggucucuucuccca

SEQ ID NO: 3511772 - RNA, 21 nt, Human
auauaggucucuucucccaga

SEQ ID NO: 3511773 - RNA, 22 nt, Human
auauaggucucuucucccagaa

SEQ ID NO: 3511774 - RNA, 19 nt, Human
auauagguuuuguuugcua

SEQ ID NO: 3511775 - RNA, 13 nt, Human
auauaguguacag

SEQ ID NO: 3511776 - RNA, 17 nt, Human
auauaguuagcuaauaa

SEQ ID NO: 3511777 - RNA, 21 nt, Human
auauaguuccuaagaagcuuc

SEQ ID NO: 3511778 - RNA, 16 nt, Human
auauaguuuacuauuu

SEQ ID NO: 3511779 - RNA, 17 nt, Human
auauaguuuuuaccuuu

SEQ ID NO: 3511780 - RNA, 21 nt, Human
auauauaaaacggugcuguga

SEQ ID NO: 3511781 - RNA, 14 nt, Human
auauauaaaauaaa

SEQ ID NO: 3511782 - RNA, 21 nt, Human
auauauaaaccuaaaaaagau

SEQ ID NO: 3511783 - RNA, 15 nt, Human
auauauaaagaauau

SEQ ID NO: 3511784 - RNA, 15 nt, Human
auauauaaaguauag

SEQ ID NO: 3511785 - RNA, 13 nt, Human
auauauaaauaaa

SEQ ID NO: 3511786 - RNA, 17 nt, Human
auauauaaauaaauaua

SEQ ID NO: 3511787 - RNA, 18 nt, Human
auauauaaauauauuauu

SEQ ID NO: 3511788 - RNA, 14 nt, Human
auauauaaauguau

SEQ ID NO: 3511789 - RNA, 16 nt, Human
auauauaaauguauaa

SEQ ID NO: 3511790 - RNA, 14 nt, Human
auauauaacaaugc

SEQ ID NO: 3511791 - RNA, 19 nt, Human
auauauaacaaugcuguau

SEQ ID NO: 3511792 - RNA, 21 nt, Human
auauauacaguaacuuuaugu

SEQ ID NO: 3511793 - RNA, 14 nt, Human
auauauacauaaca

SEQ ID NO: 3511794 - RNA, 13 nt, Human
auauauacauaug

SEQ ID NO: 3511795 - RNA, 15 nt, Human
auauauaccccccca

SEQ ID NO: 3511796 - RNA, 19 nt, Human
auauauacccccccaugca

SEQ ID NO: 3511797 - RNA, 22 nt, Human
auauauacgaacaaaacacacg

SEQ ID NO: 3511798 - RNA, 15 nt, Human
auauauacuuguggu

SEQ ID NO: 3511799 - RNA, 19 nt, Human
auauauagacagcuuugac

SEQ ID NO: 3511800 - RNA, 14 nt, Human
auauauagugcuau

SEQ ID NO: 3511801 - RNA, 13 nt, Human
auauauauaaaua

SEQ ID NO: 3511802 - RNA, 15 nt, Human
auauauauaaauaua

SEQ ID NO: 3511803 - RNA, 16 nt, Human
auauauauaacauaua

SEQ ID NO: 3511804 - RNA, 15 nt, Human
auauauauaauauau

SEQ ID NO: 3511805 - RNA, 15 nt, Human
auauauauacacaca

SEQ ID NO: 3511806 - RNA, 13 nt, Human
auauauauacaua

SEQ ID NO: 3511807 - RNA, 15 nt, Human
auauauauauauaac

SEQ ID NO: 3511808 - RNA, 21 nt, Human
auauauaucugcuguccagac

SEQ ID NO: 3511809 - RNA, 14 nt, Human
auauauaugaauaa

SEQ ID NO: 3511810 - RNA, 19 nt, Human
auauauaugccuuuuuccu

SEQ ID NO: 3511811 - RNA, 16 nt, Human
auauauauguacaguu

SEQ ID NO: 3511812 - RNA, 20 nt, Human
auauauauguacaguuaucu

SEQ ID NO: 3511813 - RNA, 20 nt, Human
auauauauguguguguaugu

SEQ ID NO: 3511814 - RNA, 13 nt, Human
auauaucauauug

SEQ ID NO: 3511815 - RNA, 20 nt, Human
auauaucauauugguauuca

SEQ ID NO: 3511816 - RNA, 17 nt, Human
auauaucccugauaaau

SEQ ID NO: 3511817 - RNA, 12 nt, Human
auauauccucug

SEQ ID NO: 3511818 - RNA, 18 nt, Human
auauaucuaaauugaaua

SEQ ID NO: 3511819 - RNA, 24 nt, Human
auauaucuaccccagacuagaugu

SEQ ID NO: 3511820 - RNA, 19 nt, Human
auauaucuaucuauuugag

SEQ ID NO: 3511821 - RNA, 15 nt, Human
auauaucuaucuuau

SEQ ID NO: 3511822 - RNA, 15 nt, Human
auauaucugcuucag

SEQ ID NO: 3511823 - RNA, 19 nt, Human
auauaucuuauaaagugga

SEQ ID NO: 3511824 - RNA, 13 nt, Human
auauaugaaaacu

SEQ ID NO: 3511825 - RNA, 13 nt, Human
auauaugaggacu

SEQ ID NO: 3511826 - RNA, 15 nt, Human
auauaugcacuaugu

SEQ ID NO: 3511827 - RNA, 20 nt, Human
auauaugcauauauauaugu

SEQ ID NO: 3511828 - RNA, 17 nt, Human
aggagguggcagcccug

SEQ ID NO: 3511829 - RNA, 23 nt, Human
aggagguggcagcccuguaggga

SEQ ID NO: 3511830 - RNA, 19 nt, Human
aggaggugucucaggcugc

SEQ ID NO: 3511831 - RNA, 22 nt, Human
aggaggugucucaggcugccug

SEQ ID NO: 3511832 - RNA, 20 nt, Human
aggaggugugaggaggaggc

SEQ ID NO: 3511833 - RNA, 18 nt, Human
aggagguuuaggucaaga

SEQ ID NO: 3511834 - RNA, 13 nt, Human
aggaguaaaagag

SEQ ID NO: 3511835 - RNA, 20 nt, Human
aggaguaaucuguguacaaa

SEQ ID NO: 3511836 - RNA, 16 nt, Human
aggagucacugagacc

SEQ ID NO: 3511837 - RNA, 14 nt, Human
aggagucccaagga

SEQ ID NO: 3511838 - RNA, 16 nt, Human
aggagucccaaggaaa

SEQ ID NO: 3511839 - RNA, 21 nt, Human
aggagucccacuccaagccag

SEQ ID NO: 3511840 - RNA, 23 nt, Human
aggagucccacuccaagccagca

SEQ ID NO: 3511841 - RNA, 12 nt, Human
aggagucccugg

SEQ ID NO: 3511842 - RNA, 13 nt, Human
aggagucugaggu

SEQ ID NO: 3511843 - RNA, 17 nt, Human
aggagucugagguccug

SEQ ID NO: 3511844 - RNA, 21 nt, Human
aggagucugagguccugagca

SEQ ID NO: 3511845 - RNA, 12 nt, Human
aggagugagcac

SEQ ID NO: 3511846 - RNA, 14 nt, Human
aggagugagcacua

SEQ ID NO: 3511847 - RNA, 12 nt, Human
aggagugaggaa

SEQ ID NO: 3511848 - RNA, 17 nt, Human
aggaguggugauuugaa

SEQ ID NO: 3511849 - RNA, 19 nt, Human
aggagugguuuuucuuuuc

SEQ ID NO: 3511850 - RNA, 18 nt, Human
aggagugugugauuuuuu

SEQ ID NO: 3511851 - RNA, 17 nt, Human
aggaguuaagaguagca

SEQ ID NO: 3511852 - RNA, 17 nt, Human
aggaguucaaugaucua

SEQ ID NO: 3511853 - RNA, 19 nt, Human
aggaguuccacagauuguu

SEQ ID NO: 3511854 - RNA, 21 nt, Human
aggaguucgagaccagccugg

SEQ ID NO: 3511855 - RNA, 22 nt, Human
aggaguucgagaccagccuggc

SEQ ID NO: 3511856 - RNA, 16 nt, Human
aggaguucgaggcugc

SEQ ID NO: 3511857 - RNA, 19 nt, Human
aggaguuuaagaccagccu

SEQ ID NO: 3511858 - RNA, 20 nt, Human
aggaguuugaggcugcagcg

SEQ ID NO: 3511859 - RNA, 12 nt, Human
aggaguuuggcc

SEQ ID NO: 3511860 - RNA, 13 nt, Human
aggaguuuggcca

SEQ ID NO: 3511861 - RNA, 14 nt, Human
aggaguuuggccag

SEQ ID NO: 3511862 - RNA, 15 nt, Human
aggaguuuggccaga

SEQ ID NO: 3511863 - RNA, 17 nt, Human
aggaguuuggccagaag

SEQ ID NO: 3511864 - RNA, 19 nt, Human
aggauaaaaagccagggcu

SEQ ID NO: 3511865 - RNA, 20 nt, Human
aggauaaaaagccagggcug

SEQ ID NO: 3511866 - RNA, 22 nt, Human
aggauaaaaagccagggcugga

SEQ ID NO: 3511867 - RNA, 18 nt, Human
aggauaaacuuuuagaaa

SEQ ID NO: 3511868 - RNA, 18 nt, Human
aggauaacacaaguaaaa

SEQ ID NO: 3511869 - RNA, 13 nt, Human
aggauaagugaaa

SEQ ID NO: 3511870 - RNA, 16 nt, Human
aggauaccuucuuauu

SEQ ID NO: 3511871 - RNA, 18 nt, Human
aggauacuauauuuuagg

SEQ ID NO: 3511872 - RNA, 13 nt, Human
aggauacuuauuu

SEQ ID NO: 3511873 - RNA, 20 nt, Human
aggauagauaacucuuugga

SEQ ID NO: 3511874 - RNA, 18 nt, Human
aggauagaugcuggccca

SEQ ID NO: 3511875 - RNA, 22 nt, Human
aggauagaugcuggcccagggc

SEQ ID NO: 3511876 - RNA, 14 nt, Human
aggauagcauuuuu

SEQ ID NO: 3511877 - RNA, 23 nt, Human
aggauagcuaacuguaaaucaug

SEQ ID NO: 3511878 - RNA, 16 nt, Human
aggauaguauuuuuau

SEQ ID NO: 3511879 - RNA, 13 nt, Human
aggauauauuuua

SEQ ID NO: 3511880 - RNA, 20 nt, Human
aucaccgugggcucccugac

SEQ ID NO: 3511881 - RNA, 22 nt, Human
aucaccgugggcucccugacug

SEQ ID NO: 3511882 - RNA, 21 nt, Human
aucaccuagcugaauguuuuu

SEQ ID NO: 3511883 - RNA, 14 nt, Human
aucaccuauuucca

SEQ ID NO: 3511884 - RNA, 22 nt, Human
aucaccuauuuccauucaacaa

SEQ ID NO: 3511885 - RNA, 12 nt, Human
aucaccuccccu

SEQ ID NO: 3511886 - RNA, 23 nt, Human
aucaccugucuugccuuuuucau

SEQ ID NO: 3511887 - RNA, 20 nt, Human
aucacgaggucaggaguuca

SEQ ID NO: 3511888 - RNA, 15 nt, Human
aucacgauguaaauu

SEQ ID NO: 3511889 - RNA, 19 nt, Human
aucacgauguaaauuauua

SEQ ID NO: 3511890 - RNA, 12 nt, Human
aucacgcucccc

SEQ ID NO: 3511891 - RNA, 13 nt, Human
aucacgcuccccg

SEQ ID NO: 3511892 - RNA, 15 nt, Human
aucacgcuccccgcc

SEQ ID NO: 3511893 - RNA, 15 nt, Human
aucacggcucacugc

SEQ ID NO: 3511894 - RNA, 18 nt, Human
aucacggcucacugcagc

SEQ ID NO: 3511895 - RNA, 22 nt, Human
aucacuagcccuccuuuuucca

SEQ ID NO: 3511896 - RNA, 13 nt, Human
aucacucauuaau

SEQ ID NO: 3511897 - RNA, 21 nt, Human
aucacucucagugcuucuuac

SEQ ID NO: 3511898 - RNA, 13 nt, Human
aucacucuguccu

SEQ ID NO: 3511899 - RNA, 20 nt, Human
aucacucugugucugagugg

SEQ ID NO: 3511900 - RNA, 21 nt, Human
aucacucugugucugaguggc

SEQ ID NO: 3511901 - RNA, 19 nt, Human
aucacucuguucauuccuc

SEQ ID NO: 3511902 - RNA, 22 nt, Human
aucacucuguucauuccuccag

SEQ ID NO: 3511903 - RNA, 23 nt, Human
aucacucuguucauuccuccagg

SEQ ID NO: 3511904 - RNA, 17 nt, Human
aucacucuuguggaugu

SEQ ID NO: 3511905 - RNA, 14 nt, Human
aucacugaacuuug

SEQ ID NO: 3511906 - RNA, 15 nt, Human
aucacugaauuuaua

SEQ ID NO: 3511907 - RNA, 23 nt, Human
aucacugccagagauaaacuaau

SEQ ID NO: 3511908 - RNA, 16 nt, Human
aucacugcucacacug

SEQ ID NO: 3511909 - RNA, 13 nt, Human
aucacuggagccc

SEQ ID NO: 3511910 - RNA, 16 nt, Human
aucacuggagcccagg

SEQ ID NO: 3511911 - RNA, 15 nt, Human
aucacuguccuccac

SEQ ID NO: 3511912 - RNA, 14 nt, Human
aucacugucuuucc

SEQ ID NO: 3511913 - RNA, 18 nt, Human
aucacugucuuuccuaga

SEQ ID NO: 3511914 - RNA, 21 nt, Human
aucacugucuuuccuagaugg

SEQ ID NO: 3511915 - RNA, 15 nt, Human
aucacuguggcuguc

SEQ ID NO: 3511916 - RNA, 17 nt, Human
aucacuguggcugucug

SEQ ID NO: 3511917 - RNA, 20 nt, Human
aucacuguguauauuugauu

SEQ ID NO: 3511918 - RNA, 18 nt, Human
aucacuguuuagaacaca

SEQ ID NO: 3511919 - RNA, 14 nt, Human
aucacuguuuagau

SEQ ID NO: 3511920 - RNA, 22 nt, Human
aucacuguuuagauuugccaua

SEQ ID NO: 3511921 - RNA, 15 nt, Human
aucacuguuuuuaga

SEQ ID NO: 3511922 - RNA, 13 nt, Human
aucacuuaaaaca

SEQ ID NO: 3511923 - RNA, 15 nt, Human
aucacuuaaaacacg

SEQ ID NO: 3511924 - RNA, 14 nt, Human
aucacuuaaacuug

SEQ ID NO: 3511925 - RNA, 15 nt, Human
aucacuuaacauucc

SEQ ID NO: 3511926 - RNA, 23 nt, Human
aucacuuaacauuccuaaaaugc

SEQ ID NO: 3511927 - RNA, 23 nt, Human
aucacuuaacggaccaaagcaag

SEQ ID NO: 3511928 - RNA, 23 nt, Human
aucacuugaacccgggaggcaga

SEQ ID NO: 3511929 - RNA, 14 nt, Human
aucacuuguacaaa

SEQ ID NO: 3511930 - RNA, 16 nt, Human
aucacuuguacaaaau

SEQ ID NO: 3511931 - RNA, 13 nt, Human
aucacuuguuguu

SEQ ID NO: 3511932 - RNA, 12 nt, Human
aucacuuucaua

SEQ ID NO: 3511933 - RNA, 21 nt, Human
aucacuuugucuaacucagaa

SEQ ID NO: 3511934 - RNA, 13 nt, Human
aucacuuuucagu

SEQ ID NO: 3511935 - RNA, 14 nt, Human
aucacuuuucagug

SEQ ID NO: 3511936 - RNA, 18 nt, Human
aucacuuuuugaacuaag

SEQ ID NO: 3511937 - RNA, 13 nt, Human
aucagaaaaggga

SEQ ID NO: 3511938 - RNA, 15 nt, Human
aucagaaagggaggg

SEQ ID NO: 3511939 - RNA, 20 nt, Human
aucagaaagggagggcucug

SEQ ID NO: 3511940 - RNA, 16 nt, Human
aucagaaauaauaaaa

SEQ ID NO: 3511941 - RNA, 15 nt, Human
aucagaaauacagau

SEQ ID NO: 3511942 - RNA, 19 nt, Human
aucagaaauacagauuuug

SEQ ID NO: 3511943 - RNA, 23 nt, Human
aucagaaaugucuggagaauaau

SEQ ID NO: 3511944 - RNA, 13 nt, Human
aucagaacagcag

SEQ ID NO: 3511945 - RNA, 12 nt, Human
aucagaacagga

SEQ ID NO: 3511946 - RNA, 22 nt, Human
aucagaacucaaauggggccag

SEQ ID NO: 3511947 - RNA, 14 nt, Human
aucagaagauaacu

SEQ ID NO: 3511948 - RNA, 18 nt, Human
aucagaagccuauuguaa

SEQ ID NO: 3511949 - RNA, 19 nt, Human
aucagaagucaucuugcua

SEQ ID NO: 3511950 - RNA, 19 nt, Human
aucagaauaucacagaaaa

SEQ ID NO: 3511951 - RNA, 18 nt, Human
aucagaauggaagagaga

SEQ ID NO: 3511952 - RNA, 18 nt, Human
aucagaauugaaacacuu

SEQ ID NO: 3511953 - RNA, 19 nt, Human
aucagacacucuggcuggu

SEQ ID NO: 3511954 - RNA, 16 nt, Human
aucagaccauaauguu

SEQ ID NO: 3511955 - RNA, 20 nt, Human
aucagacuaagccagcaccg

SEQ ID NO: 3511956 - RNA, 22 nt, Human
aucagagacaaaauauuuccca

SEQ ID NO: 3511957 - RNA, 13 nt, Human
aucagagaccagg

SEQ ID NO: 3511958 - RNA, 19 nt, Human
aucagagaccaggcccugg

SEQ ID NO: 3511959 - RNA, 14 nt, Human
aucagagcaggacc

SEQ ID NO: 3511960 - RNA, 23 nt, Human
aucagagccuuuccucaaaacug

SEQ ID NO: 3511961 - RNA, 20 nt, Human
aucagagcuccucuguccug

SEQ ID NO: 3511962 - RNA, 14 nt, Human
aucagaggacaccu

SEQ ID NO: 3511963 - RNA, 17 nt, Human
aucagaggccuauaaug

SEQ ID NO: 3511964 - RNA, 20 nt, Human
aucagaguagaaauaaaagu

SEQ ID NO: 3511965 - RNA, 21 nt, Human
aucagaguagaaauaaaagug

SEQ ID NO: 3511966 - RNA, 19 nt, Human
aucagauaagacauaucuc

SEQ ID NO: 3511967 - RNA, 12 nt, Human
aucagauacauc

SEQ ID NO: 3511968 - RNA, 16 nt, Human
aucagauacaucacug

SEQ ID NO: 3511969 - RNA, 17 nt, Human
aucagauacaucacugc

SEQ ID NO: 3511970 - RNA, 15 nt, Human
aucagauagcaucuu

SEQ ID NO: 3511971 - RNA, 22 nt, Human
aucagaucauuucaaaacucau

SEQ ID NO: 3511972 - RNA, 12 nt, Human
aucagaugacaa

SEQ ID NO: 3511973 - RNA, 15 nt, Human
aucuaucuauuugag

SEQ ID NO: 3511974 - RNA, 19 nt, Human
aucuaucugcuuaugcagu

SEQ ID NO: 3511975 - RNA, 16 nt, Human
aucuaucuggugauuu

SEQ ID NO: 3511976 - RNA, 20 nt, Human
aucuaucuggugauuucuag

SEQ ID NO: 3511977 - RNA, 13 nt, Human
aucuaucuuccaa

SEQ ID NO: 3511978 - RNA, 18 nt, Human
aucuaugaaguauauaau

SEQ ID NO: 3511979 - RNA, 13 nt, Human
aucuaugaggaaa

SEQ ID NO: 3511980 - RNA, 15 nt, Human
aucuaugauauaacc

SEQ ID NO: 3511981 - RNA, 12 nt, Human
aucuauuaauau

SEQ ID NO: 3511982 - RNA, 21 nt, Human
aucuauucagacaagcaacag

SEQ ID NO: 3511983 - RNA, 23 nt, Human
aucuauugcuggcaaagacagaa

SEQ ID NO: 3511984 - RNA, 14 nt, Human
aucuauuguaagau

SEQ ID NO: 3511985 - RNA, 20 nt, Human
aucuauuguaagauaaaaaa

SEQ ID NO: 3511986 - RNA, 16 nt, Human
aucuauuuaucuucau

SEQ ID NO: 3511987 - RNA, 13 nt, Human
aucuauuuauuaa

SEQ ID NO: 3511988 - RNA, 16 nt, Human
aucuauuuauuaaguu

SEQ ID NO: 3511989 - RNA, 17 nt, Human
aucuauuucacuuauuu

SEQ ID NO: 3511990 - RNA, 16 nt, Human
aucuauuugugugugu

SEQ ID NO: 3511991 - RNA, 13 nt, Human
aucuauuuucuau

SEQ ID NO: 3511992 - RNA, 22 nt, Human
aucuauuuucuauguacuagua

SEQ ID NO: 3511993 - RNA, 12 nt, Human
aucuauuuugau

SEQ ID NO: 3511994 - RNA, 20 nt, Human
aucuauuuugaugcagcauu

SEQ ID NO: 3511995 - RNA, 22 nt, Human
aucuauuuuggauuguauauug

SEQ ID NO: 3511996 - RNA, 12 nt, Human
aucucaaaauua

SEQ ID NO: 3511997 - RNA, 21 nt, Human
aucucaaauaacuaaaaggua

SEQ ID NO: 3511998 - RNA, 23 nt, Human
aucucaaauaggcuauuaaaaaa

SEQ ID NO: 3511999 - RNA, 14 nt, Human
aucucaaauuucua

SEQ ID NO: 3512000 - RNA, 19 nt, Human
aucucaacaggccucaggg

SEQ ID NO: 3512001 - RNA, 14 nt, Human
aucucaacaugucu

SEQ ID NO: 3512002 - RNA, 23 nt, Human
aucucaagaugggggcagggcug

SEQ ID NO: 3512003 - RNA, 16 nt, Human
aucucacacaugagca

SEQ ID NO: 3512004 - RNA, 20 nt, Human
aucucacacucaugcauugu

SEQ ID NO: 3512005 - RNA, 22 nt, Human
aucucacacucaugcauugucc

SEQ ID NO: 3512006 - RNA, 20 nt, Human
aucucacagcacacucagca

SEQ ID NO: 3512007 - RNA, 15 nt, Human
aucucacagcuaugc

SEQ ID NO: 3512008 - RNA, 18 nt, Human
aucucaccaggcagccuc

SEQ ID NO: 3512009 - RNA, 23 nt, Human
aucucaccccaucccacacccug

SEQ ID NO: 3512010 - RNA, 14 nt, Human
aucucacucugccc

SEQ ID NO: 3512011 - RNA, 16 nt, Human
aucucacucugccccc

SEQ ID NO: 3512012 - RNA, 22 nt, Human
aucucacuugugccaacacuca

SEQ ID NO: 3512013 - RNA, 17 nt, Human
aucucagaaagugccug

SEQ ID NO: 3512014 - RNA, 15 nt, Human
aucucagauauuugc

SEQ ID NO: 3512015 - RNA, 16 nt, Human
aucucagauauuugca

SEQ ID NO: 3512016 - RNA, 23 nt, Human
aucucagauguuaaaauaaaugg

SEQ ID NO: 3512017 - RNA, 15 nt, Human
aucucagcucacuac

SEQ ID NO: 3512018 - RNA, 14 nt, Human
aucucagcucacug

SEQ ID NO: 3512019 - RNA, 12 nt, Human
aucucagcucau

SEQ ID NO: 3512020 - RNA, 22 nt, Human
aucucagcuuugagaagccuuc

SEQ ID NO: 3512021 - RNA, 14 nt, Human
aucucagggccugg

SEQ ID NO: 3512022 - RNA, 15 nt, Human
aucucaggggccaga

SEQ ID NO: 3512023 - RNA, 16 nt, Human
aucucaggggccagag

SEQ ID NO: 3512024 - RNA, 23 nt, Human
aucucaggggccagaggaacugu

SEQ ID NO: 3512025 - RNA, 21 nt, Human
aucucagguuaagugugagua

SEQ ID NO: 3512026 - RNA, 18 nt, Human
aucucaguaugaauuauu

SEQ ID NO: 3512027 - RNA, 15 nt, Human
aucucagucaugcau

SEQ ID NO: 3512028 - RNA, 20 nt, Human
aucucagucaugcauaaaua

SEQ ID NO: 3512029 - RNA, 21 nt, Human
aucucagucaugcauaaauau

SEQ ID NO: 3512030 - RNA, 17 nt, Human
aucucauaauuuauaca

SEQ ID NO: 3512031 - RNA, 18 nt, Human
aucucauaauuuauacag

SEQ ID NO: 3512032 - RNA, 21 nt, Human
aucucaugccccuggcuggga

SEQ ID NO: 3512033 - RNA, 17 nt, Human
aucucauuuaagggaaa

SEQ ID NO: 3512034 - RNA, 14 nt, Human
aucucauuuccaag

SEQ ID NO: 3512035 - RNA, 13 nt, Human
aucucauuugguu

SEQ ID NO: 3512036 - RNA, 23 nt, Human
aucucauuuuuccguaaaaauga

SEQ ID NO: 3512037 - RNA, 14 nt, Human
aucuccaaaauaaa

SEQ ID NO: 3512038 - RNA, 17 nt, Human
aucuccaaaauaaaacu

SEQ ID NO: 3512039 - RNA, 13 nt, Human
aucuccaaagcuu

SEQ ID NO: 3512040 - RNA, 22 nt, Human
aucuccaaagcuuuccuggaga

SEQ ID NO: 3512041 - RNA, 13 nt, Human
aucuccaagaaug

SEQ ID NO: 3512042 - RNA, 15 nt, Human
aucuccaagaaugcu

SEQ ID NO: 3512043 - RNA, 18 nt, Human
aucuccaagaccagagau

SEQ ID NO: 3512044 - RNA, 12 nt, Human
aucuccaaggac

SEQ ID NO: 3512045 - RNA, 19 nt, Human
aucuccacaaccucuuccc

SEQ ID NO: 3512046 - RNA, 19 nt, Human
aucuccacagucaaagaag

SEQ ID NO: 3512047 - RNA, 22 nt, Human
aucuccaccagucauuuuucag

SEQ ID NO: 3512048 - RNA, 19 nt, Human
aucuccacccccagcugcu

SEQ ID NO: 3512049 - RNA, 13 nt, Human
aucuccaccugcu

SEQ ID NO: 3512050 - RNA, 19 nt, Human
aucuccaccugcucccagg

SEQ ID NO: 3512051 - RNA, 21 nt, Human
aucuccagggaguccccuccc

SEQ ID NO: 3512052 - RNA, 15 nt, Human
aucuccaguauucuu

SEQ ID NO: 3512053 - RNA, 18 nt, Human
aucuccaguauucuuguc

SEQ ID NO: 3512054 - RNA, 13 nt, Human
aucucccacaugc

SEQ ID NO: 3512055 - RNA, 18 nt, Human
aucucccauuuuggaauu

SEQ ID NO: 3512056 - RNA, 13 nt, Human
aucuccccacucu

SEQ ID NO: 3512057 - RNA, 14 nt, Human
aucucccccagccc

SEQ ID NO: 3512058 - RNA, 16 nt, Human
aucucccccagcccca

SEQ ID NO: 3512059 - RNA, 17 nt, Human
aucucccccagccccau

SEQ ID NO: 3512060 - RNA, 20 nt, Human
aucuccccucagcucggcuc

SEQ ID NO: 3512061 - RNA, 21 nt, Human
aucucccucacugaaaccagg

SEQ ID NO: 3512062 - RNA, 23 nt, Human
aucucccucgaacccacacugca

SEQ ID NO: 3512063 - RNA, 15 nt, Human
aucucccugccgccu

SEQ ID NO: 3512064 - RNA, 13 nt, Human
aucucccugccuc

SEQ ID NO: 3512065 - RNA, 14 nt, Human
aucucccugccugg

SEQ ID NO: 3512066 - RNA, 14 nt, Human
aucucccugcuuug

SEQ ID NO: 3512067 - RNA, 15 nt, Human
aucucccuggugcuu

SEQ ID NO: 3512068 - RNA, 21 nt, Human
aucucccuuuuccaugacugu

SEQ ID NO: 3512069 - RNA, 16 nt, Human
aucuccggcucccagc

SEQ ID NO: 3512070 - RNA, 18 nt, Human
aucuccggcucccagccu

SEQ ID NO: 3512071 - RNA, 19 nt, Human
aucuccggcucccagccuc

SEQ ID NO: 3512072 - RNA, 21 nt, Human
aucuccggcucccagccucag

SEQ ID NO: 3512073 - RNA, 15 nt, Human
aucuccguggcuuug

SEQ ID NO: 3512074 - RNA, 21 nt, Human
aucuccuauaaucugucaaaa

SEQ ID NO: 3512075 - RNA, 14 nt, Human
aucuccuauuuuuu

SEQ ID NO: 3512076 - RNA, 15 nt, Human
aucuccugacagaag

SEQ ID NO: 3512077 - RNA, 21 nt, Human
aucuccuguccaucagccagg

SEQ ID NO: 3512078 - RNA, 19 nt, Human
aucuccugugcauggguga

SEQ ID NO: 3512079 - RNA, 15 nt, Human
aucucggcucacugc

SEQ ID NO: 3512080 - RNA, 15 nt, Human
aucucguuucaaaaa

SEQ ID NO: 3512081 - RNA, 23 nt, Human
aucucguuuuucuucuuaagacu

SEQ ID NO: 3512082 - RNA, 15 nt, Human
aucucuaaagagcau

SEQ ID NO: 3512083 - RNA, 20 nt, Human
aucucuaccuucuccccagc

SEQ ID NO: 3512084 - RNA, 22 nt, Human
aucucuaccuucuccccagcuc

SEQ ID NO: 3512085 - RNA, 21 nt, Human
aucucuagaauuuuaagugcu

SEQ ID NO: 3512086 - RNA, 18 nt, Human
aucucuauuuaauauuua

SEQ ID NO: 3512087 - RNA, 17 nt, Human
aucucucaaaucuguua

SEQ ID NO: 3512088 - RNA, 19 nt, Human
aucucucaaaucuguuauc

SEQ ID NO: 3512089 - RNA, 20 nt, Human
aggcaugagggaucacaggg

SEQ ID NO: 3512090 - RNA, 20 nt, Human
aggcaugaguuacugugcau

SEQ ID NO: 3512091 - RNA, 14 nt, Human
aggcaugccucuga

SEQ ID NO: 3512092 - RNA, 17 nt, Human
aggcaugccucugauau

SEQ ID NO: 3512093 - RNA, 18 nt, Human
aggcaugccucugauaug

SEQ ID NO: 3512094 - RNA, 14 nt, Human
aggcaugccugugu

SEQ ID NO: 3512095 - RNA, 16 nt, Human
aggcaugccuguguga

SEQ ID NO: 3512096 - RNA, 16 nt, Human
aggcauggcccugggg

SEQ ID NO: 3512097 - RNA, 15 nt, Human
aggcaugggccacca

SEQ ID NO: 3512098 - RNA, 19 nt, Human
aggcauguaggacccugca

SEQ ID NO: 3512099 - RNA, 14 nt, Human
aggcauguccugga

SEQ ID NO: 3512100 - RNA, 17 nt, Human
aggcaugugaugagagg

SEQ ID NO: 3512101 - RNA, 23 nt, Human
aggcaugugaugagaggaaauca

SEQ ID NO: 3512102 - RNA, 18 nt, Human
aggcaugugccacccacc

SEQ ID NO: 3512103 - RNA, 17 nt, Human
aggcaugugugaaacau

SEQ ID NO: 3512104 - RNA, 14 nt, Human
aggcauuaaauuuu

SEQ ID NO: 3512105 - RNA, 19 nt, Human
aggcauuaacacaaaggag

SEQ ID NO: 3512106 - RNA, 21 nt, Human
aggcauuaauguuucuaucug

SEQ ID NO: 3512107 - RNA, 19 nt, Human
aggcauuccccaggaggcc

SEQ ID NO: 3512108 - RNA, 20 nt, Human
aggcauuccccaggaggcca

SEQ ID NO: 3512109 - RNA, 23 nt, Human
aggcauuccccaggaggccagcc

SEQ ID NO: 3512110 - RNA, 13 nt, Human
aggcauucucuga

SEQ ID NO: 3512111 - RNA, 16 nt, Human
aggcauucuggaccuc

SEQ ID NO: 3512112 - RNA, 20 nt, Human
aggcauucuggaccucuggg

SEQ ID NO: 3512113 - RNA, 18 nt, Human
aggcauugcacagggaga

SEQ ID NO: 3512114 - RNA, 18 nt, Human
aggcauugccaagggcuu

SEQ ID NO: 3512115 - RNA, 13 nt, Human
aggcauuggauau

SEQ ID NO: 3512116 - RNA, 14 nt, Human
aggcauuggauauu

SEQ ID NO: 3512117 - RNA, 18 nt, Human
aggcauuucccacccuga

SEQ ID NO: 3512118 - RNA, 19 nt, Human
aucaucuaauucucugugg

SEQ ID NO: 3512119 - RNA, 18 nt, Human
aucaucuauaaagaagaa

SEQ ID NO: 3512120 - RNA, 15 nt, Human
aucaucuauuuugau

SEQ ID NO: 3512121 - RNA, 16 nt, Human
aucaucuauuuugaug

SEQ ID NO: 3512122 - RNA, 14 nt, Human
aucaucucagcuca

SEQ ID NO: 3512123 - RNA, 18 nt, Human
aucaucugugugaaaaug

SEQ ID NO: 3512124 - RNA, 14 nt, Human
aucaucuuauucag

SEQ ID NO: 3512125 - RNA, 15 nt, Human
aucaucuugaacauu

SEQ ID NO: 3512126 - RNA, 18 nt, Human
aucaucuuggaacugcau

SEQ ID NO: 3512127 - RNA, 15 nt, Human
aucaugaaauaugca

SEQ ID NO: 3512128 - RNA, 16 nt, Human
aucaugaaauaugcau

SEQ ID NO: 3512129 - RNA, 18 nt, Human
aucaugaaauaugcaucu

SEQ ID NO: 3512130 - RNA, 16 nt, Human
aucaugaaauuacuua

SEQ ID NO: 3512131 - RNA, 13 nt, Human
aucaugaagccug

SEQ ID NO: 3512132 - RNA, 15 nt, Human
aucaugaauaacuga

SEQ ID NO: 3512133 - RNA, 18 nt, Human
aucaugaaugcuuuuagu

SEQ ID NO: 3512134 - RNA, 21 nt, Human
aucaugaauuaguuuuauaug

SEQ ID NO: 3512135 - RNA, 13 nt, Human
aucaugaauuuua

SEQ ID NO: 3512136 - RNA, 14 nt, Human
aucaugaauuuuaa

SEQ ID NO: 3512137 - RNA, 17 nt, Human
aucaugaauuuuaaagu

SEQ ID NO: 3512138 - RNA, 18 nt, Human
aucaugaauuuuaaagua

SEQ ID NO: 3512139 - RNA, 20 nt, Human
aucaugacaaagacugagua

SEQ ID NO: 3512140 - RNA, 20 nt, Human
aucaugacacucguauaagc

SEQ ID NO: 3512141 - RNA, 15 nt, Human
aucaugagauugaug

SEQ ID NO: 3512142 - RNA, 17 nt, Human
aucaugagauugaugca

SEQ ID NO: 3512143 - RNA, 16 nt, Human
aucaugagccugcugg

SEQ ID NO: 3512144 - RNA, 17 nt, Human
aucaugagccugcugga

SEQ ID NO: 3512145 - RNA, 21 nt, Human
aucaugcauguccuguaaagg

SEQ ID NO: 3512146 - RNA, 12 nt, Human
aucaugcauugu

SEQ ID NO: 3512147 - RNA, 13 nt, Human
aucaugcauuguu

SEQ ID NO: 3512148 - RNA, 21 nt, Human
aucaugcauuguugagguggu

SEQ ID NO: 3512149 - RNA, 19 nt, Human
aucaugcccggucccaccc

SEQ ID NO: 3512150 - RNA, 23 nt, Human
aucaugcccggucccaccccucc

SEQ ID NO: 3512151 - RNA, 14 nt, Human
aucaugccucugag

SEQ ID NO: 3512152 - RNA, 14 nt, Human
aucaugcuuuaaag

SEQ ID NO: 3512153 - RNA, 22 nt, Human
aucaugcuuuaaaguguaauaa

SEQ ID NO: 3512154 - RNA, 17 nt, Human
aucauggccagcuggag

SEQ ID NO: 3512155 - RNA, 19 nt, Human
aucauggcuaagcuuaaaa

SEQ ID NO: 3512156 - RNA, 15 nt, Human
aucauggcuaucugu

SEQ ID NO: 3512157 - RNA, 24 nt, Human
aucauggggggagcacccugaggg

SEQ ID NO: 3512158 - RNA, 14 nt, Human
aucaugguguaaua

SEQ ID NO: 3512159 - RNA, 19 nt, Human
aucaugguguaauaagaca

SEQ ID NO: 3512160 - RNA, 20 nt, Human
aucaugguguaauaagacau

SEQ ID NO: 3512161 - RNA, 21 nt, Human
aucaugguguaauaagacaua

SEQ ID NO: 3512162 - RNA, 11 nt, Human
aucauguaaag

SEQ ID NO: 3512163 - RNA, 17 nt, Human
aucauguaaagaaaugu

SEQ ID NO: 3512164 - RNA, 14 nt, Human
aucauguacauuuc

SEQ ID NO: 3512165 - RNA, 18 nt, Human
aucauguaguaucaaaua

SEQ ID NO: 3512166 - RNA, 19 nt, Human
aucauguaguaucaaauau

SEQ ID NO: 3512167 - RNA, 12 nt, Human
aucaugucccca

SEQ ID NO: 3512168 - RNA, 21 nt, Human
aucauguguaaucaauaaacg

SEQ ID NO: 3512169 - RNA, 18 nt, Human
aucauguuaauccuagcu

SEQ ID NO: 3512170 - RNA, 19 nt, Human
aucauguuaguaauaccuc

SEQ ID NO: 3512171 - RNA, 15 nt, Human
aucauguuaugauaa

SEQ ID NO: 3512172 - RNA, 18 nt, Human
aucauguuaugauaaaaa

SEQ ID NO: 3512173 - RNA, 22 nt, Human
aucauguuaugauaaaaaauuu

SEQ ID NO: 3512174 - RNA, 14 nt, Human
aucauguuugcucu

SEQ ID NO: 3512175 - RNA, 15 nt, Human
aucauguuugcucuc

SEQ ID NO: 3512176 - RNA, 15 nt, Human
aucauuaaaguucua

SEQ ID NO: 3512177 - RNA, 17 nt, Human
aucauuaaauuuuuccu

SEQ ID NO: 3512178 - RNA, 23 nt, Human
aucauuaaauuuuuccuuagcau

SEQ ID NO: 3512179 - RNA, 17 nt, Human
aucauuacccuucccug

SEQ ID NO: 3512180 - RNA, 20 nt, Human
aucauuacccuucccugcac

SEQ ID NO: 3512181 - RNA, 19 nt, Human
aucauuagggggaacucua

SEQ ID NO: 3512182 - RNA, 23 nt, Human
aucauuauaaacgugaugaucag

SEQ ID NO: 3512183 - RNA, 20 nt, Human
aucauuauaacugaaggaga

SEQ ID NO: 3512184 - RNA, 22 nt, Human
aucauuauaacugaaggagaag

SEQ ID NO: 3512185 - RNA, 20 nt, Human
aucauuaucagccugugcca

SEQ ID NO: 3512186 - RNA, 14 nt, Human
aucauuauuuaugu

SEQ ID NO: 3512187 - RNA, 13 nt, Human
aucauucagaaau

SEQ ID NO: 3512188 - RNA, 16 nt, Human
aucauucagaaauguu

SEQ ID NO: 3512189 - RNA, 14 nt, Human
aucauucauuuucu

SEQ ID NO: 3512190 - RNA, 13 nt, Human
aucauucuaaaga

SEQ ID NO: 3512191 - RNA, 15 nt, Human
aucauucuaaagaua

SEQ ID NO: 3512192 - RNA, 17 nt, Human
aucauucuaaagauaga

SEQ ID NO: 3512193 - RNA, 24 nt, Human
aucauucucugucucauccaucau

SEQ ID NO: 3512194 - RNA, 14 nt, Human
aucauucuuacuaa

SEQ ID NO: 3512195 - RNA, 19 nt, Human
aucauucuuauuucaugaa

SEQ ID NO: 3512196 - RNA, 15 nt, Human
aucauugaaaucuuu

SEQ ID NO: 3512197 - RNA, 20 nt, Human
aucauugaaaucuuuuugcu

SEQ ID NO: 3512198 - RNA, 22 nt, Human
aucauugcacucuagccugggc

SEQ ID NO: 3512199 - RNA, 13 nt, Human
aucauugccuggu

SEQ ID NO: 3512200 - RNA, 16 nt, Human
aucauugcugucugca

SEQ ID NO: 3512201 - RNA, 19 nt, Human
aucauuggaacaacugaua

SEQ ID NO: 3512202 - RNA, 13 nt, Human
aucauuguaugug

SEQ ID NO: 3512203 - RNA, 19 nt, Human
aucauugugaaauuauuca

SEQ ID NO: 3512204 - RNA, 14 nt, Human
aucauuguugccuc

SEQ ID NO: 3512205 - RNA, 17 nt, Human
aucauuuaauaauauac

SEQ ID NO: 3512206 - RNA, 18 nt, Human
aucauuuaauaauauacu

SEQ ID NO: 3512207 - RNA, 21 nt, Human
aucauuuaauaauauacuugu

SEQ ID NO: 3512208 - RNA, 19 nt, Human
aucauuuacaagacaacau

SEQ ID NO: 3512209 - RNA, 13 nt, Human
aucauuucaagaa

SEQ ID NO: 3512210 - RNA, 16 nt, Human
aucauuucaggaguua

SEQ ID NO: 3512211 - RNA, 15 nt, Human
aucauuucuauuucu

SEQ ID NO: 3512212 - RNA, 15 nt, Human
aucauuucucacugu

SEQ ID NO: 3512213 - RNA, 20 nt, Human
aucauuucugcaucagcugc

SEQ ID NO: 3512214 - RNA, 14 nt, Human
aucauuugaguuca

SEQ ID NO: 3512215 - RNA, 12 nt, Human
aucauuuguuca

SEQ ID NO: 3512216 - RNA, 19 nt, Human
aucauuuguucaaagcugu

SEQ ID NO: 3512217 - RNA, 19 nt, Human
aucauuuguucugggagua

SEQ ID NO: 3512218 - RNA, 20 nt, Human
aucauuuuaccuuugacaaa

SEQ ID NO: 3512219 - RNA, 23 nt, Human
aucauuuuagaagacucuaccag

SEQ ID NO: 3512220 - RNA, 17 nt, Human
aucauuuuauaugucaa

SEQ ID NO: 3512221 - RNA, 14 nt, Human
aucauuuuauguca

SEQ ID NO: 3512222 - RNA, 11 nt, Human
aucauuuucau

SEQ ID NO: 3512223 - RNA, 15 nt, Human
aucauuuugaaauug

SEQ ID NO: 3512224 - RNA, 15 nt, Human
aucauuuugcauuca

SEQ ID NO: 3512225 - RNA, 14 nt, Human
aucauuuuguuuuc

SEQ ID NO: 3512226 - RNA, 23 nt, Human
aucauuuuuccuucccuucucca

SEQ ID NO: 3512227 - RNA, 15 nt, Human
aucauuuuuguacag

SEQ ID NO: 3512228 - RNA, 20 nt, Human
aucauuuuuguacaguuugc

SEQ ID NO: 3512229 - RNA, 16 nt, Human
aucauuuuuuauauau

SEQ ID NO: 3512230 - RNA, 18 nt, Human
aucauuuuuuauauauau

SEQ ID NO: 3512231 - RNA, 15 nt, Human
aucauuuuuuccugu

SEQ ID NO: 3512232 - RNA, 21 nt, Human
aucauuuuuuccuguuuggga

SEQ ID NO: 3512233 - RNA, 18 nt, Human
auccaaaagaagccccca

SEQ ID NO: 3512234 - RNA, 13 nt, Human
auccaaacaauuu

SEQ ID NO: 3512235 - RNA, 20 nt, Human
auccaaacuuggauuuuuga

SEQ ID NO: 3512236 - RNA, 15 nt, Human
auccaaccauuuuca

SEQ ID NO: 3512237 - RNA, 18 nt, Human
auccaacuaaugccuuac

SEQ ID NO: 3512238 - RNA, 20 nt, Human
auccaacuaaugccuuacuc

SEQ ID NO: 3512239 - RNA, 22 nt, Human
auccaagacagaauaaugaaug

SEQ ID NO: 3512240 - RNA, 14 nt, Human
auccaagccuccac

SEQ ID NO: 3512241 - RNA, 16 nt, Human
auccaagccuccacag

SEQ ID NO: 3512242 - RNA, 17 nt, Human
auccaagccuccacagc

SEQ ID NO: 3512243 - RNA, 21 nt, Human
auccaagccuccacagcgagg

SEQ ID NO: 3512244 - RNA, 15 nt, Human
auccaagcucccugc

SEQ ID NO: 3512245 - RNA, 19 nt, Human
auccaagcucccugcccca

SEQ ID NO: 3512246 - RNA, 21 nt, Human
auccaagcuggucccacucag

SEQ ID NO: 3512247 - RNA, 19 nt, Human
auccaaggagaaacagaga

SEQ ID NO: 3512248 - RNA, 22 nt, Human
auccaaggagaaacagagacag

SEQ ID NO: 3512249 - RNA, 21 nt, Human
auccaaggugggguggaagcu

SEQ ID NO: 3512250 - RNA, 15 nt, Human
auccaaguuaaaugu

SEQ ID NO: 3512251 - RNA, 16 nt, Human
auccaauaggaaugcu

SEQ ID NO: 3512252 - RNA, 22 nt, Human
auccaauauuuucuuuaaugcu

SEQ ID NO: 3512253 - RNA, 16 nt, Human
auccaaucagagacca

SEQ ID NO: 3512254 - RNA, 21 nt, Human
auccaauguuagagacuuuuu

SEQ ID NO: 3512255 - RNA, 20 nt, Human
auccaauuagcuuauguuaa

SEQ ID NO: 3512256 - RNA, 23 nt, Human
auccacacacagaggaagagcag

SEQ ID NO: 3512257 - RNA, 18 nt, Human
auccacaccaaagggaga

SEQ ID NO: 3512258 - RNA, 21 nt, Human
auccacagagagucccacugc

SEQ ID NO: 3512259 - RNA, 19 nt, Human
aucuggccuggccagugcc

SEQ ID NO: 3512260 - RNA, 21 nt, Human
aucuggccuggccagugcccu

SEQ ID NO: 3512261 - RNA, 17 nt, Human
aucuggccuggccuggc

SEQ ID NO: 3512262 - RNA, 11 nt, Human
aucuggccuua

SEQ ID NO: 3512263 - RNA, 18 nt, Human
aucucacauauacaagua

SEQ ID NO: 3512264 - RNA, 15 nt, Human
aucucaccaggcagc

SEQ ID NO: 3512265 - RNA, 22 nt, Human
aucucaccaggcagccucuggg

SEQ ID NO: 3512266 - RNA, 14 nt, Human
aucucaccccaucc

SEQ ID NO: 3512267 - RNA, 16 nt, Human
aucucaccuccugcug

SEQ ID NO: 3512268 - RNA, 21 nt, Human
aucucaccuccugcugggcag

SEQ ID NO: 3512269 - RNA, 13 nt, Human
aucucacuugugc

SEQ ID NO: 3512270 - RNA, 15 nt, Human
aucucacuuuucucc

SEQ ID NO: 3512271 - RNA, 19 nt, Human
aucucacuuuucuccauga

SEQ ID NO: 3512272 - RNA, 12 nt, Human
aucucagaaagu

SEQ ID NO: 3512273 - RNA, 14 nt, Human
aucucagauauuug

SEQ ID NO: 3512274 - RNA, 20 nt, Human
aucucagaucaguguaccau

SEQ ID NO: 3512275 - RNA, 19 nt, Human
aucucagauguuaaaauaa

SEQ ID NO: 3512276 - RNA, 21 nt, Human
aucucagauguuaaaauaaau

SEQ ID NO: 3512277 - RNA, 11 nt, Human
aucucagcuca

SEQ ID NO: 3512278 - RNA, 13 nt, Human
aucucagcuuuga

SEQ ID NO: 3512279 - RNA, 23 nt, Human
aucucagcuuugagaagccuuca

SEQ ID NO: 3512280 - RNA, 18 nt, Human
aucucaggagauuucaug

SEQ ID NO: 3512281 - RNA, 19 nt, Human
aucucaggccaccugcccc

SEQ ID NO: 3512282 - RNA, 19 nt, Human
aucucagggaagcccagcu

SEQ ID NO: 3512283 - RNA, 22 nt, Human
aucucagggaagcccagcucca

SEQ ID NO: 3512284 - RNA, 17 nt, Human
aucucaggggccagagg

SEQ ID NO: 3512285 - RNA, 16 nt, Human
aucucagguucuccuu

SEQ ID NO: 3512286 - RNA, 22 nt, Human
aucucaguaugaauuauucaau

SEQ ID NO: 3512287 - RNA, 18 nt, Human
aucucagucaugcauaaa

SEQ ID NO: 3512288 - RNA, 15 nt, Human
aucucagugaagaau

SEQ ID NO: 3512289 - RNA, 17 nt, Human
aucucagugcuguaaaa

SEQ ID NO: 3512290 - RNA, 23 nt, Human
aucucagugguuaagauuccuaa

SEQ ID NO: 3512291 - RNA, 21 nt, Human
aucucaguugauuuucuggau

SEQ ID NO: 3512292 - RNA, 19 nt, Human
aucucauagguugccaaua

SEQ ID NO: 3512293 - RNA, 13 nt, Human
aucucaucauguc

SEQ ID NO: 3512294 - RNA, 16 nt, Human
aucucaucaugucuau

SEQ ID NO: 3512295 - RNA, 18 nt, Human
aucucaugaggggagagg

SEQ ID NO: 3512296 - RNA, 19 nt, Human
aucucauguaucaucugga

SEQ ID NO: 3512297 - RNA, 20 nt, Human
aucucauuggacccuuccau

SEQ ID NO: 3512298 - RNA, 16 nt, Human
aucucauuuaagggaa

SEQ ID NO: 3512299 - RNA, 19 nt, Human
aucucauuuaagggaaaaa

SEQ ID NO: 3512300 - RNA, 20 nt, Human
aucucauuuaagggaaaaau

SEQ ID NO: 3512301 - RNA, 21 nt, Human
aucucauuuccaagcaaguau

SEQ ID NO: 3512302 - RNA, 21 nt, Human
aucucauuuuuccguaaaaau

SEQ ID NO: 3512303 - RNA, 13 nt, Human
aucuccaaaauaa

SEQ ID NO: 3512304 - RNA, 16 nt, Human
aucuccaagaaugcug

SEQ ID NO: 3512305 - RNA, 22 nt, Human
aucuccaagaaugcugaaacca

SEQ ID NO: 3512306 - RNA, 23 nt, Human
aucuccaagcagcuuagaguugg

SEQ ID NO: 3512307 - RNA, 16 nt, Human
aucuccagcggcccug

SEQ ID NO: 3512308 - RNA, 19 nt, Human
aucuccagggaguccccuc

SEQ ID NO: 3512309 - RNA, 15 nt, Human
aucuccaucugucaa

SEQ ID NO: 3512310 - RNA, 15 nt, Human
aucuccauggcuucc

SEQ ID NO: 3512311 - RNA, 19 nt, Human
aucuccauggcuuccuccu

SEQ ID NO: 3512312 - RNA, 21 nt, Human
aucucccacaugccaggggcc

SEQ ID NO: 3512313 - RNA, 20 nt, Human
aucucccaccuagcagcacc

SEQ ID NO: 3512314 - RNA, 11 nt, Human
augagaaaugu

SEQ ID NO: 3512315 - RNA, 13 nt, Human
augagaacaaaca

SEQ ID NO: 3512316 - RNA, 17 nt, Human
augagaacaaagcuguu

SEQ ID NO: 3512317 - RNA, 19 nt, Human
augagaacagacuggccug

SEQ ID NO: 3512318 - RNA, 18 nt, Human
augagaacagauaaagau

SEQ ID NO: 3512319 - RNA, 19 nt, Human
augagaacagauaaagauu

SEQ ID NO: 3512320 - RNA, 17 nt, Human
augagaacauguuggua

SEQ ID NO: 3512321 - RNA, 11 nt, Human
augagaaucua

SEQ ID NO: 3512322 - RNA, 11 nt, Human
augagaauguu

SEQ ID NO: 3512323 - RNA, 18 nt, Human
augagaauucagcugccc

SEQ ID NO: 3512324 - RNA, 22 nt, Human
augagaauuucuaaaaagauua

SEQ ID NO: 3512325 - RNA, 22 nt, Human
augagacauaggccaugaaaaa

SEQ ID NO: 3512326 - RNA, 22 nt, Human
augagacuauguaaaaauaacc

SEQ ID NO: 3512327 - RNA, 16 nt, Human
augagacuugccuucc

SEQ ID NO: 3512328 - RNA, 15 nt, Human
augagacuugcucuc

SEQ ID NO: 3512329 - RNA, 13 nt, Human
augagagacacac

SEQ ID NO: 3512330 - RNA, 21 nt, Human
augagagacacacugaagaag

SEQ ID NO: 3512331 - RNA, 13 nt, Human
augagagcauaau

SEQ ID NO: 3512332 - RNA, 20 nt, Human
augagagcauaauuuaaaaa

SEQ ID NO: 3512333 - RNA, 20 nt, Human
augagagcccagagguaaca

SEQ ID NO: 3512334 - RNA, 16 nt, Human
augagaggaaaucacc

SEQ ID NO: 3512335 - RNA, 15 nt, Human
augagauacuuugca

SEQ ID NO: 3512336 - RNA, 22 nt, Human
augagauacuuugcauugucug

SEQ ID NO: 3512337 - RNA, 15 nt, Human
augagaucaggcucu

SEQ ID NO: 3512338 - RNA, 16 nt, Human
augagaucaggcucug

SEQ ID NO: 3512339 - RNA, 17 nt, Human
augagaucaggcucugc

SEQ ID NO: 3512340 - RNA, 13 nt, Human
augagauccuuua

SEQ ID NO: 3512341 - RNA, 22 nt, Human
augagaucuaagccuuuccaua

SEQ ID NO: 3512342 - RNA, 24 nt, Human
augagaugauacauccaaagcaga

SEQ ID NO: 3512343 - RNA, 18 nt, Human
augagaugccugaagcca

SEQ ID NO: 3512344 - RNA, 19 nt, Human
augagaugcguuguuacag

SEQ ID NO: 3512345 - RNA, 12 nt, Human
augagaugcugg

SEQ ID NO: 3512346 - RNA, 19 nt, Human
augagaugcuggcuugggc

SEQ ID NO: 3512347 - RNA, 22 nt, Human
augagauguguggacuguggca

SEQ ID NO: 3512348 - RNA, 20 nt, Human
augagauugguuuuccugug

SEQ ID NO: 3512349 - RNA, 18 nt, Human
augagauuguuuuaucau

SEQ ID NO: 3512350 - RNA, 17 nt, Human
augagcaauaucugcua

SEQ ID NO: 3512351 - RNA, 15 nt, Human
augagcaucaggcca

SEQ ID NO: 3512352 - RNA, 19 nt, Human
augagcaucaggccaggcc

SEQ ID NO: 3512353 - RNA, 17 nt, Human
augagcauggagcuggc

SEQ ID NO: 3512354 - RNA, 18 nt, Human
augagcccagagaacagc

SEQ ID NO: 3512355 - RNA, 18 nt, Human
augagccgcccaaggccu

SEQ ID NO: 3512356 - RNA, 19 nt, Human
augagccuacgcugaagau

SEQ ID NO: 3512357 - RNA, 23 nt, Human
augagccuacgcugaagauggca

SEQ ID NO: 3512358 - RNA, 19 nt, Human
augagccucagcauccugg

SEQ ID NO: 3512359 - RNA, 13 nt, Human
augagccuggcaa

SEQ ID NO: 3512360 - RNA, 18 nt, Human
augagcgugacacucauu

SEQ ID NO: 3512361 - RNA, 16 nt, Human
augagcuauuaaaacu

SEQ ID NO: 3512362 - RNA, 21 nt, Human
augagcuauuuccauuccaga

SEQ ID NO: 3512363 - RNA, 22 nt, Human
augagcuauuuccauuccagaa

SEQ ID NO: 3512364 - RNA, 16 nt, Human
augagcucauguagca

SEQ ID NO: 3512365 - RNA, 16 nt, Human
augagcuccagacccc

SEQ ID NO: 3512366 - RNA, 20 nt, Human
augagcuccagacccccagc

SEQ ID NO: 3512367 - RNA, 21 nt, Human
augagcuccagacccccagca

SEQ ID NO: 3512368 - RNA, 16 nt, Human
augagcucuacccagg

SEQ ID NO: 3512369 - RNA, 17 nt, Human
augagcucugaaaucuu

SEQ ID NO: 3512370 - RNA, 22 nt, Human
augagcucugaaaucuucccau

SEQ ID NO: 3512371 - RNA, 21 nt, Human
augagcuggaaggagugagag

SEQ ID NO: 3512372 - RNA, 15 nt, Human
augagcugugagaag

SEQ ID NO: 3512373 - RNA, 23 nt, Human
augagcuuaagaaauuuguggaa

SEQ ID NO: 3512374 - RNA, 12 nt, Human
augagcuuucug

SEQ ID NO: 3512375 - RNA, 15 nt, Human
augagcuuucugaac

SEQ ID NO: 3512376 - RNA, 17 nt, Human
augagcuuucugaacag

SEQ ID NO: 3512377 - RNA, 20 nt, Human
augagcuuucugaacagcug

SEQ ID NO: 3512378 - RNA, 22 nt, Human
augagcuuucugaacagcuggu

SEQ ID NO: 3512379 - RNA, 15 nt, Human
augaggaaaauucuu

SEQ ID NO: 3512380 - RNA, 21 nt, Human
augaggaacuguagaugaugu

SEQ ID NO: 3512381 - RNA, 12 nt, Human
augaggaaugua

SEQ ID NO: 3512382 - RNA, 17 nt, Human
augaggaauguauaugu

SEQ ID NO: 3512383 - RNA, 13 nt, Human
augaggacauguu

SEQ ID NO: 3512384 - RNA, 19 nt, Human
augaggacucuauucuuua

SEQ ID NO: 3512385 - RNA, 21 nt, Human
augaggagaaaaaaagcaugu

SEQ ID NO: 3512386 - RNA, 12 nt, Human
augaggagggga

SEQ ID NO: 3512387 - RNA, 19 nt, Human
augaggaguaaaauucagu

SEQ ID NO: 3512388 - RNA, 14 nt, Human
augaggaguugcug

SEQ ID NO: 3512389 - RNA, 21 nt, Human
augaggcaaugucaggaacag

SEQ ID NO: 3512390 - RNA, 20 nt, Human
augaggcagcacgugcacaa

SEQ ID NO: 3512391 - RNA, 14 nt, Human
augaggcauuuguu

SEQ ID NO: 3512392 - RNA, 13 nt, Human
augaggccagacc

SEQ ID NO: 3512393 - RNA, 14 nt, Human
augaggccagacca

SEQ ID NO: 3512394 - RNA, 19 nt, Human
augaggcccuccacaccug

SEQ ID NO: 3512395 - RNA, 20 nt, Human
augaggcccuccacaccugc

SEQ ID NO: 3512396 - RNA, 13 nt, Human
augaggcuugcug

SEQ ID NO: 3512397 - RNA, 13 nt, Human
augaggcuuucca

SEQ ID NO: 3512398 - RNA, 13 nt, Human
augagggaaaaga

SEQ ID NO: 3512399 - RNA, 13 nt, Human
augagggacugga

SEQ ID NO: 3512400 - RNA, 13 nt, Human
augagggcagcag

SEQ ID NO: 3512401 - RNA, 16 nt, Human
augagggcagcagcca

SEQ ID NO: 3512402 - RNA, 14 nt, Human
augaggggaggggg

SEQ ID NO: 3512403 - RNA, 15 nt, Human
augagggggcucagu

SEQ ID NO: 3512404 - RNA, 17 nt, Human
augagggguuccucccc

SEQ ID NO: 3512405 - RNA, 19 nt, Human
augaggguuugagagagca

SEQ ID NO: 3512406 - RNA, 21 nt, Human
augagguacaaccuguucugc

SEQ ID NO: 3512407 - RNA, 20 nt, Human
augauuuccuugaauguggc

SEQ ID NO: 3512408 - RNA, 12 nt, Human
augauuucuaug

SEQ ID NO: 3512409 - RNA, 16 nt, Human
augauuucuaugcuga

SEQ ID NO: 3512410 - RNA, 14 nt, Human
augauuuuacuuag

SEQ ID NO: 3512411 - RNA, 20 nt, Human
augauuuucauaacuuauug

SEQ ID NO: 3512412 - RNA, 11 nt, Human
augauuuuuag

SEQ ID NO: 3512413 - RNA, 22 nt, Human
augauuuuuuaaaagaaauuua

SEQ ID NO: 3512414 - RNA, 16 nt, Human
augcaaaaaaaauuag

SEQ ID NO: 3512415 - RNA, 14 nt, Human
augcaaaaaaucuu

SEQ ID NO: 3512416 - RNA, 15 nt, Human
augcaaaaaaucuua

SEQ ID NO: 3512417 - RNA, 23 nt, Human
augcaaaaagaaaugacuaauua

SEQ ID NO: 3512418 - RNA, 23 nt, Human
augcaaaaagcuagucaacagua

SEQ ID NO: 3512419 - RNA, 20 nt, Human
augcaaaaguucugacuuga

SEQ ID NO: 3512420 - RNA, 20 nt, Human
augcaaaccaucauugaaau

SEQ ID NO: 3512421 - RNA, 13 nt, Human
augcaaacucuuu

SEQ ID NO: 3512422 - RNA, 16 nt, Human
augcaaacucuuuggu

SEQ ID NO: 3512423 - RNA, 22 nt, Human
augcaaacucuuuggucguuuu

SEQ ID NO: 3512424 - RNA, 14 nt, Human
augcaaagaggcaa

SEQ ID NO: 3512425 - RNA, 14 nt, Human
augcaaaggcuggg

SEQ ID NO: 3512426 - RNA, 17 nt, Human
augcaaaguacaaugug

SEQ ID NO: 3512427 - RNA, 19 nt, Human
augcaaaguacaauguguu

SEQ ID NO: 3512428 - RNA, 16 nt, Human
augcaaauagcaaaac

SEQ ID NO: 3512429 - RNA, 18 nt, Human
augcaaaucaauuacugg

SEQ ID NO: 3512430 - RNA, 14 nt, Human
augcaaaugagcuc

SEQ ID NO: 3512431 - RNA, 14 nt, Human
augcaaauucucaa

SEQ ID NO: 3512432 - RNA, 14 nt, Human
augcaacaacaugu

SEQ ID NO: 3512433 - RNA, 18 nt, Human
augcaaccaagucacacg

SEQ ID NO: 3512434 - RNA, 14 nt, Human
augcaagaaggagg

SEQ ID NO: 3512435 - RNA, 20 nt, Human
augcaagagugauugcagcu

SEQ ID NO: 3512436 - RNA, 23 nt, Human
augcaagauaguuuaucuaacuu

SEQ ID NO: 3512437 - RNA, 21 nt, Human
augcaagcagaggaccagggc

SEQ ID NO: 3512438 - RNA, 15 nt, Human
augcaagcaguuuca

SEQ ID NO: 3512439 - RNA, 16 nt, Human
augcaaggaaggaaag

SEQ ID NO: 3512440 - RNA, 16 nt, Human
augcaaguuuuuuuuc

SEQ ID NO: 3512441 - RNA, 22 nt, Human
augcaauaaaauuauuugcagg

SEQ ID NO: 3512442 - RNA, 14 nt, Human
augcaauaaaauuu

SEQ ID NO: 3512443 - RNA, 23 nt, Human
augcaauagaagugcuccccucu

SEQ ID NO: 3512444 - RNA, 13 nt, Human
augcaauauguau

SEQ ID NO: 3512445 - RNA, 14 nt, Human
augcaauauguauu

SEQ ID NO: 3512446 - RNA, 22 nt, Human
augcaauauguuuaucaacuca

SEQ ID NO: 3512447 - RNA, 13 nt, Human
augcaauauuugu

SEQ ID NO: 3512448 - RNA, 15 nt, Human
augcaauauuuguaa

SEQ ID NO: 3512449 - RNA, 16 nt, Human
augcaauccuuacaaa

SEQ ID NO: 3512450 - RNA, 18 nt, Human
augcaauccuuacaaaug

SEQ ID NO: 3512451 - RNA, 21 nt, Human
augcaauccuuacaaaugauu

SEQ ID NO: 3512452 - RNA, 14 nt, Human
augcaaugugaagc

SEQ ID NO: 3512453 - RNA, 13 nt, Human
augcaaugugcua

SEQ ID NO: 3512454 - RNA, 17 nt, Human
augcaaugugcuacuga

SEQ ID NO: 3512455 - RNA, 19 nt, Human
augcaauuagccucauagu

SEQ ID NO: 3512456 - RNA, 17 nt, Human
augcaauuugauugacu

SEQ ID NO: 3512457 - RNA, 17 nt, Human
augcaauuuuucuuucu

SEQ ID NO: 3512458 - RNA, 16 nt, Human
augcacaaaaagaugc

SEQ ID NO: 3512459 - RNA, 15 nt, Human
augcacaaacagagg

SEQ ID NO: 3512460 - RNA, 17 nt, Human
augcacaaacagaggcc

SEQ ID NO: 3512461 - RNA, 15 nt, Human
augcacaaaguguau

SEQ ID NO: 3512462 - RNA, 15 nt, Human
augcacaaauucugu

SEQ ID NO: 3512463 - RNA, 23 nt, Human
augcacaaauucugucucuggau

SEQ ID NO: 3512464 - RNA, 21 nt, Human
augcacaauguagauaagugu

SEQ ID NO: 3512465 - RNA, 15 nt, Human
augcacaaugucuug

SEQ ID NO: 3512466 - RNA, 22 nt, Human
augcacacaaaacaacccuaga

SEQ ID NO: 3512467 - RNA, 12 nt, Human
augcacacacac

SEQ ID NO: 3512468 - RNA, 15 nt, Human
augcacacauuuuuu

SEQ ID NO: 3512469 - RNA, 17 nt, Human
augcacacauuuuuuaa

SEQ ID NO: 3512470 - RNA, 15 nt, Human
augcacagauauacu

SEQ ID NO: 3512471 - RNA, 21 nt, Human
augcacagcuaacauggaagu

SEQ ID NO: 3512472 - RNA, 17 nt, Human
augcacaguaaaaaugg

SEQ ID NO: 3512473 - RNA, 14 nt, Human
augcacaguauuug

SEQ ID NO: 3512474 - RNA, 21 nt, Human
augcacauccauucccaagaa

SEQ ID NO: 3512475 - RNA, 14 nt, Human
augcacaucccugg

SEQ ID NO: 3512476 - RNA, 16 nt, Human
augcaccuaaagaaaa

SEQ ID NO: 3512477 - RNA, 18 nt, Human
augcaccuaaagaaaaac

SEQ ID NO: 3512478 - RNA, 15 nt, Human
augcaccuugugucu

SEQ ID NO: 3512479 - RNA, 19 nt, Human
augcaccuugugucuguac

SEQ ID NO: 3512480 - RNA, 21 nt, Human
augcaccuugugucuguacac

SEQ ID NO: 3512481 - RNA, 14 nt, Human
augcacgaccuugg

SEQ ID NO: 3512482 - RNA, 16 nt, Human
augcacgaccuuggga

SEQ ID NO: 3512483 - RNA, 22 nt, Human
augcacugacccuuccagacau

SEQ ID NO: 3512484 - RNA, 16 nt, Human
augcacugauguugug

SEQ ID NO: 3512485 - RNA, 17 nt, Human
agggcggggguggcggc

SEQ ID NO: 3512486 - RNA, 22 nt, Human
agggcggggugucugucuuccu

SEQ ID NO: 3512487 - RNA, 19 nt, Human
agggcguggaaaggggcag

SEQ ID NO: 3512488 - RNA, 21 nt, Human
agggcuagaaccuagaagggc

SEQ ID NO: 3512489 - RNA, 22 nt, Human
agggcuagaaccuagaagggcu

SEQ ID NO: 3512490 - RNA, 16 nt, Human
agggcuagaaccugga

SEQ ID NO: 3512491 - RNA, 17 nt, Human
agggcuagaaccuggag

SEQ ID NO: 3512492 - RNA, 18 nt, Human
agggcuagaaccuggaga

SEQ ID NO: 3512493 - RNA, 22 nt, Human
agggcuagaaccuggagggcua

SEQ ID NO: 3512494 - RNA, 23 nt, Human
agggcuagaaccuggaggggcua

SEQ ID NO: 3512495 - RNA, 18 nt, Human
agggcuagaaccuggcag

SEQ ID NO: 3512496 - RNA, 22 nt, Human
agggcuagaaccuguagagcua

SEQ ID NO: 3512497 - RNA, 16 nt, Human
agggcuagcaucccug

SEQ ID NO: 3512498 - RNA, 15 nt, Human
agggcuaggaauaua

SEQ ID NO: 3512499 - RNA, 22 nt, Human
agggcuagugacuuguguccca

SEQ ID NO: 3512500 - RNA, 12 nt, Human
agggcucagccu

SEQ ID NO: 3512501 - RNA, 15 nt, Human
agggcucagccuggu

SEQ ID NO: 3512502 - RNA, 19 nt, Human
agggcucagcggggacagc

SEQ ID NO: 3512503 - RNA, 20 nt, Human
agggcucagcggggacagcu

SEQ ID NO: 3512504 - RNA, 13 nt, Human
agggcucaggauu

SEQ ID NO: 3512505 - RNA, 12 nt, Human
agggcuccagac

SEQ ID NO: 3512506 - RNA, 13 nt, Human
agggcucccaggg

SEQ ID NO: 3512507 - RNA, 11 nt, Human
agggcucccca

SEQ ID NO: 3512508 - RNA, 15 nt, Human
agggcucccugcccu

SEQ ID NO: 3512509 - RNA, 15 nt, Human
agggcuccuauucaa

SEQ ID NO: 3512510 - RNA, 11 nt, Human
agggcuccucc

SEQ ID NO: 3512511 - RNA, 18 nt, Human
agggcuccucccagcuug

SEQ ID NO: 3512512 - RNA, 11 nt, Human
agggcuccugc

SEQ ID NO: 3512513 - RNA, 22 nt, Human
agggcuccugccuucuguccug

SEQ ID NO: 3512514 - RNA, 18 nt, Human
agggcuccuugugggccu

SEQ ID NO: 3512515 - RNA, 23 nt, Human
agggcuccuugugggccugggcu

SEQ ID NO: 3512516 - RNA, 15 nt, Human
agggcucuaaaaaaa

SEQ ID NO: 3512517 - RNA, 17 nt, Human
agggcucuccuggcuuc

SEQ ID NO: 3512518 - RNA, 19 nt, Human
agggcucucuuuccuucuu

SEQ ID NO: 3512519 - RNA, 15 nt, Human
agggcucugaccagu

SEQ ID NO: 3512520 - RNA, 11 nt, Human
agggcucugag

SEQ ID NO: 3512521 - RNA, 12 nt, Human
agggcucugagg

SEQ ID NO: 3512522 - RNA, 21 nt, Human
agggcucugauauuccaugaa

SEQ ID NO: 3512523 - RNA, 22 nt, Human
agggcucugauauuccaugaau

SEQ ID NO: 3512524 - RNA, 12 nt, Human
agggcucugccc

SEQ ID NO: 3512525 - RNA, 20 nt, Human
agggcugacacguccacccc

SEQ ID NO: 3512526 - RNA, 21 nt, Human
agggcugacacguccacccca

SEQ ID NO: 3512527 - RNA, 17 nt, Human
agggcugaccugccucu

SEQ ID NO: 3512528 - RNA, 19 nt, Human
agggcugaccugccucuca

SEQ ID NO: 3512529 - RNA, 12 nt, Human
agggcugcauga

SEQ ID NO: 3512530 - RNA, 16 nt, Human
agggcugcaugauguu

SEQ ID NO: 3512531 - RNA, 15 nt, Human
agggcugcccugaga

SEQ ID NO: 3512532 - RNA, 20 nt, Human
agggcugccuucuggccuug

SEQ ID NO: 3512533 - RNA, 20 nt, Human
agggcuggacugaggccuga

SEQ ID NO: 3512534 - RNA, 16 nt, Human
agggcuggaggcccag

SEQ ID NO: 3512535 - RNA, 17 nt, Human
agggcuggcccagcccu

SEQ ID NO: 3512536 - RNA, 22 nt, Human
agggcuggcccagcccugcugg

SEQ ID NO: 3512537 - RNA, 17 nt, Human
agggcuggcucaauuga

SEQ ID NO: 3512538 - RNA, 16 nt, Human
agggcuggcuccugau

SEQ ID NO: 3512539 - RNA, 17 nt, Human
agggcuggcuccugauc

SEQ ID NO: 3512540 - RNA, 17 nt, Human
agggcuggcuggccuca

SEQ ID NO: 3512541 - RNA, 23 nt, Human
agggcugggaaacacuccuugca

SEQ ID NO: 3512542 - RNA, 19 nt, Human
agggcuguaacugccaggc

SEQ ID NO: 3512543 - RNA, 15 nt, Human
agggcugucaucuga

SEQ ID NO: 3512544 - RNA, 19 nt, Human
agggcuguggccucccugc

SEQ ID NO: 3512545 - RNA, 22 nt, Human
agggcuguuauaaucuuucaca

SEQ ID NO: 3512546 - RNA, 19 nt, Human
agggcuuacggcccuggcc

SEQ ID NO: 3512547 - RNA, 12 nt, Human
agggcuuccucu

SEQ ID NO: 3512548 - RNA, 14 nt, Human
agggcuuguaguuc

SEQ ID NO: 3512549 - RNA, 15 nt, Human
agggcuuuaaaauuc

SEQ ID NO: 3512550 - RNA, 23 nt, Human
agggcuuuaaaauucucuuccaa

SEQ ID NO: 3512551 - RNA, 18 nt, Human
agggcuuuccugugccag

SEQ ID NO: 3512552 - RNA, 12 nt, Human
augaguuuaaaa

SEQ ID NO: 3512553 - RNA, 15 nt, Human
augaguuucacagug

SEQ ID NO: 3512554 - RNA, 22 nt, Human
augaguuucacagugugauuuu

SEQ ID NO: 3512555 - RNA, 20 nt, Human
augaguuucauagcuaagaa

SEQ ID NO: 3512556 - RNA, 22 nt, Human
augaguuugcccugguuucacu

SEQ ID NO: 3512557 - RNA, 19 nt, Human
augaguuuugggaaguuaa

SEQ ID NO: 3512558 - RNA, 21 nt, Human
augauaaaaaauuuuguaauu

SEQ ID NO: 3512559 - RNA, 22 nt, Human
augauaaaaaauuuuguaauuu

SEQ ID NO: 3512560 - RNA, 20 nt, Human
augauaaguuccuuuccuuu

SEQ ID NO: 3512561 - RNA, 19 nt, Human
augauaauagauucucuug

SEQ ID NO: 3512562 - RNA, 17 nt, Human
augauacuugaaaauua

SEQ ID NO: 3512563 - RNA, 14 nt, Human
augauagauuugac

SEQ ID NO: 3512564 - RNA, 18 nt, Human
augauagauuugaccucc

SEQ ID NO: 3512565 - RNA, 15 nt, Human
augauaguugaaugu

SEQ ID NO: 3512566 - RNA, 16 nt, Human
augauauaagguuuuu

SEQ ID NO: 3512567 - RNA, 23 nt, Human
augauaugcuuguaacuaaaaua

SEQ ID NO: 3512568 - RNA, 13 nt, Human
augauauguaaac

SEQ ID NO: 3512569 - RNA, 14 nt, Human
augauauuccauag

SEQ ID NO: 3512570 - RNA, 16 nt, Human
augauauuccauagua

SEQ ID NO: 3512571 - RNA, 18 nt, Human
augauauugcauaugcau

SEQ ID NO: 3512572 - RNA, 17 nt, Human
augauauuuuaaaaucu

SEQ ID NO: 3512573 - RNA, 20 nt, Human
augauauuuuuuuaagucuu

SEQ ID NO: 3512574 - RNA, 17 nt, Human
augaucaauccuuuauu

SEQ ID NO: 3512575 - RNA, 18 nt, Human
augaucaccgacugaaaa

SEQ ID NO: 3512576 - RNA, 15 nt, Human
augaucacggcucac

SEQ ID NO: 3512577 - RNA, 18 nt, Human
augaucacggcucacugc

SEQ ID NO: 3512578 - RNA, 22 nt, Human
augaucacuaauacuaauucau

SEQ ID NO: 3512579 - RNA, 21 nt, Human
augaucagcaucugugauggg

SEQ ID NO: 3512580 - RNA, 18 nt, Human
augaucagcuguuuguca

SEQ ID NO: 3512581 - RNA, 20 nt, Human
augaucagcuguuugucaua

SEQ ID NO: 3512582 - RNA, 13 nt, Human
augaucaguguug

SEQ ID NO: 3512583 - RNA, 19 nt, Human
augauccagcagauuauuc

SEQ ID NO: 3512584 - RNA, 20 nt, Human
augauccagcagauuauuca

SEQ ID NO: 3512585 - RNA, 18 nt, Human
augaucccuguguugucu

SEQ ID NO: 3512586 - RNA, 15 nt, Human
augaucuagguuuaa

SEQ ID NO: 3512587 - RNA, 19 nt, Human
augaucuagguuuaacuca

SEQ ID NO: 3512588 - RNA, 14 nt, Human
augaucucugauga

SEQ ID NO: 3512589 - RNA, 19 nt, Human
augaucugccucuaaaagc

SEQ ID NO: 3512590 - RNA, 15 nt, Human
augaucugucugugg

SEQ ID NO: 3512591 - RNA, 19 nt, Human
augaucugugccuuuuuua

SEQ ID NO: 3512592 - RNA, 15 nt, Human
augaucuucuuuaua

SEQ ID NO: 3512593 - RNA, 21 nt, Human
augaucuugaguauaagaaau

SEQ ID NO: 3512594 - RNA, 19 nt, Human
augaucuuugcagacaggc

SEQ ID NO: 3512595 - RNA, 15 nt, Human
augaugaaaauauuu

SEQ ID NO: 3512596 - RNA, 18 nt, Human
augaugaucuuuaaaaua

SEQ ID NO: 3512597 - RNA, 15 nt, Human
augaugcagucuccu

SEQ ID NO: 3512598 - RNA, 21 nt, Human
augaugcagucuccucuuuaa

SEQ ID NO: 3512599 - RNA, 18 nt, Human
augaugccaaccucugga

SEQ ID NO: 3512600 - RNA, 19 nt, Human
augaugcccugcuccaggg

SEQ ID NO: 3512601 - RNA, 16 nt, Human
augaugcuauuugcaa

SEQ ID NO: 3512602 - RNA, 22 nt, Human
augaugcucaaaaucuuuccaa

SEQ ID NO: 3512603 - RNA, 19 nt, Human
augauggcaauuuuguaac

SEQ ID NO: 3512604 - RNA, 16 nt, Human
augauggguguuuuua

SEQ ID NO: 3512605 - RNA, 13 nt, Human
augauguaauuga

SEQ ID NO: 3512606 - RNA, 13 nt, Human
augauguauauuu

SEQ ID NO: 3512607 - RNA, 15 nt, Human
augauguauuuuugu

SEQ ID NO: 3512608 - RNA, 15 nt, Human
augauguccagaaga

SEQ ID NO: 3512609 - RNA, 22 nt, Human
augaugugcaaaaccuuuuacu

SEQ ID NO: 3512610 - RNA, 14 nt, Human
augaugugccugcu

SEQ ID NO: 3512611 - RNA, 18 nt, Human
augaugugccugcuucag

SEQ ID NO: 3512612 - RNA, 16 nt, Human
augaugugccugggug

SEQ ID NO: 3512613 - RNA, 11 nt, Human
augaugugcuu

SEQ ID NO: 3512614 - RNA, 19 nt, Human
augauguggaguggggcag

SEQ ID NO: 3512615 - RNA, 19 nt, Human
augauguguacccaaacgu

SEQ ID NO: 3512616 - RNA, 14 nt, Human
augauguuaaaaaa

SEQ ID NO: 3512617 - RNA, 22 nt, Human
augauguuaaaaaaauaagaag

SEQ ID NO: 3512618 - RNA, 13 nt, Human
augauguuuuuaa

SEQ ID NO: 3512619 - RNA, 19 nt, Human
augauguuuuuaaaaucuu

SEQ ID NO: 3512620 - RNA, 20 nt, Human
augauguuuuuaaaaucuua

SEQ ID NO: 3512621 - RNA, 20 nt, Human
augauuaaccacuucagcug

SEQ ID NO: 3512622 - RNA, 21 nt, Human
augauuaaccacuucagcuga

SEQ ID NO: 3512623 - RNA, 19 nt, Human
augauuaauuaaauagcuu

SEQ ID NO: 3512624 - RNA, 16 nt, Human
augauuaauucaccuu

SEQ ID NO: 3512625 - RNA, 14 nt, Human
augauuacuggccu

SEQ ID NO: 3512626 - RNA, 15 nt, Human
augauuacuggccuu

SEQ ID NO: 3512627 - RNA, 19 nt, Human
augauuacuggccuuuuuc

SEQ ID NO: 3512628 - RNA, 23 nt, Human
augauuagaaauuaccuguggau

SEQ ID NO: 3512629 - RNA, 23 nt, Human
augauuagcagaagaaaggaaca

SEQ ID NO: 3512630 - RNA, 18 nt, Human
augauuauuuucauuaca

SEQ ID NO: 3512631 - RNA, 12 nt, Human
augauucaagcc

SEQ ID NO: 3512632 - RNA, 14 nt, Human
augauucaagccau

SEQ ID NO: 3512633 - RNA, 15 nt, Human
augauucaagccauu

SEQ ID NO: 3512634 - RNA, 16 nt, Human
augauucaagccauuc

SEQ ID NO: 3512635 - RNA, 16 nt, Human
augauucaguguuaaa

SEQ ID NO: 3512636 - RNA, 22 nt, Human
augauuccuugauggagauauu

SEQ ID NO: 3512637 - RNA, 23 nt, Human
augauucgcccaaagccagacag

SEQ ID NO: 3512638 - RNA, 22 nt, Human
augauucugauguacucuaaau

SEQ ID NO: 3512639 - RNA, 20 nt, Human
augauucuuuguuacaggca

SEQ ID NO: 3512640 - RNA, 19 nt, Human
augauugccuuuuuauaac

SEQ ID NO: 3512641 - RNA, 17 nt, Human
augauugcuuuuaaaau

SEQ ID NO: 3512642 - RNA, 21 nt, Human
augauuggauuauucauuuaa

SEQ ID NO: 3512643 - RNA, 13 nt, Human
augauuguacaga

SEQ ID NO: 3512644 - RNA, 22 nt, Human
augauugugcacauacuugaga

SEQ ID NO: 3512645 - RNA, 20 nt, Human
augauuguuucucaaaucuu

SEQ ID NO: 3512646 - RNA, 16 nt, Human
augauuuaaaagggaa

SEQ ID NO: 3512647 - RNA, 13 nt, Human
augauuuaauaaa

SEQ ID NO: 3512648 - RNA, 16 nt, Human
augauuuacagagaag

SEQ ID NO: 3512649 - RNA, 13 nt, Human
augauuuacauuu

SEQ ID NO: 3512650 - RNA, 18 nt, Human
augauuuagagugcuguc

SEQ ID NO: 3512651 - RNA, 15 nt, Human
augauuuauaguuug

SEQ ID NO: 3512652 - RNA, 14 nt, Human
augauuucacaaau

SEQ ID NO: 3512653 - RNA, 16 nt, Human
augauuucacaaauau

SEQ ID NO: 3512654 - RNA, 13 nt, Human
augauuucacagu

SEQ ID NO: 3512655 - RNA, 21 nt, Human
augauuucacuagaaaagcug

SEQ ID NO: 3512656 - RNA, 20 nt, Human
augauuucaguucuaggaaa

SEQ ID NO: 3512657 - RNA, 21 nt, Human
augauuucaguucuaggaaaa

SEQ ID NO: 3512658 - RNA, 14 nt, Human
augauuucauuuca

SEQ ID NO: 3512659 - RNA, 20 nt, Human
augauuuccaaagagaaaaa

SEQ ID NO: 3512660 - RNA, 14 nt, Human
augauuuccccccu

SEQ ID NO: 3512661 - RNA, 13 nt, Human
augauuuccuuga

SEQ ID NO: 3512662 - RNA, 15 nt, Human
augauuuccuugaau

SEQ ID NO: 3512663 - RNA, 17 nt, Human
augauuuccuugaaugu

SEQ ID NO: 3512664 - RNA, 21 nt, Human
augauuuccuugaauguggcu

SEQ ID NO: 3512665 - RNA, 13 nt, Human
augauuucuaugc

SEQ ID NO: 3512666 - RNA, 14 nt, Human
augauuucuucuua

SEQ ID NO: 3512667 - RNA, 20 nt, Human
augauuuggggauucagauu

SEQ ID NO: 3512668 - RNA, 16 nt, Human
augauuuuuaaagaaa

SEQ ID NO: 3512669 - RNA, 22 nt, Human
augauuuuuagaugagauuguu

SEQ ID NO: 3512670 - RNA, 20 nt, Human
augauuuuuuaaaagaaauu

SEQ ID NO: 3512671 - RNA, 15 nt, Human
augauuuuuugaaag

SEQ ID NO: 3512672 - RNA, 17 nt, Human
augcaaaaaaucuuaau

SEQ ID NO: 3512673 - RNA, 23 nt, Human
augcaaaaaaucuuaauacuguu

SEQ ID NO: 3512674 - RNA, 21 nt, Human
augcaaaauaauaccugucca

SEQ ID NO: 3512675 - RNA, 13 nt, Human
augcaaaauggaa

SEQ ID NO: 3512676 - RNA, 14 nt, Human
augcaaaccauagc

SEQ ID NO: 3512677 - RNA, 18 nt, Human
augcaaaccaucauugaa

SEQ ID NO: 3512678 - RNA, 21 nt, Human
augcaaaccaucauugaaauc

SEQ ID NO: 3512679 - RNA, 12 nt, Human
augcaaacucuu

SEQ ID NO: 3512680 - RNA, 22 nt, Human
augcaaacuuuauuuuguguuu

SEQ ID NO: 3512681 - RNA, 15 nt, Human
augcaaagaaaauca

SEQ ID NO: 3512682 - RNA, 15 nt, Human
augcaaagaggcaag

SEQ ID NO: 3512683 - RNA, 16 nt, Human
augcaaagaggcaaga

SEQ ID NO: 3512684 - RNA, 20 nt, Human
augcaaagaugaaggucugu

SEQ ID NO: 3512685 - RNA, 12 nt, Human
augcaaagcacu

SEQ ID NO: 3512686 - RNA, 15 nt, Human
augcaaagcacugac

SEQ ID NO: 3512687 - RNA, 13 nt, Human
augcaaaggcugg

SEQ ID NO: 3512688 - RNA, 14 nt, Human
augcaaaguacaau

SEQ ID NO: 3512689 - RNA, 18 nt, Human
augcaaaguacaaugugu

SEQ ID NO: 3512690 - RNA, 11 nt, Human
augcaaauccu

SEQ ID NO: 3512691 - RNA, 15 nt, Human
auggaaaaacuugug

SEQ ID NO: 3512692 - RNA, 13 nt, Human
auggaaaaauaaa

SEQ ID NO: 3512693 - RNA, 21 nt, Human
auggaaaacuuaguuugugaa

SEQ ID NO: 3512694 - RNA, 21 nt, Human
auggaaaagucuucaagggcu

SEQ ID NO: 3512695 - RNA, 18 nt, Human
auggaaaaguguccuucu

SEQ ID NO: 3512696 - RNA, 15 nt, Human
auggaaacaaagugg

SEQ ID NO: 3512697 - RNA, 23 nt, Human
augcaugaaguaauaugcacaca

SEQ ID NO: 3512698 - RNA, 20 nt, Human
augcaugauugcagaauugu

SEQ ID NO: 3512699 - RNA, 16 nt, Human
augcaugcaaaugagc

SEQ ID NO: 3512700 - RNA, 20 nt, Human
augcaugcagccacugugcu

SEQ ID NO: 3512701 - RNA, 16 nt, Human
augcaugcuuuccaua

SEQ ID NO: 3512702 - RNA, 16 nt, Human
augcauggugccccag

SEQ ID NO: 3512703 - RNA, 17 nt, Human
augcauggugccccagg

SEQ ID NO: 3512704 - RNA, 18 nt, Human
augcauggugccccagga

SEQ ID NO: 3512705 - RNA, 20 nt, Human
augcauggugccccaggacc

SEQ ID NO: 3512706 - RNA, 20 nt, Human
auggauuucugucuucucua

SEQ ID NO: 3512707 - RNA, 17 nt, Human
auggauuucuuugaaaa

SEQ ID NO: 3512708 - RNA, 15 nt, Human
auggauuugaagcaa

SEQ ID NO: 3512709 - RNA, 17 nt, Human
auggauuugaugcuguu

SEQ ID NO: 3512710 - RNA, 19 nt, Human
auggauuugaugcuguuug

SEQ ID NO: 3512711 - RNA, 14 nt, Human
auggauuugccugu

SEQ ID NO: 3512712 - RNA, 15 nt, Human
auggauuuugggagu

SEQ ID NO: 3512713 - RNA, 15 nt, Human
auggauuuuucuuua

SEQ ID NO: 3512714 - RNA, 18 nt, Human
auggcaaaggaaggugga

SEQ ID NO: 3512715 - RNA, 17 nt, Human
auggcaacaaacugcac

SEQ ID NO: 3512716 - RNA, 20 nt, Human
auggcaacaaacugcacaug

SEQ ID NO: 3512717 - RNA, 14 nt, Human
auggcaacagaucu

SEQ ID NO: 3512718 - RNA, 15 nt, Human
auggcaaccauuaua

SEQ ID NO: 3512719 - RNA, 23 nt, Human
auggcaagaaagcugguaaacua

SEQ ID NO: 3512720 - RNA, 18 nt, Human
auggcaaggcagcccugu

SEQ ID NO: 3512721 - RNA, 15 nt, Human
auggcaauuuuguaa

SEQ ID NO: 3512722 - RNA, 23 nt, Human
auggcacaucagcacgauuucug

SEQ ID NO: 3512723 - RNA, 14 nt, Human
auggcaccagaggc

SEQ ID NO: 3512724 - RNA, 13 nt, Human
auggcacccagug

SEQ ID NO: 3512725 - RNA, 21 nt, Human
auggcaccuucagacuuugcu

SEQ ID NO: 3512726 - RNA, 14 nt, Human
auggcacuaguauu

SEQ ID NO: 3512727 - RNA, 23 nt, Human
auggcacucccuccagcacaaac

SEQ ID NO: 3512728 - RNA, 13 nt, Human
auggcagaaaagu

SEQ ID NO: 3512729 - RNA, 16 nt, Human
auggcagaagacacca

SEQ ID NO: 3512730 - RNA, 22 nt, Human
auggcagaagacaccagagcag

SEQ ID NO: 3512731 - RNA, 20 nt, Human
auggcagaguuguaaauaua

SEQ ID NO: 3512732 - RNA, 19 nt, Human
auggcagauguaggaggga

SEQ ID NO: 3512733 - RNA, 21 nt, Human
auggcagauguaggagggacu

SEQ ID NO: 3512734 - RNA, 17 nt, Human
auggcagcagaaaacuu

SEQ ID NO: 3512735 - RNA, 21 nt, Human
auggcaggacgugggcugggc

SEQ ID NO: 3512736 - RNA, 17 nt, Human
auggcaggauggccugg

SEQ ID NO: 3512737 - RNA, 22 nt, Human
auggcaggauggccuggccagg

SEQ ID NO: 3512738 - RNA, 20 nt, Human
auggcagggggcugcugcug

SEQ ID NO: 3512739 - RNA, 16 nt, Human
auggcauaaccugucu

SEQ ID NO: 3512740 - RNA, 21 nt, Human
auggcauauuuuucacauauc

SEQ ID NO: 3512741 - RNA, 15 nt, Human
auggcaucaccucca

SEQ ID NO: 3512742 - RNA, 17 nt, Human
auggcaucccuuuuuca

SEQ ID NO: 3512743 - RNA, 16 nt, Human
auggcauccuccagcc

SEQ ID NO: 3512744 - RNA, 15 nt, Human
auggcauccugugaa

SEQ ID NO: 3512745 - RNA, 16 nt, Human
auggcauccugugaag

SEQ ID NO: 3512746 - RNA, 12 nt, Human
auggccacacug

SEQ ID NO: 3512747 - RNA, 21 nt, Human
auggccacacugugacacacu

SEQ ID NO: 3512748 - RNA, 22 nt, Human
auggccacaguagucuugauga

SEQ ID NO: 3512749 - RNA, 15 nt, Human
auggccacauuuaau

SEQ ID NO: 3512750 - RNA, 20 nt, Human
auggccagcuggaggcaggg

SEQ ID NO: 3512751 - RNA, 16 nt, Human
auggccagguggccac

SEQ ID NO: 3512752 - RNA, 16 nt, Human
auggccagugucuguc

SEQ ID NO: 3512753 - RNA, 17 nt, Human
auggcccauucuacuug

SEQ ID NO: 3512754 - RNA, 17 nt, Human
auggccccagcacagcu

SEQ ID NO: 3512755 - RNA, 18 nt, Human
auggccccagcacagcuu

SEQ ID NO: 3512756 - RNA, 18 nt, Human
auggccccucugaccugc

SEQ ID NO: 3512757 - RNA, 20 nt, Human
auggccgcagggcugugcac

SEQ ID NO: 3512758 - RNA, 13 nt, Human
auggccggccggg

SEQ ID NO: 3512759 - RNA, 22 nt, Human
auggccgugaaugggugcccac

SEQ ID NO: 3512760 - RNA, 18 nt, Human
auggccguguagaagcau

SEQ ID NO: 3512761 - RNA, 15 nt, Human
auggccguuggccac

SEQ ID NO: 3512762 - RNA, 18 nt, Human
auggccuaugcacauaug

SEQ ID NO: 3512763 - RNA, 20 nt, Human
auggccuauuauauuaaaau

SEQ ID NO: 3512764 - RNA, 19 nt, Human
auggccucagcugccucac

SEQ ID NO: 3512765 - RNA, 19 nt, Human
auggccucauguggcugga

SEQ ID NO: 3512766 - RNA, 21 nt, Human
auggccucuuacuaauguaaa

SEQ ID NO: 3512767 - RNA, 16 nt, Human
auggccugggggaugu

SEQ ID NO: 3512768 - RNA, 19 nt, Human
auggccuuaauuuccuuuu

SEQ ID NO: 3512769 - RNA, 19 nt, Human
auggccuugcagcacucac

SEQ ID NO: 3512770 - RNA, 18 nt, Human
auggccuuugauaaaugu

SEQ ID NO: 3512771 - RNA, 18 nt, Human
auggcgcagugccucugg

SEQ ID NO: 3512772 - RNA, 20 nt, Human
auggcggguggggguggaau

SEQ ID NO: 3512773 - RNA, 20 nt, Human
auggcguaaguacagagaag

SEQ ID NO: 3512774 - RNA, 22 nt, Human
auggcguaaguacagagaagcc

SEQ ID NO: 3512775 - RNA, 18 nt, Human
auggcguggucaagcacu

SEQ ID NO: 3512776 - RNA, 15 nt, Human
auggcuaaggcacca

SEQ ID NO: 3512777 - RNA, 17 nt, Human
auggcuaaggcaccagc

SEQ ID NO: 3512778 - RNA, 18 nt, Human
auggcuaaggcaccagcc

SEQ ID NO: 3512779 - RNA, 16 nt, Human
auggcuaauucccaga

SEQ ID NO: 3512780 - RNA, 18 nt, Human
auggcuaccuaaaaagau

SEQ ID NO: 3512781 - RNA, 22 nt, Human
auggcuacuuugguuucugucu

SEQ ID NO: 3512782 - RNA, 21 nt, Human
auggcuauaaacaauuacaug

SEQ ID NO: 3512783 - RNA, 15 nt, Human
auggcuauaaauaua

SEQ ID NO: 3512784 - RNA, 23 nt, Human
auggcuauaggugcuacaaaaac

SEQ ID NO: 3512785 - RNA, 20 nt, Human
auggcucacuaugaaucuau

SEQ ID NO: 3512786 - RNA, 16 nt, Human
auggcucacugcagcc

SEQ ID NO: 3512787 - RNA, 20 nt, Human
auggcucacugcagccucga

SEQ ID NO: 3512788 - RNA, 13 nt, Human
auggcucagggug

SEQ ID NO: 3512789 - RNA, 15 nt, Human
auggcuccagaaaug

SEQ ID NO: 3512790 - RNA, 16 nt, Human
auggcuccagaaaugu

SEQ ID NO: 3512791 - RNA, 20 nt, Human
auggcuccagucugcugccc

SEQ ID NO: 3512792 - RNA, 17 nt, Human
auggcucccacaggagu

SEQ ID NO: 3512793 - RNA, 23 nt, Human
auggcuccgaacacccucgaagc

SEQ ID NO: 3512794 - RNA, 12 nt, Human
auggcuccucuc

SEQ ID NO: 3512795 - RNA, 13 nt, Human
auggcuccucuca

SEQ ID NO: 3512796 - RNA, 18 nt, Human
auggcucuaaaaaguuuu

SEQ ID NO: 3512797 - RNA, 14 nt, Human
auggcucugcaccc

SEQ ID NO: 3512798 - RNA, 21 nt, Human
auggcugaaggaaaccagugc

SEQ ID NO: 3512799 - RNA, 22 nt, Human
auggcugaaggaaaccagugca

SEQ ID NO: 3512800 - RNA, 14 nt, Human
auggcugcaguccu

SEQ ID NO: 3512801 - RNA, 17 nt, Human
auggcugcauaguauuc

SEQ ID NO: 3512802 - RNA, 14 nt, Human
auggcugcugaagc

SEQ ID NO: 3512803 - RNA, 19 nt, Human
auggcugcugaagcugccu

SEQ ID NO: 3512804 - RNA, 21 nt, Human
auggcuggccacugcacagag

SEQ ID NO: 3512805 - RNA, 15 nt, Human
auggcugugccucug

SEQ ID NO: 3512806 - RNA, 17 nt, Human
auggcugugccucugcc

SEQ ID NO: 3512807 - RNA, 22 nt, Human
auggcuguguugguguggccca

SEQ ID NO: 3512808 - RNA, 21 nt, Human
auggcuuaauguuuauuccug

SEQ ID NO: 3512809 - RNA, 17 nt, Human
auggcuuauccagcugg

SEQ ID NO: 3512810 - RNA, 18 nt, Human
auggcuuauccagcuggu

SEQ ID NO: 3512811 - RNA, 21 nt, Human
auggcuuccaagguggucugc

SEQ ID NO: 3512812 - RNA, 12 nt, Human
auggcuuccucc

SEQ ID NO: 3512813 - RNA, 15 nt, Human
auggcuuccuccucc

SEQ ID NO: 3512814 - RNA, 16 nt, Human
auggcuuccuccuccc

SEQ ID NO: 3512815 - RNA, 19 nt, Human
auggcuuccuccucccucc

SEQ ID NO: 3512816 - RNA, 23 nt, Human
auggcuuuauuuuuuugaacucu

SEQ ID NO: 3512817 - RNA, 17 nt, Human
auggcuuugugauucaa

SEQ ID NO: 3512818 - RNA, 17 nt, Human
auggcuuuugugcauua

SEQ ID NO: 3512819 - RNA, 18 nt, Human
auggcuuuugugcauuau

SEQ ID NO: 3512820 - RNA, 13 nt, Human
augggaaaguauu

SEQ ID NO: 3512821 - RNA, 15 nt, Human
augggaacauuuauu

SEQ ID NO: 3512822 - RNA, 21 nt, Human
augggaacauuuauuuuauga

SEQ ID NO: 3512823 - RNA, 23 nt, Human
augggaacauuuauuuuaugaga

SEQ ID NO: 3512824 - RNA, 14 nt, Human
augggaaggaggga

SEQ ID NO: 3512825 - RNA, 17 nt, Human
augggaaggagggaggu

SEQ ID NO: 3512826 - RNA, 19 nt, Human
augggaaggagggagguau

SEQ ID NO: 3512827 - RNA, 17 nt, Human
augggaauaauugcuuu

SEQ ID NO: 3512828 - RNA, 14 nt, Human
augggaaugaagcu

SEQ ID NO: 3512829 - RNA, 19 nt, Human
augggaccuguggcugucg

SEQ ID NO: 3512830 - RNA, 21 nt, Human
augggacuggagucccuguga

SEQ ID NO: 3512831 - RNA, 15 nt, Human
augggacuggccucu

SEQ ID NO: 3512832 - RNA, 15 nt, Human
augggacugggaggg

SEQ ID NO: 3512833 - RNA, 22 nt, Human
augggagaaauaguguggaaau

SEQ ID NO: 3512834 - RNA, 22 nt, Human
augggagcaguccaugcaugac

SEQ ID NO: 3512835 - RNA, 12 nt, Human
augggagccggg

SEQ ID NO: 3512836 - RNA, 20 nt, Human
augggagccgggucugccuc

SEQ ID NO: 3512837 - RNA, 19 nt, Human
augggagcuccucuccugg

SEQ ID NO: 3512838 - RNA, 20 nt, Human
augggagcuccucuccugga

SEQ ID NO: 3512839 - RNA, 22 nt, Human
augggagcuccucuccuggagg

SEQ ID NO: 3512840 - RNA, 13 nt, Human
augucacagggcc

SEQ ID NO: 3512841 - RNA, 14 nt, Human
augucacagggcca

SEQ ID NO: 3512842 - RNA, 19 nt, Human
augucaccggauccugggu

SEQ ID NO: 3512843 - RNA, 20 nt, Human
augucaccggauccugggug

SEQ ID NO: 3512844 - RNA, 20 nt, Human
augucaccguggaccuuccu

SEQ ID NO: 3512845 - RNA, 20 nt, Human
augucacguacugucugauu

SEQ ID NO: 3512846 - RNA, 16 nt, Human
augucacuaaagcagg

SEQ ID NO: 3512847 - RNA, 21 nt, Human
augucacuuuuugaggcaaaa

SEQ ID NO: 3512848 - RNA, 19 nt, Human
augucagaaaaacaauaag

SEQ ID NO: 3512849 - RNA, 16 nt, Human
augucagacuggcugg

SEQ ID NO: 3512850 - RNA, 23 nt, Human
augucagcaaaaagcaaaaucau

SEQ ID NO: 3512851 - RNA, 20 nt, Human
augucaggaacagaaggaug

SEQ ID NO: 3512852 - RNA, 17 nt, Human
augucaguaccuucaaa

SEQ ID NO: 3512853 - RNA, 12 nt, Human
augucaguguga

SEQ ID NO: 3512854 - RNA, 16 nt, Human
augucagugugacuga

SEQ ID NO: 3512855 - RNA, 15 nt, Human
augucaguuguuauu

SEQ ID NO: 3512856 - RNA, 23 nt, Human
augucauaaagugagaaaacugu

SEQ ID NO: 3512857 - RNA, 15 nt, Human
augucauacagagaa

SEQ ID NO: 3512858 - RNA, 20 nt, Human
augucauacagagaagucac

SEQ ID NO: 3512859 - RNA, 21 nt, Human
augucaucagagcuccucugu

SEQ ID NO: 3512860 - RNA, 14 nt, Human
augucaucauacau

SEQ ID NO: 3512861 - RNA, 13 nt, Human
augucauuaaaug

SEQ ID NO: 3512862 - RNA, 16 nt, Human
augucauuaauguguu

SEQ ID NO: 3512863 - RNA, 18 nt, Human
augucauugaguaauaua

SEQ ID NO: 3512864 - RNA, 13 nt, Human
augucauuucaug

SEQ ID NO: 3512865 - RNA, 12 nt, Human
auguccaaagag

SEQ ID NO: 3512866 - RNA, 18 nt, Human
auguccaaagaggcugcc

SEQ ID NO: 3512867 - RNA, 19 nt, Human
auguccaaagaggcugccc

SEQ ID NO: 3512868 - RNA, 16 nt, Human
auguccacagaugccu

SEQ ID NO: 3512869 - RNA, 20 nt, Human
auguccacagaugccuccac

SEQ ID NO: 3512870 - RNA, 12 nt, Human
auguccaggaaa

SEQ ID NO: 3512871 - RNA, 18 nt, Human
auguccaguaagaucacu

SEQ ID NO: 3512872 - RNA, 19 nt, Human
auguccaguaagaucacug

SEQ ID NO: 3512873 - RNA, 21 nt, Human
auguccaguaagaucacuguu

SEQ ID NO: 3512874 - RNA, 13 nt, Human
auguccauacacu

SEQ ID NO: 3512875 - RNA, 21 nt, Human
auguccauacacuuuguugca

SEQ ID NO: 3512876 - RNA, 19 nt, Human
auguccauaucuaaccagu

SEQ ID NO: 3512877 - RNA, 18 nt, Human
augucccaccucucugag

SEQ ID NO: 3512878 - RNA, 14 nt, Human
augucccagaaaug

SEQ ID NO: 3512879 - RNA, 17 nt, Human
auguccccagccccucu

SEQ ID NO: 3512880 - RNA, 20 nt, Human
augucccugggccagggucu

SEQ ID NO: 3512881 - RNA, 21 nt, Human
augucccugggccagggucug

SEQ ID NO: 3512882 - RNA, 18 nt, Human
augucccuugaugcacag

SEQ ID NO: 3512883 - RNA, 14 nt, Human
augucccuugcugu

SEQ ID NO: 3512884 - RNA, 20 nt, Human
augucccuuucuuggccagu

SEQ ID NO: 3512885 - RNA, 16 nt, Human
auguccuaaggacaca

SEQ ID NO: 3512886 - RNA, 17 nt, Human
auguccuaaggacacac

SEQ ID NO: 3512887 - RNA, 18 nt, Human
auguccuaaggacacacu

SEQ ID NO: 3512888 - RNA, 20 nt, Human
auguccuaaggacacacuaa

SEQ ID NO: 3512889 - RNA, 21 nt, Human
auguccuaaggacacacuaau

SEQ ID NO: 3512890 - RNA, 19 nt, Human
auguccuaauucuucuguc

SEQ ID NO: 3512891 - RNA, 21 nt, Human
auguccucagcauuucuuuuc

SEQ ID NO: 3512892 - RNA, 19 nt, Human
auguccuccagaagccucu

SEQ ID NO: 3512893 - RNA, 16 nt, Human
auguccugccuauuau

SEQ ID NO: 3512894 - RNA, 21 nt, Human
auguccugccuauuaucuguc

SEQ ID NO: 3512895 - RNA, 15 nt, Human
auguccugccuuuua

SEQ ID NO: 3512896 - RNA, 14 nt, Human
auguccuguaaagg

SEQ ID NO: 3512897 - RNA, 18 nt, Human
auguccugugucaguuua

SEQ ID NO: 3512898 - RNA, 13 nt, Human
aguauuguaaauu

SEQ ID NO: 3512899 - RNA, 17 nt, Human
aguauuguaaauuauau

SEQ ID NO: 3512900 - RNA, 22 nt, Human
aguauuguaaauuauauuugug

SEQ ID NO: 3512901 - RNA, 22 nt, Human
aguauuguuguccuuuucauag

SEQ ID NO: 3512902 - RNA, 13 nt, Human
aguauuguuuaaa

SEQ ID NO: 3512903 - RNA, 19 nt, Human
aguauuguuuaaaauguaa

SEQ ID NO: 3512904 - RNA, 11 nt, Human
aguauuuaauu

SEQ ID NO: 3512905 - RNA, 13 nt, Human
aguauuuaauuag

SEQ ID NO: 3512906 - RNA, 14 nt, Human
aguauuuaauuagu

SEQ ID NO: 3512907 - RNA, 19 nt, Human
aguauuuagaagccaacua

SEQ ID NO: 3512908 - RNA, 12 nt, Human
aguauuuauaua

SEQ ID NO: 3512909 - RNA, 13 nt, Human
aguauuuauuuau

SEQ ID NO: 3512910 - RNA, 18 nt, Human
aguauuuauuuauguacu

SEQ ID NO: 3512911 - RNA, 17 nt, Human
aguauuuauuuuguaau

SEQ ID NO: 3512912 - RNA, 16 nt, Human
aguauuucaaauugga

SEQ ID NO: 3512913 - RNA, 20 nt, Human
aguauuucaaauuggagcuu

SEQ ID NO: 3512914 - RNA, 17 nt, Human
aguauuucagaugcuuu

SEQ ID NO: 3512915 - RNA, 23 nt, Human
aguauuucaguguaguuaauuua

SEQ ID NO: 3512916 - RNA, 19 nt, Human
aguauuucuaaaguaauug

SEQ ID NO: 3512917 - RNA, 15 nt, Human
aguauuucuaugaaa

SEQ ID NO: 3512918 - RNA, 22 nt, Human
aguauuugaaaacagaaauugg

SEQ ID NO: 3512919 - RNA, 13 nt, Human
aguauuugaauua

SEQ ID NO: 3512920 - RNA, 22 nt, Human
aguauuugaauuaaaacuucuu

SEQ ID NO: 3512921 - RNA, 20 nt, Human
aguauuugauucaaaauauu

SEQ ID NO: 3512922 - RNA, 16 nt, Human
aguauuugcauauucu

SEQ ID NO: 3512923 - RNA, 16 nt, Human
aguauuuggaauuaga

SEQ ID NO: 3512924 - RNA, 15 nt, Human
aguauuuguuaauuu

SEQ ID NO: 3512925 - RNA, 12 nt, Human
aguauuuuccug

SEQ ID NO: 3512926 - RNA, 16 nt, Human
aguauuuuccuguaaa

SEQ ID NO: 3512927 - RNA, 21 nt, Human
aguauuuuccuguugucaaga

SEQ ID NO: 3512928 - RNA, 13 nt, Human
aguauuuucuaaa

SEQ ID NO: 3512929 - RNA, 23 nt, Human
aguauuuucuucucugugagaag

SEQ ID NO: 3512930 - RNA, 17 nt, Human
aguauuuugguucuuag

SEQ ID NO: 3512931 - RNA, 18 nt, Human
aguauuuugguucuuagu

SEQ ID NO: 3512932 - RNA, 19 nt, Human
aguauuuuuauacaaaccu

SEQ ID NO: 3512933 - RNA, 19 nt, Human
aguauuuuuauauuuaaau

SEQ ID NO: 3512934 - RNA, 21 nt, Human
aguauuuuuauauuuaaaugu

SEQ ID NO: 3512935 - RNA, 14 nt, Human
aguauuuuuaucca

SEQ ID NO: 3512936 - RNA, 18 nt, Human
aguauuuuuccuuuuuaa

SEQ ID NO: 3512937 - RNA, 16 nt, Human
aguauuuuugacagaa

SEQ ID NO: 3512938 - RNA, 17 nt, Human
aguauuuuugacagaau

SEQ ID NO: 3512939 - RNA, 16 nt, Human
aguauuuuugcugcuu

SEQ ID NO: 3512940 - RNA, 15 nt, Human
aguauuuuuuacauu

SEQ ID NO: 3512941 - RNA, 24 nt, Human
aguauuuuuuacauuuuacacacu

SEQ ID NO: 3512942 - RNA, 21 nt, Human
aguauuuuuucaguauuauau

SEQ ID NO: 3512943 - RNA, 13 nt, Human
aguauuuuuugua

SEQ ID NO: 3512944 - RNA, 19 nt, Human
aguauuuuuuguauaauug

SEQ ID NO: 3512945 - RNA, 22 nt, Human
aguauuuuuuguauaauuggau

SEQ ID NO: 3512946 - RNA, 17 nt, Human
agucaaaaggugccugu

SEQ ID NO: 3512947 - RNA, 13 nt, Human
agucaaaccauaa

SEQ ID NO: 3512948 - RNA, 18 nt, Human
agucaaaccauaaacuuc

SEQ ID NO: 3512949 - RNA, 20 nt, Human
agucaaaccauaaacuucau

SEQ ID NO: 3512950 - RNA, 22 nt, Human
agucaaagagaguuuuuaauag

SEQ ID NO: 3512951 - RNA, 17 nt, Human
agucaaaguugaaaauu

SEQ ID NO: 3512952 - RNA, 14 nt, Human
agucaaauaacucc

SEQ ID NO: 3512953 - RNA, 20 nt, Human
agucaaauuaauaaucuuau

SEQ ID NO: 3512954 - RNA, 22 nt, Human
agucaaauuaauaaucuuauua

SEQ ID NO: 3512955 - RNA, 13 nt, Human
agucaacaguaaa

SEQ ID NO: 3512956 - RNA, 21 nt, Human
agucaacaguaaaccacugaa

SEQ ID NO: 3512957 - RNA, 19 nt, Human
agucaacaguacccugguu

SEQ ID NO: 3512958 - RNA, 15 nt, Human
agucaaccugggcaa

SEQ ID NO: 3512959 - RNA, 17 nt, Human
agucaagauagaaaggg

SEQ ID NO: 3512960 - RNA, 16 nt, Human
agucaagcuccuccuc

SEQ ID NO: 3512961 - RNA, 17 nt, Human
agucaagcuccuccucc

SEQ ID NO: 3512962 - RNA, 18 nt, Human
agucaagcuccuccuccc

SEQ ID NO: 3512963 - RNA, 14 nt, Human
agucaaggcuuaga

SEQ ID NO: 3512964 - RNA, 18 nt, Human
agucaaggguaggguggg

SEQ ID NO: 3512965 - RNA, 16 nt, Human
agucaagugaaaaagg

SEQ ID NO: 3512966 - RNA, 20 nt, Human
agucaagugaaaaaggagga

SEQ ID NO: 3512967 - RNA, 10 nt, Human
agucaauaca

SEQ ID NO: 3512968 - RNA, 21 nt, Human
agucaauacauagugcugcug

SEQ ID NO: 3512969 - RNA, 16 nt, Human
agucaauauguggaag

SEQ ID NO: 3512970 - RNA, 17 nt, Human
agucaauauuuuuagau

SEQ ID NO: 3512971 - RNA, 18 nt, Human
agucaaugacaugaauuu

SEQ ID NO: 3512972 - RNA, 14 nt, Human
agucaaugugcagu

SEQ ID NO: 3512973 - RNA, 15 nt, Human
agucaaugugcagug

SEQ ID NO: 3512974 - RNA, 14 nt, Human
agucaauuaacaau

SEQ ID NO: 3512975 - RNA, 15 nt, Human
agucaauuacauguu

SEQ ID NO: 3512976 - RNA, 21 nt, Human
agucaauuacucuauaauaca

SEQ ID NO: 3512977 - RNA, 14 nt, Human
agucacaaaggaau

SEQ ID NO: 3512978 - RNA, 15 nt, Human
agucacaaaggaaug

SEQ ID NO: 3512979 - RNA, 16 nt, Human
agucacaauguucuuu

SEQ ID NO: 3512980 - RNA, 19 nt, Human
agucacacugcuagcaaau

SEQ ID NO: 3512981 - RNA, 16 nt, Human
agucacaucucuuccu

SEQ ID NO: 3512982 - RNA, 21 nt, Human
agucacauucuuguuuuaagu

SEQ ID NO: 3512983 - RNA, 19 nt, Human
agucaccaggaauguuaaa

SEQ ID NO: 3512984 - RNA, 16 nt, Human
agucacccaugaagac

SEQ ID NO: 3512985 - RNA, 15 nt, Human
agucccaccuuggcu

SEQ ID NO: 3512986 - RNA, 18 nt, Human
agucccaccuuggcugca

SEQ ID NO: 3512987 - RNA, 18 nt, Human
agucccacugccucaggu

SEQ ID NO: 3512988 - RNA, 17 nt, Human
agucccagcagccagcc

SEQ ID NO: 3512989 - RNA, 19 nt, Human
agucccagcagccagccaa

SEQ ID NO: 3512990 - RNA, 11 nt, Human
agucccagcua

SEQ ID NO: 3512991 - RNA, 18 nt, Human
agucccagcuacucagga

SEQ ID NO: 3512992 - RNA, 17 nt, Human
agucccaggcugagccu

SEQ ID NO: 3512993 - RNA, 18 nt, Human
agucccagguuggcucug

SEQ ID NO: 3512994 - RNA, 20 nt, Human
agucccagguuggcucugcc

SEQ ID NO: 3512995 - RNA, 15 nt, Human
agucccagugggagg

SEQ ID NO: 3512996 - RNA, 11 nt, Human
aguccccaccc

SEQ ID NO: 3512997 - RNA, 12 nt, Human
aguccccacccc

SEQ ID NO: 3512998 - RNA, 13 nt, Human
aguccccaccccu

SEQ ID NO: 3512999 - RNA, 16 nt, Human
aguccccaccccugcc

SEQ ID NO: 3513000 - RNA, 18 nt, Human
aguccccaccccugcccc
